United States Patent 10,463,751 (MODIFIED POLYNUCLEOTIDES FOR THE PRODUCTION OF CYTOPLASMIC AND CYTOSKELETAL PROTEINS) - sequence listing, part 14

SEQ ID NO: 25990 - DNA, 1188 bp, Artificial Sequence
  Description of Artificial Sequence: Synthetic coding sequence
atggccagcgccgccagcgtgaccagcctggccgacgaggtgaactgccccatctgccaagggaccctccgagagcccgtgactattgattgtggacacaacttctgtagagcctgcttgactaggtattgcgaaatccccggcccagacctcgaagaaagtcccacttgcccgctgtgtaaagagcccttccgtcctggcagttttcgacccaattggcaacttgccaatgtggtcgagaatatcgaacgccttcaattggtttcgaccttaggactcggagaggaggatgtgtgtcaggaacacggggagaaaatctacttcttctgcgaagacgacgaaatgcagctgtgcgtggtgtgtagggaggctggggaacatgctacacacacgatgcggtttctggaagatgccgctgccccatatcgggaacaaatacacaaatgtctgaaatgtctaaggaaagagcgggaggaaatacaagagatacagagtcgtgagaacaaacggatgcaggtcctcctgacacaggtaagcacaaaacgccagcaagtgatttctgagttcgcgcacctgcgcaagttcctggaagaacaacagagtatcctgttggctcagttagaatctcaggacggcgatatcttgcgccagcgagatgaattcgatctgctcgttgccggcgaaatatgtagatttagtgcattgatcgaagagctcgaggaaaaaaatgagcgcccagctcgggagctcctgacagatatacgcagcactttgatccggtgcgaaacgcggaagtgtagaaagcccgttgcagtcagtccagaactcggacaaagaatccgtgatttcccacagcaggcgctgccacttcaacgggaaatgaagatgttcctcgagaaactctgtttcgaactagattacgagccagctcacatctcattggacccacagacaagccatcctaagttgctactcagtgaggaccaccagcgggcccagttctcctataaatggcagaactctccagataatccgcagagattcgatcgggccacttgtgtgctggcccatactgggattaccggaggcaggcacacgtgggtttggatggctcgcgtgccaggagactctggttgttgtcagttctgctcgcctccttctgtcttgggcacagaagttgccgcctag

SEQ ID NO: 25991 - DNA, 624 bp, Artificial Sequence
  Description of Artificial Sequence: Synthetic coding sequence
atgaccgaggacagccagcggaacttccggagcgtgtactacgagaaggtcgggttccgcggcgtggaggagaagaagtcccttgaaattctgttgaaggacgaccggttgggaattctgcctccgcatcatgagtctcacgcaaaggttatgatgtatagaaaggagcaatacttggatgtattgcacgcgctgaaggttgtgaggtttgtgtccgatgctacacctcaggccgaagtgtatctgcggatgtatcaactggaatccggaaaactgcctcgaagtccaagtttccctctagaacctgatgacgaggtatttctcgctatcgccaaagcaatggaagagatggtcgaggattctgtggactgctactggataaccaggaggttcgttaaccagttaaacacaaagtaccgtgactccttgccccagctgccgaaagcctttgagcagtatctgaatttggaggacggcagacttctcacacacttaagaatgtgctcggcagcaccaaagctgccctatgacctatggttcaagaggtgctttgcaggctgcctgccggagagctctcttcagcgagtgtgggacaaggtggtgtctggctcatgcaagatctag

SEQ ID NO: 25992 - DNA, 1404 bp, Artificial Sequence
  Description of Artificial Sequence: Synthetic coding sequence
atggccagcctgctgcagagcgaccgggtgctgtacctggtgcagggtgaaaagaaagttagggcccctctgtcccagctctacttttgcagatattgctcagagctgcggtctctggagtgtgtgagccatgaagtggactcccactactgtccatcatgcctggagaacatgccttctgccgaagcaaagctgaagaagaaccggtgtgccaattgtttcgattgcccggggtgtatgcacaccctatctacaagagcaacatccatatcaacccagctgcccgacgacccggccaagaccaccatgaaaaaagcctattatctggcttgcgggttttgtaggtggacgtcacgagacgtcggcatggccgataagagtgtggcgagtgggggctggcaagagccagagaatccccacactcaaagaatgaataagctcatcgagtattatcagcagctcgcccaaaaagagaaggtggagagggacaggaagaagctggctcgcaggcgtaattatatgccgctggctttttctcagcacaccattcatgtggttgacaagtatgggctcgggactagactgcagagacctagggctggcgcctctatcagcactctcgctggtctgtctctcaaggagggcgaggaccagaaagagatcaagattgaacccgcacaggctgtcgatgaggtggagccattaccggaggattactatacccgtcccgtgaacttgaccgaagtcactacattgcagcaaagactattgcagcccgatttccaacctgtttgtgcgagtcagctctatccccgccacaaacacctactgattaagcgtagcctgagatgcaggaagtgcgagcataatctatcgaaacccgagttcaacccaacttccatcaaattcaagatacagctggtggccgttaactatataccagaggtgcggattatgagtatccctaatttacggtatatgaaggaaagtcaggtgttgctgacgctcaccaaccccgtggaaaacttgacccatgtgaccctgttcgagtgtgaggagggggatcccgacgatatcaacagtactgcgaaagtagtcgtcccgccaaaggagctggttctcgccgggaaggatgccgctgccgagtacgatgagttagcagagccacaagactttcaagacgatcctgatatcattgctttccggaaggccaataaggtgggcatttttataaaggttactccacaaagagaagaaggtgaagtgacagtgtgctttaaaatgaagcatgattttaaaaacctggccgccccaattcgcccaatcgaggaatcggaccagggcacggaggtcatctggttaacacagcacgtcgaactgtctctgggtccactgctgccttag

SEQ ID NO: 25993 - DNA, 435 bp, Artificial Sequence
  Description of Artificial Sequence: Synthetic coding sequence
gtgcgggagctggaggccgagctggacgccgagcagaagaagcacgctgaagccctgaaaggagtacgcaaacacgaaagaagagtgaaggagctcgcttaccaggccgaggaagataggaagaatctggccaggatgcaggacctggtagataaactccagtccaaagttaaatcctataagcgccagttcgaggaagcagtatcggcgctcggaccaggacaccttgacagagcaccccaactgtgtcccagagtctgcggccaggaacaacaggcaaatacaaatctggcaaagtaccggaaggcacagcatgagctcgatgacgcggaggagcgcgccgacatggccgagacccaggccaataagctccgcgcacggacccgggacgctctgggacccaagctgtcgttaagcccccagcacaaggaatag

SEQ ID NO: 25994 - DNA, 747 bp, Artificial Sequence
  Description of Artificial Sequence: Synthetic coding sequence
atggccaccagcgcccccctgcggagcctggaggaggaggtgacctgtagcatctgtttagattacctgagggatccggtgactatagattgcgggcacgtcttctgccggagctgtaccactgacgtgcggccaattagcggatcccgtccagtgtgtcctttgtgcaagaagcctttcaagaaagagaatataagaccagtctggcagctcgcctccctagtggagaacattgaacgcctgaaggtagacaaagggagacagcccggagaagttacgagggagcaacaggacgcgaaattgtgtgagaggcaccgcgaaaagctgcactactattgcgaggacgatggaaagttgctctgtgtgatgtgtcgggagtcccgcgagcatcgtccacacacagcggtcttaatggagaaagccgctcaaccccatagggaaaaaatcttaaaccacctgtcaacactcagaagggacagggacaagatccaagggttccaagccaagggagaggcagatatactcgctgccttaaagaagcttcaagaccaaaggcagtatattgtcgcggagttcgagcaaggccatcagtttctacgtgaacgggaggagcatctgctggaacagctggccaagctggagcaggagttaaccgagggacgcgagaagtttaaaagccgcggagtgggcgaactcgcaagacttgccctggtgatcagcgaactcgagggtaaggctcagcagtag

SEQ ID NO: 25995 - DNA, 3468 bp, Artificial Sequence
  Description of Artificial Sequence: Synthetic coding sequence
atggccgccagccgggacctgctgaaggagttcccccagcccaagaatctgctcaactcagtgatcggccgagctctgggcattagccacgctaaggacaagctggtctatgtacacactaatggacctaaaaagaagaaagtgactttgcacattaagtggcccaagagcgtggaagtcgagggttacggatcaaagaaaatcgacgcagaacgccaggccgctgccgctgcttgccagctgtttaaaggatggggtttgttgggtccaaggaatgagctgttcgatgccgctaagtatagggtgttagccgaccggtttggtagtccagccgattcttggtggcggcccgagcccacaatgcctcctacatcttggcgtcagctcaatccagaaagcattcgccccggaggccctggcggcctttcacgcagtctggggcgggaggaagaggaagatgaggaagaggagcttgaggaaggtactatagacgtcaccgatttcttgtcaatgacacagcaggattcccacgccccactgcgggactcaaggggtagctccttcgaaatgactgacgacgactcggccatcagagccctgacacagtttcccctgcccaagaatctgctggctaaggtgatacagatcgccaccagtagtagcaccgctaaaaatctgatgcagtttcacactgtcggaactaaaaccaaactttccacactcaccctgctctggccatgtccaatgaccttcgttgcgaaagggagacgtaaggcggaggctgaaaataaagcagctgccctcgcctgtaagaaactcaagagccttggccttgttgataggaataatgagccactgactcatgccatgtacaacttagcctcattgcgggagctaggggagacacagcgcaggccatgtactatccaggtaccagaacctattctgagaaagattgaaaccttcttgaaccattatccagtcgagagtagttggattgcacctgaattgagactgcagagtgacgatatcctgcccctggggaaggattccggacccctctctgacccaatcaccggcaaaccatacgtgcctttactggaagcggaggaggtacggctgagccagtcgctgctcgagctctggaggcggcgtggcccagtctggcaggaggccccccagcttcctgtggaccctcacagagacacaattttgaatgctatcgagcagcatcccgttgtagttatatccggcgataccgggtgcggaaagaccacccgcatcccacagttgcttctcgaacggtacgtcacagagggccgcggagcgagatgtaacgtgatcatcacacagccaaggcggatctcagctgtgtcagttgcccagcgagtgtcacatgaactggggcccagtctaaggcgaaacgtgggtttccaggtgcggcttgagtcaaagccaccgagcagggggggggctctgttgttttgtacagtgggtatcctactgaggaaactacagtccaatccctcactcgaaggagtttctcacgtgatcgtagacgaggtgcatgagcgcgacgtgaacacggattttttgctgattctgctgaaaggtctgcaacggttaaatcccgccctgcggctcgtgctaatgagcgctacaggagacaacgagcgattttcgagatatttcggagggtgtcccgtgatcaaggtccccgggtttatgtatcctgttaaagagcactatcttgaggatattctcgccaagttagggaagcaccagtatcttcacaggcatcgccatcatgagagtgaagacgaatgcgccctggatctagacctggtgaccgacctcgtgttacatattgacgctcgaggcgagcctggtggaattctttgcttcctgcctggatggcaggagataaaaggagtccagcagaggctgcaagaggccctcgggatgcacgaatcgaagtacctgatcttgcccgtgcactcgaatatccccatgatggaccaaaaggccatttttcagcaacctcccgtcggggtcaggaagatcgtgctggctaccaacatcgctgagacgagcatcactattaatgacattgtgcatgtggtggactctggactgcacaaagaggaaagatatgacctcaaaactaaggtctcttgcctggagacagtgtgggtgtcccgggctaacgtaatccagagacgcggtcgagctggtcggtgccagtccggatttgcttaccatctgtttccgcgctctcggttggagaagatggtgccattccaagtcccagagatcctcagaactcccctcgaaaacttggtgctgcaggctaaaattcacatgcccgaaaaaacagccgtggaatttctctcgaaagccgtagactccccgaatatcaaagcagttgacgaagccgtcattctgctgcaggaaattggagtgctagatcaaagggaatacttgaccacgctggggcagcggcttgcccatatcagcaccgacccgcggctcgccaaagccatcgtgcttgctgctatttttagatgtctccaccccctgctcgtcgtggtgagctgtttaaccagagacccttttagctcctctttacagaatagagcagaggttgataaggtcaaggcccttcttagtcacgattccggaagcgaccacctggcttttgtgagagccgtagcaggctgggaagaagtcctgcgctggcaggaccggagctcccgggagaactacctggaggagaatctgctgtatgctcctagcctgcgctttatccacggtctgattaaacaattcagcgagaacatttacgaagctttcctcgtcggaaagccaagcgactgcaccctggctagcgctcaatgcaacgaatattctgaggaggaggagttagtcaaaggggtgctcatggctgggctgtacccaaatctcatccaggtcaggcaggggaaggttactcgacaaggcaaatttaagcctaattcagtgacttacagaaccaaatcaggcaatatattactacataaatcgactattaatcgggaggcaacacgccttcgctccagatggctgacatacttcatggccgttaaatcaaatggcagtgtttttgttcgtgactcaagtcaagttcaccctctggcggtcctcctactcaccgacggggatgtccacattcgggatgatggacgacgagctacaattagcctgtcagactctgacctcttgcgcctggagggtgactccagaaccgttagattgctgaaagaattaagacgcgccctgggccggatggtggagaggagcctgcgatcggagctggccgcactgcccccttccgtgcaggaggagcacggccagctgctcgcacttctcgcagaactcctgaggggcccttgcgggtcttttgatgtgcgcaagacggcagacgattag

SEQ ID NO: 25996 - DNA, 762 bp, Artificial Sequence
  Description of Artificial Sequence: Synthetic coding sequence
tgagtgggcgtggaggccgcccgggtgatcgccaaggccctggagaaaaagtccgagctgaaacggtgccactggtcagacatgtttacaggaaggctgaggacagaaatacctcccgccctcatcagcctgggcgaggggctgataactgcaggagcccagctcgtagaacttgacctttccgataacgcattcggtccagatggcgtgcagggctttgaagctttgctaaaaagctctgcttgcttcacactgcaggaacttaagctgaataactgtggcatggggataggtgggggaaaggtgattggcaccctggaggaagtccacatgccacagaacggcattaaccaccctgggattaccgccctcgcacaggctttcgccgttaatccattgctccgagttatcaacctgaatgataacacgttcactgaaaagggcgcagtggccatggcggaaaccctcaaaactttgagacaggttgaggtcatcaacttcggagattgccttgtgaggagtaaaggggctgtggcaatcgccgacgcaatcagaggcggactcccaaagctgaaagaattgaacctttcattctgcgagatcaagcgggatgcggccctcgcagtggcagaggctatggcagataaagcggagctggaaaagctagaccttaatgggaacaccctgggggaagaaggatgtgagcagctccaggaagtactggagggctttaacatggctaaagtgctcgcatcactctag

SEQ ID NO: 25997 - DNA, 3735 bp, Artificial Sequence
  Description of Artificial Sequence: Synthetic coding sequence
gacgtgggcggcgaccggccctgggacagcggcaacacccagctgccacctcggaacccggtgaaggctaatgcaatgttcggagccggtgatgaggacgacactgacttcctgagtccctcaggaggagctcgactggccagtctgtttggcctggatcaggcagcagctggacatggcaatgaattctttcaatacactgcgcctaagcagccgaaaaaaggccagggcactgccgctaccggcaatcaggcgacccccaagaccgcccccgcaaccatgtcaactccaaccattctggtggcaacagctgtgcacgcctatcgctacaccaatggacagtatgttaaacaaggaaagttcggagctgccgtgctcgggaatcatacagctagagagtaccggatcctgctatacatttcacagcagcagcctgtgacagttgcacggatccacgttaacttcgagctcatggtccggcccaacaattactctacgttctatgacgaccagcgccagaactggtccattatgtttgagtcggaaaaggccgctgtcgagttcaataagcaggtctgtatcgcaaagtgcaattcgacatccagccttgacgctgttctgtcccaagatttgatagtggccgatggaccagcagttgaagttggcgattccctagaggttgcctataccggctggcttttccagaaccacgtgctcgggcaggtttttgactctacagctaacaaagataaacttcttaggctgaagctggggagtggcaaagtgatcaagggatgggaagacgggatgctgggaatgaaaaaaggagggaagcgccttctcattgtgcctcccgcttgcgccgtagggtccgaaggggttattggatggacacaagcaacagatagtatactggtattcgaggtcgaggtgcggagggtcaaattcgccagagacagtggttctgacggacactctgtgagttccagggattccgcagcaccctcgcctatcccaggagctgataatctgagcgctgaccctgtcgtgtcacccccgacctccattcccttcaaatccggggaacctgcactccggacaaagtcgaactcattatctgagcaacttgcaatcaatacaagccccgacgctgtgaaggccaaactgatctcaaggatggccaagatgggccagccaatgcttccaatcctgcctccgcaactcgactctaacgactccgaaattgaagacgtcaacacactccagggcggcggccagcccgtggtgacccctagcgttcagcctagcctgcatccagcacatccggcccttcctcagatgacctctcaggcgccacagccatcagtcacaggcctccaggctccgagtgccgccctgatgcaagtgtccagtttggatagccactctgccgtctctggcaacgctcagtcctttcagccatacgctggcatgcaggcctatgcttatccccaggcatctgccgttacctcccaactgcagccagttcggccgctctatccggcgcctctttcccagccacctcatttccagggatctggagacatggctagctttctgatgacagaagccagacagcataataccgaaatcaggatggcagtatccaaggtagcggataaaatggatcacttgatgactaaagttgaggaactgcagaaacactctgctgggaatagcatgctgatcccctcaatgtccgtgaccatggagacttctatgattatgagtaacattcagagaattatccaagagaacgaacgtcttaagcaagaaatcctcgaaaaatctaataggattgaggagcagaacgataaaatttcagaactcatcgaaaggaatcagcgatatgttgaacagtctaaccttatgatggagaagcgaaataacagtcttcagaccgcgacagagaatacacaggccagagtgctgcatgctgagcaggagaaagccaaagtaactgaagagctggctgccgcgacagcccaggtgtcacacctgcagctgaagatgacagctcaccagaagaaggagaccgaactgcagatgcagctcacagagtcactgaaggagacagacctcttgagagggcagctgacaaaggtgcaggctaaattgtctgaacttcaggagacctccgagcaagcacaatccaaattcaaatccgagaaacagaacaggaaacaacttgaactgaaagtcacttctctggaagaagagctgacagatcttcgggtcgaaaaggagtctctggaaaagaacctctccgagcggaaaaagaagtctgcacaggagcggtctcaggcggaggaagagatagacgagatcaggaaaagctaccaggaagaactggacaagttgcggcagctgctgaagaaaacaagggtgagtactgaccaagcagcagccgaacaactgagtctcgtgcaggcggaactacagacacagtgggaagctaagtgcgaacacttgcttgcttccgctaaggatgaacaccttcagcagtaccaggaggtctgtgcccagcgcgatgcgtaccaacagaaactggttcaactgcaggagaagtgccttgcactgcaggctcagatcacggccctgactaaacagaacgagcagcacatcaaggaactggaaaagaataagtcacaaatgtctggcgtcgaggctgctgcatccgacccttcagaaaaagtgaagaaaatcatgaatcaggttttccagtccctgcgacgagaatttgagcttgaggagagttacaatggtcggaccattctcggtaccatcatgaacaccatcaagatggttacgctgcagctgctcaaccagcaagaacaagaaaaagaggagtcatcgtcagaggaagaagaggaaaaggccgaggaacgtccccggagaccctcccaggagcagtctgctagcgcatcatctggccagccccaagccccattgaatcgggagcggcccgaatctcctatggtgccttcagagcaagtggttgaagaagccgtccccctcccaccacaggcactcactacatcccaagacgggcaccgcagaaagggggacagtgaagcagaagccctttcggagattaaagacggatccctaccccccgagctttcgtgcattccaagccaccgcgtgctgggccctccgacaagtatcccacccgagcccctcggaccagtgagtatggattccgagtgcgaagagtctctcgccgcgagccctatggccgcaaaaccagacaatccttctgggaaagtgtgtgttagagaggtcgctccggacggccctctccaggagtcaagtacccgactgtcactgacgagtgacccagaggagggagatcccctggcactaggccccgaatctccaggcgagccacagcctccgcaattaaaaaaggatgatgtgacatcttcgaccgggcctcacaaggagttgtcatccaccgaggccggtagcacggtggctggagctgccctgagacccagccaccatagtcagcgctcctcactgtccggggatgaggaggacgaactgtttaaaggcgccaccctgaaagccctgcggcccaaggctcagcctgaagaggaggacgaagatgaggtaagtatgaagggtcgccctcctccgacccctctgtttggggacgatgatgacgacgatgatatagattggttgggttag

SEQ ID NO: 25998 - DNA, 1653 bp, Artificial Sequence
  Description of Artificial Sequence: Synthetic coding sequence
atgaagtgggaggagtacgaggagctgctgcactacgccatcgtgacacccaatattgagccttgtgcctcccagtcctctcaccctaagggagagctcgtgcccgacgtccgcatatcaaccatccacgacatcctgcattcacaagggaataattcggaggtgagggaaaccgcaattgaagtcggaaagggttgtgatttccatatttcttcacactccaagactgacgagtcgagtccggttttaagcccaagaaagccttctcacccagtgatggactttttctccagccatctcctcgccgacagctcctccccagccaccaattcctcccacactgacgcccatgagattctggttagcgatttcctagtgagcgacgaaaatctgcagaaaatggaaaatgttctggacctgtggtcttccggactgaagacaaacattatatccgagctgagcaaatggcgcctcaattttatcgattggcatagaatggagatgaggaaagagaaagagaagcacgccgctcaccttaagcagctgtgcaaccagatcaatgaattgaaggagcttcagaaaactttcgaaatcagtatcggccgaaaagacgaagtcatcagttccttgagccatgcgattggaaaacagaaggagaaaatcgaactgatgcggacattttttcattggcgtatagggcatgtgcgtgcaagacaggacgtgtacgaaggcaagttagcggaccagtactaccaacgcactctccttaaaaaggtgtggaaagtgtggcgcagcgtcgttcagaaacagtggaaggacgtcgtagagagagcttgtcaggcccgcgccgaggaagtctgcatccagatttccaatgactacgaggccaaagtcgcgatgttgtccggcgccctcgaaaatgcgaaagcagagatccagaggatgcagcacgagaaggaacacttcgaagactctatgaaaaaagcgttcatgagaggcgtctgcgcacttaacttagaagctatgaccatcttccagaatagaaacgacgctggtatcgacagtactaataataagaaggaggagtacggtccaggtgtccagggtaaagagcatagcgcccacctcgatccctcagctccaccaatgccactgcctgtaactagcccactactcccaagtccacctgccgctgtgggcggcgcctctgccacagccgtgccaagcgcagcgtcaatgacaagcacccgagcagcttccgcatcatctgtgcatgttcccgtgagcgcgttgggcgcggggtcggccgccaccgccgcttccgaagaaatgtacgtgccaagggtggtgacttcagcgcagcaaaaggccggcaggacgataacagctcgcatcactggccgctgcgactttgccagcaaaaaccgtatctcctcttctctcgccataatgggcgtttctccacccatgtcttcagtcgtggtggagaagcaccatcctgtgactgtccagacaataccccaggctactgcagccaagtaccctaggaccatccatccagaaagttctacgagtgccagcagaagcttaggcacacggagcgcccatacccagagcctgacatcagtccatagcattaaggttgtagactag

SEQ ID NO: 25999 - DNA, 402 bp, Artificial Sequence
  Description of Artificial Sequence: Synthetic coding sequence
atgagccccagccagatgatcatgcccaacgtgatggagatgatcgcggcactcggccccggtccatccccataccctctgcctcctcctccaggaggaacgaacagtaatgattatagcagccagggcaataactaccaagggcatgggaatttcgactttcctcatgggaacccaggcggaacaagtatgaatgacttcatgcatggcccgccacagctctcccacccaccggacatgccgaacaacatggctgcgctggaaaaacccctgagccacccgatgcaggagaccttactgccggaactgaccaatcctgatgagttgctctcctacctcgatccccctgatctgcccagcaacagtaacgacgatctgctctccttatttgagaataactag

SEQ ID NO: 26000 - DNA, 1473 bp, Artificial Sequence
  Description of Artificial Sequence: Synthetic coding sequence
atgagcagctgcgtgagcagccagcccagcagcaaccgggccgccccacaggatgagctcggcgggagaggatcttcatcttctgaaagtcagaagccatgcgaggcgctgcgtgggctttcgtcgctgagcattcatttgggcatggaaagtttcatcgtggtaactgagtgtgagcccggctgtgccgtcgatctaggcctcgcccgtgaccgtcctcttgaggcggatggacaagaagtccctctggacacctctggctctcaggccaggcctcacttgtctggccggaaattgtctctccaggagcgcagccagggcggcctcgccgcaggcggcagtttagatatgaatggccgttgtatatgtccttccttgccttactcacctgtgagctccccccagtctagccctcggcttcctcgacgccctactgttgaatcccaccacgtgtctataacaggcatgcaagattgtgttcagttgaatcagtacacactgaaggacgaaatcggcaagggctcctacggtgtagtaaagctggcctataatgagaatgacaatacttactacgcaatgaaagttcttagcaagaaaaagcttatcagacaggccgggtttccccgaagaccacctcccagaggaacccgacccgccccagggggctgtattcagcctagaggtccgatcgagcaggtgtatcaggaaatcgccattctgaagaaactcgaccatcctaacgttgtgaaactggttgaggtcctggacgatcccaacgaggaccacctctatatggtgtttgagcttgttaaccaggggcccgtcatggaagtacctacgctgaagcctttgagtgaagaccaggctcgcttttactttcaagacctgatcaaagggattgaatacctgcattaccagaagataatccacagagacatcaaaccatctaacctattggttggcgaggatgggcacatcaaaatcgcagactttggcgtgagcaacgagtttaaaggatccgacgctttactttccaacaccgtgggaacgccagcatttatggctcctgagtcactttcagaaacaaggaagatattttctgggaaggccctcgacgtgtgggcaatgggggtaacattatactgcttcgtgttcgggcagtgtccctttatggacgagagaatcatgtgtctccattccaaaatcaaaagtcaagccttggaatttcccgaccagcccgatatcgcggaggatctcaaggacctgattacacgtatgcttgacaagaacccagagagccgaattgtagtgccagagataaaaatcctggtgaagacgatgattcgcaagcgtagtttcggtaacccattcgaagggagtcgccgcgaggaaaggtccctgtctgcaccaggaaacctgttgactaaaaaacccacccgggagtgcgagtctctatcagagcttaaaacttag

SEQ ID NO: 26001 - DNA, 1872 bp, Artificial Sequence
  Description of Artificial Sequence: Synthetic coding sequence
atggccgccgccaccggcgaccccggcctgagcaagctgcagttcgccccattttcatccgctctcgatgtgggcttctggcatgagctgacgcagaagaaactaaacgagtaccgtctcgatgaggcacctaaggacattaagggctactattataacggagactcagccggcctgccggcacgcctaacgcttgagttttccgccttcgatatgagtgctcccacgccggctaggtgttgtcccgctatcgggacactctataataccaacaccctggagagcttcaaaacagctgataagaagctactcctggagcaggcagcaaatgagatctgggaatccataaaatccggtacagctctggaaaatccagttttactgaacaagttcctgctgctcacttttgctatcgaggctttggagtgcgcctacgataacctgtgtcagaccgagggagtaaccgccctgccctactttttgattaaatacgatgagaatatggtgctcgtatctctcctgaaacactacagtgatttttttcagggccagagaactaaaataacgattggagtgtacgatccttgtaacctggcccagtatccaggatggccattacgcaacttcctcgtcctcgctgcacataggtggagttctagctttcagtcagtggaggtagtttgcttcagagataggactatgcagggagcccgggacgtcgctcattccattattttcgaggtgaaattgcccgagatggccttctcccctgattgcccaaaggctgtgggttgggaaaagaaccagaaaggcggaatggggcccagaatggtgaacctgtccgaatgtatggatcctaaacgcctggctgagtcgtctgtggacctcaatctgaagctgatgtgctggcggctggtgccaacgctcgaccttgataaagtggtgtctgtcaagtgcctgttgctgggcgccggcacacttggttgtaatgtcgcgagaacactgatgggctggggcgtgcgccacatcactttcgtcgacaatgccaaaatctcatattctaatcctgtccggcagcctctttacgagtttgaagattgcctgggaggcggtaaacccaaggccttggctgccgccgacagactccagaagatttttcccggagtcaacgcgcgaggcttcaatatgtccatcccaatgcctgggcaccccgtgaacttctcaagtgtgaccctggagcaggcccgaagggatgtcgaacaattggagcagctcatcgaaagtcatgacgtggtctttttattaatggacactagagagagcaggtggcttcccgcggttattgccgccagtaaacggaagctcgtcatcaacgcagccctcggctttgataccttcgtagtgatgcgtcacggtttgaagaagccaaagcagcagggagccggagacctttgcccgaatcacccagttgcttcagcagacctactcggcagcagtttgttcgccaacattcccggttataaactaggatgttatttttgtaacgacgtcgtagcccccggggactctacaagagaccgtacgctggaccagcagtgcaccgtttccaggccaggcctggcagttatcgccggggctttggctgtagagcttatggtatccgtgctccaacaccccgagggtggttacgcgattgccagctcgagtgacgatcgaatgaatgagcctccaacatctctggggctagtgcctcaccaaatccgcgggtttcttagccggtttgacaacgtcctgccagtaagtcttgcgttcgacaaatgtacagcatgcagctcaaaaatatgggatatgtccgatgatgagacaatttag

SEQ ID NO: 26002 - DNA, 966 bp, Artificial Sequence
  Description of Artificial Sequence: Synthetic coding sequence
cggcggaacgtggagctgatcaacgaggaggccgccatgttcgacagtctgttgatggactcgtacgtgtccagcacgacaggggagtctgtcatcaccagggagatggtagaaatgctcttttctgatgattccgacttacagctggcaaccacccagaagtttaggaaattgctgtccaaggagcccagcccaccgatcgatgaggtaattaatacccccagagttgtggacaggttcgttgaatttctgaagcgcaacgagaattgtactctccaggccgtctgggccctgggaaatatcgccggcgacagcagcgtttgtagagactatgtgctgaattgctcaatcctgaacccgttgttaaccttgctgaccaaaagcacacgccttaccatgacccgcaacgccgtgtgggcattatcaaatctctgtagaggcaagaatccacctcccgagtttgcaaaggtgtccccctgtctgcctgtactgtctcgcttactgtttagctccgattctgacctgctggccgacgcctgttgggctctgtcatatctgtctgacggccccaacgagaaaattcaggccgtgatcgactctggagtgtgtaggaggctggtagaactcctcatgcacaacgactataaagtagcctcccccgcactgcgcgcggtcggcaacatagtgacaggtgatgatattcagacccaggtgattctcaactgttccgcactcccttgcctccttcacctgctctcctccccgaaggagtctattcgcaaagaagcttgttggacaatctcaaatatcacagcagggaacagggcccagatccaggccgtgattgacgccaatattttcccagtgctgatcgagatcctgcagaaggctgaatttcgaacccgaaaggaagcagcctgggcgattacaaacgcgacttccgggggtacacctgagcagatttag

SEQ ID NO: 26003 - DNA, 795 bp, Artificial Sequence
  Description of Artificial Sequence: Synthetic coding sequence
atgggcggcgcccagctggagctgcccagcggcgcccggcccggcgtgtgcgtccgaaggtcctttcgggctcacgcgggtgaccaacccaggcggcctcccgggcccattcctgtcccaggcacaatgaagcaggagtcagccgcgcctaacactccgccaacctctcaaagcccgactccctctgcacagtttcccagaaacgatggcgacccccaggctctatggatttttggttatgggtcccttgtctggcgccctgattttgcctactcagactcgagagtgggattcgtgagagggtactctaggagattttggcaaggagacacattccatcgaggaagcgacaagatgcctggacgggtggtgactctgctggaggatcatgagggctgcacatggggcgtcgcgtatcaggtacagggcgaacaagtgtctaaagctcttaagtatctcaacgtcagagaggccgtccttggcggttacgatacaaaagaggttaccttctacccgcaagacgctcccgatcagccattgaaagccctggcgtacgtggcaactcctcaaaatcccggttatctgggccctgcacctgaggaggctatcgctacacagatcctcgcttgtcgcggcttctccggtcataaccttgagtacctgctaagattggccgactttatgcagctgtgcggtcctcaggctcaggacgaacacttggctgccattgtggacgcagtggggaccatgctcccatgcttttgtccgactgaacaggccctcgccctggtttag

SEQ ID NO: 26004 - DNA, 747 bp, Artificial Sequence
  Description of Artificial Sequence: Synthetic coding sequence
atggccaccagcgcccccctgcggagcctggaggaggaggtgacctgtagtatatgtctcgactacctgagagaccctgtaactattgactgtgggcacgtcttctgcagatcctgtacaaccgacgtcaggcctattagtggaagccggccggtttgtcctctatgtaaaaagccctttaaaaaggaaaacattcgtcccgtgtggcaactagcttcccttgtagagaacatcgagaggctgaaagtagacaagggaagacaacctggggaggtgacccgagagcaacaggatgctaaattatgcgagcgccaccgagaaaagttgcactactactgcgaggatgatggtaagctcctgtgtgtgatgtgcagagaatcaagagaacaccgccctcatactgccgtcctcatggaaaaagccgcccagccccatcgagaaaaaatccttaaccatctttctacgctgcgtagagaccgggacaagatccagggcttccaagcgaaaggggaagccgacatcctggccgccctgaagaaattgcaggaccaacgccagtatattgtcgcagaattcgaacaaggacaccagttcttacgcgagagggaggagcacttgcttgaacaattggcaaagctggaacaggaactgactgagggaagggagaaattcaaatctaggggagtaggggaactggccaggctcgcccttgtcattagcgaattggaagggaaagctcagcagtag

SEQ ID NO: 26005 - DNA, 768 bp, Artificial Sequence
  Description of Artificial Sequence: Synthetic coding sequence
atgagcagcagcatgtggtacatcatgcagagcatccagagcaagtattcgttgtccgagcgactcattaggactatcgccgccatccgttcctttccgcacgataatgtcgaggaccttattcgcgggggagcagatgtcaactgtactcacggcaccctgaaacccctccattgtgcatgcatggtatcagatgcggactgtgtggaactgctcttggagaaaggtgctgaggtgaacgcactggacgggtacaacaggactgccctccactacgcagccgagaaagatgaggcctgtgtggaggtacttttggagtacggcgccaatccaaacgctctggactacaataacgacaccccactgtcttgggccgccatgaagggcaacctcgagtccgtgtcaatcttgctggactacggtgcagaggtgagagtgattaacctgatcggccagaccccaataagtcgcctggtggctctgcttgtgcgtggactcggtacagaaaaagaggactcttgctttgagctcctgcatagggctgtaggccacttcgaactgagaaagaacggtactatgcctagggaagtagcgcgggatccacagctatgcgaaaaactgactgtgctgtgctcagctcccggtacgttgaaaacacttgcccgttacgccgtgaggagatcattgggcctgcagtacttgccggacgccgtgaagggtctccccctgccagccagcctcaaggagtacctgttgctcctcgagtag

SEQ ID NO: 26006 - DNA, 585 bp, Artificial Sequence
  Description of Artificial Sequence: Synthetic coding sequence
gagcccgtgcagccccactggttctactgcaaggaggtggagtacaagcaactctggatgccattcagcgtgtttgactcactcaatctggaggagatctacaatagcgtgcaacccgacccagaatcagtggtgttaggaacagatggaggacgctatgacgtttacttatacgatcggatacggaaagccgcatactgggaggaagagcccgccgaggtgagaaggtgcacctggttctacaagggagataccgactccagattcatcccatatacggaggaattttcggagaaactggaagtgatagtacagtttcagccttcttccgtccctgatgagtggggcaccacacaggacggccagacccggcctcgcgtagtgaagagaggtattgatgacaatttagacgagattccagatggagagatgccacaggtggatcatctggtcttcgtggttcatggaattgggcccgtgtgtgatctgcggttccggtctatcatcgagtgtgttgacgacttcagggtggtctctttaaagcttctgcgaacacactttaaaaaaagtctggatgatggctag

SEQ ID NO: 26007 - DNA, 981 bp, Artificial Sequence
  Description of Artificial Sequence: Synthetic coding sequence
atgccccacctgcccctggccagcttccggccccccttctggggcctacgccactctcgggggttgccacggttccactctgtgagtactcaaagtgaaccccacggcagcccaataagtaggaggaatcgtgaagccaaacagaagcgcctgagagaaaaacaagctacattagaagcggagatcgccggggagagcaagtctccagccgaatccataaaggcctggcgtccaaaggaactcgtgctgtatgaaatccccaccaaacccggcgaaaaaaaggatgtctccgggccacttcctccagcttactctccaaggtatgtggaggccgcatggtatccctggtgggtgagggaaggctttttcaagcccgaatatcaagcaaggcttccgcaggcaacaggagagacgttttccatgtgcataccccctcccaatgtgactggctctctgcacataggccacgccctgactgtggccattcaggacgcactagtccggtggcaccgcatgcgaggggatcaggttctctgggtgccaggcagtgatcatgctggcattgccactcaggccgtggtggaaaaacagctgtggaaagagcgaggcgtacggcgtcacgaactgtcaagagaagccttcctgcgagaagtgtggcagtggaaagaggctaagggaggcgagatttgtgaacagctgcgggccttaggcgcatcattggactgggatcgcgagtgttttacaatggacgtcgggagcagcgttgccgtaactgaagcattcgtccggctgtacaaggccgggctcctgtatagaaatcatcagctggtgaattggtcctgtgcgctccggagcgcaatctctgacatcgaagttgagaacaggcctctgccaggccacactcaactgaggctgcctggatgccctacaccggtgtctttcgggctgttgttctcagtggcctttcctgtcgatggctag

SEQ ID NO: 26008 - DNA, 990 bp, Artificial Sequence
  Description of Artificial Sequence: Synthetic coding sequence
atggccggcgccctggagggcgacatcttcatcggccccaaggccgaggagcaccgaggcttgctgagcatacgatatcccatggagcacggcatagttaaagactggaacgacatggagcgcatctggcagtatgtctacagcaaagatcaactgcagacattttcagaagagcaccctgtgctgttgacagaagcccctcttaatccaaggaagaaccgggaaagagccgccgaggtattcttcgaaacattcaatgtccctgccctctttatctcgatgcaggccgtgttatcattgtatgctaccggccgcactaccggtgtggtccttgattctggtgacggtgtgacgcatgccgtgcccatttacgaaggcttcgctatgcctcactcaattatgaggatagacatcgccggccgcgacgtgagccgctttctccggctgtacctgcgcaaggagggctatgactttcactcaagtagtgaatttgaaattgtcaaggcaatcaaggaaagggcatgttacctctctataaatccccagaaagatgaaactctggaaaccgaaaaagctcagtattatctgccagatgggtccacaatcgaaataggcccaagccgttttcgggcaccggaactgctttttagacctgatctgattggcgaggaatccgagggaattcatgaagtgttagtttttgccatacagaagagcgacatggatctgaggaggaccctcttcagcaatattgtactcagtggggggagcacactgtttaagggatttggggacaggctgctttcagaagtcaagaagttagctcccaaggatgtcaaaattcggataagcgcgcctcaggaaagattgtactcgacatggatcggaggcagtattctcgcctctttagacacctttaagaaaatgtgggtgagcaaaaaggagtacgaggaagacggtgctcgtagcattcaccggaagacattctag

SEQ ID NO: 26009 - DNA, 450 bp, Artificial Sequence
  Description of Artificial Sequence: Synthetic coding sequence
atggagaagaccgagctgatccagaaggccaagctggccgagcaggctgaacgctatgatgacatggccacgtgtatgaaagccgtaaccgagcagggagcagagctgtctaatgaggagaggaacttgctgagtgtagcatacaaaaacgtagtgggtggccgacgttccgcttggcgggtaattagttccatagaacagaaaacagatacttcagacaagaagctgcagctcatcaaggattaccgcgagaaagttgagtcagagctgcggtccatttgtactacagtcctcgaactgctggataaatacctgatcgccaatgcgaccaaccccgagtccaaggtcttctatctgaagatgaagggagattacttcaggtacctggccgaggttgcctgtggggatgacagaaaacagaccattgataattctcagggcgcctactag

SEQ ID NO: 26010 - DNA, 735 bp, Artificial Sequence
  Description of Artificial Sequence: Synthetic coding sequence
atgctgagcgaccggaagcgggagctggagcaccggctgagcgccactctggaagagaacgatctgctccaggggaccgtagaggagttacaggacagagtgctaatcctggaaaggcaggggcacgataaagatcttcagcttcaccagagccagctggaattacaggaggtgcgccttagttgtcgccagctacaagtgaaggtggaagagcttacagaagaacggtccctgcagagctcagccgcaacctcgactagcctgcttagcgagattgagcaatctatggaagcggaggagcttgagcaggaaagagaacaggtcacccttctaagcgtggagatgacagcactgaaagaagagagagatcggctgcgcgttaccagtgaggacaaagaacctaaggaacagttgcagaaagctatccgagatcgtgatgaagctattgccaaaaagaatgccgtagaattagagttagccaaatgccggatggacatgatgtccctgaattctcagctacttgatgccatccagcagaaactgaacctctcccagcagctggaagcttggcaagacgatatgcaccgtgtgatagacagacaactgatggatacacacctgaaggaacggtcccagcctgcggccgctctctgccgtgggcatagcgccggcaggggggacgaacctagtatcgcagagggaaaaagacttttcagtttcttcaggaaaatctag

SEQ ID NO: 26011 - DNA, 603 bp, Artificial Sequence
  Description of Artificial Sequence: Synthetic coding sequence
tgacacatgctgagcaaggtgggcatgtgggacttcgacatcttcctttttgatcggctcaccaacgggaacagcctggttacactgctgtgccatctgtttaacactcacggtctaatccaccacttcaagttggacatggtaacacttcaccgctttctggtgatggtacaagaagactaccactcacagaatccgtaccacaacgcagtgcatgccgccgacgtaacacaggccatgcactgttatctaaaagaaccaaaacttgcaagttttctgacacctctggatataatgctaggactccttgctgcagcagcgcacgacgtggaccacccaggggtgaatcagccctttctgataaagaccaatcatcacttggccaacctgtaccaagtcagggagcctaatctggagcccgccactgtatggtccatagcattgggacccgtgctcaagcctgaatcttgtccctggcggaagccttgcttccgcgtgctggaggtccagcgccgcatgaagcataacctatgtccccagaagttcgttcagacacagatgctcaaaatgtcgaaaatccaagccaatcttataccggtgtag

SEQ ID NO: 26012 - DNA, 1728 bp, Artificial Sequence
  Description of Artificial Sequence: Synthetic coding sequence
atggccatggcccccagccccagcctggtgcaggtgtacaccagccctgcagcggtggccgtctgggagtggcaagacggtttgggaacgtggcatccttactccgctacagtgtgcagttttatcgaacaacagtttgtccagcagaaaggtcagagatttggcctagggagcctggcccactctataccccttggacaggccgatcctagtctggccccttatatcatcgatttgcccagctggacccagttcaggcaggatactggcacaatgcgtgctgtacggcggcatctctttccacagcactccgcacctggtcggggcgtcgtttgggaatggctcagtgacgacggctcctggacagcctacgaagccagtgtctgcgactatctggaacaacaggtggctcgcgggaaccagctggtagatctggccccactgggctacaattacaccgttaattatacgacccatacccaaaccaacaagacctctagtttctgccggtctgtccggaggcaagcgggacccccgtatcctgtgaccacaatcatcgctcccccgggccacacaggcgtggcgtgtagttgtcatcaatgtctcagtggtagtcgaacgggtcccgtgagcgggcgctaccgacattcgatgacaaatcttccggcctacccggtcccccagcatccccctcacaggacagccagtgtgttcgggacacatcaagcattcgcaccatacaataagcccagtctgtccggggcgaggagcgcaccaagactgaacacaacgaacgcttggggtgccgctccaccctccctgggatcccaacctctatatcgaagtagcttgagccaccttggccctcagcaccttccccctgggtcttccacaagcggagccgtgtctgcctcgctgccgtctgggcctagctcatcacctggcagtgtgccggccaccgtccctatgcagatgccaaagccctctcgagtgcagcaggccctagccggggccacgccaaagcctgaaccggagcctgagcaagtaatcaagaattacacggaggagctcaaagtgccccccgacgaagactgcattatctgtatggagaaactgtcaaccgccagcgggtactctgatgttactgactcaaaggccattggatctctggccgttgggcacctgaccaagtgcagccacgccttccatctcctttgcctgctggcaatgtactgcaacggcaataaagacggtagcctgcaatgcccttcctgcaagacaatttacggcgaaaaaacaggcacacagccacaaggaaagatggaggtgttgcggttccaaatgtccttgccaggacacgaagattgcggcactattttgatcgtgtactccattccgcacggcatacagggaccagagcatccaaaccccggcaaacccttcactgctcgtgggttcccacgacagtgctatttgcctgataatgcacagggacgaaaggttcttgaacttctgaaggttgcctggaagcggagacttattttcactgttgggacctcttctaccaccggcgagacggacactgtcgtctggaacgaaatacaccataagaccgaaatggatcgcaatatcaccggccacggttacccggatcctaactatctccaaaacgtactggctgagctggccgcacagggtgtaactgaagactgtttagagcagcaatag

SEQ ID NO: 26013 - DNA, 3036 bp, Artificial Sequence
  Description of Artificial Sequence: Synthetic coding sequence
atggtgagcagcgaccggcccgtgagcctggaggacgaggtgagccattctatgaaagagatgattggagggtgttgcgtgtgcagcgacgagcggggttgggcggagaacccattagtctattgcgacggccacggctgttccgtggccgtgcatcaggcctgctacggcatagtacaggttcccacgggcccttggttctgccgcaaatgcgaaagccaggagcgtgccgccagggtgcggtgcgagctgtgtccccacaaggatggggctctgaagagaacagacaacggtggctgggcccatgtggtctgtgctctgtacattccagaagtccagttcgccaacgtttctactatggagcccatcgttctgcagagcgtgcctcacgacagatacaacaagacctgctacatttgtgatgagcaggggcgggaatctaaagcagcaaccggagcatgcatgacttgcaacaagcacggatgcaggcaggccttccacgtcacatgtgcacagtttgctggcctcctttgcgaggaggagggaaacggggccgacaatgtgcagtattgcggatactgcaaataccacttctcaaagctaaagaagtccaaacgaggtagtaatcgtagctatgaccagagcctctccgactcctcttctcactctcaagataaacaccatgagaaagaaaagaagaaatataaggaaaaggacaaacacaaacagaaacacaaaaagcaacccgaacctagtccggctctagtcccctcactgactgtcactactgaaaagacctatacctctacctccaataactcaatctcgggttctctaaagagattggaggatacgactgcccggttcacgaatgctaatttccaggaggtctctgctcacacctcaagcgggaaggacgttagcgagactaggggctccgagggtaaaggaaaaaaatcttctgctcatagcagcgggcagagagggcgcaaacccggtggaggccgcaatcctggtaccaccgtttccgctgcttcccccttccctcagggatcgttcagcggcacccctgggtctgttaaaagcagttctggtagcagtgtacagtcccctcaggacttcctgagcttcaccgatagcgacctgcggaatgatagctattcacatagccaacagtcctccgcaacaaaagatgtgcacaagggagagagcggaagtcaggaagggggagtcaatagcttttctaccctgataggactgccatcaacgtcggccgtcacctcccaacctaaaagttttgagaattcacctggcgaccttgggaatagttcattgccaactgctggctataagagagcccagacatccgggattgaagaagaaactgtcaaggaaaaaaaacgcaagggcaataagcaatcgaaacacggtcccggtagaccgaagggaaataaaaatcaggagaacgtctcacatctcagcgtgagtagcgcatccccaacatcctcagtagcctccgctgcgggttccatcacgagcagctcgctgcagaagtcacccaccctccttcggaacggctctctgcagtccttgtctgtcggctctagtcctgtaggctctgagatcagtatgcagtacagacatgatggggcttgccctactacaacattctcagagctgctgaatgctatccataatggcatttacaacagtaacgacgtagcagtgagcttcccgaatgtggtgagcggatccggatcctctacaccagtaagcagctctcacctcccccagcagtccagtgggcacctgcagcaggtgggcgccttatctcctagtgcggtttcttccgctgcccctgccgtggctactacacaggctaacacgctgtcgggttcttctctgagccaggcaccaagtcatatgtacgggaaccggtctaactccagtatggcagccctgattgctcaaagtgagaataaccagacggaccaggatctcggcgataacagtcggaatctcgtcggccgcggctcttcccctagaggttctttgagtccgaggagccctgtttctagcctgcagattcgctacgatcaaccagggaattcctctctggagaatctcccaccggtggccgcaagcatcgaacagcttctggagcgccagtggtcggagggccagcagttcctgttagaacagggcacaccttccgatattcttgggatgttaaaatccctgcatcagctccaggtggagaacaggcgcctggaggagcagatcaaaaacttaactgctaagaaggaacggctgcagctgctcaatgctcagctgtctgtgccgtttccgacaatcaccgccaatcccagcccttcccatcaaatccacacctttagcgcacagacggcccccactaccgattccctgaacagctcaaagtccccccacatcgggaattctttcctaccagataacagtctgccagtgctcaaccaggatcttaccagcagtggacagagcacatctagtagttcggccctctctactcccccacctgccggtcagtcgccggctcagcaaggaagtggcgtgagcggtgtgcagcaggtaaatggagttactgttggggctctggcatcaggaatgcaacctgtaacctctacaattcctgcagtcagcgctgtgggaggaatcatcggggctctcccaggcaatcagcttgccatcaatggtatcgttggtgctctaaatggagtcatgcagactccagtcactatgtctcagaacccaacccccctgacacacacaaccgtccctcccaatgcgacacaccctatgcctgccaccctgacgaattccgcatcagggctgggcctgctttctgaccagcagcgccagatcctgatacatcaacagcagtttcagcagctgcttaatagtcagcagctcacacctgtacataggcatccgcacttcacccaacttccccccacgcacttcagcccaagtatggagattatgcaggtgcggaaatag

SEQ ID NO: 26014 - DNA, 3786 bp, Artificial Sequence
  Description of Artificial Sequence: Synthetic coding sequence
atggccgccgccgccgccagcggcgccggcggcgccgccggcgccggtaccgggggcgcaggtcccgcaggacgcctcttgccaccacccgccccaggctcccctgccgcccctgccgccgtgtcccctgcagctggacaacctcgacccccagctcccgctagcagaggacctatgcccgcaagaatcggctactacgagatcgatagaacaatagggaaaggaaacttcgccgtcgttaaaagggccacccatttggtcaccaaagccaaggttgctatcaaaatcatcgataaaactcagctggacgaagaaaacttgaagaagatcttccgggaggttcaaattatgaaaatgctctgccatccacacatcattcgcctctatcaggttatggagactgaacgaatgatttatttagtgacggagtacgcgagtggcggagagatcttcgaccacctggtggcacacgggagaatggccgagaaagaggcacggcggaagtttaaacaaatcgttacggcagtgtatttctgtcactgtaggaacatcgtccacagggatctgaaggctgagaatctcctattagacgctaatttgaatatcaaaatcgccgatttcggcttcagtaatctgttcaccccaggacagctgctgaagacctggtgtggctcccctccttacgctgccccagaactgtttgagggaaaggagtatgacggaccaaaagtagatatctggtcccttggagtcgtcctgtatgtgttggtctgcggggctctgccatttgatggttccacactgcagaatcttcgtgcaagggttctgtccggtaaattcaggattccttttttcatgagtaccgaatgtgaacaccttattcggcacatgctggtcctcgatccaaataaaaggctgagtatggaacagatttgtaaacacaaatggatgaaactgggggacgcagaccccaactttgataggctaattgctgaatgtcagcaactgaaggaagagaggcaggtcgacccactaaatgaagacgtgcttcttgccatggaagacatgggcctagataaagagcagactttgcaggctgaacaggctggaacggccatgaacatttctgtcccgcaggtccagttaatcaatccagaaaatcaaatcgtcgaacccgacggcacactgaatctggattccgatgaaggagaagaaccgtcccctgaagctctggtcaggtacctgtcgatgcgccgacacacggtcggagtcgccgacccgagaactgaagtgatggaagatcttcagaagctgctcccgggattccccggcgttaacccgcaggccccttttctgcaggttgcccctaatgtgaactttatgcacaacctgttgcctatgcaaaatttacagccaacaggccagttggagtacaaggaacagagcctgcttcagcctcccacacttcagctcttaaatgggatggggccacttggacgtagagcgagcgatggtggggccaatatccagcttcatgcccagcagttacttaagaggcctcgaggaccatcacctctcgtgacaatgacaccggctgtgcccgccgtcacccctgtggacgaagaaagctccgatggggaacccgatcaagaggcagttcagaggtatctcgccaaccgctcaaaacggcacacattggccatgacaaacccaacagcagaaatcccaccagatctgcagaggcagctaggacagcagccgtttaggtcccgagtttggcccccacaccttgtaccagaccagcatagatctacatacaaagactcaaatacccttcatctgcccaccgaacgcttcagccccgttaggcggttctccgacggagccgcatccattcaggcgtttaaggcccaccttgagaaaatgggcaataattcctcgatcaaacaactgcagcaggaatgcgaacagttgcaaaagatgtatggaggccagatagatgaaaggactttagaaaaaactcagcagcagcatatgctctatcagcaggaacaacaccaccaaattcttcagcagcagatccaggactccatttgccctccacaaccatcgcctcctctacaggctgcatgcgagaaccagccagcgttgctcactcatcaacttcagagactcagaattcagccctcaagccccccccctaaccacccaaacaaccacctatttcgacagcccagcaacagcccaccgccaatgtctagcgcaatgattcaacctcacggagcagcctcctctagccagtttcagggacttccatcgcggagcgctatcttccagcagcagcctgagaactgctcttccccccccaatgtggccctgacctgtttgggaatgcagcagccagcccagagccagcaggtcaccattcaggttcaggaacccgtcgacatgctgtctaacatgcccggcactgcagctggcagtagcggccgcggtatctctatcagcccctccgccggtcagatgcagatgcagcatagaacaaacctcatggccaccctcagttatggccatagacctctgtcaaagcaactatcggcggactctgcagaagctcatagcgcacaccaacagccaccccactatactaccagcgcccttcagcaagctctgctaagccccacacccccagactatactaggcaccagcaggtgccacatatcctgcagggcttgctgtcgcctcgtcattctttaactggtcactcagacattcgtctcccacccactgagtttgctcagctgatcaagcggcaacagcaacagcgccagcagcaacagcagcaacaacagcaacaggaataccaggagctgtttaggcatatgaaccaaggtgacgcagggtcactcgcaccgagccttggaggccagagtatgactgagaggcaggctctctcttatcagaatgccgatagctaccaccatcatactagcccacaacaccttctgcaaattagagctcaggagtgcgtgtcacaggcttcttcacccacccctccccacgggtacgcccaccagcccgccctgatgcattccgagtccatggaggaagactgctcctgcgagggcgcgaaggatgggtttcaggactctaaatcttctagcacactcaccaaggggtgccatgatagtccgcttttactatcaaccggcgggcccggggatccagaatccctgctaggcaccgtgagccatgcccaggagttagggatccacccctatggtcaccaaccaacagcagcctttagtaaaaacaaagtgccctccagagagcccgtaattggtaactgcatggaccgcagcagccccggccaagctgtggaactcccagatcataatggcctgggataccccgcccgcccatcggttcatgaacaccatcgccccagggcactccagcgccaccatacaatccagaactccgacgacgcctatgtgcagttagataatctacccgggatgtctctcgtggcaggcaaggctctctcaagcgccaggatgagcgacgctgtgctttctcagagttctctcatgggtagccagcagtttcaggatggggaaaacgaagagtgcggtgcctccctgggcgggcatgaacatccggacttatctgatggaagtcagcacttgaacagcagttgttacccttcgacatgcattacagacatcctgctgtcttacaagcatcccgaggtgagcttttctatggagcaggccggcgtgtag

SEQ ID NO: 26015 - DNA, 519 bp, Artificial Sequence
  Description of Artificial Sequence: Synthetic coding sequence
atgagcagcaacgagtgcttcaagtgcggccggagcggccactgggctagggagtgccctactggaggggggagaggcaggggcatgcgctcacgaggccgcgggtttcagttcgtctcatcatctctgcccgatatttgttaccggtgcggagaatccgggcacttggctaaggattgtgacctccaggaggacgtggaggcatgctacaactgtggccgtgggggccatatcgccaaggactgcaaggaacccaagagagagcgggaacagtgctgttataattgcggcaagcccgggcacctcgccagagattgtgaccatgccgatgagcagaagtgttatagctgtggcgagtttggtcacattcaaaaagactgtaccaaggtgaagtgttaccggtgcggagagacaggccacgtagcaatcaattgctctaaaacttccgaagtcaactgctaccggtgcggtgagtctggtcatctcgctagagaatgcactatcgaggccactgcctag

SEQ ID NO: 26016 - DNA, 471 bp, Artificial Sequence
  Description of Artificial Sequence: Synthetic coding sequence
atgctggccgagaagctgcccaacctgacccacctgaacctgagcgggaacaaactgaaagacatctctacgttggaacctctgaagaagctcgaatgcctgaagtccctggacctgttcaattgcgaggtgactaatctgaatgactacagggaatcagtgtttaaactattaccccagctgacttatcttgatggctacgacagggaggaccaagaagcgcctgatagtgatgccgaagtggatggcgtcgatgaggaagaagaagatgaagagggtgaagatgaggaggacgaagacgacgaggatggggaagaggaggagttcgacgaggaggacgatgaggacgaggacgtcgagggagacgaagatgacgacgaggtcagcgaggaagaggaggagttcgggctcgacgaagaagacgaagacgaggatgaggatgaggaagaagaagaggggggtaaaggttag

SEQ ID NO: 26017 - DNA, 516 bp, Artificial Sequence
  Description of Artificial Sequence: Synthetic coding sequence
atgagcagcggcaacgccaagatcggccaccccgcccccaacttcaaggctactgctgtaatgccagatggccagtttaaggatatcagtttgtctgattataagggaaagtacgtggtcttttttttttaccccctggactttacatttgtctgtcccactgagatcatagcattctctgaccgcgcagaagaattcaaaaaactcaactgtcaggtgatcggggcctctgtggacagccacttttgccacttggcgtgggtgaataccccaaaaaaacaggggggcttgggcccaatgaatattccacttgtgtccgatccgaaaaggaccattgcccaggattatggcgtgctgaaagcagatgagggaatctcttttagggggctattcatcatcgatgataaaggaattctgcgacagatcaccgttaatgacctacctgtggggaggagcgtcgatgagacattgcggctggtccaggcctttcagtttactgacaagcacggcgagtag

SEQ ID NO: 26018 - DNA, 111 bp, Artificial Sequence
  Description of Artificial Sequence: Synthetic coding sequence
atgatcgagaagatgcagggcagccggatggacgagcagcggtgctcattccctcctcctttaaagaccgaagaggactatattccctacccaagtgtgcatgaagtgtag

SEQ ID NO: 26019 - DNA, 639 bp, Artificial Sequence
  Description of Artificial Sequence: Synthetic coding sequence
atgagcagcaagggcagcagcaccgacggccggaccgacctggccaatggctcactcagcagctctcccgaagaaatgtccggcgctgaagaggggcgggaaacatccagcggcatcgaggtggaagccagcgatctttctctaagcctaacaggggatgacggagggcctaaccgcacctcaacagagagtcggggtacggacaccgagtcttcaggcgaagacaaggacagcgactctatggaggacacaggacactacagtattaatgacgagaacagagtgcatgaccgctctgaggaggaggaggaagaggaagaggaggaggaggaagagcagcctaggcgccgtgtgcagcgaaaaagagctaacagggaccaggacagcagcgacgacgagcgagccctcgaggactgggtgagcagcgagacttctgcattgccacggcctaggtggcaggccctccctgccctgcgggagcgagagctgggctccagcgcccgattcgtgtatgaggcctgcggcgccagggtgttcgtgcagcggttccgactgcagcatggcctcgaagggcatactgggtgtgtgaataccctccacttcaaccagcgcggaacatggctggcctctggctcttag

SEQ ID NO: 26020 - DNA, 726 bp, Artificial Sequence
  Description of Artificial Sequence: Synthetic coding sequence
atgaccagcgtgacccggagcgagatcatcgacgagaagggccccgttatgtcaaagacccatgatcaccagttagagtcctccctatcgccggtggaagtttttgccaagacatccgcctcactggagatgaatcagggggttagcgaagaacgtatccatcttgggtccagtccaaaaaagggcggaaattgtgatttgagtcatcaggagcgccttcagagtaagagcctgcacctctcaccgcaggagcagtctgcatcataccaagataggcgacaatcttggcgtcgtgccagtatgaaagagaccaaccgaagaaagtccttacaccccattcaccagggtattacagagctgagtaggtcgatctctgtcgacttagctgaaagtaagcggcttggatgtctgctgctaagctcctttcagtttagcattcagaagctggagcccttccttcgtgacaccaagggattctctctggagtcttttcgcgccaaagcaagctccctgtcagaggagttaaagcatttcgcagatgggttggaaactgacggcacactgcagaaatgttttgaggattcgaatggtaaggcgtccgatttctccctggaagcgagcgtcgccgagatgaaggaatatattaccaagttctctctagagaggcagacgtgggaccaactgctgctgcactatcagcaggaggccaaggagatcttatcttag

SEQ ID NO: 26021 - DNA, 1188 bp, Artificial Sequence
  Description of Artificial Sequence: Synthetic coding sequence
atggccagcgccgccagcgtgaccagcctggccgacgaggtgaactgtcctatttgccagggaacccttcgggaaccagtcaccatagactgcgggcataacttctgccgagcctgcctcactagatactgcgaaatacctgggccagacctggaggaaagccccacatgccccctgtgcaaggagccattccgccccgggtcctttagaccaaactggcagctcgctaacgttgtggagaacatagaacgcctgcagctcgtttctaccttgggactcggggaggaggacgtctgccaggagcatggcgaaaaaatttacttcttttgtgaggatgacgagatgcagctatgcgtggtttgtcgggaggcgggagaacacgccacacataccatgcgttttctagaggatgccgccgcgccatatcgcgaacaaattcacaagtgcctgaaatgtttaagaaaggagagagaggaaattcaggaaattcagagtagagaaaataagcgtatgcaggtcctcttaacgcaggtgtccaccaagcggcagcaagtgatttctgaatttgctcacttacgtaaatttttagaagaacagcagagcatccttctcgcacaactggaatcacaagacggggatatcctgaggcagagggacgaattcgacctgttggttgctggcgaaatctgcaggttctctgccttgatagaggaactggaggagaagaatgagagaccagctcgggagctgctgacagacataagaagtacgctgatacggtgcgagacccgcaagtgcagaaaacccgtggctgtatcaccagagctgggccagcggatccgagattttccgcaacaggcactgccactgcagcgcgaaatgaagatgttcctggagaagctgtgctttgagctggactacgaacccgcccacatatctctggacccgcagacatctcatcccaaactccttctgtccgaggaccaccagcgggcccagttcagttataagtggcagaattcccctgacaacccacagcggttcgatagggccacgtgcgtccttgcccacacagggatcacaggtggcaggcacacatgggtgtggatggcacgtgtacccggcgattccgggtgttgtcagttctgcagtccccccagcgtgcttggcaccgaggtggccgcatag

SEQ ID NO: 26022 - DNA, 1887 bp, Artificial Sequence
  Description of Artificial Sequence: Synthetic coding sequence
atgagcgacaagagcgacctgaaggccgagctggagcggaagaagcaaaggctggcccaaatacgcgaagagaagaaacgcaaggaagaggagcgcaagaagaaggaagccgacatgcagcagaaaaaggaacccgtgcaagacgacagtgatttagatcgcaaacgccgggagacagaggcactgttgcagtctatcggcatcagccctgaacctcctctggttcccacgcctatgagcccttcgagtaagagcgtaagcaccccctcagaggccggatcgcaagacagcggagatttgggacccttgacgcggacattgcagtgggataccgatccttcagttcttcagcttcagagcgattccgagcttggccgccgattgcataagctgggcgttagcaaggtcacacaagtcgacttccttccccgcgaggtggtgtcctatagcaaggagacccagactcccttggccactcaccagagtgaagaggacgaagaagatgaggagatggtcgagtcaaaggtcgggcaggactccgagctggagaaccaagataaaaagcaggaggtcaaggaggctcccccgcgcgaactgactgaggaggaaaaacagcaaattctgcactctgaggaattccttatttttttcgataggaccatacgggtcattgagcgagccctggccgaggacagcgacatcttctttgactattccggacgcgagctagaggagaaagatggagatgtgcaggctggcgctaatctgtcttttaaccgacagttctatgacgagcactggtcaaaacatcgcgttgtcacttgcatggattggtcgctgcagtaccctgagcttatggtggccagctacaataataatgaggatgctcctcacgaaccggatggggtggccttagtatggaatatgaaattcaaaaagaccacacctgagtacgtcttccattgtcagagcagcgtgatgtctgtctgctttgctaggtttcatcccaacctggtggtcgggggcacttactctggacaaattgtgctgtgggataatcgttctcacaggcggacccctgtgcagcgtacacccctgtcagcagctgcgcatacccaccctgtttattgcgtgaacgttgtgggaacacagaatgcccataatctcatcactgtcagcaccgatggcaagatgtgtagttggtccttggatatgctcagcacaccccaggagagcatggaattggtctataacaagtcaaagccagttgcggtgacagggatggcgtttcctacgggagatgtgaataactttgtggttggaagtgaagagggcacggtgtataccgcatgcaggcatggctccaaggccggtatcggcgaggtgttcgagggccatcagggacctgttacgggtattaactgccacatggcagtgggtccgattgacttttcgcacttgttcgtaaccagcagcttcgactggaccgttaagctgtggactactaaacacaacaagccattatatagctttgaagataacgctgactacgtatacgacgtgatgtggtcacccgtgcatccagccctgtttgcctgcgtcgacggtatgggcaggctcgatctgtggaacctgaacaatgataccgaggtccccaccgcatccgttgccattgagggagcctccgccctcaaccgagtccgctgggctcaggccgggaaagaggtggctgtaggtgatagtgaggggagaatttgggtgtatgacgtcggtgaactcgcagtaccacacaacgatgaatggaccagattcgccagaactctggttgaaataagagcaaatcgcgccgactccgaagaagaagggacagtggagctgtccgcttag

SEQ ID NO: 26023 - DNA, 1644 bp, Artificial Sequence
  Description of Artificial Sequence: Synthetic coding sequence
atggccggcaccaagaacaagacccgggcccaggccaagaccgagaaaaaagctgcgattcaggcgaaagccggggccgagcgtgaggcaaccggcgttgtgcgacccgtggcaaagactagagcaaaggcaaaagcgaagaccggttctaaaactgatgcagtcgccgagatgaaggccgtgagcaaaaacaaggttgtggccgagaccaaggaaggagctctgagcgagccgaagaccctaggtaaagcaatgggcgacttcacacccaaggccgggaacgaatccacatcttcaacgtgcaaaaacgaggctggcaccgacgcctggttctgggccggggaagaagccacaatcaactcctggttctggaacggagaggaggcaggcaatagcttctctaccaaaaacgacaagccagagattggtgcgcaggtctgcgccgaagagctcgaaccagcagccggagccgactgcaagcccaggtccggggccgaggaagaggaagaagaaaacgtgatcgggaattggttctgggagggagatgatacgtcatttgatccaaacccaaagccagtcagtagaatcgtcaagccccaaccggtgtacgaaattaatgaaaagaatagacccaaggactggtcggaggttaccatctggccaaatgcacccgcagtgacccctgccgtgctaggatttcgcagtcaggccccctccgaagcctctcctccctcctacattgtccttgcttcagccgaggaaaatgcatgctccctccccgttgctacagcctgcaggccatcacggaataccaggtcatgcagtcagcccatcccagaatgccggttcgacagtgacccctgcattcagacaatagatgaaattcggagacagatacgcatacgagaggttaacgggattaagccgttcgcttgtccctgcaagatggagtgttacatggattctgaagaattcgagaaactggtctctctacttaaaagcacgaccgacccgctgattcataagattgcacgaattgcgatgggcgtgcataacgtgcacccattcgcacaggagtttatcaatgaagtgggggttgtgacacttatcgagtccctactatccttcccatctcccgagatgcggaaaaagacggttatcactctaaatccacctagcggggacgagcgtcagcgaaaaatcgagctgcatgttaagcacatgtgtaaagaaaccatgtctttcccactcaacagccctgggcaacaaagtgggctgaaaattctgggccagctcactaccgactttgtgcaccactatatcgtggctaactactttagcgaactgttccatctgctgagttctggcaattgcaagacaagaaacctggtcctgaaactattgttaaatatgagtgaaaatcctactgctgcgagagatatgattaacatgaaggccttagccgcattgaagcttattttcaatcagaaagaagctaaagccaacctggtatccggggtggcgatcttcattaacatcaaggaacatatccgcaaaggttcaatagtcgtcgtcgaccacttaagttacaacacccttatggcgatcttccgcgaagtgaaggagataatcgaaacaatgtag

SEQ ID NO: 26024 - DNA, 747 bp, Artificial Sequence
  Description of Artificial Sequence: Synthetic coding sequence
atggccttcagcggccgggcccggccctgcatcatccccgagaacgaggaaatacctagggctgcactaaatacggtgcatgaagctaatggaacggaggatgagcgagcagtttcaaagctgcagaggagacactccgacgtgaaagtgtataaggaattttgcgatttttacgcaaagtttaatatggcaaatgctctggcctccgccacatgtgagagatgtaagggagggttcgcccctgccgaaactatagtgaatagcaacggcgaactgtaccacgagcagtgctttgtgtgcgcacagtgtttccagcagttcccggaggggctgttctacgagttcgaggggaggaagtactgcgaacatgattttcagatgctcttcgcaccgtgttgtcatcagtgcggcgaatttatcattgggcgggtgatcaaggccatgaacaacagctggcatccagaatgtttcaggtgtgatctgtgccaagaggtgttggctgacattggcttcgtcaagaacgcgggccgacatctatgcagaccatgccacaatagagagaaagcccgtgggctgggcaagtacatctgccagaagtgtcacgccattattgatgagcagccccttatcttcaaaaacgatccttatcatccagatcactttaattgtgcaaactgtggtcaagagggcagtgactgccgatgtacaggcgccgagcggggtgccatcttgccagctatgccatag

SEQ ID NO: 26025 - DNA, 621 bp, Artificial Sequence
  Description of Artificial Sequence: Synthetic coding sequence
atggagagcaacttcaaccaggagggcgtgccccggcccagctacgtgttctcggccgatccgattgctagaccaagtgaaatcaatttcgacggcattaagttagatctcagccacgagttttctctggttgcaccgaataccgaagcaaatagcttcgagagtaaggattatctgcaagtgtgcctgagaatcaggcccttcacacaatcggagaaggagctggaaagcgaaggctgcgtacacatccttgattcacaaacggtggtcctcaaggagccccagtgcattttaggacggctctcagagaagagttccgggcagatggcacagaagtttagctttagtaaggtgtttggaccggccacaactcaaaaagagttctttcaagggtgtatcatgcagcccgtgaaagacctactcaaggggcagagtcggcttatttttacctatggtctcacgaatagcgggaagacgtacacatttcagggaaccgaggagaatatcggtatactgcctagaactctgaacgttctgttcgactctcttcaggagcggctttacaccaaaatgaacctgaagccacatcgatctcgcgaatatctccgcctcagctcctag

SEQ ID NO: 26026 - DNA, 990 bp, Artificial Sequence
  Description of Artificial Sequence: Synthetic coding sequence
atggaggtggccgagcccagcagccccaccgaggaggaggaggaggaggaagagcatagcgccgaacctagaccccgtaccaggtctaatcctgagggtgcggaggatcgagccgtgggagcacaggcaagcgtgggctcccggtctgaaggggaaggagaagccgcctcggctgacgacggaagtctgaacaccagcggagccgggcctaaaagttggcaggttcctccgcccgcgccagaagtccagattagaacccctagggtgaactgtccggagaaagtcattatctgtcttgatctctccgaagagatgtctttgcccaagctggagtcctttaacggaagcaagacaaatgccttaaacgtctcccagaaaatgattgaaatgtttgtcaggaccaagcacaagatagacaagtcccatgagtttgcactggtggttgtcaacgacgatactgcttggctgtccggcctgacctccgatccaagagagctgtgcagctgtctgtacgacttggaaacagcatcttgctctacattcaacatcagcggagcaagtcctgcaaggcaacaaaaaaccgagttgcctgtgacagagaacgtgcaaacaattccccctccatatgtggttaggactatcctggtgtatagtagacccccctgccaaccccaattctcactcactgagccgatgaaaaagatgtttcagtgtccatacttcttttttgatgtggtgtacattcacaacggaacggaggagaaagaagaagagatgtcttggaaggatatgtttgcttttatgggttctctggatacaaagggaacctcctacaaatacgaggtggccctggccgggccagctctcgaactgcacaactgtatggccaagctgctcgctcatccgctgcaacggccctgccaaagccatgcctcttattcccttttggaggaggaggatgaggccatcgaagtggaggctacagtctag

SEQ ID NO: 26027 - DNA, 1620 bp, Artificial Sequence
  Description of Artificial Sequence: Synthetic coding sequence
atggccaccagcgcccccctgcggagcctggaggaggaggtgacctgttctatttgcctcgattacctgcgggacccggtgacaattgattgtggccacgtgttctgccgcagttgcactacggatgttagacccatctctgggagtagacctgtttgcccgttgtgcaaaaagccatttaagaaggaaaacatcaggcccgtatggcagctggctagcttagttgagaacatagagcggctgaaggtggacaaagggcgacagcccggtgaagtgactcgagagcaacaggacgctaagctttgtgagcgccaccgcgagaaactccactactattgtgaagacgatggcaaactgctgtgcgtaatgtgtagggaatcaagagagcaccgcccgcacaccgctgtactcatggaaaaagctgctcagccccaccgggaaaagattcttaatcacctgtccactctccggcgggaccgtgataagatccagggttttcaagccaagggcgaggccgatatcctggctgccctgaaaaaactccaagatcaacggcaatatattgtagctgaattcgagcaggggcaccagtttctgcgcgaacgggaagagcacctgctcgagcaacttgccaaacttgaacaggagctgacggaaggacgggaaaagttcaagtcccgcggagtcggcgaactggccagactggcactggttatctctgagctcgaaggcaaagctcaacaaccagcagcagagctgatgcaggacactagagacttcctcaatcggtacccccgcaagaagttctgggtgggaaaacccatcgccagggtcgtgaaaaagaagacaggggagttctcagataagctgctcagcctccagcggggactgcgagagtttcagggtaagctgttaagggatttggagtataaaacagtctctgtgacccttgaccctcaatcagctagtggatacctgcagcttagcgaggattggaagtgcgtgacctatacatccctgtacaaatcagcctatttacacccccaacaatttgactgtgaaccgggcgtgttagggagcaaaggtttcacgtggggcaaagtttattgggaagttgaggttgagcgggagggttggtccgaggacgaggaagaaggcgacgaagaggaggagggcgaagaggaagaggaggaggaagaagctggctacggggacggctacgacgattgggaaactgacgaagacgaggaatctctgggcgacgaagaagaggaggaagaggaagaggaagaagaggtattagaatcttgtatggtgggagtcgccagagattctgttaaacgtaagggcgatctcagtctcaggccggaggatggagtgtgggccctgagactttcctcctcaggcatttgggcaaacacatcacccgaggccgaactcttccccgcactgagacctcgcagggtgggcatcgcattagactacgagggcgggacggtgacattcactaacgcggaaagtcaggaactgatttatactttcacagcgacctttacacgtcgcttagtgcctttcctttggctcaagtggcctggaactaggctgctgcttcgcccctag

SEQ ID NO: 26028 - DNA, 3558 bp, Artificial Sequence
  Description of Artificial Sequence: Synthetic coding sequence
atgtgcgaggtgatgcccaccatcaacgagggcgaccggctgggccctccacacggggcagacgccgatgccaacttcgagcagttgatggtgaatatgctcgacgagcgcgaaaaactgctggagagtttgagagagtctcaggagacccttgcggcgacacagtctcgactgcaggacgcaatccacgagagagaccagctgcaacgccatctcaactcagcattacctcaggagttcgcaacccttactagagaattaagcatgtgtcgggaacaactgctggaacgggaggaagagatctcagagctcaaagctgagaggaacaatacccgcttgttgcttgaacacctcgagtgtctggtcagcaggcatgagcggagtttgcgaatgacagtggtgaaacgacaagctcagtccccatcaggagtgagcagcgaagtggaggtcctcaaagcccttaagagcctatttgagcaccacaaggcactcgacgagaaagtccgggagaggctgcgggccgccctcgaacgagtgacgactctggaagaacaactggccggggctcatcaacaggtgagcgcacttcagcagggcgctggagtcagggacggtgccgccgaggaagaggggaccgtcgagttgggccccaaaaggttatggaaagaagacacggggcgggttgaggaacttcaggagcttcttgagaaacagaattttgagctgtctcaggcccgggaacggctggtaaccctgaccactacagttactgaacttgaggaagacctgggtaccgctaggagagacctaatcaagagtgaggagctgtctagtaagcatcagcgagatctgagagaagccttggctcagaaagaggacatggaggaaagaattacaactctggagaagagatacctggccgcacaacgagaggcaacaagtatccacgatctcaatgataagctcgagaatgagctggccaataaggagagcctgcacagacagtgcgaggaaaaagcccgccacctccaggaactgttggaggttgccgagcaaaaactccagcagaccatgaggaaagccgagacactgccagaggttgaagccgagctcgcccagagaattgccgccctgactaaagctgaagagaggcatggaaacattgaggagcacctgcgacagctggaaggacagctggaggaaaaaaaccaggaactggccagaactgccgtgcaggtgcgccaacgggagaagatgaacgaggatcacaacaagaggctgagtgataccgtggacaggctcttatccgagtcaaatgaaagactacagctgcatttaaaagagcgtatggccgcgctggaagagaagaatactcttatacaggaactggagtcgagccaaaggcaaatcgaagagcagcatcaccacaagggacggctgagtgaggaaatcgagaagcttcgccaggaagtggaccagttaaaaggaagaggtgggcctttcgttgacggcgtacactctcgaagtcacatgggttccgctgctgacgtgcgtttttccctcgggactacaacacacgcccctccaggggtgcatcggcggtattctgctctccgtgaggaaagcgctaagttagccttaccactgacagttaccttgcgcagccctacctggatgagaatgtcacaaggcgtgtgctgcaacctggaatatcactcctctggaacgctgtgcggcagtagcggccctcttcccgtccccgagatgattcaggaggagaaagaaagtactgaactgagagcggaagaaatcgagacgagggtgaccagtgggtcaatggaagcgctgaatttgaaacagctccgcaagcgaggatctatcccgacgtccctcaccgcactgtctctggcctccgcaagtccccctctaagcggaaggtccactccgaagttgactagtcgaagcgctgcgcaggatctcgaccgaatgggcgtgatgacattaccaagtgatctacggaaacacaggaggaaattactgagccctgtgtcgcgcgaggaaaacagagaggacaaagcgacgatcaaatgcgagacttcccctccttcctctcccaggacgctccggttagagaaactcggacacccagcgctcagtcaggaggagggaaagtccgcccttgaggaccaggggtccaatccaagctcctcaaattcctctcaggattcacttcacaagggcgccaaaaggaaggggataaaaagctctattggtcgcctgtttggcaaaaaggaaaaggggagactgatacagctctctagggacggagcaactggtcacgtgttacttaccgattcagaattctccatgcaggaaccgatggtccccgctaagcttggtacacaggccgaaaaggaccggcgtctgaaaaagaaacatcaattgcttgaggatgcccggagaaaaggcatgcccttcgctcagtgggatggcccaaccgtcgtgagctggcttgagttatgggtgggtatgccagcatggtacgtggccgcatgtcgcgcgaacgttaaatccggggcgatcatgagcgctttatcagatacagaaattcagcgcgagattggtatctctaacgctttgcatagattaaaattgcggctggccatccaagaaatggtgagcctgacttcgccgagcgcccctccaacatctcgaacatcttcaggcaatgtctgggtgacccatgaggagatggaaactcttgagacatccaccaagaccgattctgaggagggatcctgggcgcagactcttgcctacggtgatatgaatcatgagtggatcgggaatgagtggcttccctccttaggcctcccacagtatagatcttactttatggaatgtctggtagacgcccgaatgctggaccatctgacaaagaaggatctgcgcgttcacctcaaaatggtcgactccttccaccgcacatccctccagtatggaatcatgtgcttgaaacgcttgaattatgacagaaaggaactggagaagcggagggaagagtcacagcacgaaattaaggacgttctggtgtggactaatgaccaggtggttcactgggtgcagagcattggattacgcgactacgcggggaatctccatgaatccggggttcacggcgcattactcgcccttgacgagaatttcgaccacaatacactggctctgatactgcagatacccactcagaacacccaggctcggcaggttatggaacgtgagttcaataacctgctcgcactcggaacagatcggaagctggacgacggggacgacaaggtgtttagacgcgcaccaagctggaggaaacgctttcgcccgcgggaacatcacggaagaggggggatgctgtctgcatccgctgaaaccctgcctgctgggttccgcgtctcaactctgggcacccttcagccacctccagcaccccccaaaaaaattatgccagaagctcactcacactacctctacggtcatatgttgtccgccttccgagactag

SEQ ID NO: 26029 - DNA, 1383 bp, Artificial Sequence
  Description of Artificial Sequence: Synthetic coding sequence
atggagatctgcgacatcatcaacgagaccgaggagggccccaaggatgcactgcgggccgtcaagaaacgtattgttgggaacaaaaacttccacgaggtgatgctagccctcacagtgctggagacctgcgttaagaactgcgggcacaggttccatgtgcttgtggcatcccaagatttcgtggagtccgtgctggtcagaactatcttaccaaagaacaatccgccaacaatagtgcacgacaaggtcttgaacctgatccagagttgggcagacgccttcaggagcagtcctgacctcactggagtcgtgaccatttatgaggacctgaggagaaagggacttgagttccccatgacagacctggacatgttgtcacccatccacacacctcagcgcacagtgtttaattccgagacccagtcaggccaggactctgtcggtaccgactcttcacagcaggaagattctggccagcacgcagctccacttccagccccaccaatactgtcaggggataccccaatcgcgccaactccggaacagataggcaagctgagatctgaactcgaaatggtgtcaggaaacgtgagagtgatgagcgagatgttgaccgaactcgtaccaacccaggcagagcccgcagacctggagctcctgcaggaactgaaccgcacgtgccgcgcaatgcagcagcgtgtcctggagctgattccccagatcgctaatgaacaactgacagaggaattgctgatagtaaacgataacctgaacaacgtctttctgcggcacgaacgttttgaaagattcaggaccgggcagaccactaaggcaccctctgaggccgagccagctgctgacctgatagacatgggtcccgatcccgccgccacaggaaacctgagcagtcagctggctgggatgaatttgggctcgtcatcagttcgggctggcctgcaatcactcgaagccagtggccgccttgaggatgaattcgatatgtttgccttgacacgagggtcctccctggccgaccagaggaaagaagtcaagtacgaggccccacaggctactgacggcctcgcaggcgccctggatgccagacagcagtccactggggctatcccggttactcaggcctgcctgatggaagacatcgagcagtggctctcaacagatgtcgggaacgacgccgaggagcccaaaggggtgacatctgagggcaagttcgataagttcctcgaggagcgtgccaaggcagccgaccgcttgcccaatctgtcctccccctctgcagaagggccaccaggccctcccagtggccccgcgccgcggaagaagactcaggagaaagacgatgatatgctgttcgccctgtag

SEQ ID NO: 26030 - DNA, 180 bp, Artificial Sequence
  Description of Artificial Sequence: Synthetic coding sequence
atgatgatgaagatgatgatgcggatgaagatccggaagatccggtaccattgtcagaggaagcagaatctaatccataataatggaaatggactggggagtgtccccgtcgagaaactcgtgttacatccgtctccaatccagaacccacagcagtcagccgtggtatcttgcgagtag

SEQ ID NO: 26031 - DNA, 537 bp, Artificial Sequence
  Description of Artificial Sequence: Synthetic coding sequence
atgctgggcctggacgcctgcgagctgggcgcccagctgctggagctcctgcgcctggcattgtgtgcacgagttctcctggccgacaaggagggcgggcctcccgcagtggacgaggtcttggacgaggcggtgccagagtatcgcgcaccagggaggaaatccctactcgagatacggcaactagacccagatgatcgtagcctggcaaagtataagcgcgttctgctcggccctcttcctccagctgtggatccatcgctgcccaacgtacaggtcacaaggctgacactactctcagagcaggctcctgggccagtggtaatggacttaacaggcgacctggctgttctcaaggatcaggttttcgtgctgaaagaaggtgtagactacagggtccatagggagattgtgagcggtctcaagtgcctacaccacacataccgtcgtggactgcgcgtagacaagacggtatacatggtgggtagttacgggccgagcgcacaggaatacgagttcgtgactccagtggagtag

SEQ ID NO: 26032 - DNA, 1119 bp, Artificial Sequence
  Description of Artificial Sequence: Synthetic coding sequence
atggacagcgtgcggagcggccccttcggccaggtgttccggcccgataattttatattcggacaatgcggtgctggcaataactgggcgaagggccattacacggagggagctgaactgatggaatcagtgatggacgtagttcgcaaagaggctgaatcgtgtgactgcttacaaggcttccagcttacccacagcctgggtggcggcacaggctctggtatggggacattgttactgtcaaaaatcagagaggaatacccggatcggatcatcaacaccttttctatcctgcctagccccaaggtctctgacaccgtcgtggaaccatacaacgccaccctgtccgtacatcagctgattgaaaacgccgacgagacgttttgtatcgacaatgaagccctgtacgacatctgttcaaaaacattgaagcttccaaccccgacgtatggtgacctgaaccacttggtcagcgccacaatgtcgggcgtgaccacctgcctgaggtttccaggccagctgaatgccgacctacgaaagcttgccgtgaacatggtcccctttccgcgcttgcatttcttcatgcccggtttcgctcctctgaccagtcgcgggtcacagcagtacagggcccttaccgtggcagaactcactcagcagatgttcgacgccaagaatatgatggcagcgtgtgatccaagacatgggaggtacttgaccgccgccgcaatttttcggggacgcatgcccatgagagaggtggatgaacagatgttcaacatccaagataagaactcttcttatttcgccgattggctccccaataacgtcaaaaccgctgtgtgcgatattccgccacgaggccttaagatgagtgctaccttcatcggcaacaacactgccatacaagagctcttcaaacgggtctctgaacagttcactgccatgtttcggaggaaagctttcctccactggtacaccggggaaggcatggatgaaatggaattcactgaggccgagagcaacatgaatgacctggtcagcgagtaccagcagtaccaagatgcaacagccgaagaagaagaagatgaggaatacgcagaggaagaggtcgcgtag

SEQ ID NO: 26033 - DNA, 576 bp, Artificial Sequence
  Description of Artificial Sequence: Synthetic coding sequence
atggccgccgccaaggacacccacgaggaccacgacaccagcaccgagaacaccgatgaaagtaaccacgacccacagtttgaacccattgtgagcctgcccgagcaggagatcaagacactggaggaagatgaggaagagttgtttaagatgcgggcaaagttatttcgcttcgcttccgaaaatgacttgccagagtggaaagagcgaggcacaggtgacgtcaaactcttaaaacacaagactctcaagatttgtgctaatcattatatcacgccaatgatggagctcaagcccaatgccggttcagaccgagcttgggtgtggaacacccacgcggacttcgccgacgagtgcccaaagccagaacttctggctatccggttccttaacgcagaatcggaacccagggctttgggcacttgcctgacatggggctcacctgcctggcagcggggaggactgtgcgccacaaacgcagtggccttttggggagagggagcagtcactggcaaatgtgtggtttgggcggccctgccatgctgcctgggcgccatgcccagactgaaaccatag

SEQ ID NO: 26034 - DNA, 369 bp, Artificial Sequence
  Description of Artificial Sequence: Synthetic coding sequence
atggccaccagcgcccccctgcggagcctggaggaggaggtgacctgtagcatctgccttgattacctgcgcgatccggtaactattgactgcggccatgtgttttgtagatcatgcaccaccgacgttcgaccaatcagcggatctcggcccgtttgtcccttgtgtaagaagccctttaagaaagaaaatattaggccagtgtggcagctggcatctctggtggaaaacatcgaacgtttgaaagtcgacaagggtcggcagcccggggaggtaacacgagagcagcaggacgctaagctttgtgagcggcatagggaaaaattacattactactgcgaggacgacggtaagctcctttgcgtttag

SEQ ID NO: 26035 - DNA, 1383 bp, Artificial Sequence
  Description of Artificial Sequence: Synthetic coding sequence
atggccagcctgctgcagagcgaccgggtgctgtacctggtgcagggggagaagaaagtgcgagcccccctgtcccagctgtacttctgccggtactgctctgagctgagatctctcgaatgtgtaagtcacgaggtggattctcactattgtccatcctgccttgaaaatatgccttctgccgaggcaaaactaaagaaaaatcggtgcgctaactgcttcgactgccccggctgcatgcacaccttatctactcgggccactagcatttcgacccagctacccgatgaccccgccaagacgaccatgaagaaggcatactacttagcctgcggtttttgcagatggacaagccgggacgttgggatggccgataaaagcgtagcgtcgggaggctggcaggagccggaaaatccccatacacagcgcatgaataaattaattgaatattaccagcaactggcacaaaaagaaaaggtcgaacgagacagaaaaaaactggctagaaggagaaattacatgcccttggccttctcagataagtatggtctgggtacgcggctgcagaggccaagagccggcgccagtattagtactttggctggcctctcattgaaggaaggcgaggatcagaaggaaattaagattgaaccggcgcaggccgtcgatgaggtcgagcccctgcccgaggattactacacaagaccagtgaacctgacagaggtcactaccttacagcaaaggctcctacagccagacttccaacccgtttgtgcttctcagctgtaccctcggcataagcatctactcatcaagcgttccctcagatgccggaagtgtgaacataacctgtctaagccagagttcaaccctacatcaataaagttcaaaattcagttggtcgccgtgaactacattcccgaggtgaggatcatgtccattccaaatttgagatacatgaaagagagtcaggtgttactgacattgactaatccagtcgagaatttgactcatgtcacattgttcgaatgtgaggagggagaccctgatgatatcaacagcaccgctaaggtggttgtgcccccaaaggagctcgttctggccggcaaggacgcagcagcagaatacgacgagctggccgaaccacaggacttccaggacgatccagatattattgcatttcggaaggcgaacaaggtcggtatcttcattaaggtgacccctcagcgggaggaaggcgaagtcacagtatgttttaaaatgaagcacgattttaaaaacttggccgcaccaattagaccaatcgaggagagtgaccaggggactgaagtcatctggttaacacagcacgttgagttaagcctgggacctctgctcccatag

SEQ ID NO: 26036 - DNA, 3336 bp, Artificial Sequence
  Description of Artificial Sequence: Synthetic coding sequence
atggagatggacgccccccggccccccagcctggccgtgcccggcgccgcctctcgtcccggccgtttgttagacgggggtcatggaaggcagcaagtgcaggcgttaagctcccaacttctcgaagtgatcccggacagtatgcgcaagcaggaggtgaggacgggaagagaagccggtcaaggacacgggaccgggagccccgcagaacaagttaaggctctgatggaccttctggctggtaagggctcccaagggagccaagcaccgcaggccctggaccggactcccgacgctcctctgggaccctgctctaacgactcccgcatccagcggcacagaaaggctctgttatccaaggttgggggggggcccgagcttggcgggccctggcaccgcttagcttccctgctgctagttgaaggcctcaccgacctgcagcttagggagcacgattttacccaggtcgaggccaccaggggaggggggcacccagccaggacagttgcattagatcggctcttcttgcctctgtcacgcgtgagcgtgccaccccgtgtgtctataacaattggggttgccgggatggggaaaaccacattggtgagacactttgtgaggctctgggcccacggacaggtcggcaaggacttcagtttggtgctgcccctgactttcagagacctcaatactcacgagaagctgtgtgccgatcgactgatttgctcagttttcccccatgttggtgaaccctcgctcgccgtcgctgtccccgcccgggccctgttgattctggatggattggatgaatgccgtacaccactagatttttccaacacagtcgcctgtaccgatcccaagaaggaaatccctgtggaccacctgatcacgaacattattagggggaacttatttcctgaggtgtcaatatggataacatcccgcccaagtgcgtccggtcagattcccggagggctggtcgatcgaatgacagagataagggggttcaacgaggaggagatcaaggtttgcctggagcagatgttccctgaggatcaggcgttgcttgggtggatgctgagccaggtgcaggccgacagagccttatacttgatgtgtacagttcccgcattctgtagactaacagggatggctctaggtcacctgtggcgcagccgcacgggaccccaggacgccgaactgtggccgccaaggacattgtgcgaactctattcatggtatttccgcatggccctgagcggggagggccaagaaaagggtaaagctagtcctcgcattgaacaggtggctcacggcggacggaagatggtgggtaccctagggcgcctcgcttttcatgggcttctgaagaagaagtacgtattttatgaacaagatatgaaggcattcggggtggaccttgcgctgttgcagggcgctccttgttcttgcttcctgcagagggaggaaacccttgcatcttctgtggcctactgctttacacatctttctctgcaggaattcgttgcagcagcgtattactatggcgcgagcagaagggccattttcgatcttttcacagagagcggagtgtcgtggcccaggctcggtttcctgactcacttccgctccgctgcccagcgggccatgcaagctgaagacgggaggctggacgtgttcctgcggttcctctcgggcctccttagcccccgcgtcaatgcactgctcgccggatcattgctcgcacagggcgaacatcaggcataccgcacacaggtggctgagttacttcagggctgcctcaggcctgacgcggccgtgtgcgcacgagccatcaatgtcctacactgtctgcacgagctgcagcataccgagctcgctcgttccgtggaggaagctatggaatccggggctttagctcgtctgacaggccctgcgcaccgtgcagccctcgcttaccttctccaggtgtctgatgcatgtgcccaggaggctaacctgagcctcagtctgtcccagggggtactgcagagcctcctgccgcagctgctgtactgtaggaaattgcggctggacacaaatcagttccaggaccctgtaatggagcttctgggcagcgtcttaagcgggaaagactgtagaattcagaagattagcctggccgagaaccagatctccaacaagggcgctaaggctctcgcgagatcactcctggtgaaccgttccctgaccagtttggacctgagagggaactctatcggcccgcagggggctaaggcccttgctgatgccctcaagatcaataggacacttactagcttgagcctccagggcaatacggtgcgggatgatggggcccggtcaatggccgaggcgctagcgtccaaccgaacactatcgatgcttcatctgcagaaaaattccattggtcctatgggggcacagagaatggctgatttaaagcagaaccggtccctgaaggagttgatgttctcatctaacagtattggggatggcggggcaaaagcactggccgaggctttaaaagtgaatcagggcctggagagtctggacctccagagcaactccatttccgacgctggtgttgccgccttaatgggtgccctatgcacaaatcagaccctgctctccctgtctctccgggagaacagcatctctcctgaaggtgctcaggccatcgcccacgccctgtgcgctaatagtacgcttaagaatctcgatctgacagctaacttgcttcatgaccaaggggctagagcaatagcagttgccgtccgtgagaatcgaacgcttaccagcctgcatcttcagtggaacttcattcaggccggcgcagcacaggctctgggtcaggctttacagcttaacaggagccttacaagcctggatctgcaggaaaatgccattggggacgacggggcatgcgccgtggctcgcgccctgaaggtcaacacggcgttgaccgcactgtatctgcaggtcgcatccatcggagcaagcggggcccaggtgctgggcgaggcactggcggtcaatcgcaccctggagatacttgatctgcgggggaacgcaatcggcgtcgccggcgcaaaggcattagcaaacgctttgaaggtgaacagcagtctgagacgccttaacctgcaagagaactctctggggatggacggcgctatttgcatcgccactgcactctccggcaaccatcggctacagcatataaacctgcagggcaaccatataggagactcaggtgcacgaatgatatcagaggccattaagacgaatgctccgacgtgcacagtggaaatgtag

SEQ ID NO: 26037 - DNA, 2424 bp, Artificial Sequence
  Description of Artificial Sequence: Synthetic coding sequence
atgctggagcggcgggccctgctgtggcagcgggaggccggccccggctggggcgatagggcgcgcgccggaactgggggcgccggcggcgggtgtggtggtgcaatggccgagcgaggaccagctttctgtggattgtatgatacctcgtccctccttaggtactgcaacgatgacaacctgagcggcacttccggcatggaagtcgacgaccgcgtaagtgctctggagcagaggctacagttgcaggaagacgagttagctgtcctgaaggcggcccttgccgacgctcttaggaggctgcgcgcctgcgaagagcagggcgccgctctgcgcgctcgtggaacaccgaagggaagggcacctcccaggctgggcactaccgcctctgtgtgtcagcttttgaaggggttacccacacgaacacccctgaacggaagcggccccccgcgcagagttggggggtatgccacatcccctagcagccccaagaaggaggccaccagtggacggtcatcggtgcgccggtatttatcacctgaacgtctggctagcgtacggcgagaggatcctcggtctcggacaacatcgtcctcatctaattgttcagcaaagaaagaggggaagactaaagaagtgatcttttccgtggaggatggctccgtgaaaatgttccttcgcggacgaccagttcccatgatgatccccgacgagttggcaccaacttactcgctggacacccgctctgagctgccttcctgtaggctaaaactggagtgggtgtatggatatagaggtcgcgattgcagagccaatctgtatctcctgcccacaggcgaaatcgtctacttcgtggcctcagtcgccgttttgtactccgttgaggaacagcggcagagacattatctgggccataatgacgatattaagtgtctcgctattcaccccgacatggtcaccattgcgacgggtcaggtggcaggcaccacaaaagagggcaaaccactccccccgcatgttagaatttgggattcagtttccctgtctaccctccatgtactgggcctgggggtgtttgatcgggccgtgtgttgcgtcggattttccaaaagtaatggcgggaatctgttatgcgcagtagacgaatcaaacgatcacatgttaagcgtctgggactgggccaaggaaactaaagtggttgatgtaaagtgttctaatgaggctgtgttggttgctacgttccatcctaccgaccctaccgtgttaatcacttgcggcaagtcccacatatacttctggactctggagggcgggagcctgagcaagcgacagggactgttcgaaaaacatgaaaaacccaagtacgtgctgtgcgtgacttttctggaaggcggtgatgttgttacaggcgactctggagggaacttatacgtatggggtaaaggtggcaaccggattacacaagctgtcttaggcgcacatgatgggggcgttttcggattgtgcgcacttcgcgatggcactctcgtatcgggtggcggtcgtaatagtatccttcagggatctgttcacacaggattctctctccttgttcagggccatgtcgaagaactgtggggccttgctactcacccaagtagggcacagtttgtcacgtgcggccaagataagttggtgcatctgtggagctccgactcacaccagcctctttggagccgaattattgaggaccctgcacgatctgctgggttccatccctctggtagcgtcctggctgtcggaaccgtaacaggaaggtggcttctgctggacactgaaactcatgatcttgtcgcaatacacaccgacggcaatgaacagatcagcgttgtgtcattttcccctgatggcgcatatctcgctgtcggctctcacgataatcttgtctacgtgtacaccgttgatcaaggaggaaggaaagtgtcccggctcggaaagtgttctgggcactcctctttcatcacccatttggactgggcccaggattcgagctgcttcgtcacaaacagcggcgattatgagatattatactgggatccagccacctgcaaacagatcacctctgcggacgctgtgcgaaacatggaatgggcaaccgctacttgtgtactgggttttggggtcttcggaatctggagcgagggcgcagatggaactgacataaatgcagttgccagatcccatgacgggaagttgcttgccagtgcagacgactttggcaaggtacatctgttctcatatccctgctgtcagcctagagcactctctcacaagtatggggggcattccagtcatgtaacaaacgtcgccttcctttgggacgattctatggctctcactactgggggaaaagacacctcagtcctgcaatggagggtggtatag

SEQ ID NO: 26038 - DNA, 1413 bp, Artificial Sequence
  Description of Artificial Sequence: Synthetic coding sequence
atggaggagaccatcaaggacccccccaccagcgccgtgctgctggaccattgtcatttcagccaagttatatttaactctgtggagaaattctacatcccaggcggtgacgtgacttgccactatacattcacccagcatttcattccacgcagaaaggactggataggtatcttccgcgcattcaagtgctttcaagataaattggagcaggaactgttgaagtggaggtcgcaggggcagaaattacaagtgggttggaagacaacacgcgagtactacaccttcatgtgggtaacactgcccatcgacctgaataacaagtccgcgaaacagcaggaagtccagttcaaggcctactatctgccgaaagacgacgagtattatcagttctgttacgtcgacgaggatggcgttgtgcggggcgccagtattcctttccagttccggcctgagaatgaagaggacatcctggtggtcactacacagggcgaggtggaggaaatcgagcagcacaacaaagagctttgcaaagaaaaccaggagctcaaagacagctgtataagcctgcaaaagcagaatagcgacatgcaggcagaattgcagaagaaacaggaggagctcgagacccttcagagtatcaataagaagctggaacttaaagtgaaagaacagaaggactattgggagactgagctgctacagctgaaggaacagaaccagaagatgagttctgagaatgagaaaatgggcattagagtggaccagctgcaggctcagctaagtacacaggagaaggagatggagaaattggtccagggggaccaggacaagactgaacaactggagcagctcaagaaggagaacgatcacttatttctgtcactgaccgagcaacgaaaagaccaaaagaagctcgagcaaacggtggaacagatgaagcagaacgaaactactgcaatgaagaagcagcaggagctcatggatgagaactttgatctgagcaaacgcctgagtgagaacgaaatcatttgcaatgcactccagcggcagaaggagcggctagagggagaaaacgatctcttgaagcgcgagaactctaggctgctgtcttatatgggactggacttcaattctctaccctaccaggtgcccacttcagacgagggcggagctcggcagaaccccggtctggcatatggaaatccctacagtggcattcaggagtccagcagtccttctccgcttagcattaagaaatgtccaatttgtaaggcagatgacatatgcgaccatacactcgaacagcagcagatgcagcccctttgcttcaactgccctatatgcgacaagatcttcccggctacagaaaaacagattttcgaggatcatgtattctgccatagcctctag

SEQ ID NO: 26039 - DNA, 1023 bp, Artificial Sequence
  Description of Artificial Sequence: Synthetic coding sequence
atgagcaagacccacgaccaccagctggagagcagcctgagccccgttgaggtgttcgccaagacgtcggcctcattagagatgaaccagggcgtcagtgaagagcgaattcacctgggctctagcccaaaaaagggagggaattgtgatctgtctcatcaggagcgcctacagtctaagtctcttcacctgtcaccccaggagcagagcgcgagctaccaagatcggcggcaaagttggcggcgcgctagcatgaaagaaaccaaccggcgaaaatccctgcaccccatccatcagggtataaccgaactgtcacgctcaatttcagtggatttggcggaatcgaagcgcctcggctgcctgctgctgtcatcgtttcaattttcaatccaaaagcttgagccgtttcttagggacacaaagggtttttccctggagagctttcgcgccaaggcttcctctctaagcgaggagctcaagcacttcgcagatggtctcgaaacagatggaactctccagaagtgcttcgaagattccaatggcaaggcttcagacttcagtctcgaggcttcagtggctgaaatgaaggagtatattaccaaattttcactggaacggcagacctgggatcagctccttctccattaccagcaagaggcgaaggagatactgtccagagggtctacagaagccaagatcaccgaggtcaaggtggaaccgatgacttacctgggctcttcccagaacgaggttctcaacacgaaacctgattaccagaagatcctgcaaaaccagtcaaaagtctttgattgcatggaacttgtgatggacgaattgcaaggctccgtgaagcaattgcaggctttcatggacgagtcgactcagtgttttcagaaggtctcagtccagttgggcaaacgtagcatgcaacagctcgatcctagtccagccagaaaacttttaaaactgcagctgcagaacccacccgcaattcatgggagcggtagcggtagctgccagtag

SEQ ID NO: 26040 - DNA, 522 bp, Artificial Sequence
  Description of Artificial Sequence: Synthetic coding sequence
atgacccacgtggccagccagttcgccagcagctacgtgttctactggcgggattatttcgaagaccaacccttgctctatcctcctgggtttgacggaagggtcgttgtttatccaagtaaccagaccttgaaggattacctgtcttggagacaagcggattgtcacataaacaatctctacaacacagtgttctgggcactgattcagcaaagtggactaacccccgtgcaggcccagggccggctccagggcactctcgccgctgacaaaaacgagattctgttttctgagttcaacataaattataacaacgaactcccaatgtacagaaagggcactgtactgatctggcagaaggtggacgaggtaatgacgaaagagatcaagttgccaactgagatggaaggaaagaaaatggcggtcacccgcaccagaaccaaacccgttccgcttcactgtgacattattggggatgccttttggaaggaacacccagaaatcttggatgaggactcatag

SEQ ID NO: 26041 - DNA, 285 bp, Artificial Sequence
  Description of Artificial Sequence: Synthetic coding sequence
atggagatggagagcgccgccgccagcacccggttccaccagccccatatggaacgcaagatgagtgctatggcctgtgaaattttcaacgagctgcgcctggagggcaaactctgtgacgtggttatcaaagttaacgggttcgagttcagcgcacacaagaacatcctttgttcctgctcttcctacttcagagcccttttcaccagtggctggaataacaccgagaaaaaggtctataatatccccggcatttctcctgacatgatgaaattgattatctag

SEQ ID NO: 26042 - DNA, 1572 bp, Artificial Sequence
  Description of Artificial Sequence: Synthetic coding sequence
atgaaccagccctgcaacagcatggagccccgggtgatggacgacgatatgttgaaactcgctgtgggcgaccaggggcctcaagaggaagccggccagctagccaagcaggagggcatcctgtttaaagatgtgctctccctgcagctggacttcagaaatattctgcgaatagacaatctatggcaattcgagaacctgcggaaactccagctggataacaacattattgaaaaaatcgagggactggaaaatctcgctcacctggtgtggctcgacctcagctttaacaacattgaaaccatcgagggcttggacactctcgtaaacctagaagacctgagtctgttcaataaccgcatctccaagattgatagcctcgatgccctggtaaagctccaggtgctctctcttggcaataaccggattgataacatgatgaatattatctatctaagacggtttaaatgtctgcggaccctgtcattaagccggaatcctatatctgaggcagaggactacaaaatgttcatttgcgcctacctgccagatctaatgtacctcgattataggcgcattgatgatcatactaagaaactggcagaagccaaacatcagtacagcattgatgagctgaaacaccaggagaacctcatgcaggcccaactggaggacgagcaggcacagagagaagagctcgaaaaacataagaccgcttttgttgagcatctgaatggttcttttctctttgacagtatgtatgcagaagattcagagggaaacaacctgtcctatctccctggcgtcggggaactcctggagacctataaagacaaattcgtcatcatctgtgtgaatatttttgagtatggactgaaacagcaggaaaaacgaaagaccgagctggataccttctcagagtgtgtgagggaggccattcaggaaaaccaggaacagggaaagcggaagattgcaaaatttgaggaaaagcacttgagctcactgtccgctattcgcgaagagctggagctccccaatatcgagaagatgatactggagtgcagcgctgacatcagtgagctgtttgatgctctgatgacgcttgaaatgcaacttgtagaacagctcgaagaaaccatcaacatgttcgaaagaaacatcgtggatatggtgggtctgtttatcgagaacgtgcagtcgctaatggcgcagtgtcgagacttggagaatcaccaccacgaaaagctgttagagatcagcatctccactttggaaaaaatcgtagaaggagatctggatgaggacttacccaacgacctccgggctttgttcgtggataaagatactatcgtcaacgccgtgggagccagtcatgacatccacctgctcaaaatagataaccgtgaggatgaacttgtgactcgtatcaattcttggtgcacgcggctcattgacaggatccacaaagatgaaatcatgcggaaccgcaagagggtcaaagagatcaatcaatacatagaccacatgcagtctgagctagacaacttagagtgcggcgacatattggactag

SEQ ID NO: 26043 - DNA, 372 bp, Artificial Sequence
  Description of Artificial Sequence: Synthetic coding sequence
atgggcaccggcgacttcatctgcatcagcatgaccggcggcgccccatggggcttcagattgcagggcggcaaggagcagaagcagcccctgcaggtcgcgaagatacgaaaccagagcaaagcctcaggtagcgggttatgcgagggcgacgaggtggtttcgataaatggcaacccgtgtgccgatttgacttatccagaggttattaaactaatggaatcgatcacggactctctacaaatgttgatcaagcgacgagtgggggcgccattcctgtttttggaagatcagagccatcctcctttcctgcacctgttgggctacacctccctactcatcgttaccctggttaatcaacctatggactag

SEQ ID NO: 26044 - DNA, 1146 bp, Artificial Sequence
  Description of Artificial Sequence: Synthetic coding sequence
atgcccctgcaggtgagcgactacagctggcagcagaccaagaccgcggtgtttctgtcactgcccctcaaaggcgtctgcgtacgtgataccgacgtattctgtacagagaattacctgaaggtgaacttcccccccttcctatttgaagcctttttgtacgccccaatagacgatgagtccagcaaagctaaaatcggcaacgacactatcgtgttcactctgtataagaaagaggctgccatgtgggaaacactatctgtaacaggtgtggacaaggagatgatgcagaggattagagaaaaatctatcctgcaggcgcaggagcgcgctaaggaggcaaccgaagctaaagccgccgccaagcgagaggatcagaaatacgcactaagcgtgatgatgaaaatcgaagaggaagagcgcaaaaagattgaggacatgaaggagaacgagcgaattaaagccacgaaggccctggaggcttggaaggagtaccagcggaaggccgaagagcagaagaaaatccagagggaagagaaattgtgtcagaaggaaaagcaaattaaggaagaacgtaaaaagatcaagtacaagagcctgacgagaaacttggcgtcgcggaaccttgcccccaagggtcgcaattctgagaatatttttacagaaaagttaaaggaggactccattccggctcctaggtcagtgggctccataaaaatcaattttactcccagagtgttcccaacagcgctacgggagagccaggtcgctgaggaagaggaatggttgcataaacaggccgaagcccgtcgggctatgaacactgacattgccgagttgtgtgatctgaaggaagaggaaaaaaatccagagtggctgaaagacaagggaaacaaattgtttgctaccgagaactacctggccgcaatcaatgcatacaacctagctattcgcctcaacaacaaaatgcccctgctttacctgaatcgggccgcatgtcatctgaagctgaagaacctgcacaaggctatcgaagacagcagcaaggaattttgttcactggagggcatcgaatgccaggcttctgaacccaaactttcccaccatatccctagtgatcttcacgtttacatccagatggcctag

SEQ ID NO: 26045 - DNA, 615 bp, Artificial Sequence
  Description of Artificial Sequence: Synthetic coding sequence
atggtgatggccgagggcaccgccgtgctgcggcggaaccggcccggtacgaaagcgcagtacatccaacagaatattagagcagattgctcgaatatagataagatcctggaacctccagaaggccaggacgaaggagtctggaagtacgaacacctaaggcagttctgtctcgagcttaacggtttggcagttaagctccaaagtgagtgtcaccctgacacctgtacccagatgaccgcgactgagcagtggatttttctttgcgccgcccacaagactccaaaagagtgcccagctatcgattacacccggcacaccctcgatggagcggcctgcctccttaacagtaacaaatattttcctagccgagtgtcaatcaaggagtctagcgtagctaagttagggagcgtctgcaggcgcatctaccgcatcttttctcacgcttactttcatcatcgccaaatattcgatgagtacgaaaatgaaactttcctatgtcataggtttacaaaatttgtgatgaaatacaacctgatgagcaaggacaacttaattgtgcctatcttggaggaggaggtgcagaatagtgtgagcggggaatctgaggcctag

SEQ ID NO: 26046 - DNA, 1293 bp, Artificial Sequence
  Description of Artificial Sequence: Synthetic coding sequence
atggccgccaacctgagccggaacggccccgccctgcaggaggcctacgtgagagtggtgaccgagaaaagtccgaccgattgggcactgtttacatatgagggtaattctaacgacatccgcgtggccggaaccggggagggcggcttagaggagatggtggaggagctgaactccgggaaggtcatgtacgccttttgccgcgtgaaagatcccaactctggcctgcctaagttcgttcttattaattggacaggtgaaggtgtgaacgatgtacgcaaaggcgcttgtgcttcccatgtttccactatggctagcttcctgaagggagcacatgtgactatcaatgcaagagcagaagaagacgtggaacccgaatgtataatggaaaaagttgcaaaggcttctggcgcaaactattcgttccataaagagtctgggcggttccaggatgtgggtcctcaagcaccagtgggttccgtgtatcagaaaaccaatgcagtttctgagattaagagggtcggcaaagattctttctgggctaaggctgagaaagaggaggagaatagaagactcgaggagaaacgacgggcagaggaggcacagcggcaactcgagcaggagcgacgcgagagggagctgcgagaggctgccagaagagaacagcgataccaagaacaggggggcgaagcttcacctcaacggacttgggagcagcagcaagaagtcgtgtctaggaaccggaacgagcaggaaagcgctgtgcaccccagggaaatctttaagcaaaaggagcgtgccatgagtaccacctctatttctagcccgcagcccggaaagcttcgctctccttttttgcagaagcagctcacccagcccgaaacacatttcgggcgagagccagcagccgccatctcccgaccccgagctgatctgcctgctgaggaacccgcaccttctaccccgccatgcctggttcaagcggaagaggaggcagtgtacgaagaaccccccgagcaggagacattttatgagcaacctccgctcgtgcaacagcaaggcgccggatctgagcatatagaccaccatattcaagggcagggattgagcggtcagggcctctgtgctagggccttgtacgactatcaggccgcggacgataccgagatctcttttgatcccgagaatcttattacgggcatcgaggtgattgatgaggggtggtggagaggatacggaccagacgggcattttggtatgtttccggcgaattacgtggagctgattgaatag

SEQ ID NO: 26047 - DNA, 3189 bp, Artificial Sequence
  Description of Artificial Sequence: Synthetic coding sequence
atggtgagcagcgcccagatgggcttcaacctgcaggccctgctggagcaactaagccaagacgaactgagtaaatttaaatacctgataacaaccttctctctcgctcatgaattgcagaaaatcccccacaaagaggtggataaggctgatgggaaacaactggtcgaaatactcaccacccactgcgactcctactgggtggaaatggctagcttgcaagtcttcgagaagatgcaccgtatggacctcagtgagcgagccaaagacgaagttcgcgaggcagcactgaaatcattcaataagcggaaaccactgtccctcggaattacccgtaaggagcggcctcccttggacgtggacgagatgctcgagaggttcaaaactgaagcccaagcatttactgagacgaaaggcaatgtgatttgtctggggaaggaggtcttcaagggaaagaagccagacaaggacaaccgctgcagatatattctaaagacgaaattccgcgagatgtggaagtcttggccaggcgactccaaggaggtacaagtaatggccgaaaggtacaagatgcttatcccattttctaatcctcgtgtgctccccggccctttttcgtatactgtggtattatatggtccagccggcctcggaaaaactacccttgcccagaagctgatgctagattgggccgaagacaatcttatacacaagtttaagtacgctttctatctctcttgccgagagctcagccgcctgggcccctgctctttcgctgagctggtattcagggattggcctgaactgcaggatgatattccccacattcttgctcaggccagaaagatccttttcgtaattgacggcttcgatgagctcggggcagcaccaggagccttgatcgaggatatttgcggcgactgggagaaaaaaaagccggtgcccgtactgcttggatctctgctgaacagggttatgctcccaaaagctgccttgctcgtgacaacccgcccccgcgctctgagggacctgcgcattttggcagaagagcctatttacatcagggtcgaggggtttctggaagaagatcgccgtgcatatttcctgcgccactttggtgatgaggatcaggccatgcgggcatttgagctgatgcggagtaatgcagcacttttccagttgggatccgctcctgcagtgtgctggatcgtttgtacaaccctgaagctgcaaatggaaaaaggcgaggatccggtccctacatgtcttacacggactgggctgttcctcaggttcctgtgttctaggtttccacagggagctcagttaagaggggccctgcggacactctccctgctcgccgcccagggtctgtgggcccagaccagtgtccttcaccgggaggacttggagaggttaggcgtgcaagagtctgacctgcgcctgtttctagatggcgacattctgcggcaggatcgagtctccaaaggatgctatagtttcattcatttatcttttcagcagttcctgacggctctcttctatactcttgagaaagaggaagaagaagaccgggacggccacacatgggacataggagacgtgcagaagctcttgtctggcgtggaacggctgcgaaaccctgacctgattcaagccggttactatagtttcggacttgcgaacgagaaacgggccaaggaactggaggcgacttttggctgcaggatgtcacccgacattaagcaagagcttctccgctgcgatattagttgtaagggtgggcactctacagtgactgatttgcaggagttgctcggctgcctgtatgagtctcaggaggaagagcttgtgaaagaggttatggcccagtttaaggagatctcactgcatctgaatgctgtggacgtggtcccctcaagcttttgtgtgaaacactgtcggaacctacagaaaatgtcactccaggttattaaagaaaacctgccagagaatgtgacagccagcgagagtgacgctgaggtcgagaggtctcaggatgaccagcacatgctccctttctggaccgacctgtgctcgattttcggcagcaataaggatttgatgggattggcgattaacgacagcttcctgagtgcttcgctggtcagaattctgtgcgaacaaatcgctagcgacacctgtcacttgcagcgggtagtgtttaaaaacatatcccctgcagatgcacatcgcaatttatgcctagccttgcggggtcataagacagtcacctacctgactctccagggaaacgatcaggacgacatgtttccagccctgtgtgaagttttgcgacacccagagtgtaatttgaggtaccttggacttgtatcttgctccgccacaacacagcaatgggctgatctgtcactagcacttgaggtgaatcagtctctcacctgcgttaacctgtcggacaatgagttgctagacgagggcgccaaattactgtacacgactctgaggcaccctaagtgtttcctgcaacggttatctttggaaaactgccatctgactgaggctaactgcaaggatctagcagcggtgctagtggtgtcccgagaacttacacatctatgcctggccaaaaaccccattggcaacaccggggtgaagttcttgtgcgaaggcctgaggtatccggaatgcaaattgcagactctcgtgctttggaactgcgatatcacaagcgacggatgctgtgatctgactaagcttcttcaggaaaaaagctccctcctgtgcttggatcttggcctcaatcacataggggtaaaaggcatgaaatttctttgtgaggccctacgcaaacctctgtgcaatctcagatgcctgtggctgtggggttgcagcattcctcctttctcatgcgaagatctctgcagcgctctgtcctgcaaccaatctctggtgacattagaccttggtcagaaccccttgggttcttccggggtgaaaatgctgtttgagacgctgacatgttcgagcgggaccctgcgtactctgcggctgaagatagatgattttaacgacgaacttaataagctcctggaagaaatagaggagaagaatccacaactgattattgatactgagaagcatcacccttgggcagagcgcccttcttctcacgactttatgatttag

SEQ ID NO: 26048 - DNA, 390 bp, Artificial Sequence
  Description of Artificial Sequence: Synthetic coding sequence
atggccgagctgatccagaagaagctgcagggcgaggtggagaagtatcaacagttacaaaaagatctatcaaaaagtatgtctgggaggcagaaactggaggcgcagctcaccgaaaataatatcgtgaaggaagagctcgccctgcttgatggctccaacgtagtctttaagctgctgggacccgttcttgtgaagcaagaattgggcgaggctagggctacggtgggaaagcgcctggattacatcacagccgagatcaagcgctacgagagtcagctacgagacctggaaaggcagtccgagcaacagagagagaccctggctcagttacagcaggagtttcaaagggcacaggctgcaaaggctggggcaccgggaaaagcctag

SEQ ID NO: 26049 - DNA, 516 bp, Artificial Sequence
  Description of Artificial Sequence: Synthetic coding sequence
atggaggtggccgagcccagcagccccaccgaggaggaggaggaggaggaagaacactcagcggagccacgacctcggacacggtctaatcccgagggagcagaggacagggctgtcggtgcccaagcctcggttggatccaggagtgaaggcgaaggcgaggctgcttctgccgacgatggttcactgaacaccagcggagctggccctaagagctggcaggtgccaccacctgctcccgaagtccaaattcggaccccgagggtgaattgtcccgagaaagtgattatttgcctcgacctatccgaggagatgtccctgcctaagctagagagcttcaacgggcagcagaaaaccgagctgccagtgactgaaaatgtacagacgattccaccaccatatgtggttaggactattttagtctattcccgtcctccttgccaaccacaattctctctcacagaacctatgaaggtcggagaggcatgggagagagaaggctgcctccagccttag

SEQ ID NO: 26050 - DNA, 1446 bp, Artificial Sequence
  Description of Artificial Sequence: Synthetic coding sequence
atggccagcgccgccagcgtgaccagcctggccgacgaggtgaactgtcccatttgtcaaggaactctgcgagaaccggtgacgatagactgtggccacaacttctgtagagcgtgccttacaaggtactgtgagatccccggcccggacctcgaagagtcgccaacctgccctctgtgcaaagagccattccggccgggatcatttcgcccaaactggcagttagccaacgttgtggagaacatagaaagattacagctcgtttctaccttagggctgggggaagaggacgtctgtcaggagcacggagaaaagatttatttcttctgtgaagatgatgagatgcagttgtgcgtggtctgccgggaagccggcgagcatgccactcacacaatgcgtttcctggaggacgcagctgcgccttatagagaacagatccataagtgtctgaaatgtctgagaaaggaaagagaggaaatccaggaaatccagagtcgagaaaacaaacgcatgcaagtccttttaacccaggtaagtactaaaagacaacaggtgatcagcgagttcgctcacctgaggaaatttctggaagagcaacagtccattctgctggcccaactggagtcacaagatggggacattttgcggcagagggatgaattcgacttattagtggccggggagatctgcaggttttcggcccttatcgaggaactcgaggaaaagaatgagcgaccggcacgggaactgttgactgacataaggtcgaccctgatccgatgtgaaacaagaaaatgcagaaaaccggtggccgtgtcccccgagctgggtcagcggatccgggattttccgcaacaggctctgcctcttcagagggaaatgaagatgttcctggaaaagctgtgcttcgaattggactatgagcccgcacatatcagcctggacccacagactagccaccccaaactgctgctcagtgaggatcatcaaagggcccagttcagttataaatggcagaactcaccggacaatccccaacgattcgatagggcaacatgtgtcttggcacacaccggcatcacaggagggagacacacctgggtcgtgagcatcgacctggctcatggaggcagctgcactgtgggggtagtgagcgaggacgttcaacgtaagggtgagctgcgcttacgccccgaggagggggtctgggcagtgcgcttggcatgggggtttgtttctgccctgggatccttccccacacggcttacactaaaggagcagccgcgtcaggtgagggtgagcctggattatgaggtgggatgggttactttcacaaatgccgtcacccgggagcctatatacaccttcactgcctcattcacccgaaaagtgatccctttcttcgggctgtggggccggggcagcagtttctcccttagcagttag

SEQ ID NO: 26051 - DNA, 1986 bp, Artificial Sequence
  Description of Artificial Sequence: Synthetic coding sequence
atgaacaccggccgggacagccagagccccgacagcgcctggcggtcctataacgatggaaaccaagaaacgctaaatggcgacgcaacctattcttccctggctgccaaaggcttcaggtccgtgcgccccaatctgcaggacaagaggtcacctacacagagtcaaatcacagtgaatggcaattctgggggagccgtgagtcctatgtcctactaccaaaggcccttcagtcccagtgcctactcacttcctgcctctctgaactcctccatcgttatgcagcatggcaccagcctggactccactgatacgtacccccagcacgcacagagcctggacgggactacttctagttccattcccctgtacaggagttccgaagaggagaagagagtgactgtaatcaaagcaccgcattatccggggatcggaccagtcgatgagagcgggatacccactgctatcagaacaactgtcgaccgtcccaaagattggtacaagacaatgttcaaacagatccacatggtgcataaacctgacgacgatacggatatgtataacaccccctatacctacaatgcgggtttgtacaacccaccgtatagcgctcagagtcaccctgccgcgaagactcagacctaccgccctctctctaagagtcattcagacaatagcccaaacgccttcaaagatgcaagctccccagtgccccctccccatgtgcctcctccagtccctccactgcgcccgcgggaccggtcgtccacagaaaagcacgactgggacccccctgacagaaaggtggataccagaaagttcagatctgagcccaggtccatctttgagtacgaaccaggtaagagtagcattctgcagcacgaacggcctccccccaaaaagcctctcgactacgtacaggatcattcctctggggtgttcaacgaggccagtctgtaccagagctccatcgacaggtccttagagagacccatgtcaagcgccagcatggcatctgacttcagaaaaaggcgcaagtcagagcccgctgttggtcctcccagagggttaggagatcagtccgcatcaaggacgtctccaggaagagttgacctacccggctccagtacaacacttactaaatcgttcactagttcatcacccagctctcctagccgggctaaagatcgcgaatccccccgcagctactcttccacccttacggatatggggcggtcagccccccgggagagaaggggcacgcccgagaaggaaaaattacccgccaaagctgtttatgactttaaagctcagacctccaaagagctgtctttcaagaagggagacaccgtgtacattctgcgcaaaatcgaccagaattggtatgaaggtgaacaccacggacgcgtgggcatatttcccatcagttacgtggagaagctgacccccccagaaaaagcccaacccgcgcgcccccctccacccgcacagcccggagaaattggggaagccatcgccaagtataattttaatgccgacaccaacgttgaactctctttgcggaagggagatagagtgatcctgctcaagcgtgttgaccagaattggtatgaaggaaagatccctggcaccaatagacagggtatctttccggtttcatacgtggaagttgtgaaaaagaataccaagggtgcagaagactatccagatcccccaatccctcacagttacagctccgatcggatacacagcctctcatcaaataagccacagaggcctgtgttcacccacgagaacatacaaggcggcggcgagcccttccaggccctctacaactatacgccccgaaatgaggatgagctggagctgagggagagtgatgtgatcgatgtgatggaaaagtgtgatgatggctggtttgtcggcacctcaaggcgcacaaaattcttcgggacctttcccggcaactatgtcaaacggttgtag

SEQ ID NO: 26052 - DNA, 483 bp, Artificial Sequence
  Description of Artificial Sequence: Synthetic coding sequence
atggaggccgagcggccccaggaggaggaggacggcgagcagggcccccctcaggacgaagaaggatggccaccacccaacagcaccactcgcccctggcgatccgcacctcctagcccccctccccctggtacacggcacaccgcactgggcccaaggtctgcttcactgttatccttgcagacagaactgcttctagatttggttgctgaagctcagtctcgccgcctcgaggaacagcgcgccactttctacaccccccagaacccgtcttccctcgctcccgcacccctccggccactggaagacagagagcaactctacagcacgattctctctcatcaatgccagcgaatggaagcacagagatctgagccacccctacctccaggaggccaggagctgttggagcttctccttagagtgcaagggggaggacggatggaagagcagcggtcccgtcctccaactcacacatgctag

SEQ ID NO: 26053 - DNA, 717 bp, Artificial Sequence
  Description of Artificial Sequence: Synthetic coding sequence
atggactgccgggagatggacctgtacgaggactaccagagccccttcgactttgatgccggtgttaacaagagttatttgtaccttagtccctctggtaattcgagtcccccagggtctccaaccctccagaagtttggattacttcggactgacccagtgcctgaggagggcgaggatgtcgctgccacaatcagtgctaccgaaactctgtccgaagaagaacaggaagagctacggcgagaactggctaaggttgaagaagaaatccagacgctctcacaggttctggccgcgaaagaaaagcacctcgccgagattaagcgcaagctgggcattaattctttacaggagttgaaacagaatatagccaagggatggcaggacgtcaccgctacctctgcttacaagaagacaagcgagactctgtcccaggctggtcagaaggccagtgcggccttctcctctgtaggatcagtcatcacaaagaaattggaggacgttaacattagatctattcagcattccatttccatgccggcaatgagaaactcgcccacttttaaaagcttcgaagagaaggtcgagaacctgaagtccaaagtgggcggtaccaagccagccgggggcgatttcggtgaggtgctaaattctgccgccaatgcttctgctaccactactgagccattacctgagaagacacaagagtcactgtag

SEQ ID NO: 26054 - DNA, 108 bp, Artificial Sequence
  Description of Artificial Sequence: Synthetic coding sequence
atgcagaccagcagcagccggagcgtgcacctgagcgagtggcagaaaaactatttcgccattacatccgggatctgtacgggccctaaagcggacgcttatcgctag

SEQ ID NO: 26055 - DNA, 327 bp, Artificial Sequence
  Description of Artificial Sequence: Synthetic coding sequence
atgacccggggcaaccagcgggagctggcccggcagaagaacatgaaaaaacagtccgacagcgtcaaaggcaagcggcgagatgatggattatctgcagccgccaggaagcagtccgccataacatctagccgaaatttcctttacccagcctatgtttacttcccttcgtctgtcccctccccccctcgaaaatatactcagacgtactatgcagcagttccggccgggtggtgggggagcggcggcgggcccgctacccagcccgcagcgggagggcgctggagatttctgcatatcctaggcacacagccacagagccactag

SEQ ID NO: 26056 - DNA, 846 bp, Artificial Sequence
  Description of Artificial Sequence: Synthetic coding sequence
atgggcgccggcaacctgccccccatcacccaggaggaggccctgcacatcctgggatttcaaccaccgttcgaggatataaggttcgggccctttactgggaataccacgcttatgcgatggtttagacagattaatgaccactttcatgttaaaggttgctcatatgttctgtataagccacacggcaagaataagacggccggcgaaacagccagtggagccctctcgaagttgactcggggacttaaggacgagagccttgcctatatctaccattgccagaaccactatttctgccctataggctttgaggctaccccagtgaaggcgaataaggcattttctcgcggacctctctccccacaggaggtggagtactggatcctgatcggcgaaagctctcgaaaacacccagctatacattgcaaaaagtgggctgatatcgtgacagatctgaacacacagaatccagagtatcttgacatccgccacctggagcgcggccttcagtatcgaaagaccaagaagcccacctttttttcctcgcaggtgggtggcaaccttcactgcatcatcgcatttcagagactgaactggcagagatttggcctgtggaacttcccgtttgggacgattcggcaggagagccagccacctactcatgctcaggggattgccaagtcagaaagcgaagataatatttcaaagaagcagcacgggagactgggcagatctttcagcgcatcgttccatcaggactcagcctggaagaagatgagcagtattcacgagagacgtaactccggctaccagggctactcggactacgatgggaatgactag

SEQ ID NO: 26057 - DNA, 213 bp, Artificial Sequence
  Description of Artificial Sequence: Synthetic coding sequence
atgcgggccctgaccgtgcagcgggtgaagttcgccatggacctgcctctgctgaaacgcgctggccaggacctagccgagaaaacaaagaacttcgttagtaggtcgctggtcatcggcgaagtcctttctatggccgacatggcaacaggcgtaaaatgcggcatcatttactggctcttcggcggagcgatccgaaatctgggaagctag

SEQ ID NO: 26058 - DNA, 1644 bp, Artificial Sequence
  Description of Artificial Sequence: Synthetic coding sequence
atggccggcaccaagaacaagacccgggcccaggccaagaccgagaagaaggctgccattcaagccaaggcaggcgctgaaagagaggctacaggggtcgttcggccagttgcgaagaccagggcgaaagccaaggccaagaccggttccaaaaccgatgcggtggccgagatgaaggcagtatcaaagaacaaggtcgtggctgagaccaaggaaggcgcgctaagcgaaccaaaaactttgggcaaagcaatgggcgatttcactcccaaagcaggtaatgagtctacgagctccacatgtaagaatgaagccggaaccgacgcttggttttgggctggtgaggaagctactatcaactcctggttttggaacggcgaggaggctggcaattcattttctacgaaaaacgacaagccggaaatcggggcacaggtctgtgcggaggaattggaacctgctgccggcgccgactgtaaacccaggtctggcgccgaagaggaagaggaagagaatgtgatagggaactggttttgggagggtgacgataccagctttgaccctaaccctaaaccggtcagtagaattgtcaaacctcagcccgtctacgaaatcaacgagaaaaatcgtcctaaagactggagcgaagtgaccatctggcccaacgcgcctgccgttacccctgccgtgctgggattccgctcacaagccccttctgaagccagtccaccatcgtatatcgttttggcctctgccgaggagaacgcctgcagcctgccagtggctactgcatgccgccccagcagaaatacccgaagctgtagccagcctatccccgaatgtcggttcgactctgacccatgcatccaaaccatcgacgagatccgcagacaaatacggatccgcgaggtgaatggcattaaaccatttgcctgcccctgtaaaatggagtgctacatggacagcgaagaatttgaaaaactggtgagtcttctgaaatccaccaccgacccattgattcacaagattgctcgcatcgctatgggcgtccataatgtccacccatttgcccaggagtttattaatgaagtgggcgtggtaactctaatagagtcactgctgtccttcccttcaccagaaatgaggaaaaaaactgttattactcttaatcccccatctggagatgagagacagcgaaaaattgagctccatgtgaagcacatgtgcaaagagaccatgagttttcccttaaactcacctggacagcagtctgggctcaagattctggggcagcttaccactgactttgtgcaccactatatagtggctaactatttctctgaattgttccatcttctctcttccggcaattgcaaaaccaggaatctggtactcaaattgctactgaatatgtccgagaaccctacagccgcgcgggatatgatcaacatgaaggcactagccgcactgaagctaatcttcaaccagaaggaagccaaagctaacttggtgtcaggagtggctatttttataaatattaaagaacacatacggaagggttcaatagtggttgtcgaccatttgtcctataacactttgatggccattttcagagaggtgaaggaaattatagaaactatgtag

SEQ ID NO: 26059 - DNA, 489 bp, Artificial Sequence
  Description of Artificial Sequence: Synthetic coding sequence
atgagctacaactgctgcagccggaacttcagcagctgcagccacggcggatatctccactatcccggatcatcctgcggctccagctatccaagcaacctggtgtacagcactgacctctgttcaccaagcacgtgccaattaggttcgtcactttaccgggggtgccaggaaacctgttggcgccctaactcatgtcagacattttgctactaccctcggacccatatgctatgcaactcctgtctgactatgcatgttggcagtcggggattcggctcaaatagctgctgttctctgagctgcggctctcgaagttgtagctctctgggctgcggctctaacggctttagatatctcaactaccgcatacacacctctccatcccagagttaccggtctcgcttctgtcacccgatctattttccgccgagaagatggttccactcgtcctgttatcagcctttctgcagaagtggcttctattag

SEQ ID NO: 26060 - DNA, 495 bp, Artificial Sequence
  Description of Artificial Sequence: Synthetic coding sequence
atgttcatcagcttctacgacttcaagaacatcccccaggacagcagatgcgatggacaattatttatcaatgggagaaacaataaaaacaacagtattagcttatacttccagggcggccttcgccacgcaagtgcctctatcggcggcagtgaagcttatcggcacatgaagttcgaaggcggcgtgcatcgagtgcagagggttcctaaaaccgagaagcagggacgggtgcatacctccactatgaccgtggctatcttgcctcagcctactgaaatcaacctggttatcaaccccaaagacctgcggatcgacactaagagagcctcaggcgccggcggtcagcacgtgaacaccacggatagtgctgtgcgaatcgtgcacctcccaaccggggtcgtgtccgaatgtcagcaagagaggtctcaactgaaaaataaggaattagctatgacgaagctgagagcgaagctgtattcaatgcacttatag

SEQ ID NO: 26061 - DNA, 2166 bp, Artificial Sequence
  Description of Artificial Sequence: Synthetic coding sequence
atggaggaggagctgaagtgccccgtgtgcggcagcctgttccgggaaccaatcatcttaccttgttcgcacaacgtctgccttccctgtgcccgtacgattgcagtgcagacccctgacgggggatccgctgccggcgggctggggggcggcgcagggggcgggggtgatcacgctgacaagctttctttgtacagtgagaccgacagtgggtatggcagctatacgccatctttgaagagccctaacggcgtgcgcgttctcccgatggttcctgccccacccggttcaagtgctgcagccgcgaggggagcggcatgcagctcacttagttcgtcaagctcatccatcacgtgcccgcagtgtcaccgatcggcatcactggaccatcgcggcctgcgggggttccagagaaacaggctgctggaagcaatcgtgcaaagataccagcagggacgtggagctgtgcctggaacatccgccgccgcagctgtggccatctgccagttatgtgacagaacaccacctgagcctgccgccaccctttgtgagcagtgcgatgtactctactgttcagcatgtcagctgaagtgccacccaagccgtgggcctttcgccaagcaccggttgggcgctccgagtggaggagggggctgcaagtccccaggaggtgccggagctggcgcaacggggggatctacggccagaaagtttccaacatgccccgaacatgagatggaaaattattctatgtactgcgtcagctgtcggacaccagtgtgctatctttgcctggaggagggaaggcatgccaagcatgaggtgaaaccactcggggcaatgtggaaacaacacaaagcacagcttagtcaggcactgaacggagtctccgacaaagccaaggaggcaaaggaattcctggttcagctcaaaaatatactccagcagatccaggaaaatggtctggattacgaagcatgcttagtggctcagtgtgatgctctggttgatgccttaaccagacagaaggcgaaattactcacaaaggtcacgaaagagagagagcacaaactgaagatggtatgggatcagataaatcactgtacacttaagttaaggcaaagtacaggcctcatggagtattgcctagaggtgattaaggaaaatgatccaagtggcttcctccaaatttctgatgccctcattaagagggttcaggtgtcacaggagcagtgggtgaagggggcgctggaacctaaagtctccgccgagttcgatctgaccctcgactctgagcctctgctacaagcaatccaccaactggatttcatccaaatgaaatgcagggtaccgcctgttccactcctgcagctggaaaagtgttgcactcggaataattctgtaaccctggcctggagaatgcccccttttacacactcacccgtagatggctacatcctagaactagatgatggcgcgggcggacagttccgtgaggtttatgtgggcaaggagacactttgtactattgatgggctgcacttcaattcaacctacaatgcacgggtgaaagcctttaatagttctggggtgggcccttacagtaaaacagtggtgctgcagacctctgacgtcgcatggtttacttttgatcccaatagtggacacagggatatcatcctttctaacgacaaccaaactgcaacttgcagctcctacgacgatcgtgtagtgttgggtacagcggccttctccaaaggcgtacactactgggagcttcatgtagatcgctacgataatcaccccgacccagcctttggcgttgcccgcgcttccgtggtaaaagacatgatgctgggcaaggatgataaagcatgggctatgtatgtggacaacaacaggtcatggttcatgcactgtaactctcacaccaatagaactgagggaggggtgtgtaagggggccactgtgggcgttctcctggacctgaacaagcatactctaactttctttatcaacggccaacaacaaggaccaacagcattcagccacgttgacggcgtatttatgccagcactctctctgaaccggaacgtgcaggtgaccctgcatacaggactggaggttcctaccaacttaggcaggccaaaactatccggcaattag

SEQ ID NO: 26062 - DNA, 1479 bp, Artificial Sequence
  Description of Artificial Sequence: Synthetic coding sequence
atggacttcctgctgggcaaccccttcagcagccccgtgggccagcggatcgagaaagccacggacgggtctttacaatccgaagactgggcactcaacatggaaatttgtgacatcatcaacgaaactgaggaggggcctaaagatgctctcagggccgttaagaaaaggatcgtgggaaataaaaactttcacgaagttatgctggccctgactgtgctggagacctgcgtgaagaattgtggacacagattccatgtgctcgtggccagccaagacttcgtggaaagcgtcttggtacgcacaattttacccaagaataatcctcccactatagttcatgacaaggtcctcaaccttatccagtcttgggccgatgcctttaggagcagcccagacttaaccggagttgtgaccatatacgaagacctgagacggaaaggtctagagttcccgatgactgatctagacatgctgtcccctattcacacccctcagcgaacagtgttcaactccgaaacacaatccggccaggattctgtgggtaccgactcgtcccagcaagaggattcgggacagcacgcggcccctctgcctgctcctccaatactctccggagacacgcctatcgcaccgaccccggaacagatcggtaagcttaggagcgagctcgagatggtttccggcaacgtccgcgtgatgtccgagatgttaactgaactggttccgacgcaggccgagccggcagatctcgaactgttgcaggagttgaacaggacttgcagagctatgcagcagcgcgttctcgagctaattccacagatcgccaatgaacagctgacagaggaacttctgatcgtgaacgacaacctcaataacgtctttctccgccacgaaaggtttgagcgatttaggactggtcagacaacaaaggccccctccgaggctgagccggctgcggacctcattgacatgggacctgacccagctgccaccggcaacttgtctagccagctggccggcatgaatcttggctcaagcagcgttcgagcaggtctccagagcctggaagcttccggccggctggaggacgaatttgatatgttcgccttaactcgcggaagctccttagccgaccagagaaaggaagtgaagtacgaagccccacaagcgaccgatggcctcgctggagccctggacgccaggcagcagtcgaccggcgctataccggttacgcaggcttgtctcatggaggacattgagcaatggctttctacagacgtcggcaatgatgccgaggagccaaagggtgtgacatctgaagaattcgataagttcctggaggagcgggcaaaggctgccgataggttgccaaatctgtccagtccctctgcagagggcccccctggtcctcccagcggaccggccccccgcaaaaagacacaggagaaagacgacgacatgctttttgctctctag

SEQ ID NO: 26063 - DNA, 747 bp, Artificial Sequence
  Description of Artificial Sequence: Synthetic coding sequence
atggccaccagcgcccccctgcggagcctggaggaggaggtgacctgtagtatatgcttagactacttacgcgatcccgttaccattgactgcgggcacgttttttgtcgctcctgtaccacagacgttaggcctatctcagggagcagacccgtgtgccccctgtgtaagaaaccctttaaaaaggaaaatattagaccagtttggcagctggcgagtttagtagagaatatagagcgtttaaaggtcgataaagggagacagcccggggaagtgacccgggaacaacaggatgcaaaactttgcgagcggcaccgagaaaagttgcattactattgcgaggatgacggtaagttactgtgtgttatgtgtcgcgagagtcgcgaacacagaccccacactgcagttcttatggaaaaagccgcacagccccaccgggagaagatcctgaatcacttgtcaactttgaggcgcgaccgagataagattcaagggtttcaggctaagggcgaagccgatatcctggcagccttaaagaagctgcaagaccagagacagtatatcgtggcagaatttgaacagggacaccagttcttgcgtgagcgcgaggaacacctccttgaacagcttgccaagctggagcaagaactgacagagggccgggagaagtttaaatctaggggagtcggcgagctcgcacgacttgcccttgtgattagcgagctggaggggaaggctcagcaatag

SEQ ID NO: 26064 - DNA, 21 bp, Artificial Sequence
  Description of Artificial Sequence: Synthetic coding sequence
atgagccggcggcggttctag

SEQ ID NO: 26065 - DNA, 165 bp, Artificial Sequence
  Description of Artificial Sequence: Synthetic coding sequence
atgagcgagcagggcgacctgaaccaggccatcgccgaggagggcggtaccgagcaggagactgctacaccggagaacggcattgtgaagtctgaatcgttagatgaggaagagaagctcgagcttcagagacgccttgaagcacagaaccaggagcgccgctag

SEQ ID NO: 26066 - DNA, 1446 bp, Artificial Sequence
  Description of Artificial Sequence: Synthetic coding sequence
atggccagcgccgccagcgtgaccagcctggccgacgaggtgaactgtcccatctgccaggggaccctgcgcgagcctgtgaccatcgactgtggtcacaacttctgtagagcctgcctgacaagatactgcgagatccccggacccgatctagaggaatccccaacttgccctctctgtaaggagccattcagacctggaagtttcagaccaaactggcagttagccaatgtcgttgagaacatcgaacgcctccagttagtgagcacccttggactgggagaggaggacgtgtgtcaggaacacggcgagaagatttactttttttgcgaagatgacgagatgcagctgtgtgttgtgtgccgtgaagctggggagcatgcgacccacacgatgcgctttctggaggatgcagctgccccttaccgggagcagattcacaaatgtctcaagtgtctgaggaaggagcgagaggagatccaagaaatccagtcacgggaaaacaagaggatgcaagtgcttctaacccaggtgtccacgaagaggcagcaagtcatcagtgagtttgcccatctccgcaagttcctagaggagcagcagtcaatcctcctcgctcagttagaaagccaggatggagacattctgcgccagagagacgagtttgacctgctggtggcaggtgagatttgtagattcagcgcactgattgaggaactagaagagaagaacgaaaggcccgcccgggagctcctgaccgatatacggagtaccctgatccgttgtgagactaggaagtgtaggaagcccgtcgctgtttctcccgaactgggtcaacgaatcagggatttcccccagcaggcgctgcctcttcaacgagagatgaaaatgtttctcgaaaagctgtgctttgaacttgattatgagcctgctcatattagcttggacccccagacgtcccacccgaagctcctcttgtctgaagaccatcagagagctcagtttagttataagtggcagaatagtcccgacaacccccagcggtttgaccgcgctacatgtgtgctggcccatactgggatcaccgggggtcgtcatacatgggtcgttagcattgacctagcccacggcggctcttgcactgtgggagtcgtgagcgaggatgtgcaacggaaaggagagctgcgactccggcctgaggagggggtttgggcagtgagacttgcatgggggtttgtgtccgccctgggcagcttccctactcggctgaccttgaaggagcagcccaggcaggtgcgggtctccctagactatgaagtggggtgggtcacctttaccaacgctgtgactagggaacctatctataccttcaccgcatctttcacccgcaaggttatccctttttttggcctttggggccgcggcagctcttttagcctgtcctcatag

SEQ ID NO: 26067 - DNA, 312 bp, Artificial Sequence
  Description of Artificial Sequence: Synthetic coding sequence
atgggccagcagagcagcgtgcggcggctgaagcggagcgtgccctgcgaatctaatgaggccaacgaggcgaacgaggccaataagacaatgccggagaccccaactggggacagcgacccacagcccgcacctaagaagatgaagacgtcggaaagcagcacgattcttgtggtgaggtatcgccgtaatgttaaacgcactagccccgaagaactcgtgaatgaccatgcgagggagaaccgcataaatcccgaccagatggaggaagaagagtttatcgaaattacaaccgaacggcctaagaaatag

SEQ ID NO: 26068 - DNA, 2919 bp, Artificial Sequence
  Description of Artificial Sequence: Synthetic coding sequence
atggagcggatgaactggctgagccggctggccagccggggccccggtcatcggatcccgcagggtgccaatcttcaaaccccggtgatggccgatcctgagacctgcctgatggttttcaaaaatcactggtctcaagtcgtgcgtatcctcgagcgtcagggacccagggcagcccccggcggggcagacgatcttagcgccgtcagaaatcatacataccagatgctgacactgctcgccgaagatcgagccgttccatctgcacccacaggacctggcccgctcttagaattcgctttacatgaggatctcctcacaagagtcttgacttggcaactgcaatgggatgagctgggagacggcgttgaggaacggcgggccgaacagctcaagttatttgagatgcttgtgtccgaggcccgacagcccctcctgcgccacggcccagtgcgggaggcactgttgacactgttggatgcatgtggtagaccggttccctcctcccccgccctcgacgagggacttgtgctgctgctcagtcagctctgcgtgtgcgtggcccaagagccttctctgctggaatttttcttgcagcccccacctgagcccggtgctgcacctagactcctacttttcagcagattggttccctttgtgcacagagaaggtaccttgggccagcaggcccgggacgcactactcttactgatggccctcagcgccgggagtcccaccgtcgggcgctacatcgcagaccatagctacttctgtcctgttttagccaccggcctgagtgctctgtacagcagcctgcccaggaaaatagaagttccgggggacgactggcattgccttaggcgcgaagactggttgggtgtgcctgccctggcgctgttcatgtcatcccttgagttttgtaacgcagtaatacaagtggcgcatcccctcgttcaaaagcaactcgtggattatattcacaacggattcctggtgccagtgatggggccggcgctgcacaagaccagcgtggaggagatgattgcatctaccgcttacctagagctgttcctgaggtctataagcgagccagctctgctgcggaccttcctgagatttttactgttacaccggcatgatacacatactattctggatacactggtggcacgcattggttctaacagccgactgtgcatggtgtcactttccctctttagaactctgctgaatctgtcttgtgaggacgttttgcttcaactggtactgcgatatctggtaccctgcaatcacgtgatgctcagccaaaagcctgctgtgcgggacgtggatctgtatggaagagccgccgataaatttctcagtcttattcctcggtgctgtcggcaccatgcgccttctcccccgaggcctgagcacgcatcctgggcgcggggtccaggctcaccttcagtcgactcgtcaagcgttacaacagtgccacgtcctagtaccccatccagattggcattgtttctccgtcaacagagcctgggaggatccgagtcaccaggacctgccccctgtagccccggcttaagcgcctcaccagccagcagtcctggcagaagaccaacgccagccgaagaacccggagaactcgaggacaactatttggagtacttacgagaagcccgcaggggtgtagacaggtgcgtgagggcctgcaggacctggtcagcaccatatgacggagagagaccctcccctgaaccttcccctttcggaagccgaacgaagaagcggagcctactaccagaggaggatcggaacaatgtcggggagggggaggaagaggaactgggaagacgcgggcgcgctggaggggcgggtgaggggccaggccacctgccccccccccaattgaatggcgtgccaggcagctggcctgaaggggcaaagaaagtgcgactagttccaaaggaaggggccggagaacttttagaaggtatctcagaaggtatggccggcctcgaaggatttggacaggaactcagagaactggaggtagcactcagcaatgggggaactggttccgaaagcccgcttgagcctccgttaccactagaagaggaggaggcgtatgaatcttttacctgtccacccgagccaccaggcccttttttaagtagcccactgagaacacttaaccagctgcctagccaacccttcactggacccttcatggccgtcctattcgccaagctggagaacatgctacaaaatagcgtttatgtgaatttcctgctgaccgggttggtcgctcagcttgcttgccacccccaaccacttctaaggtctttcctgcttaacaccaacatggtgttccagccatctgttaagagcctgttgcaggtcctgggatctgttaaaaacaagattgagaattttgccgccagccaggaggattttcctgccctgctttccaaagccaagaagtacttgattgcgaggggtaaattggattgggcagaaggccccgccgctgggcctgcccctcgcaggtctgaccccctggtcaagtcacggagaccatctttaggcgaactactgctgcggcacgcccattcgcccacgcgcgcgaggcaagccgcccagctggttctgcagcctggtagagacggtgccggtcttggcttgagcggcggctcccctggggcaagcacacccgttctgctgacccggggcggggctccagagcgtcagggggaggccctgagagtgaaaaacgccgtttactgtgcggtcatttttcctgaattccttaaggaactcgcagctatatcacaggctcacgccgtgacctcaccattcctgctcgagactagtgaggagggatctggcccattgatttccggatgcggacctctgaacccttag

SEQ ID NO: 26069 - DNA, 1929 bp, Artificial Sequence
  Description of Artificial Sequence: Synthetic coding sequence
atgaagatcttctgcagccgggccaaccccaccaccggcagcgtggaatggcttgaagaggatgagcactacgattaccatcaggagatcgctcgtagcagctacgccgatatgctgcacgataaagatcgggtgttcaagccaatggctgatgcagccgtgaagatcgtcgagaaaaacggcttcagcgataaaatcaaagtgatcaataagcactccacagaagttaccgtgggacctgagggagacatgccctgccgggctaacattttagtgaccgaactgtttgatactgagctgattggggagggggccctgccttcctacgaacacgcccacaggcacctagtggaggagaactgcgaggctgtaccacatcgggcaaccgtgtacgcccagctggtggagtccggaagaatgtggtcctggaacaagttatttcccattcatgtccaaacaagcctgggggaacaggtaatagtgccacccgtggatgtagagagctgcccaggagcccccagtgtgtgcgatatccagctcaatcaggtcagccccgccgactttactgtgctgtccgatgtgctccctatgttttcgatagacttttcgaagcaggtctcttcaagtgctgcgtgtcactcgagacggtttgagcccctgacctcagggcgggcccaagttgtgctctcgtggtgggatattgagatggaccccgaggggaagataaagtgtacgatggccccattctgggcccacagcgaccccgaggagatgcagtggagagatcattggatgcagtgcgtgtatttcttgccccaggaagagccagtggtgcaggggagcgccctgtatctagtcgcacatcacgacgactattgcgtttggtactccttgcagaggacttctcccgaaaagaatgagcgtgttagacagatgcgccctgtatgcgactgtcaggcgcacctcctgtggaaccgtccccgcttcggtgaaataaatgaccaggataggaccgatcgctacgtgcaggcactccgcacagttcttaaaccggactcagtttgtttgtgtgtctctgacggctccttgctttccgtgctggcccatcacctgggcgtggagcaagtgtttaccgtcgaaagcagcgcagcaagccacaaactgttgaggaagatttttaaagcaaatcacttagaagacaagatcaatattatcgaaaaacgccccgaattgctcacgaatgaggatcttcaggggcgcaaggtttcactgctcctgggcgaacctttctttacaacttctctgctgccctggcataatctgtatttttggtatgtgcggacagcggtggatcaacatctggggcccggtgccatggtgatgcctcaggccgcttccttacacgccgtggtcgtggaatttagagatctctggaggattcggtctccctgtggggactgtgaaggctttgatgtgcatatcatggatgacatgatcaagagggcactggacttcagggaaagcagagaggcggaaccccaccccctgtgggagtacccatgccggagcttatccgaaccatggcagatcttgacttttgattttcaacagcctgtgcccctccagcccctctgtgcggagggcaccgtggaactccggcggcctggccaatcgcacgctgccgtgctgtggatggaataccatctcacacctgaatgcacattatctactggactcctcgagcctgctgacccggagggcgggtgttgttggaacccccattgcaagcaagctgtgtacttctttagccccgccccagacccacgtgctttactgggaggtcccagaaccgtctcttacgctgtggagttccacccagatactggggacattattatggaatttcgccatgccgacactccagactag

SEQ ID NO: 26070 - DNA, 1935 bp, Artificial Sequence
  Description of Artificial Sequence: Synthetic coding sequence
atgagcgtgaccctgaccagcgtgaagcgggtgcagagcagccccaacctgctggctgcaggcagggactcacaatcccctgactctgcgtggagatcatataatgatggcaatcaggagacactcaacggggatgctacgtactcctcacttgcagcaaaaggattcaggagcgtccggccaaacctgcaagataagcggtctccaactcaatcccagataacagtaaacggcaactcaggcggcgccgtgagtccgatgagctattaccagaggccctttagcccctcggcatattcacttcctgctagcttgaactcttctatcgtaatgcagcacggaacaagcctggacagcactgacacttacccgcagcatgcccagagcctggatggcacaaccagtagctccatccccctgtaccgcagctctgaggaagaaaaaagggtgaccgtcataaaagcgccccattatccaggcatcgggcccgtggatgagtcgggtatccccaccgccatcaggactacagtggatagaccgaaggattggtacaagaccatgttcaagcagatccatatggttcacaaacccggcctgtataacccaccttactctgcccagtcccaccctgcagctaaaacccaaacatacaggcctctgagtaaatctcatagcgataatagccccaacgcctttaaagacgctagcagtcccgtgcctcctccccacgtcccccctccggtgccccctctacgccctcgggataggtcgagcactgagaaacacgactgggacccccccgatagaaaagtcgacacccgcaagtttagatctgaacctagaagtatatttgaatacgagccaggtaagtcctcaatactacagcatgaaagaccagccagcttataccaaagctcaatcgaccgctccttggagagaccaatgagctcagcaagtatggcatccgacttccgcaagagacgaaagtcagagcctgccgtgggccctcccaggggcctgggcgaccaaagtgccagcagaaccagtcccggaagagtggatcttcccgggagtagcactaccctgaccaaatcttttaccagttcctctccgagctcaccctcacgagccaaagaccgagaatctcccagatcatactcaagtacgctgaccgacatgggccggagtgcacccagagagaggcggggcaccccagaaaaggaaaaactgcccgccaaagccgtgtacgattttaaggctcaaacctcaaaagaactatcctttaaaaaaggagacacggtctacattctgcgtaaaatcgaccagaattggtacgagggtgaacatcacgggagggtggggatctttccaatctcatatgtagaaaagctgactccgccagagaaggcccagccagctcgcccaccgccccctgctcagcccggagaaattggcgaggctattgcgaaatacaatttcaatgcggacacgaatgtggaactctctctacggaaaggggatagggtcatactgttaaagcgcgtggaccagaattggtacgagggcaaaatcccaggaaccaacagacaaggcattttccccgtatcatacgtcgaggtggtaaagaagaatacaaagggagctgaggactatcctgaccctcccatcccacatagctattcatctgataggattcacagtctgtccagcaacaaaccacagaggcccgtgttcacccatgagaatattcaaggcgggggagaaccctttcaagccctgtataactatacgccccgcaacgaggacgaactggagctgagggagtcagacgtgattgacgtcatggagaaatgcgacgatggttggttcgtggggacatctagacgaacgaagttttttggtacctttccaggtaactacgtgaagcgcctgtag

SEQ ID NO: 26071 - DNA, 294 bp, Artificial Sequence
  Description of Artificial Sequence: Synthetic coding sequence
atgggcaagagctgcaaggtggtggtgtgcggccaggccagcgtgggtaaaactagcatcctggaacagctcctgtatggcaaccatgtcgtcggctctgagatgatcgaaacacaggaagatatttacgttggcagtattgagacagatagaggcgtcagagaacagatagcagagtctctcttcagcgtctggtcttgttcccgtagaaggctaactaacccccgcacccggagaaggtctccgtcctggtcactcgccaccagcgtgacatacagaagcagcggagtttag

SEQ ID NO: 26072 - DNA, 915 bp, Artificial Sequence
  Description of Artificial Sequence: Synthetic coding sequence
atgagcaagacccacgaccaccagctggagagcagcctgagccccgtcgaggtgttcgcaaaaacctctgcctcccttgagatgaatcagggcgtctccgaggagcgaattcacctaggaagctcgcccaaaaaaggcggaaactgtgacctgtcacatcaggagagactgcagagcaaatcattgcacttgtccccccaagagcaatccgcgtcctaccaggacagacggcaaagctggcggagagcatcaatgaaggaaaccaaccggcgaaaatcactgcaccctatccaccagggaatcacagaactgtcaaggtccatatcagttgatctggcagagagcaagcggctcggatgcctcctactgtcctcttttcagttctcaattcagaaattggagccattcctgcgcgatacaaaggggttcagcctggaaagcttccgagctaaggcctcgagcctctcagaagaactgaaacactttgccgacggccttgagacagacggaactcttcagaaatgcttcgaagatagcaacggcaaagcaagcgatttctcactcgaggcctcagtggccgagatgaaggagtacattaccaagttctcgttagagcgccaaacctgggatcagctgttattacactaccaacaggaggctaaagagatcctgagtaggggctccacagaggccaagatcacggaggttaaagttgagccaatgacttacctgggatcctcacaaaacgaagtcctcaacacaaagccagattaccagaaaattctccaaaatcagagcaaagttttcgactgtatggaactggtgatggacgaacttcagggatccgtcaaacagctccaggcattcatggacgagtccacacagtgctttcagaaagtttcggtgcagctgtag

SEQ ID NO: 26073 - DNA, 1842 bp, Artificial Sequence
  Description of Artificial Sequence: Synthetic coding sequence
atggccaccatccccgactggaagctgcagctgctggcccggcggagacaagaagaggcatccgtgagaggacgggagaaagcggagcgtgagcggctgtcgcaaatgcctgcatggaagcgaggtctcctcgagcgccggcgagcgaagctcgggctttcccctggtgagcccagccccgttctcggcactgttgaagcaggcccccctgatcctgatgaatccgctgttttactagaggcaatcggacctgtgcatcaaaatagatttataaggcaggagcgacagcagcaacagcagcagcagcagagaagcgaggagctgctggcagaacgaaagccgggccccctggaagcacgggaacggagaccctcaccaggtgagatgcgcgaccagagcccaaaaggaagagagagccgcgaggagagactcagtcctcgggaaacgcgagagcggagactcggcataggaggagctcaagaattgagtttacgccccctcgaagcccgggattggcgacaaagtcccggagaggtcggagacagatcgagcaggctaagtgaagcctggaagtggcggctgtctcctggggaaacacccgaacgcagccttcgactagcagagagccgcgagcagagccctcggcgcaaggaagtggaatccagattatcccctggggagagtgcgtaccaaaagcttggtttaacagaggcccacaagtggagacccgactctagggaaagtcaggagcagtcgctagttcagctggaggcaacagaatggaggctgcgttccggagaggagcgccaggattattcagaggaatgtggccgcaaggaggagtggcctgtgcctggagtcgctcccaaggaaactgctgaactgtctgagactttgacccgagaggcgcaaggaaattcaagtgctggagtggaggccgccgaacaacgccccgttgaggacggcgaaagaggcatgaagcctacggagggatggaagtggactctcaattcaggcaaggcccgcgagtggacaccccgcgacatcgaggctcaaacacaaaagcccgaaccgccagaatcggcagagaaactcttggagtctccgggagtagaagccggagaaggagaagctgaaaaggaggaagccggcgcccagggaagacccttaagggcgctgcagaattgctgtagcgttccctctccgctaccccctgaagacgctgggactggtggactgaggcagcaggaagaggaggccgttgaacttcagccaccccctcctgctcccttgtctccaccaccaccagcccccaccgcaccgcagcctcctggcgacccactgatgtcacgactgttttatggtgtcaaggctggtcccggtgttggtgcacccaggcgctcgggccacaccttcactgtcaatcctaggcgttctgtgcctccagccactcctgcaacccccacatcccctgcaaccgtggacgccgcagtcccaggtgcaggcaagaaacgctatccaacagccgaggaaatattagtgctgggagggtaccttaggctgagcaggtcttgcctggcaaaaggctctccggaacgacaccacaagcaactcaagatatcatttagtgaaaccgctctcgagacgacttatcaataccccagtgaatcttctgtgctagaggagcttgggccggagcccgaagtgccttctgcacctaaccctccggcagctcagcccgacgatgaagaggacgaggaagagctgctgctcctgcagcccgagttacaggggggtctgcgcacaaaagctctgatcgtggacgaatcttgcaggagatag

SEQ ID NO: 26074 - DNA, 1560 bp, Artificial Sequence
  Description of Artificial Sequence: Synthetic coding sequence
atggagggcgtgctgtacaagtggaccaactacctgagcggctggcagcctcggtggtttctgttatgtggcggtatcttgagctattatgacagccctgaggatgcctggaagggctgtaagggttccatccagatggctgtgtgtgagatccaagtccactccgtggataatacacgaatggatctgattattcctggagagcagtacttctacctgaaagcaaggagcgtggcggagcgtcaacggtggcttgtggccttaggaagcgcgaaggcgtgtctcacggactcccggactcagaaggagaaagagtttgccgagaacaccgagaatctgaaaacaaagatgtccgaactgcgactgtactgcgacttactggtccagcaggtggataagaccaaggaggtgacgaccacaggtgttagcaattcggaggagggcattgacgtaggcaccttattgaagagtacatgcaataccttcctcaaaactttggaagagtgcatgcagatagccaacgccgccttcacttccgaactcctctaccgaacaccacccggtagcccccagcttgcaatgctgaaaagttctaaaatgaagcaccctattattcctatccacaacagcctggaacgccagatggagctgtccacctgcgaaaatggttccctgaacatggaaattaacggagaagaagagattttaatgaagaacaagaacagcctttatctgaagagcgctgagattgactgctccatctcaagcgaagagaacacagatgataatatcacagttcagggagagattcgaaaggaggacggcatggagaacctgaagaatcacgacaacaacctaactcagagtggctctgacagcagttgctctccggagtgtctctgggaagagggtaaggaggtgataccgacattcttcagcaccatgaacacaagcttttcagacatcgaacttttggaagacagtgggatccctaccgaggcattcctcgccagctgctacgccgtagttcccgtcctcgataaactgggaccaaccgtgtttgcccccgtgaagatggacctggtgggcaatattaagaaggttaaccagaagtacatcactaataaggaggaatttaccacgctgcaaaaaattgttctgcacgaagtggaagctgacgttgcccaggtacggaattccgctaccgaagcgttgctttggctgaaacgtggacttaaatttctgaaaggattcttaacagaagttaagaacggggagaaggacatccagactgccttaaacaatgcatacggaaaaaccctgaggcagcatcatggctgggtggtgaggggcgtattcgccctggccctacgggctgctcctagctacgaggactttgtggctgctctaaccgtgaaggaaggggatcaccagaaggaggctttctccatcggcatgcagagagacctctcattgtatctgcccgcaatggagaagcagttggccatcctggacaccctctatgaagttcatggactggagtctgatgaagtcgtctag

SEQ ID NO: 26075 - DNA, 1446 bp, Artificial Sequence
  Description of Artificial Sequence: Synthetic coding sequence
atggccagcgccgccagcgtgaccagcctggccgacgaggtgaactgcccaatttgccaaggcaccttgagggaacctgtgactatcgattgcggacacaacttttgtcgggcatgcctgacacgatattgtgaaatccccggaccagacctggaagagtccccaacctgcccattgtgcaaggagccattcagacctggatctttccgccccaactggcaactcgctaacgtcgtcgagaatattgagcgcctccaactagtgtctactctaggtctgggcgaagaagatgtttgtcaggagcatggagaaaagatttatttcttctgcgaggatgacgagatgcaactgtgtgtggtttgcagggaggcaggcgaacatgccacacataccatgaggttccttgaagatgccgctgccccatatagggaacagatccataaatgcctgaagtgcctacggaaggagcgagaagagatccaggagatccagtccagagagaataaaaggatgcaggtacttttgacacaggtctcgacaaaacgccagcaggtgatcagtgagtttgcacatctccgaaaattcctggaggagcagcaatccatcttgctagcccagctggagagccaagacggggacattcttagacagcgcgacgaattcgacctgttggtcgccggcgaaatctgcaggttttcagcacttattgaagaactcgaggaaaaaaatgagaggcccgcccgcgaactgcttactgacatcagatctaccctaatcagatgtgagaccaggaaatgtagaaaaccagtggccgtgagcccggagttgggacagcgcatccgggacttcccacagcaggccctgcccctgcaacgcgaaatgaagatgttcctcgaaaaactgtgctttgaactggactacgaaccagctcatatctcactggacccacagacaagtcatcctaaactgctgttgagcgaggaccatcagagagcacagttctcttataaatggcaaaatagtcctgacaacccacagagatttgaccgggccacatgcgtgctcgcacacacgggtatcactggcggtcggcatacctgggtggtgagtattgacttggctcatggcgggtcctgcaccgtgggcgttgtatcggaggatgtgcagcggaaaggtgagctccggctgaggccggaagaaggagtgtgggccgtgcgcctagcttgggggttcgtgtccgcacttggcagctttcccacgaggctaacactaaaagaacaaccgaggcaggtgcgcgtgagcctcgactatgaagtgggatgggttaccttcaccaacgctgtcacacgggaaccaatctataccttcactgcaagcttcacgcgaaaggtgatccctttctttggtctctggggtagagggagctcattttcactgtcaagctag

SEQ ID NO: 26076 - DNA, 1173 bp, Artificial Sequence
  Description of Artificial Sequence: Synthetic coding sequence
atgagcgccgccaaccccgagacccccaacagcaccatcagccgggaagcaagcacccaaagctccagcgcagctgctagccaggggtgggtgctgccggagggtaagatcgtccctaatacagtattcgtcggcggtattgacgctcgtatggatgaaaccgagataggttcctgcttcggaagatatggcagtgtgaaggaggtgaaaattatcacaaacaggactggtgtgtccaagggctacggctttgtgtctttcgtcaatgacgtcgacgttcagaaaatagttgggtctcagattcatttccatgggaaaaaactcaagctgggacccgccattaggaagcagaagctttgcgctaggcacgtgcagcctcggccactggtcgtgaatccccctccacccccacaatttcagaatgtgtggaggaatcctaacaccgaaacttatctgcagccccagattacgcctaacccagttacccagcacgtgcaagcatactcggcctacccgcactctcctggccaggtgatcaccggctgtcaattgctggtctataactatcaggagtaccccacttaccccgatagcgcctttcaagtgaccacgggttaccagctgcctgtgtacaactaccagccctttcccgcctaccccagatctcctttccaggttacggctggctaccagctgccggtgtacaactaccaggcctttcccgcttatcctaactccccatttcaggtcgctaccggttatcagttccctgtgtataattaccagcccttcccggcctacccctcatctcccttccaggtgactgctggttatcagctgcccgtctacaattatcaggcatttcccgcctaccccaactccccctttcaggtggctacaggttaccagtttcctgtctataattaccaggccttcccagcgtaccccaactcccccgtgcaagtgacaacaggctaccagctgccagtttacaattatcaagcttttcccgcataccctaatagcgcagtacaggtaaccacgggataccagtttcacgtgtacaactaccaaatgcctcctcagtgtcctgtgggcgagcagagacgaaatctctggacagaggcctataaatggtggtatctggtctgcctgatacagcgtagagattag

SEQ ID NO: 26077 - DNA, 1143 bp, Artificial Sequence
  Description of Artificial Sequence: Synthetic coding sequence
atggagaagaagaagatggtgacccagggcaaccaggagcccaccacgacccccgatgcaatggtgcagccttttaccaccattccattcccccctcccccccagaacgggattcccaccgaatacggagtgccacatacccaggattatgccgggcagactggagagcataacctgaccctgtacggatctacacaggcccacggggagcagagcagcaattcacccagtacacagaacggatccttaaccaccgaaggaggtgcccagactgacggtcaacaatctcaaactcagtcgtccgaaaactctgaaagtaaatctacaccaaagcgtttacacgtcagcaacattccgtttcggttcagggaccctgaccttcgtcaaatgtttggtcagtttggcaagatcctagatgtggagatcatctttaacgaaagagggtctaagggctttgggtttgtgacatttgaaaactctgccgatgccgatagggctcgcgaaaagctgcacggaaccgtggtggaagggagaaagattgaggtgaataatgcaactgctcgagtgatgacgaacaagaaaatggtgacgccctatgcaaacggatggaaactatcgcccgtggtaggagcagtgtatggccctgagctgtacgccgccagtagcttccaggctgacgtctctctcggaaacgatgccgctgtgcctctgagtgggagaggcggtattaatacatacatccctctcatcagtctacccctggtccctgggttcccataccctacagctgcaacgacagccgcggcttttagaggagcccatctgcgtggtcggggtaggacagtctacggtgctgtgagggccgtcccacccactgctatacctgcgtatcctggggtggtctatcaagacggcttctacggagctgacctctatgggggatatgctgcataccgatatgcacaacctgcaactgccaccgccgccactgcggcagccgcagcagcggctgcctactccgacgggtacggtagagtgtatactgctgatccctaccatgcacttgcaccggctgcctcctatggcgttggcgccgtggcgagcctgtataggggagggtactcccggtttgctccatattag

SEQ ID NO: 26078 - DNA, 1614 bp, Artificial Sequence
  Description of Artificial Sequence: Synthetic coding sequence
atggaccccggcgacgccgccatcctggagagcagcctgcggatcctttaccgactctttgaatccgtattgcctcctctccccgctgccctgcagagcaggatgaacgtgatcgaccatgtcagggacatggccgcagccggccttcatagcaacgtccggctgctatcaagtctgctgctcaccatgtctaataacaatcccgagctgttttctccccctcagaagtaccagctactggtgtatcacgccgattccctgttccacgataaggagtaccggaacgccgtttctaaatataccatggcgttacaacagaagaaggctctcagcaaaacctcaaaagtacgtccaagcacaggcaatagcgccagtacgccacagtcccagtgcctgccatccgagatcgaggttaagtacaagatggcagaatgctacacgatgctgaagcaggataaggacgctatagcaatcctggacggcataccatctcgtcagagaacccccaaaatcaatatgatgcttgcaaatctgtacaagaaggccggccaggagaggccttccgttactagctacaaagaggtcctgcgccagtgccctctggcgttagacgcaatcttggggctgctctcactgagcgtcaaaggcgcggaggtggccagcatgacaatgaacgtgattcagactgtcccaaatctggattggctgtctgtgtggattaaggcatacgcttttgtgcatacaggggacaacagcagggccatttccacgatttgtagtttggaaaagaagtcactgctgcgcgacaacgtagacctcttgggttctttggctgatctttattttcgagctggggataataaaaattcagtgctgaagttcgaacaggcccagatgctagacccatatctgatcaaagggatggatgtgtatgggtacctactagcgcgggaagggcggttagaggacgttgagaatttaggttgccgactttttaatatctctgatcagcacgccgagccctgggtagttagcggctgccattcattttattcaaagcggtacagtagagctctttacttaggcgctaaggcaattcagttgaactctaatagcgttcaggctttattactcaaaggagccgctttgagaaatatggggcgggtacaagaggctatcattcattttcgggaggctattcgattggccccctgtcggcttgactgctatgaaggtctcatagagtgctatctagcttcaaatagtattagggaagctatggttatggccaataatgtgtacaaaactttaggagctaacgcccagaccctgaccctgctcgcgacagtgtgcctcgaagatccagtgacccaggagaaggctaaaacactactggataaggctctgacacaacggccggactacattaaagccgtcgtgaaaaaggcggagctattaagtagggagcaaaagtatgaagatggaatcgcactgctgcgtaacgctctggccaaccagagtgattgtgtgctgcatagaatcctcggggactttcttgtggctgtcaacgaataccaggaggctatggatcagtatagcatcgccctgaggtag

SEQ ID NO: 26079 - DNA, 351 bp, Artificial Sequence
  Description of Artificial Sequence: Synthetic coding sequence
atggccttcatgacccggaagctgtgggacctggagcagcaggtgaaggcccaaactgacgagatcctttctaaggatcagaaaatagcagctttggaggatctggtccagaccctgagacctcatccagcagaagcaacacttcagagacaggaagagttggaaactatgtgtgtgcagctgcagaggcaagtccgcgagatggagagatttctgagcgactatggattgcagtgggtcggcgagcccatggaccaagaggacagtgagtccaagacagtcagtgagcacggcgaaagggactggatgactgccaaaaaattctggaagcccggtcgggccggtcggtag

SEQ ID NO: 26080 - DNA, 285 bp, Artificial Sequence
  Description of Artificial Sequence: Synthetic coding sequence
atgaccggcagccggaactggcgggccacccgggacatgtgccggtatcggcacaattatcctgatctggtcgagagagactgtaatggtgacactcctaatctctctttctatcggaacgaaatacggtttctgcccaacggatgctttatcgaggatattcttcagaattggacggataattatgacctcctagaggataaccatagctatatccagtggctattccctctgcgagagccaggtgtgaactggcatgcaaagcctttaacactgagggagtag

SEQ ID NO: 26081 - DNA, 1029 bp, Artificial Sequence
  Description of Artificial Sequence: Synthetic coding sequence
atgcggttctgggccccctggggcagccggacccccagcggccggtctctctggacagatccagttacctattacacagctctccatatcgctgtgctccgcaatcagcctgacatggtggagcttcttgtacaccacggagccgacgtaaacaggcgcgaccgcatccacgagtctagtcctctggatctggccagtgaagaacctgaaaggctgccatgtctccagagactattggatctcggcgccgacgtaaatgccgcagacaagcatgggaaaaccgcgttgctgcacgccctggccagttccgatggtgtgcagattcataacacagaaaacatccggctgctcctcgaaggaggtgccgacgtcaaagccaccacaaaagacggagatacagtgttcacttgtattatcttcttgctgggcgaaaccgtcggaggggacaaagaggaggcccagatgatcaacaggttctgtttccaagtgacccgcctactgctggcgcatggagctgacccctcagaatgtccagcccacgaatctttaacgcacatctgcctgaagagctttaaactacatttccccttgctgaggtttcttttggagagcggagctgcctacaattgctccctgcacggcgccagttgctggagcggctttcacattatttttgaacggctctgtagtcaccccggatgtactgaagatgaatcccatgcggatttacttcgaaaggcggaaaccgtgctagacctgatggtgactaattcccagaaactgcagctccctgaaaatttcgacattcaccctgtggggtctctggccgagaagattcaggctttacatttctctctgcgacaattggagagttacccgccaccgctcaagcatctatgtagagtggccataagactgtaccttcaaccctggcccgtagacgttaaggtgaaggctctgccactgcccgacaggcttaaatggtatcttcttagtgagcactcaggctccgtggaggatgacatatag

SEQ ID NO: 26082 - DNA, 3192 bp, Artificial Sequence
  Description of Artificial Sequence: Synthetic coding sequence
atgccccacctgcccctggccagcttccggccccccttctggggccttcgccactcccggggcctgccccggtttcactcagtctctactcagtccgaacctcacggatctcctatttccaggaggaatcgagaggctaagcagaaaagactgcgcgagaaacaggcaactctggaagcagaaatcgcaggagaatcaaaaagtcctgcagaatcaatcaaagcctggagaccaaaagagctcgtgttgtacgagatcccgacaaagcctggcgagaagaaggacgtttccgggccgttacctccagcctactcccctaggtacgtggaggctgcgtggtacccgtggtgggtgcgagaaggtttcttcaagcctgagtaccaggcccgccttccgcaggccaccggagagaccttctctatgtgcattccccctccaaacgtgacagggtccctgcatatcggccatgccctcacagtcgcgatacaggatgcgcttgtgcgttggcaccgaatgcgaggcgatcaggtgctgtgggtcccgggaagtgatcacgcaggcatcgcgacccaggccgtggtagagaaacagctctggaaggagagaggagtgcggagacacgagctgtcaagagaagcattcctgcgcgaggtgtggcagtggaaggaagccaagggtggggagatctgtgagcagctgcgggccttgggcgcctccctggactgggacagagagtgttttactatggatgtgggttcatcagtggcggtaactgaagcatttgtccggctgtataaagccggcctcctgtaccggaatcatcaactggtcaattggtcatgcgccttaagatcggctattagcgacatcgaggtcgaaaatcggcccctgccaggccatacccagctgcggctccctgggtgtcccaccccagtgagctttggactactcttttccgttgccttccccgtggacggcgagcccgacgccgaggttgtggtgggcactacccgccccgaaaccttgcccggcgacgtggccgtcgctgtgcaccctgatgattccaggtatacgcatttacacggtcgccagttgcgccacccactgatgggtcagcctctacctctcattaccgattacgcggtgcagcctcacgtgggtaccggcgctgtcaaagtgacccctgcgcactcacctgccgatgccgagatgggcgctagacatggactgagtcctctgaatgtgattgccgaggacggaaccatgacctccttatgcggcgattggctgcagggtctccaccgctttgtggcacgtgagaaaatcatgtctgtgctgagcgaacgagggctgtttcgtggtctgcagaaccatccaatggtcctgccaatttgctctcgatccggcgatgtgattgagtaccttctaaagaatcagtggtttgttagatgtcaggaaatgggcgcacgagccgctaaggccgttgaatctggagctctggaattgtccccatccttccaccagaagaactggcaacattggttcagtcacatcggcgactggtgcgtctctcggcagttgtggtggggccaccaaatccctgcatacctggtggtcgaggaccacgctcaaggcgaagaggactgctgggtggtgggcaggtctgaggctgaagctcgtgaagttgcagccgaactcactggccgccccggggcggaattgacacttgagagagacccggacgtcctggacacctggttctcttctgcactgtttcctttcagtgcgctgggttggcctcaggaaacgcctgacctagcacggttctacccattgagcctattggagaccggctccgatctgctgctcttttgggtggggcggatggtgatgctaggaacacagcttacaggccagctgcctttcagcaaagttctgctgcacccaatggtacgagacaggcaggggcgaaagatgagtaagagcttagggaacgtgcttgacccaagagatatcatcagcggggtcgaaatgcagttgctgcaggaaaagctgcggtctggcaatctagaccctgccgaactggcgatcgtggctgccgcacagaaaaaagatttccctcatggcatccctgagtgtgggacggatgctcttcggtttaccctctgtagccacggtgtccaggctggagatcttcatctatcagtgagcgaggtccagagctgccgccacttctgtaacaagatttggaacgcccttcgcttcatcctaaatgccctgggtgaaaaattcgtgccacagccagctgaggagctgagtcctagttccccaatggacgcatggatactctcccgcttggctctggccgcccaggagtgcgaaagaggcttcctgacaagggagttgagcttggtgacccatgctttgcaccacttctggcttcataatctgtgcgacgtctacctcgaggctgtgaaaccagtgttatggcactctcccaggcctctgggcccccctcaagtcctgttctcgtgcgctgacttgggccttcggctgctggctcctcttatgccttttttggctgaggaactctggcagcgactgccccctcgccccgggtgtcctccagccccaagcatctcagtggccccttacccgtctgcctgttccctggagcattggcgccaacctgagctcgaacggaggttttctagggttcaggaagtggtgcaggtgctaagagccctgcgcgcaacatatcagcttactaaggcgcgtccacgggtgctcttgcaatcatctgaaccgggcgatcaggggctcttcgaagcctttctggaaccattaggtacactcgggtactgcggcgccgtcgggcttctgccaccagggacggcggctccctcaggatgggcccaagcgcccctttcagatacagcccaagtctacatggaactgcaggggcttgtcgacccccaaatccagctgcctcttctagccgctaggcgatataagctccaaaaacagctggatagtctgacagctagaaccccctctgaaggtgaggcaggaactcaacgacagcagaaactgtcctctctgcaacttgaattgagcaagctggacaaggcggctagccatctgagacagttgatggatgaaccccccgcccccggatcccccgaactttag

SEQ ID NO: 26083 - DNA, 96 bp, Artificial Sequence
  Description of Artificial Sequence: Synthetic coding sequence
atgagcgacgaggtgttcagcaccaccctggcctacaccaagagccccaaagttactaagcgcactaccttccaggacgaactcatacgcgcgtag

SEQ ID NO: 26084 - DNA, 606 bp, Artificial Sequence
  Description of Artificial Sequence: Synthetic coding sequence
atgcccctgcagctgaagaacccccggctgcggcagaagagccggacgagatgcaataaatcccaaaaaaaagctgaactgctggataacgaaaaaccagctgccgtggtggcccctatcaccaccggatatacagtcaagatttcaaactacgggtgggatcagtccgataagttcgtgaaaatttatatcacactcaccggagtgcaccaggtgcctaccgagaatgtccaggtgcactttactgaaagatctttcgatctccttgttaagaaccttaacgggaaaagctactcaatgatcgtgaataacctgctaaaaccaatctccgtcgaagggagctccaagaaagtgaagacagataccgtgctcatcctctgccgcaagaaggtggagaatacaagatgggactatctcacccaagtggagaaggagtgtaaggagaaggagaaaccctcatacgacacagagactgatcccagcgaggggctgatgaatgtgctaaagaaaatatatgaagatggcgatgacgacatgaagcgcaccattaacaaagcctgggtggaatctcgcgagaagcaggcgaagggcgacacagagttttag

SEQ ID NO: 26085 - DNA, 480 bp, Artificial Sequence
  Description of Artificial Sequence: Synthetic coding sequence
atggccaccagcgcccccctgcggagcctggaggaggaggtgacctgctcaatttgcctcgattatctgcgggaccccgtgacaatcgattgcggacacgtgttctgccggtcttgcactactgacgtgagacctatatcaggctccagacccgtgtgtccattgtgtaagaagccattcaagaaggagaacattcgccccgtctggcaactcgaaaagattctgaatcacctttctacccttcgcagggatagagataagatccaaggttttcaggccaagggcgaggcagacatcctggcggccttaaagaaactgcaggatcagcgtcagtacatcgttgccgaattcgagcaggggcaccaatttcttcgggaaagggaagaacatctacttgagcagctcgctaaactggagcaggagctaaccgagggccgcgagaagttcaagagccgcggagtcggggaactggcccgctag

SEQ ID NO: 26086 - DNA, 4599 bp, Artificial Sequence
  Description of Artificial Sequence: Synthetic coding sequence
atgcagcgggagctggtgtacgcccggggcgacggccccggcgcccctagaccaggctctacagctcatcccccccatgccatccccaacagtcctccatctaccccagtgcctcacagcatgcctccaagccccagcagaataccctatggtggaacacgtagtatggtggtgcctggtaacgctacaattccacgggatcggatttcaagcttgccagtgagccggcctatatccccttccccttccgcgatcctggagcgccgggatgtcaagcccgatgaggacatgagtggcaaaaacatcgcgatgtatcggaacgaaggcttctatgccgacccttatctgtaccacgagggaaggatgtctatagccagctcccatggtggccacccgctggacgtacctgaccacatcatcgcttaccatcggacagcaattagatccgcctctgcatactgcaacccatccatgcaggccgagatgcatatggagcagtcattgtaccggcaaaagtccaggaagtaccctgacagccacttacccacccttggctccaagacccctcctgcaagccctcacagagtctctgatctcagaatgatcgacatgcatgcccattacaatgctcatggacccccccacaccatgcagccagatagggcttcaccttcccgacaggccttcaagaaagagcctggcacccttgtctacatcgagaagcctcggagtgccgcaggactgtcctccctggtggacttggggccgccactaatggagaagcaagtgtttgcttattccacagcaactatccctaaggaccgcgagactagtgaaaaaatgatgaagaccacagcgaatcggaaccatacagacagtgctggcactccacatgtatcaggaggcaagatgctatcggcgcttgagtcaaccgtgccaccatctcagccaccccctgttgggacttccgccatccatatgtcacttctggaaatgagacgcagcgttgctgagctgcgcttacaactccagcagatgaggcagctgcagctacagaaccaggagctgcttagagcaatgatgaagaaggctgaactggagatttccggaaaagtcatggagaccatgaaacgccttgaagaccccgttcagcggcagcgtgtgctggtagaacaagagagacaaaagtacctgcacgaagaagagaagattgtcaagaagttatgcgagctggaggattttgtggaggacctgaagaaggattccacagcggcttctcgcctggtcactttgaaggacgtggaggacggagcgttccttcttaggcaggtgggcgaagccgtcgcgaccctcaaaggcgagttccctacactgcaaaacaagatgagagccatccttcgaatcgaggtcgaggccgtgaggtttctgaaagaagagccccacaagctggacagcctcctgaagcgggtgagatcaatgaccgatgttctcacgatgttgcgtagacacgtcacagatggactgctgaagggaaccgatgccgcccaagcggcccaatacatggctatggagaaggccaccgcagctgaagtgctaaagtcccaggaagaggcagcccatacatctggtcagccgttccactctaccggcgcgccgggggatgcaaagagtgaggtcgtacctctcagcggtatgatggttcggcacgcccaaagctctcccgttgtgatacagccttcccagcattctgtggccctcctgaatcctgcccaaaaccttccccacgtggcctcaagccctgctgtccctcaagaagcgacttcaacattacagatgagccaagcaccgcagtccccgcagattcccatgaatggctccgccatgcagtccttattcatcgaggaaattcactcagtgtccgctaaaaatagggccgtgtcaatcgagaaggccgagaaaaagtgggaggaaaaacgacagaatctcgaccactacaatggaaaggagtttgaaaaacttctggaggaagcccaggcaaatatcatgaagagcatccccaatctggaaatgccccctgcaacagggcctcttccccgaggagacgctcccgtcgacaaggtcgagctgtccgaggatagccccaactctgagcaggatctggaaaagctgggaggtaagtcaccgccacctccaccccctccacccaggcgcagttatctccctggatcagggctcaccacaacaagatctggggacgtcgtctacactgggcggaaagagaacatcaccgccaaagcctcttcagaagacgcaggcccttccccacagaccagagcgaccaagtacccagccgaagagccagccagcgcttggaccccctctccaccccccgtgactacaagcagctctaaagacgaggaagaagaagaggaggagggagacaaaatcatggcagaactccaggcttttcaaaagtgttcatttatggacgtgaactccaatagccacgctgaacccagccgcgccgacagtcacgtcaaggataccagatctggcgctacagtaccacccaaagagaagaagaacctggagttttttcatgaggacgtgcgcaagtccgatgtagagtatgagaatgggccgcagatggagtttcagaaagtgactacaggcgcagtgagaccttcagaccctcccaagtgggagaggggtatggagaattccatctccgatgcctcccgcacttcggagtataagactgaaattatcatgaaggagaattcaattagcaacatgtcactgcttcgcgatagccgcaattactcgcaggaaacagttccaaaggcgtcattcgggttttcaggcatttccccattagaagatgaaatcaataaaggaagcaagatctcaggcttgcagtactccataccagatactgagaaccagacccttaactacgggaagacaaaggagatggagaaacaaaacaccgacaagtgtcacgtatcatctcacacccgcttgaccgagtcctctgttcatgacttcaaaacagaggatcaagaggtgattacaacagatttcggccaggtagtgctgaggcccaaggaagcacgacacgcgaacgtgaacccgaacgaggacggcgaatcatccagctctagccctacagaggagaacgccgcgaccgacaatattgctttcatgatcactgagactaccgtacaggtgctgagtagcggtgaagtacatgatatcgttagccagaaaggcgaagatatccaaaccgttaacatagatgccagaaaagaaatgactccgcgccaggaagggacggacaatgaagatccggtggtttgcctagacaagaagccagttatcattattttcgatgaacccatggacatacgaagcgcttacaaacgcctgagcactatttttgaagagtgtgacgaagaactggagaggatgatgatggaggaaaaaatagaagaggaggaggaagaagagaatggtgactccgtggtccagaacaacaacaccagtcagatgagtcataaaaaagtcgctcccggcaacctcagaaccggtcagcaggttgagactaaatcgcaaccgcatagcctggccaccgagaccagaaaccctggtggccaggagatgaacaggactgaactgaataagtttagccacgtggatagtccaaacagtgagtgcaaaggtgaggatgccactgacgatcaattcgaatctcctaaaaagaaatttaagttcaagttcccaaagaaacagctggctgccctcacccaggccattcgaaccgggactaagacaggcaaaaagacattgcaggtggtcgtgtatgaagaggaagaagaggatggtacactaaagcagcacaaagaggccaaacgcttcgagatagcccgaagccagcccgaagatacaccaacgtctattcctagtgcctcccggaaagggagctccggagctccacagacgagcaggatgcccgtgcccatgagtgccaaaaacaggcctggtactctggataagcccggcaagcaaagcaagctgcaagatccgaggcagtatcgacaagcaaatggaagtgcgaaaaagtcaggaggggacttcaaaccaacctcaccctcgctcccagcttcaaagattcccgcactcagcccttcaagcggcaaaagctcatctctgccctcaagctcaggagatagttcaaatctcccaaacccgcccgccacaaaacctagtattgcatcaaacccactgtccccacagactggcccccctgctcacagcgcctctttaattccttctgtgtctaatgggagcctcaaatttcagtcgctgacccacaccgggaagggccatcatctttccttttccccccagagccagaacgggcgtgccccccctcctctgtcatttagctcgtcccctccaagtccagcatcctcagtttccctcaatcagggagccaagggtaccagaaccattcacactccatctttgacttcctacaaagctcagaacggctcgtcctcgaaggccacacctagtaccgcaaaagagacatcctag

SEQ ID NO: 26087 - DNA, 1566 bp, Artificial Sequence
  Description of Artificial Sequence: Synthetic coding sequence
atgaccagcgccttcaagctggacttcctgcccgacatgatggtggagggcagattgctggtgccagataggatcaatggcactgccaataaaatgaacggggcgttggaccattccgatcagccagaccccgacgccattaagatgttcgtagggcaaatccctcggtcttggtccgagaaggagttgaaagagcttttcgagccttacggcgcagtctaccagatcaacgtgctgcgggaccggagccagaatcctcctcagtccaagggctgttgctttgtgacgttttacactagaaaagctgccctcgaggcacagaatgcattgcataacataaagacactgcccggaatgcaccaccctatccagatgaagcctgctgattctgagaagtctaatgccgtggaggaccgcaagttgttcatcggtatggtgagtaaaaagtgtaacgagaatgacatccgcgtaatgttcagcccatttggccaaattgaagaatgtcgcattctccgaggcccagacggcctaagcagggggtgcgcatttgttaccttctccacccgtgctatggctcagaacgctatcaaagctatgcatcagtcccagaccatggagggctgttcctctcccattgtggtgaagttcgctgacacacagaaggacaaagagcagcggcgcctacagcaacagttggcccagcagatgcagcagctgaacactgccacctggggaaatctaacaggtctcgggggactgacaccccaatatctcgcacttctgcagcaggcaacaagttcttccaatctcggcgcgttcagcggtatccaacagatggctggtatgaatgctttgcagctgcaaaatctggcaacattggcggctgcggcagcagccgcccagacctccgccacgtcgaccaatgccaaccctctcagcacaactagttctgcacttggagcacttacatcccccgtggctgcgagcaccccgaatagtaccgctggcgcagccatgaattcactaacaagcctgggaacactccagggattggccggcgccaccgtggggctgaataatatcaatgctctagcagtggcccagatgctctctggtatggcagcactgaatggggggctaggtgctaccgggctgaccaatgggaccgcaggaacaatggacgctctgacccaggcctatagcggtatccagcagtatgctgcagcggcacttccaactctgtatagccagagcctactccaacaacagtctgctgccgggtctcagaaggaggggcctgaaggcgccaacctttttatttaccacctgccccaggagttcggcgaccaggacattctgcagatgttcatgccgttcggcaatgtgatttcagctaaagtgttcattgacaagcaaactaacctgagcaagtgtttcggctttgtctcatacgataatcctgtgtcagcccaggcggcaattcaggcaatgaatggctttcagattgggatgaaacgcctgaaggtgcagctgaagaggtctaagaatgacagtaagccctactag

SEQ ID NO: 26088 - DNA, 315 bp, Artificial Sequence
  Description of Artificial Sequence: Synthetic coding sequence
atgagcgagcagggcgacctgaaccaggccatcgccgaggagggcggcacagaacaagaaaccgctacaccggaaaatggcatcgtgaagagtgagtccctagatgaagaggaaaagctggagctgcagaggcgcctcgaagcccagaaccaggagagacgcaaaagcaagagcggagcggggaaaggcaaactaacgagaagcttggccgtgtgtgaggagagtagtgccagaccggggggggaatcactgcaggaccaagaatcaattcatctccagctgtcctccttctcatccctgcaggaagaagactag

SEQ ID NO: 26089 - DNA, 1653 bp, Artificial Sequence
  Description of Artificial Sequence: Synthetic coding sequence
atggagcccccccaggagaccaaccggcccttcagcaccctggacaatagatctggccaggtgcaggttcttagcgccacacccctcctgcagcgcaacccctacagctccccggacatcatgcatataaaaggctccgaagcttcaagtgtgccgtacgctctcaatcaggggaccaccgccttgccaaagaataagaatcaggaaggcaccgggcacagattactcaatatgctgagaaaaactctcaaagaatccgactctgaggagctggagatcacccaagagactccaaatctcgtgccatttggtgacgtagtcggatgtttaggaattcacatcaagaactgtaggcacttcatgcccaagattagtctgcagcactacgccaacctgtttatcagaatttcgatcaacaaggcagttaaatgcactaagatgtgctccctattgagtaagaacgacgagaagaatactgtaatcaagttcgacgaagtgaaatatttcagcgtgcaggtcccaaggaggtacgacgacaaaagaaataacatcttgctggaactcatacagtatgataacagggagaaaagagcctttctgctggggtccgtgcaaatccacctttatgaagtgattcagaagggatgttttattgaagaggttcaggtcctgcatggaaacattttcgtatgccgcctggaggtggagttcatgttctcctacggcaacttcggttatggcttctctcaccaactcaagccactccagaagattactgagccatccatgtttatgaacttggcccccccacccgaacggaccgaccccgttacaaaggtgattaccccgcagaccgttgagtatccagcattcctgtcccccgaccttaacgtcaccgtcgggacaccagccgtgcaatcaagtaatcagcctagcgtggttaggttggagaaactgcagcagcagccaagagaacgcctggaaaaaatgaagaaagaatatcggaacctgaatacatggattgataaggctaattatctcgaatctatactcatgccgaaactggaacataaggattccgaggagacaaacattgatgaagcgtccgaaaatacaaagtcaaatcacccagaagaggaattggaaaatattgtcggggtggatatcccactcgtgaacgaagaggcagaaaccaccgcgaacgaacttcttgacaacgactcggagaaaggcctgaccatacctacattgaatcagagcgatcaagataacagcaccgcagatgcatctaaaaacgatgagagtactccctcccctaccgaggtacacagtctctgtactattagtaaccaggaaacgatcaaggcgggcaggataccaccgctcggagaacgtcaaagcgagtctatgcccgatcgcaagatgaagaacgtgtttttcccccttgaggttaagctgaaagataactacccaagcatcctgaaggccgacagtagcctaagcgaggtaaatctaagaagcatctgtataaatccaaagtcacgcaacctagattcttcaccaactgagatcagttggcagaataataatttaaatctagcagaacgggaaaacaccggattggtgtcaacccgactgaagatcaagagatag

SEQ ID NO: 26090 - DNA, 363 bp, Artificial Sequence
  Description of Artificial Sequence: Synthetic coding sequence
atgagcatcagcagcgacgaggtgaacttcctggtgtaccggtacctccaggagtctggctttagtcattccgcattcaccttcggtattgagtctcatatctctcagtctaatattaatggtgcgcttgtcccccctgctgccctgatctctatcatccaaaaggggctacaatacgtggaagctgaagtttccatcaacgaagatggtaccctcttcgacgggaggcccatcgaatcgctttccttaattgacgccgtgatgccagatgtcgtccaaacacgccagcaggcttaccgcgataagctcgcacagcagcaggcagccgccgcagccgctgctgcggctgcggcgtctcaatag

SEQ ID NO: 26091 - DNA, 222 bp, Artificial Sequence
  Description of Artificial Sequence: Synthetic coding sequence
atgagctactaccagcggcccttcagccccagcgcctacagcctgccagcaagtctcaacagttccatcgtcatgcagcatggcacgtcgcttgactcgacagacacttacccccagcacgctcagtcacttgatggcacgacctctagctcaatcccactttaccgaagcagtgaagaggaaaaaagagtgacagtcatcaaggctccgcactatccttag

SEQ ID NO: 26092 - DNA, 717 bp, Artificial Sequence
  Description of Artificial Sequence: Synthetic coding sequence
atgaccgaggacagccagcggaacttccggagcgtgtactacgagaaggttggcttccgcggtgtggaggagaagaagagcctcgaaatactactgaaggacgatcggctgggaatccttccacctcaccatgaaagccacgcaaaagtaatgatgtaccggaaggaacaatacctcgacgtgctccatgccctgaaagtggtccgctttgtctccgatgctactcctcaagcagaggtttacctgaggatgtaccagctggaatctggcaagttacctcgctcgccgtcattcccactcgaacccgacgacgaagtcttcttggccatcgccaaggcgatggaggaaatggttgaggactctgtggattgttattggattaccaggcgatttgtgaatcagctgaacaccaaataccgtgactccttgcctcaactgcccaaggccttcgagcagtacttaaacctcgaggacggacggctgctcacccacctgcggatgtgcagtgcggcccccaagctcccttacgacctgtggttcaaacgttgcttcgccggctgcctccctgaaagcagtttacagagggtatgggataaggtggttagtggctcttgcaagatcctggttttcgtggcagtggagattctcctgacctttaagattaaagtgatggccctgaattccgctgaaaaaattaccaagtttttggagaattag

SEQ ID NO: 26093 - DNA, 1620 bp, Artificial Sequence
  Description of Artificial Sequence: Synthetic coding sequence
atggccaccagcgcccccctgcggagcctggaggaggaggtgacctgttccatctgcctggattatcttcgtgaccctgtgacaatcgattgcggacatgtgttctgccggtcatgtacaactgatgtcaggcccatttcaggctcccgccccgtttgccccctgtgtaaaaaaccttttaagaaggagaatatccgccccgtgtggcaacttgcatctctggtggaaaacatcgagagactgaaagttgataagggaaggcaaccaggagaagtcactagggagcagcaggatgccaagctgtgcgaacgtcatcgagagaaacttcactattactgtgaagatgatgggaagctgctgtgtgtgatgtgtcgcgaatcacgagagcatcgaccacacacggctgtgctaatggaaaaggctgcccagcctcaccgggaaaagattttgaaccatttaagcacattacggcgagaccgggacaaaattcaggggtttcaggccaaaggagaggccgatatcctggctgctctgaagaagctgcaagaccagaggcagtatatcgtcgctgaattcgagcaggggcaccagttcctcagagagagagaagagcatttgctcgagcagctcgccaaactggagcaggagctgactgaagggagagagaagttcaagtcccggggcgtcggagagttggcaagactggcactggtcatttcagagcttgagggaaaggcccagcagcctgcagcggaactcatgcaggacactcgcgatttcctcaacagatacccccgtaaaaaattctgggtgggtaagcccatagcgagagtcgtgaagaagaagactggggagttctcagacaaactactcagcttgcagcggggcctgcgggaattccagggcaagctccttagagacctggagtacaagaccgtgagtgtgacgctggatccgcaatccgcctctggctacttgcagctcagcgaggactggaagtgcgtgacttacacctcgctttacaaatctgcctatctgcatcctcagcagtttgactgcgaacccggagtcttggggtccaaaggcttcacctggggtaaggtttattgggaggtggaggtggagagggaaggatggtccgaggacgaggaagagggcgacgaggaagaggagggtgaggaggaagaagaagaggaagaagccgggtacggagatggttacgacgattgggagaccgacgaggacgaggaaagcctgggggacgaggaggaggaagaggaagaagaggaggaggaggtgctcgagtcatgcatggtgggcgtggctagggacagcgtaaaaaggaagggagatctgtctctgagacctgaagatggcgtgtgggccctccggctttcgagttccgggatttgggctaacacatccccagaggcagagctcttccctgccctacgcccccgccgggtgggcatcgccctcgactatgagggtgggacggtcactttcaccaatgccgagagtcaggagttaatctacacattcactgcaacctttactcggcggctggtgccattcctgtggctcaagtggccgggtacgagacttcttctccggccgtag

SEQ ID NO: 26094 - DNA, 609 bp, Artificial Sequence
  Description of Artificial Sequence: Synthetic coding sequence
atgggccagaaggtgaccggcggcatcaagaccgtggacatgcgggacccaacttatcgacctctgaaacaagaactgcaagggctggactactgcaaacccacccgtctggatttactgctagatatgcctcccgtgagctacgatgtccagctactgcatagctggaataacaatgaccgatcactcaatgtatttgtcaaggaagatgacaagctgatcttccacagacaccctgtcgcccagagtacggatgctatcagaggtaaggtgggctacaccagagggcttcacgtctggcaaataacttgggccatgcgacagagagggacccatgccgtggttggcgtggcaaccgccgacgcaccactgcactccgtgggatacacaactttggtgggcaacaatcacgaatcttggggttgggacctgggacgcaacagactgtatcatgatggcaaaaatcagccatctaagacctaccccgctttcctggaaccggatgaaaccttcatcgtcccggatagctttcttgttgccctcgacatggacgacggaaccctttcttttattgttgatgggcagtacatgggcgtggccttcaggtag

SEQ ID NO: 26095 - DNA, 174 bp, Artificial Sequence
  Description of Artificial Sequence: Synthetic coding sequence
aacctgcccatctgcatggccaagacccacctgagcctgagccaccagccagacaaaaaaggggtgccaagggacttcatcctgcccatttccgatgtccgcgcctcgataggcgccggctttatttaccccctggtagggaccggcggaagggaagcaccactctggctctag

SEQ ID NO: 26096 - DNA, 468 bp, Artificial Sequence
  Description of Artificial Sequence: Synthetic coding sequence
atgaacaaccagaagcagcagaagcccaccctgagcggccagcggtttaaaaccaggaagcgggacgaaaaagaacgattcgaccccactcagttccaggactgtataatccagggactgactgaaactggcaccgacctggaagcagtggctaagtttcttgacgcatccggcgcaaaactcgattatagacggtatgccgaaaccttattcgatatattagttgccggaggaatgttggcccctggtgggacactggccgatgacatgatgagaacagatgtttgtgtgttcgcagcccaggaagatctggagaccatgcaggccttcgcccaggtcttcaacaagttaatccgtaggtataagtacttggagaaggggtttgaggacgaagtcaagaagctgctgttgtttctcaaaggcttctcggagtcagagcggaacaagctcgcgatgctgaccgggtag

SEQ ID NO: 26097 - DNA, 528 bp, Artificial Sequence
  Description of Artificial Sequence: Synthetic coding sequence
tgattcgacgaccagcggcggatgagcctgcacctgcacggcgccgactgtgacccaaaaactcaaaacgagatgaacatttgtgaggaagagttcgtcgagtacaagaatcgggatgctatatcagctctcatgccactgttttccgaggaagaaagttcagatggtagcaaacataataatggcttgccggatcatatatccgctcagctacagaacacttatactttaaaggcttttactgtcggctcaaagtgtgtggtctggtcatcactgcgtaatacatggtccaagtgcgagatcctcgaaactgctgaagaaggaacgagagtgctgaatttgtccaatgggatggaagagattgtgaacccagagaacgtgtggaacgggatacctaaacttgacaagagtcccccggaggccgtttctcagagagttggtaaggatctgtattttatgtctgttggggacactaccataaaggagaaaggctttggcggtgacggggacctgacagtagatctgtag

SEQ ID NO: 26098 - DNA, 2814 bp, Artificial Sequence
  Description of Artificial Sequence: Synthetic coding sequence
tgactgcggagccagcccggctgcggctgcctgtggcaggaggccccaactcactccactggtccaagcgttgagggcgaagccccttccagtgaaactggtacaagcctggattccccgtctgcatatcctcagggtccactggtgcccgggtccagcctctctcccgatcattatgagcacacatctgtcggggcatacggactttattctggaccgccaggacagcaacagagaacccgtagacccaaactacagcatagcacttctatactgcgtaagcaggctgaggaagaggcaattaagcggtctaggtcactgagtgaaagttatgagctctcctccgacctgcaggataaacaagtggaaatgctggagaggaagtacgggggaaggcttgtcactaggcatgccgcccgtaccatacagaccgcgtttcggcagtaccagatgaataagaatttcgagaggctgagaagcagtatgtcagagaaccgcatgtccagacggatagttctgtcgaacatgaggatgcagttctcgttcgaggggccagaaaaagtgcactcatcttactttgaaggaaaacaggtatccgtcaccaatgacggcagtcaactcggagcccttgtatcgcccgaatgcggtgatctgagcgagcctactaccctgaaaagccccgctccgtcctctgatttcgccgatgctattaccgaacttgaggatgccttcagcaggcaggtaaaatccttggcagagtccatcgacgacgcactgaactgcaggagcctgcacaccgaagaggcccctgcattggatgcagccagagctcgcgataccgagccccaaaccgctcttcacggcatggatcacaggaagctagacgaaatgaccgcttcctacagcgacgtcacactgtatattgatgaagaggagctgtcccccccgttgccactgtctcaggctggagaccgcccctctagtacagagagcgacctccgactgcgggccggcggcgccgcccccgattattgggctctcgctcacaaggaggataaggctgacacagatacctcttgtcggtcaacgccaagcttagagcggcaggaacaaagactgagagtcgaacacttacccctgctgacaatcgaacccccttctgatagcagtgtggatttgtcagaccgctcggaacggggctcactgaaacggcagtcagcctacgagagatcattgggggggcagcagggcagtcccaagcacggaccgcattctggggcccccaaaagcttaccccgggaagagcctgagctgcggcctcggcctcctcgtccactggactcccacctcgcgataaacgggagcgctaacagacagagtaagagcgagtccgattacagcgacggcgataacgattctataaatagtacgtcaaactccaacgatactataaactgctcttctgaaagctcttctcgcgattctttgagagaacagacactgagcaagcagacttatcataaagaagcacgtaacagttgggactcaccagctttcagcaatgacgtgatccgcaagagacactatcggatcggcctgaatctttttaataagaagccagagaaaggcgtgcaatatctcattgaaagggggtttgtgccggacacacccgtgggagtagcccatttcttgctccagaggaaaggactgagtcggcagatgatcggcgaatttctcggtaaccggcagaagcagttcaaccgagacgtgcttgattgcgtggtggacgagatggatttctctacgatggaactggacgaggccttacgaaagtttcaggctcacatccgcgtccagggggaagctcagaaagtggaacggttaattgaggcctttagtcagagatattgcatttgtaaccctggggtagtacgacaatttaggaatcctgacaccatcttcatcttggcatttgccatcatcctgctgaacaccgatatgtatagtcccaacgtgaagcccgagaggaagatgaagcttgaggacttcatcaaaaacttgcgcggcgtggatgatggggaggatataccacgggagatgcttatgggaatctacgagcgtattaggaagcgagaactgaaaacaaatgaggatcacgtaagccaggtccagaaagtggagaagctcattgtggggaaaaagccaattggttctttgcaccctggacttggctgtgtcctgtccctccctcaccgaaggctagtctgttactgccggctgttcgaggtcccggaccctaataagccacagaagttgggactgcatcaaagggagattttcctatttaacgacctgctagtggtaacaaagatattccagaagaaaaaaaactctgttacctacagtttcaggcagtcattttctttgtatggcatgcaggtgctgctgttcgaaaaccaatattaccccaacggcattcgactgacctccagtgtaccgggcgctgacataaaggtgttaattaactttaacgccccaaatcctcaggacaggaaaaagtttaccgatgacttgagagagtctatcgccgaagtgcaggagatggagaagcaccggatcgaatcagagctggagaaacagaagggggttgtgcgccctagtatgtcccaatgctccagtctgaagaaggagagtggcaatggcacactgtcacgcgcttgtctcgacgattcttacgcttcaggagaggggctcaaacggtcagcattgtcctctagtctaagagatctcagtgaggcaggagtgcaccattag

SEQ ID NO: 26099 - DNA, 198 bp, Artificial Sequence
  Description of Artificial Sequence: Synthetic coding sequence
atggtggaggccgccgaccgggagaaggtggagctgctgaaccagctagaggaggaaaagaggaaggtagaggatctgcagttcagggttgaggaagaaagcattacaaaaggggacctggagcagaagtcccagatctctgaggatcctgaaaacgtggccaccgtctcagaaaaatcccgaataatggagttgtag

SEQ ID NO: 26100 - DNA, 630 bp, Artificial Sequence
  Description of Artificial Sequence: Synthetic coding sequence
atggacttcctgctgggcaaccccttcagcagccccgtgggccagcgcatcgagaaagctaccgatgggtctctacagtcagaagactgggccctgaacatggagatctgtgatataattaatgaaaccgaggaagggcccaaagacgcgttacgggctgttaagaagagaattgtggggaacaagaatttccacgaggtgatgcttgcactcaccgtgctcgagacatgtgtgaagaactgcgggcacagatttcacgttcttgtcgcttcacaagattttgtagaaagtgtgcttgtgaggaccatactcccaaaaaataacccaccaaccattgttcacgacaaagtacttaatttgatccagagctgggccgatgctttcagatcgagtccggatttgaccggcgtggtgactatttacgaggatttgcgccgcaaaggactcgaatttccaatgaccgacctcgatatgctttcccccatccacactccccggggaccctgctcaacacagaggcacaatcaagatagaattctatgggccctcactccggcctccaaacgaaccctggcttctatgctgccattgtgtcctccccggccctacagcccggtgactaggccatag

SEQ ID NO: 26101 - DNA, 255 bp, Artificial Sequence
  Description of Artificial Sequence: Synthetic coding sequence
atggccgacaccgacctgttcatggagtgcgaggaggaggagctggagccgtggcagaaaatatctgacgtgattgaggatagcgttgtggaagattacaattccgtggacaaaaccaccacagccggcaaccccctggtccagcaggggggtcaaccattgatcctgacccagaatccagcacccggattggggaccatggtaacacagcccgtgttgcgtccagtccaggtcatgcaaaacgccaatcattag

SEQ ID NO: 26102 - DNA, 618 bp, Artificial Sequence
  Description of Artificial Sequence: Synthetic coding sequence
atggccacccccctgggctggagcaaggccggcagcggcagcgtgtgcctggctttggatcaactgcgtgatgtaatcgaaagccaggaagagcttatccaccagctgagaaacgtgatggttcttcaggacgagaatttcgtgtccaaggaagagtttcaggccgtggaaaaaaagcttgtggaagagaaagcagcccacgctaagaccaaagtgctgctggcaaaagaagaagagaaattgcagtttgctctcggggaggtcgaggtactcagcaagcagcttgaaaaggaaaaacttgctttcgagaaggcactgtccagcgtgaaaagcaaggtacttcaggagagttcaaaaaaggaccagcttatcactaaatgtaacgaaattgagtcccacataataaagcaagaagatatactcaacggtaaagagaacgaaatcaaggagctgcagcaggtgatctcgcaacagaagcagattttcaggaatcacatgtctgatttccgcattcagaaacagcaagaaagttatatggctcaggtgcttgaccaaaaacacaagaaagcctctggcaccagacaggccaggagccaccaacatccaagggaaaagtag

SEQ ID NO: 26103 - DNA, 330 bp, Artificial Sequence
  Description of Artificial Sequence: Synthetic coding sequence
atggagcccagcgcccagcagctgcagctggccgccagcctgcccgcaaatttgtctaatttttgccagggaagcgaaatgcctactacatcaagacccgccttagacgtgaaagggggaacatcgcctgctaaagaggatgcaaaccaggagatgtcatctgtggcttattcaaatctcgctgttaaggacaggaaagccgtggcaatcttgcattatcccggggttgccagcaacggcacaaaggctagcggggcacctacaagtagttccggatcacccatcggcagccccactacaacccccccgacaaagccgccaagtttctag

SEQ ID NO: 26104 - DNA, 1737 bp, Artificial Sequence
  Description of Artificial Sequence: Synthetic coding sequence
atgcccgagatccgggtgacccccctgggcgccggccaggacgtgggcagatcttgtattctggtgagcattgctggcaaaaacgtgatgctcgattgcggaatgcatatgggatttaacgatgatcgacggttcccagacttcagttacattacacagaacggcagattgaccgacttcctggattgtgtaatcatatcccatttccatctcgatcactgtggggcactgccctatttctctgagatggtgggatatgacggacctatttacatgacacaccccactcaggcgatatgccctatcctcctggaagactacaggaaaattgccgtcgataagaaaggcgaggcgaacttctttacctcccaaatgatcaaagattgtatgaaaaaggttgtggcggtccacttacaccaaactgtgcagatcaaagtgggctccgagtccgtggtctacactggcgactataatatgactcccgaccggcacctcggagcagcttggatcgataagtgtagaccaaatttgttaatcactgagtccacttacgccacaacaattagggacagcaaaaggtgcagagaacgagattttctgaaaaaggtgcatgagacagtcgagaggggcggaaaagtgctcattccagtgttcgctcttgggagagctcaggagctctgtatcctgctcgaaaccttttgggagcgcatgaatcttaaggtaccgatctactttagcaccggcttgacagagaaagctaatcattattataagctgtttatcccttggactaaccaaaaaattagaaaaacatttgtgcagcgcaacatgttcgaattcaagcatatcaaagcgtttgatagagcatttgccgacaatccaggacccatggtggtgtttgccactccgggaatgttgcacgctggccagagcctgcaaatctttcgtaagtgggctgggaacgagaagaatatggttattatgcccggctattgcgtacagggaactgtcggccacaagatcttgagcggacagagaaaattggaaatggaagggcgccaggttctggaggttaagatgcaggtggagtacatgagcttttccgctcatgcagatgcgaagggcattatgcagctagtagggcaggccgaacctgagtcagtgctgttggtgcacggtgaagcgaagaagatggagttcctgaaacagaagatcgagcaggagctacgtgttaactgctatatgcctgcaaacggcgaaactgtcacactcccaacgtcccctagcatccccgtgggtatctcattaggactcctgaaacgtgagatggcacaaggacttctgccagaagctaagaagcccagactgttgcatggaacattaatcatgaaagatagcaattttagactcgttagcagcgagcaggccttgaaggaacttggattagcagaacaccaacttcggttcacttgccgcgtacatttgcatgatacccgtaaagagcaagagacggctctgagggtgtatagccatttaaagagcgtgctgaaggaccactgcgtccagcacctgcctgacggctcagtgaccgtggaatctgtccttctgcaggctgctgcaccatcagaggaccctggaactaaggtcctcctcgtctcttggacttatcaggacgaggagctcggcagcttcctgacgtctctgctaaaaaaaggactgccccaagcgcccagttag

SEQ ID NO: 26105 - DNA, 570 bp, Artificial Sequence
  Description of Artificial Sequence: Synthetic coding sequence
atgcagcccatgagcttcggctgggaccacagcctgcacaagcggaagaggctgccccccgtgaagagatctctggtttattacctgaagaacagggaggtgcgactgcagaatgaaacatcctatagccgggtgctccacggctatgccgctcagcaactgccttcgcttttaaaggaacgagagtttcacttaggcactttgaacaaggtgtttgcaagccagtggttgaaccatcggcaggtagtttgcggcacgaagtgcaataccctgttcgtggtggatgttcaaacatcccagatcaccaagattccaattctcaaggatagagaacctgggggggtgactcagcagggttgtggtatccacgccattgagctgaaccccagcaggacgttactcgcaaccggcggggacaatcccaattccttagccatttatagactccctacgctggatccagtttgtgtgggcgacgacggccataaagattggattttctctattgcgtggatttccgacactatggctgtgtctggctccagggacggaagcatgggtttgtggtag

SEQ ID NO: 26106 - DNA, 2289 bp, Artificial Sequence
  Description of Artificial Sequence: Synthetic coding sequence
atggccagcctgctgcaggaccagctgaccaccgaccaggacctgctgctgatgcaggagggtatgcccatgcgaaaggtccgcagtaagtcatggaaaaagctgagatatttccgcttgcagaatgacgggatgactgtttggcacgcaaggcaagcccggggcagcgccaagccttcgttctccatctcagacgtggaaacgatcaggaatggacacgactcagagcttctccgctcccttgccgaagaactccccttagagcaggggtttactatcgtgtttcatgggcgccgcagtaatctggacctcatggcaaacagtgtggaggaggcgcagatttggatgcgggggcttcagctcctcgtcgatctcgtgacttctatggaccaccaggagaggcttgatcagtggttgtcagattggttccaaagaggtgataaaaaccaggacggcaaaatgtcattccaggaggtccagcgcctcctccatctgatgaatgttgaaatggaccaggaatatgcattttctctcttccaagccgctgatacttctcagagcggcaccctggagggtgaagagtttgtgcaattctataaagcgcttaccaagagggccgaagtccaagagttgttcgaatccttttcggctgacggccagaagctcactctgctcgagttcctcgacttcttgcaggaggagcagaaagaaagagattgtacatctgaactggcactggaactcattgaccggtatgaaccgtcagatagtggaaaactcaggcatgtgctttccatggatggctttttgagttacctatgcagtaaggacggcgatattttcaatcctgcatgcctcccaatctaccaggatatgacccagcctctgaaccactattttatctgttcttcccataacacctacctcgtcggcgaccaactgtgtggtcagtcctccgtggagggctacatcagagctctgaagcgcggttgtaggtgcgttgaagtggacgtgtgggatggccccagcggggaaccagtagtctaccatggacatacacttacaagccgcattctgtttaaagacgtcgtcgctaccgtggctcaatacgcttttcagacctcagactaccccgtgattctatcactggaaacacattgctcatgggagcagcagcagacaatggccaggcacctgaccgagatcctgggcgaacagctgctgtctactacacttgacggtgtcttacctacccagcttccaagtcccgaggaactccgacggaagattctagtgaaggggaagaagttgaccctggaggaggatctcgaatacgaagaggaagaggcagagccggagttggaggagtccgagctggcactggagagccagtttgagacggagcccgagccccaggaacaaaacctgcagaataaggacaagaagaaaaagtctaagccaatcctctgccccgctctctcaagtcttgtgatttatctcaaaagcgttagttttagatcgttcacccacagcaaagaacattaccacttctacgagatcagcagctttagcgaaacaaaagcaaaaagacttatcaaagaagcaggtaatgaatttgtgcagcataacacgtggcagttgtctcgagtgtacccatctggtctcagaaccgactcatctaattataatccacaggaactctggaatgccggttgtcaaatggtcgcaatgaatatgcagacagcgggactggaaatggacatctgcgacggccacttccgacagaacggaggctgcggctacgttctgaagccagatttccttcgcgacatacagtcatccttccatcccgaaaagcctattagcccgtttaaggctcagacactgttgattcaagtgatctccggtcaacagctgcccaaggttgataaaactaaagagggctccatcgtcgatcccctcgtcaaggtgcagatattcggtgtcaggctggacacggcacgtcaggaaaccaattatgtagagaacaatgggttcaatccctactggggccaaaccctttgctttagggtgctcgtgcccgagctggcgatgttgcgctttgtggtgatggattatgactggaaaagccgcaatgactttattggtcagtacacccttccctggacctgcatgcagcaaggttacagacatattcacctgctaagcaaagacggcatcagcctcaggcctgccagtatattcgtgtacatctgcatccaggaaggccttgaaggcgatgagtcctag

SEQ ID NO: 26107 - DNA, 1362 bp, Artificial Sequence
  Description of Artificial Sequence: Synthetic coding sequence
atggccggcgccgccggccgggtgcaggaccgggccctgcggcggtttcccataacactccctgttggagatctctctaatctccacctgaaagaagagaagataaaaccagacaccaatggcgcagtggtgaagacaaacgccaacgctgagaaaaccgacgaggaagaaaaggaggatagggcagctcagtccctcctcaacaaactcatcaggtccaacctcgtagataatacaaaccaggtcgaggtactgcagagagaccccaatagcccactgtactcagtcaagagctttgaggagttgaggctgccccaaaatctcatcgcacaatcacagtccggtacaggaaagacggctgcgtttgtgctcgctatgctgagccaggtcgagccagccaacaagtatccccaatgtctttgcctgtccccaacatatgaactcgcgcttcagaccggcaaggtgatcgagcagatgggaaagttttaccccgaactgaaactcgcgtatgctgttcgaggtaacaaactcgaaaggggacagaagatttccgagcagatcgtgatcggtacaccagggacagtgctggattggtgctcaaagctgaagtttatcgatcccaagaaaattaaggtgttcgtgctggacgaggccgacgtcatgatagccacacagggccaccaggaccagtccattaggatacagcggatgctgccaagaaactgccagatgttgctcttctccgccacatttgaggactcggtttggaaatttgcacaaaaggtcgttccagacccgaacgtaataaaattgaagagagaggaagagactctggatacaatcaaacagtattacgtgctgtgtagctctagagatgagaaatttcaggcattgtgcaatctgtacggggccatcacaatcgctcaggcgatgatcttctgtcatacccgaaaaacagcttcttggttagcggctgaacttagcaaggagggccaccaggtggcactcctctcaggtgagatgatggttgaacagagagctgcagtcatagaaagattcagagaaggaaaggagaaagtccttgtgacaactaatgtgtgcgctcgtgggattgacgtggagcaggtatcggtggtgattaatttcgatctccctgtggacaaagacgggaacccagacaacgagacctacctgcacaggataggaagaactggcagatttgggaaacgggggctcgcggtgaatatggtggacagtaaacatagcatgaatattctcaaccggattcaggagcattttaataagaaaatcgagcgcctggataccgacgatttggatgaaattgagaaaatcgccaattag

SEQ ID NO: 26108 - DNA, 921 bp, Artificial Sequence
  Description of Artificial Sequence: Synthetic coding sequence
atggcccgggtgcccctgggccggagcctgaccctgagcccccggctcgaacataacgggatgacctccgcgcatcacaattttcgccttcccggctcccgagactcaccggctagtgccagccaggtggctgaaatcatagacctcgaatggtacgagaaatccgaggagacccatgcatctcagatagaactgctggaaactagctcaactcaggaaccattaaacgcctcagaagcattttgccccagagactgcatggttccagtagtcttccctggccccgttagccaggagggatgttgtcagtttacatgcgaacttctaaagcacatcatgtaccagcgtcagcagctccctttaccctacgagcaactgaagcatttctacaggaagccctcaccccaagctgaggagatgctgaaaaagaaaccgcgggctactaccgaggtgtcatcgcggaagtgccagcaggccctggccgaattggaatccgtactgtcccacctggaagatttctttgcaaggacccttgtgccacgtgtactcattctcctgggtggtaatgccctttcacctaaggagttttatgagctggacttatcactactggccccatatagcgtggaccagtctctctctaccgcggcctgtcttagacggctttttagagccatctttatggccgacgccttttcagagctgcaagctccaccacttatgggcaccgtcgttatggcccaaggtcacagaaactgcggggaggattggttcagaccaaaattgaactatcgggtcccctcccgaggtcacaagttgaccgtgactctgtcatgtgggcgccccagtatcaggaccacagcatgggaagattacatctggttccaggctcctgtcaccttcaaaggctttcgggagtag

SEQ ID NO: 26109 - DNA, 426 bp, Artificial Sequence
  Description of Artificial Sequence: Synthetic coding sequence
atgccccagctgctgcagaacatcaacggcatcatcgaggccttccgcaggtatgcccggacggagggtaattgcaccgcccttacccgaggggagctgaagcggctcctggaacaagagttcgccgatgtcatcgtgaaaccccacgaccccgctacagtagacgaagtgcttcgtctgctcgacgaagaccacaccggaacagtggaatttaaagagttcctcgtactcgtgtttaaagtcgcacaagcctgctttaagacgctatccgaaagcgccgagggggcatgcggatcccaggagtcaggatcccttcattccggcgccagtcaggagctcggcttcagaccacgggtgcggccactggctctccggggctcagccgcaatgactggaaaactgagcccccgggctaggaaagagtag

SEQ ID NO: 26110 - DNA, 480 bp, Artificial Sequence
  Description of Artificial Sequence: Synthetic coding sequence
atggccaccagcgcccccctgcggagcctggaggaggaggtgacctgctccatttgcctggattacctaagggatcccgtgaccatcgattgtggacacgtgttttgcagaagttgcacgacagacgtgagacccatctccggcagccggccagtctgcccactgtgtaagaagcctttcaagaaggaaaatattcgacctgtgtggcaactggaaaagatattaaatcatttgagcacactgcggagggacagagataaaatacaagggtttcaggcaaaaggcgaggcagacattcttgcggcgctgaaaaagctgcaggaccagagacagtacattgtggccgaattcgagcaaggacaccagtttctgcgcgagagagaggagcacttgctggagcagctggccaagcttgaacaggaattgacagaaggccgcgaaaagtttaagagcaggggcgtaggcgagcttgcaagatag

SEQ ID NO: 26111 - DNA, 1506 bp, Artificial Sequence
  Description of Artificial Sequence: Synthetic coding sequence
atggacttcctgctgggcaaccccttcagcagccccgtgggccagagaatcgaaaaggcaacggatggctcattacagagcgaggactgggcgctgaacatggaaatctgtgatattattaacgaaacagaagaaggacctaaggacgccctgcgcgccgtgaaaaagcgtatcgtggggaataaaaactttcatgaagtgatgttagcccactctgcccggagacacctaagtgctctccaagtgctggagacctgtgtgaaaaactgcggccacaggtttcacgtgttggttgccagccaggactttgtggagtccgtcttagtgcgcacaatcctaccaaagaataacccccctacgattgtgcacgacaaggtactgaatcttatacagtcgtgggccgacgcatttcggagcagtcccgaccttaccggcgtggtcaccatttacgaagatttgagaaggaagggcttggagtttcctatgaccgacctagacatgcttagccctattcatactccacagcgcactgtgtttaacagtgagacacaaagcggtcaggactctgtggggactgatagttcccagcaggaagatagcgggcaacatgcggcccctttaccggcacctcccattctgagtggagatactcccattgccccaacacctgagcaaatcggtaaactgcgctccgagctagaaatggtttctggtaacgtgagagtgatgtccgaaatgctgacagagctcgtgcctacccaggcagagccggccgacctcgagctgctacaggaactgaatcgaacctgcagggccatgcagcagcgcgtgctcgagttgataccacagattgctaacgagcagctcaccgaggaactgcttatagttaatgataacctgaacaacgtatttctgcgccacgagagatttgaaagattccgtaccggccagacaacaaaggccccgtcggaggcagaaccagctgccgacctcatagatatgggccctgatccagctgccactggaaacctgtcatctcagctggccggaatgaacctcggctcgagctccgtccgcgcgggcctgcagagcctcgaagcttctgggagacttgaagatgaatttgatatgttcgctctcactcgtgggtccagtttagctgatcagcgaaaggaagtgaaatatgaggccccacaagccacagacgggttggctggagctctcgacgctcggcagcagagcacgggagctatacctgtcacacaagcctgcctcatggaggatatcgaacagtggctctccaccgacgtggggaacgatgccgaggaacctaaaggcgtcacctctgaggagtttgataaatttctggaggaaagggcaaaagccgcggaccggcttcctaacctctctagccccagcgccgaaggtcccccagggccaccttccgggcccgcgccacgaaaaaaaactcaggagaaagacgacgatatgcttttcgcgctgtag

SEQ ID NO: 26112 - DNA, 117 bp, Artificial Sequence
  Description of Artificial Sequence: Synthetic coding sequence
gagcccgtgtacttcgccgagaaggtgatgagcctgggccggaactggcatcgcccttgtctgagatgtcagaggtgccataagactttgacggccggttctcatgcagaagtctag

SEQ ID NO: 26113 - DNA, 1122 bp, Artificial Sequence
  Description of Artificial Sequence: Synthetic coding sequence
atggcccaggagagccccaagaacagcgccgccgagatccccgtgacaagcaatggggaagtcgatgattcacgcgaacactcttttaacagggacctcaaacatagcctgccaagtggcctgggactctctgaaacacagatcaccagccatggctttgacaatacaaaggaaggcgtgattgaggcaggcgctttccagggctctcccgcaccacccctccccagcgtgatgtccccttcaagggtcgccgccagtaggttggcccaacaaggctctgacctcatcgtacccgcgggggggcagagaactcagactaagtcagggccggtgattcttgctgacgagattaaaaacccagccatggagaaactcgagctggttcggaaatggtcacttaatacatacaagtgcaccaggcagattattagcgaaaagcttggcagagggagcagaaccgtggacctcgaactggaagcccagattgacatccttagggacaacaagaaaaaatatgagaacatcctgaaacttgcccagactctcagtactcaattgtttcagatggtccatactcaacggcagctgggcgatgcttttgcggacctgtcactaaaatctctcgagctgcatgaggaattcgggtacaatgcagatacacagaagcttctggccaagaatggcgaaacattgctcggagctatcaacttcttcatcgcctcagtgaatacattagtaaacaagacaatcgaggacaccctgatgacagttaaacaatatgaaagcgctcggattgagtatgacgcttataggacagatttagaggaactgaatttaggccctagggatgccaacacccttccaaaaattgagcagtcccagcatctgttccaggctcacaaagaaaagtacgataaaatgagaaatgatgtgagtgtgaagctcaaattcttggaggagaataaagttaaggtgctgcacaaccaactcgtacttttccataacgccatcgccgcatatttcgccggtaatcagaagcaactggagcagacgctgaaacagtttcatatcaaactgaagactcccggtgtggacgctccttcatggctcgaagagcagtag

SEQ ID NO: 26114 - DNA, 453 bp, Artificial Sequence
  Description of Artificial Sequence: Synthetic coding sequence
atgcacaccggcgaccccaagcaggacctggcctacgagcggcagtatgaacagcagacatatcaggtgattcctgaagtgatcaaaaactttatccagtacttccataagaccgtgtccgatcttatcgatcagaaggtgtacgaactgcaggcaagtcgcgtgagctctgatgtcatcgatcagaaggtgtacgagatccaggacatctacgagaacagctggactaaattaaccgagcgattctttaagaacactccctggccagaggccgaggcaatagcgccacaagttggtaatgacgcagtttttcttattctgtacaaagagctgtactatcggcacatttacgctaaggtttcgggcggaccatctctggaacagagattcgagtcctactataattactgcaacttgtttaattacatactcaacgccgatggccctgcatag

SEQ ID NO: 26115 - DNA, 2136 bp, Artificial Sequence
  Description of Artificial Sequence: Synthetic coding sequence
atggccatgcaggagaagtaccccaccgagggcatcagccacgtgaccagcccaaatttctgtagcagtagcgggagccctccgttccagcccattaaatcccacgtgaccatacccacagcccatgttatgccgtctacccttggtacatcacccgccaagcccaactctacccctgtcggcccatcatcatcaaagcttccactctctggcctggctgagtccgtcggtatgacacgcaacggcgatctgggcgccatgaagcactcaccggggctatctcgcgatcttatgtactttagcggcgcgaccggtgaaaacgggatcgagcagtcatggttcccggctgtgggtcacgagcggcaggaggaagcccggaagtttgacattccttccatggagtctacgttgaaccagagcgctatgatggaaacactttacagcgaccctcatcatagggtccgtttccataacccacgaacgagcacatccaaggagctctatagagtgctgcctgaagctaaaaaggcacccggtagcggggccgtatttgagcgaaatggtccccactctaacagctcaggggtcttgcctctgggattgcagcccgcccccgggttgtcaaagcctctcccttcccaggtgtggcagccatcgcccgatacgtggcacccccgcgagcaaagttgtgaactctcaacctgtagacaacagctggagctcatacgcctccagatggaacagatgcagctgcagaacggagctatctgccaccaccctgccgcttttggaccatctctgcccatcctcgagccagcccagtggatcagtatcctgaacagcaatgagcacctgctgaaggaaaaagaactgctgatcgacaaacaaaggaagcatatttcccagcttgaacagaaagttcgagagtcggaacttcaggtgcattctgctcttttgggtaggcccgccccatttggggacgtgtgcctgttgcgtttgcaagagcttcagcgtgagaatacatttctgcgggcccagtttgctcagaagacggaggctttgtcacgagagaaaatagacttagagaagaaattgagcgccagtgaggttgaggtgcagctaatcagggaatctctcaaggtggccttacaaaaacactcagaggaagtgaaaaagcaggaagagcgggtaaaggggagagataagcacatcaacaatctgaaaaagaagtgtcaaaaggagtctgaacagaaccgagaaaaacagcagcgaatagaaaccttggagcgctacctggccgacttacccaccttggaagaccaccagaaacagagccagcaactcaaggactctgagctgaaaagcacagagctccaggagaaagtcaccgagctggaatcgttattggaagaaacacaggcaatctgtagggaaaaggagattcaactggagtcgctgaggcagcgcgaggctgaattctcgtcagccggccacagcctccaggataagcagtctgttgaagagacttccggagaagggcctgaggttgagatggagagctggcaaaagcgatatgattctttgcagaagatcgtggagaagcaacagcagaaaatggaccagctccggtctcaggttcagagtctcgaacaggaggttgcccaggaggaaggcacttctcaagccctccgggaagaggctcagagacgagacagcgccctgcagcagttacggaccgccgttaaggaattgtctgtgcagaaccaagatttaatcgagaagaatctgacactgcaagagcatttgcgccaagcacagcccggcagccctccgtcccctgacacagcccaactagcgctagaactgcaccaggagttggcttcatgcctccaagatctgcaggccgtttgcagtattgtgacacaacgggcccagggtcatgatccaaacctgagcctgctgctcgggattcatagtgctcagcaccccgaaacccaattggacttgcagaagccggatgtgatcaagcgtaagttggaggaagtgcagcagcttcgcagggacattgaggacctccggacaaccatgtccgatagatacgcccaggatatgggggagaattgcgtcacccagtag

SEQ ID NO: 26116 - DNA, 531 bp, Artificial Sequence
  Description of Artificial Sequence: Synthetic coding sequence
atggccgccgccaccggcgaccccggcctgagcaagctgcagttcgccccctttagttctgcactggacgttgggttttggcatgaactcactcaaaagaagctcaacgagtatagacttgacgaagctccaaaagatattaaggggtattactacaacggggatagtgccggtcttccagccaggctaacactggaattctcagcttttgatatgagcgctcctaccccagcgcggtgctgtccagcaattggaaccctctacaacaccaatacgcttgagtctttcaagacagcggataagaaactcctcctggaacaagctgcgaacgaaatctgggagagtataaagagcggcacagccctcgagaatccagtgctactgaataagttcttgcttctgacattcgccgatcttaagaagtaccacttttattattggttctgttacccggctctttgccttccggaatcactgcctctcatccaagggccagtcggtttggaccaaaggttctccctcaaacagtag

SEQ ID NO: 26117 - DNA, 1443 bp, Artificial Sequence
  Description of Artificial Sequence: Synthetic coding sequence
atgaagctgaaggagctggagcggcccgccgtgcaggcctggagcccagcaagccagtaccccctttacctggctacgggcacgtccgcccagcaattagactccagtttcagtacaaatggcactttagagatttttgaagtggatttcagggacccaagccttgacttgaagcatcgtggtgtcctaagcgctttgagtcgctttcataaactcgtttgggggagcttcggtagcgggctgctggagagcagcggtgtaatagtgggcggcggcgacaacggaatgctgatcttgtacaatgtgactcatatattatcttctggaaaagagccagtcattgcccaaaaacaaaagcacacaggtgcagttcgagcactggatctgaatccattccagggaaacctgctggccagcggagccagtgatagtgaaatcttcatctgggatctgaataatctcaatgtgccgatgaccttgggctcgaagtctcagcaaccccccgaggacatcaaagctctgtcgtggaacaggcaggcccagcacattctgagctccgctcaccccagtggcaaggccgtggtgtgggacttgagaaaaaatgagcccattattaaggtgagcgaccattctaatcgaatgcactgcagcggtttggcttggcaccctgatatcgccacccagttggtactttgctccgaagacgatcggttgcccgttatccagctgtgggatttgaggtttgccagcagccctctgaaggtcctcgagtcacacagccgcggcatcttgtcagtctcctggtcacaggccgatgcagagctgctgctgaccagcgctaaagacagccagattctttgtcggaacctcggctccagcgaagtggtatacaaactaccaactcagagttcctggtgcttcgatgtacaatggtgccccagggatccctctgtatttagcgccgctagcttcaacggttggatcagcctctattccgtcatgggccgcagttgggaagtacagcatatgcggcaggccgataagatctcatcaagtttttctaaagggcagcccttgccacctcttcaagtccccgagcaggtggcccaagctcctctcatcccacctttgaagaagcctcctaaatggattagacgacctacaggtgtgtccttcgcctttggaggcaagctggtcacattcggcctgccatccacccccgcgcatctcgtacctcagccctgccctcgtctagtcttcatctcccaagttaccacagaatcagagttcttaatgcgttcagctgagctgcaagaggccctggggtccggcaacctgctcaattattgccagaataagagccaacaggccctattgcaatccgaaaaaatgttgtggcagtttctcaagccagccagggacagcagtggggcccgtagatag

SEQ ID NO: 26118 - DNA, 1842 bp, Artificial Sequence
  Description of Artificial Sequence: Synthetic coding sequence
atggccaccatccccgactggaagctgcagctgctggcccggcggaggcaggaagaggccagcgtgcggggacgggagaaggccgagagagagcgattatcccagatgccagcgtggaagcgcggccttctcgagcggaggagagccaagctgggtctcagcccaggggagccatcaccggttctggggaccgtggaggcaggtccccctgacccagacgaatcagccgtgctgcttgaggccataggccctgtgcaccaaaacagattcatcaggcaagagcgacagcaacagcagcagcagcaacagcgttccgaagagctcttggctgagcgcaagccagggccattggaggcacgggagaggagacccagccccggggaaatgagggatcagtcccctaaggggcgggagtcccgcgaagagagactgagtcccagagagacaagggagcgcagactgggaatagggggagcccaggagctgagtctccggccccttgaggcacgagactggcggcagtcgcctggcgaggttggcgataggagcagtcgattgtcagaggcttggaaatggagactttcacccggggagactcccgagagaagccttcgtttagccgagagtagagagcagtctccaaggcgcaaggaggtggagtctcggctctcacccggcgagagtgcctatcaaaagctcggactgactgaagcgcacaagtggaggccagatagccgggagtctcaggaacaaagtctggtccagctcgaagccaccgaatggcggttacggagcggcgaggaacgccaggattattccgaggagtgcggtcgcaaggaggaatggcctgtgccaggggtagcacctaaggagaccgccgagctcagcgagaccttgaccagagaagcccaggggaattctagcgcaggagtagaggctgcagaacaacgtcctgtggaagacggagagcgcggcatgaagcctacggaaggctggaaatggactttgaattctggtaaggcacgggagtggacaccaagggatatcgaagcacagactcagaaaccagaacccccagagtccgccgaaaagttgctagaaagtccaggggttgaagccggagagggcgaggcggagaaggaagaggctggcgcccagggaagacccttgagagctcttcaaaactgttgttctgtaccgtccccgctccctcccgaggacgctggaacaggtggactcaggcagcaggaagaggaagctgtcgagctgcagccacctcccccggcacccctgtcaccaccgccacctgcccccacagcaccgcagccaccaggagatccactgatgagtcgcctcttttacggcgtcaaggctggacccggggtcggggcaccccggcgttccggacacacgttcaccgtgaatcctagaaggagcgttcctcctgcaactcctgcgaccccgacctctccagctaccgttgacgcagccgtgcctggcgctggcaagaagcgctatcccacagccgaggaaatactggttctgggaggttacctcagactctccaggtcatgcttagcaaagggaagccccgagcgtcaccacaaacagctgaagatttccttcagtgagactgccttagaaacaacctaccagtacccctcagaaagctctgtattggaagagttggggcccgagcccgaggtgccttcagcacccaatcccccagccgcccaacccgacgacgaagaggacgaggaggagctcttacttcttcagccggaactgcagggcggcctgcgcaccaaagccctgattgtggacgagtcatgcagaaggtag

SEQ ID NO: 26119 - DNA, 1446 bp, Artificial Sequence
  Description of Artificial Sequence: Synthetic coding sequence
atggccagcgccgccagcgtgaccagcctggccgacgaggtgaactgtcctatctgccagggaaccttgagggaacctgttacaatcgattgcggccacaacttctgtcgcgcatgcttaacacgctattgcgaaattccaggccccgatttagaggaaagcccaacttgcccactgtgcaaagagccatttcgtcccggtagctttcgcccaaactggcaactggccaacgtggtggaaaatatcgagagacttcaacttgtgtctacgctgggactgggcgaagaggatgtatgtcaggaacacggagagaagatttatttcttttgtgaagatgatgagatgcagctgtgtgtcgtgtgtcgggaagccggcgagcacgcaacacacacgatgaggttcctagaggacgccgccgcaccttatcgcgaacagattcataagtgcctcaagtgcctgcggaaagaaagagaggagatccaggaaattcaaagtcgagagaataagcgaatgcaggtcctccttacccaggtttccactaagcgccagcaagtcattagcgaatttgcccacctccggaagttcctcgaagagcagcaatcgatactgcttgctcagctggagtctcaggatggagatatcctgcggcagcgggacgaatttgacttattggtagcaggcgaaatttgtaggttctcagcccttatcgaggagctcgaggaaaaaaacgagcggccggcaagagaactattaacagatataaggtctaccctcattcgttgtgagactcgcaaatgtcggaaaccggtggccgtatcccctgagctcggccaaaggatccgggacttcccccagcaggcgctgcccctgcaaagagaaatgaagatgttcttggagaagctatgctttgaactggattacgagccagctcacatctcactggaccctcagaccagtcacccgaaacttctgctgagcgaagaccatcagagggcccaattcagctacaaatggcagaattcccctgacaatcctcagcgatttgacagagcaacttgcgtcctggcccatacaggcattaccggagggagacatacctgggtggtctctattgatttggcgcacgggggatcatgcacagtcggcgttgtcagcgaggacgtacagaggaaaggggagctgcgactcagacctgaggagggagtgtgggccgtccggctggcctggggattcgtatctgccttggggagctttcccactcgactgacgctgaaagagcagcctagacaagtgagggtgtcactggattacgaggtggggtgggtcactttcacaaatgcagtcaccagggaacctatatacacgtttacagcttcctttaccagaaaagtgatcccgtttttcggactctggggccgcggctcaagcttctctctgagcagctag

SEQ ID NO: 26120 - DNA, 537 bp, Artificial Sequence
  Description of Artificial Sequence: Synthetic coding sequence
atgagcagcaacgagtgcttcaagtgcggccggagcggccactgggcccgcgagtgtccaactgggggaggaaggggtcgcggtatgcgcagtcggggtagagggggctttacatcagaccggggatttcagtttgtgtcaagttctctgcccgatatatgctacaggtgtggagaatcaggacatctggccaaggattgtgaccttcaagaagatgaggcctgttacaactgtggtcggggaggacacatcgccaaggactgcaaagaacctaaacgggagcgagagcagtgttgttataattgtgggaagcctggccacctggccagggactgtgatcatgccgacgaacagaagtgttatagctgcggtgagttcggtcatatacaaaaggactgcacaaaggtgaaatgctatcgctgcggcgaaactggacacgtggcaatcaattgctcaaaaactagcgaggtgaattgttatcgctgcggagaatcaggacatctcgcccgcgaatgcacgatagaagcgaccgcttag

SEQ ID NO: 26121 - DNA, 87 bp, Artificial Sequence
  Description of Artificial Sequence: Synthetic coding sequence
atggccatggcccccagccccagcctggtgcaggtgtacaccagcccggcggcagtcgctgtgtgggaatggcaggatggcctctag

SEQ ID NO: 26122 - DNA, 603 bp, Artificial Sequence
  Description of Artificial Sequence: Synthetic coding sequence
atggccgccaccgcccgggaggacggcgccagcggccaggagcggggccagcggggttgcgaacactatgacaggggatgcctgctcaaagccccttgttgtgataaactgtacacatgcaggctctgccacgataataacgaggatcatcaacttgaccgattcaaggtgaaggaagttcaatgtatcaattgcgaaaagatacagcacgcacagcaaacctgtgaggagtgctcaactctgtttggggagtactattgcgatatctgtcacttgtttgataaagacaagaaacaataccattgtgaaaactgtgggatctgtcgaattgggcctaaggaggacttctttcactgcttgaaatgtaacctctgtcttgccatgaacctgcaaggcaggcataaatgtatcgagaacgtatccagacagaactgccccatctgcttagaagatattcatacctccagagtggtcgcgcacgttctcccctgcggccacctgctgcacagaacgtgttatgaagaaatgctcaaagagctacaaatgtccataatgtacgcgctttgcttccgatatgatcaggttcttgaaaccgccggatag

SEQ ID NO: 26123 - DNA, 567 bp, Artificial Sequence
  Description of Artificial Sequence: Synthetic coding sequence
atggccacccccctgggctggagcaaggccggcagcggcagcgtgtgcctagccttggatcagctccgggacgtgatcgagtcacaggaggagttgatccatcagctgaggaatgtcatggtgctgcaggatgaaaactttgtcagtaaggaagagtttcaagctgtggagaaaaaactggtggaggaaaaggctgcccacgccaaaacaaaggtgctgcttgccaaggaggaagaaaagcttcagttcgcactgggggaggtcgaggtcctgagtaagcagctggaaaaggaaaaactggcctttgaaaaggctctgtctagcgtcaaaagcaaagtcctgcaggaatcaagcaagaaagatcagttgattactaaatgtaatggccggagagaggcccgtgccctgcaccacggttatatcaacggactatttcctaaccatccagtgccagtgagcaaagctggtttccatagtaatacgtgcccccagctgcggattcaggctggccctggtgggccgcacctgagaaaaggcctgaaaggcccaggcaggcctcgtaaatag

SEQ ID NO: 26124 - DNA, 381 bp, Artificial Sequence
  Description of Artificial Sequence: Synthetic coding sequence
atggaccggagcaagcggaacagcatcgccggcttccccccccgggttgaaagactggaagaatttgaaggcgggggggggggagaaggaaatgtgtcacaagtgggccgggtctggccctcttcctaccgtgcgctgatatcggcctttagcaggctgacccggctggacgatttcacctgcgaaaagataggttccggcttcttctccgaagtgtttaaggttcggcaccgggcgtcaggtcaagtcatggccctcaagatgaacaccctcagctcgaatagggcaaatatgctcaaggaggtccagctgatgaatcgactgtctcatcccaatattctacgctgtaggtcaatgaaccagaattttagcccgaattag

SEQ ID NO: 26125 - DNA, 1443 bp, Artificial Sequence
  Description of Artificial Sequence: Synthetic coding sequence
atggagaccgacctgaacagccaggaccggaaggacctggacaagttcattaagttttttgcattgaaaacggtccaggtgattgttcaagcgcggctcggggagaaaatctgcacacgatccagcagttcgcccaccggtagtgactggttcaacctggccattaaagatatacctgaagtcacacacgaggccaaaaaagccttggcaggccaattacccgccgtcggacggtccatgtgtgttgagatcagtctgaaaacatcagagggggactcgatggagctcgagatctggtgtctggaaatgaatgagaaatgcgataaggagattaaagtttcctatactgtctacaatcgactaagcctgctactgaagtctctgctggctatcactcgcgtgacgccagcctatcgcctatccagaaagcagggccatgagtacgttatcctatatcggatctattttggagaagtccagctgtccggcctgggcgaaggcttccagacagtgcgagtggggaccgtgggcacgcctgttggcactataactctttcttgcgcttacaggatcaacctggcattcatgagcacaaggcagttcgaaaggacaccccccataatggggataatcattgaccactttgtggataggccatatccttcatcaagtcctatgcacccatgtaattacagaacggctggcgaggacaccggggtaatatatccttctgtggaggactctcaggaagtgtgtaccacctcatttagtacttctccaccctcacagcttatggttcccgggaaggagggaggcgtgcctctcgcacctaaccagcccgttcacggaactcaggctgatcaggagcgattggcaacttgcacaccatcagataggacacactgcgcagctacaccctctagttcagaggacactgaaacagtgtcgaacagctcagaggggcgcgcatctccacacgacgtcctggagacaatctttgtgcggaaagtgggagcatttgtgaataagcccattaaccaggtgactttaacgagcttggacattccctttgcaatgttcgctcccaagaaccttgaactggaagatacagacccgatggtcaacccacctgatagtcccgaaacagagtccccactgcaggggagcctgcactcagacggatctagtggcggatcttcaggaaacactcatgatgacttcgtcatgatcgacttcaagcctgctttcagtaaggacgacatcctgccaatggacttgggcaccttttatcgggagtttcagaacccacctcaactgtcaagcctgtctattgacattggggcgcaatccatggctgaggatctagattcactaccagagaaactggccgtgcacgagaagaacgttcgcgagtttgacgcgtttgtggaaacactgcagtag

SEQ ID NO: 26126 - DNA, 390 bp, Artificial Sequence
  Description of Artificial Sequence: Synthetic coding sequence
atggccgagctgatccagaagaagctgcagggcgaggtggagaagtatcagcagctgcagaaggacttgtctaagtccatgtcaggacggcagaagctcgaagcccaactcaccgaaaataacatcgtaaaagaagagttagctctgctcgatgggtcgaatgttgtgttcaaactcctgggtcctgtgttggttaaacaggaactcggcgaggctagagctacagtaggaaagaggctagactatatcacagccgaaattaaacgctatgaaagccagcttagagacctggaaaggcaatcagaacagcagagagagaccctggcccagctgcagcaagaattccaaagagcccaggccgcgaaggcaggagccccaggtaaagcatag

SEQ ID NO: 26127 - DNA, 348 bp, Artificial Sequence
  Description of Artificial Sequence: Synthetic coding sequence
atggtggaggacgagctggccctgttcgacaagagcatcaacgagttctggaacaagtttaagagtaccgacacctcctgccagatggcaggtctgcgtgatacctataaagactccatcaaagccttcgctgaaaagctctctgttaagttgaaagaagaggaaagaatggtcgagatgttcttagaataccagaatcagatcagcagacagaacaaactgatacaggagaagaaggacaacctgctgaagttgatcgccgaagtaaaagggaaaaagcaggaactggaggtcctgaccgccaatattcaagatttaaaggaggaatattcccggaagaaggaatag

SEQ ID NO: 26128 - DNA, 402 bp, Artificial Sequence
  Description of Artificial Sequence: Synthetic coding sequence
atggccagcagcgcccgggagcacctgctgttcgtgcggcggcggaatccccagatgagatacactttatctccagagaaccttcagtcgttggccgcccagagctcaatgcccgagaatatgaccctgcagcgggctaactcagacaccgacctggtgacctccgagtccagaagctccctaaccgcgagtatgtatgagtacactctgggccaggcccagaatctgattatcttctgggacatcaaggaagaagtggatccttcagattggatcggattatatcacatcgacgagaacagccccgccaatttttgggacagcaagaatcggggcgtgacaggtactcagaagggacagatcgtctggcgcatcgagcctggtccgtatttcatggaatag

SEQ ID NO: 26129 - DNA, 264 bp, Artificial Sequence
  Description of Artificial Sequence: Synthetic coding sequence
atgagcctgttcggcaccaccagcggcttcggcaccagcggcacctctatgttcggctccgccacaactgacaaccacaaccccatgaaggacatcgaagttaccagttcccccgacgactccataggctgcctgtcattctctcctcccactttgcctggcaattttctgattgcaggtagctgggcgaacgatgtaaggtgctgggaagttcaggattcagggcagactattcccaaggcacagcagatgcacaccgggtag

SEQ ID NO: 26130 - DNA, 1329 bp, Artificial Sequence
  Description of Artificial Sequence: Synthetic coding sequence
atggccaacagcttcgccgcccggatcttcaccaccctgagcgaccttcagactaatatggcgaatctcaaagtgataggcatcgtgattgggaagaccgacgtaaagggctttcctgatcggaagagtattggatccgagagatacaccttttcttttactattcgcgattcacctgctcactttgtaaatgcggcttcgtgggggaacgaggattatatcaaatctctttctgatagcttccgggtcggagattgcgtgatcatcgagaatccccttatccaacgaaaagagatagaacgcgaggagaagttcagtcctgcaacaccctctaactgtaaactgcttctctcagaaaaccatagcacagtgaaggtttgtagttcctatgaggtggatacaaagctgctaagcctaattcatctgccggttaaggaatctcatgactactacagcctgggcgacatcgtagccaatggacactcccttaacgggaggatcataaacgttctggccgcagtgaaaagcgtcggagagccaaagtacttcacaacctctgacagaagaaagggacagcgatgtgaggtccgcttgtacgacgagacagagagttctttcgctatgacttgttgggacaatgagtccattctgttagcacagtcatggatgccccgtgagaccgtgatcttcgcatccgacgtcaggataaattttgacaaattcagaaactgcatgacagcaactgtgataagcaagacaatcatcaccactaacccagatattccagaggctaatattctgctgaacttcattagggaaaacaaagaaacaaacgttctcgacgacgaaattgactcctatttcaaggaatctatcaacttgagcacaatcgtcgacgtctatacagtggaacagctcaaaggaaaagctctcaagaatgaaggtaaagctgacccaagttatggaattctatacgcctatatcagtaccctgaacattgacgatgaaactacaaaggtcgtaaggaacaggtgttctagctgtggatacatagtgaatgaagcttccaatatgtgtacgacctgtaacaagaacagccttgactttaaaagcgtcttccttagtttccatgttttaattgatctgacagaccacactgggactctgcatagttgctctctgacggggagcgtggccgaagagaccctaggctgtacttttgtgctatcccacagggcaaggtccggcctcaagattagcgtgctttcatgcaaactagctgacccaaccgaagcaagccgaaacctgagtggacaaaagcatgtctag

SEQ ID NO: 26131 - DNA, 651 bp, Artificial Sequence
  Description of Artificial Sequence: Synthetic coding sequence
atgaacaaccagaagcagcagaagcccaccctgagcggccagcggttcaaaacaagaaagagggatgaaaaggagcggtttgatccaacccagtttcaggattgtattatccagggcttgaccgaaaccgggaccgacctggaggccgtcgcaaagtttctggatgcctccggcgccaaactcgactataggcgctatgcagagaccctgttcgacatcctcgtggcaggtggaatgctggcgccgggcggtacccttgcagacgatatgatgcggactgatgtgtgtgtgtttgccgctcaggaagatctcgagactatgcaagcttttgcccaggtcttcaataaattgatacgtcggtacaagtacctagagaagggattcgaggacgaagtgaagaaactcctcctgtttctaaagggctttagcgagtcggagcgaaataaattggcaatgcttacgggagtcctcctggccaatgggaccctgaacgcaagcatcttgaactcattatataacgaaaatttagttaaggaaggagtcagcgctgcctttgctgtgaaactgttcaaaagttggatcaacgagaaggatatcaacgctgtcgcggcctctctgagaaaagtctcaatggataaccgcctcatgtag

SEQ ID NO: 26132 - DNA, 429 bp, Artificial Sequence
  Description of Artificial Sequence: Synthetic coding sequence
atgaacgaggtggtgcacaccagccccaccatcggcagcaacgtggaggagatcgtgataaacaacacaaggtttctgatgtgggacattggggggcaggagagcctccgctctagctggaacacatattacaccaacactgaattcgtcattgtagtcgtggactctaccgacagagagcggatttccgtgacccgggaagaattatacaagatgctcgcccacgaggatctacgtaaggctggtctgttaatttttgccaacaagcaagatgtcaaggagtgcatgaccgtggccgaaatttcccagtttctgaaactgacctcgatcaaggatcatcagtggcacatccaggcctgttgtgctctcacgggcgaaggattgtgccagggactcgaatggatgatgtctcggctgaaaattaggtag

SEQ ID NO: 26133 - DNA, 447 bp, Artificial Sequence
  Description of Artificial Sequence: Synthetic coding sequence
gccatccacatcctggacgtgctggtgctgaacggcaccgacgtgagggagcagcatttcaaccagcggatccagctcgcagaaaaatttgtgaaggctgtgagcaagccatcccggcctgacatgaatcctattagggttaaagaggtataccgcctggaggaaatggagaaaatatttgtgaggttagagatgaaaattatcaaagggagcagtggcacgcctaaactctcatacacgggcagggatgaccggcacttcgtgcccatgggactgtatatcgtacggacggttaatgagccatggacaatgggattctccaagtccttcaaaaagaagtttttttataacaagaagactaaagactcgacttttgatctaccatattaccctttcccttctttctttttccccaatcgtcgatataacctgctgctgttcgtgtag

SEQ ID NO: 26134 - DNA, 300 bp, Artificial Sequence
  Description of Artificial Sequence: Synthetic coding sequence
atggaggagatccccgcccaggaggccgccggcagcccccgggtgcaattccagtcactggaaacacaatccgaatgtctgtctcctgagccccagtttgtgcaagacactgacatggaacaaggactgactggggggatcttgctgcggctgccaactactagaatacactccgtgaactcttgtcctgccctgtcgcatacccaagcctctgctttctccggcgagacccttgctgtgctgacagccggtatcagcaagagatggcctaaataccgattgcccatcgacatcgcatag

SEQ ID NO: 26135 - DNA, 2493 bp, Artificial Sequence
  Description of Artificial Sequence: Synthetic coding sequence
atgaagcggggccggctgcccagcagcagcgaggacagcgacgacaacggatctctctccactacctggagccagaactcacgaagtcagcatagaaggtcatcctgtagccgccatgaggatcgtaagcctagtgaggtattccgaaccgacctcattacggctatgaagctacacgattcataccagctgaatccagacgagtattatgttctagccgatccttggcgccaggagtgggaaaaaggagttcaggtccccgtctcacccggcactatccctcagcctgtggctagaccaaagaaatatatcgtgtcatctggtagcgaaccacctgagcttggttacgtggatatccgaaccttagccgatagtgtttgccgatacgatcttaacgacatggacgctgcctggttggagcttaccaacgaagagtttaaggagatgggcatgcctgaactcgacgagtacaccatggaacgggtgctggaagagttcgagcaaagatgctacgataacatgaaccacgctattgagacggaagaaggactcggtatcgaatacgatgaggacgtcgtgtgtgacgtgtgccagtccccagacggagaggatggtaatgagatggtgttttgcgataagtgtaatatttgtgtgcatcaggcttgctacggcatcctgaaggtgcccgaaggaagctggttatgcagaacatgcgctctgggtgtgcagccgaagtgtctcctgtgccccaagaaagggggtgccatgaagcctacacgctccggcacaaaatgggtgcatgttagttgcgcactttggatccctgaggttagtattggttcacctgaaaagatggagcctattaccaaggtgagtcatattcctagcagccggtgggccctggtctgcagcttgtgcaatgagaagttcggcgcgtccatacagtgttccgtaaagaactgcagaactgctttccatgtcacctgtgcgttcgaccgtggtctggagatgaaaacaattctagcggaaaatgatgaagtcaaattcaagagttactgtcctaagcatagctcgcatcgaaagcctgaggagagccttggcaaaggagctgcccaggagaacggagcacctgaatgctctccccgcaatccacttgaaccatttgcatccctcgaacagaaccgggaggaggcccatagggtcagtgtgaggaaacaaaaactccaacagttggaggacgaattctatacctttgtgaatttactggacgttgcgcgagctctgcgcctgccagaagaggtcgtcgattttctgtatcaatactggaaattaaaacggaaggttaacttcaataagccattaattactcccaaaaaggacgaggaagataacctagctaagcgcgagcaggacgttttatttcggagactgcagctgtttacgcatcttcgccaggacctggaacgggtaagaaacttgacatacatggtcacgagacgcgagaaaatcaaacgttctgtgtgcaaagtccaggaacagattttcaatttgtataccaaactgctggaacaggaacgcgtcagcggtgtccccagcagttgctcctcctcctcacttgaaaatatgctgctctttaattctcccagcgtcggcccagacgcgcccaagatcgaagatctaaagtggcactccgcctttttccggaagcaaatgggaaccagcctggttcattctttaaagaaacctcacaagagggatccattgcagaatagtcccggctctgaagggaaaactctgctgaagcagccagacctgtgcggaaggcgtgagggtatggttgtgcctgaatcattcctgggactggagaagacattcgctgaggctcgcctcatatcggcacaacagaagaacggcgtggttatgcctgaccacgggaagagaagggacaatcggtttcattgtgatttaattaagggtgatctgaaggataaatccttcaagcagtctcacaaaccgttacgcagcaccgatgttagccagaggcatctggacaataccagagccgccacgagtcccggagtgggccaaagcgcccccggaactagaaaagaaattgtacctaagtgtaatggctccctgatcaaagtcaactataaccagacagctgtcaaagtgcccacaacgccggcgagtcctgtcaagaattggggaggtttccggatacctaagaaaggtgaacgccaacagcaaggagaagctcacgacggggcctgtcatcagcacagtgactacccttaccttggactgggccgcgtccccgcaaaggagagggctaagtcaaagctcaagtcggacaacgaaaatgacggctacgtgcctgacgtcgaaatgagtgattccgaaagcgaagcttccgaaaagaaatgtattcatactagttctacgatttcccgccggaccgatatcatacgtagaagcatccttgcttcatag

SEQ ID NO: 26136 - DNA, 402 bp, Artificial Sequence
  Description of Artificial Sequence: Synthetic coding sequence
atggccagcgaggacatcgccaagctggccgagaccctggccaagacacaggtggccgggggccaactcagtttcaagggaaagtctctgaagctcaataccgccgaggacgcaaaagacgtaattaaagaaatcgaagactttgacagcttagaggcattgagactggagggaaacactgttggcgtggaggcagcccgggtaatcgctaaagcccttgagaaaaaatcggagctgaagaggtgtcactggagcgacatgttcaccggtcggttgaggactgagatccctccagctctgatcagcctgggcgagggcctcatcaccgcaggggcacaactggtggagctggacctctccgacaatgcttttggtcccgatggcgtccaaggcttcgaatag

SEQ ID NO: 26137 - DNA, 390 bp, Artificial Sequence
  Description of Artificial Sequence: Synthetic coding sequence
atgagccccggcagcggcgtgaagagcgagtacatgaagcggtaccaggagccacgctgggaggaatatggcccctgttaccgggagcttctgcattataggcttggacgccggctcctggagcaggcccatgctccatggctgtgggacgattgggggcccgcgggaagcagcgaggattcagcgagcagcgaaagcagtggggccggggggcccgctccccgctgcgcaccacccagcccacctcctccggtggagcctgcaacccaggaagaagccgagaggcgcgcacgcggagccccggaggaacaggacgcagaagccggcgacgctgaagctgaggatgcggaagacgctgccctgcccggcaacgcatggcttcgaacctag

SEQ ID NO: 26138 - DNA, 390 bp, Artificial Sequence
  Description of Artificial Sequence: Synthetic coding sequence
atggccgagctgatccagaagaagctgcagggcgaggtggagaagtaccagcagttgcagaaggacctgtctaagtctatgagcggccgccagaagctggaagcacagctgaccgagaacaacatagtaaaagaagagctggccctgctcgatggctctaacgttgtatttaagctcctggggccagtgcttgtaaaacaggaattgggggaggcccgcgccactgtgggtaagcgactggattatatcactgccgagataaagaggtacgaatcacagctacgggatttggaacgacaaagtgagcagcagcgtgagacccttgcccagcttcagcaagaatttcaaagggcgcaagcggcgaaggctggggcccctggaaaagcctag

SEQ ID NO: 26139 - DNA, 402 bp, Artificial Sequence
  Description of Artificial Sequence: Synthetic coding sequence
atggccgagaagctgatcacccagaccttcagccaccacaaccagctggctcagaaaacgagaagagagaagcgggcacgccaggaagcagagagacgggaaaaggctgaaagggctgctcggctcgctaaagaggctaaatcagagacgtccggcccccagatcaaagaactgaccgatgaggaagcggagagactgcagttggagattgaccagaagaaagatgccgaaaatcatgaggcacaacttaaaaatggtagcctggacagtccagggaaacaggatacagaggaagatgaggaagaagacgaaaaggataagggaaagctgaagccaaatctcggtaacggagcggatctgccaaattaccgttggacccagacactttccgagctggactag

SEQ ID NO: 26140 - DNA, 2373 bp, Artificial Sequence
  Description of Artificial Sequence: Synthetic coding sequence
atgggcacccggaagaaggtgcacgccttcgtgcgggtgaagcccaccgatgatttcgcgcacgagatgatacggtatggcgatgataagagaagtatagacattcatctcaagaaagatatccgccgcggcgtggttaacaatcaacagaccgattggagttttaaactggacggcgttctacatgacgcttcacaggatctggtttacgaaaccgtggctaaagacgtggtatcacaagccctggacggctacaatggaactataatgtgttatggtcaaacaggggcggggaaaacatatactatgatgggtgccactgagaactataaacatagaggaattcttcctcgggctctccagcaggtcttccgaatgattgaagagcgccctacccatgccatcaccgtccgcgtgtcgtatctcgagatctataacgaatctcttttcgacttacttagtaccctgccatacgttgggccaagtgtaactccaatgactatcgtagagaatccccagggcgtatttatcaaaggcctatctgttcaccttacctcacaagaggaggacgccttctctttactattcgaaggggaaacaaaccgcataatagcctctcatacgatgaataagaattcctcaaggtcccactgtatcttcactatctacctcgaggcacatagtagaactctatctgaagaaaagtacatcacctctaagataaacctcgtcgatcttgcaggatcagaaagactcggaaaatctgggagcgaagggcaagtactcaaggaggcaacctatatcaacaagagcctttcattcctggaacaggccattatcgctcttggcgatcagaagagggaccacatcccattccggcagtgcaagctcacccatgcacttaaagactctttaggcggcaattgtaatatggtcttggtgacgaatatctacggggaggcagcacagctcgaggaaaccctctcctccctgcgattcgcaagtagaatgaagctggtaactaccgagcccgctataaacgaaaagtacgatgcggagcggatggtcaagaatctggaaaaggaactcgctttgcttaagcaagagctggccatccacgattcactaacgaatagaacatttgttacatatgaccccatggatgagatccaaatcgccgagatcaactctcaggtgaggcgatatctcgaaggcactctcgatgagatagacattatctctcttaggcagataaaagaagtgttcaaccaatttagggttgtacttagtcagcaagaacaggaggtggaaagtaccctcagacgaaaatacacgcttattgacaggaatgactttgcggctatttccgccatccagaaggccgggttagttgacgtcgacggacacctcgttggggagcctgaggggcagaatttcgggctcggagttgctcccttctccacaaaacctgggaagaaggcaaaaagcaagaagacatttaaggaaccactctctagcctggctcggaaggagggagcttctagccctgtgaacggtaaggatctggactacgttagcaccagtaagacgcagctcgtgcctagttctaaagacggggatgtcaaagacatgctctcgagagacagagaaacaagctccatcgaaccactgccgtctgatagtccaaaggaggagctcaggcctatccgcccagataccccccccagcaagcctgtggccttcgaagagttcaagaacgagcaggggtccgagattaacaggatctttaaggagaacaaaagtatcctaaacgaacggcgtaaaagggcttccgaaactacccagcatatcaacgcaatcaagcgagaaatagacgtgaccaaagaagccctaaacttccagaaaagtctgcgtgaaaagcagggtaaatacgaaaacaagggtctcatgatcatagatgaggaggagtttctactgatcctgaaattaaaagatctcaaaaagcagtaccgttccgagtatcaagacctgagagatcttcgcgctgagattcagtattgtcagcatttagtggatcaatgcaggcacagattactgatggaatttgatatttggtataatgagtctttcgtgattccggaagacatgcagatggcgctgaagcccggcggaagcattagaccaggaatggttccagttaacaggattgtcagtctgggtgaggacgatcaggacaagttctcccagctgcagcagcgcgtgctcccggagggaccggatagcatttctttttataacgccaaggtgaaaatcgagcaaaaacacaattacctgaagacgatgatgggcttacagcaggcccacaggaaatag

SEQ ID NO: 26141 - DNA, 1356 bp, Artificial Sequence
  Description of Artificial Sequence: Synthetic coding sequence
atgtacggcgcccccggcgcccccgcccagagcgccagcgtgaccgtggtcaggtctctgaggcgccccccaccacaagccacaggcgtctcatttatgaataatcagaaacaacagaaaccaaccctgtctggccagaggttcaagactcggaagcgggacgagaaggagcggttcgatcccactcagtttcaagattgtatcatccaagggttgactgagaccggtactgacctcgaggcggtggccaaattcctggacgcctccggcgctaagcttgactaccgcagatacgccgaaaccctgttcgatattcttgtggccggcggcatgctcgcccctggggggactctggctgacgacatgatgagaactgacgtttgcgtcttcgccgcacaggaagacctggagacaatgcaggcattcgctcaggtgttcaataagttgataaggcgatataagtatttagaaaagggctttgaagacgaagtcaaaaagctcctccttttccttaaaggattctccgagtccgagcgcaacaagctcgctatgttgaccggcgtgcttctggcaaatggaacgctgaacgcctcgatccttaattccctgtataacgagaacctggtcaaggagggggtgtccgccgctttcgccgtgaagctctttaaatcctggatcaacgagaaggatattaatgctgtggccgccagcttaagaaaggtgtctatggataaccgtctaatggaattgttccccgctaacaagcagtctgtcgaacattttacgaagtactttaccgaggccgggctcaaggagctgagcgagtatgtgagaaatcagcaaacgatcggggcccgcaaggaactgcagaaggaacttcaggagcagatgagccgaggcgacccgttcaaggatattatcctgtatgtaaaagaagaaatgaagaaaaataatattccggagccggtggttatcggaatcgtatggtcttcagtgatgtccaccgtagagtggaataaaaaagaggaactggtggctgaacaagcgattaagcacctgaaacagtatagtccactgttagccgctttcacaactcaggggcagagcgagctgacccttctcttgaaaatccaggagtattgttatgataatatccatttcatgaaggcgttccagaagatcgtcgtcctgttttataaagccgaggtcttaagcgaagagcctatcctgaaatggtacaaagacgcccacgtagccaaaggcaaaagcgtctttctggaacagatgaagaagttcgtagaatggctgaaaaatgctgaggaggagtccgagagtgaggccgaggaaggagattag

SEQ ID NO: 26142 - DNA, 948 bp, Artificial Sequence
  Description of Artificial Sequence: Synthetic coding sequence
atggccggcggcgcccgggaggtgctgaccctgcagctgggccacttcgcgggttttgttggcgctcactggtggaatcagcaagacgctgctttaggccgcgcaactgactccaaggaaccacctggggagttgtgtccggacgtgctgtaccgtactgggcgtacattgcacggacaagaaacatacacacctcgtcttatactgatggatctgaaaggatccctgtcttctctcaaggaagaggggggcctgtatcgcgacaaacagctggatgcggccatcgcttggcagggtaagctcactacccacaaagaggagttgtatccgaaaaacccctacctgcaggacttcctcagtgccgagggcgtcctgtcgtcagatggagtgtggcgtgtcaagagcatacccaatggaaagggctcaagcccactgccgaccgctactaccccaaagcccctgatccccaccgaggctagtataagagtgtggtctgactttcttagagtccatctacaccctcgaagcatttgcatgatccagaaatataatcatgatggtgaggccggaaggttggaagctttcggacagggagagagcgttctcaaggaaccgaaataccaagaggagcttgaagaccgattacatttttacgtggaggaatgtgattatctgcaggtggtggcatggcagtgtgcactgcaagggggatcttccagccatcctgctaattatctctcgtcgctaaccccagctcagggcttccagatactgtgcgatcttcacgacggcttctctggcgttggtgctaaggccgctgagctgctacaagacgagtattccgggcggggcatcatcacatggggcttgttgcctgggccctatcatagaggagtaagcgggacatggaggtccaagcacagtaatcctatcggaagagtggcctag

SEQ ID NO: 26143 - DNA, 285 bp, Artificial Sequence
  Description of Artificial Sequence: Synthetic coding sequence
tgcaccagcagctgcacccccagctgctgccagcagagcagctgccaaccggcatgttgcactagcagtccctgccaacaggcatgttgtgtgcctgtgtgctgcaaaacggtgtgctgcaaaccgtcgtcctgccagccagcatgctgtatctcgagcccttgtcagcagtcatgctgcgtccccgtgtgttgtaagccaatatgttgcgtcccacctgcatgttgcacgacaagctgctgtaggcccagttcatctgttagtctgctctgcaggcccgtctag

SEQ ID NO: 26144 - DNA, 1221 bp, Artificial Sequence
  Description of Artificial Sequence: Synthetic coding sequence
atggccgccaacctgagccggaacggccccgccctgcaggaggcctatgttagagtagtgactgaaaagagtccaaccgactgggcattgttcacatacgaaggaaacagcaacgacatccgtgtggcaggaactggcgaaggcggcttggaagaaatggtggaggagctgaatagtgggaaggtcatgtacgccttctgtcgtgtgaaggacccaaatagcggcctccccaagttcgtgctgatcaactggggcgcacacgtgaccatcaatgcccgtgccgaagaggatgtggagccagagtgcattatggagaaggttgcaaaggcctcaggggccaactacagcttccataaggagagcggcaggtttcaggatgtgggccctcaggctccggtggggtcagtctatcagaaaaccaacgccgtctccgagatcaagagggtaggcaaagacagcttttgggcaaaagccgagaaggaggaagagaataggagattggaggagaagaggagagctgaggaagcacagaggcagctagagcaggaaagaagagagcgcgaactgagagaggccgcacgaagagagcaacggtaccaagagcagggaggggaggctagccctcagtcgcggacttgggaacagcagcaggaggttgtttcaaggaacagaaatgaacaggaaagcgcagtacatccccgcgagatattcaagcagaaagagcgtgctatgtcaacaaccagtattagttcaccacagccaggcaaacttagaagtccttttcttcagaagcagctaactcagcccgaaacacacttcggacgcgaacctgccgccgccatcagtcggccacgggctgatctgccggccgaagaacctgctcccagcacccccccttgtctggtgcaggccgaggaggaggcagtatacgaggaaccccctgagcaagaaaccttctacgagcaacccccgctggttcagcaacaaggggctggatccgaacatattgaccaccacattcagggtcagggactgtcgggacagggcctgtgcgctcgtgcgctctacgactaccaggccgccgacgataccgagatctcattcgacccagagaacttgattacagggattgaggtaattgacgaggggtggtggcggggctacgggcctgacggccacttcggaatgttcccagccaattatgtcgagttgatagagtag

SEQ ID NO: 26145 - DNA, 981 bp, Artificial Sequence
  Description of Artificial Sequence: Synthetic coding sequence
atgccccacctgcccctggccagcttccggccccccttctggggcctccgtcatagtcgcggactcccgagattccattccgtttccactcaatctgagccgcatggaagcccaatttccaggcgtaaccgagaagctaagcaaaagcggctgcgtgagaaacaggcgacactcgaagccgaaatcgcgggagaaagcaagtcacctgccgaaagcattaaggcatggaggcccaaggagcttgtcctctacgagatccctacgaagcccggggaaaagaaagatgtgagcggccccctgccccccgcttatagccccaggtatgtcgaggccgcctggtacccttggtgggtgcgcgagggattctttaagccagaatatcaggcgcgactgccacaggcaactggcgaaaccttcagtatgtgtattccccctccaaacgtgacgggcagtcttcacataggccacgccctgacagttgcaatccaggacgccctcgtgcgctggcacaggatgcgcggagaccaggtactttgggtgccgggttccgatcacgctggtattgcgactcaggctgtagtcgagaagcagctgtggaaggaacgcggcgtacgcagacatgaactctcacgcgaagcatttctcagagaggtatggcagtggaaggaggccaagggaggcgaaatctgcgaacagctgagggcccttggagctagtctggactgggatcgggagtgttttactatggatgtggggagcagtgtcgccgtgacggaagccttcgtccggctgtacaaagccggactactgtatagaaatcatcagctggtgaactggtcctgcgcccttcgctctgcaatttcagatatcgaggtggagaaccggcccctgcccgggcacacacaattacgcctacccgggtgtcccaccccagtgagttttggtctgctattctcagtggcctttccagtggatggctag

SEQ ID NO: 26146 - DNA, 684 bp, Artificial Sequence
  Description of Artificial Sequence: Synthetic coding sequence
atgctgtgctggggctactggagcctgggccagcccggcatcagcacaaacttacaggggatagtagccgagcctcaggtgtgcgggtttatttctgatcggtctgtaaaggaggtagcctgcgggggtaaccactcagtttttctgctggaggatggcgaagtctatacctgcgggctaaacacaaaagggcagctcgggcacgagcgagagggcaataaacctgaacagattggggccttagcagatcagcacatcattcacgttgcatgtggggagtcccacagcctggccctgtctgacaggggccaactgttcagctggggagccggctccgacggacagctcgggctgatgactaccgaagatagcgtcgcagtgcctaggctcatacagaaactcaatcaacagacaatcctgcaggtgagttgtggcaactggcattgcctggccttggccgctgacggccagttcttcacgtggggtaaaaattcacacgggcagcttgggctagggaaagagtttccttcacaagcttcaccccagagggtccggtccctggagggcattcctctcgctcaagtcgccgctggcggggctcattctttcgccctgagcctaagcggcgctgtgtttggctggggcatgaataatgctggtcagcttgggctgtccgacgagtag

SEQ ID NO: 26147 - DNA, 624 bp, Artificial Sequence
  Description of Artificial Sequence: Synthetic coding sequence
atgagcagccccctggccagcctgagcaagacccggaaggtgccccttcccagcgagccaatgaatcccggccgacgtggtatacgaatctacggcgatgtgccagcctcacatgattcggaactcatggcttttatgacaaggaagctttgggatctcgagcagcaggttaaggcacagactgacgagatcctctcgaaggaccaaaaaatcgccgctcttgaagatctcgtacaaacacttcggccacaccccgcagaggcgactctccagagacaggaggagctagagacaatgtgtgtgcagctacagaggcaagttcgcgagatggaacgatttctgagcgattatgggttgcagtgggtcggcgagccgatggaccaagaggacagcgaaagcaagacagtgtctgaacacggcgagagggattggatgacggccaagaagttctggaaacccggcgatagcctggctcccccagaggtggactttgaccgtctgctggcctccctgcaggacttatctgaactcgtagtcgagggagatacccaagtgacccccgtacctgggggtgcacggctgcggactctggaacccatccccctcaagctgtatcgcaattag

SEQ ID NO: 26148 - DNA, 717 bp, Artificial Sequence
  Description of Artificial Sequence: Synthetic coding sequence
atgaccgaggacagccagcggaacttccggagcgtgtactacgagaaggtcggctttagaggggtggaggaaaaaaaaagcctggaaatactgctgaaggatgaccgactggggattcttcccccccaccacgagtcacatgccaaggtgatgatgtataggaaagagcagtatctggatgtcctccacgcacttaaagttgtcaggtttgtctctgacgcgacaccacaggccgaggtgtacctgcgtatgtaccaactcgaatcaggaaaacttcctcggtcaccttccttccctctagaaccagatgatgaggtgttcctagcgatagccaaagccatggaagaaatggttgaggatagcgttgattgctactggattacaagacgctttgtgaaccaacttaataccaaatatagggatagtctgcctcagctgccaaaggccttcgaacagtatctgaacttggaagatgggcggctcctgacacatctcagaatgtgtagtgctgcaccaaagttaccctatgatctatggttcaagaggtgtttcgcggggtgtttgcctgagagctctctgcagagagtctgggataaggtggtttctggctcatgcaagattctggtgtttgttgcggttgagattctcctcaccttcaaaatcaaggtaatggccctgaattctgccgagaagatcaccaaatttctggagaattag

SEQ ID NO: 26149 - DNA, 369 bp, Artificial Sequence
  Description of Artificial Sequence: Synthetic coding sequence
gtgcgggagctggaggccgagctggacgccgagcagaagaagcacgctgaggctctcaagggggtgcgtaagcatgagcgaagggtgaaagaacttgcctaccaggccgaggaggatagaaaaaatctagcgaggatgcaggacctggtcgacaaactgcagagtaaagtgaagagctacaaacggcagttcgaagaagccgaacagcaagcaaacactaatttggccaagtaccgcaaggcccagcacgaacttgacgacgccgaggaaagagctgacatggccgaaacgcaggctaacaagctccgggctaggactagggacgccttgggccccaagttaagcctgtcaccacagcataaggagtag

SEQ ID NO: 26150 - DNA, 483 bp, Artificial Sequence
  Description of Artificial Sequence: Synthetic coding sequence
tgagagagcctggtgggcctgcaggagggcaagagcaccgagcagggtaatcacgatcaattgaaagagctttatagcgccggtaatctgaccgtactcgccaccgacccactactgcaccaggatccagtgcagctggacttccattttagactgacaagccaaacctccgcccattggcatgggttactatgtgatcgcaggttgttcctggatataccctaccaggcgctcgaccagggcaatcgggaatcactaacagccacactggaatacgtcgaggagaagacaaacgttgacagcgtgttcgttaacttccagaacgacagaaatgacaggggggcactcctgcgggccttctcttatatggggttcgaggtcgtaaggccagatcaccccgctctgcccccactggacaacgtcatcttcatggtctacccgctggaacgggatgtggggcacctcccttctgaacctccttag

SEQ ID NO: 26151 - DNA, 102 bp, Artificial Sequence
  Description of Artificial Sequence: Synthetic coding sequence
atgagcgtgacctacgacgacagcgtgggcgtggaggtgagcagcgattccttttgggaggtggggaactacaaacggacagtcaagcgcatcgacgactag

SEQ ID NO: 26152 - DNA, 402 bp, Artificial Sequence
  Description of Artificial Sequence: Synthetic coding sequence
atgtggagcctgaccgccagcgagggcgagagcaccaccgcccactttttcctaggggccggggacgaagggctggggacccgggggattgggatgcgccccgaggagtccgactcagagctcctggaggatgaagaggatgaggtgccaccggaaccgcagatcattgtgggaatttgcgcaatgacaaaaaaatctaagtcaaagccaatgacccagattttggaacggttatgcaggttcgattatcttactgttgtgattctcggggaggatgtcattctgaacgagccagttgagaattggccttcctgtcactgcctgatctcttttcattctaagggctttcccctagacaaggccgtggcctattctaagttgcgaaatccgttcctgatttag

SEQ ID NO: 26153 - DNA, 939 bp, Artificial Sequence
  Description of Artificial Sequence: Synthetic coding sequence
atggcccagccctacccccccgcccagtaccccccccccccccagaatgggataccagctgagtacgcaccgccaccgccacatcccactcaagactatagcggacagacgccagttcctacagagcacggaatgaccctctataccccagctcagacccacccagagcaacccggatctgaggcgagtacccagcctattgcaggaacacagactgtgccacagacggacgaagccgcccagactgatagccagcccttgcatccctctgatcctaccgagaagcagcagcctaagcggcttcacgtgtcgaacatcccatttcggttcagggatcccgatcttcgacagatgtttgggcagtttggcaaaatactagacgtggagatcatattcaacgaacgggggagtaaaggcttcggtttcgtgaccttcgagacgagttctgacgccgatcgcgcgcgcgagaagttgaacggaacaattgtggagggccggaagattgaggtgaacaacgctactgctcgcgtgatgactaacaagaagaccggtaacccctacacaaacgggtggaaactgaatcccgtggttggagccgtgtatgggcctgaattctacgccgtcacgggctttccctatcccaccactggaactgctgtggcctatcgcggtgcacatctcagaggtcggggaagagccgtgtacaacacattcagagccgctcctcctcctccgccaatcccaacttacggggctgttgtgtatcaggatggcttttacggagccgaaatttatggcggttatgccgcctaccgctacgcacaacccgccgctgccgcagccgcttatagtgacagctatggccgggtatatgcggctgccgatccatatcaccacacgataggccctgccgccacctattcgataggaacgatgtag

SEQ ID NO: 26154 - DNA, 1308 bp, Artificial Sequence
  Description of Artificial Sequence: Synthetic coding sequence
tgaagcatcctgaacagcaacgagcacctgctgaaggagaaggagctattaatcgataagcaaagaaaacatattagccaacttgagcagaaagtgagggaaagcgagctgcaagtccacagcgccctcttgggcagacccgcccctttcggagatgtttgccttctgcggctccaggagttgcagagggaaaacacttttcttcgcgcccaattcgcccagaagaccgaggcactgagtcgtgagaagattgatctcgagaaaaagttgtcggctagcgaagttgaggtgcaactgattcgcgaatcactgaaggttgcacttcagaagcactccgaagaggtgaagaaacaggaagaaagggtcaaaggcagagacaagcacatcaataacctgaaaaagaaatgccagaaagagagcgagcaaaatcgagagaagcagcagaggattgagacattggaaagatatctcgctgacttacctacccttgaagaccaccagaagcagtctcagcagttgaaggacagcgaactgaagtctacagagcttcaggaaaaggtgacagagttggagtcccttctcgaggaaacacaggccatctgccgagagaaagagatccagctagagtctcttagacagcgcgaagccgagttctctagcgccgggcattcattacaggacaagcagagtgttgaagagacaagtggtgagggacccgaggtagagatggaatcatggcaaaagcggtatgattccctgcagaagatagtggaaaaacaacagcagaaaatggaccagttgcgctcccaggtgcagtcattggaacaggaggttgcacaggaagaggggacctcacaggcccttcgagaggaggcccagagaagggactccgcacttcagcaactccgcaccgcagttaaggaactctctgtgcagaatcaggatctaatcgagaagaatcttacccttcaggaacatctgaggcaggcacagcctggaagtccccccagcccggatactgcccaactggccctggagttgcaccaggaattggcttcctgcctccaagatttgcaagctgtgtgcagtattgtgactcagcgagctcaaggccatgaccctaatctgtctctgctgctgggcattcactctcaacaccccgaaacccagctcgatcttcagaaaccagacgtgattaaacggaagctggaagaggtccagcaactccggcgcgatattgaggatttacgcaccacaatgagtgaccggtatgcgcaagacatgggagagaactgcgtgacacagtag

SEQ ID NO: 26155 - DNA, 474 bp, Artificial Sequence
  Description of Artificial Sequence: Synthetic coding sequence
atggagctgcggtgcggcggcctgctgttcagcagccggttcgactctggcaatctggcgcatgtggagaaggtggaaagcctatcctcagatggcgagggcgtgggtggcggcgcctcagccttaacctcaggaatcgctagctcgcccgattacgagttcaacgtttggacaagacctgactgcgcggagacagaattcgagaatggcaatagatcttggttttacttcagcgtgcgaggaggcatgcccggaaaactgataaagataaacatcatgaatatgaataaacaaagtaaactatacagccaggggatggccccattcgtgaggacgctgcctacacgccctaggtgggagcgcattcgggacagacccacttttgagatgacggaaacccagttcgtgctgtccttcgtgcatcgtttcgtcgagggtagaggggccaccactttttttgctttctgctattag

SEQ ID NO: 26156 - DNA, 1620 bp, Artificial Sequence
  Description of Artificial Sequence: Synthetic coding sequence
atggccaccagcgcccccctgcggagcctggaggaggaggtgacctgcagcatttgtctagactatctccgagacccggtaactatcgattgtggccacgtgttttgtcgctcttgcaccactgacgtccggcctatcagcggaagcagacccgtctgccccctgtgcaaaaaaccattcaaaaaggagaatatccgacctgtgtggcagctggcctccttagttgaaaatattgagagactaaaagtggataaaggacgccagccaggagaagtgacacgtgaacaacaggatgcaaagctctgcgaacgtcatcgggagaagctgcactactattgtgaagacgacgggaagctgctatgcgtgatgtgtcgcgagtccagggagcaccgcccccatacagccgtgctcatggagaaggcagcgcagcctcatagagaaaaaattctcaatcacctcagcacactgcgaagagatagagacaaaattcagggctttcaagcaaagggcgaggccgacatcttggctgctctgaagaaactccaggaccagagacagtacatagtggcggagtttgagcagggtcaccagtttctgcgggagcgggaggagcacctccttgagcagttggcgaaactggaacaggagctcaccgagggaagagaaaagttcaaatcgagaggtgtcggcgagctggcacggctggctctagttatctccgagctcgagggaaaggctcaacaacctgcggccgaacttatgcaagatacgcgcgattttctcaaccgctacccaagaaagaagttttgggtggggaagccgatcgcaagagtcgtgaagaaaaagactggagaattcagcgataaactcctttccctccagcggggactgcgcgaatttcagggtaaactgttgcgagatctggagtataaaaccgtgagtgtaacattggacccacaatctgcctcaggctacctccaactttcagaagattggaaatgtgtgacatatacttcattatataagtccgcatatctccatccccagcaattcgattgtgagcctggcgtgctgggcagtaaggggtttacttggggtaaagtgtactgggaggtagaagttgagagagaaggctggagtgaagacgaggaagaaggggacgaggaggaggaaggtgaagaggaggaggaggaagaagaggcagggtatggggacggctacgatgattgggagactgacgaggacgaagagagtctcggtgacgaagaggaggaggaggaagaagaagaggaggaggtgctggagagttgtatggtcggcgtcgccagggatagcgtgaaaaggaagggggacttatcattgcgccctgaagatggcgtatgggctctgcgattaagtagtagcggaatctgggcaaacacatcccccgaagccgagctgttcccagcactccgaccacggcgggttgggatagccttggactatgaggggggaacagttacctttaccaatgcagagtctcaagagctcatatacacctttacagctacgttcacccggcggcttgtgcctttcctgtggctgaagtggcctggaactaggctgctcttacgtccatag

SEQ ID NO: 26157 - DNA, 6141 bp, Artificial Sequence
  Description of Artificial Sequence: Synthetic coding sequence
atggacgaggtggagcaggaccagcacgaggcccggctgaaggagttgttcgatagctttgacacaacggggactggatccttaggtcaggaagaactgacagacctatgtcacatgctgtcactcgaggaagtggcacccgtgcttcagcagacactgcttcaggataacctgctggggagagttcatttcgaccaattcaaggaggctctgattctgatcctgtcccgtactctcagcaacgaagagcacttccaggaaccagactgtagcttggaggcacagcccaaatatgtgcgcggcggcaagaggtatggtcggaggagcttaccagaatttcaggagagtgttgaagagtttcctgaggttactgtgattgaaccgttggacgaggaggcacggccctcacacatccccgccggcgattgcagtgagcactggaaaactcagcggtccgaggagtatgaggcggagggacaattgcgcttctggaatcccgatgacctcaatgcgagtcagagtggcagttcgccacctcaggattggattgaagaaaagctgcaggaagtgtgtgaggatctaggaattactcgggatggccacttgaatcgcaaaaagcttgtgtcgatttgcgaacagtacgggttgcaaaacgtggacggggagatgttagaagaggttttccacaatcttgaccccgacggcactatgtccgtcgaggattttttctacggacttttcaagaatggaaaatcactcacgccaagtgcatctacaccctaccgacaactcaagcgccacctgtcaatgcagtctttcgatgagtcagggaggcggaccacgacctcatctgccatgacatccacgattggttttcgcgtgttctcttgtctggacgacgggatggggcacgccagtgtggagagaatcctggatacatggcaggaggagggcatcgaaaactctcaggagatcctgaaggcattggatttcagcttggatggtaacattaatctgaccgagcttactttggccctggagaatgagctgcttgtaacaaaaaattctatccaccaggcagccctcgcgagtttcaaagctgaaattaggcacctgttggagcgcgttgaccaggtggtgcgcgagaaagaaaaactccggagtgacctggacaaagctgaaaagcttaagtctctcatggccagtgaggtggatgaccatcacgcagctattgaacgccggaatgagtacaatctccggaaattggacgaggaatataaggaacggattgctgcactaaaaaacgagctgagaaaagagagggagcagatcctacagcaggctggaaagcagaggctcgagctggagcaggagattgagaaggcaaagaccgaggaaaattatatcagagacagacttgcactgtctctgaaggaaaactccagattggagaacgagctacttgagaatgcagaaaagcttgctgagtatgaaaaccttaccaacaagctccagcgcaacttagagaatgttttagcagagaaatttggagatttggatccctcatctgctgaattcttcctccaggaggaacgcctgacccagatgcgtaatgagtatgaacgtcagtgcagggttctgcaggatcaggtggacgagctgcagagtgagctagaggaataccgggctcaaggacgcgtccttcgactccctctaaagaattcaccctctgaggaagtcgaagctaacagcgggggcattgaacctgaacacgggctcgggagcgaggagtgcaatcctctgaatatgtctattgaagcggagttagtcattgaacagatgaaagagcagcatcacagggatatctgctgtctgaggctggaactggaagataaagtaaggcactatgaaaagcagctggatgagaccgtggtgtcatgtaagaaagcacaggagaatatgaagcagaggcacgagaatgaaactcacactctggagaaacaaatcagcgaccttaagaacgaaattgccgaactgcaaggtcaggcagccgtgctaaaggaggctcatcacgaggcaacgtgccggcacgaagaggagaaaaagcagctgcaggtgaagttggaagaggaaaagactcacctacaggagaagctcagactgcagcacgaaatggagctcaaagccagactgacccaggctcaggcttcattcgagagagaaagagaagggctacaatcatctgcatggactgaagagaaggtgcgtgggctgactcaggagttggaacagttccatcaggagcagctcacttcgcttgtagaaaagcatacactggaaaaggaggagctgagaaaggaacttctggaaaagcaccagcgcgagctgcaggagggtagggaaaaaatggagacggagtgtaatcgtcggacctcgcaaatcgaagcccagtttcagtctgactgtcagaaagtgaccgaacgttgtgagagtgctctacagtcgctcgagggtagatacaggcaagagctgaaggatctgcaggagcagcaacgagaggagaagagtcaatgggagttcgagaaggatgaattgactcaagaatgtgcggaagctcaggagttgttgaaggaaaccctaaaacgtgaaaaaaccacgagtctcgtgctgacacaggagcgggagatgttagagaaaacatataaagaacatctaaacagtatggtcgtggagaggcaacagctgctgcaggatctggaggatttaagaaatgtctctgagacgcagcagtcactgctgtctgatcaaatactggagctgaaaagttcccacaagcgcgaactgagggagcgggaagaagtgctctgtcaagcaggagccagcgaacagcttgcgtcacagcgcctagagcggttggagatggagcacgatcaagagagacaggaaatgatgagtaagcttctagcaatggaaaacatacacaaagccacttgtgaaaccgccgatagagagcgggcagagatgtcaacagaaatatccagactgcagtcaaaaatcaaggaaatgcagcaggctacgagccccttaagcatgctgcagagtggttgtcaagtgataggcgaagaggaggtggaaggagatggggctctatcactcctccagcagggcgaacagctgctggaggaaaatggggacgtgctgctcagtctgcagagagcccatgagcaagctgtgaaggaaaacgttaaaatggcaaccgaaatctctcgactccagcagcgattgcagaaactcgaacccggcttggtgatgagcagctgccttgacgaacccgcgactgaattcttcggaaacacagcggagcagactgaacagttcctgcagcagaacaggaccaaacaggttgagggtgttacccgcagacatgtgctttcagatctggaagatgatgaggttagagacctaggtagcaccggcacatcgtccgtgcaaagacaggaggttaagattgaggaaagtgaagcctctgttgaaggtttcagcgaactagagaacagtgaagagacgcgaaccgaaagctgggagctcaaaaaccaaatctcccaactccaggagcagctgatgatgctatgtgcggattgtgaccgggccagcgagaaaaaacaggacctgctattcgatgtaagtgtgctgaaaaagaaattgaaaatgttagagcgtatacccgaggcttcacctaagtacaaactcctgtatgaagatgtgtctcgcgagaacgactgtttgcaggaggagctcaggatgatggagaccagatatgacgaggcattagaaaacaataaggagctgacagccgaggtctttcggctccaggatgagctcaagaagatggaggaggtaacagaaacgttcctgtccctggagaagtcgtatgacgaagtcaagatcgaaaacgaagggttgaacgttttggttctgcgccttcagggcaaaattgaaaagctccaggaatctgtggtacagcgatgcgactgctgtctatgggaggcatccttagaaaatctggagatcgagcctgatggaaacattctgcaactgaaccaaacactggaagaatgtgtccccagagttagatccgtgcatcatgtgatagaggagtgtaaacaggagaaccagtacctcgaggggaacactcaactactggagaaggtgaaggcgcacgaaattgcgtggctgcacggcaccatccaaactcaccaggaacggccaagggtccagaatcaggtgatcctggaggagaacaccaccttgctgggatttcaggataagcatttccagcaccaagctactatcgctgagctggagctggaaaaaaccaaactgcaggagctgacacggaaactcaaggagagggttaccattctagtcaagcagaaggatgtcctctctcatggtgagaaggaggaggagttgaaggccatgatgcatgatctgcagataacatgctctgagatgcagcaaaaggtggagctcctgcggtatgagtctgaaaagcttcagcaagaaaacagtatccttaggaacgaaattacgaccctgaacgaggaagattcgatttcgaatttgaaacttggaaccctgaacggctctcaagaggagatgtggcagaaaacagagaccgtgaaacaggagaatgctgccgtccagaaaatggtggagaatctgaaaaagcagataagtgaacttaagatcaaaaaccagcaactggacctagagaatacagaactttcacagaaaaacagccaaaatcaggagaaactccaggaactgaatcagaggctgacagaaatgttgtgccagaaagagaaagagccaggtaactccgctctggaggaacgtgagcaggagaaattcaatctcaaggaagagttggagagatgtaaggtgcagtcctcaacactggtgagcagcctggaagctgagttaagcgaagttaaaattcagacacacatcgtccagcaagagaaccacctgctaaaagacgaactggagaagatgaagcagctccataggtgccccgacttgtcagattttcagcagaagatatcatcagtgctgtcctacaacgagaagcttctgaaggaaaaagaggctctctcagaagagctaaactcttgtgtcgacaagctagcaaagtcctcgctgctggagcatagaattgctaccatgaaacaggaacagaagagttgggagcatcagtctgcatccttaaagtcccagctggtggcaagccaggaaaaagtgcagaatctagaggatacagtgcagaatgttaacctgcagatgagccgcatgaagagcgatctgcgggttacgcagcaggaaaaggaagccctaaaacaggaggtcatgagcctccataaacagttgcagaacgcaggcgggaaatcctgggcccctgagattgccacccacccaagcggtctacataaccaacagaagcggctcagctgggataaattggatcaccttatgaatgaagagcagcaactgctgtggcaggaaaacgagcggctgcagacaatggttcaaaacactaaggcagaactgacacattcccgcgagaaggtcaggcagctcgagagcaacttgctgcccaaacatcagaagcatctgaacccatccggcaccatgaaccctactgaacaggaaaagctgtccctaaagagagagtgcgaccagtttcaaaaagagcagtcgcccgctaatcgtaaggtgtctcaaatgaacagcctggaacaggagctcgagaccatacacctggagaacgaaggcctgaagaagaaacaagtgaagcttgatgagcagctgatggagatgcagcacttaaggtcaacagccacaccgagtccttctcctcatgcatgggatctccagctgctgcaacagcaggcctgccctatggtacccagggaacagttcctgcagctgcagcgccaactgctccaggcggaaagaattaaccagcacttgcaggaggagctggagaatcgaactagtgagaccaatacccctcaagccctgcttcccgaacagcgggccgttcatgccgattcgtacagaaggatcgggcatctgtag

SEQ ID NO: 26158 - DNA, 1203 bp, Artificial Sequence
  Description of Artificial Sequence: Synthetic coding sequence
atggccggcgagaaccaccagtggcagggcagcatcctgtacaacatgttaatgtcagcaaagcaaactcgggctgcacccgaagcgcccgagacccgattggtggaccagtgctggggctgcagttgtggcgacgaacctggtgtaggtagagaagggcttctcggcggtcggaatgtggctctgctgtaccgctgttgtttttgtggaaaggaccatccaagacaaggatctattctctactcaatgctaacatctgcgaaacagacctacgcggccccaaaggctccggaggccactctgggcccttgctggggttgcagttgcggctcagaccctggcgtggggagggccgggttgcctggtggtcggccagtagcgcttctgtatcggtgctgtttctgcggtgaggaccacccaaggcagggttctatcctctattcactcttgacatcttccaaacagacacatgtcgctccagccgcacctgaagccagaccaggcggggcttggtgggaccgcagctatttcgcacagaggccgggcggtaaggaagcccttcccggagggcgggctacggcactgctgtaccgctgttgtttttgcggggaggatcatcctcagcagggtagcactctatactgcgtcccaacctcgaccaaccaggcacaggcagcccctgaggaacgtcccagggcgccttggtgggatacatcatcaggagcattgcgccccgtcgccttgaagagccctcaggtagtgtgcgaggccgcctcagccgggttactgaagacattgcgttttgttaagtacctgccttgctttcaggtcttaccactagaccagcagctagttctggtaaggaattgttgggcttctctgctgatgctggaacttgcgcaagatcgcctgcaatttgaaacggtggaggtaagcgagccttccatgttacaaaaaattctgacgaccagacgccgagaaactggcggaaacgagccattgccggttcctacgctacagcaccatttggcaccgcccgccgaagccaggaaagtcccttccgcgtcacaggtccaagcgatcaaatgctttttgtccaagtgctggagcctgaatatcagtaccaaggagtatgcatatctgaagggaacagttctttttaatcccggcaaaggtaaagaaaacgactgcaaccatcattag

SEQ ID NO: 26159 - DNA, 627 bp, Artificial Sequence
  Description of Artificial Sequence: Synthetic coding sequence
atgaagcagctggaggaccacgaggccttcgagaccagcagcctgatcgggcattccgcccgagtttacgctctctactacaaagatgggctgctgtgcactggatccgatgacctgtccgcgaaattgtgggatgtctctacaggccagtgtgtctacggtattcagacacacacatgtgctgctgtcaagttcgacgaacagaagctggttacagggtcgtttgataataccgtcgcatgctgggaatggtccagcggggccagaacccagcattttagaggccatactggggcggtgttttcggttgactacaatgacgaactagatattttggtgagcgggagcgcagattttactgttaaagtctgggccttgagcgccggaacgtgtctgaacacactcactggccacaccgagtgggtaacaaaagtggtgctccagaaatgcaaggtcaagtccctattgcacagtccaggggactacatcctgctaagcgcagacaagtacgagattaaaatttggcctatcggtcgcgagattaactgcaagtgccttaagacactgtcagtctccgaagatagatccatttgcttacagccacgccttcatttcgacggaaagtag

SEQ ID NO: 26160 - DNA, 639 bp, Artificial Sequence
  Description of Artificial Sequence: Synthetic coding sequence
atgttcggcgtgaccaagttcggcgacaacatcgaggacgagtggtttatcgtatatgtcatcaaacagatcactaaggagtttcccgagttggtggccaggatagaggataacgacggggaatttctgttgattgaagcggcggatttccttcccaagtggttggatccagaaaacagcacaaatcgagtcttcttttgccacggcgagctgtgtatcatcccggctccgcgaaagtctggcgcagagagctggctcccaacaaccccgcctaccatacctcaagcgctgaacattatcactgcacatagcgagaagatccttgcatcagagagcataagagccgctgtgaaccggcgcatcaggggataccccgaaaagatccaggcaagcctgcatcgggcccactgcttcctgcccgctggaatcgtagctgtgctgaaacaacgccctagactcgttgcagcagctgtgcaggcattttacttgcgggaccctatcgatcttcgcgcttgtagggtttttaaaacctttctacccgagaccaggatcatgacatcagtcacgttcaccaaatgtttgtacgcacagctggtgcagcagcgtttcgtgccagatcgaagaagtggttatcggtag

SEQ ID NO: 26161 - DNA, 474 bp, Artificial Sequence
  Description of Artificial Sequence: Synthetic coding sequence
atggccaccagcgcccccctgcggagcctggaggaggaggtgacctgctccatctgtttggactatttaagggaccctgtcacaatcgactgcgggcatgtcttttgcagaagctgcaccaccgatgttcggcccatcagcggctcgcgcccagtgtgccccttgtgtaagaagccgttcaagaaggaaaacattaggcctgtttggcagctcgcctcacttgttgagaatatcgaacggctgaaggtggacaagggcagacagcctggcgaggtgacacgcgagcaacaggatgctaagctgtgtgagcggcatcgggagaaactccactattattgcgaggatgatgggaaactactctgtgttatgtgtcgggaaagtcgtgaacacagaccacataccgcagttctaatggaaaaagccgcacagcctcatcgggaaaagatactgaaccatctctcgactctgcggtag

SEQ ID NO: 26162 - DNA, 4773 bp, Artificial Sequence
  Description of Artificial Sequence: Synthetic coding sequence
atgagcgccaccagctggttcctggtgagcagcagcggcgcccggcaccgcctccccagagagttaatcttcgtgggcagagaagagtgcgagctgatgctgcagtcccgcagcgtggacaagcagcatgccgtcatcaattacgatcaagatcgagatgagcactgggtgaaagacttggggtctctcaacggcacatttgtcaatgacatgaggatccccgatcagaagtatgttacactgaagcttaatgatgtgattaggttcggttacgactctaatatgtacgtactggaaagggtgcagcatcgcgtacctgaggaagcattgaagcatgagaaatacacttctcaactccaagtttctgtgaagggcctcgcccccaagcgttccgaggcactccccgagcatacaccatactgcgaggccagtaacccccgaccagagaagggagatcgcagaccgggtacggaggcagcctcctacaggactcccctctacggacagcccagttggtggggggaggacgatggaagtactctgcccgacgcacagcgtcagggtgagccctatccagccgagaggcctaaaggaccggtccaacaggacggggagcttcatggattcagagcccctgcggagccccagggctgctcatttcgtagagagccatcatacttcgaaattcccactaaggagaccccacagccctcgcaacctccagaagtcccagcccatgaaatgcctacaaaagatgcagaggccggagggggaggggccgcccctgtggtacagtctcatgcgagctttacaatagagtttgacgactgcagccccgggaaaatgaaaatcaaggatcatatcacgaaattctctctgagacagcgccggccccctggtaaggaggccactcccggagagatggtgtctgccgaaaccaaggtggcagattggctggtgcaaaatgatccttcactccttcatcgagtaggccctggtgacgatagacattctactaaatcagacctccccgttcacaccagaactctgaagggccataaacacgaggatggcacccagagcgactcggaggacccgcttgccaaggctgcgtctgctgctggcgtaccattagaggccagcggcgaacaagtgcgactgcagcgccagatcaaacgcgatccccaggaactgctccataatcagcaggcattcgtaatcgagtttttcgacgaggatacgccaagaaagaagaggagccaatcttttacacactccccctccggggatcctaaagctgataagagacggggacccaccccggccgatcgggaccggcctagcgtgcccgcgcctgttcaagcaggagggagatcatcagggcctcagcgggctggttctttaaagcgcgagaagacggaggagcgactaggtagccccagccccgcctctagaacccctgccagaccttttggatcggttggcagacgaagcaggcttgctcaagatttcatggctcagtgtctgcgtgaaagttccccagctgccaggccttctcccgaaaaggtcccccctgtgctgcctgcccccctgactccccacggcacgagtcccgttgggcctcccacaccgccaccagcacccactgacccgcagctgacaaaagctcgaaaacaggaggaagacgattccctgagcgatgcaggcacctatacaatcgagacagaagcacaggatactgaggtggaagaggccagaaagatgatcgaccaggttttcggagtattagagagtcctgaacttagccgcgcttcctctgcaacctttcgacccgtgatccggggagaccgggacgagtcagatgatgggggggtcgcacagaggatggccttgttgcaggagttcgcaagtcggcccctgggcgccgcaccccaggccgagcaccagggcctaccggtcccaggaagtccgggcggtcagaagtgggtttctagatgggcctctttggctgattcatactccgatccgggactaaccgaagatggccttggccggcgcggaggagagcccgaaggctccttgcccgtcaggatgaggagacggctccctcagctgcccagtgaacgcgcagatagccccgcgggccccgagtcaagcagacggagtggccctggcccaccagagctggatagcgaacaaccatcacgactgtttgggcaggaagagttagatcccgatagtctctctgacgcatctggatcagacggtggccggggacccgaacctggagtggaaccacaggactcccgacgtcggagcccacaggagggccccacgtggtcccgcgggcggcggtcccccagggcaccgggagaaccgaccccggcaagttttttcatcggtgatcaaaacggtgacgccgttttgagccggaagcccctggccgcccccggcgatggtgaaggactcggtcagactgcccagccttcccccccagccagggacggggtgtacgtgagcgccaatggacgcatggtgatccagctgcggcccggcaggtccccagagcctgatgggcctgctcccgctttcctccgccaagaatcctttaccaaagaacccgcctccggcccaccggccccaggcaagccaccccacatctcttctcatccactgctgcaggatctggccgctacccgcgcagctagaatggatttccactcacaggacacacatctgattctgaaagagacagaaactgccttagcagccttggaagctaggctcttgtccaacagcgtggacgccgagtgcgagggcgggtcaacgccacggcccccagaagacgccctgagtggtgactctgatgtggacacagcatccactgtgagcctaagatcaggaaagtcgggtccatctccaacgaccccccagccgctgcgggcgcagaaggagatgtccccttcgcctcccgctgcccaggaccctggcgggacagcgctggtgtcagcccgcgagcaaagtagtgagaggcagcaccatccactgggcccgaccgacatggggcgcggggaaccggtgaggagatccgccatccggcgggggcatcgcccgcggggatccttggactggccatcggaggaacgcggacccgtgcttgcacacctgcccagttccgatgtgatggcatctaatcatgagacaccggaagctactggcgctggccgcctaggaagtcggcgcaaacctgccgctcctcctccctctcctgctgctagagaagaacagtctcgatcctccgcttcctcacaaaagggcccacaagccctgacccgaagcaactccctatctactccaagacctactcgggccagtcgcctgaggagagcgaggcttggcgacgctagcgatacggaggctgcagacggtgagcgtgggtcactgggaaatccggagccagtgggacggcctgcagcagagcaagccaaaaagctgtctcggttagacattttggccatgcccagaaagagagccggttccttcacaggtacaagcgatcccgaggcagcccccgcgaggaccagcttttctggcagatcggtcgaactgtgttgtgcttcacgaaaacctactatggccgaagctagggcagtctcgcgtaaggccgccaatacagcgaccaccacaggccctcgtcagcctttttcccgcgccaggagtgggtccgcccgttatacttcaaacactcgaagaagacagcagggctccgactacacctcaaccagcgaggaagaatacgggtcgcgacacggcagcccaaagcataccagatctcatacctccactgcgacacagacaccccgggccggttcctctagtcgagctagatcccgcgctccaggccctagagacaccgacgacgatgaggaggagcccgacccgtatggctttatcgtgcagaccgctgaaatcgctgaaatcgcacggttatcccagacacttgtgaaagatgtcgctattcttgcccaggagatccacgatgttgccggggacggggacaccttgggttcttcagaaccagcccacagcgcaagtctaagtaacatgcccagtactccagccagtaccatcagcgcaagagaggaactcgttcagaggatccccgaggcgagtctgaactttcagaaggtgccccccggttccctcaactcgcgcgacttcgaccaaaacatgaatgacagctgtgaggatgccttggccaataagacccggccaaggaatagagaggaggttatcttcgataacctcatgctcaatcccgttagtcagctgtctcaggcaattcgggaaaacactgagcatctcgccgagaagatgaagatattgtttcagaacaccgggagggcctgggaggatctggaagcacgcatcaatgcagagaacgaagttcccattttaaaaacgtcaaacaaagagatttcatctattctgaaggaactgcggagggtgcagaagcagttggaggtgatcaacgctatcgtcgatccctccggctcactggatctgctgacaggcaacagatccctggccagtagcgcacagcccggcctcgggaagggacgtgtagcggcccagtcgccacccagtccagcaagcgcggaggcccttcttccagcccttccactccgcaacttcccgcaaagggcttcctgcgggccccccagtttgcctgatccaacattccttcctgatgccgagagattcctcatttag

SEQ ID NO: 26163 - DNA, 1452 bp, Artificial Sequence
  Description of Artificial Sequence: Synthetic coding sequence
atgagcggcggcggccccagcggcggcggccccggcggcagcggccgggcacggaccagttctttcgcagagccaggcggtgggggagggggaggtggcgggggccctgggggttctgcttcgggacctggagggactgggggtgggaaagcttctgtgggagctatgggcgggggcgtgggggcctcgagttccggtggtggccccggcggctctggcggtggaggatccggtggacccggagcgggtacgagctttcctccacctggtgttaaactgggccgagactcggggaaagtcacgaccgttgtggccactctcggccaaggaccagaacgtagccaggaagtggcatatacagacatcaaggtgatcgggaacggctcatttggagtcgtgtaccaagcaagactggctgaaacaagagaacttgttgcaattaaaaaagtgttgcaagataaacgatttaagaaccgcgagctgcagatcatgcgaaaactagatcattgcaacatcgtccggctccgatattttttttattcttccggagaaaaaaaagatgagctgtaccttaacttagtacttgagtacgtgccggaaactgtgtatcgagtggcgagacacttcactaaagccaaattgactattccaattttgtatgtgaaagtgtatatgtatcagctgttccgtagtctagcatacatccatagccagggagtgtgccatcgcgatatcaagccacagaacctgttagtcgatccagacactgctgtgttaaagctttgtgactttggaagcgcgaagcaactggtaaggggtgaacctaacgtttcctacatttgctccagatattatagggccccagaactgatttttggcgcaactgactacacatccagcatcgacgtgtggtccgcgggttgtgtgctggcagaattgctcctggggcagcctatctttcctggagactccggcgtggaccagctggttgaaatcattaaggtcttggggacacccacaagagaacagatccgggagatgaatcctaactataccgagttcaagtttcctcagatcaaggcacacccatggacgaaagtgtttaaatcccgcacccccccagaggcgatagccttgtgcagctcgcttcttgagtatacaccatcctctcgacttagcccgttggaggcttgcgcacattcttttttcgatgagttgcgatgccttgggacccaactgcccaacaatcgcccactcccgccactctttaatttcagtgcaggcgaactgagcatccaaccaagcttgaacgcaattctcatccccccgcacttacgctcaccagctgggacgactactctgactccctcatctcaagcccttaccgagacccccacaagttcagactggcagtcaaccgacgcaactcctactcttaccaattcctcctag

SEQ ID NO: 26164 - DNA, 1389 bp, Artificial Sequence
  Description of Artificial Sequence: Synthetic coding sequence
atgggcggcgccgaggccgagccctggggccgggcccccggccccgctattggcggccggagggctggtgactcttgccccgggtggcggcgtcgaagtagaagcagaggaaggggacagcggctgtctcacgggccccgcaggaggcctcagttgctcaccgctgcaccgcctctgcaggctagaggggcctttcggtcatttccccactcatggggggaggactttctcgctagcctcatgttcaagatccagctggagccgctcaagttgcgagcttggaccctcaacggatttgttaaatttcgcaataaggaaacaagcgccgggcccgttgccgtgatgggaaaagactactacaagatcctgggcatccccagcggcgccaatgaggatgaaattaagaaggcctacagaaaaatggccctgaagtaccatcctgataaaaacaaagaacctaacgctgaggaaaagtttaaggaaatcgccgaagcctacgatgtattgtcggatcctaagaagcggggcctgtacgaccagtatggcgaggaaggactgaaaactggaggcggcaccagcggagggagttccggctcttttcactatacctttcacggggatcctcatgctacatttgcaagcttcttcgggggaagcaacccctttgatattttcttcgcttccagtcggtcaaccagaccgttctccggcttcgatccagatgacatggacgtagatgaagatgaagacccttttggggcgttcgggcgattcgggttcaatggcctgagtagaggaccccggagagccccagagcccctgtatcctagaagaaaagtgcaagacccacccgttgtacacgagctcagggtctctctggaagagatttaccatggctctaccaaaaggatgaaaatcactcgacggcggctcaaccccgatggaagaacggttcgcacagaggacaagatattgcacattgtcataaagagaggatggaaagagggaactaagatcacctttccaaaggaaggggacgctactccagataatatacctgctgatatcgtgtttgtgctgaaagacaagccacacgcgcatttcagacgagatgggacgaatgtactctacagcgccctgatcagtctgaaagaggccctgtgtggctgcactgtgaatattcccacaatagacggcagggttatacccctgccgtgcaacgacgtgatcaagcccgggacagtgaagcgcttaaggggggagggtctccccttccctaaagtgccaactcagcgcggcgatctgatcgtggagttcaaagtgaggttccctgatagactaactccccagactcgccagattctcaaacagcacctgccctgttcatag

SEQ ID NO: 26165 - DNA, 279 bp, Artificial Sequence
  Description of Artificial Sequence: Synthetic coding sequence
gtgtacggcgccaaggacatcgagctgagccccgaggcccaggccaagattgataggtacacacaacaaggctttggcaacctcccaatctgtatggcaaaaacccacttgagcctgagccaccagccagataagaaaggtgttccacgggacttcatccttccaatcagtgacgtgagagccagcattggggccgggttcatttaccccctcgtaggaacccgctctagtcctctagccctcgtaggtgagagtcagcccaagcaggtgcatccttag

SEQ ID NO: 26166 - DNA, 468 bp, Artificial Sequence
  Description of Artificial Sequence: Synthetic coding sequence
atgagcgtgacctacgacgacagcgtgggcgtggaggtgagcagcgactcgttttgggaggtaggcaactataagagaactgttaaacgcatagacgatggccacaggctgtgttccgacctgatgaactgtctacatgaacgagcacgcattgagaaggcatacgcacagcagctgaccgaatgggcacgccgttggcgacagctggttgagaagggtccccaatacggaacagtggagaaagcttggatggcgtttatgtctgaagccgagagggtctctgagctgcatctggaggttaaggcaagccttatgaatgatgactttgagaagataaagaactggcagaaggaggctttccataagcagatgatgggcggttttaaagagactaaggaagccgaagacggttttcggaaggcccagaagccctgggcaaagaagctgaaggaagtacatttgagttag

SEQ ID NO: 26167 - DNA, 483 bp, Artificial Sequence
  Description of Artificial Sequence: Synthetic coding sequence
atggaggccgagcggccccaggaggaggaggacggcgagcagggccccccacaggatgaagagggctggccgccacccaacagtaccacgcgaccatggaggtctgcgccaccttccccccccccccccggcacacggcacaccgcacttgggcctaggagcgcttcccttctctccctgcagactgagctgttgctggacctagtggccgaagctcagagtcgtcgattagaggaacagagagcaactttttataccccacagaacccaagctccctagcccccgcacccctcagaccactcgaggacagagagcagctctacagcaccattctgagccatcagtgccagcggatggaagctcagagatctgaaccacccctccctcctggaggccaggagttactcgaacttctcttgagggtccagggaggcggaagaatggaggaacaacgatcccggccaccgacacatacttgctag

SEQ ID NO: 26168 - DNA, 660 bp, Artificial Sequence
  Description of Artificial Sequence: Synthetic coding sequence
atggagcccagcgcccagcagctgcagctggccgccagcctgcccgctaacctgtctaacttctgtcagggatccgaaatgcccacgacgtctaggccagccctggatgttaaagggggaaccagtccagctaaagaggatgcgaatcaggaaatgagtagtgtagcctattccaatttagcagtgaaagatagaaaggctgtcgcaatcctacattatcccggcgtggcaagcaacggaacgaaggcaagcggcgcacctactagctcctctggctccccgattggctcacctacaactacaccacctactaagccccccagctttaatctacaccccgctccacatctactcgcaagtatgcacctgcagaaattgaactcccagtaccaggggatggcagcggcgaccccaggtcaaccaggcgaggcagggccactgcagaactgggacttcggcgcgcaggcagggggtgccgagagtctatcgcccagtgcaggtgcgcagtccccggctatcatagactctgatccagtcgacgaagaagttctgatgtcccttgtcgtggagctgggtcttgatcgcgctaacgagctccctgagctctggctcgggcagaacgaattcgactttactgctgattttccctctagctgctag

SEQ ID NO: 26169 - DNA, 318 bp, Artificial Sequence
  Description of Artificial Sequence: Synthetic coding sequence
atgaacatgatctggcggaacagcatcagctgcctgcggctgggcaaggtgcctcatcgttaccaatcaggatatcatccagtagcccccctcggctcaaggattcttactgaccccgccaaggttttcgagcacaatatgtgggaccacatgcaatggtctaaagaggaggaggcagccgcgaggaaaaaagtcaaggagaattccgcggtacgcgtgctgctggaagagcaggttaaatatgaacgggaagctagtaagtattgggacacgttctacaaaattcataagaacaagtttttcaaagaccggaactag

SEQ ID NO: 26170 - DNA, 366 bp, Artificial Sequence
  Description of Artificial Sequence: Synthetic coding sequence
tgagagggcgagagccccaccgccagcccccacagcagcgccaccgatgacctgcatcacagcgacaggtatcagacgttcctcagggtccgggccaatagacagacaagattgaacgcacggatcgggaaaatgaagcggagaaagcaggatgagggccaggtgtgcccattgtgcaacaggcctctcgccgggtccgagcaggaaatgtccaggcatgtggaacattgtctttccaagagggaaggatcctgtatggcggaggatgacgcagtcgacatagagcatgagaataataatagatttgaggaatatgagtggtgcggtcaaaaaagaattagagcaacgacactgctggaagggtag

SEQ ID NO: 26171 - DNA, 1701 bp, Artificial Sequence
  Description of Artificial Sequence: Synthetic coding sequence
atggacctgcaccgggccgccttcaagatggagaacagcagctaccttcctaaccctctagcttcacctgccttgatggtcctggcatctactgcagaggcttcccgtgacgcctccatcccttgccaacagcctaggccatttggcgtgcccgtatccgtagataaggatgttcatatcccgtttaccaacggatcgtatacatttgcctccatgtaccacaggcagggcggggtgcccggcacatttgcaaacagggactttccccctagcttgttgcacctccatcctcagttcgcaccccctaatctggactgtacacccatttccatgctgaaccactctggggtgggagcatttcggcctttcgcctctaccgaggatcgcgaatcttaccagtccgcattcacaccggcgaaacggctgaagaattgccacgatactgaatccccacatttgaggttttctgatgctgatggaaaggagtatgactttgggacacagctgcccagcagctcccccggcagtttaaaggtcgatgacacaggcaaaaaaatatttgctgtgagtggtttgatttccgatagagaggcctcttcgtcgcctgaagataggaacgatcggtgcaaaaagaaggcagctgctctctttgattcgcaagcacccatctgccctatctgccaagtgttgctgcgcccttctgaattgcaagaacacatggagcaagagctggaacaactggcacagctgccatccagcaagaacagcctgctcaaggacgctatggcccccgggactcctaagtccctgctgctgagtgcttccatcaaacgcgagggcgagtcccccactgctagcccccactcaagcgctacggatgacctgcaccactccgaccggtatcagaccttcttgagagtgcgggctaacaggcaaaccaggctgaacgccaggatcggcaaaatgaagcgccgaaagcaggatgaaggacaaagggaggggagctgtatggctgaggacgatgccgtggacattgaacacgagaacaataaccgctttgaggaatacgaatggtgtggacaaaagaggattcgagccacaactctcctcgagggcgggttcagaggatctggattcataatgtgtagcggcaaggagaatccagattctgacgccgatttggatgtggacggagacgacacactagagtatggcaaacctcagtacaccgaagctgacgtaattccctgtactggtgaggagcccggtgaagcgaaggagagggaggccttgaggggcgccgtcttgaacggtggccccccttcaacaaggatcactccggaattttcaaaatgggcctccgatgagatgcccagcactagcaacggggagtcttctaagcaggaagccatgcagaagacttgtaagaactccgatattgaaaagattacagaggacagcgcagtaaccacctttgaggcactcaaggctcgggttcgggaattagagcgccagctgtcaagaggagacaggtacaagtgtttaatctgcatggactcatacagcatgcctttaacctcgatacaatgctggcacgtgcactgcgaggagtgctggctccgtaccttgggcgccaagaagctctgtccgcagtgtaatactatcaccgctcccggcgatctgcggcgcatctacctgtag

SEQ ID NO: 26172 - DNA, 4719 bp, Artificial Sequence
  Description of Artificial Sequence: Synthetic coding sequence
atgctgctgcacctgtgcagcgtgaagaacctgtaccagaaccggttcctggggctggctgcaatggccagcccatctaggaattcccaatccagaaggaggtgcaaggagccgctgcgatactcgtataaccctgatcagttccacaatatggacctgcgagggggcccccatgacggagtgaccattcccagaagcacaagcgacacggacctggtcaccagcgactcacgctccacactcatggttagctcctcttattactccattgggcactcccaggaccttgtgatccactgggatatcaaagaggaggtggacgcaggggattggattggaatgtaccttatagatgaggtgctgagcgagaactttctggactacaaaaacagaggcgtgaacggttcccatcgagggcagatcatctggaagatcgacgcgtcctcgtacttcgtggagcccgagactaagatatgttttaagtactaccatggcgtgagcggcgccctgcgcgcaacaacaccctccgtaactgtcaaaaactccgctgccccaatctttaaatcgataggagcggatgagaccgtccagggccagggaagccgccggctaataagtttcagcctgtctgacttccaggcaatgggcctcaaaaaaggcatgtttttcaacccagatccttatctgaagattagcattcagccaggcaaacactctatatttccagctttaccccatcatggtcaggagaggcgctccaaaataatcggaaacacagtcaaccctatttggcaagcagagcagttctccttcgtgtccctacccacagatgtgttagagattgaagtcaaagataagttcgcaaagagccggcctatcatcaagagatttctggggaagctctccatgcctgtgcaacgccttctagaacggcacgccattggtgacagggtagtgagctatactttaggacggcgattgcccaccgaccatgtctcaggtcaactacagtttcgcttcgagataacatcgtcaattcaccccgacgacgaagagatttctttatccaccgagccagagtccgcacaaattcaagacagccccatgaacaatctcatggaaagcggcagcggggaacctcggtccgaagccccagaaagcagcgagtcctggaaacctgagcagttaggcgaaggcagtgttccggatggccctggaaatcagtccattgagctgagtaggcctgcagaggaagccgcagtcatcactgaggctggggaccagggcatggtctcagtcggacctgaaggggctggagagcttcttgcacaggtccagaaggacatacaacccgcaccatcggctgaggaactggcagaacagctggatctgggtgaggaagcttcagccttgctattggaagatggggaagctcctgcctctacaaaggaggaacccctggaggaggaagccaccacacagagtcgagcaggacgcgaggaagaagagaaggagcaagaggaagagggtgacgtctcaacactggagcagggtgaggggcgccttcaactccgcgcatccgtgaagaggaagagcagaccctgcagtttgcctgtatccgagctggagaccgtaatagcatccgcttgtggcgacccggaaactcctcgaacacattacatcaggattcacaccctcttgcattcaatgccgtccgcccagggcgggagcgcggcagaagaggaagatggagcggaagaggaaagcactctcaaagacagtagcgaaaaggatggccttagcgaagtcgacaccgtcgcagccgacccatccgcattagaagaggatcgagaagagcctgagggcgccacaccaggcaccgcccatcccgggcactcgggggggcattttccttctctggcaaacggagcagcccaagacggggacacacatccgtcgactggtagtgagtcagatagctcacccagacaggggggcgaccactcttgcgaaggatgcgatgccagctgttgttccccgtcctgttactcatcctcatgttatagcacaagctgctattcttcaagttgttatagcgcttcgtgctatagcccatcctgctacaacgggaacagatttgccagtcacacaagattttcttccgtggattcagcaaaaatctccgagtccacggtcttttcctctcaagacgatgaggaagaagagaattccgcgtttgagtccgtgcccgatagtatgcagagccctgagctggacccagagtcgactaatggcgcaggtccatggcaagatgagctagcagcaccaagcggccacgtcgaacgttcacccgaaggcctcgaatcacccgtggctggtccatccaaccgccgggaggactgggaggcgaggatcgattcccacgggcgggtgttttacgtggaccatgtgaatcgaactaccacttggcagcggcccaccgccgctgcaacacccgacgggatgcgcagatctggaagtatccagcagatggagcagcttaataggcgttaccagaatattcagcggaccattgctacagaaagatctgaggaagactctggtagccaatcctgtgaacaggcccccgctggagggggaggcggaggcggtagcgattcagaggcagagagcagtcagagtagcctggacctgcggcgggaggggtcgctcagccccgtgaattcccaaaagataacattactgttgcaatcaccagccgtaaagttcatcacgaatcccgaattcttcaccgtgctccacgcgaattactctgcataccgagtatttaccagctcaacttgtctaaagcacatgattctaaaggtccggagggatgcccgcaacttcgaaagataccaacacaaccgcgatctggttaacttcattaacatgttcgccgacacgcgtttggaactgcccagaggatgggagatcaaaacggatcagcagggaaaaagtttcttcgttgaccacaattcccgcgccactaccttcatagaccctagaatccctcttcagaacgggcgactcccgaatcacctcacccataggcagcaccttcaacgcctaaggagctattccgccggggaggcaagcgaggtcagcaggaaccgcggagcttctttactggcccgtccgggccattctttggtggccgcaatacgatcccaacaccagcacgagtcgttgcccctagcttataacgataagatcgtggctttcctaagacagccaaatatcttcgagatgctgcaggagagacaaccaagtctggcgagaaaccacacgctaagggaaaagatccactacatcaggactgagggaaatcacggtttggaaaaactgtcatgcgatgcggatctggttatactgctgagtctgttcgaagaagagatcatgagctacgtgcccctgcaggcagctttccacccggggtactctttctcaccacgctgcagtccttgctcctcccctcagaattctcccggtcttcagagggcttccgctagggcaccatcaccatatcgccgagactttgaggctaagttaagaaatttctatcgaaaacttgaagctaagggtttcggacagggcccagggaagattaaactcatcatcaggagggaccacctacttgaggggacatttaatcaagtgatggcctatagccgcaaagaactgcagagaaacaagctttacgtgactttcgtaggggaggaaggactggactattccgggccttcaagggaatttttctttcttcttagtcaggaactgtttaacccgtattatgggttattcgagtactccgctaatgacacttacaccgttcaaatctctccgatgtcagcctttgtagagaaccatctggagtggtttcgtttttcgggtagaatccttggcctggcactaattcatcaatacctgcttgacgccttttttacccggccgttctataaggccctgctgcgtctgccctgcgatctgagcgacctcgagtaccttgatgaggagtttcatcagtccctgcagtggatgaaagataacaatattactgacattctcgacctaacgttcaccgtcaacgaagaggtattcggacaggttacggaacgggagctgaaaagtggcggcgcaaatacccaggtcaccgagaagaataagaaagaatatattgagcgcatggtcaaatggagggtggaaagaggagtggtgcagcaaaccgaggccctggtccgagggttttatgaggttgttgatagtcgcctggtctccgtgtttgatgcgcgcgagttggaactggttattgcaggaactgctgagattgatttgaacgattggcgaaataatacagagtatcggggcggctatcacgacgggcacttagtgatacgatggttctgggccgctgtggaaagattcaataatgaacagcgcctcaggttattgcagttcgtgactggcaccagctctgtgccctacgaaggctttgccgctcttagagggtctaacggcctgaggcggttttgcattgagaaatgggggaagatcacaagtctcccacgcgctcacacatgtttcaacaggctggatcttccaccctatcctagttattccatgctgtatgaaaagttgctaactgctgtcgaggaaaccagcacatttgggctggaatag

SEQ ID NO: 26173 - DNA, 1629 bp, Artificial Sequence
  Description of Artificial Sequence: Synthetic coding sequence
atgagcggcctggtgctgggccagcgggacgagcccgccggccacagacttagccaagaggaaatactagggtcaacccgactagtgtcacaaggcctggaagccttgaggtccgaacaccaggctgttctgcagagcttgtcacagacaattgagtgcttgcagcaaggggggcacgaggagggcctggtgcacgagaaggccaggcagctcagacggtccatggagaatatcgagcttgggctatctgaggcccaggaagaaaaggaaggcgatgcaacgaaagatagcctcgatgacttatttcccaatgaggaagaggaggacccttctaatggactgagcagaggtcagggagcaacagcagcccaacaaggggggtacgaaattccagcccgcctgagaaccctgcacaacttagtgatccagtatgctgcccagggccgttatgaagtcgcggtgcccttgtgtaaacaggccctagaggatctggagcggacctcaggtcgcgggcacccagatgtggccactatgctgaatattctagcgctggtgtacagagaccaaaataaatataaggaggccgcacacctgctaaatgacgcactttctatcagggagtccactttgggcccagaccatccagccgtagccgcaaccctgaacaatctcgccgtgctttatgggaaaaggggaaagtataaagaggcagaacccttatgccagagggccctggagatcagggaaaaggtcctgggtaccaatcaccctgatgtggccaagcagcttaacaatctcgctctgttatgtcaaaaccagggcaagtacgaagcagttgagcggtactaccaacgggcgttggcaatttatgagggccagctgggaccggacaatcccaacgtggctaggaccaagaataatcttgcatcttgctacctgaaacagggaaaatatgccgaggctgagacgctgtacaaagagattcttacgcgcgctcacgtgcaggaatttggatccgtggacgacgatcacaaacccatctggatgcacgccgaggagcgggaggagatgtcgaaaagtaggcaccatgagggagggaccccctacgccgaatacggaggatggtataaggcttgcaaggtctctagtcccaccgtcaataccactctcaggaatttgggagccttataccgcagacaggggaaattagaggctgctgagactctcgaagaatgcgccctcaggtctcgacgccagggaaccgaccccatctcgcagactaaagttgctgagttgcttggtgaaagtgatggcagacggacgagtcaggaggggccaggagattccgttaaatttgaaggcggtgaagacgcctcagtggccgtcgagtggagcggcgatggatctggcaccctgcagcggtcggggtcccttggcaagatccgagatgtgttacgtaggtcatctgaactcttggttcgcaaacttcaaggaacggaacccaggcctagctccagtaatatgaaacgggctgctagtctaaattatctgaatcagcccagcgccgcacccctccaggtgtcccgcggtttgtcggcctccaccatggacctgtctagctcctcctag

SEQ ID NO: 26174 - DNA, 1548 bp, Artificial Sequence
  Description of Artificial Sequence: Synthetic coding sequence
atgtgccaggtgggcgaggactacggcgagcccgcccccgaggagcccccaccagcccctcgcccctctagggagcaaaagtgcgtaaaatgtaaagaggctcagccagtagtagtcatacgcgctggcgacgctttttgcagagactgctttaaggccttttatgtacacaaattccgcgctatgctcggcaaaaaccgtttgatctttcccggggagaaagtccttcttgcgtggagcggcgggccctcatcttcaagcatggtgtggcaagtgctggaggggctaagccaggactccgctaagcgattgaggttcgtggccggggtcatcttcgtggacgaaggcgcggcatgcggacaatcattagaggaacgctccaagaccctcgccgaagtgaagcccatcctccaagctaccggattcccatggcatgtggtcgctctcgaagaggtgtttagcctgcccccctccgttctgtggtgcagcgcccaggagctggtgggaagtgagggcgcctacaaggctgccgtggactcatttcttcagcagcaacatgtcctaggtgccggggggggcccaggacctactcagggtgaggagcagcctcctcaacctccactcgatcctcaaaacctggcccgaccgccagccccggcccagactgaggccctatcgcagttattctgcagcgtgaggactctaactgccaaagaggagcttcttcagactctccggactcacttgattcttcacatggcccgggcacacggctacagcaaggtcatgactggagactcttgtacgagactcgccattaagctgatgactaatctggcccttgggcgcggcgcgtttctggcatgggacacaggattcagcgatgagagacacggggatgtggtggtcgttaggccaatgcgagatcacacattgaaggaagttgctttttataaccgtctgttctctgttccttccgtgtttacaccagcagtcgacactaaagcacctgagaaggctagtatccaccgcttgatggaagccttcatacttcgattgcagacccagttcccaagtacagtttctaccgtctatcgcacgtctgaaaaacttgtgaaaggcccacgggatgggccagctgcgggggacagtggcccacggtgtttgctgtgcatgtgcgcgctcgacgtggatgcagctgattctgccacagcatttggggcccagaccagctcccgattgtcccagatgcagtcacctattcccctgactgaaacgaggaccccacccggaccatgctgttcgccaggcgtcgggtgggcacaacgttgtggacagggggcatgccgacgcgaggacccccaggcctgtattgaagagcagctctgctactcctgcagggtcaatatgaaggaccttccctctcttgacccactccccccttacatactggccgaagcccagctccggacccaacgggcatgggggctgcaggaaattcgagattgtctcatcgaggattcggacgatgaggcagggcagtcttag

SEQ ID NO: 26175 - DNA, 1263 bp, Artificial Sequence
  Description of Artificial Sequence: Synthetic coding sequence
atgttcaagcggaccgtgctgagctgccccccccccgccgcccccccattacaggctcgaggggccttcaggtctttccctcacagctggggggaggactttctggcctctttaatgtttaagatccagctggaaccgctgaaactgagggcttggacgctaaatggcttcgtaaagtttagaaacaaggagactagcgctggtcccgtagccgtgatggggaaagattattataaaattttggggatccctagtggcgccaacgaagatgaaatcaaaaaagcttaccgtaaaatggccctgaaatatcatcccgacaagaataaggagccaaatgctgaagaaaagtttaaggagattgcggaagcttatgacgtgctctctgacccgaagaagcgcggcctttacgaccagtacggggaagaaggcctcaagacagggggaggaaccagcggaggatcctccggctcattccattatacatttcatggggatccacacgctactttcgcctcgtttttcggaggttcaaacccgttcgacatcttctttgcttcctctcgaagcacgcggcccttctccgggttcgatcctgatgacatggatgtggacgaagatgaagaccctttcggcgcctttggacgcttcgggttcaacggcttaagtcgcggccctcggagagcccccgagcccctttacccaaggagaaaagtacaggatccacccgtggtccatgagctgagggtctcactggaggagatatatcatggctcaactaaaaggatgaagattaccagaagacgtctcaacccagacggccgaactgtcagaaccgaagacaagatcctgcatatcgtgattaagcgcggttggaaagagggtaccaagatcacattcccaaaagagggagatgctacacccgataatatccccgccgacatcgtctttgttctgaaggacaaaccccatgcccactttagacgggatggaaccaacgtgttgtactctgcgctcattagcctcaaagaggccctgtgcggctgcaccgttaatattcccaccatagacggtagagttattccattgccatgcaatgacgtgattaagcctgggacagtgaaaaggttacggggtgaggggctgccctttcctaaggtacccacgcagcgcggggatttgattgttgaattcaaggttaggttcccagatcgtctaaccccccagaccaggcagattctgaagcaacatttgccatgctcctag

SEQ ID NO: 26176 - DNA, 2979 bp, Artificial Sequence
  Description of Artificial Sequence: Synthetic coding sequence
atgtacggcagcgcccggagcgtgggcaaggtggagcccagcagccaatctcctggcaggtcgcctcgccttccccgctcgccaagactaggccatcgccgtaccaattctactggtggaagctccggaagcagtgttgggggtggctccggaaagaccttatctatggaaaatatccagtctctcaatgcagcgtatgccacctcaggccctatgtacctgtcggatcacgaaaacgttgggtctgagacgcctaaaagtactatgactctgggacgatcaggaggcagactgccgtatggcgtccgtatgaccgcgatgggatcatctcctaacatcgccagttcaggcgtggcttccgatactatagctttcggcgagcatcatctgccccccgtctctatggcgtccaccgttccacactctctcaggcaggctcgtgataacactatcatggacctccagacccagctgaaggaagtgctcagagaaaacgacctgctgaggaaggatgttgaggtgaaagagtccaaactgtctagttccatgaactctatcaaaactttctggagcccggagttgaaaaaggagcgcgcgctaaggaaggatgaggcctcaaaaatcacgatttggaaggaacagtatcgggtggtgcaggaggaaaatcagcacatgcagatgacaattcaggccctccaggacgaactgcgtattcagagggatcttaatcagctgtttcagcaggattcgtccagtcgcacaggggagccatgtgtggctgaactcaccgaggaaaattttcagagactgcacgccgagcacgagagacaggccaaagaactttttctgctgaggaaaaccctcgaagaaatggagctgaggatcgaaactcagaagcagactcttaatgccagagatgaatccattaaaaagttactggagatgctgcagagcaagggactgagcgctaaggctaccgaggaagaccatgagcgcactagacgtctcgcagaggccgagatgcatgtgcaccaccttgaaagtctgctggaacagaaagagaaggaaaactccatgctccgggaagagatgcatcggaggttcgagaatgctccagactcggccaaaactaaggcactccagacggtaatcgaaatgaaagacagcaagatctcttcaatggagcgcgggctgagggatctggaagaagagatccagatgttgaagtctaacggtgcactctccaccgaagaaagagaagaggagatgaaacagatggaggtttacagaagtcatagtaaatttatgaagaacaaaatcggacaagttaagcaggaactgtcccgaaaggataccgagctacttgccctgcagaccaagctagaaacactgacaaatcagttctccgactcgaagcagcatatcgaagtgcttaaggagagccttactgctaaggaacagcgtgcagccattctgcaaactgaagttgacgccctccgtttacgactggaggaaaaggagacaatgcttaacaaaaagaccaaacaaattcaagacatggctgaggaaaagggcacgcaggccggcgagattcatgatctgaaggacatgctggatgtcaaggagcgcaaagttaatgtgctccagaagaaaatcgaaaatctccaagagcaactgcgtgataaggagaagcaaatgtcttcactgaaggagagagtgaagtctctgcaagccgatacaacaaatactgacaccgccttgactaccttggaggaggccttagcagagaaagagaggactattgaaagactgaaggagcaacgcgaccgggatgagcgagaaaagcaggaagagatagataattataagaaggacctgaaggatctcaaggagaaggtttctttactccaaggcgacctgtccgaaaaagaagccagcttgctggatctcaaggaacatgccagcagcctcgccagctctgggttaaagaaagacagtcgccttaaaacactcgaaattgctctggagcaaaaaaaggaggaatgcttgaagatggaatcccagctcaaaaaggcgcatgaggccgctttagaggctagagcatcgcctgagatgtccgaccgcattcagcacctggagagagagataacacgctacaaggatgaatcttcaaaagctcaggccgaggtcgatagactcctggagattttgaaagaagtagagaatgagaagaatgacaaagataagaagattgcagagctcgaatctctcttttctaggcaagtgaaggatcagaataagaaggttgccaacttgaagcacaaagagcaggttgaaaaaaagaaatcagctcagatgctcgaggaggcccgcagaagggaagataacttgaatgattcgtcccaacagttgcaagattcactaagaaagaaggacgataggattgaggagctagaggaggctctccgtgagagcgtgcaaatcaccgctgagagagaaatggttttggcccaggaggaatcggcacgcactaacgccgagaagcaggttgaggagctcctgatggctatggaaaaagttaagcaagaacttgagagcatgaaggcaaaactgtcatccactcagcagtccttggccgaaaaagagacccatcttactaatctgcgggctgagcgccgaaaacatcttgaagaggtcctggagatgaagcaggaggccttgcttgccgctatatcagaaaaagacgccaatatcgccctcctagagttatctagctctaagaaaaagacccaggaggaggtcgcagcacttaaacgtgagaaggatagacttgttcagcaactgaaacagcaaactcagaacagaatgaaactgatggcagataactatgaggatgatcacttcaagtcttcccactcgaatcagacaaatcataagccatcacctgaccaggatgaggaagagggcatctgggcttag

SEQ ID NO: 26177 - DNA, 180 bp, Artificial Sequence
  Description of Artificial Sequence: Synthetic coding sequence
atggagcccagcgcccagcagctgcagctggccgccagcctgcccgcaaacctgagtaatttttgccagggaagcgagatgcccactacttccagacccgctctcgatgtgaaaggcggcactagcccagctaaggaagacgccaaccaggagatgtcctcagttgcctacagtaattag

SEQ ID NO: 26178 - DNA, 6978 bp, Artificial Sequence
  Description of Artificial Sequence: Synthetic coding sequence
atgaagaagggcagccagcagaagatcttcagcaaggccaagatcccttcttcgtcacactcccccattccttcaagcatgtctaacatgcgctcccggagtttgtcccctcttatcggatccgagaccctgcccttccatagtggaggacagtggtgcgagcaagtggagatcgctgacgagaacaacatgcttcttgactaccaggatcacaagggggcagacagtcatgccggagttcgctatatcactgaggccttgatcaaaaagctcaccaagcaggataacctggcgcttattaagtctttgaatctgtccctgagcaaggacggtggcaaaaagttcaaatatattgagaacctcgaaaagtgcgttaaactggaggtgctgaacctttcgtacaacctgatcgggaagatcgaaaaactcgacaaactcctgaagctgagggagcttaatttaagctataacaaaatcagcaagatcgagggcatcgaaaacatgtgcaatctgcaaaagctcaatctggctggcaacgaaatcgaacatattcctgtctggttaggtaaaaaactgaagtcactcagagttctgaacttaaaggggaacaaaatttcatcactgcaggacatcagtaagctgaagcctctacaggatctgatctcactgatcctggtggagaaccccgtagtgaccctcccgcattatctgcaattcaccattttccatctgcgttccctagaatctctggaagggcaacccgtcacaacccaggatagacaggaggccttcgagagattctcactggaggaagttgaaaggctggagcgagacctcgagaagaaaatgatagaaacagaggaacttaagtccaagcagacgagatttctcgaggaaattaagaaccaggataaactgaacaagtcattgaaagaagaagccatgttacagaagcaaagctgcgaggagctgaaaagtgacctgaacaccaagaacgaacttctgaagcagaagacaatcgagctgacaagggcctgtcagaagcagtacgagctggaacaggaacttgccttttataagatcgatgccaagtttgagcctctgaattactatccatcagagtacgccgagatagacaaggcacctgatgagagcccctatatcggcaaaagccgttacaaaaggaacatgttcgctacggagtcctacataatcgacagcgcgcaggccgtgcaaataaagaaaatggagcccgacgaacagcttaggaacgaccatatgaatcttagggggcacacaccacttgacactcagcttgaggacaaggaaaagaaaatcagtgcagctcagaccaggctgagtgaactgcatgacgaaatcgagaaagccgaacagcaaattttgcgagctacagaggagttcaagcagctggaagaggctattcagttgaaaaaaatctccgaagccggtaaggacctcttgtacaagcaacttagcggaagactgcagctggtgaacaaactacgacaggaggcacttgaccttgagttgcaaatggaaaaacagaagcaggagattgcaggtaaacagaaggagatcaaggacttgcaaattgctatcgatagcttggatagcaaggaccccaaacacagccacatgaaagcacagaagtctgggaaggagcaacagttggatattatgaataagcagtaccaacagcttgagagtagactcgacgagatcctctctcggatcgcaaaagagactgaggaaatcaaggatttagaagaacaattgactgaaggccaaatagcagccaacgaagccctgaaaaaggacctggaaggggttatcagcggcctgcaggagtatctagggaccattaagggccaagccacgcaggcccagaatgagtgtcgcaaactgagagatgagaaggagaccctgctccaacggctcaccgaagtggagcaagaacgagatcagcttgaaatagtggccatggatgctgagaacatgcgcaaggagctggctgagctagaaagcgcactccaggaacagcatgaggtgaatgcttcactgcagcagacacagggagacttgtctgcctacgaggcagaattagaagcccgactgaatcttagggatgctgaggcaaaccagttgaaagaagagctcgagaaagtgacacggctgacgcaattagaacagtccgctctgcaggcagagctcgagaaggaacgccaagcgctgaagaacgcactaggcaaggcacagtttagtgaagaaaaagagcaggagaatagtgagctgcatgctaagctgaagcatttgcaggacgacaataatctgcttaaacagcagctgaaagatttccagaatcacctgaatcacgtagtcgatggcttggtgcgccctgaggaggtggccgccagagtcgatgagctgcgcagaaagttgaagctcggaacaggagaaatgaacattcattcaccaagcgacgtcctcggaaagtcactggccgatctccagaagcagttctccgagattctggctcgatcaaagtgggagcgcgacgaggcccaggtgcgagagagaaaacttcaggaggaaatggccctccagcaggagaagctggcaactgggcaagaagagttccggcaagcttgcgagcgggccctggaggcgaggatgaattttgacaagcggcagcacgaggcccggatccaacagatggagaatgaaatccactacctgcaggaaaatctaaaatctatggaggaaattcagggactgacagatctgcagctgcaagaagctgacgaagaaaaggagagaatcctggctcaattgagagagctcgagaagaagaagaaactggaagatgccaaatcacaggagcaggttttcggcttagataaagagttaaagaagctgaagaaggctgtggccacttccgacaaattggcgaccgcagagctgaccatcgctaaggaccagttgaaaagtctgcatggaaccgttatgaagatcaaccaagagcgcgccgaggaactccaggaggccgagcgcttttcgcgaaaggctgctcaggctgctagggatcttacacgcgctgaggcagagatcgagttgctgcaaaacttgctaagacagaaaggtgagcagttcagattggaaatggaaaagaccggcgtgggcaccggggcaaactctcaggtactcgaaatcgaaaaattgaatgagaccatggaaagacaacgtaccgagatagcacggctgcagaatgtgctcgacctgacagggtccgacaataaaggcggtttcgagaacgtgctggaggagatcgccgaactccgccgggaagtgagctatcagaacgactatatctcttcaatggccgatccatttaaaaggagaggctactggtactttatgccgcctcctccctcaagcaaagtatcttcgcacagttctcaggctacaaaggatagcggagtaggcttgaagtacagtgcgtctacgccggtcagaaagcctcggcccgggcagcaggacggtaaggaaggaagccaacccccgcccgctagtggctactgggtatactcccctattcgctccgggctccacaagctctttccatctagagacgcagacagtggcggtgacagtcaggaagaatccgaattagacgatcaggaggagccaccgtttgtgcccccccctgggtacatgatgtatactgtgctccctgatggaagccctgttcctcaaggcatggcactgtatgcccctccaccaccgcttccaaacaactctcgccccctgacacccggtacagtcgtctacggacctcctccagccggagccccgatggtctacgggccccctcctcctaacttcagcatacccttcatacctatgggggtgttgcactgtaatgtcccagagcaccacaacttggaaaacgaggtctcccgcctggaggatatcatgcagcaccttaaatccaagaaacgggaagagcgctggatgagagcgtccaagagacagtccgagaaagaaatggaagagctgcatcataatatcgatgacttgttgcaggaaaagaaaagcttggaatgcgaagtcgaggagctgcaccgaaccgtgcagaaacgacagcagcaaaaagattttatcgatggaaatgtggagtctcttatgacagagctagagatcgaaaagtccctgaaacatcatgaggatatcgtggatgagatcgaatgcattgagaagaccctcctgaagcgaaggagcgagctgcgtgaagcagacagactgcttgctgaggctgaatcggagctgagttgcactaaggaaaagacaaaaaatgcagtcgaaaagttcaccgatgctaaaaggagcctgctgcaaactgagtcggacgccgaggagcttgaaagacgggcccaggaaacggctgtgaacctggtgaaggcagatcagcagctaagatccctccaggctgatgcaaaggatctggagcagcacaaaatcaaacaagaagagattttgaaggaaattaataaaattgtagccgccaaggattccgactttcaatgcttgtccaaaaagaaagaaaaactgactgaggagctgcaaaagctccagaaggacatcgaaatggcagaaagaaacgaggatcaccacttgcaagtcctgaaggagtccgaagtgctcctgcaggccaagagagcagagttagagaaactgaagagccaagtcacaagtcagcaacaggagatggccgtgttagatcggcaactgggccacaagaaggaagagcttcacctcctgcagggtagtatggtccaggccaaggccgatttgcaggaagcgttgagactgggggaaacagaggtaactgagaagtgcaatcacataagagaggtgaaaagcttgcttgaagagctaagcttccagaagggcgaactcaatgttcagatcagcgaacggaagacccagctgaccctaataaaacaggaaattgaaaaggaagaagagaatcttcaggtggtccttcgacagatgtccaagcataagactgagctcaagaacattctagacatgctccagctcgagaatcacgagttacagggactgaagctgcagcacgaccagagggtcagcgaactggaaaagacccaagtcgccgtgctggaggagaagcttgaactcgaaaatctccagcagatcagccagcaacagaaaggggagatcgaatggcaaaaacagttgctggaacgcgataaacgcgagatagaacggatgaccgctgagagcagggcattacagagctgcgttgaatgtctgagtaaggaaaaagaggatctgcaagaaaaatgtgatatttgggaaaagaaactagctcagactaaaagggtcttagccgccgcggaagagaatagcaaaatggaacagtcaaacctcgagaagctggaactgaatgtccgaaagctacagcaggagcttgatcaattgaacagagacaaactgtccctgcacaatgacatcagtgcaatgcaacagcagctacaggagaagagagaggccgtgaatagtctgcaggaagagcttgcaaacgtgcaggatcacctgaacttagcaaagcaggatctcttgcacacaaccaaacaccaggacgtcctcctatcggagcagacccgactccaaaaggatatatccgagtgggcaaatcgattcgaagactgtcagaaggaggaagaaacaaaacaacagcagctccaggtgctccagaacgagattgaggagaataaactaaagctggtgcagcaggagatgatgttccagagactgcagaaggagcgcgaatctgaggagagcaagcttgagactagcaaagtgacactgaaagaacagcagcaccagctcgagaaagaactcactgaccagaaaagcaaactggaccaagtcctctccaaggtgctcgccgcagaggaacgcgtccgcacattacaagaagaagaaaggtggtgcgaaagtctagagaagacactgtcacagaccaaacggcagctctcggagagggagcagcagctggtggagaagagcggagagctgcttgcactccaaaaagaagcggactcaatgcgcgccgatttcagtctcttgagaaaccagttcttgaccgagcggaagaaggctgagaagcaggtcgcttccctcaaagaggcactcaagattcagcgaagccagctggaaaaaaatcttctggaacagaagcaggagaattcatgtatacagaaagaaatggctaccatcgagttagttgctcaggataaccacgaaagggcccgacgcttgatgaaagagctgaaccagatgcaatacgagtacacggagctgaaaaagcaaatggccaatcaaaaggacttggagcgacggcagatggagatcagtgatgccatgcgtacattaaagagcgaagtaaaggacgaaataagaacttcattgaaaaatttaaaccagttcttgcccgagcttcctgctgacctcgaggcaatactcgaacgcaatgaaaacttggagggtgagctggagtcgttgaaggaaaatctgccattcacgatgaacgaggggccctttgaagagaagctgaatttttcacaggtgcatataatggatgagcactggaggggcgaggcccttagggaaaagctgcgccatcgcgaggatcgattgaaggcacagcttagacactgcatgtctaagcaggctgaggtgttaattaagggcaaaaggcagacggaggggacactgcactccctccggagacaagtggacgcgttaggggagttagtgacctctacctctgctgacagtgccagttccccctctctgtctcagctggagagctcacttactgaagattcccagctgggccagaatcagaagcagaataatagcctgcggtag

SEQ ID NO: 26179 - DNA, 657 bp, Artificial Sequence
  Description of Artificial Sequence: Synthetic coding sequence
atggacgagctggtgaccctggaggaggccgacggcggcagcgacatcctgttagtggtacccaaagctaccgtcctgcagaatcagctggacgaatcacaacaggaacgaaatgatcttatgcaattgaaactccagctagagggtcaagttactgagctccgatctcgcgtacaggagctggaacgggccctcgccacggcgaggcaagaacacacggagctcatggagcagtacaagggcatcagcagatctcacggggaaattacagaggaaagagatattttaagtaggcagcagggcgaccatgtcgcgaggatcctagaactggaggacgatattcagacaatcagcgaaaaggtactgacaaaagaggttgagctcgacaggctcagggataccgtgaaggcactgacccgggaacaagaaaagttgctagggcaattgaaagaagtgcaggctgacaaggaacagagtgaagctgagctccaagttgcccaacaggaaaaccaccacctaaacttagatctgaaagaggctaagtcctggcaagaggagcagtcagcccaagcccagagactcaaagataaggtggcgcagatgaaggatacactcgggcaggcacaacagagagtccgtccgtcttggagcccgtag

SEQ ID NO: 26180 - DNA, 693 bp, Artificial Sequence
  Description of Artificial Sequence: Synthetic coding sequence
atgaagaagccccggcccgccgccgccgcccccagcccccggcccccagcctgttcccgaggggctcaccctggcactgcctcggagctgcgcgttcctgcgctgagacgcggcggctgtggggaccggcgtctgcgcgaagaggcggccccagaacaagccgcggccgggccaagacgatccaccgtgggagccctgctggctagcgagctaggatggaagttctatgatgccgatgattaccaccccgaggagaaccgtcgcaagatgggtaagggcattccccttaatgaccaggaccgcatcccatggctgtgtaacctccatgatatactgttgagggatgtggccagcggacagcgtgtcgtccttgcttgcagcgccctgaagaagacatatcgggatattctaacccaggggaaggatggagtcgccttgaagtgtgaggaatccggcaaggaggccaagcaggccgagatgcaattactcgtagtacatttatcaggctcattcgaagtaatttctggccgcctgctgaagagagaggggcattttatgccccctgagttacttcagagccagtttgaaacacttgaaccccctgctgcccctgaaaacttcatccagatttccgtggacaaaaatgtctcagaaataattgccaccataatggaaaccctgaaaatgaagtag

SEQ ID NO: 26181 - DNA, 957 bp, Artificial Sequence
  Description of Artificial Sequence: Synthetic coding sequence
atgtgccggaccgccctgggcgtgaccaccctgcaggacctgggcgtatgctggcgaaaagaacatgaccccgcagagatgctccgggtgggacgtgccgaactggggggatggaaacctagctgggaagccattgtgaaggaggtggccgctgctaccggccataccgtcgtcctagtggatcagaccgaggacatcctggccaaatcgaagaagggcatcgaagaatccctgcggaaagtggccaagaaaaagttcgcagagaaccttaaggcaggcgatgagtttgtggaaaagacactctccaccattgccaccagcactgatgccgcctcagttgtgcatagcaccgatttagtcgttgaggccatagttgaaaatctcaaagttaagaacgaactcttcaagcgcctggacaaatttgccgccgagcacacgatctttgcaagtaatacatcttccctgcaaattactagcatcgccaacgcaactaccaggcaggatagatttgcagggctgcatttcttcaaccccgtgccagtgatgaagctcgtggaggttatcaagacccctatgacgtcccagaaaacatttgagtccctcgtcgacttctcaaaagcgctcggaaaacaccccgtatcttgcaaagatacgccaggatttatcgtgaatcgccttttagtcccgtacctgatggaggcaatccgtctttatgagagaggggatgcctctaaagaagacatcgacaccgccatgaagcttggcgcagggtacccgatgggtcccttcgagctgcttgattacgtcgggctggacactaccaaattcattgttgatggatggcacgagatggacgccgagaaccccctccaccagccaagcccatccttgaataagttagtggcggaaaataagttcggaaagaagacaggagagggcttttacaagtacaagtag

SEQ ID NO: 26182 - DNA, 666 bp, Artificial Sequence
  Description of Artificial Sequence: Synthetic coding sequence
atggccatcgtgcagaccctgcccgtgcccctggagcccgcccccgaggctgccactgctccacaagcacccgtgatggggagtgtgtcatcccttatctcaggacgcccctgtccaggcggccccgcacccccaagacaccatggtccgccaggaccgaccttctttcggcaacaagacggactgctgcgggggggatacgaggctcaggagcctttgtgccccgctgtgcccccacgtaaagcggtccccgtaaccagctttacgtacatcaacgaggacttccgcaccgaaagcccccccagcccctcatctgatgttgaggacgcccgggagcagagggcgcacaacgcccatcttaggggccccccccccaagctgattcctgtttctggtaaacttgagaagaatatggaaaagattctgattcgaccgaccgccttcaagccagttctaccaaagcccagaggtgcccccagtctgccaagcttcatgggcccacgtgcgaccggcctgagcggctcgcaagggagccttacacaactgtttggcgggccagccagctcgagttcttcaagcagttcgtcaagtgccgccgacaagcccttagcattttcgggatgggccagcggctgtccctccggcaccctctctgatagcggatag

SEQ ID NO: 26183 - DNA, 585 bp, Artificial Sequence
  Description of Artificial Sequence: Synthetic coding sequence
atgcgggagctggccgccgtggtgagccgggacatctacctgcacaaccccaacatcaaatggaacgacatcattggactcgatgcagcaaagcagctggtgaaagaggctgtcgtgtacccgataagataccctcagctcttcaccggtattctgtccccatggaaggggctgttgctgtacggacctcctggaacgggcaagacactgctggcaaaagcagtagctactgagtgtaagaccacattcttcaacatctccgctagtactatcgtatccaagtggagaggcgattccgagaaattggtgcgggtgctcttcgagctcgcccgataccacgccccctccacaatctttctggacgagctcgaatctgtgatgtcacagcgaggcaccgcctctgggggggaacacgagggcagcctccggatgaagactgaactcttggtgcaaatggacggactggctcggtcagaggacctggtcttcgttcttgcggccagtaatctgccatgcctaaaggctattgccctccagccgggtgatcgggcaaggcttaggttgaaaaagaaaaagtgcacgtag

SEQ ID NO: 26184 - DNA, 555 bp, Artificial Sequence
  Description of Artificial Sequence: Synthetic coding sequence
atgaccttccagttcaacttcaccatcgaggaccacctggagaacgaattaacccccatcagggacggggccctgacgctggactcttcaaaggagctttcggtgagcgaatcacaaaaaggagaggagcgagaccgcaaatgttccgcagaacagttcgacctgcctcaggaccacctgtgggagcataagtccatggagaatgctgcaccatcccaggatactgattcacctctttcggccgctagttcctctagaaacctcgagccacacggaaaacaaccatctttgagagccgcaaaggagcacgccatgcctaaggatcttaagaagatgctcgaaaacaaggtcattgaaaccttgcctggcttccagcacgtgaagctttcagtagtgaaaacaatcttactaaaggaaaacttccccggcgagaatatcgtcagcaaaagtttctcttcccatagtgatctgataaccggtgtgtatgaaggaggtctaaagatttgggaatgtacattcgatttgttggcctacttcactaaagctaaagtgtag

SEQ ID NO: 26185 - DNA, 354 bp, Artificial Sequence
  Description of Artificial Sequence: Synthetic coding sequence
atggtgctgatcctgggccggcggctgaaccgggaggacctgggcgtgcgggatagcccagccaccaaacgaaaggtcttcgagatggaccccaaaagcttaaccggccacgagttctttgattttagtagtggaagttcccacgctgagaacatactgcagatttttaatgagtttcgcgacagcagactcttcacagacgtcatcatctgtgtggagggaaaggagttcccatgccatcgtgctgtactgtccgcatgctcctcctacttcagggctatgttttgcaatgaccatagagagtcaagggagatgctagtggaaataaacggcattctggccgaggccatgtag

SEQ ID NO: 26186 - DNA, 498 bp, Artificial Sequence
  Description of Artificial Sequence: Synthetic coding sequence
atgatcctgaacgtgctggagtacggcagccagcaggtggccgacctgactctcaatctcgatgattacatcgacgccgaacacctgggggactttcaccggacctacaaaaacagcgaagaactgagatcaagaattgttagcgggatcatcactcctatccacgagcaatgggaaaaggctaacgtgagctctccccaccgagagttcccacctgctaccgcccgggaggtggacccactgcgaatcccccctcaccatccacatacgtcccgacagcctccatggcctcgtcgcgggggaatgatcgtggaccccttaaggagcgggtttcctcgcgctctgattgaccccagttcaggactgccaaaccggctgccccccggagccgtgccaccgggagcccgcttcgatcccttcgggccaatcggcacttccccaccaggacccaaccctgaccatctcccccctccagggtatgatgatatgtatctctag

SEQ ID NO: 26187 - DNA, 369 bp, Artificial Sequence
  Description of Artificial Sequence: Synthetic coding sequence
gccctgaccttcagcctgcgggccggcgccgccagcgcccaggacggtcggtgcccttgcggcgcgcgacggccagattcacgccttctccaactccatatcacaatgcctttctcatctcctatggaggcagaattggtgcgcagaattctctcgagagatgctgctcctctcccccgccctggagctgtgctgaaggatttcaccgtcagcggcaatcttctatttatacggctgaccgcagcggatcacaggcagctgcaactgagcatcagcagctgtctgcagcaattgtctcttctgatgtggattactcagtgctttctccctgtgtttcttgctcaggcgccctcaggccagcggaggtag

SEQ ID NO: 26188 - DNA, 2415 bp, Artificial Sequence
  Description of Artificial Sequence: Synthetic coding sequence
atgaagagcatcggcgtgaagaccgtgaaggtgtgcggcagcaagtcctctgtaagaatagagggacaaccctgctccctcggacagtcccgacgcaaagtgaagctcatgggcgaaaggagctacacactgagcatcggtaacggtgattatttttgggccaataaggagatgctgtgggactacgtgcagacactctctgaccagggggccgagaaacacgagggcaccggacagtcaagcggcataacggatcaggaaaaggaactgtctacaaatgcgttccaagcctttacaagtgggaactacgatgcttgcctgcagcatttggcctgccttcaggacatcaataaggacgactacaagatcattctgaataccgccgtggcagaatttttcaagtcaaaccagacgactacagataatcttagacagacactgaaccaacttaagaatcaggtgcattcagctgtcgaggaaatggatggcttggacgacgtggaaaactccatgctgtactataaccaggccgtcatcctgtaccatctgagacagtacaccgaggctatctccgtcggtgagaagctttaccagtttatagaaccatttgaagagaagttcgcccaggccgtttgctttctcctggtagacctgtatatcctaacatatcaggccgagaaagccctgcacctgcttgcagtactcgaaaaaatgattagccaagggaacaacaataagaacggtaagaacgaaacagggaataataataataaggatggctccaaccataaagccgagtctggggctctcattgaggcagccaaatccaaaattcaccaatataaggtgcgcgcttatatccagatgaaatctctcaaagcctgtaagcgggagattaagagcgtgatgaacaccgcagggaactccgccccttcactgtttctgaagtctaacttcgaatacctgcgaggcaattaccgcaaggctgtcaagttactcaacagcagcaacattgccgagcaccctggctttatgaaaaccggcgagtgcctgcgctgcatgttttggaataatctgggttgtatccattttgccatgagtaaacacaaccttggaatattttatttcaagaaagccctgcaggaaaacgataacgtgtgcgcccagctgtcagccggatctaccgatcccggcaagaagttcagcggtcggccaatgtgtacactgcttacaaataagagatacgagttgctctacaactgtggcatccagcttctccatatcggccgacccctcgcggccttcgagtgcctcattgaggccgtgcaggtctaccacgccaacccacgactatggctccgactcgccgaatgctgcatcgcagccaacaagggcacctcagaacaggagactaagggcttgcctagtaaaaaaggcatcgtacagagtattgtcggtcagggctaccaccgaaaaattgtgcttgcatcccagagcatccagaacacagtgtacaatgatgggcagtcttcagccatccctgttgctagcatggagtttgcagcaatctgtctgcgaaacgcgctgttgttgctaccagaggagcagcaggaccctaagcaagagaatggggctaaaaattcaaatcagctgggcggaaatacggagtcctccgagagtagcgaaacgtgctctagcaaatcgcacgatggagacaaatttattcccgctccaccatcttccccattgagaaaacaggagctagaaaacctaaaatgttctatccttgcctgctcagcttacgttgccctggctctgggagataacctcatggccctgaatcacgcggataagttactgcagcagcctaagcttagtggcagtctcaagttcctcggtcatctgtacgctgctgaggcgctgatcagtctcgatagaatttccgacgccataacccacctcaaccccgagaacgtgacggacgtttcactgggaattagctctaatgaacaagaccaagggtcagataagggagagaacgaggctatggagtcttctggcaagcgggccccccagtgttatcctagtagcgtaaatagcgccaggacagttatgctgtttaaccttggctctgcttattgcctgcggagcgagtacgacaaggctaggaagtgtctgcatcaggctgctagcatgatccatcccaaagaagtcccccctgaggcaatactattagccgtgtacttggaactgcagaatggcaacacccagttggcactgcagatcattaaaagaaaccagctcctccccgctgttaaaacacacagcgaggtgcgaaagaagccggtgttccagcccgtgcatcctattcagccaatccagatgcctgcattcacaaccgttcaacgcaaatag

SEQ ID NO: 26189 - DNA, 1899 bp, Artificial Sequence
  Description of Artificial Sequence: Synthetic coding sequence
atggacaccatgatgctgaacgtgcggaacctgttcgagcagctggtcagaagggtagaaattttgagtgagggcaacgaggtccagtttatacagctagcaaaggacttcgaagactttagaaaaaaatggcagcgtacagatcacgaactcggcaagtataaggaccttctaatgaaagccgagacagagcgctccgccctagacgtgaaactgaaacacgcaagaaaccaggtcgacgtggaaattaagagacgccagcgggctgaggctgattgcgagaagttggagcggcagatccagctgatccgcgaaatgctcatgtgcgacacaagcggctccatccagctgtcagaagagcaaaagtccgctttagcattccttaatagggggcagccatccagcagtaacgccgggaacaagaggctgtcaacaatagatgaatcaggctcgattctcagtgacatctctttcgataaaacagatgagtcccttgactgggatagcagtctggttaagaccttcaagctgaaaaagcgggagaagcgacgctccacatctcggcagttcgtggatggcccacctggtcctgtcaagaaaacaaggtctatcggctctgccgtggatcagggtaacgaatctatcgttgccaagaccacggttactgtgccaaatgacggaggccccatagaggccgtttctacaatagagactgttccctattggacccggtcccgtcgcaaaacggggaccctgcaaccttggaactctgacagcaccttgaactcacgacaattggagcctcgaaccgaaacagattctgtgggtacaccccaatctaacggcggcatgcgcctccacgacttcgtatccaagactgttataaagccagagagctgtgtgccttgtgggaagagaatcaagttcggcaagctgtcactgaagtgtcgtgactgccgcgtagtgtctcaccctgaatgcagagataggtgccccctaccatgcattccgacacttatcggcacccccgtgaaaatcggcgaaggaatgctggcggacttcgtcagccaaacctcccctatgataccgtctatagtggtgcactgtgtgaatgagattgagcaaagaggactgacagagaccggactgtaccgaatctcaggttgcgacagaactgtcaaagagctcaaagagaagtttctgagagttaagacagtacccttgctgtccaaggtggacgacattcacgccatctgttcacttctgaaagatttcctgaggaatttgaaagagccactactaacattcagattgaatcgcgcgttcatggaagctgcagagataacagatgaagacaactcaattgccgctatgtaccaggcagttggtgagctcccacaggctaatagggatacccttgcttttcttatgattcacttgcagagggttgcccagagtcctcataccaaaatggacgtagccaacctggctaaggtgttcggccccacgatcgtggcacacgccgtgcctaaccccgacccagtgactatgctgcaggacattaaacgacagcctaaggttgtagaaagactgctaagcctgcctctggaatattggtctcagtttatgatggtggaacaagagaatatcgatcctctgcatgtaatagaaaattccaacgcattctctacaccccagacccctgacatcaaggtgagcctgctcggccccgttactacccccgaacaccagctcctgaagactccgtccagctcatcactgagccagagggtgcgctcgacgctgactaagaacaccccaagattcggttctaagagcaaatctgcaaccaatctcggacgccagggtaacttcttcgcaagtccgatgctgaaatag

SEQ ID NO: 26190 - DNA, 585 bp, Artificial Sequence
  Description of Artificial Sequence: Synthetic coding sequence
atggaggacctgttcgagaccttccaggacgagatgggcttcagcaacatggaggacgacggccctgaagaggaagagagggtggcggaaccccaggccaattttaatacaccccaagccctgagatttgaagaattactggcaaatctgctcaacgaacagcaccagatcgctaaagaactgtttgaacaactgaaaatgaagaagccaagtgcgaagcaacaaaaggaggtggagaaggtaaaacctcaatgtaaagaagtgcaccagacactcatcctggatcctgcccaacgcaaacgcctccagcaacagatgcaacaacatgtccagttactgacacagatccatttgcttgccacatgtaatcccaatctcaaccctgaagcctccagcacccgaatctgcttaaaagagcttggtactttcgcccagtcctccatagcgctgcaccatcagtacaatcctaaattccagacactgtttcagccctgcaatctcatgggggcgatgcagctaatcgaagacttctcaacgcacgtgtctattgattgttcaccccataagactgtaaaaaagacctag

SEQ ID NO: 26191 - DNA, 1803 bp, Artificial Sequence
  Description of Artificial Sequence: Synthetic coding sequence
atggtgctgatcctgggccggcggctgaaccgggaggacctgggcgtgcgggattcgccagccacaaagaggaaggtgttcgagatggaccccaaaagccttactgggcatgaattctttgacttttcctctgggagcagccacgcggagaatatcttgcagatcttcaatgaatttagagattcccggctatttacagacgtcataatatgtgttgagggaaaagagttcccctgtcaccgcgccgtgctcagcgcttgctcctcttacttccgcgcgatgttttgcaacgatcatcgcgagagccgggagatgctggttgagataaatggcatcctcgcggaggccatggagtgctttctgcagtacgtgtacacaggcaaggtgaagatcacgacagagaatgtccagtatctctttgagacctcaagcctgtttcagatttcagtgctgcgggacgcttgtgcaaaattcctggaggaacagcttgacccctgtaattgtctgggcatccagagattcgccgatactcatagcctcaaaacattgtttaccaaatgcaagaactttgccctgcagacgtttgaggacgtgagccagcacgaggaattcctcgagctggataaggacgaactgattgactacatctgcagcgatgagctggtcattggaaaggaggaaatggtattcgaagccgtaatgcgctgggtgtatagagcagtcgacctccggaggcccctcctgcacgaactgctgacgcacgttcggctgcccctcttacatcctaattattttgttcaaactgttgaagtggatcagctcattcagaattcccccgagtgctaccagctgttacacgaagctcgcagataccacattcttggaaacgagatgatgtcaccaaggactcggccccgcaggagcacgggctattctgaagtcattgtggtcgtaggtggttgtgagcgcgtaggggggttcaatctaccttacaccgagtgctacgaccccgtgacaggtgagtggaaaagtttggccaagctgcctgaattcaccaaaagtgagtatgctgtgtgcgcactcagaaatgatattttagtgtctggcggaaggataaattctagagatgtgtggatctataatagccagctgaacatctggataagagtcgcttctttgaataagggtagatggcggcacaagatggccgtcttgcttggaaaggtttatgtggtgggcggctatgacggccaaaatagactctcatcagttgagtgctacgactctttcagcaacagatggacagaggtcgcacctctgaaagaggccgttagctcaccggcagtgaccagctgcgtggggaaattattcgtaatcggaggtgggccagacgacaatacctgctcagacaaggtgcagtcctacgatccagagacgaattcttggctcctgagagccgcgatacctatcgcaaagcgatgcatcacagcagtatcattaaacaacctcatctatgtggccggggggctgacgaaagcgatatattgttacgatccggtcgaagattattggatgcacgtccagaacacttttagtcgtcaggagaactgtggtatgagcgtatgcaatggtaaaatttacatcctagggggccgtcgcgaaaacggtgaggcaaccgataccattctctgctacgaccccgctacaagcatcataacaggtgtcgcagccatgcctcgaccagtgagctatcacggttgcgtcaccatccatcgttataatgagaagtgtttcaagctctag

SEQ ID NO: 26192 - DNA, 1620 bp, Artificial Sequence
  Description of Artificial Sequence: Synthetic coding sequence
atggccaccagcgcccccctgcggagcctggaggaggaggtgacctgtagtatctgcctggactatttgagggaccctgttacaatcgattgcgggcatgtgttctgtcgtagttgcacaacagacgtacgccctatttctgggagcaggccggtgtgccccctgtgcaagaagccctttaagaaggaaaatatccgtccggtgtggcaacttgcctccctggtggagaatattgagagactgaaggtggacaaaggtcggcagccgggcgaggtaacacgcgagcagcaagacgcaaagctttgtgagagacaccgagagaaattacactattactgcgaggatgacgggaagctgctatgtgtgatgtgccgggaatcccgggaacacagaccacatactgctgtcctgatggaaaaggctgcacaaccccatcgcgagaagattctgaatcatttgagtaccctccggcgtgatcgggataaaattcaaggcttccaggcaaaaggcgaggccgacatcctggcggcactgaaaaagttacaggatcagaggcaatatattgttgcagaattcgaacaaggacaccaattcctgagagagcgcgaagagcacctcctcgagcaacttgctaaattggaacaagaactgaccgaggggcgtgaaaagtttaagtcacggggagtgggggaattggcccgattggcactggtgatctccgaactggaggggaaagcccagcagccggccgcagagctgatgcaagacactagagacttcctgaatcgctatccgaggaagaaattctgggttggaaagcctatagctcgggtcgtgaagaagaaaacgggagagtttagcgacaaacttcttagtctccagcgcggcctcagagagtttcagggtaaactgctccgggacttagaatataagaccgttagcgttacacttgatccacaaagtgcctctggatatctgcaactgtctgaggattggaagtgcgtgacctatacctccctatacaagtccgcctacttgcatccacagcagttcgactgcgaaccaggggtgctggggtcaaaaggattcacctggggaaaggtgtattgggaagtggaggttgagcgggagggctggagcgaggatgaggaagaaggggacgaagaagaggagggcgaggaggaagaggaagaggaggaagcagggtacggggatggatatgatgactgggagactgacgaggatgaggaaagcctgggagacgaggaagaggaggaggaggaagaagaagaagaggtgttggagagctgcatggttggagtggcacgcgattctgttaaaagaaaaggagatctgtccctcaggcctgaagatggcgtatgggcccttaggctgagttcctccggcatttgggccaacacaagccccgaggctgagctcttccccgctctaaggcctagacgagtgggcatcgccctagattacgaagggggtacagtgacgttcacgaatgccgagtcccaggaattaatttacacctttacagccacctttaccagaaggctggttcccttcctgtggctgaagtggcccggaactagactgctgctgagaccttag

SEQ ID NO: 26193 - DNA, 567 bp, Artificial Sequence
  Description of Artificial Sequence: Synthetic coding sequence
tgatacgtgaacgccgtggacagccggtggagcagctacggcaacgaggccacaagctctgctcactacgtggagagggatagattcattgtgacagacttgtccggccaccggaagcacagcagtactggagatctgctatctctggaactgcagcaggcaaagagcaattcattgctcctccaacgcgaggcaaacgctctggctatgcagcagaaatggaattccctcgacgagggacgtcatctgaccttgaacctgctgtctaaggagatagagcttagaaacggcgagcttcagtctgattacacagaggatgcaactgacaccaaacccgaccgggacatcgaacttgaactcagcgccttagacactgacgaacctgacggacagtccgagcctatcgaggaaatcttagatatacagttgggaatttctagccagaatgaccaactcctgaacgggatggccgttgagaacggccatcccgtccagcaacatcagaaggaaccccccaagcaaaagaagcagtcactggggcgatctaagaaacaattttgtcgctag

SEQ ID NO: 26194 - DNA, 1806 bp, Artificial Sequence
  Description of Artificial Sequence: Synthetic coding sequence
atggaggagaccatgaagctggccaccatggaggacaccgtggagtactgcctgtttttgattcccgacgaaagccgggatagcgataagcacaaagagatcctgcagaagtatattgaaaggatcattacccggttcgcccccatgctggtaccttacatatggcagaatcagccatttaacctcaaatataaaccaggcaaaggcggggtgccagcccacatgttcggagtgacaaagtttggcgataacatcgaagatgagtggtttatcgtatatgttattaagcaaatcacaaaggaatttcccgagctggttgcaagaatcgaagacaacgatggggaatttctgctcatcgaggctgcagatttcttacccaagtggctggacccagagaatagtacgaaccgggtgtttttttgtcatggggagctgtgcataattcccgcgccgagaaagagtggggccgaatcttggcttcccactacacctcctaccattccccaagccctgaacatcataactgctcattccgaaaagatccttgcaagtgagagcatcagggcagccgtaaatagaaggatcagggggtatccggagaaaatccaggctagcctccaccgcgcacactgtttcttgccggcaggcattgttgctgtgttgaagcagcggcccagactggtggccgctgcagtacaggcgttttacctgcgggacccaatcgatctacgagcatgccgcgtgttcaaaaccttcctcccagaaacgaggattatgacaagcgcacacggattcgaaattctttgctccaagtgctctccccacttttctgactgtaagaagtccctcgtgactgcgagtcccttatgggcttctttcctggagtccttgaagaaaaacgattactttaaaggtctgatcgagggatccgcacagtaccgagagaggttggaaatggccgagaattattttcagcttagtgttgattggccggagtcttcattggctatgagtccgggagaagagatcctaactctgctgcagactatccctttcgatatcgaggacctgaaaaaggaagccgcaaatctgccaccggaggacgatgatcaatggttggacctatcccccgatcagttagaccagctcctgcaggaagcagttggtaaaaaagagtcagaatcggtgagcaaggaagagaaggagcaaaactatgacctgacagaagtgagtgaaagcatgaaagcattcatttccaaagtgtccacacacaagggtgctgagttgcctcgagagccatccgaggctccaataaccttcgacgctgattcctttcttaactacttcgacaagatactcgggccacgccccaacgagtccgattccgatgatcttgatgatgaggactttgaatgcctggattctgatgatgaccttgatttcgaaacccacgagcccggagaggaagcatctcttaagggcaccttggataacctgaagtcctatatggctcagatggaccaggagctagcccacacgtgtatttctaaatcatttaccactagaaatcaagtggagccggtgtcccagactacagataataactcagacgaagaagattctgggactggtgagtccgtgatggcacccgttgacgtggaccttaacctcgtatcgaatattctcgagagctacagttctcaagccggccttgcgggacccgcaagcaatctgctgcagtccatgggcgtgcagctgccggacaataccgatcatcggcccactagcaagccaaccaaaaactag

SEQ ID NO: 26195 - DNA, 405 bp, Artificial Sequence
  Description of Artificial Sequence: Synthetic coding sequence
atgaagaagaagcacgacggcatcgtgtacgagaccaaggaggtgttgaacccctctcccaaggtgacgcactgctgcaagtccctgtggttaaaatattccttccagaaagcgtacatgactcaattggtcagtagccagcctgtgcccgctatgtctcggaatcctgatcataacctgttgagccagccgaaggaacatagcattgttcaaaaacatcaccaggaagagatcatccacaaattagctatgcagctgagacatataggcgacaatatcgatcaccgcatggtgcgggaagatctacagcaggacggcagggatgcactggaccattttgttttctttttcttcagacgtgtccaggtgttactgcacttcttttggaacaaccacttgctgtag

SEQ ID NO: 26196 - DNA, 1791 bp, Artificial Sequence
  Description of Artificial Sequence: Synthetic coding sequence
atggaggacgccccccagcggctgcggtggcaggcccacctggagttcacccacaaccatgatgtgggcgatctcacatgggacaagattgcagtgagtctgccacggtcggagaaacttagaagcctcgtcctggccggaattccacatggtatgcggccccaactctggatgcgccttagtggcgcattacagaagaagagaaattcagaactctcctaccgcgagatagtaaagaactcgtctaacgacgaaacaattgctgccaagcagatagaaaaggacctccttcggactatgccttccaacgcctgcttcgcatcgatgggttcaattggagtgccacgacttaggcgggttttgagagctttggcctggctgtaccctgagatagggtactgtcagggaaccggcatggttgcggcctgtctactactcttcttggaggaggaagacgccttctggatgatgtccgccatcattgaggatttactgcccgcgtcatacttcagtaccacacttctcggggtgcaaaccgatcagagagtcctgagacacctgattgtccagtaccttcccaggttagataaactgctgcaggagcatgatatcgaactcagtttgataacactgcactggtttctgactgctttcgcctctgtggttgacatcaaattactgctgcgaatctgggacctgttcttttacgagggctcaagagtactgtttcagctcacgctggggatgttacatcttaaagaggaggaactcattcagtccgaaaacagtgcgtctatattcaacactctgtctgatattccttcccaaatggaggacgccgagctgttactcggggtggccatgcgtctcgccgggagcctgacggacgtggctgtggagacccaacgccgtaagcatctcgcctacctaatagcagatcaaggccagctgctgggcgccggaaccctgaccaacctgtcccaggtggtccgacggaggacccagcggcgaaagtcaactataactgctttgcttttcggcgaggatgacctcgaagccctaaaggctaaaaatattaaacaaacagagctggtcgcagacctccgggaagccatcctccgtgtggcgcgacatttccagtgtacagatcctaagaactgctccgtggagctgaccccggactactcaatggagagtcaccagcgggatcacgagaattacgtggcatgttctcgcagtcatcgacgccgagccaaagccctcctggactttgagcgccatgacgacgatgagctcggcttcagaaagaacgacattattactatcgtgtcacagaaggatgaacattgttgggtgggggagctgaatggccttagaggctggttccctgcaaagtttgtggaggttcttgacgagcggagcaaagaatactctatagccggcgacgacagcgtgacggagggggtgaccgaccttgtgagaggaactctgtgtccagctctcaaagccttgtttgagcatgggcttaagaaacctagccttctgggtggagcttgccacccgtggttgtttattgaggaggcagcgggccgagaagtagaaagagacttcgcctctgtatactcccgcctggtcctgtgcaaaaccttccggctcgacgaggacgggaaggtgctcacgcccgaggagcttctctaccgtgctgtgcagtcagttaatgtgacacacgatgcagttcacgctcagatggacgtaaaactgaggtctctgatctgcgtgggccttaaatag

SEQ ID NO: 26197 - DNA, 399 bp, Artificial Sequence
  Description of Artificial Sequence: Synthetic coding sequence
atggagagccgggtggccgacgccggcaccggcgagaccgcccgggctgccggtggaagccctgccgtcggatgtaccacccggggaccggtagtgtctgctcccttaggggccgctaggtggaagctcctgagacaggtgttaaagcagaaacacctagatgattgcttgcgacacgtgagtgtccgtagatttgagtcattcaatctattttcagtaaccgagggaaaagagagagaaaccgaagaggaagtcggggcctgggtgcagtacacctctattttttgtccggagtattcgatttccttgcgccataactcaggctccctcaacgtcgaggacgtgctcacctcattcgataataccggtaatgtttggtctttctctcgggggaagtag

SEQ ID NO: 26198 - DNA, 1620 bp, Artificial Sequence
  Description of Artificial Sequence: Synthetic coding sequence
atggccaccagcgcccccctgcggagcctggaggaggaggtgacctgctcaatttgtctggactatctgagggacccggtgacgatcgactgcggccatgtcttctgcaggtcatgtactaccgacgtgcgcccaatctctggctcaaggcccgtgtgccctctttgtaaaaagcctttcaagaaggaaaacatccgacccgtctggcagctggcatccctcgtagagaacatcgaacgtctgaaggtcgataaagggaggcaacccggagaggtcacgcgggaacagcaagacgccaaactgtgcgaaagacatcgcgagaaattgcactactattgtgaagacgacgggaagctgctttgtgtaatgtgccgagagagtagagagcacagaccgcataccgccgttctcatggagaaggcggctcaacctcatcgcgagaagatactgaaccatctcagtacactgaggcgggaccgagacaagattcagggcttccaggccaagggtgaagccgatattctcgcagctttgaaaaaactgcaagatcagagacagtacatagttgccgaatttgaacaaggccatcagttcctgcgtgagcgggaggagcacctgcttgaacagttagccaaattggagcaagaactgaccgagggcagggaaaagtttaagagccgcggggtgggggagctcgccagactggccctggtcatctccgagcttgagggcaaggctcagcagcccgcagccgaactgatgcaagacacacgggactttctgaaccgatatccgcggaaaaaattctgggtgggaaagcctatcgcgcgggtggtcaagaagaagactggcgaattctccgataagttgctctccctgcagcgaggactgcgcgagttccaggggaagctgctgagggatctagagtataagacagtttctgtgaccttggaccctcagtcagcctctggttacctgcagttgagcgaggattggaagtgcgtgacctatacctctctctacaagtccgcgtatctgcacccgcagcagttcgattgtgaacccggcgtattagggagcaaggggttcacatggggtaaggtctactgggaagtcgaggtggagagagaggggtggtctgaagatgaagaggagggcgacgaggaggaagagggagaagaagaggaagaagaggaagaggctgggtatggggacggctatgatgattgggaaactgatgaggatgaagaatcactgggtgacgaagaggaggaagaagaagaagaagaggaagaggtgcttgaatcatgtatggtcggcgtcgcaagggacagcgtaaagagaaaaggcgatctgagcctccggcctgaagacggtgtctgggcacttcgcttgtcctcctccggaatctgggcaaacacaagtccagaagctgagcttttcccagcgcttcggcccagaagagtgggcatagcattggattacgaaggagggacagtcacctttacaaatgcagagtcacaggagttaatatacacctttaccgcaacatttacccgtcgactcgttccttttctgtggctcaaatggcccggaacacgcttactgttgcgcccttag

SEQ ID NO: 26199 - DNA, 2193 bp, Artificial Sequence
  Description of Artificial Sequence: Synthetic coding sequence
atgaacaacagcagcagcgagacccggggccacccccacagcgcctcaagccctagcgagcgagtatttccaatgcctttgcccaggaaggctccccttaatattcctggtacccctgtcttggaggatttcccccagaacgatgacgagaaagaaagattgcagagaagaagatcccgcgtcttcgatctccagttttcaacggattcaccccggctgttggcctctccctcaagtcgcagcatagacatcagtgccacaattcccaaattcactaacacccagatcacggaacattattctacgtgtattaaactcagtacggaaaacaaaattaccaccaaaaacgcttttggcctgcacctaatcgattttatgtccgaaatcctgaaacagaaagacaccgagccgaccaacttcaaggtggctgcagggacgcttgatgcctcaaccaaaatttatgctgtacgggtggatgcggtgcatgccgatgtgtatcgtgtcctgggtgggttggggaaggacgctccatcattagaagaagtggagggacacgttgccgatggtagcgccacagagatgggcaccaccaagaaagctgtgaagccaaagaaaaaacatctccaccggaccattgagcagaatatcaataatctcaacgtcagcgaagctgataggaagtgcgagatcgatccaatgtttcagaagaccgccgccagttttgatgagtgtagtacagctggggtcttccttagcacactgcattgccaggactatagatcggagttgctgtttccaagtgacgtgcaaacactgagcaccggagagcctctggaacttcctgagttggggtgcgtggagatgacggatctgaaagcccctttgcagcagtgtgcagaagataggcaaatctgcccctctctggcggggtttcagtttacccagtgggattctgaaacacataatgagagtgtcagcgccctggtcgataaattcaagaaaaacgaccaggtctttgatattaatgcggaagtcgacgagagcgattgtggggattttccggacggatctctcggcgatgatttcgatgccaatgatgagcccgatcatactgccgtcggggatcatgaggagttcagaagttggaaggagccttgtcaggtacagagttgtcaggaggaaatgatctccctcggggacggagatattaggaccatgtgcccattgcttagcatgaagcctggggagtattcctacttctctccccgaaccatgtcaatgtgggctggccccgatcactggcgctttaggcccaggagaaagcaggatgccccctcccaatctgaaaataagaagaagagcacgaaaaaggatttcgagattgatttcgaggacgatattgattttgacgtgtattttcggaagacaaaggccgccacaatcctcactaagtctaccctcgagaaccaaaactggagggccactacgcttccaaccgactttaactataacgtagatactttggtgcagttgcaccttaagccaggaactagactcctgaagatggcccaaggccaccgtgtcgaaactgaacattacgaggaaatcgaggattacgactacaacaatccaaacgacacgtccaatttttgccccggccttcaggcagctgattcagacgacgaggacctggacgacctgttcgtggggccggtgggcaactccgatctgagcccgtacccttgtcatcccccgaagacagcacagcagaacggcgatacacccgaggcgcagggactggacattacaacatacggtgagagtaacctggttgctgagcctcagaaggttaacaaaattgagatacactatgccaagaccgcaaagaagatggacatgaagaagctgaagcagagtatgtggagtttgttaactgctctgtccggcaaggaggctgatgctgaggccaatcaccgcgaagccggaaaagaggccgccctagcggaggtagcagatgagaagatgctctctggacttaccaaagatttacaacggtctctgccaccagtgatggcccaaaacttgtccatccccctggcattcgcatgccttctgcaccttgccaacgaaaagaatctgaagcttgaggggaccgaagacctaagtgatgtcctcgttcgtcagggtgactag

SEQ ID NO: 26200 - DNA, 900 bp, Artificial Sequence
  Description of Artificial Sequence: Synthetic coding sequence
atggagacccagttccccgtgagcgagggcaaggtggacccctaccgatcttgtggattcagctacgagcaggacccgaccttgcgcgatcctgaggccgtggccagacgctggccttggatggtgtcagtaagagcaaacgggacccatatttgtgccggcaccattatcgcttcacagtgggtgctcaccgtagcgcactgcttgatttggcgcgatgtgatctatagtgtcagagtgggctccccatggatcgaccagatgacgcaaaccgcatccgacgtacccgtcctgcaagtgattatgcactcacgctatagagcccagcggttctggtcttgggtaggacaggccaatgacatcggtctattgaaactcaagcaggaacttaagtattccaactacgtgaggccaatctgcctgccaggcactgattatgtgctgaaggaccacagcagatgcacagttactggatggggactgagcaaggctgacggtatgtggccccagttcagaacaatccaagagaaagaggttatcattctgaataataaagaatgtgataacttttaccataactttacaaaaattcccaccttagttcagataataaaaagccagatgatgtgtgctgaagacactcatcgagagaaattttgctacgagctgacgggggaacctttagtttgttccatggagggcacttggtacctcgttggactggtgtcgtggggtgctgggtgccagaagtctgaggcgcctcctatttacctacaagtgtcatcttaccagcattggatttgggattgcctgaatggccaggcactcgcccttcccgccccctccagaaccctgctccttgcgctacccttacccttatctctgctggccgccctttag

SEQ ID NO: 26201 - DNA, 1089 bp, Artificial Sequence
  Description of Artificial Sequence: Synthetic coding sequence
atgctggtgcccggcagcacccggccctacagcaagaagcggcagaactcaaaatccgcccagggtctagctggactccgtaatttgggaaatacatgtttcatgaactccatactgcaatgcttgtctaacacacgcgagctgagagactactgccttcagcgattgtatatgagggacctccaccacgggtcgaatgcgcatacagcattagttgaagagtttgcaaaacttatccagactatctggacaagctctcccaacgatgttgtgtctccaagcgaattcaagacccagatccaaaggtacgcaccacggttcgtgggttataatcaacaagacgcgcaggaattcctccgtttccttttggatgggctccacaacgaagtgaatcgagtgactctgcggcccaaatccaacccagagaacctcgatcacttacctgatgatgagaagggccggcagatgtggcgcaaatacctggagagagaggattcccgcattggggatctattcgtggggcagttgaaaagctcgttgacttgcaccgattgtggatattgctccacagtatttgacccattctgggatctgtccctgcccatcgcaaagaggggctaccccgaggtgacgctgatggattgcatgcgcctgtttaccaaagaagacgtgctggacggagacgaaaagccaacttgttgtcgatgtcggggccgtaagcgctgtatcaagaaattttccatacaacgcttcccaaagattctcgtgctgcacctgaagagattcagcgagagccgtatccgtacaagcaagttaacaaccttcgtcaacttcccgctccgagacttagacttgagagagttcgcctcagaaaatactaaccatgctgtctacaacctctacgctgtctcaaaccactccggaaccaccatgggaggtcattataccgcctactgcaggtcccccggtaccggagaatggcacacgtttaacgacagcagcgtgactcctatgagtagtagccaggtccgcacctcagatgcataccttttgttttacgaactggcttccccaccttctaggatgtag

SEQ ID NO: 26202 - DNA, 1800 bp, Artificial Sequence
  Description of Artificial Sequence: Synthetic coding sequence
atggaccccggcgacgccgccatcctggagagcagcctgcggatcctctacaggctctttgaaagtgtgctgccccctttgcccgcagcactgcaatctagaatgaacgttatcgaccatgtgcgtgatatggcggctgctggcttgcattcaaacgtgaggctgctgagctctctgctgcttactatgtccaacaacaaccccgaactgttctcacccccacagaagtatcaactcctcgtgtaccatgctgacagccttttccatgataaggagtaccgaaacgccgtgtccaagtatactatggcacttcaacagaaaaaagccctgtcaaagacaagcaaggtgcgcccctccactggtaactccgcctccactccacaatctcagtgcttgccaagtgaaattgaagtcaagtataagatggccgaatgttatacgatgctgaaacaggacaaggatgcaatagctatattggatgggatccccagcagacaaagaacccccaagattaacatgatgctggcaaacctatacaaaaaggccgggcaagaaagaccgtccgtgacatcatataaggaggtccttcgtcaatgcccactcgccctggacgctatcctgggactgttgtctctaagtgtaaagggagcggaggtggcttccatgaccatgaacgtgatccagactgtccctaacctagattggttatcagtgtggattaaagcctatgcctttgtacacactggcgataattcaagagccattagcaccatatgtagccttgagaagaaatcgttgctcagagacaatgttgacctgctcggctccctggccgatctgtactttcgagctggggataacaagaatagcgtccttaaattcgaacaggcacagatgcttgatccatatttgatcaaaggtatggatgtttatggctacttgctggcccgagagggccgtcttgaggatgtcgagaacctcggctgtagactgttcaacatttccgatcagcacgccgagccttgggtggtatctgggtgtcattcattctactccaaaagatatagcagagcgctgtacctgggagccaaagccatccagctgaacagtaattcagtgcaagcactgctgctgaagggagctgccctgaggaacatgggacgggtgcaagaagctattatccacttccgggaggcaattcgccttgctccatgcagactggactgctacgagggcctgatcgaatgctacttggcttctaattccatccgggaggccatggtaatggccaataatgtctacaagaccctgggtgcaaacgcccagacactgaccttgctggctactgtctgtttggaagaccccgttacccaggagaaggcgaaaacattactcgacaaggcccttacacagcgtccagattatatcaaagcagtcgtcaagaaggcagaactgctctcccgggagcagaaatacgaggatggtatcgctctgcttagaaatgcattagccaaccaatctgactgtgtcttacacagaatccttggagacttcctggtagccgtgaatgagtaccaggaggccatggatcaatatagcatcgctctgagtctggaccccaatgatcagaagtccctagaggggatgcagaagatggagaaagaggagtcccctacagatgctacccaggaagaggacgtggacgacatggaagggagtggagaggagggcgatctggaagggagcgatagtgaggcagcccagtgggccgaccaggagcagtggttcggtatgcagtag

SEQ ID NO: 26203 - DNA, 507 bp, Artificial Sequence
  Description of Artificial Sequence: Synthetic coding sequence
atgcccgccacccggaagcccatgcggtacggccacaccgagggccacaccgaggtgtgcttcgacgacagcggctcattcatcgtgacatgcggctccgacggtgatgtgcggatctgggaagaccttgatgatgacgaccccaaatttattaacgtgggggaaaaagcgtattcttgtgctcttaagtccgggaagctagtgaccgcagtgtccaacaacacgatccaagtccacacctttccggaaggcgtgccagacgggattttgacgcgctttacaactaatgctaatcatgtggtgtttaacggagacggaactaagatcgcagctggctcctctgactttctggtcaaaattgtggacgtgatggactcctctcagcagaaaacgtttcgcggccacgacgcaccagtactttctcttagctttgacccgaaagacatttttcttgcctccgcttcatgcgatgggagtgtgagagtgtggcagataagcgatcagtag

SEQ ID NO: 26204 - DNA, 141 bp, Artificial Sequence
  Description of Artificial Sequence: Synthetic coding sequence
atggtgaacagctgctgcggcagcgtgtgcagcgaccagggctgcgggctggaaaactgctgtcgaccctcctgttgccaaaccacatgctgccgaaccacctgttgtcgcccattatgttgcgcctcctcttgttgctag

SEQ ID NO: 26205 - DNA, 669 bp, Artificial Sequence
  Description of Artificial Sequence: Synthetic coding sequence
atggccagcgtggtggagtacaagggcctgcgggccggctaccactgcggatactgcgattccaaggaaggaaaggcctcatgcggtatgtgggctcactcaatgacagttcaggactatcaagatctaattgatagaggctggagaaggtccgggaagtatgtgtacaaaccggttatgaatcagacttgttgcccacaatacaccatccggtgccgacctttacagtttcagccctccaagtcacacaagaaagtcctgaaaaagatgctgaagtttttggcaaagggtgaggtgcctaaaggcagctgtgaagacgagcccatggatagtaccatggatgacgctgtggcaggagactttgccctcatcaataaactggacattcaatgcgaccttaagactctctcagacgatatcaaagagtcactcgagagcgaaggtaagaactctaaaaaagaagagccccaagaactgctccagtctcaagattttgttggcgaaaagctggggagtggagagcctagccacagcgtgaaggtacacactgtccccaaacccgggaagggggctgacctttcaaaacctccctgccgcaaagcgaaggagatcaggaaggagaggaagcggctcaagcttatgcagcaaaaccctgccggcgagctgtag

SEQ ID NO: 26206 - DNA, 495 bp, Artificial Sequence
  Description of Artificial Sequence: Synthetic coding sequence
atgctgaaggccgtgatcctgatcggcggcccccagaagggcacccgatttaggccgctgtcttttgaggttccaaaaccactgttcccagtagctggagtgcctatgatacaacatcatatcgaggcatgcgcgcaggtgccgggcatgcaggaaattctcttaatcggattctaccagccagacgagcccctgacacagttcttggaagcggcccagcaagagttcaacctaccggtaagatacctgcaggagtttgcacccctaggcacaggtgggggcctgtatcactttcgagaccagatcttggccggttcgccagaggcgttttttgtgcttaacgcagacgtgtgtagcgatttccccctgtccgccatgctggaagcacatcggaggcagcgtcatccattcttgctcctgggaacgaccgctaaccgaacacagtcactaaactacggatgtattgttgaaaatccccaaacacacgaagtatag

SEQ ID NO: 26207 - DNA, 339 bp, Artificial Sequence
  Description of Artificial Sequence: Synthetic coding sequence
atgttcgtgagcgacttccggaaggagttctacgaggtggtgcagagtcaacgcgtgctgctctttgttgctagcgatgtggatgcactctgcgcatgcaaaatcctgcaggctttgttccagtgtgaccacgttcagtacactctagtgcctgtgagcggttggcaggagctcgaaaccgctttcctggagcacaaagagcagttccattacttcatcctcatcaactgtggcgccaacgttgacctgctggatatcttacagccagacgaagacacaattttctttgtatgcgacactcacagacccgtaaatgtggtaaatgtttacaacgattag

SEQ ID NO: 26208 - DNA, 942 bp, Artificial Sequence
  Description of Artificial Sequence: Synthetic coding sequence
accctggtggtgagcggccgggacgacccccccacccacagccagcccgactcagatgatgaagctgaagagatacagtggtccgacgatgagaacacagcaacactcaccgctccagaatttcccgagttcgcgaccaaagtgcaggaggcgatcaattccctgggcggctctgtctttccaaagctgaattggtccgccccacgcgatgcttactggatcgccatgaactcctcgctcaagtgcaagacactgagtgatatttttttgctttttaagtcttcagatttcatcacacgcgacttcactcagccatttattcattgtaccgacgactctcctgatccctgtatcgagtatgagctggtcctgaggaaatggtgcgaactgatacccggggccgagtttcgctgctttgtgaaggagaataagctgattggaattagccagcgcgattatacacagtactatgaccatatatccaaacagaaggaggagatacggaggtgcatacaggacttctttaagaagcacatacagtataagtttttggatgaagattttgtgtttgatatctatagagacagtagagattcaccagcttttagatgtactaactcagaggtaaccgttcaaccctccccgtacctctcctacagacttcctaaagattttgtcgacctgagcacaggagaagacgcacacaaactaatcgataaaagcgcaggtggacggcttatgtcagtcctggaactcgaaaaacgcagacctcggccaacagccccgggagccgctcaccagcctcaactacctgcagacccagacgccggaggaccatcttctgtagacatttcgcactttctgtacagttgcacctttacctggggcaagaagcggagggacttcgctacatgcaagaataacattatcaatcggagttag

SEQ ID NO: 26209 - DNA, 1017 bp, Artificial Sequence
  Description of Artificial Sequence: Synthetic coding sequence
atggagctgtggggccggatgctgtgggccctgctgagcggccccggaaggagaggatctaccagggggtgggccttctcgagctggcaaccgcagcccccacttgctggcttaagcagcgctattgaactggtcagtcattggacgggtgtatttgaaaaacgcggaatacccgaggctcgagagtcctctgagtacattgtagctcacgtcttaggtgcaaaaacattccagtctctcagaccagctctttggactcagccactgactagtcagcagctgcaatgcattagagaactgtcgagtaggcgtctccagagaatgcctgtacagtacatactgggtgaatgggatttccagggcctgagcttacggatggtgccccccgtctttatccctaggcccgagacggaggagctggtcgaatgggtcctggaagaggtggcacagcggtcccacgcagtggggtcccctggtagtccactcatcctggaagtcggatgcggctcaggcgccatcagtctgagtctcctgagtcaactgccccagtctcgagtgattgctgtggacaaacgggaggcagctatttcgcttacgcacgaaaatgcacaaagacttaggctgcaggaccgaatctggatcatccacctcgacatgacgtctgagagatcctggacccacttgccctgggggcctatggaccttatagtctctaatccaccttatgtgtttcaccaggacatggagcagctggctccagagatccggtcttatgaggatccagccgcgcttgatggaggcgaggagggaatggacatcatcacacatattttggccttagccccccgcctgctgaaagatagcgggtccatttttctggaggtcgatccaagacatcccgaactggtctcaagctggctgcagagccggccagatctgtatctgaatctcgtggctgtccggagggatttctgcgggcgccccagattccttcacatccgccgctccggcccttag

SEQ ID NO: 26210 - DNA, 1119 bp, Artificial Sequence
  Description of Artificial Sequence: Synthetic coding sequence
atgaagcggcggaccgaccccgagtgcaccgcccccatcaagaagcaaaagaaacgtgtggccgagctcgctttgagcctgtcatccacctccgacgatgaacccccaagctcagtgtcacatggtgctaaggctagcaccacttccctgagcggctctgattctgaaacagagggcaaacagcattcgtcggactcatttgacgacgccttcaaagccgactcgcttgttgagggcacaagcagcaggtactcgatgtacaacagtgtttcacagaagctgatggccaagatgggatttcgggaaggcgagggcctagggaaatacagccagggacgtaaagacatcgtggaggcctcatcccagaaaggtcggcgcggactgggcttgaccctgcgaggtttcgaccaggaactaaacgtggattggagggatgagccagaaccaagtgcttgcgagcaggtatcatggtttccggaatgtacaacagaaattcctgacactcaagaaatgagcgactggatggtggtcggaaagagaaaaatgattatcgaagacgaaacagagttctgtggagaggagctgctacacagtgtactgcaatgcaagaagcctttggtgaaggatcgagaggcggaactgctttacttcgccgatgtttgcgccggcccaggtgggttttctgagtacgtgctctggcgcaagaaatggcatgctaagggctttgggatgactctcaagggacctaacgatttcaaactggaggacttctacagcgctagcagcgaactgttcgagccatactacggcgagggggggatagacggagatggcgatatcaccagacctgaaaacatctcggctttccgaaactttgtcctggataacacggaccgaaaaggagtgcatttcctgatggccgacggggggttttccgtggaaggccaggagaatctccaggagatcctctctaaacagcttcttttgtgtcagttcctgatggccctctcaatcgtgagaactggtggccactttatctgcaagacattcgacctatttaccccattctcagtgggtctcgtgtacctcttgtattgttgctttgaacgggtctgctag

SEQ ID NO: 26211 - DNA, 408 bp, Artificial Sequence
  Description of Artificial Sequence: Synthetic coding sequence
tgacagctggccagcatggtgtggaacaaccccagccagcagcagttcatgcagttcggcggaagcagcggatctcaactcccacagatacagacagacgttgtcctcccgtcttgcaagaaaaaggccccggcagagacaccggtgaaagaacgtctgtttattgtcttcaaccctcatcctctgccgctggatgtgctggaggatatcttttgtaggttcggtaaccttattgaggtgtatttggtttcgggcaaaaacgtaggttacgccaagtatgccgatcgcataagcgccaacgacgctatagctacactgcacgggaagatcctgaacggagtacggctgaaggtgatgctggctgacagcccccgggaagaatccaacaaaagacagcgcacatattag

SEQ ID NO: 26212 - DNA, 1764 bp, Artificial Sequence
  Description of Artificial Sequence: Synthetic coding sequence
atggccagcgaggacatcgccaagctggccgagaccctggccaagacacaggtcgccggcggccagctctcctttaaaggaaagagcctaaagttgaacacagcagaggatgccaaggacgtcatcaaggagatcgaggacttcgacagccttgaggctttacggcttgagggaaacacagtgggagtcgaagccgcccgggtcattgctaaggcccttgagaaaaagtctgagctcaagaggtgtcactggtcagacatgtttacaggtaggctccgcaccgagattccacccgcgttgatcagtttgggagaaggtttgatcacagctggagctcagcttgtggagcttgacctgtcagacaacgcgtttggcccagatggcgtgcaggggtttgaggctttacttaaatcatcagcgtgcttcacactacaggagctgaagctgaataattgcggcatgggaatcggcgggggcaaaatcttggcagcagcactaacggagtgccataggaaatctagtgctcaaggcaagccactcgctctgaaagtgtttgtggcagggagaaatagacttgagaacgatggtgctaccgcactcgccgaagctttcagagtaatcggtacactcgaagaagtgcatatgcctcagaacgggataaaccacccagggatcacagccctggcccaggcattcgcagtgaaccccctactaagagttatcaacctgaacgacaacacatttaccgagaagggggccgtggcaatggcagaaaccttaaaaacattgaggcaggtggaagtgatcaattttggggactgtctggtgaggtccaaaggggccgtcgccatcgcagacgcaattagaggaggccttcccaagctcaaagagttgaacttgtctttttgtgagataaagcgagatgccgccctggctgtggccgaagctatggcagataaagccgaattagagaaattggaccttaacggcaataccctgggcgaggagggatgcgagcagctgcaagaggtgctcgagggcttcaacatggccaaggtgctggcctccctgtctgacgatgaggatgaggaagaggaggaagaaggcgaggaggaagaagaagaagccgaagaggaggaagaggaggacgaggaggaagaagaggaagaagaagaagaagaggaggaagagcctcaacagcgcggacagggggaaaagtctgcaactccttccagaaagattttagacccaaataccggcgagccagcgccagtgctgagctcaccacctccagccgatgtgtcaacttttctggcttttccttcacccgaaaaactgctacgacttggacctaaatcttccgtactcattgcacagcagacagatactagcgatccggagaaggtggtttccgcctttctcaaggtgagctccgtattcaaggacgaagcaacggtccgcatggcggttcaggatgctgtagatgccctgatgcaaaaggcttttaatagcagcagtttcaattcgaatacctttttaacgcgtctgctcgtgcatatgggactcctcaaatcagaggacaaagtgaaggctattgccaacctctatggacccctgatggcgctgaatcacatggtgcaacaggactatttcccaaaagccctcgctcccttgctactagccttcgtgactaagccaaactcagcactcgagtcctgttcattcgctaggcactcactgctccaaacactctataaggtgtag

SEQ ID NO: 26213 - DNA, 1842 bp, Artificial Sequence
  Description of Artificial Sequence: Synthetic coding sequence
atggccaccatccccgactggaagctgcagctgctggcccggcggaggcaggaggaagcatccgtgcgtggaagggagaaggccgagcgcgagcggctgagccagatgcccgcctggaagcgggggctccttgagcggcgacgggccaagctggggctgtctccaggagagcccagtccggtcctcggcaccgttgaggccgggcctccagatccagatgaatctgccgtactgctggaagcaatcgggcccgtccatcagaatagattcattaggcaggagaggcagcagcaacagcagcaacagcagcgatcggaggagctcctggctgagcggaagccgggcccgctggaggccagggagcgcaggccctctcctggggaaatgcgggaccagtcccctaaagggagggagtccagggaggagagactgtcacctcgggagaccagggagcgcagattaggcatcggaggcgcccaagaactgtccctccgaccattggaggcccgagactggaggcagtccccaggagaggtgggggaccggagctcccggcttagcgaggcttggaaatggagactgtctcccggagagacacccgagcgctctcttcgactggctgaatcccgcgagcaatctccacgaagaaaggaggtcgagagccggctatcccccggagagtccgcctaccagaagctggggctgaccgaagcccataagtggcgccccgatagccgtgaatcccaggagcagtctctggtgcaattagaagcaaccgagtggcgcctcaggtctggcgaagagagacaggactacagcgaagagtgtggacgcaaagaggaatggcccgttcccggggtcgctcccaaggaaacagctgaattgagcgaaacattaacccgcgaggctcaggggaatagtagcgctggagtcgaagccgcagaacagcgcccagtggaggatggagagaggggaatgaaacccacagagggatggaagtggaccctcaattctggtaaagctcgcgagtggacgcctagagacatcgaagcccagacccagaagccagagcctccagagtcagcagagaagctcttagaaagcccaggtgtggaggcaggagaaggggaggccgagaaagaggaggctggggcgcagggaagacctcttagggcgctgcaaaattgctgctctgtgccaagcccgctgccacccgaggacgcgggaaccggcggcttacgtcaacaggaggaggaggccgttgaactccaaccccccccaccagctccactaagtcccccaccgcctgcaccaaccgcgccccagcctccaggcgaccctctgatgtccagactgttttacggtgtaaaagcaggacctggcgtcggagctcccaggcggtccggacacaccttcacagttaaccctcgccggtcggtgcctccggctacgccagcaacgcctacctctccagcgactgtagacgcagctgtgccaggagctggcaagaagcgataccccacagccgaggagatactggtcttaggtggctacttgcgcctctcacggtcatgcttggctaagggcagtcctgaacggcaccacaagcaattgaagattagcttctctgaaaccgccctggagactacgtaccaatacccgagcgaatcaagtgttttggaggaacttggtcctgaacctgaagtgcccagcgccccaaacccccccgcggcacaaccagacgacgaggaggatgaagaggaactcctgttgcttcagcccgaacttcagggaggcctgcggaccaaggccttaattgttgatgaatcctgccgccgatag

SEQ ID NO: 26214 - DNA, 477 bp, Artificial Sequence
  Description of Artificial Sequence: Synthetic coding sequence
atgacccactgctgcagcccctgctgccagcccacctgctgccggaccacatgctgccgcaccacctgctggaagccgaccactgtgacaacctgtagtagcactccatgttgccagccggcctgttgtgtctcgagttgttgccaaccttgttgcaggcctacttgttgtcagaatacatgctgtaggacgacgtgctgtcaaccaacttgccctacatgctgtggaagcagttgttgcggccagacgtcttgtggcagttcctgcggccagtcgagctcctgcgcgcctgtgtactgtaggcggacgtgttactatcctaccaccgtctgtctccctgggtgcctcaaccagagttgcgggtctaactgctgccagccttgctgtcgccctgcctgctgcgaaaccacctgttgtaggacaacatgctttcagccaacttgcgtgagcagctgctgtcagcccagctgctgctag

SEQ ID NO: 26215 - DNA, 1620 bp, Artificial Sequence
  Description of Artificial Sequence: Synthetic coding sequence
atggccaccagcgcccccctgcggagcctggaggaggaggtgacctgtagcatttgcttggactaccttcgggatccagtcaccatcgactgtggacatgtcttctgtaggagctgcacgacagatgtgcggcctatatccggctccaggcctgtctgcccgttgtgtaaaaaaccctttaagaaggagaatattcgaccggtatggcaattggcctccctcgtggagaacatcgaacggctgaaggtagacaagggccgccagccaggagaagtcactcgcgaacaacaagacgccaagctgtgtgagcgccatcgggaaaaactccactactactgcgaggacgacgggaagcttctctgcgtaatgtgccgggagtccagagaacatcggccccataccgctgtgttgatggagaaggctgctcagcctcacagagaaaagattctgaaccacctgagcactcttcgaagagatcgcgacaagattcaagggttccaggccaagggggaggccgatatcctggccgcattgaagaagcttcaggatcagcgtcagtatatcgtcgccgagttcgaacagggccatcagtttctgagagaacgagaagagcatcttcttgagcagctcgcaaagctcgagcaggaattaactgagggccgggaaaagttcaaatcccgcggagtgggggagcttgcacgattggctctggtgatttccgagcttgagggcaaagcgcagcagcccgccgctgagctaatgcaggacactcgcgatttccttaatagataccctaggaagaagttctgggtaggtaaaccgatagcgagggtcgttaagaaaaaaaccggggaattcagtgataaactcctgtccttgcaaagaggattgcgcgagttccagggtaaactgctgcgggacctggagtacaagaccgttagcgttaccctcgacccacagtcggcttccgggtacctgcaactgagcgaggactggaaatgtgttacctatacaagcctttacaagtccgcatacttgcaccctcagcaattcgattgcgagcccggagtgcttggatctaagggattcacatggggcaaagtctactgggaagttgaagttgaaagagagggatggtccgaagacgaagaggagggcgatgaagaggaggagggagaggaggaggaggaggaagaggaggccggatacggtgatggatacgatgactgggaaactgatgaagatgaagagtccctgggtgacgaggaagaggaagaggaggaggaggaggaagaagtgctcgagagctgcatggtaggggtggcacgtgactcagttaaacggaagggggacctgtctctgcggcccgaggacggagtgtgggctttaaggctaagctcctccggtatctgggccaatacgtcacctgaggcagaacttttccccgctctgcgaccccggagggtcggaattgctctcgactacgaggggggcaccgtgaccttcacgaacgccgagtcacaggagctgatatatacattcaccgccacttttacacgtcggttggttccctttctatggcttaagtggcccggaactcgcctgctattaagaccctag

SEQ ID NO: 26216 - DNA, 2511 bp, Artificial Sequence
  Description of Artificial Sequence: Synthetic coding sequence
atggccgccgccctgggcccccccgaggtgatcgcccagctggagaacgccgcaaaagttctgatgcaaacccttgcttgttctattctgacggcactcctgtcagagttcagctcttctagtaagaccagtaacatcggtctgtctatggaatttcacggtaattgcaaaagggtgttccaagaagaggatctccgccagatttttatgcttacggttgaggtcctccaggaattttcgcggagggagaatctcaacgcgcagatgtcctccgtctttcagagatatcttgccttggccaatcaggtcttgtcctggaattttctgcccccgaagcttggacgtcactatatcgctatgttcgagagcagccagaatgtactgttgaaacccacggaaagctggcgtgaaactcttctggattcacgagtgatggaattgttttttacggtgcatcggaagattcgagaagattccgatatggcgcaggacagtttgcagtgcctggcacagctagctagcctccacggtccaatcttccccgacgaagggagccaagtcgactatctggcacattttatagaggggttgttgaacaccattaacgggatcgaaatagaagactccgaagccgtcggcatctcatctattatcagcaatctgataacagtgtttccccgcaatgtgctcactgccattccttccgagctcttctcatcgtttgtgaactgtctcacacacctgacctgtagctttggccgcagcgcggccctggaagaagtgctagacaaagatgacatggtgtacatggaagcctacgataagctgctggagagctggctgactctggttcaggacgataaacatttccataagggcttcttcactcagcacgctgtgcaggtgttcaattcttacatacagtgccacttggctgcacccgacggaaccagaaaccttaccgcgaacggggtggcttctagagaggaggaagaaatttcagaactacaggaagacgacagggatcagtttagcgatcagcttgccagcgtcggtatgctcggtcggatcgccgctgaacattgtatccctctgttgacctctttgctcgaggaacgggtgacaagactgcacggccagctacagcggcaccagcagcagttgctggcaagccccggctcatcaaccgttgacaacaagatgctagatgacctttatgaggatatccattggctgattctcgtgaccgggtatcttctcgccgacgatactcagggtgagactcctcttattccacccgaaatcatggaatactccatcaaacattccagcgaggtcgatatcaacactactctgcagatactggggagtccgggagaaaaggcctcaagtatccctggctacaataggacagactcagtcatccgcctattatcagccatattaagggtctctgaagtggagtctcgcgccatcagggccgatttaacacaccttctctcaccccagatgggtaaggatatcgtgtggtttcttaaaagatgggcaaagacttatcttctggtagacgagaagctgtacgatcagatctccctgccattttctactgctttcggcgccgatacggagggcagtcagtggattatcggttacctgctgcagaaagttatcagtaacttgtcagtgtggagttctgagcaagacttggccaacgataccgtgcagttgctcgtgacactggtcgaacgcagggagcgagccaatttagtgatccagtgtgaaaactggtggaacctggctaaacagtttgcctcccgaagccctcccctcaacttcttaagcagtcctgtgcagaggacactgatgaaggcactggtgcttggtggatttgcacacatggacacagagacaaagcagcagtactggaccgaggttctacaacccctgcagcaaagatttcttagagtcattaatcaggagaactttcaacagatgtgccagcaggaagaagtaaaacaggaaataactgcaacactggaggctttgtgtgggatagcggaagctacacagattgataatgtcgctatcctttttaatttcttaatggactttctgaccaattgtattggacttatggaggtttataagaataccccggagactgtgaacctgataatcgaggtgttcgtggaagtagcccacaaacagatatgctatcttggggagtctaaggctatgaatctttacgaagcttgtctgactctcctacaggtctacagcaaaaacaacctcggtcgccagagaatagacgtgactgctgaagaggaacagtaccaggatctgttgctcatcatggaactccttaccaatctcctcagtaaggagttcatcgactttagcgatacagacgaagtctttagagggcacgaacccggccaagccgccaataggtcagtgtctgccgcagatgtggtgctgtatggggtgaacctgattctgcctctgatgtag

SEQ ID NO: 26217 - DNA, 1008 bp, Artificial Sequence
  Description of Artificial Sequence: Synthetic coding sequence
atggacttcctgctgggcaaccccttcagcagccccgtgggccagcgaatcgaaaaagccactgatggctctctgcagtcagaggactgggccctgaatatggagatctgcgacattattaacgagacagaagagggaccgaaggatgcgcttcgagcagtgaaaaaaagaatcgtgggaaacaaaaatttccatgaagtactggaaacctgcgttaagaattgcggtcataggttccacgtactggtggcttcgcaagactttgtagaaagcgtgttggtaaggaccatcttgcccaagaataatcctcctactattgtacatgacaaggtgctaaacctgatccagtcttgggccgatgcattccggtcttccccagacctcactggtgtggtgaccatatatgaggatctgcgcaggaagggattggaattcccgatgaccgacctggatatgctgagccccatccacactccccagaggaccgtcttcaactctgagactcagtctggacaagattctgtggggacggattctagccagcaggaggactcgggccagcatgcagctcccctgccagcaccgccgattttatcaggagatacacccatcgcccccacccccgaacaaatcggcaaactgcgcagtgagttggagatggtgagtggaaacgtgagggttatgtctgaaatgctaactgaactagttcctacccaggctgagcctgcggacctggaacttcttcaggagctgaaccggacctgcagggccatgcagcagcgggtgctcgagcttatcccccaaattgctaacgagcaactcacagaggaactgctgattgttaatgacaacctaaacaacgtgtttctgagacatgagcggttcgaaaggttccggacaggtcagaccacaaaagcacctagcgaggcagagcccgctgcagatctgattgacatgggccctgatcctgcagcaacgggcaatctcagctcccaactggctgggtag

SEQ ID NO: 26218 - DNA, 5193 bp, Artificial Sequence
  Description of Artificial Sequence: Synthetic coding sequence
atgggcaacagcgacagccagtacaccctgcagggcagcaagaaccactcaaacacaataaccggggcgaagcagattccctgcagtctgaagatcaggggcattcatgcaaaagaggagaagtcactgcacggctgggggcatggcagcaacggcgcaggatataaatcgagatccctggcacgcagctgcctcagccatttcaaaagtaaccagccctacgcctcccggctggggggaccaacatgcaaggtttcacggggcgtggcctactctacacataggactaacgccccgggcaaggacttccagggcatctccgctgccttttcaacggagaacggcttccactctgtcggacacgaactggcggataaccatatcacgtcccgggactgcaatggccacctcctgaattgctacggtcgcaacgagagcatagccagcacgccccctggcgaggaccgaaagtctccacgcgtcctgataaaaaccctcggcaagctggacggttgcctaagagtggaatttcataacgggggcaatccatccaaagtgccagcagaggattgcagcgagcctgtacagctgttgcgatacagccccacactggcctccgagacctctcccgtgcccgaggcaaggagggggtccagcgccgactctttgcccagccaccgcccctcacctacggactcgcgactgcggagctccaagggatcttcgctgagctcagaatcaagttggtacgactccccttggggcaacgccggggaattaagcgaggctgagggatcattcctggctcccggtatgcccgaccccagtctgcacgcatccttccctccaggtgatgcaaaaaagcctttcaaccagtcatccagtctgagtagcctcagagagctctataaggatgctaaccttggcagccttagtccctcaggcatccggctaagcgacgaatacatgggaacccacgcttctcttagcaaccgagtcagcttcgcttccgacattgatgtgccttcccgtgtcgcccacggggaccccattcagtactcctcttttaccctgccctgccgcaagccaaaagcctttgtggaagatacagccaagaaggacagtctcaaggcacgcatgagacggatatccgactggaccggtagcctgtctcggaagaaacgcaaactacaggaacccagaagtaaggagggaagcgactactttgactcccggtctgatggcctgaatactgacgtccaggggtcatctcaggccagtgccttcctctggtccggagggtcaactcagattctctcccagcggtctgagtccacacatgcaatcggcagtgatcccctgcggcaaaatatttatgagaattttatgcgggaactcgagatgagccgcacaaatactgaaaatatcgaaacctcgactgagacagcggaatcttcaagtgaatccctgtcgtctctggaacaacttgacctactgttcgagaaagagcagggtgtggtgaggaaggctggttggctttttttcaagcctttggtcacagtgcagaaggaaagaaaactcgagctggttgcccggcgaaagtggaagcagtattgggtgactctgaagggctgtacactgctcttctacgaaacctatgggaagaatagcatggatcagagttctgcacctcgctgtgcactgtttgctgaagatagcatcgtgcagtctgtgcccgagcatcctaagaaggagaacgtcttctgtttaagcaattccttcggcgacgtgtatctctttcaggctaccagccaaaccgacctggagaattgggtcactgcagtgcactccgcatgtgctagccttttcgcaaagaaacatggcaaggaagacaccctccgccttctgaagaatcagactaagaatctcctgcagaagatagacatggactccaaaatgaaaaagatggcagagctacaactaagcgtggtctctgacccaaaaaatagaaaagctatcgagaatcaaattcagcagtgggagcaaaacctggagaaattccacatggacctgtttcgcatgcgatgttatttggccagcctccagggcggcgagctacccaatcctaaatccctgctggccgcagccagcaggccaagtaagttagcactcgggagactgggcatcctgagcgtgtcctcattccacgccctggtgtgctccagggacgactcagcgctcagaaagagaaccttgagcttaacccagaggggccggaataagaaaggcattttcagctccttaaaaggtcttgacacgcttgcgcggaaggggaaagagaagcgccccagtatcactcaggtcgatgagctgcttcacatctatggatccacggtggatggtgtcccaagagacaacgcctgggaaattcaaacatatgtgcattttcaagataatcatggggtcactgttgggattaaaccagaacacagagttgaggacatccttacgctcgcttgtaaaatgcggcagctagagccgtcccactacgggctgcagcttcgaaagctcgtggacgacaacgtcgaatattgcattccagctccatatgaatacatgcagcagcaggtgtacgatgagatcgaagtttttcccctgaatgtatacgacgtccagttgaccaagaccggttcagtgtgcgactttggtttcgccgtgactgcgcaggtggatgagcggcaacatttatctaggatattcatcagcgacgtgcttccagacggtcttgcttatggagaaggactcagaaagggaaatgagattatgaccttgaacggggaggccgtgtctgatttagacctgaaacagatggaggccctcttctccgagaagtctgttggtctcactctgatcgcccgacctcctgatactaaagccacattgtgtacttcatggtccgactccgatttgttttcaagagatcaaaagtccctcctcccaccccccaaccaatctcagcttctggaggaattcctggataattttaaaaaaaatacagctaatgacttcagtaacgtcccagacatcactaccggccttaagcgaagccagaccgatggcaccctggaccaggtctcgcaccgcgagaaaatggagcaaacatttcgaagcgccgagcaaatcaccgccctatgtcgcagctttaacgattcacaggcgaacgggatggaaggccctcgcgaaaaccaggatccgcctcctcgtagtctcgccagacacctttcagatgccgacaggctccgcaaagtgatccaggagctggttgataccgaaaaatcctacgtcaaggatctgtcatgcctctttgagctgtacttagagcctctgcagaacgagacctttctgacgcaagacgagatggagtccttgttcgggtcattgcccgagatgttagagttccagaaggttttcctcgagaccctggaagatggaatctctgcctcgagcgatttcaatacccttgagaccccttcacagttccgaaagcttctattttctctggggggtagctttctgtactacgccgatcattttaagctgtattccgggttctgcgcaaatcacattaaagttcagaaggttctcgaacgcgccaagacggataaggcatttaaggcctttctcgatgctcggaatcccactaaacagcatagtagcaccctcgagtcttaccttattaagcctgtccagagggtacttaagtatcccctgctgctcaaggagctggtttcactcactgaccaggagagcgaagagcactaccacttgacagaagcccttaaggccatggagaaggtggcttcccacatcaatgaaatgcagaaaatttatgaagactatggtacggtctttgatcagctagtggccgagcagtcaggtaccgaaaaggaacagcccgagtggtcaagcgaggtaatggatgtgctggatcctagggggaagttgaccaaagggactcttgaggaaccccgaaccctggtgacagagctgtctatgggggaactgctgatgcattccacagtgtcatggttgaatccctttctgagtttaggcaaggcgcggaaggacctggaactaacagtgtttgttttcaagcgggccgtgatcctagtgtataaagagaactgcaaactcaaaaaaaaactaccgtctaactcccggcccgcccacaattccaccgatttggacccatttaagtttagatggctgatccctatctccgctctgcaagtcagactgggcaacccagccggcactgaaaataactcaatttgggagctgatccacacaaagtctgagatcgagggacgccccgagacaatttttcagctttgctgctctgactcagagagcaagaccaacattgttaaagtgatccggtccatcctccgcgaaaattttcgccggcacatcaaatgtgaactgcctctggagaaaacctgcaaagaccgcctggtgcctttaaaaaaccgagtgcccgtgagcgccaagctggccagttctagaagcctgaaggtacttaagaatagcagtagcaacgagtggaccggagaaaccggtaagggtacactcctcgattcagatgagggatccctgtcttccgggactcagagtagtggctgtcccaccgctgagggaagacaggattccaaatcgaccagtcctggcaaatatccccaccccgggctggccgatttcgctgacaatttgatcaaagaatccgacattctgtcagacgaggatgatgatcacagacagacggttaaacaggggagcccaaccaaggatatcgagattcagttccagcggttaagaatatcagaagacccagacgtccatccagaagcagaacagcaacctggcccggaatctggggagggtcagaagggtggggagcagcctaagctggttcggggccacttttgtcccattaaaagaaaggccaactccacaaaaagggaccggggtacactcctcaaggcccagattcgccatcagtccctggattctcagtccgaaaatgccacgattgatttaaacagtgtgctagaaagggagttctccgtacagtcattgacctcagtggtgagtgaagagtgcttctatgagaccgaaagccacggcaaaagttag

SEQ ID NO: 26219 - DNA, 348 bp, Artificial Sequence
  Description of Artificial Sequence: Synthetic coding sequence
atggcccccgccaagaagggcggcgagaagaagaagggccggagcgcaattaacgaagttgtaaccagagagtatactattaacatccataagagaattcacggggtgggctttaagaaacgtgctcccagagccttaaaggagatccggaagtttgccatgaaggagatgggcacccctgatgtgcgcattgacaccagactgaacaaggctgtgtgggccaaaggaattcgaaatgttccatacaggatccgtgtgcgcctgtctagaaagcgcaacgaggatgaggatagccccaataaactctacaccctggtgacttacgtacctgttaccacgttcaagtag

SEQ ID NO: 26220 - DNA, 747 bp, Artificial Sequence
  Description of Artificial Sequence: Synthetic coding sequence
atggccctggaggtgggcgacatggaggacggccagctgagcgactctgacagcgatatgaccgtggcaccttccgatcggcctcttcagctgccaaaagtactgggcggagactctgccatgagggcgttccaaaatacagcaactgcatgtgccccagtgtcccattaccgggccgtggagtcagtggattcatcagaggaatctttcagtgactcagatgatgattcatgcctctggaaacgcaaacgccagaagtgttttaacccaccgcctaagccagagccattccagttcggtcagagttcccagaagcccccagtcgccggaggcaaaaagatcaacaacatttggggcgccgtgctgcagaagttacgaaaggagagtcaggagcataccaaagacctggataaggagctggatgaatacatgcacggtgggaagaagatgggatctaaagaagaagagaacggccagggtcacctcaagcgtaaaaggcccgtgaaggacagactcgggaacagacccgagatgaattacaagggccgttatgagatcaccgccgaggattctcaagaaaaagttgccgatgagatatcctttaggctccaggaacctaagaaagacctcattgcgcgggtcgtccggaacaaactgcgtaccttctctactttaaaaacaaagcggaatatgaagatcaagaaactgctcggtcgtggcgagcataagtgctggggtaaacgctag

SEQ ID NO: 26221 - DNA, 78 bp, Artificial Sequence
  Description of Artificial Sequence: Synthetic coding sequence
atggccatggcccccagccccagcctggtgcaggtgtacaccagcccagcggccgtggcagtgtgggaatggcagtag

SEQ ID NO: 26222 - DNA, 171 bp, Artificial Sequence
  Description of Artificial Sequence: Synthetic coding sequence
atgagctactaccagcggcccttcagccccagcgcctacagcctgcccgcttccctaaattccagtattgtcatgcagcatgggactagcctggacagcacagacacctatccacagcacgctcagagcctggatgggaccacatcctcttcaatccctctgtaccggtag

SEQ ID NO: 26223 - DNA, 450 bp, Artificial Sequence
  Description of Artificial Sequence: Synthetic coding sequence
gtgcgggagctggaggccgagctggacgccgagcagaagaagcacgccgaggctctgaaaggcgtaagaaagcacgagcgcagagtgaaggagttggcttaccaggctgaggaggatagaaaaaacctcgcgcgaatgcaggacctcgtggacaaacttcagagcaaagtgaagagctacaagcggcagttcgaggaagccgaacagcaggccaataccaacctggctaagtatagaaaggcccagcacgagcttgacgacgcagaggaacgcgcggatatggcagagacccaggccaacaaactcagggcccgcacgcgcgatgcgctgggacccaaggtcagatccggaagagggattgcgttgtgtgccggaggcctctggggcctcactgggagcacagcccacagcgcaatcccattctcctcggcccaaggcgtgaccgcttag

SEQ ID NO: 26224 - DNA, 468 bp, Artificial Sequence
  Description of Artificial Sequence: Synthetic coding sequence
agcaacgtgatggaggccaacgccgcccggcaggccacccccgccgagtggtcccaggatgattcgaatgatatgtgggaggatcaagaggaggaagaggaggaggaagaggacgggcttgccggacagctcctctccgacatcctggccacctccaagtacgaagaagactattatgaggatgacgaggaggacgatcctgatgcacttaaagacccgctgtaccagatcgatctgcaggcaaccctaatgacaatgcggggagaattttacaggccaagtgctagtaaaaagggttccttatccacattcgccccctcaggcccggcggccaaccacttcgctgccctcacagggttagaaatgcactttctgttgaacctcaagtggcacttggacccgtggccgttggcctccgcagtcaccttgatgaccatacagactagactgaccggagccgtgacctag

SEQ ID NO: 26225 - DNA, 1620 bp, Artificial Sequence
  Description of Artificial Sequence: Synthetic coding sequence
atggccaccagcgcccccctgcggagcctggaggaggaggtgacctgctccatatgtctcgattacctgagagatccggtgacaatcgattgcggccatgtattttgtagaagctgcaccactgatgtgcgccctatttctggcagtcgaccggtgtgccccctgtgcaaaaagccgttcaaaaaggaaaacatcaggcctgtatggcagctggctagtctggtggagaatattgaaaggctcaaagtagacaagggcaggcagcccggagaagttacccgagagcagcaggacgctaaattgtgtgaacgccatagggaaaaactccactactactgtgaggatgacggaaaactactctgcgtcatgtgtcgcgaatcccgggagcaccggccgcatacagccgtcctgatggagaaggctgcacagcctcaccgcgaaaaaattctgaaccacttaagcacactgcgcagggatagagataagattcaggggttccaggcaaagggcgaggccgacatcttagccgccttaaaaaagctgcaggatcaacgccagtacattgttgctgagtttgagcagggacaccagtttctcagagagagagaggaacatcttcttgagcaactagccaaactggagcaggagttgaccgaaggcagggagaaattcaagtctcggggggtaggggaactggcccgcctggctttggttatctctgagctagaagggaaggctcagcagcccgccgccgaattaatgcaagatactcgtgactttctgaatagatacccccggaagaagttctgggtgggtaagcctatcgcccgagtagtgaaaaaaaagactggtgagttctctgataagctgctctccctgcaaagagggttgagagagtttcagggcaagctgcttcgcgacctggagtataagacagtcagtgtcacactggatcctcagagtgcatcaggttatttgcagttgtccgaagattggaaatgcgtcacttataccagcctatacaaaagtgcctacttacacccgcagcagtttgattgtgaaccaggcgtgctgggcagtaaagggtttacatggggcaaagtctactgggaagtggaggtagagcgtgaaggctggtcagaagacgaagaggagggcgacgaggaggaggaaggagaggaagaggaagaagaggaggaggcgggttatggcgatgggtatgacgactgggaaactgacgaggacgaagagtccctcggggatgaagaagaggaagaagaggaggaggaggaggaggtgcttgagtcatgcatggtgggagtggcacgtgactcagtgaagcggaagggcgatctgagccttcgcccggaagacggcgtgtgggcgctcaggctgagctcctcggggatctgggctaatacctcgccagaggctgagttatttccagcgctgcggccaagacgagtgggcatcgccctcgattatgagggggggacagtgacctttacaaatgcagagagccaagagctgatatacaccttcactgccacctttacgcgccgtctggtgccctttctgtggctcaaatggcccggcacccggttgctcctgcggccatag

SEQ ID NO: 26226 - DNA, 645 bp, Artificial Sequence
  Description of Artificial Sequence: Synthetic coding sequence
atgcccagcccctggggctggttcgccgtgaccgcctgcggcgcccagaggaataatttcgaggagcctgtcgcattacaggagatggatacatccaatggagtcctgttacccttttacgatcctgactcttccatagtgtatctttgtggcaaaggcgactcctcaattcgctacttcgagattaccgacgagcctccttttgtgcattacctgaatacattcagctctaaggagccccagagaggcatgggatttatgcccaaacgtggtctcgacgtgtctaaatgcgagattgcgcgcttttataaactacatgagaggaagtgcgaacccatcattatgacagtccccaggaagtctgacctcttccaggacgccgaaccagtgctcataagcctccgggacgggtacgtgccccccaaacaccgcgagttaagagtcactaagcggaatattttggatgtgaggcctccgtcaggcccacgacgcagccagtccgcttccgatgctcccctgtctcaacacactttggaaactttactggaggagattaaagccctacgggaacgggtgcaggcccaagaacaacgaattaccgctctagagaacatgctttgtgaacttgtggatggcactgattag

SEQ ID NO: 26227 - DNA, 690 bp, Artificial Sequence
  Description of Artificial Sequence: Synthetic coding sequence
atgctgcagctgcgggacagcgtggacagcgccggcaccagccccaccgctgtgttggctgctggcgaagaacctggctccatagaacaagctgtggaggagataagagtggttgttagaccagtggaagatggagaaatccagggggtgtggctgctgaccgaggtagatcattggaataacgagaaggaacggctggtcctcgttaccgagcaatccctgttgatttgcaagtacgatttcatctctctgcagtgtcagcaagtggtacgaatcgcccttaatgcggttgataccatcagttatggtgagttccagtttcccccaaagtcactgaacaagcgagaagggttcggtatccgaattcaatgggacaagcagtcccgacctagcttcatcaacagatggaacccatggtccaccaacgttccttacgctacctttacggagcacccaatggctggtgctgatgagaagacggcatccctttgccagctcgaatcttttaaggcactgctgattcaagccgtcaagaaagcccagaaggagtcccccctccctggacaggccaacggcgtgctgatacttgaaaggcccctgttgatcgagacctacgtgggattgatgtccttcattaacaatgaggcgaagctcggctacagtatgactagaggcaagataggtttctag

SEQ ID NO: 26228 - DNA, 390 bp, Artificial Sequence
  Description of Artificial Sequence: Synthetic coding sequence
atgtgcgaggtgagccggggctggaagccctgcaccgagggcatcctcaaggtgagacccactaggaagatcagttatgagggtaatattacccctacagtcgagctgaacgctctgtgcatgaagctcggcaagaagcccatgtacaagccagtagatccttatagtagaatgcagtccacttacaattacaacatgcggggtggtgcatacccacctagatatttctaccccttcccagtgcctcccctcctgtaccaagtggaattatctgttggagggcagcaatttaacgggaaaggaaaaacacgccaagcggcaaaacacgatgccgccgcaaaggcactccggatcctgcagaatgaacctttgcctgagagactagaatag

SEQ ID NO: 26229 - DNA, 3042 bp, Artificial Sequence
  Description of Artificial Sequence: Synthetic coding sequence
atggacctgttccggatgcggtgctacctggccagcctgcagggcggagaactccctaaccccaagtccctcctggctgcagccagccggccctccaagctcgcccttggacggctgggaatcctgagcgtatcaagttttcacgcacttgtatgctcgcgagatgattccgccctccgtaaacgcacactgagtctgacccagagaggacgaaacaagaaaggcatattcagctccctgaaaggccttgatacactggcaagaaaggggaaggagaaaaggcctagcataacgcaggttgacgagctgctacatatatatggatcaacggtagatggcgtgccccgagataatgcatgggaaatccagacatacgtgcacttccaagacaaccacggcgtgaccgtaggtataaagcccgaacaccgcgtggaggacatcctgacactggcctgtaagatgagacaattagaaccgtcccattatggactgcagctacgtaagcttgtggatgataatgtagaatattgcataccagctccatacgaatatatgcagcagcaggtttacgacgagattgaagtctttcccctgaacgtatatgacgtgcagctgactaaaaccggaagcgtgtgtgatttcggctttgccgtgactgcacaggtggacgaaaggcagcacctgagcaggatttttatctctgacgtgctacctgatggcctggcctacggtgaaggactgcggaaagggaatgagattatgactttaaatggggaagccgtgtcagatctggacttaaagcagatggaggccctcttctccgaaaaatctgtggggctgactctgatagcgcggccacctgacactaaagccactctctgcacatcatggtctgactctgacctgttcagccgcgaccagaaatctttgctgccacctcctaatcagtcccagcttctagaggaatttctggataacttcaagaagaacactgcgaacgacttcagtaacgtgccagacatcaccactggactgaagaggtcacaaacggatggaaccctagatcaggtttctcaccgtgagaaaatggagcaaacatttcgcagcgcagagcagattactgccctctgccgcagtttcaacgacagccaagcaaacggcatggaaggtccccgggagaaccaagacccaccccccaggtccctcgctcgacacctctctgatgctgacagactgcggaaagtgattcaagagctcgtagataccgaaaaaagctatgttaaggatctctcttgtctcttcgaactctacctggagccccttcagaatgaaacttttctcactcaggatgaaatggaatccctcttcggttctctgccagaaatgctggagttccagaaggtattcctcgagaccctagaggacggcattagtgcatcatccgattttaataccctggaaaccccttctcagtttcggaagctgcttttttccctgggtggctccttcctgtactacgcagaccactttaagctatatagtggcttctgcgccaaccacataaaggtgcagaaggttctggagcgcgccaagaccgataaagcttttaaggcgtttcttgacgcgaggaacccaaccaagcagcatagctcaactctggaaagttacctgatcaaacccgtgcaaagggtgctaaaatatccgctcttgttgaaggagctagtctctctgaccgatcaggagtccgaggagcactaccacctgaccgaggcgctcaaggccatggaaaaggtcgctagtcatataaatgagatgcaaaagatttacgaggactatggtacggtgtttgaccagctcgtggccgaacagtcaggcactgaaaaggaggtaactgagctgtctatgggtgaattgctgatgcattctaccgtgtcttggctgaatccctttctgagtttaggaaaggctcgcaaagacctcgagctgaccgtatttgttttcaagagagcggtgattttggtgtacaaggaaaactgcaagttgaagaaaaagcttccttcaaactcgagaccagcccacaattctaccgacctcgacccattcaaatttcgttggttgatccctattagtgcccttcaggtacggttaggaaacccagccggaaccgagaacaatagcatttgggagctcattcataccaagagcgagatcgaaggccgccctgagacaatctttcaactttgttgcagcgactctgagtcaaaaaccaatattgtgaaggttatacggtccattctgcgcgagaacttcaggcggcatatcaaatgtgagcttcctctagaaaaaacatgtaaggaccggttagtccccctaaaaaacagagttccagtgagtgccaagcttgcgtcaagcagaagcttgaaagttttaaagaatagctcttcgaatgagtggaccggtgaaaccggaaagggcacattgctcgattcagacgaggggtccctatcgtcaggtactcagtcctccggatgtccgactgccgagggtaggcaggactccaaatctacgagcccaggcaaatacccgcatcctggtctcgcggactttgccgataacctgatcaaggagtcagacatactttctgatgaggatgatgaccaccggcagacggtaaagcaaggcagtcccaccaaagacatagagatccagttccagcgcctgaggatttccgaggaccccgatgtgcacccagaggctgaacagcagccaggtcctgagagtggagaaggccagaagggcggggaacagcctaagcttgtgagaggccatttttgtcccatcaagcgcaaggcaaacagcaccaaaagggataggggtacattgctcaaggcacagatccgtcaccagagccttgattcccaaagtgaaaatgcaacaatcgatctaaacagtgttctcgagcgggagttctccgtgcagtcactgacctcagtggttagcgaagagtgtttctatgaaacagagtcacacggaaaatcatag

SEQ ID NO: 26230 - DNA, 1149 bp, Artificial Sequence
  Description of Artificial Sequence: Synthetic coding sequence
atggccgccaacctgagccggaacggccccgccctgcaggaggcctatgttcgtgtggttacggaaaagtcacctacagactgggcgctcttcacctatgaggggaactccaacgacatccgcgtcgccggaacaggcgaagggggattggaggagatggtggaggagctgaactctggcaaagtaatgtatgccttctgcagggtgaaggacccgaactcaggcctgccaaagttcgtgttgattaactggaccggtgaaggtgttaacgacgttcggaagggggcctgcgcttctcacgtgagcaccatggcttcctttctgaaaggcagtgtctaccagaaaaccaatgcagtctcagagatcaagagggtaggaaaagactcattttgggccaaggcagagaaagaggaggagaaccggcgcctggaggaaaaacggcgagccgaggaggctcagaggcagctggaacaagagcggcgggaacgtgagctgcgagaagcagctcgacgcgagcagcgttatcaagagcaaggaggcgaggcctccccacagtctagaacctgggagcaacaacaagaggtagtcagtagaaacaggaacgagcaggagtccgccgtgcacccacgggaaatatttaaacagaaagagcgagcaatgtcaaccacctccatctcttctccgcagcccggaaaacttcggtcaccttttctgcagaagcaactgactcagcccgaaactcattttggccgggagcccgccgccgccatttccaggccaagagctgacttgcccgccgaagagcccgccccctccactcccccctgtctcgtgcaagctgaggaggaggccgtctacgaggagccgccagaacaggaaaccttctacgagcaacctccgctggtccagcagcagggagcagggtctgagcacattgatcaccacatccagggccaggggcttagcggccaggggctgtgcgccagggctttgtatgattaccaggcagccgatgatacagagatttctttcgatcccgagaatttaatcaccggaattgaggtaatcgacgaagggtggtggcgaggttacgggccagacggacatttcggaatgttcccagctaattatgtggagctgatcgaatag

SEQ ID NO: 26231 - DNA, 660 bp, Artificial Sequence
  Description of Artificial Sequence: Synthetic coding sequence
atggtggtgctgagcgtgcccgccgaggtgaccgtgatcctgctggacatcgaggggacaaccacacctatcgcattcgtgaaagacatcctgttcccttacattgaagagaatgtgaaagagtaccttcagactcactgggaagaggaggaatgtcagcaggatgtgtctctcctgcgaaaacaggcggaggaggacgcccacctggacggggctgtcccaattccggcggcaagcggcaatggcgtagatgacctgcagcagatgattcaggcggtggttgacaacgtgtgctggcagatgtcactggatcgcaaaacaacagcactgaagcagctccagggacacatgtggagggccgcattcaccgctggacgtatgaaggctgagtttttcgcagatgtggtacccgccgtcaggaagtggcgggaagctggcatgaaagtgtacatctactcgtccggttcggtggaggctcaaaagctcttgtttggacactctacagagggtgacatcttagagcttgtcgacggacactttgatacaaagataggccacaaagtggagtccgagagctacaaagattgtaggcaacactgggtgctgaaccagcagcatttcgtttcagacagatgttatagtcggggacagtgctgctag

SEQ ID NO: 26232 - DNA, 1446 bp, Artificial Sequence
  Description of Artificial Sequence: Synthetic coding sequence
atggccagcgccgccagcgtgaccagcctggccgacgaggtgaactgcccaatctgtcaggggacattaagagagccagtgaccatcgactgcggccacaatttctgtcgtgcatgtctcaccaggtactgtgaaatacctggtccagatcttgaagaaagccccacgtgcccactgtgtaaggaacccttccggcctggctcttttaggccaaattggcagctggcgaatgtggttgaaaatattgagaggcttcagctggtgtccaccctgggcctgggcgaggaggatgtgtgccaggaacacggagagaagatttactttttttgcgaggacgatgagatgcagttgtgcgtcgtgtgcagagaagccggggaacatgccacccataccatgcgctttctcgaggatgccgccgcaccttaccgagagcaaatacacaagtgcctgaaatgcctgaggaaggagcgggaggagatccaggaaatccagagcagggagaacaagcgaatgcaggttctgctcacgcaggtgagtactaagcgccagcaggtcatcagtgaatttgcccatttgcgaaagtttctggaggagcaacagtctattctgctggctcagcttgaaagccaagacggggatatcttgagacagcgtgacgagttcgacctgctggttgccggggagatatgccggttcagtgcgttaatcgaggagcttgaagagaaaaatgaaagacccgctagggagctcctgaccgatattcgctctactctgattcgatgtgaaacccggaagtgtaggaagcccgttgccgtgtctcctgagctcgggcagaggatcagggatttcccacagcaggctctacctttacagagagagatgaagatgttcctggagaagctgtgctttgaattggattatgagcctgctcacatctccctagatccacagacctcacatccaaagctgctcctgagcgaggaccaccagcgcgcccagttctcttacaagtggcaaaatagccctgacaatccacaacggtttgaccgggccacttgtgttctggcccacaccgggatcaccggggggagacatacatgggtagtgtctattgacctggcccatggtggctcttgcaccgttggcgttgtcagtgaggacgtacaaagaaagggagagctccgattgagacccgaggagggcgtttgggccgtccggcttgcctggggctttgtctccgcattagggagtttcccaacgcggttgactcttaaagagcagcctaggcaagtcagggtgtctcttgattacgaggtaggatgggtgacctttacaaacgctgtgacccgtgaacctatatacacattcacagccagctttacaaggaaggtgatcccattcttcgggctgtggggccggggcagctcattctccctgtcctcctag

SEQ ID NO: 26233 - DNA, 1644 bp, Artificial Sequence
  Description of Artificial Sequence: Synthetic coding sequence
atggccggcaccaagaacaagacccgggcccaggccaagaccgagaaaaaagccgctatccaggcgaaggctggagcagaacgggaagcaaccggcgtcgttaggcccgtggccaagacaagggcaaaggctaaggccaagacaggatccaagacagatgcagttgcagagatgaaggcagtctccaagaacaaagtagtggccgagacaaaagagggagctttgagcgaaccaaagacgctcggcaaggcaatgggggactttactcctaaagccggcaacgagagcacctcctctacatgtaagaatgaggcgggaactgatgcctggttctgggccggagaagaagcgacaataaactcatggttttggaacggagaagaggccggcaactccttttccactaaaaacgacaaacctgagatcggagctcaggtgtgcgcagaagaactggagccagccgccggcgctgactgtaagcctcgcagcggcgccgaagaggaagaggaagagaatgtgatcggcaattggttttgggagggggatgacactagcttcgaccccaatcctaaacccgtttccaggatcgtgaaaccacagcctgtatatgagatcaacgagaagaatcgacctaaggattggtccgaggttacgatctggcccaatgcccctgcggtgaccccagcagtgctgggatttagatcacaggctccatcagaggcctcaccaccatcgtatattgttctggcctcagccgaagaaaatgcttgttcactacctgtggcaacggcatgtcgaccttcaaggaatactagatcttgctcccaaccaattcctgaatgcagatttgattctgatccctgcattcaaacaatcgacgaaataaggcggcaaattcggatccgagaggtaaacgggattaagcccttcgcttgtccttgcaaaatggaatgttacatggacagtgaagaattcgaaaaactggtgtcactcttgaagtccaccaccgaccctctgatacacaaaatcgcaaggatcgcgatgggcgtgcacaatgtgcatcccttcgcacaggagtttataaatgaagtcggagtggtcactctgatcgagagccttctgtccttcccttctcctgaaatgaggaagaaaaccgttattactctgaatcctcccagtggagacgagcggcaaagaaaaatcgagctgcacgtcaaacacatgtgtaaggaaaccatgtctttccctctaaattctcccggacaacagtctggacttaaaattctcggtcaattgaccacagacttcgtacatcactacatagtggctaactatttctccgagttgttccatcttctttcgagcggcaattgcaagacgcggaatctggttctaaaactgctgcttaatatgtctgaaaaccccacagctgcgcgggatatgattaacatgaaagcgctggctgcgctgaagttgatttttaaccagaaggaggctaaggctaacctagtgagcggagtagcaatattcatcaacataaaagaacatattcggaagggatccatagttgtagttgaccatctgagttacaacactttgatggcaatattccgagaggtaaaagagattatcgagaccatgtag

SEQ ID NO: 26234 - DNA, 1887 bp, Artificial Sequence
  Description of Artificial Sequence: Synthetic coding sequence
atgagcgacaagagcgacctgaaggccgagctggagcggaagaagcagcggctcgcacagattcgggaggagaagaagagaaaggaagaagagcgtaaaaaaaaagaagcagatatgcagcaaaagaaggaacctgttcaggacgactccgatttggaccgaaaacgaagggaaaccgaagctctgctgcagagcatcggtattagcccagagccccccctggtgcctaccccaatgtccccctccagcaaaagtgtaagtaccccatctgaagctggctcccaagattccggtgatttgggacctctgacgagaaccctgcagtgggatacagacccttctgttctgcagctgcagtccgactcggaactgggccgacgcttgcataagctcggcgtgagtaaagtcacccaggttgacttcctgccgcgcgaggtagtctcctacagcaaggagacgcagactcctttggcaactcaccagtctgaagaagacgaggaggatgaagaaatggtcgagtcaaaagtcggccaagacagtgagcttgagaaccaggataagaaacaggaagttaaagaagctccaccccgtgagctcacagaagaggaaaaacagcaaatccttcacagcgaggaatttttgatatttttcgataggaccatccgcgtcatagagagagcactggctgaggactccgacatattctttgactactctggcagggaattggaggaaaaggatggcgatgtgcaggcaggcgccaacctgagcttcaaccgacagttttacgatgagcactggagtaagcacagggtcgttacatgtatggactggtctctccagtaccccgaattaatggtggcctcttacaataacaatgaagatgctccccacgaacctgacggagtcgccctcgtatggaatatgaaattcaaaaaaactactcctgagtacgtgtttcattgccagagcagcgtgatgagcgtgtgctttgccagatttcaccctaacctggtcgtggggggtacatactccgggcagatcgtgctttgggataaccgatcccatcggcgtaccccagtacagcgcacccccctatctgccgctgctcatacccaccctgtgtattgcgttaatgttgttggtacccagaatgcacacaatctaattactgtgagcactgacgggaaaatgtgctcctggtctctggacatgttgagcactccgcaggaatccatggagctcgtctacaacaaatccaaaccagttgcagttaccggaatggctttccccacaggagacgtgaacaatttcgtggtaggatccgaggaggggactgtttacaccgcctgccgacatggctccaaagctggcataggcgaggtgtttgaaggccatcaggggccagtcacaggcatcaattgtcacatggccgtgggtcctattgatttttctcatcttttcgtaacatcatcgttcgattggacagtgaaactgtggaccaccaagcacaacaaacctttatactcttttgaagacaacgcagactacgtgtatgatgtgatgtggagccccgtccaccctgctctattcgcttgcgtggacggcatggggaggctggatctgtggaacctgaacaatgacaccgaagtgccaaccgcatcggttgccatcgagggagccagtgcgttaaatcgtgtgaggtgggcacaagccggcaaagaggtggccgtgggcgacagtgaaggcagaatttgggtgtacgatgtcggggagctggccgtgccacacaacgacgagtggaccagattcgcccgcacactggtggagattagggcaaaccgggctgactcagaggaggaagggacagtagagctgtccgcgtag

SEQ ID NO: 26235 - DNA, 474 bp, Artificial Sequence
  Description of Artificial Sequence: Synthetic coding sequence
atgcggagcggcttccggtgcgacgagcccgccgaggccgtggcccccgagaggcaaacagtgtcgggcgcagtggcactggctagtttcacaagtccgcatacgcatccagttgacgatgggggccgtcactactcttgggggtcacccaagcggatcttgggacttggccccggagacgcagccaaggaggccggcctcgtaaggcccctccaaggacagagcgagaagatcttactgcggactagaaaccgccagcctatggaacccccgatggagccatccggtggcgaacaggagccgggagctgtacgcttccttgatctcccttgggaggatgtcctgctgccacatgtgttaaatcgcgtacccttaagacagctcctaaggctacaacgagtgtcccgggctttccgctcactggtgcagctgcatctggctggcttaagacggttcgatgccgctcaggtgtag

SEQ ID NO: 26236 - DNA, 483 bp, Artificial Sequence
  Description of Artificial Sequence: Synthetic coding sequence
atggaggccgagcggccccaggaggaggaggacggcgagcagggccccccccaggatgaagagggatggcctccccctaacagcaccacacggccatggaggtccgccccccccagccccccccctcctggaacacggcatactgccctgggccctagatccgcatccctcctatccttgcaaaccgaactgctactcgaccttgtggcagaggctcagtcccgacggctggaggaacaacgcgctacattttacaccccccaaaacccctccagcctggcaccggcaccattgaggccgcttgaggatcgggagcaactgtatagtacgatcctgtcacaccagtgccagagaatggaggctcagcggagcgaaccgcccctgcctcccggtggacaggaactcctggaattactccttagggtgcaggggggcggtcgtatggaagagcagcgatcccggccacccacccatacctgttag

SEQ ID NO: 26237 - DNA, 402 bp, Artificial Sequence
  Description of Artificial Sequence: Synthetic coding sequence
atggccgccctgcggcccctggtgaagcccaagatcgtgaagaagagaactaagaagttcattagacatcagagcgatcggtatgtaaaaattaaacgcaattggcgaaagcctaggggaattgacaatcgggtgaggcggcgattcaaaggccagatcttgatgccaaacattgggtacggatccaacaagaagactaaacatatgctgccatcaggctttcgaaagttcctggttcataacgtgaaggagctggaggtgctcctgatgtgcaataaatcttactgcgcagagatagcacacaatgtgagctctaagaaccgaaaagccattgttgaaagggctgcacagctcgctattagagtaacaaaccctaatgcccggcttcgctccgaggagtag

SEQ ID NO: 26238 - DNA, 639 bp, Artificial Sequence
  Description of Artificial Sequence: Synthetic coding sequence
atggacctgttcggcgacctgcccgagcccgagcggagcccccggcctgccgcgggaaaagaggcccagaagggcccactattatttgatgatctccctcccgccagttccaccgatagcgggtccggtggaccgctcttatttgacgatctgccccccgcgagctcgggagactctggctctcttgccacatccatcagtcaaatggtcaaaacggaaggaaaaggcgccaaacgtaagacctcagaagaagagaagaacgggtctgaggagctagtggagaagaaagttagcagcagtgttatctttggacttaagggatacgtcgccgagcggaagggagagcgcgaggaaatgcaggatgcccacgtgatccttaacgacataacagaagagtgccgacctccctctagtctcattacacgtgtgagctattttgccgtgttcgatggccacggtggcatcagagccagcaagtttgccgcccagaacctccaccagaatctgattcgtaagtttcctaaaggggacgttatttccgtggagaagactgtgaagagatgtttgctggataccttcaagcacacggacgaagaatttctgaagcaggcatcatctcagaaacctgcatggaaatag

SEQ ID NO: 26239 - DNA, 1131 bp, Artificial Sequence
  Description of Artificial Sequence: Synthetic coding sequence
atgcccctgcaggtgagcgactacagctggcagcagaccaagaccgcagtcttcctgtccttgccgctaaaaggagtgtgtgtgagggacaccgatgtgttttgcacagagaactaccttaaggtcaattttcctcccttcctctttgaagcatttctgtatgccccaattgatgacgagtcaagcaaggcaaagatcgggaatgacaccatcgtgtttaccctttacaagaaggaggctgccatgtgggaaaccttgtctgtcacgggggtggataaggagatgatgcagcggatccgggaaaaaagcatcctgcaggcccaagaacgtgcaaaagaagccactgaggccaaagcagccgcaaagcgcgaagatcagaaatatgccctatcagtgatgatgaagatcgaagaggaggagcgcaaaaagatcgaggatatgaaagagaacgaacgtatcaaggctactaaggctttggaggcgtggaaagagtatcaacggaaagccgaggaacagaagaaaattcagcgcgaggagaaactctgtcagaaggagaagcagatcaaggaggagcgaaaaaagatcaagtacaaatccctgactagaaatctggccagccgcaacctcgcgccaaagggtcggaattctgaaaatatttttacggagaaactgaaggaagactcaattcccgcaccgcgcagcgtgggttctataaagatcaatttcacaccccgtgtgtttcccactgcactgagggaaagccaggtggccgaggaggaggaatggttacataagcaggccgaggctcgccgggctatgaacaccgacatcgccgaactctgcgacctgaaagaagaagagaaaaatcccgaatggctgaaggacaagggaaacaagctttttgcaacagagaactaccttgctgccataaacgcgtacaatctagctattcggctgaacaataaaatgccgcttctttacctgaatcgagccgcatgccacctgaagttaaagaaccttcacaaagcaatcgaggactcttcgaaggcctacagaataatgaaacgacatctccggttgattcacccgaccaagctgtacaagctaatgctgcggcgctttggaatgtag

SEQ ID NO: 26240 - DNA, 1485 bp, Artificial Sequence
  Description of Artificial Sequence: Synthetic coding sequence
atggccgccgccgccgagtgcgacgtggtgatggccgccaccgagcctgaattgctggacgaccaggaggcgaagcgcgaggcggagaccttcaaagagcagggaaatgcatactatgccaagaaggattataacgaggcttacaactattacacgaaagcaattgacatgtgtccgaagaatgcgtcttactatgggaatagagcagccacgttaatgatgctcggccggttccgggaggcccttggcgatgcccagcagtccgtccgcctggatgatagctttgtgcgtgggcatctcagagaggggaaatgccacttgtcccttgggaacgcaatggccgcttgtcgatccttccagagagcgctcgaactggaccacaagaacgcccaggctcagcaagagtttaaaaacgccaacgcagtgatggagtatgagaaaatcgccgagaccgacttcgaaaaacgcgacttcagaaaggtggtgttttgtatggacagagcactggagttcgctcccgcctgtcatagattcaagatactcaaagctgaatgtctggcaatgctcggccggtaccctgaggcgcagtccgtggcctccgatatcctcaggatggattcgacaaacgctgatgccttatacgtgagaggcctctgtttatactacgaggactgtatcgaaaaggccgtccagtttttcgttcaggcgttacgcatggctcccgatcacgagaaagcctgtattgcatgccgcaacgccaaggcccttaaggcaaagaaagaggatggtaacaaagcgttcaaagagggtaactacaagctagcctatgagctgtatacagaggctctaggcatcgaccctaataacataaagactaacgccaaactgtattgtaacagggggacggtgaactcaaagcttcggaagttagatgatgctatcgaagattgcactaacgccgttaagctggacgatacctatatcaaggcctacctcagacgcgctcagtgttacatggataccgagcagtacgaggaagcagtccgggattacgagaaggtctatcagaccgagaagaccaaggagcataagcaactgctgaagaatgctcagctggaacttaaaaaaagcaaacgtaaggactactataagattctaggtgtcgataagaatgcctctgaggacgagattaagaaagcctacaggaagagagcgctaatgcaccaccccgacaggcacagcggggcctctgcggaagtgcagaaagaagaagaaaagaaatttaaagaagtcggagaagcatttacgattctgtctgaccctaagaagaaaaccagatatgactccggacaggacctggacgaagagggcatgaatatgggtgattttgaccccaacaacatcttcaaggccttctttggcggtcctgggggctttagttttgaggcctccggacccggcaatttctttttccaattcggatag

SEQ ID NO: 26241 - DNA, 1329 bp, Artificial Sequence
  Description of Artificial Sequence: Synthetic coding sequence
aacgaggtgtacaacctgacccaggagttcttccggcacgacaagccagtaaacgcagaatctcagaactcagtgggggtgttcacacgggaggaagtgagaaacagaatccgaaatgatcccgatgatcctgaagcgactaagcgacttaagcttgcaatgatccagcagtacctgaaggttgagtcttgtgagtcgtccagtcactcgatggacgaagtgtccctgtcggctttcggggagtggactgaaatcccgggcgcccatcacattataccaagcggctttatgcgagtggttgaattactggccgagggaatcccggcccacgttatccagctgggaaagcctgtgcgctgcatccattgggaccaagccagtgcgaggccgcgaggccctgaaattgaacctaggggcgaaggagaccataatcacgacacaggggagggcggtcagggaggggaggagccgcgtggcgggcgctgggacgaagatgagcagtggtccgtcgtggtggaatgcgaagactgtgagttgattccagctgaccatgtgattgtcaccgtctccttaggagtgctgaaacgacaatacacctctttcttcagacctggtcttcctacggaaaaggtcgccgcgattcaccgcttggggattgggactaccgacaagattttcctggagttcgaggagccgttttggggccccgagtgcaacagcctgcagttcgtctgggaggatgaagccgaaagtcatactttgacatacccccccgaattatggtaccggaagatctgtggctttgacgtgctctatccccccgaacgatatggtcatgtgctcagtggctggatctgcggggaagaggctctggtgatggaaaagtgcgatgacgaggccgttgccgaaatttgtactgagatgctgaggcagttcactgggaatcctaatattcccaaaccgagacgaatcctcaggtccgcctggggcagcaacccctactttagaggctcatattcctacacccaagtcgggagcagtggagcggatgtagagaagctggctaaacccctgccctacaccgagtcttctaagaccgcccacggctctagcactaagcaacaaccaggacacctgttcagcagtaaatgccctgagcagccgctcgatgccaaccgcggggccgtgaagcccatgcaggtgctcttctccggcgaggcaactcaccgtaagtactatagtactacacatggtgccctgctctccggccaacgggaggcggcacgtttgatcgagatgtacagggatcttttccagcaaggtacttag

SEQ ID NO: 26242 - DNA, 180 bp, Artificial Sequence
  Description of Artificial Sequence: Synthetic coding sequence
atgagctactaccagcggcccttcagccccagcgcctacagcctgccggcatctctgaacagcagcattgtgatgcagcacggaaccagcctggactccacggatacttacccccaacacgcacagagcttggacggcacaacctcatcttcaatcccattatatcggagcagcgaatag

SEQ ID NO: 26243 - DNA, 837 bp, Artificial Sequence
  Description of Artificial Sequence: Synthetic coding sequence
atgaagtgcgagcactgcacccggaaggagtgcagcaagaagaccaagacggacgaccaggagaatgtgtccgcggacgctccctcccctgcccaagaaaatggggaaaagggtgagttccacaaactggccgatgcgaaaatcttccttagcgactgcctagcgtgcgactcatgcatgacagctgaggagggagtgcaactgtcccaacaaaatgccaaagatttcttcagagtgctgaacctcaataagaagtgtgatacctccaagcataaggtgctggttgtgagcgtatgcccacagtctcttccgtattttgctgctaagttcaacctgtcagtgactgacgcctcacggagactgtgcggttttctcaaatctctgggatgggttaggtacgccgagagggtgttagggagaccaattacagcgcatctctgcaccgccaagtcaccacaacaggtgatggggtctctggtgaaggattactttgctagacaacagaatctgtcacccgaaaagatttttcatgttatagttgccccatgctatgataagaaactggaagctctgcaggaaagtttgccaccagccctgcatgggtctcgcggcgcagactgcgtcctgacttctgggacagggtctctgtgggagtgcacccctgtcatcaccgccacgcaggaagctgcagcccgtgaaagtcttgagccagggcggcaacgcttgcagcgggacaagatcgcccctctggacagttcactgggtggcggcggcgaaattgcacagattatggagcagggcgatttgtcagttagggacgcagcagtggacacttag

SEQ ID NO: 26244 - DNA, 471 bp, Artificial Sequence
  Description of Artificial Sequence: Synthetic coding sequence
tgaggcaaggcccagcggaagatcagcgccatccacatcctggacgtgctggtccttaacgggacagacgtgagggagcagcattttaatcagaggatccaactagcagaaaaattcgtgaaggccgtgagtaagccatcccggccagatatgaatccaatccgggtgaaggaggtgtacaggctggaggagatggagaagatcttcgtgcggctggaaatgaaaattataaagggttcttcgggcaccccaaagctgtcttataccggaagagatgacagacactttgtgcctatgggactctacatagtgagaacagtgaacgagccgtggacaatgggctttagcaagtctttcaaaaaaaagtttttttataacaaaaagaccaaagattcgacgttcgacttgcctgctgattctatcgcaccattccacctaccatcgctcgcgtgcctgagcaaaatggactag

SEQ ID NO: 26245 - DNA, 1200 bp, Artificial Sequence
  Description of Artificial Sequence: Synthetic coding sequence
atggccaccggcgacctgaagcggagcctgcggaacctggagcaggttctccggctgctaaattacccagaagaggtcgattgtgttggcttgataaagggggaccccgcagccagtctcccaattatctcatattctttcaccagctactcaccttacgtcaccgagctgattatggagagcaatgtcgagctcatagccaaaaatgatcttaggtttatagatgccgtttacaaactgctacgcgatcagttcaactataagccgatcctgacgaagaagcagttcattcaatgtggttttgccgagtggaaaatccagattgtctgtgatatcctgaattgtgtgatgaaaaagcataaggagctgagcagcctgcagaaaatccctagccagcagcggaaaaagatctcatcaggaaaatccgagccccctctaggcaatgaaaaaatttctgcagaagcagttggagtggatatcagtggacggttcatgacctcaggcaagaaaaaagccgttgtgatacgacatctctataatgaggacaatgtggatatttccgaagatactctgagtccaatcacagacgtgaacgaggcggtggacgtgagcgatctgaacgccacagagattaagatgccagaggttaaggtgcctgaaatcaaggccgaacagcaggacgtgaatgttaatccagaaatcactgccctgcagacaatgctcgccgaatgtcaggagaacctcaaaaagctgacctccattgaaaagcggctcgactgcctagagcaaaagatgaaaggcaaagtaatggtggacgaaaatacctggaccaatcttcttagccgcgtgactcttcttgagaccgaaatgctcctgagcaagaaaaatgacgagttcatcgaattcaatgaggtcagcgaggactatgctagctgcagtgacatggacctcctcaacccccacagaaagagtgaggtggagcggcccgcatccattcccttgtcaagtggctattcaaccgcttcctcggatagtacaccgagagcttccaccgtcaactactgcggtttaaatgaaattagcgaaaactttcccgcgtggagcgcgacaagttcatgctctagcttgagctggctgctgcgcggccacacatcctacctctccagccaatctttcgcttggccccttagttgtgtatag

SEQ ID NO: 26246 - DNA, 819 bp, Artificial Sequence
  Description of Artificial Sequence: Synthetic coding sequence
atggccagcctgctgcaggaccagctgaccaccgaccaggacctgctgctcatgcaggaaggcatgccgatgaggaaagtccgatcgaagtcctggaagaagctccggtatttccgtttgcaaaacgatggtatgaccgtgtggcacgcacggcaggccaggggatctgccaagccatccttcagcatttccgacgtggaaacaattcgaaacggtcacgatagcgagttgctcaggtcgctggcagaagagctgccgcttgagcaggggtttaccattgttttccatggcaggcgctccaacctggacctaatggccaactccgtagaggaggcacagatctggatgcgcggcctgcagttgctcgttgatttggtgaccagcatggatcaccaggaacggctagaccggtggctgtccgactggtttcagcggggcgataaaaaccaggacggtaagatgagtttccaggaggttcagcggcttctgcacctgatgaatgtcgaaatggaccaggaatacgctttttctctgttccaggccgctgacacttctcagtcaggaacactggagggggaagaattcgtgcagttttacaaggccctcaccaagcgagccgaggttcaggagctttttgaatccttctccgctgacggacagaagcttacattgctggagttcctcgacttcctgcaagaagagcagaaagagcgggactgtacaagcgagcttgccctggagttgattgataggtacgagccgagcgacagcggagccagtgaggaggatcctggcgagggcgaagaggtcaacacatag

SEQ ID NO: 26247 - DNA, 360 bp, Artificial Sequence
  Description of Artificial Sequence: Synthetic coding sequence
atggacaagaacatcggcgagcagctgaacaaggcctacgaggccttccggcaggcctgcatggaccgtgactctgctgtcaaggaactgcagcaaaagaccgagaactacgagcagaggatccgagagcagcaggaacaactcagtcttcagcagacaataattgacaagctcaaaagccagctgctgctggtaaattccacccaagacaacaactatggttgtgtgccacttttggaggactctgagactcggaagaataacctgaccctggaccaaccgcaggataaggtgatttcaggtatcgctcgggagaaactgcctaaggtcgacatagcttccgccgagtccagcatttag

SEQ ID NO: 26248 - DNA, 1881 bp, Artificial Sequence
  Description of Artificial Sequence: Synthetic coding sequence
atgtgcagcaccctgaagaagtgcggcacctaccggaccgaggtggctgaatgccacgatcacggatcaactttccaaggccggaaaaaaggcggttcctccttcagggacaactttgacaagcgctcatgccactatgagcatgggggttatgagaggccaccctctcattgtcaggagaatgacggttccgtggaaatgcgggatgtccacaaagatcaacagctgagacacactccgtacagcatacgctgcgaaagacgcatgaagtggcattcagaggatgagattcgcataacaacctggagaaatcgaaaacctccagagaggaagatgagtcagaatactcaggacggctacacacgaaactggttcaaggtcacaatcccatatggtatcaagtatgataaggcttggctgatgaactcaattcaatcacattgctccgatagatttactccagtggattttcattacgtccgcaatcgcgcctgttttttcgttcaagatgccagcgctgcaagtgcgctcaaggatgtctcttataaaatctatgatgatgaaaaccaaaagatatgcatttttgtgaatcactctactgcaccctactcggttaagaataaactaaagcccggccagatggaaatgctgaagctgacgatgaataaacggtataacgtgagccagcaagcccttgatctgcagaacctgcggttcgaccccgacctgatgggccgtgacatagacatcatccttaacagacgtaactgcatggccgctactctcaaaattatcgaacggaatttcccagagctgctgtcgctcaatctctgcaacaataaactttaccagctggatggcctctccgacatcactgagaaggccccaaaagtgaaaactttgaatctgtcaaaaaataagctcgagtcggcatgggaactggggaaagtcaaaggcctgaagctcgaagagctgtggttagagggaaaccctctgtgttcaacattcagcgatcagtcagcatatgtaagcgccataagggactgtttccccaaactactgcgactagacgggcgcgaactgtcagcacctgtgatagtggacatagacagcagtgaaactatgaaaccgtgcaaagagaactttactggtagcgaaaccctgaagcatctggttctccaatttctgcagcaatattacagtatatacgactccggggatcgccaggggctgctgggggcatatcatgacgaagcttgcttctctctagccatccctttcgatcccaaagacagcgctccgtctagcctttgcaagtactttgaggacagccgaaatatgaaaacactgaaggacccttaccttaaaggggagctcctaaggcgcaccaaacgcgacatagtagattccctgagcgcactcccaaagacacaacacgacctcagttccattctggtcgacgtttggtgtcaaacagagcgcatgctctgtttttctgtcaatggagtttttaaggaagtggagggtcagagccagggttccgttttggcttttaccagaaccttcatcgccacacccggatcctctagctctctctgtatagtgaacgatgaattgttcgtacgggatgcgagcccacaggagactcagtcagcgtttagcattcccgtgagcaccttgtccagcagctcggaaccctcactaagtcaagagcagcaggagatggtgcaagccttctcagcacagtctggaatgaagctggagtggagtcagaagtgcctccaagataacgagtggaactacactcgggctggtcaagctttcacaatgttacaaaccgaggggaagattcccgcagaggccttcaaacagataagctag

SEQ ID NO: 26249 - DNA, 189 bp, Artificial Sequence
  Description of Artificial Sequence: Synthetic coding sequence
atggccatggcccccagccccagcctggtgcaggtgtacaccagccctgctgctgtggccgtgtgggagtggcaggatgggcttggcacatggcacccttacagcgcaactgtgtgttccttcattgagcagcaattcgtacagcagaaaggacagaggttcggactaggatcactagctcactcatag

SEQ ID NO: 26250 - DNA, 228 bp, Artificial Sequence
  Description of Artificial Sequence: Synthetic coding sequence
atgcggctgagcctgcccctgctgctgctgctgctgggcgcctgggctattcctggaggccttggggacagagctcccttgaccgcaacagccccacagttagatgatgaggagatgtactcagctcacatgcctgcccatctgaggtgtgatgcctgccgggctgtggcctatcagagactttgtagttacccacctcatctgcctctgacagagcaacagagctag

SEQ ID NO: 26251 - DNA, 2619 bp, Artificial Sequence
  Description of Artificial Sequence: Synthetic coding sequence
atgggcgacagcgacgacgagtacgaccggcggcggcgggacaagttccggcgggagagaagcgactacgataggagccgcgaacgggacgaaagaaggcgcggggatgactggaacgatagagagtgggatcgaggtagagaacgccgcagtagaggagaataccgagattacgatcgcaacagaagagaaagatttagcccccctagacacgagctctcccctcctcagaaaaggatgaggcgagattgggacgagcatagctctgacccctaccactccggatacgagatgccttatgctgggggaggaggcggacccacctatggtcccccccaaccttggggccaccccgacgttcacattatgcagcaccacgtgttgccgatccaggcccgcttaggtagtatcgcagaaattgacctgggagtcccgcctcccgtgatgaaaacctttaaagagttcctactgtctttggatgactctgtagatgagacagaggccgtgaaacgctacaatgactacaaactcgacttcaggaggcagcaaatgcaagacttttttctcgctcataaagatgaggaatggtttcgttctaaatatcaccctgatgaagtcgggaagcgcaggcaggaggctcggggcgccttacagaaccgcctgagagttttcttgagcctgatggagactggctggtttgacaacctgctccttgatatagacaaagccgacgcgatcgtcaagatgctagacgcggcagtgatcaaaatggaaggggggacagagaacgatctgcgaatcctggaacaggaagaggaagaagagcaggccgggaagcccggcgagccgagcaagaaagaagagggccgcgccggcgctggcctgggcgacggcgagagaaaaaccaacgacaaagatgaaaagaaggaggacgggaagcaggctgagaacgacagctccaacgacgacaagacgaaaaagtctgaaggcgacggtgataaggaagagaagaaagaggactcagagaaggaagcaaagaaaagttctaaaaaaaggaatagaaaacacagcggcgacgacagcttcgacgagggatccgtgtccgaaagtgaatcagagagcgagtccggccaggcagaagaagagaaggaggaagcggaagaagcgctcaaagagaaggagaagccaaaagaagaggaatgggagaagcccaaggacgcggctggcctcgagtgcaagcccaggcccctgcacaaaacctgctccctgttcatgaggaatatcgcccctaatattagccgggccgagataatttcactgtgcaagcggtacccgggcttcatgagggtggcattgagtgagcctcagcccgagcggcggtttttcagacgagggtgggtgacgttcgatagaagtgtcaacatcaaggaaatctgctggaacttacagaacataaggctacgagaatgcgaactaagtcccggcgtgaatcgtgatttgactaggcgagtgagaaacattaacggaattacgcagcacaaacagattgtcaggaacgatatcaagctagccgctaaactcatccatacactagatgaccgaacgcagctgtgggcaagtgaacccggtaccccgccgctacccacatccttaccctctcagaaccccattctgaaaaacatcactgactacctcattgaggaggtttcagcagaggaggaggagcttctgggctcttccggcggagctcctcctgaggagcccccaaaagaagggaacccagccgagattaacgtcgagagggatgagaagctgataaaagtacttgacaagctcttattatacctccgcatcgtgcactctcttgattattacaacacttgcgagtatcctaatgaggatgaaatgcctaataggtgtggcataatccacgttagaggtcccatgcctccgaatcgaatctcccacggggaggtactggaatggcaaaagactttcgaagaaaaactgacccccctgctatccgtccgggaaagcctaagcgaagaagaggcccagaagatggggcgtaaggatccagagcaagaggtcgagaagttcgtcacttcaaatacccaggaactcggcaaagataagtggctgtgcccactctctggaaaaaaattcaaggggccagaatttgtgaggaagcatattttcaacaagcatgctgagaagatagaggaagttaaaaaagaagtcgccttttttaacaattttctcaccgacgctaagcgccccgctctgccagaaataaaaccggcccagcccccaggtcccgctcagtctctgacacccggtctgccctatccacaccagaccccacagggcttgatgccgtatggtcagccgagaccccctattctgggatacggagcgggagctgtgcggcctgccgtgcctactggaggccctccctaccctcacgcaccttacggagcaggaagagggaattatgatgctttcagaggccagggaggctaccccggcaagcctaggaaccgcatggtgagaggagatcctcgagccattgtggaataccgcgatttggatgctcccgacgatgtggactttttttag

SEQ ID NO: 26252 - DNA, 483 bp, Artificial Sequence
  Description of Artificial Sequence: Synthetic coding sequence
tgacccgaggacgtgcaggccctggtgagcggcaagctggccctgcgatacgccggaaggcagaccgaggcattgaaatgtgttgctcaggcctctaagaatagatccctggccgattttgaaaaggccttgaccgactatagggccgagctccgggacgacccaatcatttccacgcacttggcgaagctttatgacaaccttttagaacagaaccttattagagtgattgagccgtttagccgggtccaaatcgagcatatcagcagccttataaagctatctaaagccgacgtcgaacggaaattatcacagatgattctggacaagaaatttcatggcattcttgaccagggagagggtgtgctcatcatttttgatgaacccccagtcgacaaaacttacgaagctgcactagagacgatccagaatatgagcaaggtggtggattctctctataacaaggccaaaaagctgacctag

SEQ ID NO: 26253 - DNA, 3906 bp, Artificial Sequence
  Description of Artificial Sequence: Synthetic coding sequence
atgtggcggcggaagcacccccggaccagcggcggcacccggggcgttttgtcaggcaacagaggcgtggagtatggaagcggccggggccacctcggtactttcgagggccgctggcggaaactccccaagatgccagaggccgtcggaactgaccctagtaccagcaggaaaatggctgagctggaagaagtgacgttagacggtaaacctctgcaggccctgagggtgactgatttgaaagcagctctcgaacagaggggattagccaagtccggacagaagtccgccctcgtaaaacggctgaagggcgctctgatgttagaaaacctgcagaagcatagtacacctcatgcggcatttcagcccaatagtcagataggagaagagatgtcccaaaactcattcataaaacagtacctggaaaaacagcaggagctgctccgacagagactcgaaagagaagcaagagaggccgccgagttagagggtaaaagcagctcgatctccgaggagaagggggattccgacgacgagaagccaagaaagggcgaaagaagaagctctagagtgaggcaggcccgggctgctaagctctcggaagggtcacagcccgcagaagaggaagaggatcaggagaccccttcacgtaacctaagggtgagagccgatagaaacctgaagactgaggaggaagaggaggaggaggaggaggaggaggaggatgatgaggaagaagagggggatgacgaggggcagaaatcccgggaggcccccatattaaaggagttcaaggaagaaggtgaggaaatacctcgggtgaaaccagaggaaatgatggatgaaaggccaaagacacggtcccaggagcaggaggttctcgagaggggaggcagattcacaagatcccaggaagaggcccgcaaatcgcatttagcccgccagcaacaggaaaaagagatgaaaactacctctcctctcgaagaggaggaacgcgaaattaagagttcacaggggttgaaggaaaaatctaaaagccccagtccccccaggctaactgaggaccgaaagaaggcatcactggtggcgttgccagagcaaacagctagtgaagaagagacccctccccctctacttactaaggaggcttccagtccaccgccccacccccagcttcactctgaagaggagatcgagccaatggaaggacccgccccagccgtcttaatacaactgtccccccccaacactgatgcagacactcgtgagctgctggttagccagcacacagttcagctggttggcggactttcaccactctcaagcccttccgatactaaagctgaatcgcctgcagaaaaggtgcctgaggagtcagttctgcccctggtgcagaagagtactctggccgactactcagctcagaaggatctcgagcccgaatccgaccgcagcgcccagccgctgcctttaaagattgaagaactggccctcgccaagggcattaccgaagagtgcctaaagcagccttcattggagcagaaagaaggccgaagagctagccatacgttacttccttcccatcgacttaaacagagcgcggactcttcgtcaagcagatcctcatcttcctctagttctagtagtcgctcacgctcacggagtccagactccagtggctctaggtcccattccccactcaggtccaagcagcgcgacgtcgcccaggcacggacccatgccaaccccaggggcaggcccaagatgggatctcggtcaacttccgaatctcgaagccgctcaaggtcacggtcacgcagcgcatcatcgaacagtcgtaagagcctgagtccaggggtctcccgcgatagctccactagctatacggagactaaagatcctagttcgggccaggaggtggcaacaccaccagtcccccaactgcaggtttgtgagcctaaagaacggacctctacttcttcatcttccgtgcaagctagacggctgtcacagcctgagtctgctgaaaagcacgtgactcagagactgcagcccgagaggggatcacccaagaaatgcgaggccgaggaggccgaaccaccagccgctactcagccacagacatccgaaacgcagacatcccaccttccagaaagcgagagaatccaccataccgtagaggaaaaggaggaggttaccatggatacctcggagaacaggcccgaaaatgatgtgccagagccaccgatgccaatcgcggaccaggtgtccaacgatgatagacccgaaggatcagtcgaggacgaggagaagaaagaatcatcgctccccaagagctttaagcggaaaatctccgtcgtctctgctaccaagggagtgcctgctggaaacagtgacaccgaaggcggtcaaccagggcgcaagcgtcggtggggagcttcgactgcaacaacacaaaagaagccatcgattagcataacgaccgagtccttgaagagtcttattcctgacatcaagccacttgctgggcaagaagcagtagtggacttgcacgctgatgactcccgcataagcgaggatgagacggagcggaacggagatgatggcacacacgacaagggcctgaagatctgcaggactgtgacacaggtcgtacccgccgaggggcaggaaaatggacagcgggaggaggaagaggaagagaaggagccagaagcagaacccccggtgcctccacaggtctcagtggaggtggctctccctcctcccgcggagcacgaagtgaaaaaggtaaccctcggggacaccttgacaagaagatctatctctcagcagaagtccggcgtatcgatcacaatcgacgatcctgtgcggaccgcacaggtgcccagccccccaagaggaaaaatctcaaacattgtacacatatcaaacctcgtacgaccatttactctaggccagctcaaagagctactgggcagaacaggcaccctggtggaagaagctttctggattgacaaaattaagtctcattgcttcgtaacctattctactgtagaggaggcagtggccactcggacagcgctgcacggagtgaaatggcctcagtccaaccctaaatttttgtgcgcagattacgctgagcaggacgagctggactaccaccggggacttctagtggatagaccaagcgagactaagacagaagaacaggggatcccccggccattgcatccaccacccccccctccagtgcagcccccacagcacccacgtgctgagcaacgagagcaggagcgagcagtgcgggaacagtgggctgagcgcgaacgcgaaatggagaggagggaaaggacgcgtagcgagagagaatgggatagggataaggtccgggaaggtcctcgttctcgcagccgaagtcgcgatcggcgcaggaaagaacgagctaagtctaaggagaagaaatccgagaagaaagagaaggctcaggaggagccgcctgccaaattactagacgacttgtttcggaagactaaggccgctccatgtatttattggctccctctaaccgactcccagatcgtacagaaagaagcagaaagagccgaacgcgccaaggaaagggagaaacggcgtaaagagcaggaagaggaagaacagaaagagagggagaaagaagctgagagagagaggaaccgacagcttgagagagagaagcggagagagcatagcagggagcgtgatagagagcgggaaagggaacgtgagagagaccggggtgatagagacagggatcgcgaaagagaccgggaaaggggaagggagcgggatcgtcgtgataccaagagacattcgcggagcagaagtaggtctactcccgtccgcgatagaggaggccggaggtag

SEQ ID NO: 26254 - DNA, 231 bp, Artificial Sequence
  Description of Artificial Sequence: Synthetic coding sequence
atgctgctggagaacctgaccgacaacgagagcgagaacaccaacctgaaaaaaaaagtgttcgaaaaggaggcccatatccaggagctatcctgtctctttcaatcagaaaagtctctcgaaaccaagatcgccaaatggaatttgcagtctcgaatgaataagaatgaggctatagtcatgaaagaggctagccgtcagaagacggtagccctcaagaaggcaagctag

SEQ ID NO: 26255 - DNA, 1749 bp, Artificial Sequence
  Description of Artificial Sequence: Synthetic coding sequence
atggaggtgcgggccagcctgcagaaggtgagcggcagcagcgactcagtggcaactatgaactccgaagagttcgtcctggtgcctcagtacgcggatgacaactctactaaacacgaggaaaagccccagctgaagattgtgtcgaacggagacgaacagttagaaaaggccatggaagagattttgcgggactcagagaaacggccatcatctctgctcgtggactgccagagttctagtgagattagtgaccattcgttcggtgacatcccagcatcccaaaccaataagccgtctttgcaattaatactagaccccagtaataccgagatttcaacaccaaggcccagtagtcctggcggtctgcccgaagaagatagcgtgctgtttaataaattaacatacctgggatgtatgaaggtgagcagtcctaggaacgaagtggaggctttacgggccatggctacaatgaaatcgtcatcccagtatcccttccccgtgacgctctacgtgcctaacgtgccagaaggatctgtcaggatcatagatcagtccagtaatgtcgagatagcctcatttccgatctacaaagtgttgttttgcgcacgcggacacgacggaactaccgagtcaaactgttttgcattcacagagagttcacacgggtcagaggagttccaaattcatgttttttcctgcgaaattaaagaggcagtgtctaggattctgtactctttctgcactgccttcaagcggtccagcagacaggtctcagatgttaaagatagcgtgatcccgactccagactcagatgtcttcacattctcagtgagcctggaggtgaaggaggacgatgggaagggcaacttccgactgctggttataccaatcccttttgagtacttctcccctgttcccaaagacagagacaaattctatttcaagctgaaacagggcattgagaagaaagtcgtgatcaccgtccagcagctgtccaataaggaactggccattgaaagatgcttcggcatgctgctgtcgcccggaagaaatgtgaaaaactctgacatgcacctcctggatatggagtcaatgggtaaatcctacgatgggagagcgtacgtcatcaccgggatgtggaatccaaacgcccccgtgtttcttgcgctcaatgaagagactccgaaagataagcaggtatatatgactgtggccgtggacatggtcgtgaccgaggtggttgaaccggtcagatttctgcttgagacagtggtcagggtctatcctgccaacgaaagattctggtacttttccaggaaaaccttcacggagacattcttcatgagactgaagcagtccgaagggaaaggacacactaacgccggagatgccatatacgaagtggtgagtctgcaacgggagtccgacaaggaagaaccagtgactccaacatcaggtgggggaccaatgagcccacaggacgatgaggcagaggaggagagcgacaatgaactttctagtggaacaggagacgtgtccaaggactgtcccgagaagattctgtacagttggggggaactcctggggaaatggcatagtaatctgggcgcccgccccaagggactgtctaccctggtgaaatccggcgtgcccgaggcccttcgcgccgaggtctggcaacttctggctggttgtcacgacaatcaagcaatgctggatcgttatcgtatcctcattactaaatag

SEQ ID NO: 26256 - DNA, 138 bp, Artificial Sequence
  Description of Artificial Sequence: Synthetic coding sequence
atggacgccgacagcgacgtggccctggacatcctgatcaccaacgtagtctgtgtgtttagaacccggtgccaccttaacttaaggaagattgctctcgagggagccaatgtgatctacaagcgggacgttggatag

SEQ ID NO: 26257 - DNA, 762 bp, Artificial Sequence
  Description of Artificial Sequence: Synthetic coding sequence
atggaggacgccccccagcggctgcggtggcaggcccacctggagttcacacacaaccatgacgtaggggatcttacctgggataagattgcagtgtcactgcctcgctctgagaagctgagaagtctggtgttggcaggcattccacacggcatgcggccccagctgtggatgcgcctgagcggcgcgttgcagaagaaacgaaactcggaactgtcatatagagaaatcgtaaagaatagcagcaacgatgagaccatcgccgcgaagcagatcgagaaggatttgctgaggacaatgccctcgaatgcctgttttgcaagcatgggctcaatcggggtcccccgcctgcggcgtgtgctcagggcacttgcttggctctatcctgagattggatactgtcaaggcaccggaatggtggctgcctgtctcttactgttccttgaagaggaggatgcattttggatgatgtctgcgatcatcgaggatctgttgcctgcatcctacttctcaacgaccctcctgggagtacagaccgatcagagagtgctgaggcatctcattgttcagtaccttccccgattagacaagctgctccaggaacatgacatcgagctgagcctgatcaccttgcactggttcctgaccgccttcgcttcagtggtggatatcaaactgctactcagaatctgggatctgttcttctatgagggaagccgcgtgctgtttcagctgaccctgggaatgttacatttaaaatag

SEQ ID NO: 26258 - DNA, 336 bp, Artificial Sequence
  Description of Artificial Sequence: Synthetic coding sequence
tgacccctggtgaaggtgcagatcttcggcgtgcggctggacaccgcccgccaggaaacaaactacgtggagaataacggatttaacccgtactggggccaaaccctttgtttccgtgtcctagttccggagttagcgatgctcagatttgtcgtcatggattatgattggaagtcgcgaaatgacttcatcggacagtacactctcccatggacatgtatgcagcagggttaccggcacatccaccttctgagtaaagacggtatctccctgcgacccgctagcattttcgtgtatatctgtattcaggaggggctggaaggtgacgagtcgtag

SEQ ID NO: 26259 - DNA, 552 bp, Artificial Sequence
  Description of Artificial Sequence: Synthetic coding sequence
atgatgcagatctgcgacacctacaaccagaagcacagcctgttcaatgccatgaatcggtttatcggcgctgttaataacatggatcaaaccgttatggtcccttccctactccgcgacgtgcccttggccgaccccggccttgacaacgacgtgggcgtggaggtcggcggttccggggggtgtctggaagaaagaaccccccctgtgccagatagcggctcagcaaacggctcattttttgctccttcacgtgacatgtattcacactacgtgctgctcaaaagcatccggaatgacatagaatggggagtgctgcatcaaccgccccctccagcagggagcgaggaaggctctgcctggaaaagtaaggacatactggtggacctggggcacctggaaggcgcagatgctggagaagaggatctggaacagcaattccattaccacctccggggcctacatactgtgctgtcaaaattaacacgcaaggcaaacatactgactaacagatataaacaggaaataggcttcggcaactggggtcactag

SEQ ID NO: 26260 - DNA, 1215 bp, Artificial Sequence
  Description of Artificial Sequence: Synthetic coding sequence
atgatgctgagcaccgagggccgggagggcttcgtggtgaaggtgcgtggtctgccgtggtcgtgctcagcagatgaggttatgcgattcttttcagactgtaaaatccagaatggaacaagcggtattcggtttatttatactagagaggggcggccctccggtgaagccttcgtggagcttgaatcagaagaagaggtcaagctggcgctcaaaaaagaccgggagactatgggccatagatacgtggaggtgtttaagtccaacagcgtggaaatggactggatgactctcccggtggatttccagggacgtagcactggggaggccttcgtccaattcgcttcacaagaaattgctgaaaaagcgctgaagaagcacaaggaaagaatcggccaccggtatatcgaaattttcaagagtagtcgggccgaggtgcggacacactatgatcctccgcgcaagctcatggccatgcaacgccctggcccgtacgaccggccgggagccggaagaggctataactctatcggtaggggcgcagggttcgagcggatgagaagaggagcatacggtggagggtacggtgggtacgacgattatggaggttataatgacggctatgggttcggcagcgatcggtttggcagggatctgaattattgtttctcaggcatgtccgaccaccggtacggagatggcggtagcagtttccagagcactaccgggcattgcgttcacatgcgtggtctaccgtatcgggcgacggaaaatgatatttataacttcttcagcccgcttaatcccatgcgagtgcatattgaaataggacctgacggaagagtcacgggcgaagctgatgtggaattcgccacacacgaagatgccgtcgctgcaatggccaaggataaggctaacatgcagcaccgctatgtggagctgttcctcaactccaccgctggaacatctggtggtgcttatgaccactcctacgtggagttgttcttgaattccactgcaggagctagcgggggggcatacggcagccaaatgatgggcggaatgggcctgagtaaccagtcttcttatgggggccctgcgtctcagcagctgagcggcggatatggtggcgggtatgggggtcagtcatctatgtcagggtacgaccaggtgctgcaggaaaatagctccgactatcagtctaacctggcctag

SEQ ID NO: 26261 - DNA, 1545 bp, Artificial Sequence
  Description of Artificial Sequence: Synthetic coding sequence
atgagcatcagcagcgacgaggtgaacttcctggtgtaccggtacttacaggagagtgggttctcccactctgctttcacctttgggatcgagtcccatatctcccagtccaacattaatggtgctctggtgcctccagctgccctgattagtatcatccagaagggcttacaatatgtggaggccgaagtaagcattaacgaagatggaacgctcttcgatgggcgcccaattgagagtctgtctttgatagatgcggtcatgcccgacgtggttcagaccagacagcaggcttaccgggataaactcgctcagcaacaggctgcggcggccgccgccgccgccgcagccgctagtcagcaggggtcagccaaaaacggcgagaacaccgctaatggtgaagagaatggcgcccacaccatcgctaacaaccacactgatatgatggaggtagatggagatgtggagatcccgcctaacaaggccgtggttttaaggggccacgaatcagaggtattcatatgcgcgtggaatccagtatccgacctcctagcatcaggctccggcgatagcactgcgcgcatctggaatttgtccgaaaacagtacatcagggtcgacacagttggtactgagacattgcatacgagaaggagggcaagatgtgccttccaataaagacgtgaccagtctggattggaattctgagggaactctactagcaacgggctcatatgatgggtttgctcggatctggactaaggatggcaacttggccagcaccctcggccagcacaagggaccaatctttgctctgaaatggaacaagaagggcaatttcatcctttccgccggtgtggacaagaccaccatcatttgggacgcccataccggagaggcaaagcagcagtttccctttcacagtgccccggctctcgacgtggattggcagagtaataacacttttgcctcttgttctaccgacatgtgcatccacgtgtgcaagcttgggcaggatagacctataaagacctttcagggacacaccaacgaggtcaatgccatcaaatgggatcctactggtaacctgcttgcttcttgcagcgacgacatgacccttaagatttggtcaatgaagcaggataactgtgtccacgatctccaggcacataacaaagaaatatacaccattaaatggtctcccacagggccaggaacaaataatccaaatgccaacctcatgctggcctctgcgtctttcgatagtacggtcaggctatgggacgtcgacagagggatttgtatccatacactcactaagcaccaggagcctgtttacagtgtcgccttcagtcccgatggaagatatcttgctagcggatcttttgacaagtgcgtgcacatttggaatacccagacaggagcactggtgcatagctatagaggcactggaggaatcttcgaggtgtgttggaatgcagcgggagacaaggtcggtgcatctgcttcagacgggagtgtgtgcgtactggatctgagaaaatag

SEQ ID NO: 26262 - DNA, 2928 bp, Artificial Sequence
  Description of Artificial Sequence: Synthetic coding sequence
atgaagttcgtgagcgaggacctgcaccggtgcgccctgctgaccgctgacagcttcggcgatccattcttccctcggaccacacagatcctgctggaatatcaactggggcgctgggtgccccggctcagagagcctagagatctttacggcgtgagttcaagtggtcctctgtcaccgacacgatggccataccactgcgaggtcattgatgagaaagtccagcatattgattggacacccagctgccccgagccagtctacattccaacaggtttggagaccgagccactgtatccggactctaaggaggcaactgtggtttaccttgccgaggacgcgtataaagagccctgctttgtttactccagagtgggagggaaccgcacccccctcaaacagccagtagattaccgtgacaatacactgatgttcgaagcccgatttgagtctggaaacctccagaaggtagtgaaggtcgcagaatacgaatatcagttgaccgtgagaccagatttgtttaccaataagcacacccagtggtactactttcaggtcaccaatatgcgagccggaatagtgtatcggtttactatcgttaatttcacaaaaccagctagcctgtacagtagggggatgaggccgttattttacagcgagaaggaggctaaggcccatcatatcggctggcagcggattggtgaccaaattaaatattatagaaacaatccaggacaggatggcagacactatttcagcctgacctggacatttcagttccctcacaataaagacacatgctacttcgcccactgttacccttatacatacacaaacctgcaggaatatctgtcaggaatcaataatgatcccgtgcgtagcaagttctgcaaaatccgcgtgctgtgtcatacactggctcgtaatatggtatatatcctcactataacaacacccctcaagaattccgattctcggaaaagaaaagctgtgatattgactgccagagttcaccccggagaaactaactcctcttggatcatgaagggattcctcgactacatactgggtaacagctcagacgctcaactcctgcgggacactttcgtgtttaaagtggtgcccatgctgaacccagatggggtgattgtgggcaactatcgctgctccctggctgggagagacctcaaccggaactacacctcactgctgaaggagtcattcccatccgtatggtataccagaaacatggttcatagactcatggaaaaaagagaggtgatcctgtactgcgatcttcacggccacagccggaaggaaaatattttcatgtatgggtgtgatggctcagacaggagcaagacattgtatctccagcaacggattttccccctcatgcttagcaaaaactgtcctgataaatttagcttctccgcttgcaaatttaatgtgcagaagagtaaagaaggtactgggagagttgtgatgtggaaaatgggtataaggaactcttttaccatggaggcgactttttgcgggtccacccttggcaataaacgtggcacgcacttctctaccaaggacctggaatcaatgggatatcacttttgcgattctctattagattactgcgaccccgataggaccaagtactacagatgtcttaaggaactggaagagatggagagacatattaccctcgagaaggtcttcgaagatagcgacactccggtcattgacatcaccctggacgtagaatcatctagcaggggcagcgactcctcagagtcaatcgactctctgacttacctcctgaagctgacatcacaaaagaagcacctgaaaaccaaaaaagaaagaaactcaactattgcaagtcatcaaaatgcccgcggccaagaagtgtacgatcggggccaccttctgcaacggcatacccagtccaattccgacgtgaaggacacccgtccaaatgaacccgacgactacatggtcgactattttaggaggcagttacctaaccaaggtctagcccactgtaagctcaggctgcctggatctagacactcccctgccagcgccagccgcgtggccggcactaccgggacccgacaccacacctggttgatctttgtgttcttggtggagatggggaaaaagattccactgaaaggaaccgacctttacggaaattgcttcaaggttacaagcctccaatctcctatgggaaagcagacttcgacctggaccgagaagacgaggattccaacagaggatctccatcacaacctaaagtccaagattaaagagtgcatttcctttcagagtaaaaagaccggcattaattggaccgatgatgaaaagcgatcctataaagacaaaggaatagttcagacccaggaaatcctgcaatacctccttcctatcgtccactccaccaaaaacatgcaaaccacccagatcaagcagttgtttaaccccaggaccaatttccaaatacagcaccaacttaatccagccacgtgcagaaatattaagaaatactctacatcttggaccgcgccccgcaatcaccccttcgtgatccagggggatgtgatggccaatagttcagagtgggtacagtctaagccgcaccgtagcctagaatctttgagtcccctgaaaggtccaaaaaaaaacaagcatagccagatttgggcaatcaaaaatgaggatatcaaacccttgtctagtaagtgggagaccgcttccagcagtttcgggatggatgctaacgtgttgaagtacaagagtctgcaggccgaggaaacgaaccagcagagctcgaagcataccgctttgcacctcaccaagaacaaagatgaacaggccaataagaatgacggccagcctacgttgtacttaaagttccagagagagtcatag

SEQ ID NO: 26263 - DNA, 1626 bp, Artificial Sequence
  Description of Artificial Sequence: Synthetic coding sequence
atgagcagcagcggctacccccccaaccagggcgccttcagcaccgagcagagccggtatcctccccattctgtgcagtataccttcccaaatactaggcatcagcaagagttcgctgtgcctgactaccggtccagtcatctggaggtaagccaggcctcccagttgttacagcagcaacagcaacagcagctgcggcgacgcccaagcctgctgtccgaattccatcctggttccgatcggccacaggagaggcgcacctcatatgaaccattccatccaggccctagtcccgttgatcacgactctctggaatcaaaaaggcctagactggaacaagtatcagattctcatttccagcgcgtgtcagctgccgttctccctttggttcaccccctgcccgaggggctgcgcgcatctgccgatgccaaaaaagatccagctttcgggggcaaacatgaagccccctcatctccaatttctggtcagccttgcggcgacgatcagaacgccagtcccagtaaactgagtaaggaggaactgatacagagcatggacagggtagaccgagaaatcgctaaggtggagcagcagatccttaagctcaagaaaaaacaacagcagctggaggaggaggcagcaaagccgcctgagcctgaaaagccagtttcccccccccctgtagagcagaaacataggtccatcgtgcagatcatttacgacgagaataggaagaaagcggaggaagctcacaagattttcgaaggcctgggccccaaggtggaacttccactgtacaatcagcctagcgacacaaaagtgtaccatgagaacattaaaaccggggtcccagcccgccgaatgatgaaaaaccaggttatgcgcaagaaacttatcctcttctttaagcgccgcaatcatgcaagaaagcaaagagagcagaaaatctgtcagcggtacgaccaacttatggaggcgtgggaaaaaaaggtggaccggattgagaacaatcctcggcggaaggctaaggaatccaagacacgcgaatattacgaaaaacagttccctgaaattagaaagcagagggaacagcaggaacggtttcagcgcgtggggcagcggggggcagggctgtcagcgacgattgctcgatcagaacacgagatttctgaaattattgacgggcttagcgaacaggagaacaatgagaagcagatgcgacaactttcagtgatcccacctatgatgtttgacgctgaacaaagacgggtgaaatttattaacatgaacgggttgatggaggatccaatgaaggtgtacaaggaccgtcagttcatgaatgtttggacagatcatgagaaagagatttttaaagacaaatttattcagcatccgaagaatttcggcctgatcgcatcctacctcgaacgtaaatccgtgccggattgcgtgctctactactacctcacaaagaagaatgagaactacaaggctctcgtgaggaggaattacggaaagcgcaggggcagaaatcaacagatagctcgcccttctcaggaggagaaagtggaggaaaaggaggaagacaaggctgaaaagaccgaaaaaaaagaggaggagaaatag

SEQ ID NO: 26264 - DNA, 840 bp, Artificial Sequence
  Description of Artificial Sequence: Synthetic coding sequence
atgaagttccccttcctgcccatcctggtgatgaagttcatcgagaaagcccagaatatgagcaagtacgtcttaatcgacacacccgggcagatagaggtgtttacttggagcgcaagtggaaccatcataactgaagcgttagcaagctccttcccaaccgtagtgatttatgtgatggatacgtctcggtcaactaaccctgtgactttcatgagcaacatgttgtacgcctgctctatcctgtacaaaaccaagttgcccttcatcgtcgtgatgaacaagaccgacattatcgatcacagctttgctgtggagtggatgcaagatttcgaagcctttcaggatgcactgaaccaggaaaccacgtatgtctccaacctgacacgcagtatgagcctagtgctagatgagttttatagttcactgagagtggtgggcgtctcagcagtgctgggcacaggactcgacgagcttttcgtgcaggtcacatccgccgccgaggagtacgaacgggaataccgtcccgaatacgagcgcctgaagaagagccttgctaacgccgaaagccagcaacagcgcgagcaactcgaaaggctccggaaagatatggggtccgtcgcactggatgctgggactgccaaggactcactttcacccgtgttgcatccttctgatcttattctgacccgtggcacattggatgaggaggatgaagaagccgactccgataccgacgacatcgatcaccgcgtcaccgaggaaagccatgaggaacccgccttccaaaacttcatgcaggagtcaatggcccaatactggaaacgaaacaacaagtag

SEQ ID NO: 26265 - DNA, 1230 bp, Artificial Sequence
  Description of Artificial Sequence: Synthetic coding sequence
atgaaggacacccaggacatccaggaggccagcaaggccatgcagaataaggtccacgagcaggaggacaaaaatgagaaacaaaagcagagggaggataaactgggagtgtattccctcgtacatttctccccgaagatgctgggatccgtggcaactactttgccattgtcatctagcaattcctctggcatgcctctcggctactacctgagttccccccaaatcagcagagtgactatatcaacaactggccagctgaccagcaaagcaacagttgggtcgtgttccagagtcgagaattccctagacgcatctccattcagcgtcccaaagaagcaagatgagtcacctatgataggagatggagaagactatttcctttctctcttcggggattccaagaagctgacagctcactccaactacactcaaaagactcttaaatatttcagcatgattttggaagaggtcggccaatttacgagctcgtccctcggggacgtagagatcgcagaggtgaatgtaaagggcctttttgtcaaactcatcaacagctccctcgacaaagagatggctattggggatcatatcctacagcaaaatgtcaacggacagacaatatccctgtaccgttttctgccaaacatagtaatgcaggcaaatagcacagtgaccgtgtgggctgcagcttctgaagcaaagcatcaaccgccttctgacttcttatggaaagagcaggacaagtttcgagccagccctgattgcattacaatcctgtgtaagcccaacggtcaggctatcgcctggtatactcccatccactggaagcaggcatgggaaaaactagatgcggacgtggagttcaaccggtgtagcgtcgtgtcgccaacctttcgtaagcgggtgttccaatggacagcatccacggctacaataaccaaggagaagcaggaccagccaaaaaaggatatctctaactatcaggttgagcaggctcaggtcctcttgaagcgcgaaaaagaaatcccacctacagtgtttcccaatagatcgccctggtgtcagaatccctatgtctccgcacacccttattgcccgctgatcgagccccacaatacgagcacagccggagggagactagacagacaaccacgcacgcgctccacacgaccaaatcgagcttctggatccaagaaaaagaagaccagtgagtcgcagaagcagtag

SEQ ID NO: 26266 - DNA, 2442 bp, Artificial Sequence
  Description of Artificial Sequence: Synthetic coding sequence
atgagcgagcagggcgacctgaaccaggccatcgccgaggagggcgggacggagcaagagacagcaactcccgaaaacggcattgtgaaaagtgagtcactggatgaggaagaaaaactggaactccaacgacgtttggaggcgcagaatcaggaaagacgaaagtcaaaatcgggtgctggtaaagggaaactaactcggagtttggccgtgtgcgaggaaagtagcgccaggcccggtggggaatctttgcaggaccaggagtctatacacctccagctttcatctttctcatctctccaggaagaggacaagagcagaaaagacgacagcgagcgggaaaaagagaaagacaagaacaaggataaaacatcagagaagcctaaaattcggatgcttagcaaagactgttcccaggaatataccgattccactggcattgacctgcatgagtttctgatcaacactctcaagaataacagccgagatcgcatgatcctgctcaagatggagcaggaaattatcgatttcattgcggacaataacaaccactataagaagtttccgcagatgtcgtcgtatcagcggatgctagtgcaccgggtagcagcttacttcgggctcgaccacaatgtagatcagaccgggaagtcagtgatcattaataaaacctcttcgacgagaattcccgaacaacgattttgtgaacacctcaaagacgaaaaaggagaagagagtcagaaacgattcatacttaagcgggataacagcagcattgataaggaggataaccagtctgtatgttcccaggaatcactgtttgtggagaatagccgcctcctcgaagattctaatatctgcaatgagacctacaaaaaaagacagctgttccgcggcaatagggatggaagcggacggacgagcggttcccgccaatctagcagcgagaatgagcttaaatggtctgaccaccagagagcatggtcatcaacagatagcgattctagcaaccggaacttaaaaccagccatgactaagactgcgagctttggaggaattaccgtactcactaggggggacagcacctcgtccaccaggtcaaccggcaaactttctaaggcaggcagcgagagcagcagctccgcaggctcctctggatcgctctccagaactcatcctcctctgcagagtacccctctcgtctcaggcgtggcagccggatcccccggctgcgtgccgtaccctgaaaacggcatcggagggcaggtcgctccttcgtcaacttcgtatatcctgcttcccttggaggctgcaaccggcatcccccctggatctattctacttaatccgcacacaggacaaccattcgtgaatccagacggcactccagccatctacaatcctcctaccagtcaacagcctttacgaagcgccatggtaggacagtcgcagcaacagccaccgcagcagcagccgagcccacagccccaacagcaggtccagcccccgcaacctcagatggccgggccgttagtgacacagagtgtacaggggctgcaggctagttctcagagcgtgcagtatcccgccgtgagctttccgcctcaacacctcctgcccgtgtctcccacacagcactttcctatgagggacgatgtagccacccagttcggtcagatgacgctgtccaggcagtccagcggcgagacccctgagcctccgtcaggtcctgtgtacccttcaagtctgatgccacagcccgcccagcagccgagttacgtgatagcaagtacgggccagcaactgccaaccggtggtttctccggatcaggcccccccatttctcagcaagtactccagcctcccccctccccccagggattcgtgcagcagccgcctcccgcccagatgccagtctattactacccctcaggtcaatatccaacatccactacgcagcagtatcgaccaatggcccccgtgcaatacaatgcacaacgctcccagcagatgcctcaggctgcacagcaagcaggatatcagcctgtgttatctgggcaacagggatttcagggattgatcggagtccaacagcctccccagtcacaaaacgtgataaacaaccagcaaggaacaccagtacagtccgtgatggtaagctacccaacaatgtcctcctatcaagtcccaatgacccagggcagccaggggttacctcaacagtcctatcagcagcccatcatgttaccaaaccaggccggccagggaagcctcccggcaactgggatgccagtttattgtaacgttacacctccgacaccacagaacaatctacgcctcataggcccgcattgcccaagctcaacagtaccagtgatgagtgcatcgtgcagaactaactgtgcatctatgtccaatgctgggtggcaagtgaagttttag

SEQ ID NO: 26267 - DNA, 1773 bp, Artificial Sequence
  Description of Artificial Sequence: Synthetic coding sequence
atgcccagcccccagctgctggtgctgttcggcagccagaccggcaccgcacaagatgtcagcgaacgactgggaagagaagcccgaagaagacgccttgggtgcagagtgcaggcgctggactcttaccccgtggtaaaccttattaatgaacctttggtgatctttgtatgcgctacaactggccagggtgacccacctgacaatatgaaaaacttctggcggttcatttttagaaaaaatctgccttctactgcgctatgtcagatggatttcgccgtgctgggcctgggggactcctcttatgctaaattcaatttcgtggccaaaaagctacaccgaagactgctccaactcgggggctcggctttactgccggtttgtctaggtgacgaccagcatgagctgggcccagatgccgccgtggatccttggctgcgtgatctttgggacagagtactgggcttatatcctccaccgccgggattaacagaaatccctcctggtgttcccttacccagcaaattcaccctgttgttcttgcaagaggccccctcaactggatctgaaggacaacgggtcgcccacccaggcagccaggagcccccaagcgagtctaagccctttttggcaccgatgattagtaatcagagagtgaccgggccgtcccattttcaagacgtgcgccttatcgagttcgacattctaggctccgggatttccttcgctgccggcgatgtagtgctgattcagcccagcaatagcgccgcacacgtccagcgcttctgccaggttctgggccttgatccagatcaactgttcatgctgcaacccagagaacccgatgttagctcaccaacccgtttaccccaaccttgttcaatgagacacttggtgtcccattacttggatatagcctctgtgccacgccgtagtttctttgagctgctcgcgtgcctgagcctacacgagctcgaaagggaaaaactccttgagtttagctcagctcagggacaggaggaactcttcgaatattgcaataggccgaggagaacaattttagaagtactgtgcgattttccacacaccgctgctgcgatcccgccagactatcttttggacctcatcccagtgatccgccccagagcgttctccattgcaagttcactgctgattttggtggcggtggtgcagtttcagacccgtctgaaagaaccacggcggggcctctgctcttcctggctagcttctctggacccaggtcaagggcctgtgcgtgttcctctgtgggttcgacccggcagtttagcgttccctgaaacacctgataccccggtgatcatggtcgggccgggtaccggagtcgcaccattccgtgcagcgatccaagaacgcgttgcacagggccagactgggaacttcttgttcttcggctgtaggtggcgggaccaggatttttactgggaggcagagtggcaagagctggagaagagagactgcctgacgcttatccctgcatttagcagagagcaagaacaaaaggtatacgtgcagcatagactgcgggagctagggagtttagtgtgggagcttctggaccgacagggcgcatacttctacctggcagggaacgctaagtctatgcccgccgatgtaagcgaggcactgatgagtatcttccaagaagaagggggactttgctctcctgatgcggctgcttatcttgcacgcctgcagcagacgcgtcggttccagactgaaacctgggcttag

SEQ ID NO: 26268 - DNA, 2436 bp, Artificial Sequence
  Description of Artificial Sequence: Synthetic coding sequence
atgcccctgagcagccccaacgccgccgccaccgccagcgacatggataaaaattctgggagcaatagtagctctgccagttctgggtcatccaaagggcagcagcctcctcgatctgctagcgccggaccggctggtgagtcaaagcccaaatcggatggcaaaaactcttccggcagtaagcggtacaaccggaaacgtgagctttcttatcccaaaaatgagagcttcaataaccaaagccgtaggtccagctctcaaaaaagcaagaccttcaataagatgccaccccagcgcggaggtggcagctccaaacttttttcttcatcgttcaacgggggcagaagggatgaagtcgccgaggcccagcgggctgaatttagtcccgcgcagttcagcgggccaaagaagatcaacttaaatcatctgctgaactttacattcgaaccgcgcggtcagaccggccattttgagggaagcggacacgggtcttgggggaaacggaataagtgggggcataagccattcaacaaggagctcttccttcaggcgaattgtcaattcgttgtcagcgaggatcaggactataccgctcacttcgctgacccagataccttagtcaactgggattttgtggaacaggtgcgtatctgcagtcatgaggtgcccagttgtcccatctgtctataccctcccacggctgccaagattacaagatgtgggcatattttttgctgggcttgtatcctccattaccttagtctgtcagaaaaaacatggtctaagtgtcctatctgttattcttcggtccacaagaaagacctgaagagtgttgttgcaacagagtctcatcaatacgtggtgggtgatacaattaccatgcagcttatgaaaagggaaaaaggcgttttggtggccctccccaagtctaagtggatgaacgtggaccaccccatacacctaggtgacgagcaacactcccaatacagtaaactgctgctggctagcaaagagcaagtgctgcaccgagttgttttggaggaaaaggtcgccctagagcagcagctagccgaggagaaacataccccggagagttgctttattgaagctgctatccaagagttaaagacccgggaagaggcactcagcgggctagccggcagtcgcagagaggtcaccggggtggtggccgccctggaacagctcgttcttatggctcccctagcaaaggagtctgtgtttcagcctcgtaaaggggtcctggagtacctgagcgcgttcgacgaagaaaccactgaggtgtgtagccttgatacaccatctaggcctctcgccttacctcttgtcgaagaagaggaggccgtgtcagagccagaaccagagggtcttcccgaagcctgcgatgaccttgaactcgcagacgataatctgaaagaaggaactatctgtaccgagagtagtcagcaggaaccaatcactaagtcggggttcacgcgcctgagctcttccccatgctactatttctaccaagctgaggacggtcagcacatgtttttacacccagtcaacgtccggtgtctcgtgagggaatatgggtccctggagcgcagcccggaaaaaatttcggcaacagtagttgagatcgccggatacagtatgtccgaagacgtcaggcagcgccatagataccttagtcacctccctcttacatgtgaattctctatttgcgaactggccctacagccccccgtcgtttctaaagagacgttggagatgttctctgacgacattgagaaaaggaaaaggcaaagacagaagaaggcccgcgaggagagaagacgagagagaaggattgaaatcgaggaaaataaaaaacagggaaagtatcctgaggtccacatccctctagagaaccttcagcaattccctgcattcaattcttacacttgctcctctgattcagccctcggtcctactagtactgagggccacggcgccctgtccatttctccccttagccgatctccagggtctcatgccgacttcctgctcacacccctgtctcctactgcgtcacagggcagtccatccttctgcgtaggttcgctcgaggaggactccccgttcccatctttcgcccagatgctgcgagtgggcaaggcgaaggctgatgtgtggcccaaaacagctccaaagaaggacgagaatagcttagtcccacccgcaccagtcgatagcgatggcgagtcagacaactctgatcgcgtgccagttcccagttttcagaattcgtttagccaggctatagaagctgcctttatgaagctagacacccctgccacgtcagacccgttatctgaagagaagggcggcaagaagcgcaaaaaacaaaaacagaaactgctgtttagtacctctgtcgtgcataccaagtag

SEQ ID NO: 26269 - DNA, 189 bp, Artificial Sequence
  Description of Artificial Sequence: Synthetic coding sequence
atgcccgagatccgggtgacccccctgggcgcctgccccgtgctgtcctggaatctcgtattaccacctggcagaggcagcagggcaccgtccagcaccgacactcgcactgggttccacgtgcttccgcacggcgtgtcggccagctctgagggcgcccctagacccggagtagacaccgtcctgtag

SEQ ID NO: 26270 - DNA, 948 bp, Artificial Sequence
  Description of Artificial Sequence: Synthetic coding sequence
atgagcggcctggtgctgggccagcgggacgagcccgccggccaccgattatctcaggaggaaatcctcggaagcacccggctggtttctcagggattggaagcgttgagatccgaacatcaggccgtactccagtcgctgtcacaaacaatagaatgtcttcagcagggcgggcatgaggaaggccttgtgcacgagaaggctagacaactccgaaggtctatggagaacatcgaactgggattaagcgaggcacaggttatgctggccttagcctcgcatctctcaaccgtcgaatccgagaagcagaagctgcgggcccaagtgcggcggttgtgccaggaaaaccagtggttgagagatgagctagccggaactcagcaacgccttcagaggtcagaacaggcagtagcacaactggaggaagaaaagaaacatctggaattcttgggccagctacgacagtatgatgaagatggacacacctccgaagaaaaagagggcgatgctacgaaagacagtctggatgatttatttcctaatgaggaagaggaagatccttcaaatggcctgtcccgcggacagggtgccacagcggcacagcaaggggggtatgagattcctgcccgcttacgaacgttacataatttagttatacagtatgcggctcaggggaggtacgaagttgcggtgcccctctgtaagcaggctctggaggacctcgagcggacctccggccgcggtcatcccgatgtcgctaccatgctcaacatccttgccctggtgtatcgtgaccagaataaatataaggaggctgcacacttactgaacgatgccctttccatccgagaatccacattggggcccgatcaccccgcggtctcgattccctgtcctccccaccccacccccagaactcctcatcactgctgttttgggctaagctag

SEQ ID NO: 26271 - DNA, 2055 bp, Artificial Sequence
  Description of Artificial Sequence: Synthetic coding sequence
atggagaacctgcagaccaacttcagcctggtgcagggcagcaccaaaaaactcaatggcatgggagatgatggaagcccaccagcaaagaaaatgattacagacatccacgcaaatggaaaaactatcaataaagttcctaccgtgaagaaggagcatctagacgattatggggaagcaccagtcgaaactgatggagagcatgttaaacgaacctgcacatcggttccagagacactccacctgaacccttccctgaagcacaccctagctcagttccatctcagctcccagagttctttaggcggcccagccgctttttctgcacggcacagccaagagtcgatgtcacccaccgtcttcctgcccctgccgagcccacaagttctcccaggcccactgctaatccccagcgacagttctaccgaactcactcagacggtgctggaaggggaatccattagctgcttccaagtcggtggtgagaagcgtctctgtctgccccaggtgctcaactctgtgttgcgggagtttacattacagcagattaatacagtgtgcgatgaactttacatctactgttctcgctgtactagcgatcagcttcatattctgaaagtcctcggcatactaccgttcaatgcaccgtcctgcggcctgatcacactgacggacgcccagagattatgtaacgcgcttctgaggccaaggaccttcccacaaaacggatctgtgttacctgccaagtccagtctggcccagctgaaggagaccggctcagcctttgaagtcgagcatgaatgtctgggtaagtgccagggactttttgcgccccagttttacgttcagcccgacgccccctgtattcagtgtttagagtgctgcgggatgttcgctccccaaaccttcgtgatgcactcccatcgatccccggataagaggacttgccattgggggttcgagtctgccaagtggcactgctacctccacgtcaatcaaaagtatctcggtactcctgaagaaaagaagctgaaaatcatactagaggagatgaaagagaaattcagcatgcgtagcggaaagcggaatcaaagcaagaccgacgctcctagtgggatggagctgcaaagctggtacccagtcataaaacaggaaggtgatcacgtgagtcaaactcatagcttcctgcacccgtcctactacctgtacatgtgtgacaaagtggtcgcccctaatgtgtctctgacctctgctgtgtcccagagcaaggaacttacaaagactgaagcatctaaatccatctcccgtcaatctgagaaagcacactcatctggcaagttgcagaagacggtgtcatacccggacgtgagccttgaggagcaggagaagatggaccttaaaacttccagagagttgtgtagtcgtttagacgcatccatcagcaataacagcacatccaagaggaagtcagaatctgcaacttgcaacctggtgcgtgacatcaataaggtcgggatcggcttggtagcagccgccagctcaccactgttagtaaaagatgtgatctgcgaggacgacaaaggaaagatcatggaggaggttatgcgcacttatctgaagcagcaggaaaagctgaaccttatcctgcaaaaaaagcaacaactccaaatggaagtcaagatgctgagtagttctaagagcatgaaagagctgacagaggaacagcaaaacttgcaaaaggagctggagtctctacagaacgaacacgcccagaggatggaagagttctatgtggagcagaaggacctggaaaagaaattggagcaaataatgaagcagaagtgcacctgtgattctaatttggagaaggacaaggaggccgaatatgctggtcagctggcagaacttaggcaacgcctggatcacgccgaggctgatcgtcaggagcttcaggacgagttaagacaggagcgtgaagcacgtcagaagctagagatgatgatcaaggaactgaaactgcaaatactgaaatcttccaaaaccgccaaggagtag

SEQ ID NO: 26272 - DNA, 4050 bp, Artificial Sequence
  Description of Artificial Sequence: Synthetic coding sequence
atggaggagaacgagagccagaagtgcgagccctgcctgccctacagtgcggaccggcgtcaaatgcaggaacaggggaaggggaatctccacgtaacaagccccgaggacgcagagtgccgcaggactaaagagagactcagcaacggtaatagccgagggtctgtctccaaatcctccaggaatataccccgaagacataccctaggcggcccccggtcctccaaagagattctcgggatgcagaccagtgagatggatcgtaaacgagaggccttcctggagcacctgaagcagaaatacccccatcatgcctcagcaattatggggcatcaagagcggcttagggaccagacaagaagtcctaaactgagccacagcccgcagccaccttctctgggagatccagtggagcatctaagcgagactagtgccgattccttggaggcaatgtcagagggggatgctcctacaccattcagccgcgggagccgcacccgcgctagtctccctgtggtgaggagcaccaatcagacaaaagaacgaagtttaggcgtcttgtacctgcagtacggggacgagaccaagcaacttcgaatgcccaatgaaatcacgtctgcagatacgatccgggcactcttcgttagcgcttttcctcaacagctgacaatgaagatgctcgagagcccaagcgtggccatctacatcaaggatgagtcgcggaatgtgtactacgagctgaacgatgtgaggaacatccaggatcgctctctgcttaaagtctacaacaaagaccccgcccatgcattcaatcatacacctaagacgatgaacggcgatatgaggatgcagcgagagttagtatatgcgaggggggacggtcctggagcccctaggcctggaagcaccgctcacccaccccacgctattccgaacagccctccgagtaccccggtgccacattccatgcccccctccccgtcgcggatcccatacggcgggaccagatctatggtggtgcccgggaatgcaactattcctcgagacaggataagctcactcccagtgagtcgcccgatttccccctctcccagcgcaatactggagcgacgggatgtcaagcctgacgaggatatgtccgggaagaacattgctatgtatcgcaacgaaggcttttacgccgatccatatttgtaccacgaggggcgcatgtcaattgctagctcccacgggggccaccctcttgatgttcccgaccacattattgcctatcatcgtacagcaattcgtagcgcctccgcatactgcaacccgtccatgcaggccgagatgcacatggagcaatctctgtacagacagaagtcccggaaataccctgacagccatctgccaacgctgggatcaaagacgccacccgccagcccgcatcgggtaagcgacctgagaatgatagatatgcacgcccactataacgctcacggaccccctcacacaatgcaacccgaccgcgcaagcccgagtaggcaagccttcaagaaagagccaggaactttggtttacatagagaagcccagaagcgctgctgggctcagcagcctcgtagatctgggtccaccattaatggagaagcaagtgtttgcgtattccacggccactattcctaaggaccgcgagaccagtgaaaaaatgatgaagaccacagctaaccggaaccacactgatagcgcagggacaccacatgtctcgggcggaaagatgcttagcgccctagaatctaccgtgcccccctcccagccgccacccgtaggaacaagtgccattcacatgagccttcttgaaatgcgccgtagcgtggccgagctgaggcttcagttgcagcaaatgagacagttacaactccagaatcaagagttgctccgggctatgatgaagaaagccgagcttgagatttctggaaaggtaatggaaacaatgaaacgcttggaggaccctgtacagaggcagagagtgctggtagaacaagagagacagaagtatttgcacgaagaggagaaaatcgtgaagaaattgtgtgagcttgaagactttgttgaggacctgaagaaggacagcactgccgctagtaggctagtaacactcaaggacgtcgaggatggggcatttctgctcaggcaagtaggtgaggctgtagcaacgttgaagggggaattccctactctgcaaaataagatgcgcgctatcttgaggatcgaggtggaggccgttcgcttcctcaaggaggagccacacaaactggattcactcttgaaacgagttagaagtatgaccgatgtgctgacgatgctgagacgacatgtgacagatggcctcctgaagggaaccgacgctgcccaggccgcacagtacatggcaatggaaaaagccacagctgctgaagtcctcaagtcccaagaagaagccgcgcacacatcgggtcaaccattccattctactggtgccccaggggacgccaagtccgaggttgtgcctctatctgggatgatggtccgacatgcccagagctctcctgtcgtgatccaacccagccagcacagtgtggccctgctcaaccctgcccaaaatctacctcacgtcgcctcctctcctgcagtaccacaagaagccactagtacactacagatgagccaagctccccagagcccacagatacccatgaacgggtccgctatgcagtctctgttcatagaggaaatccactccgtgagtgctaaaaacagagcagtctcaatcgagaaagccgagaagaagtgggaagagaaaagacagaacttggaccactacaatgggaaggaatttgagaaactgctggaggaagcacaagccaacatcatgaaatcgatcccaaacctggagatgccacccgccaccgggcccctaccccgaggcgacgccccggttgataaggtagagctgtctgaggacagtcccaactctgagcaagacctggagaaactaggtggcaaaagcccgccccctccgccccctcccccccgccgctcctacctccccgggtccgggctgactaccacaagatcaggcgacgtggtatacaccggacgcaaagagaatataaccgctaaggcaagttcagaggacgcaggcccttctccacagacaagggctacgaagtaccccgctgaggagccagcatccgcgtggactcccagcccccctcctgtgactacgtcttccagtaaagatgaagaagaggaggaagaggagggtgataagatcatggccgaactccaggctttccaaaagtgcagtttcatggacgtcaattccaactcccatgctgaacctagccgcgcggactcgcacgtgaaggataccaggtccggcgccaccgtgcctcccaaggagaagaagggatcgtccggggcaccacagacaagccgaatgccagtccccatgtccgccaaaaacagaccaggcactctggacaaacccggcaaacagtctaaattacaggacccacgacagtatagacaggccaatggctctgccaagaagtctggcggtgattttaagcccacttctcctagcctgccagcatccaagatcccagcgctcagcccaagttctggcaaaagcagcagtctcccctcatcctcaggtgacagtagcaatctgcctaaccctcccgccaccaagcccagtatcgcctctaatccactctctccccagactggccccccggcacattccgcctcactcatcccttctgtgagtaacggttcactcaaatttcaaagtttgacccacacagggaaggggcatcatctgagcttcagcccccaatcccaaaatgggcgagccccaccacctctatccttctctagcagccctccatcaccagcctcatctgtgtccctgaatcagggagccaaaggaacaaggaccatacacactccctctctcacaagctacaaagcgcagaacggttcctcatcaaaagccaccccctcaaccgccaaagagacctcatag

SEQ ID NO: 26273 - DNA, 177 bp, Artificial Sequence
  Description of Artificial Sequence: Synthetic coding sequence
tgaatcatccacaagctggccatgcagctgcggcacatcggcgacaatattgaccatcgaatggtaagggaagacctgcagcaggatggccgcgacgcactagatcacttcgtgttctttttcttcaggagagtgcaggtccttttgcattttttttggaacaaccatttattgtag

SEQ ID NO: 26274 - DNA, 429 bp, Artificial Sequence
  Description of Artificial Sequence: Synthetic coding sequence
atgcccgaggaccaggtgggcaagctggaggccaccgagaacaccatttccgccatggctgctgcagcagctgaacagcagcagttttatttgctgctcggaaatctcctgagcccagataacgttgttaggaagcaggcggaagagacctatgagaacattcccgggcaaagtaaaattacattcttgctgcaagctatccggaacacgaccgcagccgaagaagctagacaaatggccgccgtcttgctgcgaaggcttctcagcagcgcattcgacgaagtttaccctgccttgccatccgacgtccagaccgctatcaaatctgaactgttgatgataatacagatggagacccagtctagcatgaggaaaaaggtctgcgacattgcagccgaacttgcacggaatctgattggcgtctattag

SEQ ID NO: 26275 - DNA, 93 bp, Artificial Sequence
  Description of Artificial Sequence: Synthetic coding sequence
atgggcagccggaagaaggagatcgccctgcaggtgaacatcagcacccaggagttgtgggaagagatgctgtcatccaagggcttaacctag

SEQ ID NO: 26276 - DNA, 645 bp, Artificial Sequence
  Description of Artificial Sequence: Synthetic coding sequence
atggccggcgagaacttcgccacccccttccacggccacgtgggccgcggtgccttttcagacgtgtacgagcccgccgaagataccttcttgttactgaacgctctggaagcagcagccgctgagttagccggggtggaaatttgccttgaagtgggcagtggatcgggtgtcgtttccgcctttctggcgagcatgattggaccccaggctctttacatgtgcacggatatcaatcctgaggctgccgcttgtaccctggagacggctaggtgtaataaggttcacatccagcctgttataaccgacctcgtgaaggggttactgccacgccttaccgaaaaagtcgatctgctagtctttaatcctccgtacgtggtcaccccacctcaggaggtcggctcccacggcatagaagctgcttgggctggaggcaagaacgggcgggaagtgatggaccgctttttccctctggtgccagatcttctcagccccaaggggctgttctatctggtgacaatcaaggagaataatccggaagaaattctcaaaatcatgaagacgaaagggttgcagggaactacagccctgagtcggcaagccggacaggaaaccttgtcggtcctcaaatttactaagtcctag

SEQ ID NO: 26277 - DNA, 1158 bp, Artificial Sequence
  Description of Artificial Sequence: Synthetic coding sequence
atgggccggtggtgccagaccgtggcccggggccagcggccccggacctctgccccaagtagagccggggccctgttgctgcttctgctgctgctgagaagcgccggttgttggggtgcaggcgaggctcctggcgccctgagtactgccgatccggcagatcaatccgtacagtgtgtgccgaaggcaacctgcccaagctcgcgcccacgcctgctgtggcagactcccacaacacagaccttgccatcaactacgatggaaacccagtttccggttagcgagggcaaggtggacccataccggagctgtggcttttcctatgagcaggacccgacgctccgggacccagaagctgtggctcgcaggtggccatggatggtcagcgtgcgggccaatggaacgcatatttgcgccggaacaatcatagcgagccagtgggtgcttacagtggcccattgtttaatctggcgtgacgtgatttatagcgtccgcgtgggatcaccctggatcgaccaaatgactcagactgccagcgatgtgcctgtgctgcaagtcatcatgcactcacggtatagagcacagcgcttttggagctgggtgggtcaggccaatgatatcggcttgctgaaactaaagcaagagctgaaatacagcaactatgtgcgaccaatctgcctcccaggtaccgattatgttctgaaggatcactctcgctgcaccgtcaccggatggggcctttctaaggccgacggcatgtggcctcagttccgaacaatccaagaaaaagaggtaatcatcctaaacaataaggagtgcgacaacttctatcacaactttacaaaaatccctaccctggtacagataatcaaaagtcagatgatgtgcgcagaggacacacaccgcgaaaaattttgttacgagctgactggtgagccactcgtgtgctccatggaagggacatggtatctggtcgggctggtcagttggggggcggggtgccagaaatcagaggcccctcctatatacttgcaggtcagctcatatcaacattggatttgggattgcctgaacgggcaagcgctggctctgcctgcaccttcaagaacccttctgttagcgctacccttgccactgtcactcctggcagcactctag

SEQ ID NO: 26278 - DNA, 255 bp, Artificial Sequence
  Description of Artificial Sequence: Synthetic coding sequence
atgagcggcctggtgctgggccagcgggacgagcccgccggccaccgtttgtctcaggaagagattctggggagcacgaggctggtttcccagggcttggaggctctacgaagtgagcatcaagctgtactccagagcctgagtcagaccattgagtgcctgcaacagggaggacatgaggaaggacttgtccatgagaaggccagacagctaagacgcagtatggagaacattgaactggggctgtcggaatag

SEQ ID NO: 26279 - DNA, 483 bp, Artificial Sequence
  Description of Artificial Sequence: Synthetic coding sequence
atgagcgtgaacagcgagaagagcagcagcagcgagcggcccgagccgcagcagaaagctccactcgttcccccaccacccccaccaccacctcctcctcccccccccttaccggaccctactcccccggagcccgaagaggaaatcctgggctccgacgatgaagaacaggaggatccagctgactactgtaagggggggtaccacccggtgaaaattggcgatctgttcaatggcagataccacgtgatccggaagctgggatggggtcacttttctacagtttggctgtgttgggacatgcaaggaaagcgctttgttgccatgaaggtggtcaaatctgctcagcattacaccgaaaccgctcttgatgagatcaaattgttgaaatgtgttcgggaaagtgacccctctgatcccaacaaggacatggttgtccagcttatcgacgacttcaaaattagtggtatgaacggcatctag

SEQ ID NO: 26280 - DNA, 66 bp, Artificial Sequence
  Description of Artificial Sequence: Synthetic coding sequence
atgaaccccgccagcgcccccccccccctgcccccccccggccagcaggttatccacgtgacatag

SEQ ID NO: 26281 - DNA, 1212 bp, Artificial Sequence
  Description of Artificial Sequence: Synthetic coding sequence
atgagcggcagcgacggcggcctggaggaggagcccgagctgagcattaccctgactctacggatgctgatgcatggcaaagaagtgggctccatcattgggaaaaagggcgagacagtgaaacggatccgtgagcaaagctcagcccggatcacaattagtgaggggtcgtgccccgagagaatcaccactatcacaggatctacggccgcggtgtttcatgcagtttcaatgattgcatttaaactggacgaagacctgtgcgccgccccagcgaatggaggcaatgtatcccggccacccgtgactttgaggcttgttatcccagccagtcaatgcgggagtctcattggaaaggcaggaacaaaaattaaggaaattagagaaactacaggtgctcaggtgcaggtagccggcgacttgctccccaactccacagaacgggcagtaactgtttcgggggtgccagatgcaataatcctttgcgtgcgacagatctgcgcagtgattctggagtcgcctcccaagggagctaccattccatatcatccttcactgtcccttggtactgtgcttttgagtgccaaccaaggcttcagtgtacagggccaatatggcgcagttacacccgccgaggtgaccaagctgcagcagctgagtagtcatgctgtcccgtttgccactcctagtgtggtgcccgggttggatcctggtacacaaacgtcaagccaggaatttttagtgcccaacgacctaatcggatgcgtgattggtcggcaaggtagcaaaatctctgaaattcggcaaatgtccggggctcacataaagattgggaatcaggccgaaggcgcgggtgaacggcacgtcacgatcaccggaagccctgtgtccattgccttagcccagtacctgatcacggcgtgcctcgaaacagccaaatctacatcaggcggaacaccaagttccgcgcccgcagatcttccagcccccttttcgcctccattgactgccctgcctactgctccccctggcctcctggggacaccttacgcaatctcccttagtaattttattgggctcaagccaatgccatttctggcattgccaccagctagccccgggccccctcccggactcgcggcatacactgctaaaatggctgctgccaacggatccaagaaggctgagcggcagaagttcagcccttactag

SEQ ID NO: 26282 - DNA, 5106 bp, Artificial Sequence
  Description of Artificial Sequence: Synthetic coding sequence
atgggcaacagcgacagccagtacaccctgcagggcagcaagaaccactctaacacgataaccggggccaaacagattccgtgctcgctcaagatccgaggaattcatgcaaaggaggagaagtctctgcatggttgggggcacgggtcaaacggtgccggctacaaaagtaggtcattggccaggtcttgtttatcccatttcaagtccaatcagccttatgcttccaggttgggagggccaacttgtaaggtgagccgcggagtggcctattctacccacagaactaatgccccaggaaaagacttccaaggaatttccgctgcatttagcacagagaacgggttccactctgtcggtcatgagcttgctgacaaccatattacatcccgggattgtaacgggcacctgctgaattgctatggtcgcaatgagagtatagcgtccaccccgccaggggaggataggaaaagtcctcgagtgctgatcaaaacattgggaaaactggatgggtgcttgagagtggaatttcataatggcggcaacccaagcaaggtaccagctgaggactgctcggagcctgtgcagctgctccgctactctccaactctggcttctgagaccagtcctgtgcccgaggcccggcggggctcaagcgccgactccctcccctctcacaggccctctccgactgattcccggctcaggagtagcaaggggagttcactgagctcggagtctagttggtatgatagcccttggggaaatgccggcgagctatcggaagctgaaggttccttccttgcaccaggaatgccagaccctagcctccatgccagctttccccctggggacgcaaagaaacctttcaaccaatcctccagcctgtcaagcctgcgcgaattgtataaagacgcaaatttgggcagcctgagtccctcaggaattcgactgtctgacgagtatatgggaacgcacgctagcctcagcaaccgtgtgagtttcgccagcgacatcgacgttccaagtcgcgtggcgcatggggatccgatacagtattcgagctttaccctgccttgccggaagccgaaggcttttgtggaggatacagccaaaaaagattctctgaaggccaggatgcgaagaatctcagattggactggatcgttatcaaggaaaaagaggaagctccaggaacctcgctctaaagaggggtccgattatttcgacagcaggagtgacggattgaatacagatgtccaggggagctcccaggcttcagccttcctgtggtcgggtggatccacccagatcctcagtcagcggagtgaaagcacacatgcgattggttcggaccccctacggcagaatatctatgaaaacttcatgcgtgaattagaaatgtcacgcaccaacaccgagaacattgagactagcacagaaacggcagagtcgtcaagcgaaagtctgagctcccttgagcagctagatctgctgttcgagaaagaacagggagtcgtgcggaaggccggctggctgttctttaaacccctggtgacggtccagaaggagcgcaagttggagctggtggccaggcggaagtggaagcagtattgggtgactttgaagggctgcaccctgctgttttatgagacctatggcaagaatagtatggatcaatcctccgcccctcgttgcgcattgttcgccgaagactcgattgtacagtccgttcctgaacaccctaagaaagagaacgttttctgtctaagcaactcattcggggacgtctacctgtttcaagccacctcccagacagacctggaaaattgggtgactgcggtgcactctgcgtgcgcaagcctctttgcaaaaaagcatggcaaggaggacactcttcggctgcttaagaaccaaacaaaaaatcttctacagaagattgacatggacagtaaaatgaaaaaaatggcagagctacagctgtcggttgtgtctgatccaaagaatcggaaggccatagagaatcaaattcagcaatgggagcagaacctggaaaagttccatatggatttgtttcggatgaggtgttatctagcctctcttcagggcggtgaattgccaaaccctaagtcattattagctgccgcctccaggccatctaagttggctctgggccggctcggaatcctgtctgtcagttccttccatgcattggtgtgcagtcgagacgatagcgccttgagaaaacgcaccttgagtttgacccagcgaggtcggaacaagaaggggatcttctctagcctcaaagggctcgacaccctcgcccgtaaggggaaggaaaagagaccaagtatcacgcaggtggacgaattgctgcacatatacggttctactgtcgacggggtgccacgagataatgcgtgggagatccagacatacgtgcattttcaggacaaccatggggtgacagtcggaatcaagcccgagcacagagttgaggacattttgactctcgcatgcaaaatgcgacagttggagccaagccactacgggctgcagttacggaagctagtagatgacaatgttgaatattgtatacccgccccatacgagtacatgcagcagcaagtgtatgacgaaatcgaagtattccccctaaatgtgtacgacgttcagctgacaaaaaccggctctgtatgcgactttggcttcgctgtgacagcccaagtggacgaacggcagcacttgagtcgcatttttattagcgatgtgcttcctgacggtcttgcatatggcgaagggttgagaaagggtaatgagattatgacactaaacggagaggcagtctccgacctcgacttgaagcagatggaggctctgttcagcgagaaaagtgtcggcctgacactcatcgccaggccgcccgatactaaggctacgctctgtacatcttggtctgacagcgacctgtttagccgagatcagaagagtttgcttccacctcccaaccaatcccaattgctcgaggaatttctggacaattttaaaaagaacacagctaatgacttctccaacgttcctgacattacgacaggcctgaaacgctcccaaacggacgggacactggaccaggtctctcatcgagagaagatggaacagacttttcgctctgcagagcaaatcaccgctctgtgcaggtcattcaatgactctcaggccaatggcatggaaggtcctcgggaaaaccaggacccacctcctcgctcacttgcacggcatcttagcgacgccgacagactgcgcaaggttatacaggagctagtggataccgagaagtcctacgtgaaggacctttcttgcctgttcgagctgtatctggagccactgcaaaacgaaacgttcctgacccaagatgagatggaaagcctctttgggtccctgcctgagatgctggaattccagaaggtgttcctggaaacacttgaagacggtatctcagcatcaagcgatttcaacacactcgaaaccccttctcaatttcgcaagctcctgttttccctcggagggagttttctatattacgcggatcatttcaagctgtacagtgggttctgcgctaaccacattaaagtacagaaagtactagagagagcaaagacagacaaagcgttcaaggcgtttttagatgccaggaatcccactaaacagcactcttctactctcgaatcatacctcataaaacccgttcagagggtgctcaagtacccgctcttgcttaaagaactggtttcattgactgatcaggaatcggaagaacattatcacttgacagaagccctcaaggcaatggagaaagtggccagtcacataaatgagatgcaaaaaatatacgaagattacggaaccgtcttcgaccaattagtagcagagcaatctggtactgaaaaagaggttacggaattatctatgggagaactgttaatgcattccaccgtgagttggctgaacccttttctgtccctgggcaaagcccgcaaggacctagagcttactgttttcgtgtttaaacgggcagtaattctagtttataaagaaaattgcaaactcaagaaaaagctccccagcaatagtagacctgcacataactccactgatctggatccgttcaagttcagatggttgatccccatttccgcactgcaggtgaggttgggcaatccagccggcactgagaacaactcaatttgggagctgatccacacaaagtctgagatagaggggcggccagaaacaatatttcagctgtgttgcagcgatagcgaaagtaagacaaatatcgtgaaggtgatcaggtctatactacgggaaaacttcagacgccacatcaagtgtgaactgcctcttgagaagacctgtaaggatcgactggtccctctgaagaaccgcgtacctgtctctgccaagcttgcctcatcaaggagtctaaaggtcctcaagaattcctcaagcaacgaatggacgggtgaaactggtaagggtacgctgctggacagcgatgaagggtctctgagttctggaacgcagtcatctggatgtcctaccgcagaaggcagacaggattctaagtccacatccccaggaaagtaccctcatcctggattggccgattttgcggataacctgatcaaagaatccgacatcctgtcagatgaggacgatgaccatcgccagacagttaaacaggggtctcctaccaaggatatcgaaattcagttccagaggctgcgcatttccgaggacccagatgtccaccccgaggcagaacagcagcccggtcccgaatccggtgaggggcagaaaggcggggagcagcctaagcttgtacgcgggcatttctgcccgatcaaacgcaaggcaaactcgactaagcgtgaccggggcacattactgaaagctcagatcaggcatcaatcacttgactcccagagtgaaaacgctactatcgatctgaactctgtgctggagagggagttcagcgtacagtcacttacaagcgtagtgtcagaagagtgtttttacgagactgaatcccatgggaaatcctag

SEQ ID NO: 26283 - DNA, 408 bp, Artificial Sequence
  Description of Artificial Sequence: Synthetic coding sequence
atgggcaagagctgcaaggtggtggtgtgcggccaggccagcgtgggcaaaacttccatccttgagcagttgctctatgggaatcacgtggtgggctcggaaatgatagagacccaggaggacatctacgtaggctccatagaaaccgatcgcggcgtgcgggaacaggtgaccattgtagtactcggcaataaatgtgatctccaagaacagcgcagagtagacccggacgtagcccagcactgggccaaatcggagaaagtaaaactatgggaggtctccgtggcggatcggcgttctctgctggagccctttgtgtaccttgcctccaaaatgactcagccacagagcaagagcgcttttccactctcaagaaaaaacaaaggatccgggtcacttgatggatag

SEQ ID NO: 26284 - DNA, 3693 bp, Artificial Sequence
  Description of Artificial Sequence: Synthetic coding sequence
atgccccggaagggcacccagcccagcaccgcccggcggcgggaggagggtccgcctcctccctcacctgacggcgcatcgagtgatgctgaaccagaaccgccgagcgggcggaccgagagcccggctaccgccgctgagactgcttctgaagagctagacaaccggagccttgaggaaattcttaacagtatccctcctcctccaccaccagcaatgacaaacgaagccggggctcctcggctcatgatcacgcacatcgtaaaccagaactttaagtcttatgcaggcgaaaagatcttaggacccttccataaaaggttctcctgcattattggcccgaatggcagtggcaagtcaaatgtgatcgactccatgctgttcgtgtttggctatcgcgcacagaagatcaggagtaagaaactttcggtgctgattcacaactccgacgagcacaaggatatccagtcttgtaccgtggaagtgcactttcaaaaaatcatagacaaggagggagacgactacgaagtgattcccaacagcaatttttacgtgtctcggaccgcctgcagggataacacaagcgtgtatcacatctccggtaagaagaagacctttaaggacgtcggcaatctcttgaggagccacggcatagatctcgaccataacaggttcctcatcttacagggagaagtggaacagattgctatgatgaagccaaagggccagaccgaacacgacgagggcatgttagagtatttagaggatattataggctgtggccggctgaatgagcccatcaaggttctttgcaggcgcgtggagattctgaacgaacatcggggcgaaaaacttaaccgcgttaaaatggtggaaaaggagaaagacgcgctggaaggtgaaaagaacatagcgatcgagtttctgactcttgaaaatgaaatttttaggaagaagaatcatgtctgccagtattatatttatgaactgcagaaaagaatagctgagatggagactcagaaggagaagatccacgaggacacaaaggagattaacgaaaaatctaacattttaagcaacgagatgaaagccaagaacaaggacgtaaaggatacagaaaagaaactgaacaagatcaccaaatttattgaggaaaataaggagaagtttactcagctggaccttgaggacgtgcaggttcgggagaagctcaagcatgccaccagtaaggcgaagaaactagagaagcagctgcaaaaagacaaggaaaaggttgaggagtttaagtctattcctgccaaatcaaataatattattaacgaaactactacaagaaataacgctctggaaaaggagaaggagaaagaagagaagaaactcaaagaagtgatggattctctgaaacaggaaactcagggcctccagaaagagaaggaatcaagagagaaggagctgatggggttcagcaagtcggtgaatgaagctcgttccaagatggacgttgcccagtccgaactggacatctacctttctcggcacaacactgccgtatcccagctgaccaaagccaaggaagcactcattgcagcatccgagacacttaaggagcggaaggccgctattcgggatattgagggaaaactgccccaaaccgaacaagaattaaaggaaaaggaaaaagagctgcaaaaactgacacaggaggagaccaacttcaagtcgctggttcacgacttattccagaaggtggaggaggcgaagagcagcctggctatgaaccgctcaaggggcaaggtgctcgatgcaattattcaggagaagaaaagtggtagaatcccagggatctatggcaggctcggagatctgggagccatcgatgaaaagtacgatgtggccatttcgagctgctgtcacgccctggactacatcgtggtggattctatcgacatcgctcaagagtgcgtgaacttcctcaagaggcagaatattggggtagcgacatttataggattggacaaaatggccgtctgggcgaaaaaaatgacagaaatccaaactccagagaatacaccccgcctgtttgatctagtgaaggttaaagacgagaagataagacaagcgttctacttcgccttaagggacacactcgtcgcggataacttggaccaggccacgcgagtggcttaccagaaagatagaagatggagggtcgtgaccctccagggccaaatcatcgagcagagcggcacaatgacaggcggcggtagcaaagtcatgaagggacgcatggggtccagccttgtaattgaaatttccgaagaggaggtcaataaaatggaatcccagctacagaacgactccaagaaagccatgcagatacaggagcaaaaggtgcagctcgaggagagagtggtcaaactcagacattccgagcgagagatgcgcaacactctggaaaaatttacagctagcatccagagactcatcgagcaggaggagtacttaaatgttcaggtaaaagagctagaggcaaacgtcctcgccaccgcccctgacaagaaaaagcagaaacttctagaagaaaatgtctccgcctttaagaccgaatacgacgccgtggcagagaaagccggcaaagttgaggcggaagtgaagagacttcacaatacaatcgtagagattaataaccacaaactcaaagcacagcaggacaaattggacaagataaacaagcagctggacgagtgcgcgtctgccatcaccaaagcgcaggtcgccattaagaccgctgataggaacctgcagaaggctcaggacagtgtcctgcgcacagagaaagagattaaggacactgagaaggaagtggatgacctgacagccgaactcaaatcactggaggataaagcagccgaagtcgtcaaaaataccaatgcagccgaaatcagtaagatttcactacatccaatagaagacaacccaattgaggagatctccgtgctaagcccagaagacctggaagctattaaaaaccccgacagcataaccaatcagatcgccttgctggaagcccgctgccacgagatgaaaccgaatttaggggccatcgcagagtacaagaagaaggaagagctgtacctccaaagagtggcagagctggacaagattacttacgaacgtgatagcttcaggcaggcatacgaggacctgagaaagcagcggctgaacgaattcatggctgggttctatattatcaccaataaattaaaggagaactaccagatgttgaccctgggaggggacgcggagcttgagttagtggatagtcttgatcccttctccgaaggaatcatgttcagcgtgaggcctccgaagaaaagttggaaaaaaatctttaacctaagcgggggggaaaagaccctatcaagcctagcccttgtctttgctctgcaccattacaagcctacacccctgtattttatggatgaaatcgacgctgcgctcgactttaagaacgtttctattgttgctttctatatttatgaacaaactaagaacgctcagtttatcattattagccttcgcaacaatatgtttgagatttctgataggctaattggcatatacaagacatacaatattacaaaaagtgttgcagtcaaccccaaagagatagctagcaagggcctgtgctag

SEQ ID NO: 26285 - DNA, 267 bp, Artificial Sequence
  Description of Artificial Sequence: Synthetic coding sequence
atgcccgaggaccaggtgggcaagctggaggccaccgagaacaccatctcagccatggcagcagcagctgcagagcagcagcaattctaccttctgctcgggaacctgcttagccccgacaatgttgtgagaaaacaggccgaagagacatatgagaatataccaggccagtccaagatcacctttctcctccaggccattaggaacaccaccgctgcagaagaggccaggcagatggccgccgtgttgctccggaggctgctttag

SEQ ID NO: 26286 - DNA, 3627 bp, Artificial Sequence
  Description of Artificial Sequence: Synthetic coding sequence
atggacagcctgcccgacgagttcttcgtgcggcaccccgccgtggaggatcagagaaaggaagaaaccgaaaataaactcgagaagtcttctggtcagctgaataaacaggaaaacgatatacccaccgacctagtccccgtgaacctgctcctggaggtcaaaaagcttttgaacgcaataaacaccttacctaagggtgtggtacctcatattaaaaagttcctgcaagaagatttcagcttccagaccatgcagagagaagtggctgcaaacagtcaaaatggggaagagattgtgcctgcgcttactttacggttccttatcacgcaactggaagctgctcttaggaatattcaggccgggaattataccgcccaccagattaatatagggtattacctcacactgcttttcctttatggagtagcactgacagagcggggaaagaaggaggattacacagaggctgagaacaagtttctggtaatgaaaatgatgatacaggagaatgaaatttgcgaaaatttcatgagcctagtatacttcggacgtggactcttgagatgtgcgcagaaacggtacaacggcggactcctggaattccacaaatcattgcaagagataggcgacaaaaacgatcactggtttgacatcgaccctactgaggatgaggatctacctactacctttaaggatctcctgaacaactttattaagacgacggagtccaacattatgaagcagaccatctgctcatatctcgactgtgagcgatcctgcgaagccgacattttaaaaaacacatcttataagggctttttccagttgatgtgcagcaaatcctgttgtgtctactttcacaaaatatgttggaagaagttcaagaatttaaagtaccctggcgagaacgaccaatccttttctggcaagaagtgcctgaaggaggggtgcacgggcgacatggtccgcatgctgcagtgtgacgttcccggtattgtgaaaattctcttcgaggtggttaggaaggatgaatatattacaatcgaaaatcttggtgcctcatatcgtaagcttatcagtttgaagatcaccgatacagatattcggccgaagattagtcttaaatttaatacaaaagatgaaatgcctatcttcaagctggattataactacttttatcacctcctgcatatcataatcatctctggaaccgacatcgtgagacaaatcttcgatgaggctatgccgcctcccttgcttaagaaagagctgttgatccataagaacgttctcgagtcatattataatcatctgtggaccaaccatccccttggcgggtcgtggcacttactctacccccctaacaaggagcttcctcaatctaagcagtttgacttgtgtctgcttctggccctgatcaaacacctgaacgtctttcctgctccaaaaaagggatggaacatggaaccaccgtccagtgatatctcgaagagtgccgatattctcaggctgtgcaaatatagagatatcttgttatcagaaattttgatgaacggcctgaccgaatcgcagtttaattcgatctggaagaaggtgagtgacattttgttgcggctgggcatgatgcaagaggatatcgacaaggtgaaagaaaacccaatcgagaacatttccttggactaccatcaattgtccgtttatctcggaatcccagtgcctgaaattatccagagaatgctgtcctgctaccagcagggcattgctttgcagtccataactgggtcccagcgaattgaaatcgaagagctgcagaacgaggaggaagaactaagcccccccctgatggagtataacatcaatgtcaaaagccaccctgagattcagtttgctgagataaacaaggacggtacttctatcccatccgaatccagtaccgaatctctgaaggacctccaggaggtgaagtctaagcagcggaaaaagaagaagacaaagaacaaaaagaataaggacagcaaggaggatcaagtgccttacgtggttgaaaaagaggagcagttacgtaaagagcaggcaaatccccattctgtgagcagactgatcaaggacgatgcgagtgatgtgcaggaagacagtgccatggaggataaattctacagtctggacgagcttcacatactcgatatgatcgaacaaggcagtgctggtaaagttaccaccgactacggcgagacggaaaaggagcgactcgcgcgccagcgccagctgtataaactgcactaccagtgcgaagacttcaagagacagttgcgtaccgtgacattcaggtggcaagagaatcagatgcaaataaagaagaaggataaaattatcgcatcactgaaccagcaggttgcgtttggcattaataaagtgagtaagctccaacgccagatacacgcgaaggacaacgagattaagaatcttaaggaacagctatccatgaaaaggtcacaatgggagatggaaaaacataatctagagagcactatgaaaacctacgtttcaaagctcaatgctgaaacttcccgggctttaaccgcggaggtttacttcctacagtgtaggagagatttcggacttttacatctggagcagactgaaaaagaatgtctaaatcagttagcacgcgtcactcatatggccgccagcaacttagaaagcctccagctcaaggcagctgtagattcctggaacgccatcgtagccgatgtgcgcaacaaaattgcctttttacggacccagtacaatgaacagatcaataaagtaaagcagggttttgctctatcaaccctgccccctgtgcaattgccaccgccccctccatcccccgagattctcatgcagcaattcctaggccggcccctagtgaaggaatctttcttcaggccaatcctgacggtgcctcaaatgcccgcggtgtgccccggagtggtttccgccacgggtcaacctcgcgcccctctgatgaccgggatcgcctgggcccttccagcccctgttggcgacgcggtccctcccagtgccggactgcgatcagacccatctattatgaactgggaacggattactgatcggctgaagaccgcattcccccagcagacaagaaaagagcttaccgattttctgagaaagctgaaagacgcatatgggaaaagtctctctgaactgaccttcgatgaaatcgtttgtaagataagccagtttatcgacccgaaaaaaagccagtcacaggggaagagcgtcagcaacgtcaactgcgtatcgccctcacatagtcccagccagccagacgccgcccagcctcctaagcccgcgtggcgacctctgactagtcagggacccgctacctgggagggcgcctctaaccccgatgaagaggaggaagaggaggaaccttgcgtcatctgtcacgagaatttgtctcctgagaatctctctgtgttgccttgcgctcacaaattccatgcccagtgcatcagaccatggctgatgcagcagggaacatgcccgacgtgccgactgcatgtactcttgccagaggaattccctggacatccctcgcgacagctgcccaagatttag

SEQ ID NO: 26287 - DNA, 1743 bp, Artificial Sequence
  Description of Artificial Sequence: Synthetic coding sequence
atggtgctggtgggcacccaggacgccatcagcgccgccaaccccagagtgatcgacgacagcagggcgcgcaaactctcaactgatttgaagcgctgtacttattatgagacatgtgcgacatatggcttgaatgtggagcgcgtatttcaggacgtcgcccagaaggttgtagcgctgcggaagaaacagcagcttgcaatcggaccctgtaaatctctgcctaactcacctagccactccgcggtgagtgccgcctccattcctgcagtccacattaatcaggccacaaatggcgggggctccgcgttttccgactacagtagctccgttcccagtactccctcaataagccaacgcgaacttagaatagaaactattgccgcttctagcacccccacaccaataagaaaacagtctaagcgccgcagtaacattttcaccagtcgaaagggggctgatctagatcgcgagaaaaaggccgcagagtgcaaggtggactcaatcggcagcggacgcgcaatcccgatcaaacaggggatcttgcttaagcggtcaggcaagtccctcaacaaggagtggaagaaaaaatacgtgacactgtgtgataacgggctgctgacctaccacccttccctgcacgattacatgcaaaacattcatgggaaggaaatagatctcctcaggaccacagttaaagtcccagggaagagacttccacgcgccacccccgccacggcgcccgggacttcccctcgagctaatggactgtccgtggaacgctcaaacactcaactgggaggaggaactgaagcagaagagtctttcgagttcgttgtggttagtctgaccggccaaacctggcactttgaggctagtaccgccgaagaacgagagctgtgggtccaatcggtgcaggcccagatattagcatccctgcaggggtgtagaagcgccaaagacaaaacaagacttggaaatcagaacgctgccctggccgtacaggcagtacgcaccgtgaggggtaatagcttctgcattgattgcgacgcgccaaatccggattgggccagcctgaacctgggcgcgctcatgtgcattgaatgctctggcatccaccgacacctgggcgcacatctgtcgcgagtgagatcactggatctagatgactggcccccggagcttcttgccgtaatgaccgccatgggtaacgctctggccaacagcgtttgggaaggcgcgcttggtgggtattccaagccaggcccagatgcatgccgagaggaaaaggagaggtggatccgcgcaaagtacgaacagaaactctttctggccccattaccttctagcgatgtaccattggggcagcagctgctgagggctgtggtcgaggatgacctgaggctcttagtgatgctgctggcacacggcagtaaggaggaggtgaatgagacctatggagatggcgatggccgcaccgcactccacctgtcctctgccatggccaacgtcgtgttcactcaactgctcatctggtatggcgtcgatgtgagatctagagacgctcggggcttgacgcccttggcctatgccaggcgcgccggatctcaagagtgtgccgatattcttattcagcatggctgccctggcgaaggctgtggcctcgcgccgacaccgaacagagagccggcgaatggtactaatcccagtgctgaactgcacaggtcgccaagccttctatag

SEQ ID NO: 26288 - DNA, 312 bp, Artificial Sequence
  Description of Artificial Sequence: Synthetic coding sequence
atggccgagctgatccagaagaagctgcagggcgaggtggagaagtaccagcagctgcagaaggatctctcaaaatcaatgagtggcaggcagaaattggaggcacagctcacggagaataacattgtaaaggaggaactcgccctcctggacggtagtaacgtcgtattcaaactccttggccctgtgctcgtcaaacaggaactcggagaagcacgggctaccgtcgggaagcgactggactatataactgctgagatcttcctcagaacaatacccgatccaggcgatgtccctgacagcttcttttag

SEQ ID NO: 26289 - DNA, 453 bp, Artificial Sequence
  Description of Artificial Sequence: Synthetic coding sequence
atgaccagccggaagaaggtgctgctgaaggtgatcatcctgggcgattctggcgtcgggaaaacttctttgatgaaccagtatgtcaacaagaaattcagtaatcagtataaagctacaatcggagcggattttttgaccaaggaagtcatggtcgacgacagacttgtgacaatgcaaatctgggatactgctggacaggagagattccaatcccttggcgttgccttttacaggggagccgactgttgtgtccttgtgtttgatgtaacagcaccaaataccttcaagacactcgatagctggcgcgacgagttcctgattcaggcttcccccagagaccctgaaaactttcctttcgtcgttctggggaacaaaatcgatttagagaataggcaagtcgcgacaaagcgggcacaggcatggtgctattccaagaacaatataccatag

SEQ ID NO: 26290 - DNA, 540 bp, Artificial Sequence
  Description of Artificial Sequence: Synthetic coding sequence
atgaccgacctggtggccgtgtgggacgtggccctgagcgacggcgtacacaagattgagtttgaacacggtacaacttcggggaaaagagtcgtgtacgtggatggcaaggaggaaattagaaaagaatggatgttcaaacttgtgggaaaagagaccttttatgttggtgccgcaaagaccaaggccactatcaatatagacgcgatctcagggttcgcctacgagtacaccctggagatcaacgggaagtccctcaagaaatatatggaggatcgttcaaagacgacgaacacatgggtccttcacatggatggagaaaactttcggatcgttcttgaaaaggatgccatggatgtatggtgcaacggcaagaagctggagactgcaggtgaattcgtcgatgatggcacagagacacatttttccattggcaaccatgactgctacataaaggccgtgagctcagggaaaaggaaagagggaattattcatacactcatagttgataatagggagattcctgagatcgcgagctag

SEQ ID NO: 26291 - DNA, 171 bp, Artificial Sequence
  Description of Artificial Sequence: Synthetic coding sequence
atggacagcagcatccacctgagcagcctgatcagccggcacgacgatgaagccacacggacgtccacttcagaaggcctggaggagggcgaggttgagggcgagaccctactgattgtggaaagcgaggatcaagcctccgtggatctgtcgcatgatcagtcaggatag

SEQ ID NO: 26292 - DNA, 153 bp, Artificial Sequence
  Description of Artificial Sequence: Synthetic coding sequence
atgtgcagcaccagcggctgcgacctggaggagatccccctggacgatgacgatctgaacaccatcgagttcaaaatccttgcctattacacgagacatcacgtgttcaaatctacacccgctctcttttctcctaaactcctcagaacatag

SEQ ID NO: 26293 - DNA, 1203 bp, Artificial Sequence
  Description of Artificial Sequence: Synthetic coding sequence
atgaaccccgccagcgcccccccccccctgcccccccccggccagcaggttatccatgtcacccaggatctggacaccgacctggaggcgctattcaacagtgtcatgaacccaaagccctctagttggcgtaaaaaaatcctcccagagtctttcttcaaggagcccgatagtggatcccactctcgtcaatcctctacagactcttctggcggacaccccggaccgcgcctagctggtggagctcagcacgtgcggtcacacagttctcctgcttcccttcagctcggaaccggcgcgggagcggccggaagccccgcacagcagcacgcccatctgagacagcaatcttatgatgtcacagacgagctccccctgccccccgggtgggagatgactttcaccgccactgggcaaaggtattttttgaaccatatcgaaaagattactacatggcaggacccacgcaaggccatgaaccagcctctcaaccacatgaacctgcacccagcggtgtctagtactccagtcccgcagcggagcatggccgtgtcccaacctaatctggtgatgaaccatcaacatcagcagcagatggcccccagtaccctgagtcagcaaaaccaccccacccagaatccgccagccgggcttatgtcaatgcctaacgccctcaccacacagcagcagcagcaacagaagctccggctccagagaattcaaatggagcgggaacgcattcggatgcgtcaggaagaactgatgaggcaagaggctgcactgtgtagacagctgcccatggaggcagagactttggcacccgttcaggcagccgtcaatccacctacaatgacacccgacatgaggtctattacaaataattccagcgaccccttcctgaatggcgggccctatcatagccgcgagcagtctacagattccggtcttgggttagggtgctatagtgtccccaccaccccagaagattttctgtccaatgtggacgagatggacaccggcgaaaacgcagggcagaccccaatgaatattaatcctcagcagacacgattccccgatttccttgattgcctgcccgggacaaatgtcgacttgggcacactcgagtcagaagatctaataccgttattcaacgatgtagaaagcgctctgaataaatcagagccattcttgacctggctgtag

SEQ ID NO: 26294 - DNA, 513 bp, Artificial Sequence
  Description of Artificial Sequence: Synthetic coding sequence
atgccccggaagggcacccagcccagcaccgcccggcggcgggaggagggaccaccccccccttcacccgatggggcaagttctgatgctgaaccggagcctccaagcggaaggacggaatcccccgccacagcggcagagaccgcttcagaggagttagacaatcggtctctggaagaaattttaaattcaatcccccccccacctccgcctgcaatgactaatgaggccggagcacccagacttatgatcacacacattgtgaatcagaactttaagtcttatgctggagagaaaatcctcggcccctttcataagagatttagctgcatcattggccctaacggcagcggcaagtccaatgttatagattctatgttgttcgtgtttgggtatagagctcaaaagattaggtccaaaaagttgtcagtattgattcataattcagatgagcacaaggatattcagagttgtacggtggaggtgcatttccaaaaaataattgacaagtag

SEQ ID NO: 26295 - DNA, 504 bp, Artificial Sequence
  Description of Artificial Sequence: Synthetic coding sequence
atggagaaggccgtgaacgacggcagccacagcgaggagctgttctgccacctcaagactataagcgagaaagaagatttgcccaggtgcacttctgaatcccatctgtcatgcctgaagcaggacatcttgaacgaaaagactgagctagaagcaaccctgaaagaggctgagctggtcacacacagtgtggaactgttgctgcctttgttcaaggacacaattgaaaagattaactttgagaacgccaatctttcagccttaaacctgaagatttcggaacaaaaggaaattcttattaaggagctggacaccttcaaaagcgtgaagctagcactggaacacctactccgcaagcgagattacaagcagactggcgacaacctgagttccatgttactggagaacctgacggacaatgaatcagaaaatactaatttgaagaaaaaggttttcgagaaagaggcccacattcaagaattgtcttgccttttccagtcttag

SEQ ID NO: 26296 - DNA, 2376 bp, Artificial Sequence
  Description of Artificial Sequence: Synthetic coding sequence
atgagcaaccagcaggagaagtacgaggcccagaacatcgtgaactcaacagaggaatccgacgatgccttcgacaccgtgacaattcccgttccttccgaggaaccccaggaaagcgaccagactgaggagcatgagtccggtatagaacagtttagcgagagtcatgccattcacgtggaggaacagagtgatcagagcttttcttctcttgaacctgacaacgaacagcttatggaagaagtcattagccctaggcaggtttcatatacaccacagcaccatgagaagcagtacgcaatgcagcgccccaatgacgacagcttagccttcttggataagatcaagagcgtgaaagaaagcctgcaggaatctgttgaagactccctggccacggtgaaagtggttctcatcccagtcggccaggagatcgtgatcccatttaaagtggataccattctcaagtatctgaaagaccacttctctcaccttttaggaattccgcatagtgtgcttcagatcagatacagcggcaaaattctcaagaacaatgagacattggttcagcatggtgtcaaacctcaagaaatagttcaagtggagatcttttccactaatcctgacctgtatcccgtgcgcaggattgatggtcttactgatgtgagccaaattattacagtaactgtacagactggactcgaccagtatcaacaagtgccagtggagatcgtgaagtccgattttcataagccattcctgggaggatttcgccataaagtgacaggagtggagtaccataatgccgggacgcagacagtccccaagagaattccggagcgcctgagcattttctgtcgagacacacagacggtattccagaaaaagaacctacaacagacaacgaatactaccagcacccagatgaccaatatcggtgtatatgtgagcaatatgacagacaaactggtcactcctggcaagtatttctcggcagcagaatatcacgcccagcgactgaaggcagtgatcgtcattcagacctactatcgccagtggcatgccaaaattttcgtggagaatttgcggaggcagaagtcccttcgtctagaatgggagacccagcaggagctccgcaagattagggagaaggaggagtggatcaagcttgattaccataggaggcataacccaaaaaccaacgaagactttgaatttctgtacaacgcgctcgaattttggagacaggaggagctcacaaggatcaaccagtcattcactggagccgagaggaaggctgctttatgtgaactgctagagaaggaaactcaaatcattgcctcaataggtcgacaccgatacattgcctacatggcaaaccaagaggcagccattcaggcatttctagataaatgctccgctcccaaaatctggcgcactcctaacggaaagacgatcgaaatggatacacagtttaccattcgcgcgcgcgaactccagaacatctacaagtgtatcatgctgaagaacatatcccaggatgaacgtctggacgttctcctgaccttaaaacacaccgtgaaggaacatgagtgtaaactgacccaggagattcttgaactgatcgatcgggaagtagatctgatgatgcggggcgtaaaacaccataacttggaaggattgcggaagaggatcgctacccttttttttcattatattaaaacgcctctttttaatccggaagtggcaaagtacctgaaagttcctcaggacccactcaagttctacaaaaagatctacttctgtcactcctgccaactttatctgccgagtaccgagttttctgttagcagcacctctcgacgcatttatcggtgtcggaattgcataaacctgcaaaatgaggcccagaagcgcgaatcctttctgaagtataaatgcctgctccaacagctctattataccgaagcagattatgaggacgactcaaagatcgccttcctgatgcagcttcaagacattcagtacctcactgagaacatctgggcatcccaatcggtgttgtccgcatgtgacaatctcagtgatttggtgatggtgcgatggaacaagtcgctggagtggtcaccatggaactgcatcttgctgacaaaggacgaagcagctgcccatctcaaactgacatccattgaagaaggctatgaacgttcatttatccataagataaaacacaagcacatattggccaagaactacttttctcaggtacccgttctggccagcttcatcctggacgacggggagatcgatgagatcaggtggaagtatcacagcgacacgaccccgaaaataatagagagtcagcgtccgccccattag

SEQ ID NO: 26297 - DNA, 687 bp, Artificial Sequence
  Description of Artificial Sequence: Synthetic coding sequence
atgaccgaccagacctactgcgaccggctggtgcaggacaccccctttcttactggccatgggaggttaagtgaacaacaggtcgacaggattatactgcagctcaatcgctactaccctcagatcctcacgaacaaagaggcagaaaaattcagaaatcccaaggcaagccttcgagtgaggctgtgtgaccttctcagtcatttgcagcggtccggcgagcgggactgccaggagttctaccgcgcgctgtacatccacgcccagccgttacacagtaggctcccttctcggcacgccttacgtaagttccatatcacaaatcacgcctgcttggtgctggccagaggaggccatccgtctctccctctcatggcttggatgtcatctatgactacacaggtttgctgcagcccagggctcgcgtcccccttggcgagcgcacccccccagagacctccaagcggacctgaaggcagagtgtggcaggctcaagcggttcagatgttggtgtctgtctcacactttttgcccctcccacccagcctctcccacgggagtttccatacagcttggggcattctgtacgtccattcatgcccgagcttttcaaacctcatcccacggggatccttacatgtatgcgtggattctaaccttgtgcctaccgccgcctggcgcagctag

SEQ ID NO: 26298 - DNA, 948 bp, Artificial Sequence
  Description of Artificial Sequence: Synthetic coding sequence
atgcccggcctgagctgccggttctaccagcacaagttccccgaggtggaggacgtcgtgatggtgaacgtgaggtccatcgctgagatgggcgcttacgtctcactgctggagtacaacaatatcgaaggaatgatcttgttgtccgagctatctcgccgacggattagatcaatcaataaactgatccgaatcggtcgtaacgagtgtgtcgtagttatccgggtagacaaggagaaaggctatatagatctgagcaagagacgcgtctcgcccgaggaagctataaagtgcgaagataagtttactaaatctaagaccgtgtacagtatacttcgacatgtggccgaagtgctggagtataccaaggacgaacagctcgagtctctctttcaacggaccgcctgggtctttgatgacaaatataagaggcccggctatggtgcatacgatgcttttaagcatgcggtgtcagatccttcaattctcgactccctcgacctgaatgaagacgaaagagaagttctgatcaataacatcaataggagattgacccctcaggctgtaaagatacgtgcagatatcgaagtggcatgctatggatatgagggtatcgatgcagttaaggaagctttgcgtgctggcctgaattgtagcacagagaacatgcccataaaaattaacctgattgcgccgccacggtacgtaatgacgaccaccactctggaacgaacagagggcctgagcgtgttatcacaggctatggccgtgatcaaggagaaaatcgaggagaagaggggcgtattcaacgttcagatggaaccaaaggttgtgactgataccgacgagaccgagcttgccaggcagatggaacgactcgaacgggaaaacgcagaagttgacggcgatgacgatgcagaagagatggaagccaaagccgaggattag

SEQ ID NO: 26299 - DNA, 1203 bp, Artificial Sequence
  Description of Artificial Sequence: Synthetic coding sequence
atgaaccccgccagcgcccccccccccctgcccccccccggccagcaggtgatccatgtcactcaggacctggacacagatctcgaagcgttgtttaacagcgtcatgaacccaaagccctcctcctggcgcaagaaaatactacctgagtccttttttaaggagcccgacagtggaagccactcacggcagagctccacagattccagcggcggccaccccggcccgaggctggctggaggggcccaacatgtgaggagtcattcaagcccggcttcactgcagctaggcacgggcgctggcgccgcggggtctcccgcacagcaacacgctcacctccgccagcagtcctatgacgtgaccgacgaactaccccttcctcctgggtgggaaatgacatttaccgccactggccaaaggtactttctgaaccatatagagaaaatcaccacatggcaggatccaagaaaagcaatgaatcaaccactgaatcacatgaatctacaccctgccgtgtcctccacaccggttccgcagcggagtatggcagtcagtcagcctaacctcgtaatgaaccaccaacatcagcagcagatggccccctcaacgctgagccagcagaaccaccctacccagaatcctccagctgggctgatgtctatgcctaacgcactgactacccagcagcaacagcagcagaagctgcgcctccagcgcattcagatggaaagagaacggatccggatgaggcaggaagagctaatgagacaggaggccgccctctgccgccaacttcccatggaagcagaaaccctggctcccgtccaggcagcagtgaatcctcccaccatgactcctgacatgcgttcaatcactaacaacagttctgatcctttcttgaatggtggcccataccactcccgggaacagtccacagattccggcctgggcctgggctgctatagcgtcccgactaccccggaggatttcctgtcaaacgtagacgagatggacacaggagaaaatgctggccagacaccaatgaatataaatcctcagcaaacgcgatttccagatttcctcgactgcttgcccggcacaaatgtcgatctggggactctcgagagtgaggatcttattccactgttcaatgatgtggagagcgcacttaataaaagcgagccctttctcacttggctctag

SEQ ID NO: 26300 - DNA, 381 bp, Artificial Sequence
  Description of Artificial Sequence: Synthetic coding sequence
atggtgctgatcctgggccggcggctgaaccgggaggacctgggcgtcagggactccccagctaccaaacgcaaagtgttcgaaatggaccccaagagtctgactgggcacgaatttttcgattttagcagtggatctagccacgccgagaacattctgcagatctttaacgagttccgcgactcgcgtttgtttacagatgtcatcatctgcgttgaggggaaagaattcccctgtcaccgcgcagtgctctccgcttgctcgtcatacttccgagcaatgttctgcaacgaccacagggaatcccgagagatgctggtggagattaacggcatactggctgaggccatggaatgttttctgcaatacgtgtacacctag

SEQ ID NO: 26301 - DNA, 312 bp, Artificial Sequence
  Description of Artificial Sequence: Synthetic coding sequence
atggccgagctgatccagaagaagctgcagggcgaggtggagaagtaccaacagctgcagaaggacttgtcgaagtcaatgtcagggagacagaagctggaggctcaattaacagagaataatatagtcaaagaggagttggccctcctggacggatcaaacgtggtgtttaaattactgggccccgtgttagtgaagcaggaattgggcgaggcccgggctaccgtgggcaaacggttagattatattaccgcagaaattttcctgcgcactatcccagatccaggagatgtccctgactcttttttctag

SEQ ID NO: 26302 - DNA, 237 bp, Artificial Sequence
  Description of Artificial Sequence: Synthetic coding sequence
atggtgctgatcctgggccggcggctgaaccgggaggacctgggcgttagagacagccctgcaactaagagaaaggtgttcgagatggaccctaaaagtctgacaggccatgagtttttcgacttcagttccggctcatctcacgccgagaatattctgcagatttttaatgagtttagagatagccgtctgtttactgacgtgatcatttgtgtggagggtaaggagttcccatag

SEQ ID NO: 26303 - DNA, 1320 bp, Artificial Sequence
  Description of Artificial Sequence: Synthetic coding sequence
atggccgccaacctgagccggaacggccccgccctgcaggaggcctatgtgcgggttgtgaccgagaaaagtccgacagactgggccctttttacctatgagggcaatagcaacgacatccgggtggccggcaccggcgaagggggtctggaggagatggtagaggaattgaattcgggcaaagttatgtacgcgttctgtcgtgtgaaggatccgaactcagggctgcctaagtttgtcctcattaattggacaggcgagggggttaacgacgtgcggaagggtgcctgtgcctcacacgtgagtaccatggcttcctttcttaagggggctcacgtgaccatcaacgccagggcagaagaggatgttgagccagagtgcatcatggagaaagtggctaaagctagtggcgctaactactcttttcataaggagtctggcagattccaagacgtggggcctcaggcacccgttggctctgtatatcaaaagacgaatgcggtaagtgagatcaagcgggtgggcaaagattccttctgggctaaagccgaaaaagaagaggagaacagacgccttgaggaaaaacgtcgcgccgaggaggcccagaggcagcttgaacaggaacgtcgcgagagggaactgcgtgaagcggcccgtagagagcaacgctaccaggagcagggtggagaagctagccctcagagtagaacttgggagcagcagcaggaggtagtgtcgcgtaaccggaatgaacagggttctacatgtgcaagtttgcaggagagcgctgtgcatccgcgggaaatatttaagcagaaagaaagggcaatgtcaactacaagcatttcctcaccacaacctggaaagctgcgctccccttttcttcaaaaacagttgacccaacctgaaacgcactttggtcgcgagccggccgccgctatttctcgcccacgtgcagacctgccagcagaggaacccgcccctagcacccccccatgcctggtacaagctgaagaggaagctgtgtatgaagaaccccccgaacaggagactttctacgaacagccacctcttgtgcagcagcagggcgccggctccgagcatatcgaccaccacattcaaggccaaggcctttccggtcagggcctgtgtgctcgcgccctgtacgattaccaagctgccgatgacactgaaattagtttcgacccagaaaatctcatcactggaattgaagtcattgatgaagggtggtggcgcggttatgggccggacgggcactttggcatgttccctgccaattatgttgaactcatcgaatag

SEQ ID NO: 26304 - DNA, 219 bp, Artificial Sequence
  Description of Artificial Sequence: Synthetic coding sequence
atgagctaccagcagcagcagtgcaagcagccctgccagcccccccctgtctgccccgcccccaagtgccccgagccgtgtcccccccccaagtgtccagagccctgtcccccttccaagtgcccacagagctgtccaccccaacagtgccagcaaaagtgcccgcccgtgacaccgtcgcctccgtgccagcctaagtgcccccccaaatccaaatag

SEQ ID NO: 26305 - DNA, 342 bp, Artificial Sequence
  Description of Artificial Sequence: Synthetic coding sequence
atgagcgccatccagaacctgcacagcttcgaccccttcgccgacgctagcaagggtgacgacctcttaccagcgggaacagaggactatatccacatccgtattcaacagcggaatggaagaaaaacactcacaacggtccagggtattgccgacgactacgataagaagaaacttgtcaaggccttcaagaaaaaattcgcctgcaacggcaccgtaatcgaacaccccgagtacggcgaagtgattcagcttcaaggggaccaacgcaaaaacatttgccagtttctcgtggagatcggcctggctaaggatgaccagttgaaagtccatgggttttag

SEQ ID NO: 26306 - DNA, 927 bp, Artificial Sequence
  Description of Artificial Sequence: Synthetic coding sequence
atggccagcagcaacaccgtgctgatgcggctggtggccagcgcctactcaatcgctcagaaggctgggatgatagttcgacgcgttatcgctgagggggacctgggaattgtagagaaaacctgcgccacagacctccagactaaggcagatcggctggcccagatgagcatatgcagtagccttgcccgtaaattccccaagttaaccataatcggagaagaagacctcccaagcgaggaagtggaccaggaactgattgaagactcccagtgggaggaaatcctgaagcagccatgtccatcacagtattcagcaattaaagaggaagatcttgtggtctgggttgatcctctcgatggtaccaaagagtataccgagggcctgcttgacaacgtcaccgtgctgattggtattgcctatgagggaaaggctatagccggcgtcatcaatcagccatattataattacgaggctgggccggacgccgtgttgggcagaaccatttggggagtactgggtctgggggctttcggattccagcttaaggaagtgcctgcagggaagcatatcattaccaccactcgctcccatagtaacaaactggtgacagactgcgtcgccgctatgaatccagacgcggtgctccgggtgggcggggcaggcaataaaattatacagctgattgaaggcaaagcttcagcttatgtgttcgccagcccaggatgcaagaagtgggatacatgtgcgcccgaggtcatcttgcatgcagtcggaggaaaactcactgacattcatgggaatgtgcttcagtaccataaagatgtaaagcacatgaattctgctggcgtgttggctacgctgagaaactatgactactacgccagtcgcgtgcccgaaagcatcaagaatgcccttgtgccttag

SEQ ID NO: 26307 - DNA, 1809 bp, Artificial Sequence
  Description of Artificial Sequence: Synthetic coding sequence
atgatcgagaagatgcagggcagccggatggacgagcagcggtgcagctttcccccccctttgaaaacagaggaggattatataccctatccctcagtgcacgaggtgctcgggagagagggacccttccccctaattctgttaccccagtttgggggctattggatcgaggggacaaaccatgaaatcacttcaatcccagagaccgaaccgctgcagtctccaacgactaaagttaaacttgaatgtaatcccactgctagaatttacagaaaacactttctgggaaaagaacacttcaattattattcacttgacgccgctctgggtcacctagtgtttagcttaaagtacgatgtcatcggagaccaagagcacctgcgactcctgctgcgaacaaaatgccggacctatcacgatgtgataccgatctcatgcctaactgaatttcccaatgtggtccagatggctaagcttgtttgtgaggacgtcaatgtcgacaggttttacccagttttgtatccaaaggccagtaggctgatcgtgacttttgacgagcacgtcatcagtaacaacttcaagttcggcgtgatctatcagaagctgggacaaacttccgaagaagagctgtttagcacaaacgaagagtcgcctgctttcgttgagttcttagaatttttgggacagaaggttaaactccaggattttaaaggcttccggggcggcctagatgtgacgcacggccagaccggaacagagtccgtatactgtaatttcagaaacaaagagatcatgttccacgtcagcacgaagcttccctataccgaaggagacgcccagcaactgcagcggaagagacatataggcaacgatatcgtggccgttgtgtttcaggacgaaaacactcccttcgtcccagatatgattgcttccaacttcctgcacgcatacgtcgtagtccaggctgaggggggcgggcccgatggtcctctatacaaagtttccgtgactgcccgagatgacgttcccttttttggacctcctctgccagacccggctgtcttccgcaagggtcccgaattccaagagtttcttctgacaaaactgatcaatgccgaatatgcatgttataaagcagagaaattcgcaaagctggaggagaggacccgagccgctcttctggaaacgctgtacgaagaactgcatatccattcccagagtatgatgggccttggtggggatgaggataagatggaaaacgggagcgggggcggtggcttctttgaaagctttaagagggtgatacgctctcgctctcagtccatggatgcgatgggcctgagtaataagaaacctaacacagtcagcaccagccacagtggctcattcgctccgaataatcccgacctggcaaaagccgctgggattagcctgatcgtgcctggaaaatcgcccacgagaaagaagtccggtcccttcgggtcccgccgttcctccgccatcggcattgagaatatccaggaagtccaggagaagagagagtcgccgcctgctggtcagaaaacccctgacagtgggcatgtttcccaggaacccaagagtgaaaacagttctacacagagctcccctgagatgcccactacaaaaaaccgcgccgagactgccgcccagagagccgaggcactcaaagatttctcacgatcttccagctctgccagttcatttgcttctgtggtggaagagaccgaaggagtggacggggaagacacagggctacacgtggcagggggccaatgccagcatcattag

SEQ ID NO: 26308 - DNA, 177 bp, Artificial Sequence
  Description of Artificial Sequence: Synthetic coding sequence
atgggccgggtgtgggacctgcccggcgtgctgaaggtggagggctttcgggctacaatggcacaacggttggtgcgggtgctccagatatgcgctgggcatgtgcctggagtatcagcccttaacctgctgagcctgctcaggagctctgagggaccttctttggaggatttgtag

SEQ ID NO: 26309 - DNA, 2199 bp, Artificial Sequence
  Description of Artificial Sequence: Synthetic coding sequence
atgctgccctgcgccgccggcgcccggggccggggcgccatggtggtactcagagcaggtaagaagaccttccttccgcctctgtgccgcgccttcgcgtgccggggctgccagctggccccagagcgaggggcagagaggagagataccgcaccatcaggggtgtccagattctgccctccacgaaagagctgccatgactggatcggccctcctgataagtacagtaacttgaggccagtccatttctacatccccgaaaatgagtcccctctcgaacagaaactgcgcaaactgaggcaggaaacccaagaatggaatcagcagttttgggcgaaccagaatctgacctttagcaaagagaaggaggagttcattcactcacgcctgaagaccaaggggcttgggcttcgtactgagtctggtcagaaagccaccttaaatgcagaggagatggctgatttttacaaggaatttttgtctaagaacttccagaaacacatgtattacaatcgaatgtacgataacatgtctacaatggtatatataaaagaagacaaacttgaaaaactgacacaagatgagatcatttctaaaacaaagcaggtgatccagggtctagaagctttgaagaatgaacacaactcaatacttcagtctctgttggagactctgaagtgcctgaaaaaggatgacgaatctaacctcgtcgaagagaagtccaacatgatccgcaagtcgttggagatgctcgagttaggactctcggaagcacaggtaatgatggccctttcgaaccatcttaacgccgtagaatccgaaaaacagaagctgcgagcccaggtgcgtcgactctgccaagagaaccaatggttgcgagacgaacttgccaatacgcaacagaagttgcagaaaagcgaacagagcgtagcccagctggaggaagagaaaaagcatttggagtttatgaaccagctaaagaagtatgacgacgatatcagcccttcagaggataaggataccgactctactaaggagccccttgatgacctgtttcctaacgatgaggacgatcccggacagggcatacagcagcaacacagctccgcagccgccgctgctcagcagggaggctatgaaattcccgcaagacttcggacgttgcacaaccttgttatccagtatgcaagccagggacgctatgaggtggcagtgcccctgtgtaagcaggcgttagaagacctcgagaaaacatcaggtcacgatcaccctgacgttgcgactatgttgaatatcctagccctggtgtaccgtgaccagaacaaatacaaggatgcggccaacctgctcaatgacgcgctggccattagggagaagaccctggggaaggaccatcctgccgttgccgccacacttaataatctggcagtcctctatggtaagcgcggaaagtacaaggaggctgagcctctgtgtaaaagggccctggagattcgcgaaaaggtgttagggaaggaccacccggatgtcgctaaacaattgaacaacctggccttattgtgccaaaatcagggcaagtacgaggaagtggagtactactaccaacgcgcactcgaaatttatcagaccaagttgggtcccgatgacccgaatgttgctaaaacaaagaacaatctagcatcatgttacctgaagcagggaaagtttaagcaggccgagacactttataaagaaattctgaccagagcccacgaaagggaattcggcagtgtggatgacgagaataaacctatctggatgcatgccgaagaacgggaagagtgtaaaggaaagcaaaaggacggaacaagctttggtgagtatggcggttggtacaaggcctgcaaagttgattcgcctacagtgaccactactctgaaaaatcttggcgctctatataggcgccagggaaagtttgaggctgccgagacacttgaagaggccgctatgagaagtcgcaagcaggggctcgataacgttcacaagcagagggttgctgaggtgctgaatgatcctgagaacatggagaagaggcggtctcgtgaaagtctgaacgtggatgtggttaagtacgagtctggacctgatggtggcgaggaggtcagcatgtccgttgagtggaacggcatgcgtaaaatgaagttgggcctcgtcaattag

SEQ ID NO: 26310 - DNA, 249 bp, Artificial Sequence
  Description of Artificial Sequence: Synthetic coding sequence
atgagcggcctggtgctgggccagcgggacgagcccgccggccaccgactgtcccaggaagagatccttgggtcaaccagacttgtgtcacagggccttgaagctctgcggagcgagcatcaggccgttcttcagagcctgagtcagaccatcgaatgcctccagcagggcggccatgaagagggtctggtgcatgagaaggcaaggcagctgcggcgtagcatggaaaatatcgagctcgggctgtag

SEQ ID NO: 26311 - DNA, 222 bp, Artificial Sequence
  Description of Artificial Sequence: Synthetic coding sequence
atggtgctgatcctgggccggcggctgaaccgggaggacctgggcgtcagagattctcccgcaacgaaaagaaaggtgttcgagatggatcccaagagtctgacaggacatgagttctttgatttctcctctgggtcctcacatgcagagaacattttgcagatcttcaatgagttcagagactcccgattattcaccgatgtgatcatatgtgtcgagtag

SEQ ID NO: 26312 - DNA, 1191 bp, Artificial Sequence
  Description of Artificial Sequence: Synthetic coding sequence
atgaacttccaggccggcggcggccagagcccccagcagcagcagtcgctagccgctcctggcggcggaggagcagctgcacagcaacttgtgtgcggcgggcagttcggcggggctgggccgggcgcaggcgggggaggaggacccagccagcaactcgcgggcgggccccctcagcagttcgcattgtcaaattccgctgctatcagagctgagatacagcgatttgaatctgtgcatcctaatatatacgctatatacgacctcatcgaacggattgaggacctggccctgcaaaaccaaattcgggaacatgtgataagcatcgaggacagcttcgtgaacagccaggaatggacactatccagaagcgtacccgaactgaaagtcggcattgtcgggaacctctcctccggaaaaagcgcactggtgcataggtatctgacgggcacctatgtacaggaggagtctcctgagggggggagatttaagaaagagatcgttgtcgacggccagagttaccttttgctgattcgggacgagggcggaccccctgagctgcagtttgccgcatgggtcgacgcagtggtatttgtcttctcgctggaggatgaaatctccttccagaccgtttataactacttcctgagattgtgttctttcagaaacgccagtgaggtgcctatggtcctggttgggacccaggatgcaatttcagctgccaacccaagggtgatagacgactctcgggccaggaagcttagtaccgatctgaagcggtgcacatactatgaaacatgcgcaacctacggtctcaatgtggagcgggtcttccaagatgtggcccagaaagtggtggcacttcgtaagaagcaacagctggctattggcccctgcaagtctttgcccaactcacccagtcattccgcggtctccgctgcttccatccccgcagttcatattaatcaggctacgaatggcggcggtagcgctttcagcgactactcatccagcgttcctagtaccccatctatctcccaacgagagctcaggatcgagactatcgccgcaagctccacccctactcctatccgcaagcagtctaagaggcgctcaaatatctttaccatatgcgcaacggtcagtaacttctcttccacaaagcgaccctttcagctcctgccaaactag

SEQ ID NO: 26313 - DNA, 1110 bp, Artificial Sequence
  Description of Artificial Sequence: Synthetic coding sequence
atggacagctgcctgatggtgtggcacatgaagccccagagccgggcctaccggtttactgggcacaaggatgctgtgacttgcgtgaatttttctccaagcggtcacttgctggcatcaggatcacgagataaaacggttagaatctgggtgcccaacgtgaaaggtgagtctaccgtgtttcgggctcacacagccacggtgcgttcagtgcacttttgttccgacggccagagctttgtcacggcctcagacgataagacggttaaggtgtgggcaacgcaccggcagaagtttctcttttccctcagccagcatatcaactgggtaaggtgcgctaaatttagcccagatgggaggctgattgtcagcgctagcgatgataagacagtcaagctgtgggacaaatcttcgcgggagtgtgtgcacagttactgcgaacacggtggctttgtcacctatgtcgactttcacccgtccgggacatgtatcgcagctgctggaatggacaatactgtgaaagtttgggacgttagaacgcacaggctgctgcagcattatcagctgcactctgcggcggtgaatggcctcagtttccatccatccggcaactatcttatcaccgcgtcctcagatagcactctcaaaatccttgatttgatggaaggccggctcctctacactctgcacggccatcagggacccgccaccactgtggccttctcaaggaccggcgagtacttcgctagcggcggaagtgacgaacaagtcatggtatggaaatcaaactttgatatcgtggaccatggagaggttaccaaggtgcccaggccaccagctacacttgcaagcagtatggggaacctccccgaagtggattttcccgtaccacctggcagaggcagatccgtggaaagcgtgcagtcccaaccgcaagaaccggtgagcgtcccccaaaccctcacgagcacattggagcacatagtgggtcagcttgatgtccttactcagacggtgtccatcctcgagcagcggctgacactgaccgaggacaagttaaagcagtgtctggagaatcaacaacttatcatgcagcgggcgaccccctag

SEQ ID NO: 26314 - DNA, 312 bp, Artificial Sequence
  Description of Artificial Sequence: Synthetic coding sequence
atggccgagctgatccagaagaagctgcagggcgaggtggagaagtatcagcagcttcaaaaggacctgtcaaagagcatgtctggccgtcagaagctggaggcccaactgacggaaaataacatcgtgaaagaggagttggccctgctagacggttctaacgttgtttttaagctgctgggccccgtgctggtcaagcaagagcttggagaagctagggccacagtcggcaaaagattggattatattaccgccgaaatcttcctgcgaaccattcccgaccctggcgacgtgcctgattcttttttttag

SEQ ID NO: 26315 - DNA, 270 bp, Artificial Sequence
  Description of Artificial Sequence: Synthetic coding sequence
atgagcgagcagggcgacctgaaccaggccatcgccgaggagggcggaacagagcaggagactgcaaccccagagaacggcattgtcaagagcgaaagcttggacgaggaagaaaaactcgagctgcagcgccgtcttgaagcccaaaatcaggagagacggaagagcaagagcggtgccgggaagggaaagttgacacgttctctggcagtatgtgaagagtccagtgcccgcccaggtggcgagtcactgcaggatcagacattatag

SEQ ID NO: 26316 - DNA, 1140 bp, Artificial Sequence
  Description of Artificial Sequence: Synthetic coding sequence
atgtggcacctggacttcggcctgcacaccggcaagaccttccagccactaccattcattatcgtggtgtatcctggcgcaggaaggagatggggtctcgtgttatccctggcgtcgcacaggagacgaaccgaggccggcggaggtacagggccaacaagcgatactggttgggggtgcatgctgaggtgcgggcaaatgattttcgcccaggcccttgtgtgtcgccacctgggaagggattggcggtggacccagagaaagcgccaacccgacagttattttagcgtgttgaacgcatttatcgaccgaaaagatagttattactcaattcatcagatagcacagatgggagtgggcgagggcaagtccatcggccagtggtacggccctaacacggtggctcaagtgttgaagaaactggcagtgttcgacacttggtctagtctggcagtgcatattgctatggacaatacggtagtgatggaagaaattcgcagattatgtaggacatccgtcccctgcgcgggagctaccgcttttcccgccgattctgacagacactgcaacggatttcccgccggtgcagaggtaacgaaccgccccagcccgtggcgaccattggtgctcctgatacccttgaggttgggtcttaccgatatcaatgaggcctatgtcgagactctgaaacactgtttcatgatgccccagtcccttggagtgattggaggaaagccaaattcagcgcactatttcataggctacgtgggagaggaactaatatacctcgacccccatacaacacaacctgctgtggagcctaccgatggatgtttcattcccgatgaaagctttcactgtcagcaccccccatgccgcatgtccatcgctgagttagaccccagtatcgctgtgggcttcttctgcaaaaccgaggacgacttcaacgactggtgccagcaggtgaaaaaactcagcctccttgggggggctctcccaatgttcgaactggtggaactgcagcctagtcatctggcctgcccagacgtgctgaatctgagtcttgactcctctgacgttgagcggctggagaggttcttcgactccgaagacgaggacttcgagatcttgagcctgtag

SEQ ID NO: 26317 - DNA, 1683 bp, Artificial Sequence
  Description of Artificial Sequence: Synthetic coding sequence
atgagcgagcacagccggaacagcgaccaggaggagctgctggacgaagaaatcaacgaggacgagatcctagccaacctgagtgccgaggaactgaaggaactgcaaagtgagatggaggtcatggcaccggatccctccttacctgtggggatgatccagaaagaccaaaccgacaagcccccaacaggaaactttaaccacaagtcacttgtggattacatgtattgggagaaagcctccagaagaatgctggaggaagaaagggtcccggtcacttttgtgaaatcagaggaaaagacgcaggaagaacatgaagaaatagagaaacgaaacaagaatatggctcagtacttgaaggaaaaattaaataacgagattgtcgccaacaagcgcgaatcaaaaggaagctctaacattcaggaaaccgatgaggaggatgaggaggaagaggacgatgacgatgacgatgaaggagaggatgacggcgaggagtcagaagagacaaacagggaagaggaggggaaagcaaaggaacaaattcggaactgtgaaaataattgtcagcaggtaactgacaaggcctttaaagaacagcgggatagaccggaagcacaggagcaaagcgaaaaaaaaataagcaagctcgatccaaaaaaactggccctagatacgtccttcttgaaggtgtcaaccagacccagcggtaatcaaactgacctcgacggatctttgcgcagagtgcggaagaatgatcccgacatgaaggaactgaatctgaacaacatcgaaaatatccccaaagaaatgttattagattttgtcaatgccatgaagaaaaacaaacatatcaagacattctctttggctaatgtgggcgccgacgaaaatgtggctttcgccctcgcgaacatgctgcgcgaaaatcggagtatcaccacactcaacatcgagtccaacttcatcacgggcaaaggaatcgttgccatcatgagatgtctacagttcaatgaaacccttaccgagctgaggtttcataaccaaaggcatatgttgggacaccatgctgagatggagatagctcgactcctgaaggctaacaacactcttctgaagatgggctatcattttgagctgccagggcctcggatggtggtcacaaacctcctcacaagaaaccaggataagcaacgacagaaaagacaggaagagcagaagcagcagcaactgaaggagcagaagaagttgatcgcaatgttggagaacggcctaggtctccccccagggatgtgggaattattgggtgggcctaaacctgattcgcgaatgcaggagttcttccagccccctcctccccgcccccccaatccccagaatgttcctttcagccaacgcagcgagatgatgaagaagccctcacaagccccaaagtaccgaaccgatccggattccttccgcgtcgttaagctcaagagaatccagcgaaagagccgaatgcccgaggctagggaaccccccgagaaaaccaacctcaaggatgtcattaaaaccctgaagcccgttccacgaaaccgaccacccccgcttgtggaaatcactcctcgcgatcagttgctgaatgacattagacattcctccgtcgcctatctgaaacctgtgcagttacctaaagagttggcgtag

SEQ ID NO: 26318 - DNA, 330 bp, Artificial Sequence
  Description of Artificial Sequence: Synthetic coding sequence
atgaaccccgccagcgcccccccccccctgcccccccccggccagcaagtgatacatgtgacccaggatcttgacaccgacctcgaagctttattcaatagcgtcatgaaccccaagccctccagctggcgtaagaaaattttacctgagtctttctttaaggagccagattcaggatcccattctcgccagtcaagtaccgactcttctggagggcaccccgggccgcgcctggctggaggggcccagcacgtgcgatctcattcatcccccgcttccctgcagctgggcactggtgccggagccgccggctcgccagctcagcagtag

SEQ ID NO: 26319 - DNA, 609 bp, Artificial Sequence
  Description of Artificial Sequence: Synthetic coding sequence
atgggcagccggaagaaggagatcgccctgcaggtgaacatcagcacacaagagctgtgggaggagatgctctccagtaaaggactcactgtggtggatgtgtaccagggatggtgtggcccttgtaaacccgtggtcagtctatttcagaaaatgcggatcgaagtcggattggacttgctccattttgccctggccgaagccgacagattggacgtgctggaaaaataccgtgggaaatgtgaacccacttttctcttctatgctggcggtgagttagttgcggtcgtccggggcgctaatgcccctctcctgcagaaaactatcttagaccaactcgaggcagagaagaaggtgctggccgaaggcagggagagaaaagtcataaaagatgaggcactgtccgatgaagacgagtgtgtgtcccatggcaagaacaacggcgaagacgaagacatggtgtcttccgaacggacctgtactttggctatcatcaaaccagacgccgtggcgcatggcaagaccgacgagatcatcatgaagatccaagaagctggcttcgagattctgacgaatgaagaacggacaatgacagaagctgaagtgtag

SEQ ID NO: 26320 - DNA, 195 bp, Artificial Sequence
  Description of Artificial Sequence: Synthetic coding sequence
atggccccccagaaggaccggaagcccaagcggagcacctggcggttcaatcttgatctcacgcatcccgtcgaggatgggattttcgattctgggaatttcggaacgttcccttccgaatacttggggttctcaagcctggtcctgcattttttttgtttcaaaattggagcaattagcaccggtgagggctag

SEQ ID NO: 26321 - DNA, 372 bp, Artificial Sequence
  Description of Artificial Sequence: Synthetic coding sequence
atggagaacctgcagaccaacttcagcctggtgcagggcagcaccaaaaaactgaatggcatgggagacgatggatctccccccgctaagaaaatgatcacggatatccacgccaatgggaagacaatcaacaaggtacctacggtcaaaaaggagcacctggatgactacggagaggccccggtcgagacagatggagagcacgtcaagcggacctgtaccagcgtcccagaaacgttacatctgaacccttccctgaagcatacactagcgcagtttcatctgtccagtcagagtagtctcggtggcccagcagctttctccgcccgccactcgcaggagtccatgtcgccaacggtgttcctcccctag

SEQ ID NO: 26322 - DNA, 201 bp, Artificial Sequence
  Description of Artificial Sequence: Synthetic coding sequence
atgaaccccagcatgaagcagaagcaggaggagatcaaggagaacattaagaacagcagtgttccccgccgcactctgaaaatgatacaacctagtgccagtgggtctctggttggtcgggagaacgagcttagcgccggcctgtcgaagcggaagcaccggaatgaccaccttactagcaccacgtccagccccggctag

SEQ ID NO: 26323 - DNA, 1614 bp, Artificial Sequence
  Description of Artificial Sequence: Synthetic coding sequence
atggtgctgatcctgggccggcggctgaaccgggaggacctgggcgtccgcgactctccagctaccaagcgaaaggtgttcgaaatggatccaaaaagcctcacagggcacgagttctttgatttttcttctggctcttctcacgcggagaatatcctgcagatcttcaacgagtttcgtgattctcgcctgttcacggatgttattatttgcgtggagggtaaggaattcccctgccatcgagctgtgctttcagcctgttctagctatttccgcgccatgttttgtaatgatcacagagagagtcgcgagatgcttgtcgagattaacggaattctggccgaagcaatggaatgcttcctgcagtatgtttacaccggaaaagtcaaaataaccacagagaacgtgcagtacctttttgaaacatctagcttatttcagatttctgtactacgagatgcctgcgccaagttcctcgaggagcagctggatccttgtaactgccttggaatccagagatttgccgacacccacagcctgaaaactctttttaccaaatgtaagaacttcgcgctccaaacctttgaggatgtgagtcagcatgaagagtttctggaattggacaaagacgagctaatagactacatatgcagcgacgagctcgtgataggcaaagaggagatggtttttgaagccgttatgagatgggtgtaccgtgcagtggatctgagaagaccactgcttcatgaactactgacgcacgttagactcccgctcctccatcctaattattttgtgcagaccgtggaagtggatcaattaatacaaaacagccctgagtgctaccagctgttacacgaagccaggcggtaccatattcttgggaatgaaatgatgagcccgaggactagacccagacggtccactggctattccgaagtgattgttgtagtcggcggatgtgagagggtcggtggcttcaaccttccttacacggagtgttacgaccccgtaaccggtgagtggaagtccttggcaaagctgcctgaattcaccaaatccgagtacgctgtatgtgcactgaggaatgatattctggtcagtgggggaaggattaattctcgtgacgtctggatctacaattctcagttaaatatctggattagagtggcatccctgaacaagggccgctggcgacataagatggcagtcttgctggggaaggtgtatgttgtgggggggtatgacggacagaatagattgagctcagtcgagtgctatgattccttctccaatcgctggaccgaagtggctccgttaaaggaggctgtgagttctcccgccgtgacctcctgtgtgggaaagctgtttgtgatcggaggcggccccgatgataacacctgtagtgacaaggtgcagagctacgatccagagacaaactcttggcttctccgcgctgccattccgatcgcaaagcgctgcataaccgctgtctcactgaacaacctcatctatgtcgctggcggactcaccaaagctatttactgttatgatcctgtggaggattattggatgcacgtccagaacacctttagtcgacaggtaattacatag

SEQ ID NO: 26324 - DNA, 1611 bp, Artificial Sequence
  Description of Artificial Sequence: Synthetic coding sequence
atgcggctggaggagctgaagcggctgcagaaccccctggagcaggttaatgatggaaagtatagcttcgaaaacatccagcgcgcctggcgcgaatacctgcaaaggcaagaaccactgggcaagcgatccccgagtccaccctctgtcagcagtgagaaactgagcagctccgtgagcatgaacaccttttctgattcgagcacaccagactatcgagaggatggcatggatctgggcagtgacgccggctcatcctcctcaagctctcgcgccagcagccagagcaacagcacaaaggtcaccccttgttcagagtgtaaatcttcctctagccctggcgggtctctcgatttagtctcggctctggaggattacgaggaaccttttcctgtttaccagaagaaagtgatcgacgagtgggcacctgaggaagatggcgaggaggaagaggaggaggatgagcgggaccaaaggggatatcgcgacgaccgcagccctgccagggagcctggggacgtctccgctcgcaccagatcaggcggtggcggtggtagatctgctaccaccgcaatgccacccccagtgcctaatggaaacctgcaccaacacgatcctcaggatctccgtcacaacggtaacgtcgtagtggcgggcaggccatcatgctcacgcgggcctaggagagctattcagaaaccacagcccgcgggaggcaggaggtccggcagaggaccggccgccgggggactatgcctgcaaccccccgatggcgggacctgtgtgcccgaggagccccccgttcctcctatggattgggaagccctggagaagcatctcgcaggtttacagtttcgcgagcaagaggtcaggaaccaggggcaggctcgcacaaatagcactagcgcacaaaaaaacgaacgggaaagtatcaggcagaagctggctctgggttccttttttgatgacggcccagggatctatacaagttgcagtaagtctggtaagccctcgctgtcatcaaggctgcaatcaggcatgaatctgcagatttgttttgttaatgactctgggtcggacaaggattcggatgccgacgatagcaaaaccgaaaccagcctcgatactcctctatcccccatgtcgaaacagtcaagctcctactctgatcgagacaccacagaagaggaatccgaatcactggacgacatggattttctgacccggcaaaagaaattgcaagccgaagcaaagatggcactggccatggccaaaccgatggccaagatgcaggtggaggtggagaagcagaataggaaaaagagtccagttgcagatcttctgccgcacatgccacatatctctgagtgcctgatgaagcgatccctgaagcctacggatttaagggatatgacgattggacagctccaggtaatcgtcaacgatttgcactcacagatcgaatccctcaatgaggaactggtgcagttgctgctaattcgggacgaactgcataccgagcaggacgcaatgctcgtggacatcgaagatcttacccggcatgcggagtcacagcagaagcatatggctgagaagatgccagcaaaatag

SEQ ID NO: 26325 - DNA, 630 bp, Artificial Sequence
  Description of Artificial Sequence: Synthetic coding sequence
atgagcgagaacgccgcccccggcctgatcagcgagctgaagctggccgtgccctgggggcacattgctgctaaggcatggggatctcttcagggcccacctgtgttatgtctgcacgggtggttggataacgctagctctttcgacaggttgatcccactgctcccacaggacttttactacgtggccatggactttggcggccacggccttagctcccattacagcccaggcgtgccttattacctccagacattcgtctcagagattagacgcgttgttgccgctctgaaatggaataggttttccatcttaggacattctttcggaggcgttgtcggcgggatgtttttttgcacttttcctgagatggttgacaaactgatcctgctggacacacccttgttcctcctggaaagtgacgagatggaaaatcttctgacatataagaggcgcgccatcgagcacgtacttcaagtagaggctagtcaagagccctcacacgtgttcagcctgaagcagctgctgcagcgactattgaaatcaaattcccacttgagcgaggagtgtggagaattgctcctacaacggggcaccactaaagtcgcaacaggccgggaacagcactag

SEQ ID NO: 26326 - DNA, 201 bp, Artificial Sequence
  Description of Artificial Sequence: Synthetic coding sequence
atgcccgaggaccaggtgggcaagctggaggccaccgagaacaccattagtgcaatggcagctgccgctgcagaacaacagcagttttacttgcttctcggcaatctgctttcccctgataatgttgtaaggaagcaggcagaggaaacttacgagaacatccccggacagtccaaaatcactttcctccttcaagcctag

SEQ ID NO: 26327 - DNA, 2061 bp, Artificial Sequence
  Description of Artificial Sequence: Synthetic coding sequence
atggccatcagccagcaccagttctacctggaccggaagcagagcaaagcaaagattcctagtgccagatcactggatgagatcgccatggacctcacagagacaggaacacaacgagcctccaaactggtcacattggagaccaagagccagtttattatggcgtctaacggatcgttgatatcgagcggtagtcaagacagcgaagtatccgaagagcagaaaagggagaagattcttgaactaaagaaaaaagagaagctgctgcaggagaaattgctcaagaaggtggaggagctgaagaagatttgccttcgcgaagctgagctcacaggcaagatgccaaaagagtaccctctcaatataggcgaaaaaccaccccaggtgcggcgacgggtgggaaccgcgtttaagttggacgataatctgctcccctcagaagaggatccagccctacaggaactggaatctaattttctgatacagcagaagttggtggaggcagctaagaagctggccaacgaaccagacctctgcaagactgtgaagaagaaaaggaaacaagactacacagatgcgatgaaaaagctgcaagagattgagaacgcaattaacgagtacaggattcgttgcggcaaaaagcccagccagaaggctactgtgcttcccgaggacatcatcccctctgagagcagtagtctatccgataccaccacatacgatgacccgtctgacgccttcacattcccaggacagaggagctctagcgttcctcattcacctcgaatactgcctcctaagtccctgggcatcgaaagaattcattttaggaaatcctccatcaatgaacagttcgtagatacccgtcagtctcgggaaatgctgtctacccactcgtctccatataagaccctcgagagacgaccacagggaggcaggtcaatgccgaccaccccagtcttaactagaaacgcatactcctcctcccatctcgaacctgaatctagcagtcagcattgtcgccagaggtcagggagcctcgagtctcaatctcacctgttgtccgaaatggatagcgataaaccctttttttctctttcaaaatcacaacgctctagctcgaccgaaattctggacgatggatcaagttatacctcccagtcatcaacagagtattattgtgtgacacccgtaacgggtccttattacacaacccagacactggacacccgcacacggggacgacggcggtcaaagaagcagaacgtgtctacgagcaacagcggaagcatgccaaatctggcacagaaggactctctgcgcaatggtgtctatagcaagtctcaagaaccaccaagcagttcctactacattgctggttacactccatacgcagagtgcgacttttattacagtggcggttacgtttacgaaaacgatactgagggccaatattccgtgaacccaagctaccgcagcagtgctcattacggctatgaacggcagagggattactccagaagtttccacgaggacgaagttgacagagtgccacataatccctacgctaccctccgactccctcgcaaggcggccgctaaatcagagcatatcacaaagaacattcacaaggctctggtggccgagcatctaagagggtggtatcagcgagcgtcagggcagaaagatcagggccactctccgcaaacgtcgtttgactccgacagaggcagccagcggtgcctgggctttgccggactccaagtgccttgtagcccctcctcccgggcatcctcatacagcagcgtgtcttctactaacgcgagcggaaattggcggacccagctgaccattgggctgagcgactatgagacacccgcccactcctcctacacttcatgctatgggaatgtgtacaatccattgccaagtccttcgagacagtacaccgagatttcacagctggacgggactgatggaaaccagttggaggataacctagagtctagcgagcagcgactgttttggcacgaggactctaaaccagggacactggtgtag

SEQ ID NO: 26328 - DNA, 219 bp, Artificial Sequence
  Description of Artificial Sequence: Synthetic coding sequence
atgatggaggagatcagcatcatggtggcctacgacgcccacgtgttctcccagttgcacgacgaggacttcctgaccagcctggtggccattagcaagcctaggtcaatggtgccaacaaagaagctcaagaagtatgagaaagagtaccagaccatgcgggaatcccagttgcaacaagaggaccccatggatcgctacaaattcgtttatctttag

SEQ ID NO: 26329 - DNA, 1965 bp, Artificial Sequence
  Description of Artificial Sequence: Synthetic coding sequence
atggacagcctgcccgacgagttcttcgtgcggcaccccgccgtggaagatcagagaaaggaagagactgagaataaactggagaagagcagcgggcaattgaataaacaagagaacgatataccgactgacctggtccccgtgaatcttctcctggaagtgaaaaagttactgaacgccattaacaccttgccaaagggtgtcgtacctcatatcaagaagttcttgcaggaggactttagtttccagaccatgcagagggaggtggccgccaactctcaaaatggagaggagattgtgcctgccctcaccttgagattcctgatcacccaattagaagcagccctgcggaacatccaagccgggaactacactgcacaccagataaacatcggatattacctcaccttattgttcctgtacggggtcgcgctcacagagcggggaaagaaggaggattacacagaggctgagaacaaatttctggtcatgaaaatgatgattcaagagaacgaaatctgtgagaacttcatgagcttagtgtatttcggtcgggggttgttgcgatgtgctcagaaaagatacaacggaggattgctggaattccataagtccttgcaagagattggggacaagaatgaccactggttcgacatagaccccacggaagacgaggacctcccgacgacgtttaaagatttactgaataatttcattaaaacaactgagagcaacattatgaagcagacaatttgctcgtatcttgactgcgagaggagctgtgaggccgatatccttaagaatacttcctacaaggggttctttcagcttatgtgctcaaagtcgtgttgcgtctacttccataagatctgctggaagaagtttaagaatctgaagtaccccggtgaaaacgaccaaagttttagcggtaagaagtgccttaaggagggctgcaccggcgatatggttagaatgctccagtgtgacgtgcctggtatcgtcaagattttgtttgaggtagtccgtaaagatgagtacataacgattgagaacctgggcgctagctaccgtaagctgattagcctaaaaataaccgacacagacataagaccaaagataagcctgaagtttaatactaaggatgagatgcccatctttaagctggattataactatttctaccaccttctgcacatcatcattatctctggaacagacatcgtaagacagatcttcgacgaagcaatgccaccccctttgctgaagaaagagctgctgattcataaaaatgtcttggaaagctactacaaccatctgtggacaaaccatcctctgggggggtcttggcacctgctctaccctccaaacaaggagctgccgcaaagcaaacagttcgacttgtgcctcttacttgctcttatcaaacatctgaacgtctttcccgcacccaagaagggctggaacatggagcctcctagcagtgatatttcaaagtcagccgacattcttcgcctgtgtaaataccgtgacattctgttgtctgagatacttatgaatggactcaccgaatcccagtttaatagcatctggaaaaaggtgtccgacatcctgctccgcctggggatgatgcaggaggacatcgataaagtgaaagagaatccaattgagaatataagcttagactatcaccagttgagtgtctacctgggaatccccgttccagaaatcatacaacgaatgctgtcatgttaccaacagggcattgcccttcagtctatcactggaagccaacgcatcgagattgaagagctccagaatgaggaagaggagctgagtccacctctgatggagtataacataaatgtgaagtcccatcctgaaattcaattcgcggagatcaataaggatggtacatctatccctagtgagtccagcaccgagagcctgaaagacctgcaggagtag

SEQ ID NO: 26330 - DNA, 570 bp, Artificial Sequence
  Description of Artificial Sequence: Synthetic coding sequence
atgaaccccgccagcgcccccccccccctgcccccccccggccagcaggttatacatgtgacacaggacctagatacggatctggaggctctcttcaattcagttatgaaccccaagccaagtagttggcgaaaaaagattttaccagagagtttctttaaggagccagactccggtagccatagccgccaatcaagcacagattcttccggcggccatcccgggcctagacttgccggcggagctcagcacgttcgatcgcacagcagtcccgccagtctacagcttggtaccggagccggtgcggccggctcacccgctcaacaacacgctcacctgcggcaacaatcttacgacgtgaccgacgagctgcctctgcctcccgggtgggaaatgacctttactgccacaggccaaaggtacttcttgaatcacatcgaaaagatcaccacctggcaggatcctcggaaggccatgaaccaacctctgaaccacatgaacttacatcccgccgttagtagtacccctgttccccagaggagcatggccgtctctcagcccaatctgtag

SEQ ID NO: 26331 - DNA, 849 bp, Artificial Sequence
  Description of Artificial Sequence: Synthetic coding sequence
atgggccccctgccccggaccgtggagctgttctacgacgtgctgtccccatactcatggctcggttttgagatcctctgcaggtaccaaaacatctggaacattaacctgcagctccggccttctctcatcacagggataatgaaggactccggtaataagccgccaggtctccttccccgtaagggactttacatggccaatgacctcaagttgctgagacaccaccttcagatccccatccatttcccaaaagatttcttgtcggtgatgctggagaaggggagcctcagtgccatgcgattcctcacagccgtgaacctagagcatcccgagatgctggagaaggcttcaagagaactttggatgagagtttggtcacgtgtgagtgttggactttgggagagcagtggtcgcacactcgacgatttcctcactttcccccggcacgtgttcagggtgatgatacttcctccccctggcgggtccaccgtactccccgtgacccccctcagtccccatcgcctgcccgctgtgttcagctcctcccaaaacgaggatatcacagagccacagtcgatcctggctgccgcagagaaggcagggatgtcagcagagcaggcccagggactccttgaaaagatcgctacccccaaggttaaaaatcagctgaaagagacaacagaagcagcatgtcgctatggagcctttggcttgccaattaccgtggctcacgtggacggacaaacccatatgctgttcggtagcgaccggatggaacttttagctcatcttttgggagaaaaatggatgggcccaattccacctgcagtaaatgcccgactgtag

SEQ ID NO: 26332 - DNA, 1221 bp, Artificial Sequence
  Description of Artificial Sequence: Synthetic coding sequence
atggaccagctggagaacgccaagatggagcacaccaacgccagcttcgacacttttttttgtgagacccgagccggaaagcatgtgccccgggcactgtttgtagacctagaacccacagtgatagatggaattcggacaggacagcatcgcagcctatttcacccagagcaattgctatctgggaaagaagacgctgcgaacaactacgctcgcgggagatatagcgtgggcagcgaggtaatagacctggtgctagaacgcacaagaaagctcgccgaacagtgtggcgggctccaggggtttcttatcttccgctcgtttgggggtggcaccggctccggcttcacttccctgctgatggagcgcttgacaggggaatactcacgaaaaacgaagcttgagttttctgtgtacccggctcctcgtattagcacggcggtagttgagccctacaactctgtgctgacgacccactccaccaccgagcacacagattgtacattcatggtggataatgaggccgtctatgatatctgccatcggaaactgggcgtggagtgtccttcgcacgcatccattaacagactcgtggtgcaggtcgtttcctctattacagcatctcttcggttcgagggccctctcaacgttgatcttatcgagtttcagaccaatttggtgccttacccaagaatccacttcccaatgactgcgtttgctccaatcgttagtgcagacaaggcataccacgaacagttctctgtaagcgacatcacgactgcttgtttcgagtctagtaatcagcttgtgaagtgcgatccccgcttaggcaaatatatggcctgctgccttttgtatagaggagacgtggtgcctaaagaagttaacgcagctatagcagccactaaaagccggcattctgtgcagttcgtcgactggtgtcccactgggttcaaagtcgggattaacaaccgccctccaactgtcatgcctgggggcgatctggccaaggtacacagaagcatttgtatgctttccaacactaccgccatcgtggaagcgtgggcccgacttgaccataagtttgacctgatgtacgccaagagagctttcttgcactggtatctacgggagggaatggaggaagccgagtttttggaagcacgcgaggatttagcggccctagaacgtgattacgaagaagttgctcagagcttctag

SEQ ID NO: 26333 - DNA, 1860 bp, Artificial Sequence
  Description of Artificial Sequence: Synthetic coding sequence
atgagcggcctggtgctgggccagcgggacgagcccgccggccaccgcctgagccaggaagagattttaggcagcacacgcctcgtatcccagggcctggaagccctcaggagtgagcaccaggcagtgctgcagtccctctctcaaacgattgagtgccttcagcagggcggccacgaagaagggctggtgcacgaaaaagctcggcaattgaggcggtcaatggaaaatatcgagctgggcctttccgaggcccaggtgatgttggctctggcatcacacctgtccactgtggagtctgaaaagcagaaactgcgtgctcaggttcgtcggttgtgtcaggagaaccagtggctgagggacgagctggccggaacccagcagcggcttcagcgatcagaacaggccgtggcacaactagaagaggaaaaaaaacatctggagtttctgggccagctcaggcagtacgacgaggatgggcacacgagcgaggaaaaggagggcgatgccaccaaggactctctcgacgacctttttccaaacgaggaggaagaagatcccagcaacggattgtctcgggggcagggggcgactgctgcccagcaaggcgggtatgagatacctgctcgtctcagaacacttcacaacctggtaatccagtatgccgcccaagggaggtacgaggtggccgtccccttgtgtaaacaggctttggaggatttggaaagaacatcagggcggggtcatcccgacgttgccacaatgctgaacatcttagctcttgtatatagagaccagaacaaatacaaggaagcagcccacctgctcaatgacgccctgtctatacgcgagtcaacactggggccagaccaccctgcagtggcagctactttgaataatctggctgtcctgtatggtaagcggggcaaatataaggaagccgagcctttgtgtcaaagggctcttgagattcgggagaaggttctcggtacaaaccatccagacgtggctaaacaactgaataacctcgccctgctgtgtcagaaccagggcaagtatgaagcggttgagaggtactaccagagagcgcttgctatctatgagggacagctgggccccgataaccctaatgtcgccagaactaagaacaacctcgcaagctgttatctgaagcaaggtaagtacgctgaagccgagacactgtacaaggaaatcctgactagggcccacgtacaggagtttgggagcgtcgatgacgaccacaaaccaatttggatgcacgcagaagaaagggaagaaatgagtaagagcagacatcacgaaggaggcactccctatgccgaatacggggggtggtacaaagcttgcaaagttagctcccctactgtgaacactaccttgcgcaacctcggagccctttatcggcggcagggcaagctcgaagctgccgaaaccctcgaggagtgcgcgcttagaagtcgcaggcagggaacagatcccatcagtcagactaaagtagctgagctgctgggggaatccgacggcaggagaacgagccaggaaggaccgggtgatagcgttaaattcgaggggggcgaagatgccagtgtggccgtggagtggagtggcgatggatccggcactctgcaacggtcagggagtcttggtaaaattagagatgtccttaggaggtcctcagagcttctcgtgcgcaagcttcaaggcaccgaaccccgcccatcttccagcaacatgaagagagccgctagtctgaactatttgaaccagccttctgccgcccctctccaggtctcaaggggcctgtccgcctccacgatggatctatcgagttctagttag

SEQ ID NO: 26334 - DNA, 294 bp, Artificial Sequence
  Description of Artificial Sequence: Synthetic coding sequence
atgggcaagagctgcaaggtggtggtgtgcggccaggccagcgtgggaaaaacttccatcctggaacagttgctttatggcaatcatgtagtgggctctgagatgatcgagacgcaagaagatatatatgtggggagcattgaaacggatcggggagtcagagagcagatagccgaatccctctttagtgtgtggagttgctctagacggagactgacgaatccccgcacaaggcgcaggtccccaagctggtccctggctacttccgtgacctatcgctcctcgggagtctag

SEQ ID NO: 26335 - DNA, 387 bp, Artificial Sequence
  Description of Artificial Sequence: Synthetic coding sequence
atgaccgacctggtggccgtgtgggacgtggccctgagcgacggcgtgcacaagattgagtttgagcacggcacaacgagcggaaaaagagttgtgtacgtcgatggtaaggaagaaattagaaaagagtggatgtttaaactcgtgggtaaggagaccttttatgttggagcagccaaaacaaaggccaccataaatattgatgctataagtggctttgcatacgaatacacattggagatcaacgggaaatccctgaagaaatacatggaggacaggtcgaagactactaacacctgggtcctgcatatggacggcgagaacttccgcatcgtactcgaaaaggacgcgatggacgtgtggtgtaatggcaaaaagctagagtag

SEQ ID NO: 26336 - DNA, 879 bp, Artificial Sequence
  Description of Artificial Sequence: Synthetic coding sequence
atgaccgtgagcaagttcatggccatccagaaggccctgcagcccgactggttccagtgtctgagtgatggggaggtgagttgtaaagaggcgacgtctataaaacgcgtgcggaaaagtgtcgatcgcagcctgctgtttctggataattgcctgcgtctgcaggaggaaagcgaggtgctgcaaaagagcgttatcattggagtcatcgaagggggcgatgtgatggaagaacgtttgcggtctgcccgcgaaactgcaaagcgacccgtgggaggcttcttattggacggcttccagggcaaccctacgacactggaggccaggctgagactcctgagctcagttaccgcagagctccccgaggacaagccacgcctgatcagtggggtgagccgccccgacgaggtcttagaatgcatcgagcggggtgttgacctgtttgagtctttctttccctatcaggtgaccgaacgcggatgtgccctcacattttcctttgactaccagcccaatcccgaggagacactgctacagcagaacgggactcaggaggagatcaagtgcatggatcagatcaagaagattgaaaccactgggtgtaatcaggaaatcacatctttcgagataaatttgaaagagaagaaataccaggaggatttcaacccactggtcaggggatgtagttgctactgctgtaaaaatcatacacgagcctatattcaccatctcctcgtgacgaacgagctcctggctggggtcctactgatgatgcacaattttgaacattactttggcttctttcactatatcagggaggctctcaagtccgacaagctggcccaactcaaggagctcatccacagacaggcctcgtag

SEQ ID NO: 26337 - DNA, 600 bp, Artificial Sequence
  Description of Artificial Sequence: Synthetic coding sequence
atgcggttccggttctgcggcgacctggactgccccgactgggtgttggctgagatttctaccctagccaagatgtcatctgtgaaactgagactcctgtgctcgcaggttctaaaggagttactgggccaggggatagactacgaaaaaatcctgaagctgactgcggacgctaaatttgaaagcggcgacgtgaaagctaccgttgctgtcctttccttcatcctatcctccgccgctaaacattcagtagatggcgagagcttgagttccgagctgcagcagctcggactgcccaaggaacacgccgcctccctgtgccggtgttacgaggagaagcagtcaccccttcagaagcaccttagggtgtgcagcctgcggatgaatcgactcgctggcgtggggtggcgggtggactataccctttcgtcatcacttctacagtccgttgaagagcctatggtccacctgaggttggaggttgcagccgctcccggtacccccgcccaacccgttgccatgagccttagcgccgacaaattccaggtgctgctggccgagttgaagcaggctcaaacccttatgtcaagccttgggtag

SEQ ID NO: 26338 - DNA, 354 bp, Artificial Sequence
  Description of Artificial Sequence: Synthetic coding sequence
atgcccgaggaccaggtgggcaagctggaggccaccgagaacaccataagcgcgatggctgcggccgctgctgaacagcagcagttttatctgttgttagggaacctgctttcacccgacaatgtggttcggaagcaagcagaggagacatatgaaaatattccaggacaaagcaagatcaccttcctcctacaagctatcaggaataccaccgcagcagaagaggcacggcagatggccgccgttctcctgaggagactcctctcttctgcattcgatgaggtgtatccagctctgccgagtgacgttcagaccgccattaagtcagaactattaatgatcatccagatgtag

SEQ ID NO: 26339 - DNA, 888 bp, Artificial Sequence
  Description of Artificial Sequence: Synthetic coding sequence
tgaaccaagctggccaccggcagcaaggacaccaccgtgatcatctggcaggtagaccccgacacccatctcctcaagcttttgaagaccctggagggtcacgcctacggggtgagctacattgcctggtccccagatgacaattacctggtcgcctgcggtcccgacgattgtagtgaactgtggctctggaacgtacagacgggagagttgcggacaaagatgtctcagtcacatgaagactctctcaccagcgtggcatggaacccagatgggaaaaggttcgtgacgggcggccaaagaggccagttctaccaatgtgacttggatggcaacctgttggattcatgggagggtgtccgggtgcagtgcctttggtgtctctcagatggtaaaaccgtgctggccagcgatacacaccagcggattagaggctacaatttcgaagacttgacagataggaatatcgtgcaggaagaccatcctattatgagtttcacaatcagtaagaacgggcgcttggcgttactaaatgtggcaactcagggggtacatttgtgggacctgcaggacagagttctggtgcgcaagtaccagggagtgactcaggggttctataccatccacagttgtttcgggggccataacgaggatttcatcgctagtggttccgaggaccataaggtctacatctggcataaacggtcagagcttcctatcgcggaactgacagggcacaccaggaccgtgaattgtgtgtcttggaatccccaaatcccctccatgatggcctccgcaagcgatgacggcacagtaagaatctggggaccggccccatttatcgaccaccagaatattgaggaagagtgttcctccatggactcctag

SEQ ID NO: 26340 - DNA, 1053 bp, Artificial Sequence
  Description of Artificial Sequence: Synthetic coding sequence
atggcccggtggatccccaccaagcggcagaagtacggcgtggccatttacaactacaacgctagccaggacgttgagctgtccctgcaaatcggcgacacggtgcacatcttggaaatgtatgagggatggtatagggggtacactctgcaaaataagtccaaaaaaggcattttccccgaaacctatatccatttaaaggaagctacagttgaggatcttggccagcacgagactgtaattccaggggaacttccgctggtccaggaattgacatctacacttagagaatgggccgtaatttggaggaagctatatgttaacaacaagttgaccttgttccgccagctgcagcagatgacctattcattaattgagtggaggtcacagattctgtccggaactcttcctaaggacgaactggcggagttgaagaaaaaagtgacagccaaaattgaccacggtaatcggatgctgggtctagacttagtcgtgcgcgacgacaatggaaatatcctggatcctgatgagacgagcacaatcgcgctctttaaggctcacgaggtggcctcgaaacgtatagaggagaagatccaggaggaaaagtcaatcctccagaacctcgacctgagagggcagtctatattcagcactatccatacttacggcttgtacgtgaactttaaaaactttgtttgtaacatcggggaggacgcggaactattcatggcactttacgatcctgaccaatccactttcattagcgagaattacctgatccgatggggttccaatgggatgcctaaagagatagaaaagcttaataacctccaggccgtatttacagacctgtcaagtatggatcttataaggccccgcgtcagtcttgtttgtcaaatagtgcgcgtggggcatatggaacttaaggagggtaaaaaacacacctgtggtctgagacggccctttggcgtggcagtgatggatatcactgacatcatccacggtaaggtagatgatgaggaaaagcagcactttattccttttcaacagtag

SEQ ID NO: 26341 - DNA, 360 bp, Artificial Sequence
  Description of Artificial Sequence: Synthetic coding sequence
atgcccgaggaccaggtgggcaagctggaggccaccgagaacaccataagtgccatggccgccgctgccgccgaacagcagcagttttacttgctgttgggcaaccttctgagtccggacaatgtggtgaggaagcaggcagaggagacctacgagaatatcccaggacagtctaagataacattcctcctccaagccattagaaacaccacggccgctgaggaggcccgacaaatggctgccgtgcttttaaggcgactgttgtcgtcggctttcgacgaggtgtaccccgccctgccctcagatgttcagaccgccatcaagagtgagctcttgatgatcattcagatggagacctag

SEQ ID NO: 26342 - DNA, 279 bp, Artificial Sequence
  Description of Artificial Sequence: Synthetic coding sequence
atgagcggcctggtgctgggccagcgggacgagcccgccggccacaggctctcacaggaggagatccttgggtctacaagactggtgtcacaggggctggaggccctgaggtctgaacatcaggccgtgctgcagagcctgagccagactatcgagtgcctgcagcagggcggacacgaggaggggctcgtgcatgagaaggctaggcaactaagacggtcaatggagaatatcgagttgggacttagtgaagcccaggtcatgcttgcccttgcctag

SEQ ID NO: 26343 - DNA, 405 bp, Artificial Sequence
  Description of Artificial Sequence: Synthetic coding sequence
atggtgctgatcctgggccggcggctgaaccgggaggacctgggcgtaagggattctcctgccacgaaaaggaaggtcttcgaaatggaccccaagtcactcaccggccatgagttctttgatttctcttctgggagctctcacgccgagaatatcctacaaattttcaatgagtttcgcgactccagactgttcaccgacgtaattatctgtgtcgagggtaaggaattcccctgccaccgtgctgtgctgtctgcttgctcttcgtatttcagagctatgttctgcaacgatcatagggagtctcgggaaatgctggtcgagattaatgggattttagccgaagcaatggaatgtttcctccagtacgtatacaccgggaaggtaaaaatcactacggagtag

SEQ ID NO: 26344 - DNA, 312 bp, Artificial Sequence
  Description of Artificial Sequence: Synthetic coding sequence
atggccgagctgatccagaagaagctgcagggcgaggtggagaagtatcagcaattgcagaaggatctctctaagagtatgtcggggagacagaagttggaggctcagctgacagagaataatatagtgaaggaagagttggcacttttggacgggtcaaatgtggtttttaagctgctggggcccgtactcgttaagcaggaacttggcgaagccagggccacagtaggcaaacgtctggactatataacagccgagatctttctgcgcaccattccagaccccggggatgtgcccgactctttcttctag

SEQ ID NO: 26345 - DNA, 1923 bp, Artificial Sequence
  Description of Artificial Sequence: Synthetic coding sequence
atgggccggcggagcggcctgctgggcctgcggcccggccccgagccggtagccttggagagggtgatcaacaaggtacacctgaaggccaaccacgtggttaaacgtgatgttgatgaacatttacgcatcaaaactgtctacgacaaaagcgtcgaggagttactccccgaaaagaagaacctggtgaaaaataaactctttcctcaggctatctcctatcttgagaaaacttttcaggttcgccgaccagcaggcaccattctactctcgaggcaatgcgctaccaatcagtatttaaggaaggagaatgacccgcaccgatactgcacaggggaatgtgctgcacatactaagtgcgggcccgttattgtgccagaggagcacctgcagcaatgccgcgtatacaggggagggaagtggccccacggcgccgtgggggtgcctgatcaggaagggatctctgatgctgatttcgtcttgtacgtgggcgcgttggccaccgaacgctgttcccacgagaacatcattagctatgccgcttattgccagcaggaggccaacatggaccgcccaattgccggctatgctaatctttgccctaacatgatcagtacccagccccaggaattcgtcggtatgttaagtaccgtgaagcatgaggttattcatgctctcgggttctcagctgggttatttgcgttctatcacgataaggatggaaatcctttgacttccagattcgcagatggtcttccacccttcaactacagcctgggcttgtatcagtggagtgacaaagtggttcgaaaagtcgagaggctctgggacgtaagggataataaaatcgttcgccataccgtgtatctgttggttacaccaagggtcgtggaagaggcaaggaagcacttcgactgcccggtcctcgaaggaatggaactagagaatcagggtggagtgggcaccgagttaaatcattgggagaagcggctgctggaaaatgaggccatgacggggtcacatacgcagaacagggttctgagcaggattacccttgctctgatggaggataccggatggtacaaagccaactattccatggctgagaaactcgactgggggcgcggcatgggatgtgatttcgttaggaagtcctgcaaattttggatagatcaacagcggcaaaagaggcagatgttatctccctactgtgatacattacgaagcaaccccctgcagcttacctgtaggcaggaccagcgggcagtggccgtctgtaatctccagaagttcccgaaacccctgccccaagaatatcagtacttcgacgagttgagtggtatcccagcggaggatctaccatactacggcggatctgttgagatagccgactactgccccttctctcaagagttcagttggcatctgtcaggagaataccaaagaagctcggattgcagaattctggaaaatcagccagaaatcttcaagaattatggcgcggaaaaatatggcccacattctgtgtgcctgatccagaagtcggcatttgtaatggaaaaatgcgagaggaagttaagctaccccgactggggctctggatgctaccaagttagttgctccccacagggactaaaagtgtgggtgcaggacaccagctacctttgttcacgcgcaggtcaggtgctgcccgtctctatccagatgaatggttggatccatgacggtaacctcctgtgccccagctgctgggatttttgcgagttatgcccccctgaaaccgaccctcctgctacaaatctgacccgggccctcccactggatctctgtagctgttcatcatctctggtggtgacactctggctgctcctgggtaacctctttcccctgctggctggctttttactgtgcatatggcattag

SEQ ID NO: 26346 - DNA, 783 bp, Artificial Sequence
  Description of Artificial Sequence: Synthetic coding sequence
atgaacctggacagcgacggcatggacgacatcatcagccaggagtccagtttggacatggaaggaaactacaaaaaagcccaaaaaaatgaacgtgaatctatacgtcagaaactcgcattggggtccttcttcgacgatggccctggcatctacacttcttgttcaaaatcagggaaacctagcctctcttcccgcttacagtcaggaatgaatctgcagatttgtttcgtcaacgactccggaagcgacaaggacagtgatgccgatgatagcaagaccgagacgtccctggatacgccacttagtcccatgtcaaaacaatcctcatcgtattctgaccgggataccaccgaggaggagtcagagagcttggacgacatggattttctgacccgacagaagaaactacaggccgaggctaagatggccctagccatggccaagccaatggcgaagatgcaggtagaagttgaaaagcagaataggaagaaaagccctgtggccgatctgttgccccatatgccacacattagtgagtgtctcatgaagagaagcctgaagccaaccgatctgcgggacatgactatcggccaattacaagtaatagtgaatgacctgcactcgcagatagagtctctgaatgaagagctcgtgcagctgctcctaatccgcgatgagctgcataccgaacaagacgccatgctcgtggatatcgaggatctgacccgccacgcagaaagccagcaaaagcatatggcagaaaagatgccggcaaaatag

SEQ ID NO: 26347 - DNA, 633 bp, Artificial Sequence
  Description of Artificial Sequence: Synthetic coding sequence
atggccgccagcgtggagcagcgggagggcaccatccaggtgcaggggcaggcgctcttcttccgagaggctttacctggttccggccaggcacggttcagcgtcttgctgcttcacggaattagattttccagcgagacttggcagaacctgggcactctgcataggctggcacaagcaggctacagagctgtggctattgacctccccggcctaggccattcaaaagaagctgcagcaccagcccccattggggagctggccccgggctcctttcttgccgcagtggtggacgccttagagctgggtcccccagtggtgataagcccttctctgtcgggaatgtactccctgcccttcttgactgcccccggctcgcagttgcccggattcgtccctgtggcccccatttgcaccgacaagattaatgccgccaattacgcctcagtcaagaccccagccttgatcgtatatggtgaccaagatcctatgggtcagacctcgttcgaacacctgaagcagctgcctaaccatagagtgctgattatgaagggagccgggcatccatgctatctggataaacccgaagagtggcataccggtctgttggacttcctgcagggccttcaatag

SEQ ID NO: 26348 - DNA, 381 bp, Artificial Sequence
  Description of Artificial Sequence: Synthetic coding sequence
atgaaccagcggagccacctgggcaccacctacctggacaccgccaagggcgcagtggagaccttcatgaagctgagagcaagggatcccgccagccgcggggaccgctatatgctggtcacctttgaagagccaccctacgcgattaaagctgggtggaaggaaaatcacgcgacgttcatgaacgaactgaagaacttgcaggcagagggtctgaccaccctgggtcagagcctgcgcacagcttttgacctcttaaatcttaaccggctggtcaccggaattgataattacggacaggggaggaatccctttttccttgaaccggctattatcatcacaatcacggatggatccaaactaaccaccaccagtgggtag

SEQ ID NO: 26349 - DNA, 1188 bp, Artificial Sequence
  Description of Artificial Sequence: Synthetic coding sequence
atggccaacgaccccctggagggcttccacgaggtgaacctggcctccccaacctccccagacctactgggcgtgtatgaatctggaacacaggaacagactacctctcccagtgtcatatatagaccccatccctctgctttgagttctgtgccgatccaggcgaacgcgctggatgtgagcgagctgccgacccaaccggtgtactcctcacctcggagactgaattgtgcagaaatatcctcaatcagctttcatgtgactgatccggccccatgctctacaagcggcgttactgccggtctgacaaagttgaccacgaggaaagacaattacaatgcggaacgggagtttctgcagggcgcaaccattacagaagcctgtgatggatcagacgacatcttcggcctcagtactgattctctcagcagactcagatcaccttccgtcctcgaggtgagagagaaggggtacgaacggcttaaggaagaattagccaaggctcagcgtgagctaaagctgaaggatgaggaatgcgagcggcttagcaaggtgcgcgaccagctcgggcaggagctcgaagaactgactgctagcctcttcgaggaggctcacaaaatggtgagagaggcaaacataaagcaggctacggccgaaaaacagcttaaagaagcccaaggaaagattgatgttctgcaggcggaagtggccgcgctgaagacgctcgtgttaagtagctcacctaccagcccgacgcaggagcccctccctggaggcaaaactccattcaaaaaagggcacacaaggaacaagtccacgtcttcagccatgtcagggagtcatcaggatttgtcagtaatccagccaatcgtaaaagattgcaaagaagccgacttgtctctgtacaacgaattcagattgtggaaagatgagccaaccatggatagaacttgcccatttctggacaagatttatcaggaagatatctttccatgcctcactttttccaagtctgaactcgcctccgctgtgcttgaggccgttgaaaataatactctgtccattgagcccgttgggctgcagccaatccgcttcgtcaaggcatccgccgtggagtgcggcggaccaaagtcgctgctctacgttacatttctgcatacattcgacacttttagccgggacagctag

SEQ ID NO: 26350 - DNA, 786 bp, Artificial Sequence
  Description of Artificial Sequence: Synthetic coding sequence
atgggcagccggaagaaggagatcgccctgcaggtgaacatcagcacccaagaactttgggaggagatgttatcttctaaagggcttaccgtggtcgatgtttaccagggatggtgtggaccctgtaagccggtcgtctccctgtttcaaaagatgcggattgaagtagggctcgatctgctgcactttgccctgattaaggatgaggccctctccgatgaggatgagtgcgtttcacacggtaagaacaacggcgaggacgaagacatggtgagttcggagcgcacctgtacccttgccattatcaaacccgacgccgtggcacacggaaagaccgatgaaataatcatgaagattcaggaagctggttttgaaatcctaaccaatgaagagaggactatgacagaagcagaggtccgcttgttttaccagcacaaagctggtgaagaggcattcgagaaactcgtgcatcacatgtgctcgggcccctctcaccttctgatcctgaccagaactgaaggcttcgaggatgtagtcacaacttggagaacggtaatggggccccgcgacccaaacgttgctcggagggagcagcccgagtctctgagggcacaatacgggaccgaaatgccctttaatgccgtgcacgggtctcgcgaccgagaggatgctgaccgcgaactggcacttctgttccccagtttgaaattctcagacaaagacactgaagccccccagggggagtcatcaacccaaccaaggcttaagatcaccgatctggattag

SEQ ID NO: 26351 - DNA, 1284 bp, Artificial Sequence
  Description of Artificial Sequence: Synthetic coding sequence
atggtgtgctggcaggacctggaggagagcctgcggatgaagctgtccctaaccaaagtggttaatggatgtagactgggcaagattaagaatctggggaagaccggggatcatactatggacatccctggatgtctgctatatacaaaaacaggcagcgccccacacttaacccaccatactttgcacaatatccacggcgttcctgccatggcgcagttaaccctgagttctctggcagagcaccacgaggtactgaccgaatataaggaaggagttggtaagttcattgggatgcccgaatctttgctctattgctctctgcacgatcccgtgtctccttgccctgccggatacgttactaacaagagcgtatctgtgtggtcggtcgccggccgggttgagatgaccgtctccaaatttatggcgatccagaaggcgctgcagccggactggtttcagtgccttagcgacggagaagtgtcatgcaaggaagccactagcattaagagggtcaggaagagcgtggaccgcagcctgctgtttcttgataactgcctccgacttcaggaggagtccgaagtcctgcagaaaagcgtcatcatcggtgtcatcgagggtggtgatgtgatggaagagcggctccgttcagctagggaaaccgctaaacgtccagtgggcgggttcttacttgatggcttccagggaaaccccacaacgcttgaggcgaggctgcgcctgctgtcctccgtaacagcagaactgcccgaagacaagccccggttgatctctggagtatcaaggcctgacgaagtcctggagtgtatcgaaagaggggtggacctcttcgaaagtttctttccgtaccaggtcacagaaaggggatgtgcactcactttctcattcgactaccagccaaacccggaagaaactctcctgcagcagaatggaactcaggaagagatcaaatgtatggatcagataaaaaaaattgagacaaccggctgtaatcaggagatcaccagttttgaaattaacctgaaggaaaagaagtaccaggaagactttaatcccctcgtgcgcggttgttcgtgctattgttgcaagaatcacactagagcctacatacaccacctgctggtaacgaatgagctgctggccggcgttttactcatgatgcacaattttgaacactactttggctttttccactatatacgtgaggcgctcaaatctgataaactggctcaattgaaggaattaatccacaggcaagcctcttag

SEQ ID NO: 26352 - DNA, 393 bp, Artificial Sequence
  Description of Artificial Sequence: Synthetic coding sequence
atgaaccagcggagccacctgggcaccacctacctggacaccgccaagggcgctgtggagacattcatgaaactgcgcgcgcgggatcccgcctcacgcggggatagatacatgctcgttacctttgaggaaccgccatatgccatcaaggctggctggaaagagaatcatgccacttttatgaatgaactcaagaacttgcaggccgaaggccttaccacacttggccagtctcttagaacagctttcgacctgctgaacctcaaccggctggtcactggaatcgataattacggccaaggccggaacccatttttcctcgaaccagctatcatcatcaccataacagacggcagcaagttgacaaccacaagcggggtccaagatgaatag

SEQ ID NO: 26353 - DNA, 417 bp, Artificial Sequence
  Description of Artificial Sequence: Synthetic coding sequence
atgaaccccgccagcgcccccccccccctgcccccccccggccagcaagtgattcatgtaacgcaagatctggacaccgacttggaagcacttttcaattcagtcatgaaccctaagccttccagctggcgaaaaaagatcctacccgagtctttcttcaaagagccggatagcggatcccactcaaggcagtcaagcactgattcaagcggcgggcatcctggaccaaggctcgctggtggcgcacagcatgttcggagccatagcagccctgcatccctgcagctgggaaccggagccggggcggccggctcaccggcacaacaacacgcccacttgagacagcagagttatgatgtgaccgatgagttaccacttcctccagggtgggagatgacttttaccgcaacgggctag

SEQ ID NO: 26354 - DNA, 1692 bp, Artificial Sequence
  Description of Artificial Sequence: Synthetic coding sequence
atgcggctggaggagctgaagcggctgcagaaccccctggagcaggttaacgatggtaagtacagtttcgagaaccatcagctggccatggatgctgagaacaatatcgagaagtatccactgaatctacagccactggagagcaaggtgaagatcattcaacgggcctggcgggagtatttacagcgtcaagagccactgggtaaacggtccccgagccccccgtctgtatcttctgagaagctcagttcatctgtttcaatgaatacctttagcgactcctctacccctgactacagggaggacggaatggatctggggtctgacgcaggctcatctagttcttccagtcgagcctcttcccagtctaattccacaaaggtgacgccatgttccgagtgcaagtccagctccagccccggggggtctctggacctcgtgtccgccctagaggattatgaagaaccctttcccgtttaccagaagaaagttatagacgagtgggccccagaggaagacggagaggaagaagaggaggaagatgagcgcgaccagcggggatatcgggacgatcggtcacccgccagggagcccggtgacgtttccgctaggacacgcagtggcggcggtgggggacgcagtgctacaaccgctatgccacctccagtacccaatggcaacctgcaccagcacgacccccaggatttgcgccataacgggaatgtcgtagtggccgggcgcccatcatgtagccgagggccgcgacgcgcaattcaaaagccccagcccgccggcggacgacgtagtgggaggggccccgctgcaggagggttgtgtttgcagccacctgatggcggtacttgtgtgcccgaggagccccccgtcccaccaatggattgggaggccctcgaaaagcacctggcagggctgcagtttcgcgagcaggaggtcaggaaccagggacaggctaggaccaattctactagtgcacagaaaaatgagcgcgagtccattcggcagaagctcgccctgggatcattcttcgacgatggtcccggcatctacacatcatgtagcaaatctggcaagccttccctgagctccagactccaatccggcatgaacctccaaatctgttttgtgaacgatagcggctcggacaaggactctgatgctgatgattctaaaactgagacttctctagacacacccctgtcgccaatgtctaaacagtcatcaagttattctgaccgcgatactaccgaggaagagtccgaatccctggatgacatggacttcttgacccgacagaagaagctccaggccgaagcaaagatggcattggccatggctaaacctatggccaaaatgcaggtagaggtggagaaacagaatcggaagaagtcgcctgtcgctgatctactcccacatatgccgcatatcagtgagtgcctcatgaaaaggtcattgaagcccactgacctgcgtgatatgactatcggacagctccaggtgatcgtcaatgacctgcactctcagattgaatcacttaacgaagaattggtgcagttgttgcttatcagagacgagttacacactgaacaggatgccatgctggtcgatatagaggaccttacacgccatgcggagagtcagcagaagcatatggccgagaagatgccagccaagtag

SEQ ID NO: 26355 - DNA, 228 bp, Artificial Sequence
  Description of Artificial Sequence: Synthetic coding sequence
atgcccgaggaccaggtgggcaagctggaggccaccgagaacaccatcagcgccatggctgctgccgccgctgagcagcaacagttttacctcctattaggtaacctgctctctccagataatgtggtcaggaaacaggccgaagagacttacgagaatatccctggacagtccaaaatcaccttcctcttacaggccattaggaatactactgccgctgaagaatag

SEQ ID NO: 26356 - DNA, 2712 bp, Artificial Sequence
  Description of Artificial Sequence: Synthetic coding sequence
atgcccgagcagttcagcgtggccgagttcctggccgtgaccgccgaggacctcagttctccagctggggccgcagctttcgctgccaagatgccaagatataggggtgccgcactcgcacgagaagaaatcttggagggtgatcaggctatcctccagcggatcaagaaggccgtgcgcgcaattcatagctcaggacttggccatgtggaaaacgaggagcaatacagagaggccgtcgaatctctgggtaacagccacctaagccaaaacagtcacgaactgagcactggcttcctcaacttggctgtgttcacccgggaagtggccgctctgtttaaaaatctgatccagaatctaaataacatcgtgtctttccctctggactcactcatgaaggggcagctgcgagatgggagacaagactccaaaaagcagctggaaaaagcctggaaagattatgaggccaaaatggccaaactagagaaagaacgcgatcgggccagggtgacaggcggcatccctggggaagtcgctcaggacatgcaacgcgaacgaaggatcttccagctgcacatgtgcgagtacctcttaaaggcgggagagtcgcagatgaagcagggacctgacttcctccagtctttgatcaaattcttccatgctcagcacaatttcttccaagatggctggaaggccgcccaatccctgttccctttcattgagaaactggcggcatcagttcacgcccttcaccaagcgcaagaggacgaactacagaaattaacacagctgcgcgactcactgcgaggaactctgcagttggaatccagagaagaacacctgagtcggaagaattccggctgtggttactctatccaccaacaccagggcaataagcaattcggaacggagaaagtggggttcctttataaaaagtccgatggtattaggcgggtttggcagaaacgcaagtgtggagtgaaatacggctgtcttactataagtcattctacaatcaatcgacctcccgtgaaactgactcttcttacatgccaggtgcgacccaaccccgaagaaaaaaaatgcttcgatttagtgacacacaaccgaacatatcatttccaggccgaggacgaacacgagtgcgaggcttgggtgagcgtcctccaaaactcaaaggacgaggcgctgagcagcgcatttctgggcgaacctagcgcgggaccaggaagttgggggtcagctggacacgacggcgaaccacacgatcttacgaagctcctgatcgccgaagtgaagagtaggcccggaaactctcagtgttgcgattgtggcgcggccgaccctacatggctgtctaccaacctcggcgttctgacctgcattcagtgttctggagtacaccgtgagctgggagtgaggttcagtcggatgcagtcactcacactggatctactcggtccatcagaactgctgctggcgttgaatatgggcaacacttccttcaatgaagtgatggaggcacagcttccctcccatgggggtccaaagccctcggccgagtctgacatggggacacgccgagactacatcatggctaaatacgtggagcatcgcttcgcgcgcagatgtacaccagagccccagcgactatggacagccatctgtaatcgagacctgctcagtgttctcgaggcgtttgccaacggccaagattttggccagcccttgccaggccccgacgcccaggcacctgaagagctcgtactgcacctggcggtgaaagtggcaaatcaagcatccctcccactagtcgacttcatcatccaaaatggtggccatctggatgccaaggctgcagatgggaacactgctctgcattatgccgccctctataaccaacctgattgtcttaagctattgttaaaaggccgagccttggttggaaccgtgaatgaagctggtgagacagccctcgatattgcgcgaaaaaagcatcataaagagtgcgaggaactgttggagcaggcccaggctggcacattcgcctttccactacatgtggattatagttgggttatttctactgagccaggcagtgactcggaagaagacgaggaggaaaaacggtgtcttctaaaattgccagcacaagcccactgggcctcaggtagactcgatatctcaaataagacctacgaaacagtggcaagcctgggagcagcgactccccagggtgagagcgaggactgccctccccctctgccagtcaaaaatagctcgcggactttggtgcagggatgtgcaagacacgccagtggcgaccgctcagaggtcagctctctgtctagcgaggccccggagacgcccgagagtctcggctcccctgcctcatcttctagcctgatgtccccgttagagcctggtgacccatcccaggcccctcctaattccgaagagggactgcgagagccccccggtactagccggccttctctgacttcaggcacaaccccttcggaaatgtatctccccgtgagattcagcagtgagtctacccggagctatcggagaggcgccagaagccctgaagacggccctagtgctcgccagcctttacccaggcgcaacgtccctgtcggtatcactgagggggatggatcccgtactgggtccctccccgcaagctccgtgcagctcctgcaggattag

SEQ ID NO: 26357 - DNA, 522 bp, Artificial Sequence
  Description of Artificial Sequence: Synthetic coding sequence
atgccccggaagggcacccagcccagcaccgcccggcggcgggaggagggtcctccgccccctagtcccgatggggccagctcagatgctgagcctgagcccccaagtggcagaacagaatcaccagcaacggcagccgaaaccgcctccgaagaactggataaccgttccctcgaggagatcctcaacagcattcccccgccacctccccccgccatgaccaatgaagccggcgcacccaggcttatgattacacacatcgtcaaccaaaatttcaagtcatatgccggggagaagattctggggccttttcataaacgtttttcatgtatcatcggaccgaatggatctggaaagtccaacgttatagacagtatgctgttcgtgtttggttatcgggcccagaagatccggagcaagaagctgagtgtgcttatccacaactctgatgaacacaaggacattcagtcctgtaccgtggaggtgcacttccagaagattattgataaggagggcgactag

SEQ ID NO: 26358 - DNA, 2262 bp, Artificial Sequence
  Description of Artificial Sequence: Synthetic coding sequence
atgtacagccccatcatctaccaggccctgtgcgagcacgtgcagacacagatgagtcttatgaatgacctcaccagcaagaacatccccaacggtatacctgctgtgccctgccacgccccatcccattcagagtcccaggccacaccacacagctcctatgggttatgtacatccacgccggtgtggagcctccagcgccctccctgccccccgaaagtgcacagtgaagtacaaaccgacgggaattcgcaatttgcgtcccagggaaagaccgtgtccgctacctgcactgatgttcttaggaactcctttaacacgagcccaggagtgccatgcagcctccctaaaactgatatcagcgccatcccaaccctgcagcagctaggattggtaaatggcattctgccccagcagggtatccataaggagaccgacctgctgaagtgtatccagacatatttatcgctgttcaggtctcatggcaaggaaacccacttggattctcagactcacaggtcacctactcagagccagccagccttcctggctactaacgaagagaagtgtgctcgcgaacagattcgagaagcaacttcagaaaggaaagaccttaacattcacgtaagggataccaagactgtgaaggatgtgcagaaagccaaaaatgtgaataaaaccgccgaaaaggtcagaatcataaagtatctcctgggggagctgaaggctttggttgctgagcaggaggattccgaaatccagcgtctcatcactgagatggaagcttgcatttccgtcctgcccacggtctctggcaacacagacatccaggttgagatagcactggccatgcagccactgcgatctgagaacgcccagctcagacggcagttgagaatcttgaaccagcaactgcgggaacagcagaagacgcagaaacctagcggggctgtggattgtaacttggagctcttttcgctgcagtccttgaacatgagtcttcagaaccagctggaggagtccttaaagagtcaggagctgctccagagtaagaatgaagagttgctgaaggttatcgaaaatcagaaagacgaaaacaaaaagttctcaagcatcttcaaagacaaagatcagacaattctggaaaacaagcaacaatacgatattgagatcacacgcataaagattgagctggaggaagcactcgtgaatgtgaagagcagccagttcaagctggagaccgccgagaaggagaatcaaatcctgggcatcaccttgcggcagcgcgacgctgaggtgactaggttgcgcgaactgacccgtaccctccaaacgagtatggccaaattactgtccgatctgtcagtcgattcagccagatgtaagcccggaaataatctgacaaagtccctgttgaacatacatgacaaacagttgcagcatgacccggctcctgctcacacttcaatcatgtcctatctcaataaactcgaaacgaactactccttcacccactctgagccattgagcaccattaagaacgaggaaacaatcgagcccgacaagacatacgaaaacgtgttgtcttcacgcggtccgcagaactcaaatactagaggtatggaagaggcctctgccccgggtattatcagcgctctgagcaagcaggacagtgacgagggttccgagacaatggcactcattgaagatgagcataatttggataataccatctacattcccttcgctcgaagcacgccggagaaaaagtccccgctgtcaaaacgcctttcaccccagccccagattcgggctgctaccacgcagctcgtgtctaacagtggactggccgtgtctggcaaagaaaacaagctgtgtacaccggtcatttgctccagctcaacaaaggaagccgaagacgcccccgaaaagctgtccagggcatcagatatgaaggacacccagctcctcaagaagatcaaagaggccattggaaagattccagccgcaaccaaggagcccgaggagcagacagcttgccatgggccctccggctgcttgagcaatagcctacaggtgaaggggaacactgtgtgtgacggatcagtctttacatctgatttaatgtcagattggtcaatatccagttttagcacattcaccagcagagacgaacaggatttccgcaatggtcttgcggccttagatgccaatatagcccggctgcagaagtctctgaggaccggactactggaaaagtag

SEQ ID NO: 26359 - DNA, 219 bp, Artificial Sequence
  Description of Artificial Sequence: Synthetic coding sequence
atgatggaggagatcagcatcatggtggcctacgacgcccacgtgttttctcagctgcacgacgaggatttcctcacctcactcgtggcgattagcaaacccaggtcgatggtacccacaaagaagctcaaaaaatatgagaaggaatatcagacaatgcgtgaaagtcagctgcagcaggaggatccaatggacaggtacaaattcgtttacctgtag

SEQ ID NO: 26360 - DNA, 588 bp, Artificial Sequence
  Description of Artificial Sequence: Synthetic coding sequence
atgtggcacatgacccggaactggcccctggtgggcaagaccagcctcattactaggttcatgtatgacagcttcgataacacttaccaagcaacgataggcatcgacttcctatcaaagaccatgtacctcgaggaccgcacggtgcggcttcagttgtgggataccgctggacaggagcggtttcgaagtttgatcccaagttacattcgagactctactgtggcagtcgtggtgtacgacatcacaaatctgaactcctttcagcagacttctaagtggatagacgacgtcaggacggaaagaggatccgatgtgataatcatgctggtggggaacaagaccgatttagccgacaaacggcagatcaccatcgaagaaggagagcagcgagccaaggagctttctgtgatgttcattgagacttctgctaagaccggatacaatgtgaaacagctgttccgccgagtggcttccgcgctccctggtatggaaaacgtacaggagaagtctaaagagggaatgatcgacatcaaactggataagcctcaggagcctcctgcctcggaagggggatgtagttgctag

SEQ ID NO: 26361 - DNA, 1047 bp, Artificial Sequence
  Description of Artificial Sequence: Synthetic coding sequence
atgagcctgccccggttccagcgggtgaacttcggcccctacgacaactacattcctgtgtccgaactctcaaagaagtcatggaatcagcagcactttgcgctcttgttccctaagccacagcgccctggaacaaagcggcggagcaagcctagccagatacgcgataacaccgtctctattattgatgaagagcagctgcgaggagacaggagacagcccttgtggatgtatagatctctgatgcgtatcagtgaacgcccttccgtctatctggctgcacgacgccagcccttgaaacccaccaggacggtggaagttgattccaaggcagccgaaatcggcaaaaagggagaggacaaaaccacccagaaggataccacagattcggaatccgagttgaaacagggcaagaaggattcaaaaaaagggaaagacattgagaaaggcaaggaggaaaagctggatgccaaaaaggatagcaaaaaaggcaagaaagacgcggaaaaaggtaaagactctgccacagagtccgaggatgaaaagggaggggccaagaaagataataagaaagacaaaaaagactccaataagggaaaagacagtgctactgagtccgaaggtgagaagggcggcaccgaaaaggactccaagaaggggaagaaagactccaaaaaaggcaaggatagtgccattgaactccaggcagtgaaggccgatgaaaaaaaggatgaagacggaaaaaaggatgccaataagggcgacgaatcaaaggatgccaagaaggacgctaaggagatcaaaaagggcaaaaaggataaaaaaaaacctagtagtactgattccgacagtaaggacgacgtcaaaaaggaaagcaagaaggatgcgaccaaagacgcaaaaaaggtggcaaagaaagacaccgagaaagagtcagcggactcgaagaaggacgcgaaaaagaacgcaaagaaagacgccaaaaaggatgcaaagaagaatgcaaaaaaggacgagaaaaaagatgccaaaaagaaaggcaagtag

SEQ ID NO: 26362 - DNA, 2862 bp, Artificial Sequence
  Description of Artificial Sequence: Synthetic coding sequence
atgaagcggggcatccggcgggaccccttccggaagcggaagctgggaggtcgcgccaagaaagtccgcgaacccacagccgtcaattccttttacagggaggcctccttaccttcggtctgggctagcctccgcagacgggaaatggtgcggagcggtgcaagacctgggcaagtcctgtccagtggacggcataccgggcctgctaaactgactaatggcaagaaggccacatacctgcgaaagattccacgctttaacgccgatagtggatattcaatccacagcgattccgaatcccaggccgagacagtccacggcctggatggatgcgcatctttgctgcgggacatccttcggaatgaagacagcgggtccgagaccgcttatctggaaaacagatcaaacagcagacccctcgaatcgaagcgttatgggtcgaaaaagaagaggcatgaaaaacacaccattcctctggtggtgcagaaggaaacctcctcatccgacaataaaaaacagattcctaacgaggcttcggcccggagcgagagagacacctctgacttggaacagaactggagtctgcaagaccactaccgcatgtatagccccattatatatcaggctctatgtgaacacgttcagacacagatgtctcttatgaacgacttgacatcgaaaaacattcctaacggcatccccgcggtgccttgtcacgccccttctcactccgagtctcaggcaaccccccactcaagttatggcttgtgtaccagtactccagtctggagtctacagaggcccccatgccctcccaaggtccactcagaggtgcagaccgatgggaatagtcagtttgccagccaaggaaagacggtcagcgctacctgcaccgatgtgctgagaaacagctttaacacgtccccaggtgtgccttgttccttgccaaagaccgacatatccgcaatccccacactgcaacagctgggtttagtcaacgggatcttgccacagcaggggatccacaaggagaccgaccttctcaagtgtatccaaacttacctcagtcttttccgaagccatggtaaggaaacccacttggactctcaaacacatagatctccaacccagtcacaacccgctttcttggccactaatgaggagaagtgcgctcgggaacagatcagggaggctacgagtgaacgtaaggatttgaacattcatgtgcgtgacactaagacagtgaaggatgtccaaaaggctaaaaatgtcaacaaaactgcagaaaaagtgagaatcattaaataccttttgggagaattaaaagcgttggtcgcagagcaggaagactccgagattcaacgccttatcacggagatggaagcctgtatttctgtcctgcccaccgtctcgggaaacacggacatccaagtcgaaatcgctcttgccatgcagcccctgaggagcgaaaacgcgcagctgagaaggcagctccgcattttgaatcagcaactgcgcgaacagcagaagacacagaagccatccggcgcggtcgattgcaatctggagctgttctcccttcaatctctaaatatgagccttcagaaccagctggaagagtccctgaagtctcaagagcttcttcagtccaaaaatgaagaactgctcaaggtcatcgagaatcaaaaagatgagaataagaagttcagtagtattttcaaggataaagaccaaactattttggagaacaagcagcagtacgacatagagataactcgcattaaaattgagctggaggaggctctggtgaatgtaaagagctcccaattcaagttagaaactgctgaaaaggagaaccagattttgggcatcactctccgccagcgggatgccgaggtaacgcgactgagagagctgacccggaccctgcagacctcgatggcgaagctgttgtccgacctttctgtcgactctgctaggtgcaaacccggaaacaaccttacaaagtctctgctgaacatacacgacaaacaattacaacacgacccggcccccgcccatacgtctatcatgtcttatttgaataagctggagaccaattattcatttacccacagcgaacccctgtccacaataaaaaatgaggagaccattgaaccagataaaacttacgaaaatgttctcagctcacgtggtccccagaatagtaataccagaggtatggaggaggccagcgcacctggcattatttccgcactatccaagcaggattctgacgagggatccgagactatggctctgattgaggacgagcacaatttagacaacaccatatacatcccgttcgccagatcaacacctgagaagaagagccccctctctaagcggttgtcaccccagccacaaattcgagccgcgaccacacagctcgtgtccaactcgggtcttgcagtttccgggaaggaaaataagctttgtactcccgtgatctgctcctcatctacaaaggaagccgaggatgcccccgagaaactctcccgcgcctctgatatgaaagacacacagttactcaaaaagatcaaggaggctattggcaagattcctgcggcgacaaaggagcctgaggagcagaccgcatgtcacggacccagtggctgcctctcaaatagtctccaggtgaaaggcaacaccgtgtgtgacggaagcgtgtttacttctgacctcatgagtgactggtcaataagcagcttctcaacttttacaagcagggatgagcaggacttccgcaacggattggccgccttggatgcaaatatcgcacgactccagaagtcgctcagaactgggctgctggagaaatag

SEQ ID NO: 26363 - DNA, 1683 bp, Artificial Sequence
  Description of Artificial Sequence: Synthetic coding sequence
atgagcgagcacagccggaacagcgaccaggaggagctgctggacgaggaaataaacgaagacgagatcttggcaaatctgagcgccgaggaactgaaggaattgcaatcagagatggaggtcatggcccctgacccctctcttccagtgggaatgatacagaaggatcagaccgataagccccccacaggcaacttcaaccacaagagccttgtagattacatgtattgggaaaaagcttcgcgaagaatgcttgaagaagagcgcgtcccagtgacttttgtaaaatccgaagaaaagacacaggaagagcacgaggagattgaaaagagaaataagaatatggcccaatacctgaaggaaaaactgaataatgagatagtcgctaataagcgagaatcaaaagggtcatcgaacattcaggagacggacgaagaagatgaggaagaggaggatgatgatgacgatgatgagggagaagatgatggtgaggagtctgaggaaaccaatagagaggaggaaggaaaagcaaaagagcagatccgcaattgcgaaaataactgtcaacaagtgaccgacaaagcctttaaggaacagagggacaggcccgaggcccaggaacaatctgaaaagaagatatccaagctggatcccaagaaattggcactcgatacctcttttctcaaagtgtccacccgcccctccggtaaccagacagacctggatggttcactgagaagagtacgaaagaatgaccctgatatgaaagagctcaatctaaataatatagagaacatccctaaggagatgctgttagacttcgtgaacgcaatgaaaaaaaacaaacacattaaaacgtttagcctggccaacgtgggggccgatgaaaatgttgcatttgccctggcaaatatgcttcgggaaaacagaagtatcacaactctaaatatcgaatcgaacttcatcacgggtaaaggtatcgttgctattatgcgatgccttcagttcaacgaaactctcactgaactgcgcttccataatcagaggcacatgctgggccaccatgccgagatggagatcgctcgcctgctgaaggccaataatactttactgaagatggggtatcactttgagttgccaggtcctcgtatggtggtaacaaatctgctgacccggaatcaggacaagcagagacaaaaacggcaggaggagcagaaacagcagcagctgaaggaacagaaaaagctgattgcgatgctggaaaatggcctgggtctgccccccgggatgtgggagctcctgggtggcccaaagcctgactcacgtatgcaagaatttttccaaccccccccaccccgacccccaaacccacagaatgtgccattctctcagcgaagcgaaatgatgaaaaaaccaagccaggcaccaaagtaccggacggacccagactccttcagagtcgtgaagttgaagaggatccagaggaagagcagaatgccagaggcccgggagccaccagagaaaacaaacctgaaggacgtaattaagacattgaagcccgttccacgcaatagaccaccgccactcgtagagatcactcctcgtgatcagctgctgaatgacattcggcacagctcggtggcctacctaaagccagttcaactacctaaagagctggcttag

SEQ ID NO: 26364 - DNA, 153 bp, Artificial Sequence
  Description of Artificial Sequence: Synthetic coding sequence
atgcccgaggaccaggtgggcaagctggaggccaccgagaacaccatcagcgccatggccgcagccgcagcagagcagcaacagttctatctcctgctggggaatctgctctcacccgataatgtggtaaggaagcaagcggaggttacctag

SEQ ID NO: 26365 - DNA, 288 bp, Artificial Sequence
  Description of Artificial Sequence: Synthetic coding sequence
atggccatcggcaagcggctggccaccctgcccaccaaggagcagaagacccagcgactcatctcggaattgtctctgcttaaccataaactgcccgcgagggtgtggctcccgacggcgggatttgatcaccacgtggtgcgcgtccctcatacccaggctgtggttctcaactcgaaggataaagccccctacttgatctacgtcgaagtcctggagtgtgaaaatttcgatacaacatctgtgcccgctcggattcctgaaaacagaataagaagtacaaggtag

SEQ ID NO: 26366 - DNA, 1260 bp, Artificial Sequence
  Description of Artificial Sequence: Synthetic coding sequence
atggccggcagcggctgcgcctggggcgccgagcccccccggttcctcgaagcctttggacggttatggcaggtgcaatcccgtctagggagtggcagctctgcatccgtctaccgggtcaggtgctgtggcaacccagggtcaccacccggtgccctgaaacagtttttgcctcccggaacaactggcgctgctgccagcgcagcagagtacgggttccgtaaagaaagggcagctctggaacagttgcagggtcatcgaaacatcgtcacgctgtatggcgtctttaccatacatttcagccccaacgttccatcaaggtgccttctgctggaactgctcgatgtgtccgtttctgagttattactgtatagcagccaccagggctgtagcatgtggatgatccagcattgcgccagagacgtgctggaggccctagccttcttgcaccacgagggctacgtgcacgccgatctcaagcctcgcaatattttgtggtctgcagagaacgaatgttttaagctgattgactttgggctgtcttttaaggagggcaatcaggatgtcaagtacatccaaactgatggataccgggctcctgaagccgaactccagaactgcctggcacaggccggactgcagtccgacaccgaatgcactagtgccgtagacctctggtcactgggcatcatcctgctggagatgtttagtggcatgaagctgaaacacactgtcaggtctcaggagtggaaggcaaactcttcagctatcattgatcatattttcgcttctaaggccgtagttaacgctgcaattccggcataccatcttagggacttgatcaagtctatgcttcacgacgatccttccaggcgcatacctgccgagatggcactatgttcacccttcttcagcatcccctttgcacctcatatcgaggatctggtgatgcttccgactcctgtgttgaggctgcttaacgtgctggacgatgattatctcgaaaacgaggaagagtatgaggacgtggttgaagacgtaaaagaagaatgccagaagtacggtcccgtggtgtccctgctagtgccgaaggagaatcccggacggggacaggtcttcgtggagtacgctaatgcgggcgactcgaaggcggcccagaagctcctcactggacgaatgttcgatgggaagtttgtggtggcaacattctacccactttctgcttataaacgggggtatttatatcagacactgttatag

SEQ ID NO: 26367 - DNA, 1272 bp, Artificial Sequence
  Description of Artificial Sequence: Synthetic coding sequence
atgccccggaagggcacccagcccagcaccgcccggcggcgggaggaaggaccccccccaccttctccggatggagcctctagtgacgcagagccagagcccccatccggaagaaccgaaagtccagcgaccgctgcagagacggctagtgaagaactcgacaataggtcccttgaggaaatactcaatagtattccgccgccgccccctcccgcgatgactaacgaagccggcgcacctaggctcatgatcacacatatcgtgaaccaaaactttaaatcttacgccggagaaaagatacttgggccttttcacaagcgcttctcatgtatcattggacctaatggttccggaaagagtaacgtcattgattctatgttatttgtgttcggctaccgggcccagaagatcagatcaaaaaaactgagcgtactgatacacaattccgacgaacacaaggacatccagtcctgcactgttgaagtgcactttcagaaaattatagacaaggagggggacgattacgaggttatcccaaactccaacttctatgtgagtcgcactgcttgtagggacaacacctccgtgtaccacataagcggcaagaaaaagacatttaaggatgttggaaatctactgcggagccatggaatcgatctggaccacaacaggtttctgatactgcagggcgaggtcgagcaaatcgctatgatgaagcccaagggtcagacagagcacgatgaggggatgttggaatacctggaagacataatcggatgtggacgacttaatgagccaatcaaggtgctctgtaggagggtggaaattcttaacgagcacaggggcgagaaattgaaccgcgtaaagatggttgagaaggaaaaagacgcacttgagggtgagaagaatatcgccatagagttcctgactctcgagaatgagatcttccgaaaaaagaatcacgtgtgccagtactatatttacgagttgcaaaaaagaatagcagaaatggagacgcagaaggaaaaaattcatgaggacaccaaggagatcaacgaaaaatccaatattctatcaaacgaaatgaaggcaaagaacaaagatgtcaaagatacagagaaaaaactgaataaaataacgaagttcatcgaggaaaataaagagaagtttactcagttggacttggaagatgtgcaagtgcgtgagaagttgaaacacgccaccagtaaggccaaaaagttggagaagcaactgcaaaaagacaaagaatag

SEQ ID NO: 26368 - DNA, 1113 bp, Artificial Sequence
  Description of Artificial Sequence: Synthetic coding sequence
atggaggagggcgtgccctgccccgcccccgccgccaagctgacccctcccgttaagaagtcacaggatatgcatgacgaacgaagcaagctggtaaatgagtatgcttgccgagtgctggagctgctgggaatgggccaccgcctcttcgttccccgcctcctggccacttccaaggaggatctgctccaggcagactttgaaggagccctcaagttttttagggtacagctgccgaagagataccgggcggaagagaacgctcgcagactaatggagcaagcctgcaatatcaaggtacccactaagaaattaaagaagtacgagaaagagtatcagactatgcgggaaagccagttacagcaggaggaccccatggataggtataagagggagaacagaaggttgcaggaggccagtatgaggctggaacaggagaacgacgacttggcccatgagctggtgacatccaaaatcgcactgagaaacgacttagatcaggctgaagacaaagcggacgtcctgaataaagagctgcttctgactaaacagcgacttgtcgagacagaggaggaaaaacgcaagcaggaagaggagaccgcacaactcaaggaagtttttaggaaacaactggagaaggctgagtatgagattaaaaagaccactgcaattatcgcggagtataagcagatctgcagccaactgtctacgcgcctcgaaaagcagcaggctgcttctaaggaagagctggaagtggttaaaggtaagatgatggcctgtaagcactgctccgacatcttttctaaagaaggagccttgaaactcgccgcgacagggagagaggaccaggggatagaaacagatgacgagaaggattccctgaaaaagcagctgagagaaatggagctggagctggcccaaaccaaattgcagctggtggaggctaagtgtaaaatacaggagctggagcaccagcggggagccctgatgaatgaaatccaggccgctaagaactcctggttcagcaaaacactgaattctatcaagactgcaacgggaacacagccactacaacctgcccctgtgacgcaaccacctaaggagagtacatag

SEQ ID NO: 26369 - DNA, 2262 bp, Artificial Sequence
  Description of Artificial Sequence: Synthetic coding sequence
atgtacagccccatcatctaccaggccctgtgcgagcacgtgcagacacagatgtccttgatgaatgatctgacaagcaagaacatccctaacggtattccagcggtgccctgtcacgcaccgagtcacagcgagagccaggctacccctcactcttcctacggtttgtgcacttccactcctgtgtggagtctgcagaggcccccgtgtcctccgaaggtgcactccgaagtacaaaccgacggcaacagccagtttgcatctcaaggtaaaactgtttccgcaacctgtactgacgttttgcgcaattcttttaacacttctcccggcgtaccgtgctccctgccaaagaccgacatcagcgccattccaacactgcagcaactagggctggtgaacggcattctgccgcagcagggaatccataaagagacggacctcctgaagtgtattcagacatatctctctctatttcgctcacacggcaaagagacccaccttgacagccagacgcaccgaagcccaacacagagccagccagcttttctggccacaaacgaagaaaagtgcgcaagggaacagattcgcgaggccacctctgagcgaaaggacttaaatatccacgtcagagatactaaaacagtaaaagatgttcagaaggctaagaacgtcaacaagacagcggagaaggtgaggattatcaaatatttacttggagagctgaaggccttagtcgcagagcaagaggacagcgagattcagcggctcattaccgagatggaggcgtgcatcagcgtgttgcccaccgtgtcaggcaacacagacatccaggtcgagatcgccctggcaatgcagccgctccgcagcgaaaatgcgcagttgaggcgccaactccgaattctaaatcaacagctacgagagcagcagaagacccagaaaccatcaggagcagtggactgtaatctagaactgttttctctccagagcctgaacatgtccctgcagaatcagcttgaggaatcattgaaatcacaggagctgctgcagtctaagaatgaagagctcttaaaagtgatcgagaaccagaaggatgagaacaaaaagtttagctccatatttaaggacaaagaccagacaattctcgaaaacaagcagcagtatgacattgaaatcacacgaattaaaattgagctcgaagaggccctggtcaatgtgaagtcttcccagttcaaactggaaacggccgagaaagaaaaccaaatcctgggtattactttaagacagcgcgacgccgaagtgaccaggctgcgcgagttaacgcgcacactgcaaaccagtatggctaagctcctctctgaccttagcgttgatagtgccaggtgcaaaccagggaataatctgaccaaaagtctgctgaacattcacgacaaacagttgcaacacgatcctgcccccgcgcacacgtcaattatgtcatacctcaacaagctagagacgaactatagtttcacccatagcgaaccactgtccaccatcaagaacgaagaaaccatcgagccagataagacctatgagaacgtcctcagttccagaggtccgcaaaactccaacactcgggggatggaggaggcaagtgcccccggtatcatcagcgcactttccaagcaggattccgatgagggtagcgaaacaatggcactgatcgaggatgaacataacctggataataccatttacatcccttttgcaaggagcacgcccgaaaaaaagagccctctgtccaagagactgagtcctcagcctcagatccgtgctgcgacaactcagttggtgtccaactctggactggccgtgagcgggaaggaaaacaaactgtgtacccccgtcatatgctccagtagcaccaaagaggccgaggacgcaccagaaaaactctcccgcgctagtgatatgaaggacacacaattactgaagaaaattaaagaggcaataggtaaaattcctgccgcaacgaaagaacctgaagagcagaccgcttgtcacggaccctcggggtgtttaagtaatagcctgcaagtaaagggcaacaccgtgtgtgatggctccgtgtttacgtctgatctcatgagtgactggtcaatctcatcattttccaccttcaccagccgcgatgagcaggattttcgtaacggcctggctgcgttagacgccaacatcgccagactgcagaaatctttacgcactgggcttctcgaaaaatag

SEQ ID NO: 26370 - DNA, 2067 bp, Artificial Sequence
  Description of Artificial Sequence: Synthetic coding sequence
atgagcgtgaacagcgagaagagcagcagcagcgagcggcccgagccgcagcaaaaggctcccctggtaccccccccacctcccccccctccacctccacctccgccacttccagatcccacgccacctgaaccggaggaggagatcttaggaagtgacgatgaagaacaggaggatcccgcagactattgtaaggggggttatcaccctgtcaagattggggacctgtttaacggtagatatcacgtgatccggaagttagggtggggtcatttctcgacagtgtggctttgttgggatatgcagggcaaaaggtttgttgccatgaaagtggttaagtcggcacagcattataccgaaacagcactcgatgagatcaagcttttgaaatgtgttcgagagagcgacccatctgatcctaacaaagatatggtcgttcagttaatagatgattttaaaatctcaggcatgaacggtattcatgtgtgcatggtcttcgaggtgctcggtcatcacttgctgaaatggataataaagtccaactatcaggggctgcctgttaggtgcgtaaaaagtatcattagacaggtcttgcagggtctcgactacctacatagcaagtgcaagatcatccacacagacattaagcctgagaacatcctgatgtgcgttgacgatgcgtacgtcaggcgtatggctgctgaggcaaccgagtggcagaaggcgggcgctccccccccctcgggctctgcagtgtctactgccccgcagcagaagcccatcgggaagatcagtaaaaataaaaaaaagaaactgaagaagaagcagaagaggcaggccgagctgctggagaagaggcttcaggagatagaagagctggagagagaggccgaaagaaaaatcattgaagaaaacataacaagcgcagcaccctcgaatgatcaggacggggaatattgtccggaagttaagctgaagactacaggcctggaggaagcagcggaagcggagaccgccaaagataatggtgaagcagaggaccaagaagaaaaggaggatgccgaaaaagagaacatcgaaaaagacgaggatgacgtagatcaagaactggcgaatattgaccccacctggattgaatctcctaaaacaaacggtcacatcgagaacgggccgttttctctcgaacagcagttggatgacgaggatgacgatgaggaggactgccccaacccagaagagtacaatctggatgaacccaatgctgagagcgattacacatattctagctcgtacgagcagttcaacggggaattgcctaatggccgccacaagatccccgagagtcagttccctgagtttagcacaagccttttctccggatccctggagccagtagcgtgtggctcagttctttctgagggatcccccctcaccgaacaggaagagtctagtcccagccatgatcggtcacgcaccgtgtctgcgtccagcactggcgatctgcctaaggccaaaaccagggcggctgacttgcttgttaatcccttggatcccagaaacgccgataaaatccgcgtaaagatcgcagatctgggcaacgcgtgctgggtccataagcacttcaccgaggacatccagactcgacagtatagatctatcgaggtacttatcggggcaggatattcaacacctgcggacatctggtctactgcttgtatggctttcgaacttgcaacaggtgattacctttttgaaccacactccggcgaggactactccagggatgaggatcatatcgctcacatcatcgagctgctggggagcatccctcggcattttgctctatccgggaagtactctcgtgagttcttcaatagacgcggagaattgcggcacatcactaaactgaagccgtggtcccttttcgatgtcctggtcgaaaaatacggttggccccacgaggacgcagcccaattcacagactttctcatccctatgctggagatggtgcccgaaaaaagagcatcagccggcgaatgtctgaggcatccttggctgaactcatag

SEQ ID NO: 26371 - DNA, 543 bp, Artificial Sequence
  Description of Artificial Sequence: Synthetic coding sequence
atgccccggaagggcacccagcccagcaccgcccggcggcgggaggagggacccccccctccctcgcctgatggtgcctctagcgacgctgaacccgaacctcccagcgggaggaccgaaagtcctgccaccgccgctgagactgcctctgaggagttggacaaccggtcactggaggagattctgaacagcatcccaccacccccccctcctgcaatgaccaatgaagcaggagcgcctcggctgatgattacccacattgtcaatcaaaattttaagagctatgcaggggaaaagatcttgggtccttttcataagcgcttctcatgcatcattgggccaaatggttcaggaaaatcaaatgttatcgactcgatgctgtttgtgtttggttatagggctcaaaaaatacggtccaagaaactgtctgtactgattcacaacagtgacgagcacaaggacatacaatcctgtacagtagaggtacactttcaaaagataatcgacaaggagggtgatgactacgaagtgattcccaattag

SEQ ID NO: 26372 - DNA, 4689 bp, Artificial Sequence
  Description of Artificial Sequence: Synthetic coding sequence
atgcccggcgaggccgcccgggccgagctgctgctgcccgaggccgataggccgggtccacgtactgacctgagttgcgatgcagcagccgccactaccattctcggaggggacagaagggagccgtgtgccttgacaccgggcccaagccacttggcccttacattcttaccatccaagccaggcgctcgacctcagccggaaggcgcaagctgggacgccgggcctggaggagcaccatccgcatgggctgacccaggagagggcgggcccagccctatgctccttccagaaggacttagttcccaagcgctgtcgaccgaagcgccactcccagcaactctggagcctaggattgtgatgggagaggagacctgtcaagcgctgctgtccccgcgagcggccaggacagcactccgtgaccaggaggggggccacgcctcaccggacccaccaccggagctgtgcagccagggggacctgagcgtgccaagtcctcctccagatcccgatagcttctttacccctcccagtacgcctactaagaccacatacgctcttctgccagcttgcgggccacatggagacgctcgagacagcgaggctgagctgcgcgacgagctgctcgacagcccccccgcttccccgagcgggagttacattaccgcggatggcgattcttgggctagcagccccagttgtagcctatccctacttgctccagccgaggggttagacttcccctccggatggggcctgtccccccaggggtctatggttgacgagcgagagctccatccggccggaactccggaaccaccctccagtgagtccagcttgagtgctgattcctcttcctcttgggggcaggaggggcacttctttgacctcgacttcttggcaaacgatcccatgatccccgcggctttgctgccctttcagggatccctgatcttccaagtggaggccgtggaggttactcctctgtctcctgaagaagaagaggaagaagcagttgcggaccccgaccccggaggtgacttggccggcgaaggcgaagaggactcaacctctgcctccttcctgcagtcactctctgatctgagtattactgaggggatggacgaggcatttgcgttcagggatgatacatctgctgcatcctctgacagtgattctgctagctatgccgaggccgacgatgaaagattgtacagcggagagcctcacgcccaagccactttgctccaagactccgtccaaaagacagaagaagaatccggcggaggcgcgaaaggactgcaggcccaagacggtactgtgtcctgggccgttgaggccgcacctcagacatcagaccgcggagcatatctgtcccaacgtcaagaactgattagtgaggttacagaagaaggtttagccctcggacaagagagcacggctacagttacccctcacacgctccaggtggccccagggctgcaagtcgaagtggcaaccagagtgactccccaggctggagaggaagagactgatagtaccgcgggtcaggagagcgcagcaatggccatgcctcagccatcccaggagggaatttctgaaattctgggacaagagagtgtgaccgccgagaagctccccacgccacaggaggaaacaagtctcacactgtgccccgactcgcctcagaatctcaaggaggagggcggtctggacctaccctctgggcgtaagcccgtggctgccgccacaatcgttcctcggcaggcgaaggaggacttgactttgccccaagatagcgctatgactccacctttacctttgcaggacactgatctgtcaagcgctcctaagcctgtcgcagccgccaccatcgtcagccagcaggcagaggaagggctaaccttgcctcaggacagcgtgatgacgccaccacttcccctgcaggacactgagctctcatcagctcccaaaccggtcgccgcggcgacccttgtaagtcagcaggcggaggaaggcctgacattacctcaagactcagccatgaccccccccctccccctccaggacactgatctgtcttctgccccaaagcctgttgccgcggccactctagtgtcgcaacaagctgaagagggtctgactctgccccaagatagtgctatgactcccccgctgccattgcaagacactgatctttcgtctgccccaaagcctgtagcagcggccacgctggttagtcagcaagcggaggaaggacttactctcccccaggatagtgcgatgactcctcctctccccctccaggatacggatctatcaagcgccccaaaacctgttgccgcagccaccattgtgagccagcaggccgaggaaggtctgacactgccacaagattcagctatgaccccacccctacctctacaagatacggacctctcttctgctcctaagccggtggctgccgcaaccatcgtgagccaacaggctgaagagggccttacactgccgcaggactccgctatgacaccaccactcccgctccaagataccgacttgagctccgcaccaaagcccgtagccgcagctaccccggttagccagcaggcagaagagggtcttactttaccccaagatagtgcaatgacaccacctctccccctgcaggatacagacctgagttcggccccaaaacctgtcgccgccgccacaccagtgtcacagcaggcagaggaaggcttgaccctgccccaggattcagctatgaccgcccctctccctttgcaggataccggccccacgtcagggcccgagccattggccgttgcgacgcctcagacactgcaggcagaggctggctgtgctcccggaacagaaccggtggctactatggcacagcaggaggtgggggaggcattaggcccgaggccggcaccagaggaaaaaaacgccgcactgccaactgtgcccgagccggcagccctggatcaggtccagcaggatgacccccaaccggccgccgaggccgggacaccctgggcagcgcaggaggacgcggatagcacactgggcatggaggccctgagcttgccagaaccggcatccggagctggagaagaaatcgcagaagccttgtcgcggccaggtagggaggcatgcttagaggcccgggctcataccggagacggcgctaaacctgactccccacagaaagagactctcgaggtggagaaccagcaggagggcggtctcaagccactagcccaggagcatggacctcgttcagccttgggcggagcaagagaagtgcccgacgctcccccggcagcttgtcctgaggtgagccaggcaaggctgctgtctcccgccagggaggaacgcggcctaagcgggaaatctacccctgagcccaccttaccctctgcggtagctaccgaggccagcctggactcctgccctgagagctcagtaggcgccgtctcaagcttggacagaggttgcccagacgctcctgctccaaccagcgcccccacgtcccaacagcccgaaccagtactgggtctgggaagcgtggagcagccacacgaagtgcccagcgtcctgggaaccccccttctgcagccgcctgagaatctggccaaaggtcagcccagtacccccgtagaccggcctctgggaccagatccatcagcccctggtacgctcgcgggtgctgcacttcctccattagagccccctgccccctgcctttgccaggatccccaggaggattctgtagaggacgaggaacctccgggatccctcgggcttccgccaccccaggcgggtgtccagcccgctgccgcagctgtctcgggaaccacccagcccttgggcactggcccccgggtcagtcttagcccacattcacccctgttgtctcctaaagtcgccagcatggacgccaaagatcttgcactacagatcctgcctccatgccaagttccccccccctcgggtccgcagtctccagccggcccccaaggactgtctgcgcccgaacaacaagaggatgaggactcactcgaggaagactcaccccgagcgctgggatctggacagcactcagactctcatggggagtcatcagccgagctagacgagcaggacattcttgctccccagaccgtacagtgccctgcgcaggctccggctggaggctcggaagagacaatcgcaaaagccaagcagtcccggagcgagaaaaaagctaggaaggctatgagtaaacttggccttcgccaaattcagggagtcacacggataacaattcagaagagcaaaaatattctgttcgtgatagctaaacccgacgtctttaagtctcctgcatcagatacttatgtcgtgttcggagaagcaaaaattgaggacctgagtcaacaggtccataaagcagcagcggagaagttcaaggtccccagcgaaccatctgcgttggtacccgaaagcgctccccggccacgcgttaggctcgagtgtaaggaggaggaggaagaagaagaggaggaagtcgatgaggccgggcttgagctgagagacatcgaactggttatggcccaagccaatgtgagccgtgccaaagctgtccgcgcgctgcgcgacaatcattctgatatcgtcaacgctatcatggagctgactatgtag

SEQ ID NO: 26373 - DNA, 3294 bp, Artificial Sequence
  Description of Artificial Sequence: Synthetic coding sequence
atggccgccgccgccgccgagcagcagcagttctacctgctgctggggaatctcctaagccctgacaatgtggttcggaagcaggctgaggagacgtacgagaatattcccggccagtctaaaattacttttctgctgcaggccatccggaatacgacagcagcagaggaagcacggcagatggccgccgtgctactgcggagactgctgtcgtccgcattcgacgaagtctatccagctttgcccagcgatgttcagacagccatcaagagcgagcttctaatgatcatacagatggaaacacaaagttctatgcgcaaaaaggtatgtgacattgccgcagaacttgctaggaatctcatcgatgaagacggaaacaaccagtggcccgagggtctcaaattcctgtttgacagcgttagcagtcagaatgtgggactgagggaggctgctcttcatatcttctggaactttccaggcatcttcgggaaccagcagcagcattacctcgacgtaatcaaacgcatgttagtgcagtgcatgcaggatcaggaacacccatctatacggacactatccgcacgggcaacggctgcctttatccttgcaaacgagcacaatgtggcattgttcaagcattttgccgaccttcttccaggattcctacaagctgtaaatgattcatgctaccagaatgatgactctgtgctgaaaagcctcgtggagattgcagacacagtgcccaagtatttacgacctcacctggaggcgacacttcaactgagcctgaagctttgtggggatacctccctgaataacatgcagcgacagttagcgctggaagtcatcgtgacattaagtgagaccgccgccgccatgctcaggaagcatactaatatagtcgctcagaccattcctcagatgctagctatgatggtggatttagaagaggatgaagactgggcaaatgcagacgagttggaagacgacgatttcgattcaaatgcagtggctggcgaatccgcacttgataggatggcctgtggcctcggcggtaagctcgtgcttcctatgataaaggagcatattatgcagatgctacagaaccctgactggaaatatcgacatgctgggcttatggcactgagcgcaataggggagggttgtcaccaacagatggaggggatccttaacgagattgtgaacttcgtcttactcttcttgcaggacccccaccctagggttcgctacgctgcctgcaacgctgtcgggcagatggcaactgactttgcccccggatttcagaaaaagtttcatgagaaagtcatcgctgctctgctgcagacaatggaggatcagggcaatcagagggtgcaggcgcacgctgctgccgctttaatcaatttcactgaggattgtcctaaatcattactaatcccgtatctcgataaccttgtgaagcacctgcactcaattatggtactgaaactccaggaactgattcagaaaggtaccaagctggtccttgaacaggtggtgacgtcaattgcctctgtggccgataccgccgaggaaaaatttgtcccctattatgatctgttcatgccgtctcttaagcatatcgtagagaacgccgtccagaaggagttgcgccttctcagagggaaaactattgagtgcatatcactgatcggacttgccgtgggaaaggaaaagtttatgcaagatgcttctgatgtgatgcagcttctcctcaagacccaaactgactttaatgatatggaagacgacgacccgcagataagttacatgatatcggcttgggcgcgtatgtgtaagattcttgggaaggagttccagcagtatctcccggttgtgatgggaccgctgatgaagacagcctctatcaagccagaagttgctctgttagacacacaggacatggaaaacatgagtgatgacgacggctgggaatttgttaacctaggggatcagcagagttttggcataaagacagcaggtctagaagagaagagcaccgcatgtcagatgttggtctgttatgcaaaagagctgaaggaaggctttgttgagtacactgaacaggtggtgaagttgatggtccccctgctcaaattttattttcacgatggcgttcgggttgccgctgctgagtctatgccattgctgctcgagtgtgcacgggtccgaggaccggagtatctgacccagatgtggcacttcatgtgcgacgcacttattaaggctattggcacagagccggactccgacgtccttagcgaaattatgcacagcttcgcaaaatgcattgaagtcatgggggatggatgtctgaacaatgaacatttcgaagaattaggagggatcctgaaagctaagctggaggaacatttcaagaaccaggagctgaggcaggttaaacgacaggatgaggattacgatgagcaagtggaggaaagcctccaggatgaggatgataacgacgtctacattctcacaaaggtttcagacatccttcactctatctttagcagttacaaggaaaaagtactgccctggttcgaacagttacttccgcttatcgtgaatttgatttgtcctcacagaccctggcctgacaggcagtggggtctgtgcatttttgatgacgtgattgaacattgtagccccgcgtcttttaagtatgccgagtactttctaagaccaatgctgcaatatgtgtgcgataactccccagaggtgcggcaggccgccgcgtatggcctgggcgtgatggctcagtatggcggcgataactacaggcctttctgcactgaagcactgccgctactggtgcgagtgatacagagcgcggactcgaagacaaaggagaacgtcaatgcaactgagaactgcattagcgcagtgggaaagataatgaagttcaaaccagactgtgtgaatgtggaggaagtactgcctcactggctctcgtggcttccactccacgaggacaaggaggaagccgtgcagacttttaattatctttgtgacctgattgaaagcaatcaccccatagttctggggccaaacaacactaacttacctaagattttctctatcatagcagaaggagaaatgcacgaggccattaagcatgaagacccctgcgcgaagaggttagcaaacgttgtgcgtcaagtgcagacctctggcgggctgtggactgaatgcatcgctcagttaagtccggaacaacaggcggctattcaggaactgctgaattctgcttag

SEQ ID NO: 26374 - DNA, 1011 bp, Artificial Sequence
  Description of Artificial Sequence: Synthetic coding sequence
atgaaggccaccgccatgaccagcgcctggctggcccagggcggcgctcacgtgaccattaatgcccgcgcagaggaagatgtggagccggagtgcataatggagaaggtagccaaggcctccggcgctaattactctttccacaaagagagtggccggttccaggacgtgggaccgcaggccccagttggatccgtgtaccaaaagactaacgctgttagtgaaattaagcgcgttggaaaagatagtttctgggctaaagcggaaaaagaggaagagaacaggaggctggaggagaaacgtagggcagaagaggctcagaggcagcttgagcaggagcggcgcgagagggaattgcgcgaagccgccagaagagaacagagatatcaagagcagggcggggaagctagcccacagagcaggacatgggaacagcagcaggaagtagtgtctaggaacaggaatgagcaggagagcgcagtgcatccccgtgaaatttttaagcagaaagagcgtgcaatgagcacaacctctatttcttcccctcagccaggcaagctgagatctccttttttacagaagcaactcacacagcccgaaactcatttcggtagagaacctgccgctgctatttcccgccccagggccgatctgcccgccgaggagcccgctccaagcactcccccctgcctcgttcaggctgaggaagaggctgtttatgaagaacccccggagcaagagactttctacgagcagcccccacttgtgcaacagcagggagcaggatctgaacacatcgatcatcacattcagggccaggggctatccggccaaggtctctgcgcccgagccttatatgactatcaggctgcggacgatacagaaatcagcttcgaccctgaaaacttaataaccggtatcgaagtaattgatgaaggctggtggcgagggtatggccccgatggacacttcggcatgtttcccgctaactacgtggagttgatcgagtag

SEQ ID NO: 26375 - DNA, 78 bp, Artificial Sequence
  Description of Artificial Sequence: Synthetic coding sequence
atgtggatgcacgtggccaaggtgcaccccaagggcggcgagatggtgggcgcgattcggaatgcagctttcttatag

SEQ ID NO: 26376 - DNA, 312 bp, Artificial Sequence
  Description of Artificial Sequence: Synthetic coding sequence
atggccgagctgatccagaagaagctgcagggcgaggtggagaagtaccagcaactgcaaaaggacctttccaaaagtatgtcgggaagacagaagctggaggcacagctcacagagaataatattgtgaaggaagaattagcgctgctggatgggtctaatgtcgtgttcaagctcctcggccccgtccttgttaaacaagagctcggcgaagcaagggcaaccgtgggaaagcggctggactatataacagctgaaattttcctgcgcacaatcccggatcccggggacgttcctgactcgtttttctag

SEQ ID NO: 26377 - DNA, 4101 bp, Artificial Sequence
  Description of Artificial Sequence: Synthetic coding sequence
atggccgacaccgacctgttcatggagtgcgaggaggaggagctggagccgtggcagaaaatatctgacgtcatagaggactcagtggtagaggactacaattccgtggacaagacgactacagccggaaatccactggtgcaacagggcggtcaaccgctaatactaacccagaatcccgctcccggcctgggtacgatggtgacacagccggtcctgcggcccgtgcaggtgatgcagaatgctaatcatgtgaccagctcccctgtggcctctcagccaatctttataacgacacagggttttccagtcaggaatgtgagaccagtgcagaatgctatgaaccaggtggggatcgttctgaatgttcagcagggtcagacagtccgcccaataacattggtgcctgcacctggaacacagttcgtgaagccaacagtcggggttccacaagtcttcagccagatgacccctgtgcggccaggttccactatgcccgttagacccacgaccaataccttcacaaccgtgattcctgcgacgctcacaattcgcagcacggtgccacagagtcagagtcagcagacgaagtctacgccgagcacaagtaccacccctacagcgactcagcctactagcctgggtcagcttgctgtgcagtcgcctgggcagtctaatcaaaccacaaaccctaagctcgctcctagctttccatctcctcccgcagtgagcatcgccagcttcgtgacagtaaaacggcccggtgttaccggcgaaaatagcaatgaggtggccaaactcgtaaatacactcaatacaataccaagccttggacagtcccccgggcccgtggtcgtgtcgaacaattcctcagcccacggcagtcagcggacctcagggccagaaagttcgatgaaagttacatcttcaattccggtgttcgacctccaggacggagggcgcaagatctgtcctcgctgcaacgcccagttccgagtgactgaggctctacgtggacacatgtgttattgctgtcccgagatggttgaatatcaaaaaaaaggcaaaagcctggacagcgagccgtccgttcctagcgcagccaaacccccaagccccgaaaagacggcaccagtcgcatcaactccctcaagcacgccaataccagctctgtcgcctcctaccaaggtgcccgagcccaacgagaatgtaggcgatgccgtgcagacgaaactgatcatgcttgttgacgatttttactacggacgcgacgggggaaaggtggcccaattaaccaactttcctaaggtggctacctcctttcgatgcccccactgcactaagagactgaaaaataacatccgcttcatgaatcacatgaagcatcacgtcgagctcgatcagcagaatggggaagtggacggtcataccatttgccagcactgttacaggcaattcagcacgccgttccagctgcagtgtcaccttgaaaatgtgcattccccatacgagtcgacaactaagtgtaaaatctgcgagtgggccttcgagtccgagcccctgttcctacaacatatgaaagatacccataagccaggcgaaatgccgtatgtgtgtcaaccttacttcccaagctacgtcacacaggtttgccagtaccgcagctctctctattcagaagttgatgtgcatttccgcatgattcatgaagacacaagacacttactctgcccctactgcctgaaagtgtttaaaaatggcaatgccttccagcagcattacatgcggcatcagaaacggaatgtctatcactgtaacaaatgcaggctgcaattcctttttgccaaagacaagatcgagcacaagctgcaacatcacaagactttccgtaaacctaagcagcttgaaggcctgaagccaggcacgaaagtcacaatacgtgcctctaggggacagcccagaacagtgcccgtgtcctcaaatgacacaccccctagcgctctgcaagaagccgcccctttaacgagttccatggacccgctgccagttttcctctaccctccagtccaacgatctattcaaaaacgcgcggtgcggaaaatgtccgttatgggccggcagacttgtctggaatgctcattcgagattcctgattttccgaaccatttcccaacatatgtacattgctcactttgtagatactccacttgctgcagcagggcttacgcaaaccacatgattaataatcacgtgcccagaaagtcccctaaatacttagccctgtttaaaaattcggtcagcggcatcaaactcgcttgtaccagttgcaccttcgtcacttcagtgggcgatgctatggcgaaacatctggtctttaatccttcacaccggagcagctccatcttgcctcgggggctgacttggatagctcactcacgccatggccaaaccagggaccgggtgcacgatcggaatgtgaagaatatgtaccctccaccatctttcccgaccaacaaagcagccactgtgaagagcgctggagcgacacccgccgaacccgaagagctgctgacccccctggcccccgctctcccaagcccagcctctaccgcgacacccccacctacacctacccacccccaggccctcgcgctgccccctttggccaccgagggtgccgagtgtctgaatgtcgacgaccaggacgagggctcacctgtcacacaagaaccagagctggcttcaggcggaggcgggtcgggaggtgttgggaaaaaggaacagctttcagtaaagaagcttagagtcgtgctgtttgcactttgctgtaacaccgagcaggccgctgagcactttcggaacccacaacgaaggattcgtcgctggctgcgccggttccaggcatcccagggcgagaacctggagggaaagtatttgagttttgaggcagaggagaagcttgctgagtgggtgctgactcagcgcgagcagcagctcccggtcaatgaagaaaccctgttccagaaggctactaaaattggacgatcacttgagggtgggtttaagattagctacgaatgggccgtgagattcatgcttagacaccacttgaccccacacgcgcgcagagcagtagcacacactctgcccaaagatgtggctgagaacgccggactcttcatcgacttcgtgcaacgccagatccataatcaggatctgcctctttccatgatcgtcgccatcgatgaaatctcactgttcctagatactgaggtgctgagtagcgacgaccggaaagaaaacgcacttcaaaccgtgggaaccggcgagccctggtgtgacgttgtcttagctatcttagcggacggcactgtactgccaactcttgttttctatcgaggacagatggaccagcctgctaacatgcctgattccattctcttggaagccaaagaaagcggctactccgatgacgaaattatggaactgtggtccacccgcgtatggcaaaagcacactgcctgccaacggagtaagggcatgttagtaatggattgccatcgcacacacctgtcggaagaagtcctggctatgctttccgcaagctccacccttccagctgttgtgccagccggctgcagtagcaaaatccagccactggacgtctgcattaaaagaacggtgaagaacttcttgcacaagaagtggaaggagcaggcacgcgagatggccgacactgcctgtgactctgacgtgcttctgcagctggtgttggtgtggctgggggaagtgttgggggtcatcggtgattgccctgagctggttcagagatcctttctcgtggcatccgtgctgcccggtcctgatggcaacattaattcgcccactcgaaatgccgacatgcaagaggagttgatcgcaagcctggaagagcagctgaagctgagtggggagcacagtgagtcctcaactccacgtccccggagctctccagaagagacaatagaaccagagtccctgcaccaactgttcgagggggagtctgagaccgaatccttctacgggttcgaagaggccgacctggatctaatggaaatttag

SEQ ID NO: 26378 - DNA, 564 bp, Artificial Sequence
  Description of Artificial Sequence: Synthetic coding sequence
atggacatcagcaagggcctgcccggcatgcagggcggcctgcacatctggattagtgagaataggaagatggtcccggtgccagagggtgcgtacggcaacttctttgaggaacattgctacgtgatcctgcatgtccctcagtccccaaaagcaacgcagggtgcttcttctgacctccattactgggtgggaaaacaggccggcgcagaggcccagggcgcggccgaagcttttcagcagcggcttcaggacgagctcggcggccagaccgttttgcatcgagaagcgcagggacacgagtccgattgtttctgctcttactttaggccaggtatcatttacaggaaaggtggtctagcatccgacctgaagcacgtggaaacaaacttatttaacatacagagattgctgcacatcaaaggacgtaaacacgtgagcgctacagaagtggagttatcgtggaactcctttaataagggcgatatcttcttactcgatctgggcaagatgatgattcagtggaatggcccaaagactagcatctcagagaaagctcgatag

SEQ ID NO: 26379 - DNA, 1329 bp, Artificial Sequence
  Description of Artificial Sequence: Synthetic coding sequence
atgcccctggagaacctggaggaggagggcctgcccaagaaccccgacctccgaatcgcccaactccgtttcctccttagcctgcccgagcacaggggagatgccgccgttcgagatgaacttatggctgccgtcagggataataatttttggaacagaatccgacaggagcaaaccgaagattgtccacctagctctccttctcggggttggcactgccaggattggccttcaagaaaaccaccaacctcgattcgattgtgcttcgccaaacccatcattaagcggcaccggatgccgagctacatggctccgtactacgaggccctgtgcaaaagcctggactggcaaattgacgtcgacctgctgaataagatgaagaaggccaacgaggacgagctcaaacggcttgatgaggaactggaagatgcagagaagaatctgggcgagagcgagattcgtgatgccatgatggctaaagctgaatacctctgcaggattggtgacaaggaaggcgcactgaccgcctttcggaagacttatgataagacggttgctctggggcaccgcttggacatcgtcttttacctcctcagaattgggctcttctacatggacaacgatctcatcacaaggaacactgagaaagcgaagtccttgattgaggaggggggggactgggaccggaggaaccgactgaaggtgtaccagggcctgtattgcgtcgccatccgggactttaagcaggcggctgagctctttttagatacggtttccacctttacatcatatgagctgatggattacaagactttcgtgacttacactgtttatgtctccatgatagcccttgaacgtccagatctgagagaaaaagtcattaagggcgctgaaatcttggaggtgctgcattcccttcccgccgttcgtcagtatctgttctctctgtacgaatgcaggtactccgtgttcttccaatccctggctgtcgttgaacaggaaatgaagaaggattggctgtttgctccacactatagatattacgtccgagagatgaggatccacgcctatagtcaactgctcgagtcatataggtctctcacgctcggctacatggccgaagctttcggcgtcggcgttgaattcatcgaccaggagctgtcacgattcattgccgctggaagactgcactgtaagattgacaaagtgaacgagatcgtcgagactaataggcctgatagcaagaattggcagtaccaggaaaccatcaaaaagggcgatttactcctcaatcgagtccagaaactatcacgggtcattaacatgtag

SEQ ID NO: 26380 - DNA, 333 bp, Artificial Sequence
  Description of Artificial Sequence: Synthetic coding sequence
atgctgtgctggggcaacgccagcttcggccagctgggcctgggcggtatcgacgaggagatcgttcttgaacctaggaaaagcgacttctttattaataaacgagtcagagatgtaggctgtgggctgagacatacagtgttcgtacttgacgacggaaccgtctatacttgcggatgcaatgacttaggacagctcgggcatgagaaatcacggaagaagcctgaattcagatcttgcttccccgggagaagtgcaatggcaccatcccgcctcactgctacctcagcatctcaagtgcaagccattctccttcctcaaccaccagagtag

SEQ ID NO: 26381 - DNA, 930 bp, Artificial Sequence
  Description of Artificial Sequence: Synthetic coding sequence
atggtgtgctggcagagcgtgagcgtgtggagcgtggccggccgggtggagatgaccgtgagcaaatttatggctatacagaaagccctccagcctgattggtttcaatgtctgtcagacggagaggtcagttgtaaggaggcgacatctatcaaacgcgttcggaaatctgtcgaccgatctctgctctttttagacaattgtctgcgccttcaggaagaaagcgaagtcctccagaagagcgtgattatcggcgtcatcgaaggtggcgacgtgatggaggagaggctaaggagtgctcgggagacagctaaaagaccggtggggggcttcctgttagacggttttcaaggcaatccgacaacccttgaggcccgactccgtctgctctcatccgtcacggcggagctgcctgaggataagcccaggttgatatctggcgtgagccgacccgacgaagtcctcgagtgtatcgagcgaggcgtagatctcttcgagtccttttttccctatcaggtgacagaaaggggatgtgctctgaccttcagcttcgattaccagcccaatcccgaggagaccttgctacagcagaacggtacccaggaggagatcaaatgtatggatcagatcaaaaagattgaaaccaccggctgcaatcaagagataacatcctttgaaattaacctcaaggagaagaaatatcaggaagacttcaacccgctggtacgcgggtgctcatgttattgttgcaaaaaccacacgcgcgcatacattcaccacctattagtcactaacgaactactcgccggcgtccttctgatgatgcataacttcgaacattactttggattctttcattacatcagagaagccttgaagtccgataagttagcccaattaaaggagttaatccaccggcaggcctcatag

SEQ ID NO: 26382 - DNA, 384 bp, Artificial Sequence
  Description of Artificial Sequence: Synthetic coding sequence
atggtgctgatcctgggccggcggctgaaccgggaggacctgggcgtgagagattcaccagcgacaaagcgaaaagtattcgaaatggatccaaaatccctgacaggtcacgaattctttgacttcagctctggatcttcccacgcagagaacatactgcaaattttcaacgagttccgggatagtagattgtttaccgacgtgattatttgtgtggaggggaaggagttcccctgccacagagcagtcctgtcagcatgtagtagttactttcgcgcaatgttctgcaacgatcatagggaaagccgtgagatgctggtggagatcaatggcatcttggctgaggcgatggagtgcttcctccagtacgtctacacaggctag

SEQ ID NO: 26383 - DNA, 1581 bp, Artificial Sequence
  Description of Artificial Sequence: Synthetic coding sequence
atggaggagatccccgcccaggaggccgccggcagcccccgggtgcagttccagtccctcgaaacacagtccgagtgtctctcccctgagccccaatttgtgcaggatacggacatggaacagggtctgacaggtggcttcccaatcagcaagcctgatggcatatcacagctggagcaggacctgcaggtatttgacctggagactaagactcgtgaagtgttaagagatgactgcagcgatggcgagacgagagaggagaacaaattgctcatcccaaagcaaaagatctcagaggaggtacattcctacaaggtaagggtgggccgcctgaaacacgatataacacaggttcctgaaacacgggaggtctacaaatctgaggatagacttgaacgcctgcaggagattctgcgcaagttcttgtatttagagagagaatttaggcagatcacaatttcaaaagagacctttacctccgagaagaataatgaatgtcatgagccggaaaaatcattttccctggacagtacgattgacgccgatcagagagttttaagaattcaaaatacagacgataatgacaaatatgacatgtccttcaatcaaaattcagcctccggaaaacatgagcacctgaacttaactgaagatttccagtcatccgagtgcaaggagtccctgatggatttgtcccacttaaacaagtgggaatccatacctaatacagaaaagagttacaaatgcgatgtgtgcggcaaaatttttcatcagtctagcgcattaacacgccaccaacgaatccacactcgtgagaagccttataaatgcaaggagtgtgagaagtcatttagtcaatctagctctttaagccggcacaaaaggattcacacccgcgagaagccatataagtgtgaagccagtgataagtcctgcgaggcctccgacaagtcctgctccccgagtagcggtatcatccaacacaagaaaatacatactcgcgcaaaatcttacaaatgctcgtcttgcgaaagggtcttcagcagaagcgtgcacctcacccagcaccagaagatccacaaggaaatgccgtgtaaatgcaccgtgtgcggatcggatttctgccataccagctacctgctcgagcatcagcgggtacaccacgaggagaaagcctatgagtatgacgagtacgggcttgcttatatcaagcaacaggggatccacttccgcgagaagccttacacctgttcagagtgtggcaaggacttccgcctgaactcgcacctgatccagcatcaacggatccacacaggggaaaaggcccacgagtgcaacgagtgtgggaaggcattctcacagacatcctgtctgattcagcaccacaaaatgcaccgcaaagagaagagctatgaatgcaatgaatacgagggatctttctctcacagcagcgacctcattttgcagcaggaagtgttgacgaggcaaaaggcctttgattgcgacgtatgggagaagaatagctctcagagagcacaccttgtgcaacatcaatcaattcatacaaaggaaaactcctag

SEQ ID NO: 26384 - DNA, 195 bp, Artificial Sequence
  Description of Artificial Sequence: Synthetic coding sequence
atgcccgaggaccaggtgggcaagctggaggccaccgagaacaccatttctgctatggcagctgcagccgccgaacagcaacagttttatttattgttagggaatctgctgtcaccagacaatgtggtgaggaagcaggccgaagaaacatacgaaaatattcccggtcagtcaaaaatcacctttctactgtag

SEQ ID NO: 26385 - DNA, 741 bp, Artificial Sequence
  Description of Artificial Sequence: Synthetic coding sequence
atggccgagcaggagcagcggaagatccccctggtgcccgagaacctcttgaagaagagaaaggcttaccaggcacttaaggctacccaggcgaaacaggcactgctggccaaaaaggaacagaagaagggcaaaggtctgcggtttaaacgactggagagcttccttcacgattcctggaggcagaaacgcgacaaggttaggctgcggagactggaggtgaaacctcacgctctggagctacctgataagcactcactcgcttttgtggtgaggatcgagcgtattgacggcgtgagcttgctggtccagcgtaccattgcccgcttgcgattaaaaaagatcttcagcggggtattcgtgaaggttacaccacagaacttgaaaatgctgcgcatcgtcgagccctacgttacctgggggttccccaatctgaaatccgtgcgagagctgatacttaagagggggcaggccaaagttaagaataagactatccctctcacagataatactgtaatcgaagaacatttgggaaaattcggtgtcatttgccttgaggatctgattcatgagattgcatttcccggtaaacactttcaggagatcagctggttcctgtgcccttttcacctcagcgtcgccaggcacgcgaccaaaaacagagtggggtttctgaaggagatgggaactcccggataccggggggaacgcatcaaccaactaatcaggcagctgaactag

SEQ ID NO: 26386 - DNA, 1296 bp, Artificial Sequence
  Description of Artificial Sequence: Synthetic coding sequence
atggccgccaacctgagccggaacggccccgccctgcaggaggcctacgtgagggtggtgacagaaaagtccccgactgactgggccctgtttacctatgagggaaactcaaacgacatcagggtggctggtactggcgaaggaggactagaggaaatggtggaggagctgaactctggcaaagtgatgtacgctttttgcagagttaaagatccaaactccgggctgcccaagttcgtactgatcaactggacaggcgagggcgtcaatgatgtgaggaagggagcctgcgcatcccacgtgagcaccatggcctccttcctgaagggtgcgcacgtcacaattaacgcccgagccgaggaagatgtggaaccagagtgcatcatggagaaggtggctaaggcctctggggctaattactcctttcataaggaaagtggtcggtttcaggatgtgggcccacaagcccccgtgggaagtgtctatcaaaagactaatgccgtaagcgagattaagcgagtgggtaaggactcgttctgggccaaagcagagaaggaggaagaaaaccgtcgcctggaggagaagaggagggccgaggaggctcaacgccagttggagcaggagcgaagagagcgagagctgcgggaagcagcccggcgggaacagaggtatcaagaacagggtggagaagcgagccctcagtcccgcacgtgggagcaacagcaggaagtggtgagccgcaacaggaatgaacaagaatctgccgtgcatccaagggaaatcttcaagcagaaagaacgggccatgtccacaacctctatctcaagtccccagccaggtaagttaagatcccccttcttgcagaaacaactgacccaaccggagacccattttggccgcgaaccagccgccgccatatctcgtcctcgggctgatcttcctgcggaagaaccagccccaagtacaccaccttgcctggtgcaggctgaggaggaggccgtttacgaagagcctccagaacaggaaactttctatgagcaaccacctctggtccagcaacagggcgctggcagcgagcatatcgatcatcatatccagggccagggcctgagcggtcaggggttatgcgcacgggcgttatacgactaccaagccgctgacgacactgagatctcttttgacccagagaatctcattactgggatagaggttattgacgagggatggtggaggggatatggcccagacgggcatttcggcatgttcccggccaattatgtggagttgatcgaatag

SEQ ID NO: 26387 - DNA, 1854 bp, Artificial Sequence
  Description of Artificial Sequence: Synthetic coding sequence
atgatcgagaagatgcagggcagccggatggacgagcagcggtgctccttccctccgcccctgaaaactgaggaggattacattccctatccttcggtgcacgaggtcttgggcagggaggggccatttcctctgatcttgttgccgcaattcgggggctattggatcgaaggaactaaccatgaaatcacctccatccccgagactgagccattgcagtctcccaccacaaaggtcaaactggaatgtaacccaaccgcaaggatctatagaaaacactttctcggtaaagagcatttcaactactatagcctggacgccgctcttgggcatctggtgttcagtcttaagtacgacgtcataggagaccaggagcatctccgactcctgttaaggactaagtgtcgcacataccacgatgtgatacccattagttgtctgaccgagtttcccaacgtggtccagatggcaaagctcgtttgcgaggacgttaacgtagacagattttaccctgtcctgtatcctaaagcctctcgcttgatcgtgacatttgatgaacacgtcatttctaataatttcaaattcggcgtgatctaccagaagcttggacagaccagtgaggaggagttgttttcgacaaatgaggaatctccggcttttgtcgagtttctggagtttctgggacaaaaagtgaagctgcaggattttaaaggattccggggtgggctggatgttacacacggtcagactggtacggaatccgtatactgcaattttcgaaacaaagagataatgtttcacgttagtacaaagttgccttataccgagggagacgctcagcagctgcagagaaagcgccacattggcaatgacatagtcgctgtggtgtttcaggacgaaaataccccattcgtgcctgacatgattgcttccaactttctgcatgcttacgttgtggtgcaggctgagggaggaggacccgacggtcccctgtataaggtttccgttacagcgcgcgacgacgttccattctttgggccacctctgccagaccccgcagtcttccggaagggaccggagtttcaggagttcctccttactaagctcatcaacgctgagtacgcatgttacaaagccgaaaagtttgctaagctcgaggagcgaacaagagctgctctccttgaaactctctacgaggaactgcacattcactcacagtctatgatggggctgggcggagatgaggataaaatggaaaatggcagtgggggagggggcttttttgagtcttttaaaagagtcattcgatctcgatctcaatccatggacgcaatgggcctcagcaataagaaacccaacaccgtgagtacttcccatagcggttccttcgcgcctaataacccagacctggccaaggcggcgggcatttcccttcttatcccagggaagtctgcaagtcgattcggtcgaagaggatccgccattggaatagggaccgtggaagaagtggtggttagaggcgcggccggctcagggggatgccttcatgccctatttagtgcaaggtctcaggacggcgggcatatcggggatgtggcccccctgccacccggccaggcccccgggcgggcgggttggtcgggcggatcatccgatggcacacagcaccttctgtggggattggtccccgttcccgagcctgtgcctttgactcgcgggttctggccctgccttgggccttgggatcctggtccggtgccagcccggattaggtatccaaaagccctgcacccagccgctcggccccctataagcccagtgtgcatggagaggcacccctctcctctaccatag

SEQ ID NO: 26388 - DNA, 1224 bp, Artificial Sequence
  Description of Artificial Sequence: Synthetic coding sequence
atgggcaacaccagcttcaacgaggtgatggaggcccagctgccctcgcacggtggtcccaaaccatcagccgagtctgatatgggtactaggagagactacatcatggcaaagtatgtggagcatagattcgcaaggcggtgcacaccggagcctcaacgcctctggaccgcaatttgcaatagagacttgctgtccgtgctcgaagcctttgccaacggacaggactttggacaaccactgcccggcccagatgcccaagcgcctgaagaactggtccttcaccttgcagtgaaagtggccaaccaagctagcctgccactggtcgatttcatcattcagaatggtggccatctagatgcaaaagcggccgacgggaacactgcattacattatgcagctctttacaaccaacccgattgcttgaaactgctcctaaaaggaagagctcttgtgggcactgtcaatgaggctggcgagaccgctctggacatcgcaaggaagaagcaccacaaggagtgcgaagagctgctcgagcaagcccaagcaggtaccttcgctttcccactccacgttgattacagctgggtcatctcgaccgaacctggttcagactcagaggaggatgaagaagagaaaaggtgtctgctgaagctccccgcccaggcacattgggcctcaggtcggctagacatttctaacaaaacatacgagactgttgcgagcttgggggctgccacccctcagggagaaagcgaagactgtcctcctcctttgcccgtgaaaaattcaagtcggactttggtccagggttgcgctcgccatgcgtcaggcgaccggagcgaagtctcttccctatcaagcgaagctcccgagacacctgaaagtcttggtagccctgcaagttctagttccttgatgtcccccctggaaccaggcgatcccagccaggccccaccaaactctgaggaagggctgcgcgagcctccaggcacgtctagaccaagcttgaccagcggaactacaccaagcgagatgtatttgccagtcagattcagctccgagagcactcgcagttatcgacgcggtgcccgttccccagaggacggcccgtcagcacgtcagcctctgccccggcgcaacgtccccgtcggcataactgagggggatggctcgcggactgggtccctccccgcatcctcagtccagctgctccaggactag

SEQ ID NO: 26389 - DNA, 813 bp, Artificial Sequence
  Description of Artificial Sequence: Synthetic coding sequence
atggccatggagatgcggctgcccgtggcccggaagcccctgagcgaaagattgggcagagacactaaaaagcacctagtcgtgcctggagacacaataaccaccgacaccggcttcatgcggggacacggcacctacatgggcgaagaaaagttgattgccagcgttgccggctccgtggagagggttaataaactgatatgcgtaaaggccctgaaaactaggtatatcggagaggtgggtgatattgtggttggccggataaccgaggtgcagcaaaagagatggaaagtggaaaccaacagcagattagacagcgtgttgttgctgtcctcgatgaatttacccggcggagagctgaggcgacgatctgctgaggacgaattggccatgagaggattcctgcaagagggcgatctgatctccctgggccaaggggtcctggtacaggtgtccccttccttggtgaaacgacaaaagacacatttccatgatttgccatgtggcgcctcagtcatcctaggaaacaacggatttatctggatatatcccaccccagagcataaggaagaagaggcaggtggtttcatcgcaaatctcgaacctgtgagtttggctgaccgagaagttatctcccggctcagaaattgcataattagtttggtgacacaacgcatgatgctgtatgacacatccatcctttactgttatgaagcttccctgcctcatcaaataaaggatatcctcaagcctgaaattatggaggaaattgttatggaaacacgccagaggctcctcgaacaggagggttag

SEQ ID NO: 26390 - DNA, 297 bp, Artificial Sequence
  Description of Artificial Sequence: Synthetic coding sequence
atgcccgaggaccaggtgggcaagctggaggccaccgagaacaccatcagcgccatggccgccgcggcagccgaacaacagcaattctaccttctgctgggcaacctgttaagcccggataacgttgtccgcaagcaggccgaggaaacctacgaaaatattccagggcagtcaaagatcacgttccttctgcaagccatcagaaatacaactgccgccgaggaagcccgtcaaatggcagcggtcctgctgagacgcttactatcatcagccttcgatgaagtctacccagcatag

SEQ ID NO: 26391 - DNA, 306 bp, Artificial Sequence
  Description of Artificial Sequence: Synthetic coding sequence
atggacgaggtggagcaggaccagcacgaggcccggctgaaggagctgttcgattctttcgatactacaggcactggttcgctaggacaagaagagttgactgatctttgccacatgctctctctcgaggaggtggcaccagttctgcagcagaccttattgcaagataaccttctagggcgcgtccatttcgaccagttcaaagaggccttgatcctgattttaagtcgaacattgtccaacgaggagcatttccaggagcccgattgctcactggaggcccagccgaagtacgtgcgcgggtag

SEQ ID NO: 26392 - DNA, 1065 bp, Artificial Sequence
  Description of Artificial Sequence: Synthetic coding sequence
atggcccacagccccgtggccgtgcaggtgcccggcatgcagaacaacatcgctgaccccgaggagctgtttacaaagttggagaggatcggcaagggctcctttggcgaggtgtttaaaggaatcgacaacaggacccagcaggtggttgccatcaagatcatcgatctcgaggaagccgaggatgagatcgaggacatccaacaggagataacagtcctgtctcagtgcgatagtagttatgttacgaagtattatggctcctacctcaagggatcaaaactctggataatcatggaatatctgggcggcggaagcgccttggatctactgagagcaggccctttcgatgaattccagattgctactatgttgaaggagatcctcaaagggctcgactacttacacagtgagaaaaagatacatcgcgatatcaaagccgccaacgttctgttgtccgaacaaggggatgttaaactggccgatttcggtgtggcaggacagctgaccgatactcagattaagagaaataccttcgtgggtacccccttctggatggccccagaggttatccagcaatcagcatacgacagtaagagacccaccgcaaaggagttgctcaagcacaagttcatcgttaaaaactccaagaagacaagctacctgaccgagttgattgatcgtttcaaacggtggaaagcggagggtcacagcgacgacgagagcgatagtgagggttccgactccgaatccacctcccgagagaacaatacacatcctgagtggagcttcactacagtgagaaagaagcctgaccctaaaaaggtgcagaacggagctgagcaggatctcgtccaaaccctgtcatgtctgagcatgatcattactcctgcctttgcagaactgaagcagcaggacgagaataatgcctcaaggaaccaggctattgaggagttggagaagtccatcgctgtcgccgaggccgcgtgtcccggaattactgataagatggttaagaagctgattgaaaaatttcagaaatgtagcgccgacgaaagcccatag

SEQ ID NO: 26393 - DNA, 522 bp, Artificial Sequence
  Description of Artificial Sequence: Synthetic coding sequence
atgccccggaagggcacccagcccagcaccgcccggcggcgggaggagggcccgcctccaccaagcccagacggtgcttcaagtgatgctgagccggagcctccatcaggtagaaccgagagccccgccaccgccgcagagactgcctcagaggagctggataatcggtccctcgaggagatattaaacagtatacctccccccccaccacctgccatgacaaatgaagccggagcgccccggctcatgataacccatatcgtgaatcagaacttcaagagctacgccggggaaaaaattctgggccccttccataagcggttctcctgcattatcggaccaaacgggtctgggaaatcaaacgttatcgactccatgctatttgtctttgggtacagggcccagaagattcgcagcaagaaactgtcagttctaattcacaatagcgacgaacataaggacattcagagttgcactgtagaggtgcactttcaaaagatcattgacaaagagggggactag

SEQ ID NO: 26394 - DNA, 801 bp, Artificial Sequence
  Description of Artificial Sequence: Synthetic coding sequence
tgaccccgggccgccgcccgggtgcgggccgccggcgaggccctggagaggagacgacggtggctcggccgcctctccccctctgccccgaggccccgtagagctaggccctcccttcgtcgcgcctccgcatgggtgcgggaccgggtcgccggccggcccggtgccctgcctggattccaagcctcaggagtggccggcgaggctcagaaagcgcccgggcatcctgcagcgccagctccagcagccagttgtctcaccgaggccgatggccgagtgttccttcatgcctttaggttggctctcatacaattgcaaatttcttcaatcaagtcagacaatgtgacaagggcttgttcattcatccgtgaagcagccactcagggcgccaaaatcgtgtcgttacctgagtgttttaattccccgtacggtgcgaaatactttcccgagtacgccgaaaagattccgggggagtcaactcaaaagctgtctgaggttgccaaggagtgttctatctacctgatcgggggaagcataccagaggaggacgctggtaaactgtacaatacatgcgcggttttcggccctgacggaaccctgctcgcaaagtaccggaagattcacctctttgacatcgacgtgcctggcaagatcacctttcaggagagtaagaccttgtctccgggagactcatttagcactttcgacacgccctattgccgagtgggactgggcatatgctatgatatgcggttcgccgagcttgcacagatttatgctcagagaggtgaggctgtgtag

SEQ ID NO: 26395 - DNA, 216 bp, Artificial Sequence
  Description of Artificial Sequence: Synthetic coding sequence
atggacagcctgcccgacgagttcttcgtgcggcaccccgccgtggaagaccagcgcaaggaagaaacagaaaataaactcgaaaaaagcagcggccagctcaataagcaggagaacgacatccccacggatttggtacccgtgaatctcctacttgaggtcaaaaaactcctgaatgcaatcaacacgctgcctaagggtgtcgtaccccattag

SEQ ID NO: 26396 - DNA, 2130 bp, Artificial Sequence
  Description of Artificial Sequence: Synthetic coding sequence
atgagcgtggagagcgagcagctgaccggcgtgcccctggacgactcggctataacacccatgtgtgaagtgaccgggggacgaagctattctgtttgctcaccccggatgctgaatcagtgtctggagtctctagtgcagaaggtccagagcggagtggttattaattttgagaaagccgggccagacccctctccagtagaggacggccagcctgatatttcacgcccatttggatcgcaaccctggcacagttgtcacaagctcatttacgtacggccaaatcccaaaacaggagtgcctatcggccactggcccgtgccagagagcttctggccagatcaaaattcaccaacactgccgcccagaacatcacatcctgtagtaaagttcagctgtaccgattgtgagccgatggtcatcgacaagttacctttcgacaaatacgaacttgaaccaagtccccttactcagtttattctcgaaaggaaatctccccagacctgctggcaggtatatgttagcaattctgcaaagtattccgagttggggcaccctttcggatatttgaaggccagtactgctctcaactgcgtaaatttattcgtaatgccttacaactaccccgtgttactcccactactggatgatctgtttaaggtgcataaagccaagcccacactcaaatggagacagtccttcgagtcctacctgaagactatgcccccgtactatctgggccccctaaaaaaagccgtgcgcatgatgggggccccgaatctgattgccgattccatggagtatggcctcagctacagtgtgatttcttatctaaagaagctcagccagcaagcgaagattgaaagcgatcgcgtgatcggcagcgtcggtaagaaggttgtccaggagactggcattaaagtccgaagtcgttcacatgggctgagcatggcgtatcgaaaagacttccagcagctgcttcaaggcatttccgaggacgtgccacatcgactgctagacctcaacatgaaggagtatacgggcttccaggttgctcttctaaacaaggacctcaaaccccaaacttttaggaacgcctacgacatcccccgaaggaatctgctcgatcaccttactaggatgagatcaaatctgctgaaatccacacggcgctttctcaaagggcaagatgaggaccaggtccatagtgtgcccattgcacagatgggcaactatcaggaatatctgaaacaagttccttctccacttcgggaactggatccggaccaacctagacgcctccacacattcggaaaccctttcaagttagacaaaaagggtatgatgatcgacgaggccgacgagttcgtggcaggaccgcagaataaacacaaaaggccaggagaacccaatatgcagggaatacctaagagacgccgctgtatgtctccgctgttgcgaggtcgtcagcaaaaccctgtcgttaataatcacataggggggaaaggacccccagctcccactacacaggcccaaccagacctaatcaaaccgctccctctgcacaagatctctgaaacgacaaatgatagcatcatccacgacgttgttgaaaaccacgtcgcagaccagttatcctctgacatcacacccaacgcgatggataccgagttctccgcctcaagtcccgcgagcctgcttgaacggcccaccaaccacatggaagccttgggccacgaccatctcgggacaaatgatttaactgtgggtgggtttctggagaaccacgaagaacctcgcgataaagagcagtgcgccgaagaaaatattcccgcctcctcacttaataagggaaagaagcttatgcattgccgctcgcacgaagaggttaatactgagctcaaagcacaaattatgaaggagataaggaagcctggcagaaaatacgagcgtatctttacacttctcaaacacgtgcagggcagtctgcagacacgcctgatttttctgcagaacgtaattaaggaggcaagccggtttaagaaaaggatgttgatcgaacaactggagaatttcctggacgaaatacaccggagggcaaaccagatcaatcacatcaactcaaactag

SEQ ID NO: 26397 - DNA, 387 bp, Artificial Sequence
  Description of Artificial Sequence: Synthetic coding sequence
atggccagcagcaacaccgtgctgatgcggctggtggccagcgcctacagtattgcacaaaaagctggcatgattgtacgcagagtgatcgcagagggggatctgggcatcgttgagaagacttgcgcaactgatctgcagacaaaagctgatcggttggcccaaatgtccatctgcagttctctggcccggaagttccctaagctaacaataattggagaagaggacctgccatctgaagaagtggatcaggagctgatagaagattcccagtgggaagagattttgaagcagccatgcccctcacaatatagcgccataaaggaagaggaccttgtggtgtgggtcgatccgttggatgggaccaaggaatacaccgagggatag

SEQ ID NO: 26398 - DNA, 237 bp, Artificial Sequence
  Description of Artificial Sequence: Synthetic coding sequence
atgcggttcatgatgatgcgggccgagaacttcttcatcctgcggcgtaaacccgttgagggctacgacattagctttttgataacaaattttcatacagagcaaatgtacaagcacaaacttgtcgactttgttattcatttcatggaggaaatcgataaggaaattagcgaaatgaagcttagcgtaaatgctcgcgcccgcattgtggctgaggagtttctgaaaaatttttag

SEQ ID NO: 26399 - DNA, 171 bp, Artificial Sequence
  Description of Artificial Sequence: Synthetic coding sequence
atggtgatggagaagcccagccccctgctggtgggccgggagttcgtgcggcagtattataccctcctgaataaagctccagagtacctccatagattctacggtcgaaacagcagttatgtacacggaggagtggatgccagcggcaagcctcaggaggccgtgtattag

SEQ ID NO: 26400 - DNA, 357 bp, Artificial Sequence
  Description of Artificial Sequence: Synthetic coding sequence
atgaagatcttcgtgggcaacgtggacggcgccgacaccacccccgaagaacttgctgccctgtttgccccgtatggcactgtgatgtcttgcgcggtcatgaaacagttcgcctttgtgcacatgcgcgagaatgccggggcgttgagggctattgaggctctccacgggcacgaactgcgaccaggtcgcgcactcgtggtggaaatgtctagaccaaggccgttgaatacatggaagatcttcgtcggcaacgtcagcgccgcctgcacgtctcaagagctcaggtcactgtttgagcgacgggggagggttattgagtgcgatgtcgtcaaaggaggaatgtgtgtggggtag

SEQ ID NO: 26401 - DNA, 438 bp, Artificial Sequence
  Description of Artificial Sequence: Synthetic coding sequence
atgagcagcccccgggacttccgggccgagcccgtgaacgactacgaaggcaatgactccgaagcagaggacttaaatttccgcgaaactctgccatcatcttcccaggaaaacacacctcggagtaaggtgtttgagaacaaagtgaacagcgaaaaggtgaaactctctttaaggaactttccccacaatgattatgaggatgtattcgaggagcctagtgaaagcggttctgacccctcgatgtggaccgccagggggcctttccggcgggaccgctggtcgagcgaggacgaggaggccgcaggaccatcccaggccctctcgcctttgctttctgtgcagcaccacggctattccggtccaaacgagcgaacaactttttggcatggaagtaatgaaggagctgtgagcctgctcttgaggtactgtgcgtag

SEQ ID NO: 26402 - DNA, 438 bp, Artificial Sequence
  Description of Artificial Sequence: Synthetic coding sequence
atgtggaccgcccggggccccttccggcgggaccggtggagcagcgaggatgaggaggccgccggaccatcccaagctctgagccctctgttatccgatactagaaaaattgtttccgagggagagctagatcagttggcccaaatccgccctttaattttcaacttccatgaacagacggccattaaagattgtctgaaaatattggaggaaaaaaccgcagcttacgatattatgcaagaattcatggccttggaactcaagaatctgcccggcgagtttaattctggaaatcaaccatcgaatcgggaaaagaataggtaccgcgatatcctcccctttcaacaccacggctattccgggccaaacgaacgcacgaccttttggcatggctccaacgagggagcagtatcactcctgctcagatactgcgcttag

SEQ ID NO: 26403 - DNA, 444 bp, Artificial Sequence
  Description of Artificial Sequence: Synthetic coding sequence
atgtggaagttccccggcggcctgagcgagcccgaggaggacatcggtgataccgccgtaagagaggtgtttgaagagaccggcatcaagtccgagtttcgaagcgtgcttagtattcgccagcagcacacaaatcccggcgccttcggcaaaagcgatatgtacataatctgtagattgaaaccatattcatttaccattaatttctgtcaagaggagtgcctgcgatgtgagtggatggacctcaatgatctggccaagacagaaaatacaaccccgatcacatccagggtggcgcgattgctcttgtatggctaccgcgagggctttgacaaaattgatcttactgttgaggaactccccgctgtgtatactgggctgttctacaaattgtaccacaaggaattgcccgagaattataagaccatgaaggggatcgactag

SEQ ID NO: 26404 - DNA, 300 bp, Artificial Sequence
  Description of Artificial Sequence: Synthetic coding sequence
atggacgagagcgccctgctggacctgctggagtgccccgtgtgcctcgaaaggctggacgcgtctgccaaggtgctgccatgtcagcacaccttctgcaaacgttgtctacttgggattgtgggatcacgcaacgaactccgctgtccagagtgcagaaccttagtagggagtggtgtggaggaactgccttcaaacatcttgctcgtacgcctgctcgatggaattaagcagcgaccgtggaagcccggccccggcggcggctcaggaaccaattgcacaaacgccctgcggtcctag

SEQ ID NO: 26405 - DNA, 3675 bp, Artificial Sequence
  Description of Artificial Sequence: Synthetic coding sequence
atggccctgcggcccggcgccggcagcggcggcggcggcgccgccggagcaggtgccgggagcgccggaggtggagggttcatgtttcccgtggcagggggaatcaggccaccccaagccggcctcatgccaatgcagcagcaagggttccccatggttagcgtcatgcagcccaacatgcagggcattatgggtatgaactactcttcgcagatgagccaagggcctattgccatgcaggccggaatcccaatgggacctatgcccgcagcaggaatgccctacctgggccaagctcctttcctgggaatgcggcctcccggaccccaatacactcccgatatgcagaaacagtttgccgaagagcagcagaagcgattcgagcagcaacaaaagctccttgaggaagagcgtaaaagaaggcaatttgaggaacagaaacagaagctaaggttgctatcttcagtcaaacctaagacaggagaaaagtccagggacgatgcattagaagccattaaagggaatttagatggctttagccgggacgcaaaaatgcatccaacacctgcctcccaccccaaaaagccaggggtaggagtattcccgtcccaagaccctgcccagccccgcatgcccccctggatttacaatgagagcctggtgcctgacgcctacaaaaagatcctggagacaaccatgacacccacaggtatcgacaccgccaagctctacccaatcctcatgagtagcggtctgccccgggagaccttggggcaaatctgggctctggcgaacagaacgacgcctgggaaactcacaaaggaggagttgtataccgttctggccatgattgcggttactcagcggggggtccctgctatgagcccggacgctttaaaccagtttcctgccgcaccaatacccacgttgagcgggttttcgatgactctgcctacgccagtgtcccagcccacggtcatcccatctggaccagctggaagtatgcctctctccctcggtcagcctgtgatgggcattaatttggttggacctgtgggaggcgccgccgcccaggcgagcagcggcttcatcccgacctatcctgccaaccaggtggtcaaaccagaggaagacgatttccaggacttccaggatgcatctaaaagcgggtctctggatgatagcttcagcgacttccaggaactgccagctagcagcaagacctctaacagccagcacggaaactccgcccctagcctgctaatgcccctacccggtactaaggcactcccttctatggacaaatacgctgtatttaaaggcatcgcagctgacaaatcatctgagaatactgtccctccaggagaccctggagataagtattccgcattccgggagctggagcagaccgctgaaaacaagccgctcggtgagtccttcgccgaatttcgctcagccggcacggatgatgggttcacagatttcaagaccgccgatagtgtgagcccccttgagccccctacaaaagataaaacatttcctcctagttttcctagcggaactattcaacagaagcagcaaacacaggtgaaaaatccgctaaacctcgctgatctagacatgttttctagtgtgaactgctcaagtgagaagcccttgtccttctccgctgtcttctcaacgtccaaaagcgtctccacacctcagtcaactggtagtgctgcgactatgacagccctcgccgccacaaagacatcctccctggcggacgatttcggggagttctcattgttcggtgaatattcaggactagcacctgtgggcgaacaggacgatttcgccgattttatggcctttagtaatagtagcattagcagtgagcagaagcccgacgacaagtacgacgccctaaaggaggaggctagtcccgtgcccctaacaagtaacgttggttctaccgtgaaaggtggccagaatagcacagctgcgtctacaaagtatgatgtgtttcgccagctgtccttagaaggaagcggcctaggcgtggaggacctaaaagacaacacacctagcggcaaaagtgatgacgacttcgcagacttccacagctctaagttctcttccataaatagtgataagagtctcggggagaaagcggtggcgtttcgccacactaaagaggactccgcaagcgttaagagcctcgatctgccatccatcggcggctcatccgtgggtaaggaggacagcgaggatgcattatctgtgcagttcgatatgaagctagccgatgtcggaggagaccttaagcatgtgatgagcgactcctcgctcgacttaccgaccgtgagcggtcaacaccccccggccgcagacatcgaggatctgaaatacgctgcgttcgggtcttattcaagtaatttcgccgtaagcactttgactagctatgactggagtgatcgcgatgatgccacccaggggcgaaagctgagtccgtttgtgctctcagcaggtagtggtagtcccagcgccaccagcattttgcagaagaaagagacctcgttcgggtcctcagaaaacatcaccatgacgtcactcagtaaagtgactacctttgtgagtgaagacgccctgcctgaaaccacttttcccgcccttgcctcatttaaagacacaattccacagacatccgaacagaaagagtacgaaaatagagattacaaggatttcactaaacaggatttacccacagccgagcgatcccaagaggcaacatgcccaagccccgcctccagcggagctagtcaggaaacccctaacgagtgttccgacgactttggcgagtttcaaagcgaaaaaccgaagatctctaagttcgacttcctcgtggccacttcacagagcaagatgaaaagcagtgaagagatgatcaagtccgaactagccaccttcgatctgtccgtccaaggcagccataagcgaagcttgtcactcggggacaaagaaatttccagatctagcccgtcacctgccttagaacaaccgttccgagacaggagtaacaccctgaatgagaaacccgctctgccggttatccgcgacaagtacaaagacctgaccggagaagtggaggagaacgaacggtatgcttatgagtggcagcgctgtttgggctccgccctaaacgtcataaagaaggcaaacgatacacttaatggcatttcgagctcgtccgtttgcactgaggtgatccagtcagcccaggggatggaatatctcttgggagttgttgaagtttaccgggtaaccaagcgcgtggagttaggtattaaagcaactgcagtgtgctcggagaaacttcagcaactgctgaaggacatcgacaaggtctggaacaacctgatcggatttatgtccctagctactctgaccccggatgaaaactcactggattttagctcatgcatgctccggccaggcattaagaatgctcaagagctggcatgtggtgtctgcttgctcaacgtggattctaggtcaagagctttcaactcagagaccgacagttttaagctcgcctatggaggccaccagtatcacgcatcttgcgccaacttctggataaattgtgtggagccaaagccaccaggattggtcctgccagacttactctag

SEQ ID NO: 26406 - DNA, 354 bp, Artificial Sequence
  Description of Artificial Sequence: Synthetic coding sequence
atggtgcagcggctgacctaccggcggcggctgagctacaacaccgcttcaaacaagacgagactgtcccggacccccggcaacaggatcgtgtacctgtacacaaaaaaggtcggaaaagcccctaagtcggcctgtggagtgtgccctgggagattgaggggggtgagagccgttcggcctaaagtgctgatgaggttgtctaaaaccaagaagcatgtgtcaagagcctacggcggctccatgtgcgcaaaatgcgtcagagacaggattaagcgggccttcctcatcgaggagcaaaaaatcgttgtgaaggttcttaaggcccaagcccagtcccagaaagcgaagtag

SEQ ID NO: 26407 - DNA, 621 bp, Artificial Sequence
  Description of Artificial Sequence: Synthetic coding sequence
atgagcagcccccgggacttccgggccgagcccgtgaacgactacgagggcaacgatagtgaagcagaggacctcaactttagggagactctacccagctcctctcaggagaacactccacggagtaaagtatttgaaaataaggtcaatagcgaaaaggtcaaactctccctcaggaacttcccacataatgactacgaagatgtttttgaggaaccatccgaatccggatctgatccctctatgtggactgctaggggtccttttaggcgggatcgctggagcagcgaggacgaggaggccgccggtccatcccaggcactgtctccgctgctctcagacactagaaagatcgtctccgaaggcgagctggaccagttagctcagattaggcctctcatctttaattttcacgaacagacagccattaaggactgccttaaaatcctggaggagaagaccgccgcctacgacattatgcaggaattcatgtttaacataatggatattgtggctcagatgcgagaacagcgctctggaatggttcagaccaaggaacaatatcacttctgttacgatatcgtcttggaagtgctgagaaaactgctgacactggactag

SEQ ID NO: 26408 - DNA, 582 bp, Artificial Sequence
  Description of Artificial Sequence: Synthetic coding sequence
atggaggagaccatcaaggacccccccaccagcgccgtgctgctggatcattgccactttagccaagtgatctttaattctgtcgagaagttctacattcctggtggagatgtaacctgtcattacaccttcacccaacacttcatacctcggcgtaaggactggatcggcatcttccgggtgggttggaaaaccactagagaatattacacctttatgtgggtgacccttccaatcgatttgaataacaagtctgccaagcaacaagaggttcagttcaaggcgtactacctgccgaaggacgacgaatactatcagttctgctatgtggacgaagacggggttgtacgcggagcctcgatcccctttcagttcagacccgagaatgaggaagacatcctcgtcgtgactactcagggcgaagttgaagagatcgaacaacacaacaaagaactgtgcaaggaaaaccaagagctcaaagattcgtgtattagcctacagaaacagaatagcgacatgcaggccgaacttcagaagaaacaagaggaacttgagacactccaaagtatcaacaaaaagtag

SEQ ID NO: 26409 - DNA, 156 bp, Artificial Sequence
  Description of Artificial Sequence: Synthetic coding sequence
atggacttcttcagcagccacctgctggccgacagcagcagccccgcaaccaattcttcgcacaccgatgcgcatgagatcctcgtgtctgacttccttgtatccgacgagaacttgcagaagatggagaatgtccttgacctgtggagcagctag

SEQ ID NO: 26410 - DNA, 513 bp, Artificial Sequence
  Description of Artificial Sequence: Synthetic coding sequence
atgagcagcaacgagtgcttcaagtgcggccggagcggccactgggcgcgagagtgccccaccggagggggaagagggcgtgggatgcgcagtcgagggcgcgggttccagttcgtctcatcctcccttcctgacatctgctaccggtgcggcgagagtggacaccttgcaaaggactgcgatctgcaggaggacgcatgttataattgtggacggggtgggcatatcgctaaagactgcaaggaacccaagcgcgaaagggagcagtgttgttataattgcggaaagccaggacatctcgctagggattgcgaccacgctgacgagcagaaatgttattcctgcggtgaattcgggcatattcagaaggattgcacaaaggttaagtgttataggtgtggggagactgggcatgtggcaattaactgcagcaagacaagcgaagttaattgctaccgctgcggcgagagcggtcacctcgctcgcgagtgtacaatagaggctactgcctag

SEQ ID NO: 26411 - DNA, 399 bp, Artificial Sequence
  Description of Artificial Sequence: Synthetic coding sequence
atgaaccaggaggacctggaccccgacagcaccaccgacgtgggcgacgtgactaacacagaagaggagctcatccgggagtgcgaagagatgtggaaggatatggaagaatgtcagaacaagctgtctctgatcgggactgaaacgttaaccgatagtaacgcccagctgtccctgttgattatgcaagttaagtgcttgactgccgagttgagtcagtggcagaaaaagactcccgaaactattcccttgaccgaggatgtactcattaccttgggaaaggaggagttccaaaaactgagacaagatcttgaaatggtgttgagcacgaaagaatccaagaacgagaagctcaaggaagatctcgaaagagagcagagatggctggacgagcagtag

SEQ ID NO: 26412 - DNA, 1095 bp, Artificial Sequence
  Description of Artificial Sequence: Synthetic coding sequence
atggtgaagctgttcatcggcaacctgccccgggaggccaccgagcaggagatcagaagcctgtttgagcaatatggtaaggtgctcgaatgcgatattatcaagaattatggctttgtgcacatcgaagataaaactgctgcagaggacgctatccgaaacctgcaccattataaactccatggggtgaatatcaatgtggaggcatcgaagaacaagtccaaaacctctacgaagctgcatgtcggtaatatcagcccaacgtgcactaataaggaactgcgcgctaaatttgaggagtatggccccgtgatagagtgcgatattgtgaaggactacgcgttcgtccatatggaaagggcagaggacgcggtggaggcaataagggggcttgataacacagagttccaaggcaaacggatgcatgttcagctgtccactagccggctgaggaccgccccaggtatgggtgaccaatctggatgttacaggtgcgggaaagagggccactggtctaaggagtgtccaatcgatcgctctggccgcgtagcagaccttactgagcagtacaacgagcagtatggcgcggtgcgcacaccctatacaatgtcttatggagatagtctctattacaataatgcttatggggccctggacgcctactacaagcgctgccgggcagccaggtcctatgaggcagttgctgccgccgcagctagcgtgtataattacgccgaacagacattatcgcagctgcctcaggtccagaacacagccatggcatctcacttgacaagcactagcttggatccctacgatcggcatctcctgccaacctccggagcggctgctacagccgcagccgccgctgctgccgctgcagccgtgacagccgcgagcacgtcctactacgggagggatagatcccctctgagacgggccactgcacccgtgcccactgtcggtgaggggtatggttacggtcatgagtcagagctgagccaagcttccgccgcagctcggaatagcctgtatgatatggcccgctacgagcgcgagcagtacgccgatcgcgcacggtatagcgccttctag

SEQ ID NO: 26413 - DNA, 420 bp, Artificial Sequence
  Description of Artificial Sequence: Synthetic coding sequence
atggccaccggcgacctgaagcggagcctgcggaacctggagcaggttttgagattactgaattatccagaggaggtggattgtgtggggctgatcaagggtgaccccgccgcctccctcccgataataagctacagcttcacatcctactcaccatatgtcaccgagctgatcatggaatcgaatgtggagttaattgcaaaaaatgacctacgattcatcgatgctgtttacaagctcctccgggaccagttcaactacaaacctattttgacaaagaagcagttcattcaatgcggattcgccgaatggaagatacagattgtttgcgatatactcaactgcgtaatgaagaagcacaaagagctgagctccctgcagaaaataccttctcagcagaggaaaaagatatcatcatag

SEQ ID NO: 26414 - DNA, 450 bp, Artificial Sequence
  Description of Artificial Sequence: Synthetic coding sequence
atggccaacatcgccgtgcagcggatcaagcgggagttcaaggaggtacttaagtccgaggaagttcgttttattaccaaaatttggcacccgaatatcagctccgtgactggtgccatctgtcttgacatactcaaggaccagtgggctgcagctatgactctgagaacagtgctattgtcgttgcaggcgctactggccgccgcggagccagatgatcctcaagacgcagtcgtagctaaccagtataagcagaaccccgagatgttcaagcaaaccgctaggctgtgggcacatgtgtacgccggtgcgcctgtcagctcccctgaatacactaaaaagatcgaaaatctgtgtgcaatgggcttcgacaggaatgctgtgatcgtggccctctcatccaagagttgggatgtggaaacagctactgaactgctgctgtcaaactag

SEQ ID NO: 26415 - DNA, 597 bp, Artificial Sequence
  Description of Artificial Sequence: Synthetic coding sequence
atggtgatggagaagcccagccccctgctggtgggccgggagttcgttcgccagtattacacattattgaacaaggcaccggagtatctgcaccgcttctatggccgcaattcgtcctacgtgcacgggggagtcgacgcttctggtaagccccaagaggctgtctacggtcagaacgatatccatcacaaggtgctgagcttgaatttttcagagtgtcataccaagataagacatgttgacgctcacgcaacactgagtgacggcgtcgttgtccaggttatggggctgctcagcaactcagggcagcctgaacgcaagtttatgcagacattcgtgctcgcccccgaggggagcgttcctaacaagttctatgtacacaacgacatgttccgttatgaggacgaggttttcggcgatagtgagcccgagctggacgaagagtccgaggatgaagttgaagaagaacaagaggagcggcagccctccccggaaccagttcaggaaaatgctaatagcggctattatgaggctcacccggtaactaacgggattgaggaacctctggaagaatccagccacgagccagaaccctag

SEQ ID NO: 26416 - DNA, 150 bp, Artificial Sequence
  Description of Artificial Sequence: Synthetic coding sequence
atgatgctgggcaccgagggcggcgagggcttcgtggtgaaggtgcgaggcctgccttggagctgcagcgccgacgaggttcagagattcttcagcgactgcaagattcaaaatggtgcacaagggatcagatttatctacacgagatag

SEQ ID NO: 26417 - DNA, 1266 bp, Artificial Sequence
  Description of Artificial Sequence: Synthetic coding sequence
atgatggaggacaacaagcagctggccctgcggatcgacggcgccgttcagagcgcaagtcaggaggttacgaatctaagagctgagctgactgctacgaatcgaagactcgccgaacttagtggcggaggcggcccgggccctgggccaggcgccgctgcgtcggctagcgcggctggcgactccgcagcgactaatatggaaaaccctcagctgggggcccaagtgctgcttcgagaggaggtttcaaggttacaggaggaagtgcatctgctccgccagatgaaggaaatgctggctaaagacctggaggagtcacagggcgggaagtcctctgaagtcttgagtgctacagaattacgcgtccagctggcgcagaaggagcaggagctggccagagctaaggaagccctccaggcaatgaaagccgaccgcaaaaggctgaaaggcgaaaagaccgacctggtgtcccagatgcagcaactctatgccacacttgaaagtcgtgaggaacagctccgggacttcataaggaattatgagcagcatcgaaaggagtccgaggacgccgtcaaagccctcgccaaggagaaggatttactggagcgggaaaagtgggagcttaggcgacaggccaaggaagcaacagatcacgcaaccgccctgcggagccagctggacctgaaggacaataggatgaaagagctcgaagcggagctggctatggcaaaacagtctttggccaccttgactaaggatgtacccaagagacatagcctggccatgcccggggagacagtcctgaacgggaaccaagagtgggtggtgcaagctgatttgcctctaacggccgctataagacagtcacaacaaactctgtaccacagccatccgccgcatccggccgacagacaggctgttcgggtcagtccgtgtcactcacgtcagccctcagtcatctcggatgcatctgctgctgagggcgatcgttcatcaaccccatctgacatcaatagcccccgacaccggacacattcactgtgcaatggcgatagccccgggcctgtacagaagaacctgcacaatcccatcgtgcaaagcttagaggaccttgaggatcagaagaggaaaaaaaaaaaagaaaagatgggctttgggagcatctcacgagtattcgcccggggcaagcagcggaagtccttagaccctggactgttcgatggcaccgcacctgactattacatcgaagaagacgcggactggtag

SEQ ID NO: 26418 - DNA, 1173 bp, Artificial Sequence
  Description of Artificial Sequence: Synthetic coding sequence
atggccaccggcgacctgaagcggagcctgcggaacctggagcaggtgctgagacttctgaattatccggaggaagttgactgtgttggactgatcaagggcgatcccgccgcttccttgcctatcatttcatattcattcacctcttactccccctatgttacggagctgattatggaaagcaatgtcgaattgatcgccaagaatgacttgcgcttcatcgatgccgtctacaaattactgagagaccagtttaactataagcccatcctcacaaaaaaacagttcattcagtgcggtttcgcggaatggaaaatccaaattgtctgcgatatactgaactgtgtgatgaaaaaacacaaggagctgtcaagccttcagaagattcccagtcagcagcgtaagaaaatcagctctgggaagagcgagccacccctcgggaatgagaaaataagcgcagaggccgttggggtggatataagtggacgtttcatgacgtccgggaagaagaaggctgtcgttatccgccatctctacaacgaggacaacgtggacatttcagaagacactctaagccccatcacagatgtcaacgaggcggtagacgtatctgaccttaatgccaccgagatcaagatgcccgaggttaaggtgccggagatcaaggcagagcagcaggacgtaaatgtgaaccccgagattaccgccctgcaaaccatgttagccgagtgccaagaaaatctgaagaagttgacatccatcgaaaagcggttagactgtctagagcagaaaatgaaaggtaaagtgatggtcgacgagaatacctggacaaacctgctgtcaagagttaccctcctggagactgaaatgctcctgagtaagaagaacgatgagtttatcgaattcaatgaggtgtcagaagattatgcctcctgcagcgacatggatctgctgaatccccataggaaatccgaggtcgagaggcctgccagcattccacttagttcggggtactcgacggcctcctctgactcaaccccacgtgctagcactgttaactattgtggtttgaatgagatttccgaggagacaaccatccaaaagatggagaggatgaaaaagatgttcgaggaaacagccgaattgctgaaatgtcctaaccactacctatag

SEQ ID NO: 26419 - DNA, 390 bp, Artificial Sequence
  Description of Artificial Sequence: Synthetic coding sequence
atgaagcggggccggctgcccagcagcagcgaggacagcgacgacaatggttctctctccaccacctggtctcaaaattccaggtcgcagcatcggcggtctagctgtagtcgccacgaggatcggaagccttctgaagtttttagaacggatctgattacggccatgaaactgcatgattcataccagctaaatccggacgaatattatgtactggccgacccctggagacaggagtgggagaagggtgttcaagtccccgtgtcaccagggactatcccacagccggttgccagagtagtctccgaagagaaaagcctgatgttcatccggcccaagaaatacatagtctcttccggatctgagccacccgaacttggatatgtatag

SEQ ID NO: 26420 - DNA, 489 bp, Artificial Sequence
  Description of Artificial Sequence: Synthetic coding sequence
atggacttcttcagcagccacctgctggccgacagcagcagccccgccacaaattcaagtcacaccgatgctcatgagatcctagttagcgattttttagtgtctgacgagaatttgcagaagatggagaacgtgctagacctgtggtccagcgggctcaaaactaacattatctcagaattgagtaagtggcgtctaaacttcatagattggcaccgaatggagatgcgaaaagagaaagagaaacatgcagcccatctgaaacaactgtgcaatcaaatcaacgagctgaaggagctgcagaagacatttgaaatttccatcggccggaaggacgaagtgatttcctccctcagtcatgctatcggcaagcagaaggagaagatcgagctgatgaggacattctttcactggaggatcggccacgtgagggcacgtcaggacgtgtatgaagggaagctggctgatcagtattatcaacggacatag

SEQ ID NO: 26421 - DNA, 411 bp, Artificial Sequence
  Description of Artificial Sequence: Synthetic coding sequence
atgatcgtgaacgactacgagggcaacgacagcgaggccgaggacctgaattttagagagacgcttcccagttcctcccaggagaataccccaaggagcaaggtattcgagaacaaagtaaattccgaaaaggtgaagctcagtttgcgcaactttcctcataacgactacgaagacgttttcgaagagcctagcgaatccgggagtgatccgagcatgtggacagccagagggccttttaggcgcgacagatggagttctgaagacgaagaagctgccggtccgtctcaggccctgtccccactgctctccgtgcagcaccatggctactctggcccaaatgagcggactacattctggcatggctctaatgagggcgccgtgtctttgctcctgagatattgcgcgtag

SEQ ID NO: 26422 - DNA, 321 bp, Artificial Sequence
  Description of Artificial Sequence: Synthetic coding sequence
atggccagccagctgcaggtgttcagcccccccagcgtgagcagctccgctttctgcagtgcaaagaagttgaagattgagcctagcgggtgggacgtgagcggccaaagttctaatgataagtattacacccatagcaagacacttccagctacacagggacaggcaaatagctcccatcaggtggctaattttaacataccagcctatgaccagggcctcctgttaccagcccccgccgtggaacatatagtcgtcactgccgcggacagtagtggctctgcagcaacatcaacttttcagagttctcagacactgtag

SEQ ID NO: 26423 - DNA, 411 bp, Artificial Sequence
  Description of Artificial Sequence: Synthetic coding sequence
atgaagcggggccggctgcccagcagcagcgaggacagcgacgacaacgggagtctgtccacaacttggtcacagaactcacgttcccagcatagacgttccagctgctcacgccatgaggatcggaaaccgtctgaggtcttccgaaccgatctaatcaccgcaatgaagctgcacgattcataccagctgaacccggatgagtattatgtcctggccgatccttggcgccaggaatgggaaaagggcgtgcaggtgcctgtgtcccctggcactattccccagcctgtcgcccgcgttgtttctgaagagaagtccctcatgttcatcaggccaaagaaatacattgtgtctagcgggtctgaaccccccgagttaggctatgtcgatatcaggacacttgccgactag

SEQ ID NO: 26424 - DNA, 396 bp, Artificial Sequence
  Description of Artificial Sequence: Synthetic coding sequence
atggaggacggcacccccaagcacatcatccagatgaccggcttcaagatggaagagaaagaagcattggttaaactgttgctgaagctggactgcactttcatcaagtccgaaaagtacaagaattgtactcaccttatcgccgaaagattgtgcaaatcagaaaagttccttgcagcatgtgccgctggcaagtggatactgactaaggattatataattcacagcgccaagtccgggcgatggctggacgagactacatacgaatggggttacaagatcgaaaaagactcccggtactccccccagatgcagagcgcccccaagcggtggagggaggagctgaaaaggactggggcccccggagccttccacaggtggaaggttgtgctgtag

SEQ ID NO: 26425 - DNA, 1668 bp, Artificial Sequence
  Description of Artificial Sequence: Synthetic coding sequence
atgcggctgatcggcatgcccaaggagaagtacgacccccccgaccctcgtcgcatctataccattatgtccgcggaagaggttgctaacgggaagaagtcccactgggcggaacttgaaattagcgggagagtgcgctccctctcaacttcactgtggtctctcacacacctgactgccttacacttaaacgataattatctgtcacgcatcccccctgatatcgctaagctccacaatctcgtgtatctcgatttgagtagcaacaagctaagaagccttccagctgagttgggcaatatggtaagccttcgggagcttctgctcaacaataacctgctgcgcgtgctcccctatgagctggggagactgttccaattacagaccctcggattgaagggtaacccactgagccaagacattttaaatttatatcaggatcctgacggaactagaaaactgttaaactttatgctggacaatctggctgtacaccccgagcagctgccacctcgaccatggatcacgttaaaggagagggaccaaattttaccatccgccagcttcactgtgatgtgttacaacgtgctatgcgataaatacgcgaccagacaactgtacggatattgccccagctgggcccttaactgggagtaccggaagaaaggcattatggaagagattgtgaattgcgacgcagacatcatttcgctgcaggaagttgagacggaacagtacttcaccttgttcttgcctgccctgaaggagcgcgggtacgatggtttcttctctccaaaatctagagcgaaaattatgtcagagcaggagcggaaacacgtggatgggtgtgccatatttttcaagaccgagaaattcaccctcgttcagaagcacaccgtggagtttaatcaagttgcaatggccaactctgacgggtctgaagccatgctcaatagagtgatgacaaaggataacattggcgttgcagtcgtgctggaggtgcacaaggaacttttcggggccgggatgaaacccatccatgcggccgacaaacaactgctcatcgtggcaaacgcccatatgcactgggacccagagtacagcgatgtgaagctgatacagaccatgatgtttgttagtgaggtgaaaaacatattggagaaggcatcatcacgacccggctctccaaccgctgatcccaactccattcccctggtactttgtgctgacctcaattcactgccagactctggcgtggttgagtatctctctaacggcggggtggctgacaatcataaggacttcaaggaactcagatataacgaatgcctgatgaatttttcttgtaacgggaagaacgggtcctccgaaggacggatcacccacggcttccagctcaagagcgcttacgaaaacaatttgatgccatataccaattacacctttgacttcaagggagtgatcgattacatcttctacagtaaaactcacatgaatgtcctgggcgtattggggcctctagatccccagtggttagttgaaaataacatcaccggctgcccacatccccacattccctctgaccactttagtcttctgacccagctagagctccatccccctcttctgcccctggtcaacggcgtccacttgcccaaccgccgttag

SEQ ID NO: 26426 - DNA, 1635 bp, Artificial Sequence
  Description of Artificial Sequence: Synthetic coding sequence
atgaacaccagcatcccctaccagcagaacccctacaacccccggggcagctctaacgtaatccaatgctaccgctgcggagacacatgtaagggagaggtcgtaagagtgcacaacaaccatttccacatacgttgcttcacgtgccaggtttgcgggtgcgggttagcacagtccgggtttttcttcaaaaatcaggagtatatatgtactcaggactaccaacaactgtacgggactcgctgcgattcttgtagggattttatcactggggaagtaatctccgcattggggcggacttatcaccccaaatgcttcgtttgctctctgtgccgaaaacccttccctatcggcgataaagttacgttttccggaaaggaatgtgtgtgccagacgtgcagccagtccatggcaagttcgaagccaattaaaataaggggccccagccattgcgctggttgcaaggaagaaattaagcacggccaaagcctgctggcgctggacaagcagtggcatgtgagttgcttcaagtgtcagacgtgttccgtgatcctcactggcgagtacatatcgaaggatggagtcccttactgtgaatcagactaccacgcgcagtttggtattaaatgtgagacttgcgaccgctacataagcgggagagtgttagaggccggaggaaaacattatcatcccacttgcgctcgttgcgtgcgctgccaccagatgttcacagagggcgaggagatgtatcttacagggtctgaggtatggcacccaatatgcaagcaggcagccagggcagaaaagaaacttaagcaccggcgcacgtccgaaacctctatctcaccgccaggatcgagcatcggtagtccgaacagggtgatatgcgatatatacgagaacctggacctgcgtcagaggagggcttccagtccgggatatatagattcccctacttacagccgccagggaatgtctccaaccttctcccgctcaccacatcattattatagatctggagatctttcaacagcgaccaagtccaagactagtgaggatatctcacaaacaagcaagtatagtcccatctactctcctgacccatactacgcctccgaatcagagtattggacttatcacggaagcccgaaggttccacgggcaagaagattttccagcggcggtgaagaggacgatttcgatcgatcaatgcacaaacttcagtctgggatcggtcgcctgattctgaaagaagaaatgaaggcccggagttcctcctatgccgatccttggacgcccccgagatctagtacatcgagccgggaagctcttcacactgccgggtacgaaatgtccttaaacggatccccaagatctcattatctggctgactctgacccactcattagcaagtccgcgtcactccctgcatatcgaaggaacggactgcaccggactccatcggcggatttgtttcactacgacagcatgaacgccgtgaattgggggatgcgcgaatacaaaatctatccatacgaactgcttctagtgaccaccagagggcgcaacaggctgccgaaagatgtggaccggaccagattggaaggaaatttctggaagagcggctgtctctag

SEQ ID NO: 26427 - DNA, 393 bp, Artificial Sequence
  Description of Artificial Sequence: Synthetic coding sequence
atgggccggctggacggcaaggtgatcatcctgaccgccgccgcccagggaattggccaagctgccgccctggcattcgcgcgggaaggcgccaaggtgattgccaccgacatcaatgagtccaagttgcaggagttggaaaaatatccaggtatacaaacaagagtgctggacgtgactaagaagaaacaaatcgaccaattcgctaatgaagttgaaaggcttgatgtgctgttcaacgtcgctgggtttgtacatcacgggaccgtactggactgcgaggagaaagactgggatttctccatgaacctgaacgtccgctcaatgtacttgatgatcaaggcatttttacctaagatgttggctcagaagtctggcaatattattaattag

SEQ ID NO: 26428 - DNA, 1119 bp, Artificial Sequence
  Description of Artificial Sequence: Synthetic coding sequence
atgcagggccccgccggcaacgccagccggggcctgcccggcggccctcccagtactgtagcctccggcgcaggcagatgcgagagtggagctctgatgcattccttcgggattttcctgcaggggctgttaggggttgtggctttctccacccttatgctgaagcgctttagagaaccaaagcacgaacggaggccctggagaatttggtttctggatacctcaaaacaggccattggcatgctgtttatccatttcgccaacgtgtatctagctgacctgactgaagaagatccttgctccctttatctcatcaacttcctgctggatgcaaccgtcgggatgttacttatatacgtcggagtgcgtgcagtgtcggtcttggtcgagtggcagcagtgggaatctttgcggttcggagagtatggggacccccttcagtgcggagcttgggtggggcagtgtgccctttacatcgtcatcatgattttcgagaaaagcgtggtgtttattgttctcttgatactgcagtggaagaaggtagccctccttaaccctatagaaaaccctgatttgaaactggctatagttatgctcatcgtccccttttttgtgaacgctctcatgttttgggttgtggacaactttctcatgagaaaaggtaaaaccaaagccaagctcgaagaacggggcgctaaccaggacagccggaatggctctaaggttcggtatagaagggctgctagccatgaagagtcagagtccgagatcttgatttccgctgatgatgaaatggaggagtccgacgtggaagaagacctgcggcgactgacacctcttaagcccgtgaagaagaagaagcatagatttggactaccagccggcgcacaggaagctcccataaaaaagaagcgtcctcccgtgaaagacgaggatctcaaaggagccagagggaatctgacaaaaaatcaggaaataaagagcaagacatatcaggtcatgagggaatgcgagcaggctggctctgccgctccatcagtcttctcacgcaccagaaccggaacggaaaccgtgtttgagaaacccaaagcggggcccacaaagtcagttttcggctag

SEQ ID NO: 26429 - DNA, 507 bp, Artificial Sequence
  Description of Artificial Sequence: Synthetic coding sequence
atgatgctgggcaccgagggcggcgagggcttcgtggtgaaggtgagaggcctgccttggtcttgctctgcggacgaagtgcagcgctttttctctgattgtaagatccagaacggtgcccagggcataaggtttatctacacgagggaaggccggccttctggcgaagcattcgtagagttggaatctgaggacgaagtgaaattggctctgaagaaagatcgagagacaatgggacaccggtacgttgaagtcttcaagtcaaacaatgtggagatggattgggtgcttaagcacacgggtcctaacagtccagacacagcgaatgacggtttcgttcggctacgaggacttccattcggatgcagcaaggaggagatagtccagttcttcagcggattggagattgttccgaatggcatcactctgcctgtcgatttccagggaaggtctaccggtgaggccttcgtccaatttgcaagtcaggaaattgccgagaaagcctag

SEQ ID NO: 26430 - DNA, 9 bp, Artificial Sequence
  Description of Artificial Sequence: Synthetic coding sequence
atggcctag

SEQ ID NO: 26431 - DNA, 1131 bp, Artificial Sequence
  Description of Artificial Sequence: Synthetic coding sequence
atgaccaccgtggtggtgcacgtggacagcaaggccgagctgaccaccctgttggaacagtgggagaaggagcatggttcaggccaggacatggtgccaatcttaacccggatgtcccagctcatcgagaaagagactgaagagtatcgcaaaggcgatccagacccttttgatgatcggcatcctggacgggccgatcctgagtgcatgctcggtcatctgctacggatactttttaagaatgacgactttatgaacgcgcttgttaatgcatatgtgatgacatcccgggaaccaccattaaacactgcggcttgtaggctccttttagacattatgccagggctggagactgctgtggtgttccaagagaaggagggcattgtcgagaatttatttaaatgggcaagagaggctgaccaacctctgcgcacatacagtaccggtctgctcggtggggcaatggagaaccaggacatcgcagccaactatagagacgaaaactcccagctggtggccatcgtgctcaggcgcctgcgtgagctgcagctccaagaagttgctctgaggcaggaaaacaagcgaccatcacccaggaagttgtcttctgaacccctcctgccattggacgaggaggccgtggatatggactatggcgacatggctgtggatgtagtcgacggcgaccaggaggaggccagtggagacatggagatatcattccatttagacagtggtcataaaaccagttcccgtgtgaactccactactaagcctgaggatggggggcttaagaagaataagtcggccaagcaaggggatcgcgaaaattttagaaaggctaagcaaaagctgggctttagcagctccgacccagatcggatgttcgtggagttgtccaattcttcttggtctgaaatgagcccatgggtgattggcaccaactacaccctgtatcccatgacccctgcaattgaacagagactgatcctgcaatacctaactcctctcggtgaataccaggagttgctccctatattcatgcagctgggttccagagagttgatgatgttttatatagacctaaaacagacaaacgatgtcctcctgacctttgaggctctaaagtag

SEQ ID NO: 26432 - DNA, 504 bp, Artificial Sequence
  Description of Artificial Sequence: Synthetic coding sequence
atgagcagcaacgagtgcttcaagtgcggccggagcggccactgggcacgcgagtgcccgacaggaggtggacgcggaagaggcatgcgatctagaggaaggggtggtttcacatcagacagagacatttgctaccgatgcggtgaatcaggccacttagctaaggattgtgatctccaggaagacgcctgctacaactgtgggcggggaggtcacatcgcaaaagattgtaaggaacccaagcgggagcgcgagcagtgctgttacaattgcggcaagcctggtcatctggcccgtgactgtgatcacgccgatgaacagaaatgctactcgtgtggggaattcggccacatccaaaaggattgtaccaaagtcaaatgttatcgctgtggagagaccgggcacgtcgcgatcaactgctctaagacctccgaggtgaactgttaccgatgcggtgaatctgggcacctcgcacgagagtgtactattgaggccaccgcatag

SEQ ID NO: 26433 - DNA, 999 bp, Artificial Sequence
  Description of Artificial Sequence: Synthetic coding sequence
atgagcgaggccggcgaggagcagcccatggagaccaccggcgccactgagaacggccacgaagccgtgcctgaaggagagagtcccgcaggggccggaaccggtgccgcggctggcgccggcggtgctaccgccgccccaccaagtgggaatcagaatggggcagagggcgaccagatcaatgctagtaagaacgaagaagatgctggtaagatgttcgtgggcggactttcttgggacaccagcaaaaaggatctgaaggattacttcaccaagtttggagaggtcgtcgactgtacgatcaagatggatcccaataccgggcgctcccgcgggtttgggttcatccttttcaaagatgccgcatccgtggaaaaagtcctcgatcagaaggaacatagattggacggtcgggtcattgatccaaagaaagcgatggccatgaaaaaggatccggtcaagaagattttcgtcggcggtcttaacccggaagctacggaggaaaagattcgcgaatactttggagagttcggggagatcgaagcgattgaactgccgatggaccctaaattgaacaaaaggcgaggattcgtctttatcaccttcaaagaagaggagccagtcaagaaggtgcttgagaagaagttccacaccgtgtccggttcgaagtgtgagatcaaggtagcgcagccaaaggaggtttaccagcagcagcaatacggatccggtgggcgaggaaatcggaatcgaggtaacaggggtagcgggggcggcgggggaggcggaggacagagccagagttggaaccaagggtatggtaattactggaaccaaggatatggatatcaacagggatacggccctggatacggcgggtatgattacagcccctatgggtattacgggtacggtcctgggtacgactatagtcaagggtctacgaattacggaaaatcacagcgacgtggtggacaccagaataattataagccttactag

SEQ ID NO: 26434 - DNA, 615 bp, Artificial Sequence
  Description of Artificial Sequence: Synthetic coding sequence
atgagcgacctgcggatcaccgaggccttcctgtacatggactacctatgcttccgcgcactgtgttgtaaaggaccaccaccggcccggcccgagtacgatctggtttgtatcggtctgactggctccggtaaaacatcacttctgtcgaaactttgctctgagtcccccgacaacgtggtttccaccaccgggttttctatcaaggcggtcccattccagaatgctatactcaatgtgaaagaactcggaggcgccgacaacattcggaaatattggagtagatactaccagggaagccagggggtgatttttgtgctggactctgctagcagcgaagatgacttagaggctgcccgaaatgagcttcactctgctctgcagcatccacaactgtgtacactgccctttttgattttggcaaaccatcaggataagcccgctgctaggagcgtacaagagatcaaaaaatacttcgagctggagccattggcgaggggcaagagatggattcttcagccatgtagtctggacgatatggacgccctcaaggacagcttcagccaattaatcaatctacttgaggagaaggaccatgaggctgttaggatgtag

SEQ ID NO: 26435 - DNA, 6315 bp, Artificial Sequence
  Description of Artificial Sequence: Synthetic coding sequence
atggagagccaggagttcatcgtgctgtacacccaccagaagatgaaaaaatccaaggtgtggcaagatggtattttaaaaatcacccacctcggcaacaaagccatcctttacgatgacaagggcgcttgcttggagtccttgttccttaagtgccttgaggtcaagcccggcgatgatctcgaatcggatcggtatcttataacagtcgaggaggtgaaagtcgccggtgctatcgggattgtgaaacagaatgtaaataaagaggcacctgaactgaacagcagaactttcatctcatccggaaggtcattgggctgccagccaagcggtttgaaacggaagtttacagggttccaggggccgagacaggtccctaagaagatggtgatcatggagtcaggcgagtcggctgctagccatgaagctaagaaaacaggccctaccattttcagcccattctgtagtatgccaccgctcttccccacggtgggcaaaaaagatgttaataacatccttgccgacccagagaacatcgtcacatataagaatagggaaagaaatgccatggacttctcttccgtatttagcccttccttccagatcaatcccgaagtcctgtgtgaagagaactacttctgttcgcctgtaaactctggaaataaactgagcgactccctgctcaccaacgaacctgtgaagcgggattccctggcttcacactactcaggggtttcgcagaacataaggtctaaagcgcagatcttagcactcctgaagtccgagtcttcctcctcctgcgaagaactgaatagcgagatgactgaacatttcccccaaaagcagccccagggaagcttgaaaatcgccaccaagccaaaatacctaatccagcaggaggagtgcgccgaaatgaagagcaccgaaaacctgtactatcagcaccagagtgagaacaccatgagaaataaaagccgctgggccatgtatcttagttctcagagcagccctatacatagcagtaccgtggacgggaatgacaccgaaagaaagcctaaagcccaagaagatgacgtgaactctaacctcaaagacctgtctctacagaagattatccagttcgtggagacctacgccgaggaacgtaaaaagtataacgtagatcaaagcgtaggcaacaacgatcccagttggaaccaggaggtgaagctggagatcccaagcttcaacgagtcctcttctctccaagtcacctgctcaagcgcggagaatgatggaattctctcagaaagcgatattcaggaagacaacaagatccccttcaatcagaatgataagggatgcattaaaggctctgtcttaattaaggaaaacgcccaagaagtgaacacatgtggcacactggagaaggagtatgagcagtccgagtccagtctacccgagttgaagcaccttcagatcgaaagctccaacaactcccggatttccgacgacattacggacatgatctctgaatccaaaatggacaatgagtccctcaacagtatacacgagtctctttctaacgtgacccagccattcctcgaggtgaccttcaacctgaacaatttcgagacatctgacacggaggaagagtctcaggaaagtaacaaaatttcacaggatagtgaatcatgggtgaaggacatcctcgtcaacgacggaaattcatgctttcaaaagcgatctgagaatacgaactgtgaggagatcgagggcgagcatttaccgttcctgactagcgtgtctgacaagccaaccgtgacctttcccgtgaaggaaaccctgccttctcaattttgcgataaaacttatgtggggttcgacatggggatatgcaagaccgaaaatacaggcaaagagattgaggaatacagtgatacactgtcaaactttgaaagcttcaagtggaccgatgcggtatacggcgataataaagaggatgccaataagcctatccaggaagttagaatcaattatgactttgcccttcctcctaacaaatcaaaaggaatcaatatgaacctacatattcctcacatacaaaaccagatcgccgagaatagcaaccttttttctgaggatgctcagccccaaccattcattcttggtagcgatcttgataaaaacgatgagcacgtacttccaagcaccagtagcagtgacaatagtgtccagttgctgaatacgaaccaaaatcactacgagtgtattgccttggacaagtctaacacgcacatatccaatagtctcttctacccattaggaaaaaagcatctgatttcgaaagacacggaagctcatatcagcgaacccgaggatctgggcaaaatcagaagccctccacccgatcacgtcgaggtagagaccgctagggagggtaagcagtactggaacccacggaactcttccgagttaagcggtctggtgaataccatttctatcctgaagagcctttgtgagcacagcacagccctcgacagccttgagattctaaagaaaaaaaacaccgtattccagcagggaacgcaacaaacatacgaaccagatagcccccccgaagtgcggaagccattcatcactgtagtaagccctaaaagtccacaccttcacaaggattcacagcaaatcctcaaggaagacgaggtggagctgagcgagcccttgcaatctgtccagttcagctccagcgggtcaaaagaagaaaccgccttccaggcagtgattcccaagcagatcgaacggaagacttgcgatccgaaacccgtggagtttcaggggcaccaggtgaaagggtctgcgaccagcggcgttatggtccggggacactcgtcgcaactgggctgttctcagtttccagactcgactgagtatgagaactttatgactgagacaccggagctgccttccacgtgcatgcagattgatttccttcaagtgacttcaccagaggaaaacataagcacattatcgcccgtctccactttttctctaaactcccgggacgaagactttatggtggaatttagtgagacaagtctaaaagcccggaccctgcccgacgacctccactttctcaacctagaaggtatgaaaaagagccggtcactggagaatgaaaatcttcagaggttatcactgctatcccgaacacaggtgccgctgatcaccctaccgcgtaccgatggccccccagacctagattcccatagttatatgatcaatagcaacacctatgagtcgtcagggagtcccatgctgaatctgtgcgagaaatcagcagtcctgagctttagtattgagcccgaagatcaaaacgaaaccttcttcagtgaagaaagtcgggaggttaacccaggtgacgtttccttaaataacattagcacccaatcgaaatggctgaagtaccagaacacatcacagtgcaatgttgcaacacctaacagggtcgataagcggatcaccgatggattcttcgccgaagcggtgagcgggatgcactttcgtgacacctccgaacgccagtccgacgcagtcaacgaatctagcctggatagtgtgcatctgcagatgattaagggaatgctgtaccagcagcggcaggatttctctagtcaagacagcgtctctaggaaaaaggttctgtcccttaacctcaagcaaacatccaagaccgaggaaatcaagaacgtccttggaggcagcacttgctacaactactccgtgaaagatctgcaggaaatctctggctcagagctttgctttccgtccggccagaaaatcaaatcagcatacctcccacaacgccaaatccatatccccgctgtcttccagtctcctgcacattacaagcagacattcactagctgtctgattgagcaccttaacattttgctttttggactggctcagaatctgcaaaaggctctgagtaaggtcgacataagtttctacacatcattgaagggggagaaacttaaaaatgctgagaataacgtcccatcctgtcaccatagccagccagccaagctggtaatggttaagaaggagggtcctaacaagggtagactcttttatacatgcgacggccctaaggcagaccgctgtaaattctttaaatggttggaagatgttactcccgggtattctacccaggaaggagctcgccccggaatggtcctgtcagatatcaagtccatcggactgtatttacgttcacaaaagatccctctctatgaagagtgccagttgttggtgcgaaaaggcttcgactttcagcggaaacagtatggaaaactgaagaagtttactaccgtaaatcctgaattctacaatgaacctaagaccaagctgtatctaaaactgtcgcgcaaggagcgcagcagcgcatattccaagaacgatctgtgggtggtgtctaagactctcgatttcgagttggacaccttcattgcctgttcagctttctttgggccctcctccatcaacgaaatagagatactgccactgaaggggtactttccatctaactggcctacgaatatggttgttcatgcactgctggtgtgcaatgcctctactgagctgaccaccctgaagaatattcaggactatttcaacccagcaacattgcccctaactcagtacttactcaccacgtcaagccccaccatcgtcagcaacaaacgagtgtccaagagaaaattcattcctcccgcttttactaatgtgagtactaagtttgaactgctgtctctcggtgcaaccctgaaacttgccagcgagctcatccaggttcataaacttaataaagaccaggcaacggctcttatccagattgctcagatgatggctagccatgagtccattgaggaagtaaaagagctacagacacacactttccccatcactatcatccacggcgttttcggagcagggaagagctatctactggctgtggtcattctcttttttgtgcagttgttcgaaaagagtgaggctcccacaattgggaatgcacgaccatggaagctgctcatcagttccagcaccaacgtggccgtcgatcgggttctgcttggactgctcagtctgggtttcgagaatttcattagggttggatctgtacggaagatagccaaacccatactaccctactctctccatgcagggtctgagaatgagtctgaacaattgaaggaactgcacgctctcatgaaagaagatttgacccccactgagagggtttatgtccggaagagcatcgagcagcacaagttgggtacgaatcgaacattgcttaaacaggtgcgcgttgtgggagtaacatgcgctgcatgtccctttccctgcatgaacgatctgaagtttcccgttgtggttcttgatgaatgttcccagattactgagccggcctcccttctgcctatagctaggttcgagtgtgagaagttaattctagttggcgatccaaagcagctacccccaaccattcaggggtctgatgcagcacacgagaatgggctggagcagaccctcttcgatcgactctgcctgatgggccataagcctatcttgttgaggacacagtacagatgccatcctgcgatctctgcaatagcaaacgatcttttctacaagggcgctttgatgaatggggtgacagaaatcgaacgttcacccttgctagaatggcttcccacattatgcttttacaacgtgaaaggtctagagcagatcgagagggacaatagcttccataacgtggcagaggccacatttacactcaagctaattcaatctctcatagcatcaggtattgccggcagcatgataggggtgatcacactctataagtcacaaatgtataaactgtgtcatctgttatccgccgtcgattttcatcaccccgacataaagactgtgcaggttagtacagtggacgcatttcagggagcagaaaaggaaatcattattctcagttgtgtgcgtactcggcaggtgggttttatagattccgaaaaacggatgaatgtggctctgacccgggggaaacgacacctgctcatcgtaggaaacctcgcatgtctgagaaaaaatcagctatgggggcgggttattcagcactgtgagggtcgggaagatggacttcagcacgccaatcagtatgagcctcaactcaaccacctcctcaaggattacttcgagaaacaggtggaagagaagcaaaaaaagaaaagcgaaaaagagaagagcaaggataaatcccatagctag

SEQ ID NO: 26436 - DNA, 567 bp, Artificial Sequence
  Description of Artificial Sequence: Synthetic coding sequence
atggccgccaccgcccgggaggacggcgccagcggccaggagcggggccagagggggtgtgagcattacgatagggggtgccttctcaaagcaccgtgctgtgacaagctctacacatgccgcttatgccacgacaacaacgaagaccaccagttggatcgattcaaagtgaaggaagtgcagtgtattaattgcgagaagatccagcatgcacaacagacatgtgaagaatgtagcaccttgttcggtgagtactactgtgatatctgccacctgtttgataaagacaagaagcagtaccactgtgagaattgtggaatctgtaggatcggaccaaaagaggacttctttcactgcctgaaatgtaatctgtgcctggccatgaacctacaagggcggcacaagtgtattgagaatgtcagcaggcagaactgccccatctgcttggaggatatccacacatcccgtgtggttgcacatgtgctcccttgtggacacctcctccaccggacatgctacgaagaaatgttaaaagagtacgatcaggtgctcgagacagctggatag

SEQ ID NO: 26437 - DNA, 339 bp, Artificial Sequence
  Description of Artificial Sequence: Synthetic coding sequence
atggccaccggcgacctgaagcggagcctgcggaacctggagcaggtgcttcgcttgttgaactatcccgaggaagtggactgtgtggggctgatcaagggagaccctgctgcatcacttcctatcatttcctactcgttcaccagctacagcccttatgtgaccgagctgatcatggaatcgaacgtggaactgatcgctaaaaatgatctgcgattcatagacgccgtgtataagctgctgcgcgatcagtttaattacaaacccatcctgactaagaagcaattcattcagtgtggatttgctgaatggaagattcagattgtgtgtgacatctag

SEQ ID NO: 26438 - DNA, 363 bp, Artificial Sequence
  Description of Artificial Sequence: Synthetic coding sequence
atgtggaaggtggtgaacctgcccaccgacctgttcaacagcgtgatgaacgtaggaaggttcactgaggagatcgagtggctcaaatttctggcattagcctgctcagccctgggagtcaccattactaaaactcttaagatagtatgtgaagtgttgagctgtgaccataatggcggtctaccacgtatacctttttctacatttcagttcctgtacacttatatcgccgaggtcgacggagagatttgcgccagccacgtgtctcggatgctgaattatatcgagcaggaggtgatcggccctgatggtctgattaccgtcaacgactttacccagaaccccagggtgtggttagaatag

SEQ ID NO: 26439 - DNA, 2490 bp, Artificial Sequence
  Description of Artificial Sequence: Synthetic coding sequence
atggccaagtacaacaccggcggcaaccccaccgaggacgtgagcgtaaactcccgcccatttcgcgtcacaggcccgaattccagctcgggaatccaggcacgaaagaacctgtttaacaatcagggcaatgcatccccgccggctggccccagcaacgtgccaaagttcggatccccaaaaccaccagttgccgtaaagccttctagtgaagagaagcccgataaagaaccaaaaccccccttcctcaagccaaccggcgctggccaacgatttgggactcctgcttctctgaccacccgagaccctgaggctaaggtgggattcttgaaaccagttgggcctaagcctatcaacctgccaaaggaagactcaaaacctacgttcccctggcccccagggaataaaccctcgttacactctgtaaaccaagatcatgatctaaagccgctggggccaaagtccggcccgactccacccacatccgaaaacgagcagaagcaggccttccccaaattgacgggagtgaagggcaagtttatgtcagccagtcaggacctcgagcccaagccactcttcccgaagcctgccttcgggcaaaagccacctctttctacagaaaatagtcacgaggatgagtctcccatgaaaaatgtgagctcctccaaaggtagcccagcacctttgggtgttaggagcaagagcggcccacttaaaccggcaagggaggactctgagaataaggaccatgcgggggaaatttcttccctccctttccccggggtggtgctgaagccagctgcgagcaggggtggcccgggattatctaaaaatggagaagagaaaaaggaagatcggaaaatcgacgccgctaagaacacttttcaatccaaaatcaatcaggaggaactggctagtgggacgccccctgctcgtttcccgaaagcaccttcaaagttgacagtcggtggaccctggggtcagtcccaggaaaaagagaagggggataagaattcggccacacccaagcaaaagccattaccgccactatttacgcttggcccacccccacccaaaccaaataggcctcctaacgttgatctgaccaagtttcacaagacgagctccggtaattcaacatctaaaggtcaaactagttacagcactacctctttgcctccgcccccgccctcccatccagcctcccagcccccccttcctgcgtcccatccatctcagccacccgttccttccctcccaccacggaacataaagccgccatttgatctgaagagtcccgtgaatgaggacaatcaggacggagttacacattcagacggagctggcaacttggacgaagagcaggatagcgaaggggaaacttacgaagatattgaggcttcgaaggaacgcgaaaaaaaaagggaaaaggaggaaaagaagagactggaacttgagaaaaaggagcagaaagagaaggagaagaaggagcaggaaatcaagaagaagttcaaattgaccgggcccatccaagtcatacacctggcaaaggcttgctgtgatgtgaaaggtggaaaaaatgagctcagttttaagcagggagaacagatagaaatcattaggatcactgataacccagagggtaagtggctgggacgtaccgctcgcggttcatacggttatataaagaccactgccgtcgaaatagattatgatagcctgaagctcaaaaaagatagtcttggggccccaagtcgacctatcgaggacgaccaggaggtctacgacgatgttgcagaacaagacgatatctcttctcacagtcagagcggatctgggggaatatttccccctcctcccgacgatgacatctatgacggaattgaggaggaggatgccgatgacggaagtacactgcaggtgcaggagaaatctaatacatggtcatggggaatcttgaagatgctgaaagggaaggacgaccgaaagaaatcaatccgggagaaacccaaggtcagtgatagtgacaataatgagggcagttctttccctgctcctccaaagcagctcgatatgggggatgaggtgtacgatgacgttgacaccagtgacttccctgtctcctcagccgaaatgagccaggggaccaatgttggtaaagccaaaactgaagaaaaggacctgaagaaactaaagaagcaagaaaaagaggagaaagactttcgaaaaaaattcaagtacgacggggagatccgcgtactttactccacaaaagttactacctccatcaccagcaagaagtggggcaccagagatcttcaggtaaaaccaggagaatcactcgaagtgatccagaccaccgacgacactaaggtcttgtgcagaaatgaagagggcaaatacggatacgttctgagatcctaccttgcggataacgacggcgaaatctacgatgacattgccgatgggtgtatctacgataacgattag

SEQ ID NO: 26440 - DNA, 795 bp, Artificial Sequence
  Description of Artificial Sequence: Synthetic coding sequence
atgcccgacagcgcccccgccatggccgacaagatggacatgagcctggacgacatcattaaattgaaccgctctcagcgaggaggtaggggggggggaagaggccgcggtcgggctgggtcacaggggggccgagggggaggagctcaggccgccgctagagttaacaggggggggggccctatccgcaatcgtcccgcaatagccaggggggccgccgggggaggtggacgcaacaggccagccccttattctcggcctaaacagcttcctgataaatggcaacatgatctgttcgactctggatttggcggcggggccggcgtggaaacaggaggcaaactgctggtctccaacttagattttggcgtctcagatgctgatatccaagagcttttcgcggagttcggcacactgaagaaagcggccgtgcactacgacagatcagggaggtctttggggactgcagatgtgcatttcgaaaggaaagcagacgccctgaaggctatgaaacaatacaacggagttccactagacggaagaccaatgaatatccagttggtgacctcacaaatagacgcacagcgtagacccgcccagtctgttaatcgcggaggcatgacccggaacaggggggccgggggattcggcggtggtggcggcacacgtcggggtacccgtggtggagcgcgagggagaggacgaggggcaggccgtaattcaaaacagcagttatccgctgaggagctggacgcacagctcgacgcgtataatgctcgtatggacacctcatag

SEQ ID NO: 26441 - DNA, 312 bp, Artificial Sequence
  Description of Artificial Sequence: Synthetic coding sequence
atggccaagcacggcgccgacgagcccagcagccggagcggcagccctgatagagagggacgcgccagtgaggaccggtccctgctgcaccaaagacttgcagtgcgggagcttatcgacaccgaggtgtcctacctgcacatgctccagttgtgcgctagtgacatcaggtcacgcttgcagcagctgccacagggagaccttgacgtgcttttctcaaacattgacgatattatcaaagtgaacagcaggttcttgcacgacctgcaggaaactgccagcaaggaggaggagcaagttcagcttgtttag

SEQ ID NO: 26442 - DNA, 639 bp, Artificial Sequence
  Description of Artificial Sequence: Synthetic coding sequence
atgatgctgggcaccgagggcggcgagggcttcgtggtgaaggtgcgtggcctgccctggagctgttccgccgatgaggtccagagattctttagtgattgcaaaatccagaatggcgcacaaggaatcagattcatttacacgagagaaggccgcccttctggagaagcttttgttgaattggagagcgaggatgaggtcaagttggccctgaagaaggaccgcgagaccatgggtcaccgatacgtcgaagtctttaagtctaacaatgtggaaatggactgggtgctgaaacacaccggtcccaactcacctgacacagctaacgacggctttgtgcgactgagagggctaccattcggttgctcaaaagaggagatagtgcaattcttcagcggcctcgagattgtgcccaatggaatcactctccctgttgactttcagggaagaagcacaggggaagcattcgttcaattcgcctcccaagagatcgccgagaaggctcttaagaagcataaagagaggattggtcataggtacatagaaatcttcaaatcatcacgcgctgaagtgaggacacattatgaccccccacgtaaattaatggcaatgcaacggccaggtccttatgacaggtag

SEQ ID NO: 26443 - DNA, 1020 bp, Artificial Sequence
  Description of Artificial Sequence: Synthetic coding sequence
atgtggaccgcccggggccccttccggcgggaccggtggagcagcgaagatgaggaagcagccggcccctctcaggctctctcccccctgctgtctgataccagaaagatcgttagtgaaggcgagctggaccagctggcccagattcgccccctgatttttaactttcatgagcagacagcaatcaaagattgcctgaagatcctggaagagaaaacggcggcgtacgacatcatgcaggaattcatggctctcgagctgaagaatctgcctggagagtttaattctgggaatcagccctccaatcgcgaaaagaaccggtacagagacatacttccctacgacagtaccagggtccctctgggtaagtcaaaggattacataaacgcctcttatattaggattgtaaattgtggagaggaatatttctacatagccacccagggccctctgctgagcaccattgatgatttttggcagatggtgcttgagaacaactcaaacgtgattgccatgatcacgagagaaatcgagggggggattataaagtgctaccactactggccaatttctctcaagaagccgttggaattgaagcacttccgcgtattcctggagaactatcaaatcctgcagtactttattattcggatgttccaggtggtcgaaaagagtaccggtacttcccattccgttaaacaacttcagttcacaaaatggcctgatcatgggacaccagcatcggccgacagcttcatcaaatacattaggtacgccaggaaatcccacttgacggggcctatggtggtgcactgctcagccggaatcggacgtacaggcgtgttcctttgcgttgacgtcgtgttctgtgccatcgtgaagaattgcagcttcaacatcatggacatcgtggcccaaatgcgggaacagcgcagtggaatggttcagaccaaagagcagtatcacttttgctacgacatcgtgcttgaggtcctgagaaagctacttaccctcgactag

SEQ ID NO: 26444 - DNA, 3213 bp, Artificial Sequence
  Description of Artificial Sequence: Synthetic coding sequence
atggccggcgccctgcggcggggccgggccctgggcagccggccctcaggacctacggtttcctcccgccgctcacctcaatgccccgttgcccaggagggcctgggagcccgttctagaccacgagttgccccccggagcttggcccgttgcggcccatctagccgactgatgggatggaagccatccgaagctcgcggccagtctcagagctttcaggcctctggactacagcctcggtctttgaaagccgctagacgtgctaccgggcggcctgacaggtcccgggcggctcgccccacgatggacccatcagcccatcgcagcagagctgccccccctaacatggaccctgacccccaggccggagtgcaggtaggaatgcgggtggtgaggggagtagattggaagtggggccagcaggacgggggggaggggggggtgggcaccgtggtagagcttgggcgccacgggtcaccatccaccccagacaggactgtggtggtgcagtgggaccaaggcactaggacaaactaccgggccggctatcagggcgcccacgacctgttgctgtacgataacgcccaaatcggggtacgccatcccaacattatctgcgattgttgcaaaaaacatggactccgcggcatgaggtggaaatgccgggtctgtctggattacgacctgtgtacccaatgttacatgcacaataaacacgagctcgcacatgcttttgacagatatgagaccgcccacagcaggccggtgacgctgagcccaaggcaaggacttcctaggatcccacttcgcggaatctttcagggcgcaaaagtcgtgaggggtccagactgggagtgggggagccaggatggcggcgagggcaagccaggcagggtggtggacatcagagggtgggacgtggagacgggacgctctgtggctagtgttacttgggccgatggcacgaccaacgtgtatagggtcggtcacaaggggaaagtggacctgaaatgtgtgggagaagccgcaggagggttttactacaaagaccacttgccacgattgggcaagcccgctgaactgcagaggcgagtgtctgccgactcccagccatttcagcacggagataaagtaaaatgcctcctcgacacagacgtgttgagagagatgcaagaggggcatggggggtggaacccccgcatggccgaattcataggccaaaccgggaccgttcaccggataacagacagaggtgacgtcagggtccaatttaatcacgaaacgcggtggacgtttcatccaggggctcttaccaagcaccattccttctgggttggagatgtggtgcgcgttattggcgatctcgacactgttaagcggctgcaagccgggcacggggaatggaccgatgatatggcaccggccttggggcgagtcgggaaagtcgtcaaggtgtttggagacggcaatttacgtgtcgctgttgcaggacagcgttggaccttttctcccagctgcctggtagcttacagacccgaggaagacgctaacctggacgtcgccgaaagggctagggagaataaatctagtttgtctgtcgctctggacaaactgagagctcaaaagtccgacccggagcaccccggaagactggttgtggaagtggccctcggaaatgccgcacgcgctttagatctacttcgcaggagaccagaacaagttgataccaagaaccaaggacggactgccctgcaggtggccgcttacctgggtcaggtagaattaatcaggctgctgctgcaggcacgggcaggtgtggacctgcccgacgacgaggggaacacagcactccattacgcggctcttggcaaccagcccgaggcgacacgtgttttgctgagcgccgggtgcagagcagatgccataaattccacccagtctacagcgcttcacgttgcggtgcaaagggggttcctggaggttgtgagagcgctgtgtgagcgcggctgtgatgtgaaccttcccgatgctcactctgacacaccacttcacagcgcaatttccgctgggaccggggcatccggcatcgtcgaggtactcacggaggttcccaacattgacgtgactgctaccaatagccaaggcttcacactgttgcaccacgcgtctctgaaaggccacgccttggcagttcggaagattctggccagagcccggcagctggtcgatgccaaaaaagaggatgggtttacggccctgcatctggctgccctgaataatcatcgcgaggtcgcgcaaatcctcatcagggaagggagatgtgacgtcaatgttagaaatcgtaagctccaaagtccgctgcacctggctgttcagcaggcccacgtcgggcttgtccccctgctcgtggatgccggatgctccgtcaacgctgaggatgaagagggtgacaccgctctgcacgtggctctgcagcgccaccaactgctgccactggttgcagacggagccgggggggaccctgggcctctgcagttgctaagccgcttacaggcctcaggactgcctggatcagccgaactgacggtgggagcggctgtcgcatgctttctcgccctagagggtgctgatgtatcttatactaaccacaggggccggagccccctggatttagccgcggaaggacgcgtgctgaaagcgctccagggctgcgctcagcgattcagagagaggcaagccggcgggggcgccgccccaggtcccaggcagacccttgggactcctaatacggttacaaacctccacgttggtgcagcccctggcccagaagcagcagagtgtctcgtttgtagcgagctggcactgttggtactcttctctccgtgccagcatcgaactgtttgtgaggagtgcgcacggcgtatgaaaaaatgtattcggtgccaggtggtggtgtctaagaaactgcggcctgacggttctgaagttgcctccgctgcccctgccccgggccccccacgacagttggtggaggaattacaaagtaggtataggcaaatggaagagaggatcacctgccccatttgcattgacagccacataagacttgtgttccagtgtggacatggagcctgtgctccttgtggaagcgctcttagtgcgtgcccgatatgcaggcagcctattcgagatagaatccagatattcgtttag

SEQ ID NO: 26445 - DNA, 957 bp, Artificial Sequence
  Description of Artificial Sequence: Synthetic coding sequence
atgtgccggaccgccctgggcgtgaccaccctgcaggacctgggcgtttgttggagaaaagagcatgatcctgccgagatgctacgggttggcagagctgaactcggagggtggaagccaagttgggaggcaatcgttaaagaggtggccgcagccaccggacacacagtagttttggttgaccagacggaggatatacttgccaaatctaaaaaagggatcgaggagtcgctgaggaaggttgccaaaaagaagtttgctgagaacctcaaggccggggacgaatttgtcgagaaaactctttctaccatcgccacctctacagatgcggcctctgtggtgcactctacagacctcgtagttgaggccatcgtcgaaaatctcaaagttaaaaatgagctttttaaaaggctggataaattcgctgcagagcacacaatattcgctagtaatacaagttccctccagataacctctatcgcaaatgcaactactagacaggatcgcttcgccggtctgcacttttttaaccccgtgccagtcatgaaactagtggaagtgattaaaacacctatgactagccagaaaaccttcgaatcccttgtcgacttttcaaaggcattaggcaagcatccagtcagctgtaaggacacaccgggctttattgtgaatagattgttggtcccatacctcatggaagctatcaggctctacgaacggggggacgccagtaaagaagatattgacacagctatgaagctcggcgcaggctaccctatggggcctttcgagcttctggactatgttggtttggatacgactaaatttattgttgatggctggcacgagatggatgccgagaaccctctgcatcagccctcgccatcacttaataagcttgtggctgaaaataaatttggaaagaagaccggggaagggttctacaagtacaagtag

SEQ ID NO: 26446 - DNA, 1044 bp, Artificial Sequence
  Description of Artificial Sequence: Synthetic coding sequence
atgaagctgaccagcgagaagctgcccaagaaccccttctacgcctcagtgtctcaatatgccgctaagaatcagaaatttttccagtggaaaaaagagaagacagactatacccatgccaatctggtcgataaggccctgcagctgctcaaagagagaatcctcaaaggtgacacactggcctattttctgcggggtcagctgtactttgaagaagggtggtacgaggaggccctcgaacagtttgaagaaataaaagagaaggaccatcaggccacgtaccagctcggcgttatgtattacgatggcttgggcactaccctggacgccgagaaaggcgttgactacatgaagaagatccttgattccccctgccctaaggcccggcaccttaaattcgccgcagcctacaatctggggagagcttactacgagggtaagggggtgaagcgaagcaatgaggaagcggaacggctgtggctgatcgccgccgataacgggaatcctaaggctagcgtcaaagcacagagcatgctgggactgtattactctacaaaagagccaaaggagctcgagaaggctttctactggcactcagaagcttgcggaaacggaaatttagaaagccagggtgccttaggtctcatgtacctttacggtcagggaatcaggcaggacacagaggccgctctgcaatgcctgcgggaggcagccgagaggggcaatgtatatgcacagggcaacctcgtcgaatattactataagatgaagttcttcaccaagtgcgtcgccttctctaaacggattgcggactatgatgaggtccacgacatccccatgatcgcacaggtgaccgactgtcttcctgaatttatcggccgagggatggcgatggcctcgttctaccacgcccggtgcctgcagctaggattggggattacaagggatgaaacgaccgctaaacattactacagtaaagcctgcaggctaaatcctgctctcgctgacgagcttcatagcctcttgattaggcagcgaatatag

SEQ ID NO: 26447 - DNA, 108 bp, Artificial Sequence
  Description of Artificial Sequence: Synthetic coding sequence
atgccccagaccttcagcggcggccggggcttcgagctggacagcggcagtgacgacatggatcccggaaggcctaggccacccagagacccagatgaacttcattag

SEQ ID NO: 26448 - DNA, 1179 bp, Artificial Sequence
  Description of Artificial Sequence: Synthetic coding sequence
atgggcaccacctgcctgcacctgggcaccctggagcagagcctggtgttcgaaaacaaggtcaacagcgaaaaagtgaaactgtcccttaggaactttccacataatgactacgaggacgtatttgaagaacctagcgagtcggggagtgatccctcaatgtggactgctcgtggccccttcaggcgggataggtggagtagcgaggatgaagaagccgctggcccctcacaggccctgtccccacttctcagcgacacacggaaaatcgtcagtgagggcgaactggatcagctcgctcagattcggccactgatattcaattttcacgaacagactgctataaaagattgtctgaaaattcttgaggagaagactgccgcctacgacatcatgcaggaattcatggctctggagcttaaaaacctgcctggggagtttaatagcggaaatcaaccgtccaaccgcgaaaaaaaccggtaccgggatattctgccatacgatagcactcgcgtgccacttggaaaaagcaaggactacattaacgcatcatatatccgaatcgtgaattgcggtgaagaatacttttacatcgccacccagggtcccctgctgtcaacgattgatgacttctggcagatggttctggaaaataactctaacgttattgctatgattaccagggaaatcgaaggtggaatcattaagtgctatcactactggcctatctcacttaagaagccacttgagctcaagcattttcgggttttccttgagaattaccagatattacagtatttcattattaggatgttccaggtggttgagaaaagtaccggcacttcgcattcagttaagcagctacagttcaccaaatggcctgatcatggcactcctgcgagtgccgacagctttattaagtacatcaggtacgctcgtaagagtcatctaaccggacccatggtcgtgcactgctccgctggcattgggaggactggggtcttcttgtgtgtagacgtcgtgttttgcgcgatcgtgaaaaattgctcttttaatattatggacatcgtcgcacagatgcgtgaacaaagatctggcatggtccagacgaaggaacagtaccatttctgttatgatatcgttctcgaggtcctgagaaagctgctgactctcgactag

SEQ ID NO: 26449 - DNA, 2052 bp, Artificial Sequence
  Description of Artificial Sequence: Synthetic coding sequence
atgaacaccagcatcccctaccagcagaacccctacaacccccgggggagctctaacgttatccagtgctaccgttgcggagatacatgcaagggtgaagtggttagggtccataacaaccattttcatatccgctgcttcacatgtcaagtgtgcggctgtgggttggcccagagtggctttttctttaagaatcaggagtatatttgtacccaagattaccagcagctgtacggcacccggtgtgactcctgccgtgactttattaccggagaagtaatctcggcgctcggtcggacgtatcatccaaagtgcttcgtgtgctcattatgtcggaagccatttccaatcggcgacaaggtaacctttagcggcaaggagtgtgtttgccaaacatgctcacagagtatggccagctcaaagccgataaagattaggggtccatcacattgcgctggctgcaaggaagaaattaaacacggacagagcctgctggccctcgacaaacagtggcacgtgagctgctttaaatgtcagacctgtagcgtaattttaacaggcgagtacattagcaaggatggcgtgccgtattgtgagagtgactaccacgcgcaattcgggatcaaatgtgaaacttgcgatagatacatttctggtcgcgtcttagaagcgggcggaaagcactaccatccaacttgtgcaaggtgtgtgaggtgccatcagatgttcaccgagggggaagagatgtatttgaccggatctgaggtgtggcatccaatctgcaagcaggcagctagggcagagaaaaaacttaagcaccggaggacaagtgaaacatcaatctctccccccggtagcagcatcggatctccaaaccgcgtgatctgtgccaaggtagataacgaaatattaaactataaagatctggcagctctgccaaaagtcaagtctatttatgaggttcagagacctgacttaatttcgtacgagccccattctcggtacatgagtgatgaaatgctggaaagatgtggttatggagaatctcttgggactctgtcaccctatagtcaggacatctacgagaacctggacctccgtcaaaggcgggcaagctccccaggctatatcgacagtcccacgtattctcgccaagggatgtctcctactttttcacgtagcccacaccattactatcggagtgggcccgagtctggccggtccagtccctaccacagtcaactcgacgtaaggagttccacgcccacctcatatcaggcacctaagcattttcacattcctgccggtgactctaacatttaccgcaaacctcctatttataagagacacggcgatctgagtactgccaccaaatctaagacttccgaggatatatcacaaacctccaaatacagcccgatatattcacccgatccctattacgctagcgagtcagaatactggacgtaccatgggagccctaaggtacctcgggcccggaggttcagtagtgggggagaggaagatgacttcgatcgctcaatgcacaagctgcagtctggcatcggacgtttgattcttaaggaggaaatgaaagccaggtctagttcctacgccgatccatggacgcccccacggtccagtacaagttctagggaggcactccacacggctggatatgagatgagccttaacggctctccacggtctcattatctggccgactcagatcctctgatatccaagagcgcttccttgcctgcctacagacgtaatggcctgcacagaacacctagcgcggatctgttccattacgactcaatgaacgctgtcaactgggggatgagggagtataagatttatccttatgagttgctgctggttaccaccaggggcagaaaccgccttcccaaagatgtggataggacccgcctggagcgtcatctcagccaggaagagttttaccaggtgttcggtatgaccatctcagagttcgatagactggctttgtggaaaaggaatgaactgaaaaagcaggcaaggttattctag

SEQ ID NO: 26450 - DNA, 99 bp, Artificial Sequence
  Description of Artificial Sequence: Synthetic coding sequence
atggacttcttcagcagccacctgctggccgacagcagcagccccgcaaccaacagctcccacactgatgcccacgaaatacttgtctctgacttctag

SEQ ID NO: 26451 - DNA, 858 bp, Artificial Sequence
  Description of Artificial Sequence: Synthetic coding sequence
atgagcgaggccggcgaggagcagcccatggagaccaccggcgccacagaaaacggacacgaggctgtacccgaaggtgaatcaccggcaggcgccggcacaggcgccgcggccggggctgggggcgctactgccgcaccaccctcggggaaccagaacggtgcagaaggagatcagatcaacgcgtctaagaatgaagaagacgctgggaagatgtttgtgggtgggttgtcatgggacacctcgaaaaaggacctgaaggattacttcaccaagtttggggaggtggtggactgtactatcaagatggatcccaacaccgggagatccaggggctttggcttcatcctattcaaggacgctgcttcggtggaaaaagtgctggaccagaaagagcatcggctggatggacgcgtgatcgacccaaaaaaagccatggctatgaaaaaagatccagtgaaaaagatatttgtgggtggcctcaatccagaggccaccgaggagaaaattagggaatattttggtgagttcggcgagatagaagccatcgagttgcccatggaccctaaactgaacaagcgtagaggttttgtctttataaccttcaaggaggaagagcccgtcaaaaaagttttagagaaaaagtttcataccgtcagtggtagtaagtgtgaaattaaggtggcgcagcccaaagaagtctaccagcaacagcagtacggctctggtggtaggggcaaccggaaccgcggaaacagaggatccggcggaggggggggcggtggcggccaggggtcaactaattatggaaagtctcaaaggcggggcggccatcagaacaactacaaaccgtattag

SEQ ID NO: 26452 - DNA, 354 bp, Artificial Sequence
  Description of Artificial Sequence: Synthetic coding sequence
atggtgcagcggctgacctaccggcggcggctgagctacaacaccgccagcaacaaaactcggctatctcgcactcccggaaacagaatcgtttacttgtacacgaagaaagtggggaaggctccaaagtctgcgtgtggggtgtgtcctggccggcttaggggggtgcgggccgttcgcccaaaggtactgatgcggctctctaagactaaaaagcatgttagcagggcgtacggcggaagtatgtgcgctaagtgtgttcgggatcgcatcaagagggcatttctgattgaagaacagaaaatcgtggtgaaggtgctgaaggctcaagcccagtctcagaaagccaagtag

SEQ ID NO: 26453 - DNA, 7614 bp, Artificial Sequence
  Description of Artificial Sequence: Synthetic coding sequence
atggaggacttccggggcatcgccgaggagagcttccccagcttccttaccaatagcctattcggaaactctggcatcctggaaaacgtcaccctgtcctccaatctcggtctgcccgtcgctgtatctactctcgcgagagacagatcatctacggacaatcgttatccagatattcaggcatcttatctggtagagggcagattctctgtgccctctggcagctctccaggaagccagtcagatgccgagcccagagagcggctccagttatcctttcaggatgatgattctatcagtaggaagaaatcctacgtcgagtcccagaggttatctaacgcgctgagcaaacagagcgcccttcaaatggaaaccgcggggccagaagaagaaccagctggggcaacagagagtctccagggacaggacctgttcaatcgggcatcgccactggagcaggcgcaggacagccccatagactttcacctccagagctggatgaacaacaaagaacctaagatagtggtgttggacgccggaaagcactttgaggacaagacactcaaatcagacctgtcccacacatcgctcctggaaaacgaaaagctgatcttgcctactagccttgaagacagctcagatgacgacattgacgacgagatgttctacgacgaccacctggaagcttactttgaacagctggcgatccccgggatgatatatgaagatctcgaaggcccggagccgcctgagaaaggcttcaaactgcctacaaatggtttgaggcaagccaacgagaatggaagtctgaactgcaagtttcagtctgaaaataattccagtctcatctcgctggactcccacagctctgagacaacccacaaggaaagcgaggagagccaagttatctgtttgcccgggacttcgaattccatcgggaccggcgattctcgccgctatacagacggtatgcttcccttctcttcaggcacttggggcaccgaaaaggagattgaaaatctgaaagggatcgtgccagatctcaactcagaatgtgcaagtaaagatgtgttggttaagacactgcgtgctatcgatgtgaaattaaatagcgataattttcatgacgctaatgctaaccgaggagggtttgaccttaccgaccctgtgaaacagggagctgagtgtcctcaccagaataagaccgtcctgcatatggatggctgtctggatactgaaacaccaactgtgtccatccaagagaatgttgatgtggcaagtctgaaaccaatctctgacagcggcataaacttcacagatgccatttggtcaccaacatgcgaaaggaggacatgcgaatgccacgaatctatcgagaagaacaaggacaaaacagacttgccccagagtgtggtataccagaatgaagaggggcgctgggtgaccgatctggcctactacactagcttcaactctaagcagaatctgaatgtcagcctgtctgacgagatgaacgaggatttccgctccggctctgaggcgtttgatcttattgcccaagacgaggaggagtttaataaagagcaccaatttattcaagaggagaatatcgatgcgcacaatacttctgtagccctcggcgacacctcatggggcgctaccatcaactattcactccttcggaagagtaggagtacgtctgatctggataaagatgatgcttcatatctcaggcttagtttgggcgagttctttgcccagcgctccgaggctctcggatgcctcggaggcggcaataacgttaaacgaccatctttcggctatttcatccggagtccagagaaacgagagcctatcgctctcatcagaaagagcgacgtgtcaaggggcaatctggagaaggagatggctcatctgaaccacgatttgtatagtggcgatttaaacgagcagtcccaggcccagctgtctgaaggcagcatcactttgcaagtggaggccgttgagagcacttctcaggtagacgagaacgacgtgaccttgacagccgacaagggaaagaccgaggacaccttttttatgagtaataagccacagcgttacaaagataaactgcccgacagcggagacagcatgctgcgcatctcaacaatagcgtctgccattgccgaggccagtgtcaacaccgatccttcccaactagccgccatgattaaagctctgtcaaacaaaactcgagataagacctttcaggaggatgaaaagcagaaggactattcccatgtgcgccacttcctccccaacgatctcgagaaaagtaatggctccaatgccctggatatggaaaaatatttaaaaaagaccgaggtgtctcgctatgagagcgccctggagaatttttcacgcgccagcatgagcgacacctgggacctgtccctgccaaaggagcaaactacccaggacattcacccagttgatctttcagcaacttccgtttcggtccgggccccagaggagaacaccgctgctatcgtctatgtagagaatggcgagagcgaaaaccaggaaagtttccggaccataaactcctcgaactcggtgactaacagggaaaataactccgcggtcgtcgatgtaaagacttgctccattgataacaagctgcaggacgtgggcaacgacgaaaaggccacctccatctcaactccgtcggacagctattcttcggtccggaaccctcggattacgagcctttgtctgctgaaagattgcgaagagatacgtgacaacagggaaaatcagcggcagaacgaatgtgtatcagagataagtaatagcgagaagcatgttacttttgaaaaccaccggatcgtgtcacccaaaaactctgacctgaaaaatacaagccctgaacatggcggacgcggctctgaagatgagcaagagtcttttcgaccaagcaccagccctctgagtcatagctcaccgtcagagattagcgggacatctagctccgggtgtgccctggaatcattcgggtcagcggcgcagcaacagcagccgccatgtgagcaggaactgtctcctctggtgtgcagtcctgcaggcgtctcacggctgacctatgtgtctgaacccgagagttcgtacccaacaacagcgactgatgatgcccttgaggaccggaagtccgacattaccagcgaactttccacgacaatcattcagggttctccagccgctctggaagaacgggccatggagaagctgcgggaaaaggttccatttcaaaaccgcgggaagggaaccctatcaagtattatacagaataatagcgacacgcggaaggccacagaaaccactagcctatctagcaaacctgaatacgtcaaaccagatttcagatggtcaaaagatccatcctcaaaaagcggcaacttgctcgagactagcgaagtgggctggacgagtaaccccgaggaattggatcccattcgtctcgcgttactcggtaagagtggcctgtcgtgccaggtaggttctgccacttcccaccccgtgagctgtcaggagccaatagatgaggatcagagaatcagccccaaggacaaatccacagccggtcgcgagttcagtgggcaggtctcccatcagaccacgtctgaaaatcagtgtacccccatcccctcgtcaacggtccactctagtgtcgctgatatgcaaaatatgccagcggcagtacatgcactgctcacccagccatccctatccgcggccccatttgctcaacggtacctggggaccctgccttccacggggagcacaacactgccacaatgtcacgcaggaaatgccactgtctgtgggttttccggtggcctgccataccccgccgtcgccggcgaaccggtgcaaaacagcgtggctgtgggcatctgtctcggatccaatataggaagcgggtggatgggtacctcctccttatgtaacccctactctaacacgctcaatcagaatcttctgtcgaccacgaaaccgtttcccgtgccatcagtgggaacgaactgcggtatagagccatgggacagtggtgtaacatcaggcctggggagcgtgcgagtgccagaggaactaaaactgccccacgcatgttgcgtgggaattgcatctcagacactcctgtccgtcctgaatcccactgataggtggctgcaggtgtccatcggagtgctgtcaatctctgttaatggggaaaaagtggatctgtccacctatcgatgtttagtgttcaagaataaggcaatcatccgcccccatgcaaccgaggagataaaggtcctgttcattccctctagtcctggtgtctttcgatgtaccttcagtgtggcgtcctggccttgctcgacggatgcagaaacaattgttcaggcggaagccctggcctcaacagtaacccttaccgctatcgctgaaagcccggtaatcgaggtcgagacagaaaaaaaggatgtgcttgactttggagacctgacttacgggggttggaaggcactcccattgaagctgatcaatcgcacacacgccaccgtaccaatcagactcattataaatgcaaatgcagtagcatggcgttgcttcactttttcaaaggaatccgttagggcacccgtggaggtggctccttgtgccgacgtcgtaaccagactcgcgggaccttccgtggtgaaccacatgatgcctgcctcttatgacggacaggatcctgaatttctgatgatctgggtgctttttcacagtcccaagaagcagattagcagttctgatatccttgactctgcggaggaattcagcgctaaggtcgatatcgaggtcgactcccctaacccgacacctgtgcttcgctctgtcagtctcagggcccgagctgggattgcacggattcatgctccccgggatctccagacaatgcatttcctggccaaagtggcgtcgtctcgcaaacagcacctgccccttaaaaacgcaggaaacattgaggtttacctggatatcaaagtgccggagcaaggctcgcatttttcggtagaccctaagaaccttctgttgaagcccggtgaagaacacgaggtgatcgtatccttcacccctaaagaccccgaagcgtgcgaggagcgcatccttaagatctttgtccagccgttcggcccccagtatgaagttgtgctgaagggagaggtgatctcttccggcagcaagccgctttcacccggaccctgtctagacatcccctcgatcctgtccaacaaacagttcttggcgtggggcggagtgcccctgggtaggacacaactccagaaacttgccttgaggaataactccgcttcaaccacacagcatctacgtttactgatcagaggccaggaccaggactgcttccaactgcagaacaccttcggcagcgaacagcggctaaccagcaactgcgagatccggatccaccccaaggaggatatcttcattagtgtgctgttcgcaccgaccagactgtcttgtatgctagctaggctggaaattaagcagcttggcaaccgctcacaacctgggatcaagtttaccattccactatctggttacgggggaacttcgaacctgattttggagggggtaaaaaagctgtctgacagctatatggtcacagtaaatggcctcgtgcctggtaaagaatcaaagatcgtcttctctgtgcggaatacagggtcccgcgccgcatttgtgaaggcggtgggattcaaggacagtcaaaaaaaggtgcttcttgatcctaaagtgctgcgaatctttcctgacaagtttgtgcttaaggagaggacacaagagaacgttaccctgatctataatccctctgacaggggtattaataataagaccgcaaccgagctgtctaccgtttatctcttcgggggagacgagattagcaggcaacaataccgtcgggctctgctgcacaaacccgaaatgatcaagcaaattctccctgagcactccgtgttacagaacatcaacttcgtcgaagcctttcaggatgagctcttagtgaccgaagtatacgatctccctcaaagacccaatgatgttcagttgttctatggcagcatgtgcaaaatcatactaagcgtcatcggtgagtttcgcgactgcatatcttctcgggagtttctgcagccttccagcaaggccagccttgaaagcacatccgatctgggcgcctcggggaaacatggcggaaatgtgagcctcgacgtgctgccggtcaagggtccccagggcagccctctgctgagtcgagccgcgagacctcctctagaccagctagcctcagaagagccttggaccgtcctgcccgagcaccttattctggtcgccccaagtccatgcgacatggctaagactgggcgttttcaaattgtcaataactccgttaggctgttgagattcgagttgtgttggcctgcacattgtctgaccgtgacaccacagcatgggtgtgtagcgccagagagtaaactacagatattggtcagccctaacagtagcctaagcactaaacagtcaatgtttccctggtcaggtttgatctacatccactgtgatgacgggcagaagaagatcgttaaggtgcaaattagggaggaccttacccaggtagaactgctcacccgcctgaccagcaaacctttcggcattctatctccagtaagtgagccttcggtctctcatctggtgaaaccaatgaccaagcccccttccaccaaggtggaaataaggaataaatctatcacgttcccaacaactgagcccggcgagacatcagaatcgtgtctcgagctggagaatcacggcacaacagacgtaaagtggcacctaagcagcttagcgcccccatacgtgaaaggggttgatgagagcggagatgtgttccgcgccacctacgcagccttcagatgttctccgatctcaggcctcctcgaaagccacggcatccagaaggtgtccatcacatttctgcctcgcggacgaggggactacgctcagttttgggatgtggaatgccaccctttgaaagaacctcatatgaaacacacactcagattccagctgagtgggcagtcaatcgaggccgagaatgagcccgaaaacgcatgcttatctacagactccttaataaagattgaccatttggtgaagcctcggcgccaagcagtgtctgaagccagcgcaaggatcccggagcagctggacgtcactgctcgaggcgtatacgcacccgaggacgtgtaccggttccggccaacgtctgtgggcgaatcgcggacgctgaaagttaacctgagaaataatagtttcatcacgcactcactgaagttcctgtctcccagggagccgttctatgtgaaacattcgaaatacagtctgcgagcccaacactatatcaatatgcccgtccaatttaaacctaaatcagccgggaaattcgaggccctgctggtcatccaaactgatgagggcaaatctattgctatacgcctaatcggggaagcacttggaaaaaattag

SEQ ID NO: 26454 - DNA, 90 bp, Artificial Sequence
  Description of Artificial Sequence: Synthetic coding sequence
atgctgtgctggggcaacgccagcttcggccagctgggcctgggcggaatagatgaagaaattgttctggagcctcggaaatcagactag

SEQ ID NO: 26455 - DNA, 66 bp, Artificial Sequence
  Description of Artificial Sequence: Synthetic coding sequence
atggccaagtacaacaccggcggcaaccccaccgaggacgtgagcgtcaacagtaggccattttag

SEQ ID NO: 26456 - DNA, 261 bp, Artificial Sequence
  Description of Artificial Sequence: Synthetic coding sequence
atggaggccgacatcatcaccaacctgcggtgccggctgaaggaggccgaggaggagaggctgaaagctgctcaatacgggttgcagctggtggaatctcagaacgagctgcaaaatcagctggacaagtgccggaacgagatgatgaccatgaccgagagctatgaacaagagaaatacaccctgcagcgggaagttgagctgaagagtcgcatgctggaatcgctgtcctgtgagtgcgaagctataaagcaacaatag

SEQ ID NO: 26457 - DNA, 1983 bp, Artificial Sequence
  Description of Artificial Sequence: Synthetic coding sequence
atggtgaccagcctgaacgaggacaacgagagcgtgaccgtggagtggatcgagaacggggatacgaaagggaaggaaattgacctggaatccattttttctctgaaccccgatcttgtacccgacgaggagattgagcccagtcctgagacgcctccccccccggcaagctccgccaaggttaacaagatcgtgaagaaccgaaggacagtagcaagtataaagaacgacccaccgagccgggataatcgggtggttggaagcgctcgggctcggcccagccagttccccgagcagagcagcagtgcccaacagaacgccaggagaaagtcaaattgtgtaaaagaggtggaaaagctgcaagaaaaacgcgagaagcgtcggcttcagcagcaggaactgcgggaaaagagggcacaggatgtagatgccactaatcccaattatgagattatgtgcatgatcagagactttcgagggagtctggactacagaccccttacaaccgctgaccccattgacgagcacaggatatgtgtttgcgtcaggaaacgtcccctgaacaaaaaggaaacacagatgaaggaccttgatgtcatcacaattcctagtaaggacgtggtgatggtccatgagcctaaacaaaaggttgatttgactaggtacctggagaaccaaacctttagattcgactatgccttcgacgatagtgctcccaatgagatggtataccggttcacggcaagaccactggtggagaccatatttgagagaggtatggctacctgcttcgcttacggccagactggaagcggaaagacgcacactatgggtggcgacttttctggaaaaaatcaagactgttctaaaggcatctacgcactggccgcacgagatgtgttcttaatgttaaagaagcctaactacaaaaagttggagctccaagtgtatgccactttctttgagatctactccgggaaggtgtttgatttactgaaccggaagaccaagctgagggtactcgaagacggcaaacaacaagtgcaggtggtgggcctgcaggagagagaagtgaaatgtgtggaagacgtgctcaaactgattgacattggcaactcctgcagaactagtggtcagacctcagccaatgctcactctagccggagtcacgcagtgttccagatcatcctgcgccgaaaggggaaactccacggcaagttcagtctgatcgacctggcaggcaatgaacggggggcagatacatctagtgctgaccggcagaccaggctggagggggctgaaattaacaagtcacttttggctcttaaggagtgtattcgtgctttgggtagaaacaagccccacacccctttcagagccagtaagctcacgcaagtcctaagagattcctttataggagaaaattctagaacatgcatgatcgcaactatctcgcctggcatggcctcttgtgagaatacactcaacacactccggtacgcaaaccgcgtaaaggaactcacagtggatcccactgccgccggcgatgtccggccaattatgcaccacccacctaaccagatcgacgatctcgagacacaatggggcgtggggagttctccgcagcgcgacgacctgaaactgctctgcgaacaaaatgaagaggaggtgagtccacagttattcacatttcatgaggccgttagccagatggtcgaaatggaggagcaggtcgtggaggaccatcgggccgtatttcaggagagcattcgctggctggaggacgaaaaagctctgctggaaatgactgaggaggtcgactacgacgtggacagttatgctactcagctggaagccatcctggagcagaaaattgacatcctgaccgaactcagggacaaagtcaagtcttttcgagcagctctgcaggaagaggagcaggcctcaaaacaaattaaccctaagcgcccccgggctctctag

SEQ ID NO: 26458 - DNA, 207 bp, Artificial Sequence
  Description of Artificial Sequence: Synthetic coding sequence
atgagcagcccccgggacttccgggccgagcccgtgaacgactacgaagggaatgacagcgaggctgaagatctcaacttcagagaaaccctaccgtccagcagccaggagaatacaccgaggagcaaggtctttgagaataaagtgaactctgagaaagtaaagctaagtctgcgtaacttccctcacaatgattacgaggattag

SEQ ID NO: 26459 - DNA, 294 bp, Artificial Sequence
  Description of Artificial Sequence: Synthetic coding sequence
atgaacggccgggccgacttccgggagcccaacgccgaggtgcccaggcctattccccacatcggacccgattatattcccaccgaggaagagcggagggtttttgccgaatgcaatgacgagtccttctggtttagatccgtgcccctcgccgcaacaagcatgctgataacacaggggcttataagcaagggcattctgtccagtcatccaaagtatggtagcattcccaaactcattttggcatgtattatggggtacttcgcaggaaaactgtcctacgtgaaaacctag

SEQ ID NO: 26460 - DNA, 309 bp, Artificial Sequence
  Description of Artificial Sequence: Synthetic coding sequence
atggtgatggagaagcccagccccctgctggtgggccgggagttcgtgcgtcagtattataccttacttaacaaggcccccgaataccttcatcgattctacggtaggaatagctcatatgtccacggtggtgtggatgcaagcggcaagccacaagaggccgtgtatgggcagaacgacatacaccataaagtgctttccctgaatttcagcgagtgccatacgaagattcgacatgtggacgcccatgccacactcagcgacggggtcgtggtccaggtgatgggcctgctgtcgaactcagggtag

SEQ ID NO: 26461 - DNA, 597 bp, Artificial Sequence
  Description of Artificial Sequence: Synthetic coding sequence
atgggcaccacctgcctgcacctgggcaccctggagcagagcctggtgttcgaaaataaagtgaactccgaaaaagtgaaactctctctaagaaatttcccgcacaacgactacgaggatgtgtttgaggagccgagtgagagtggttcagacccgagtatgtggacagcgcgcggtcctttccgaagagatcggtggagcagcgaagacgaggaggccgctggaccctcccaggcgttgagtcccttgctatccgacactcggaaaatcgtctctgagggcgagctggaccaactagcgcagatccgccctcttatcttcaacttccacgagcagacagccattaaggattgtttgaagattctggaggagaagacggcagcttacgacatcatgcaggaatttatggcccttgagctgaagaacctgcctggggagttcaacagcgggaaccaacccagcaatagggaaaaaaaccgctatagggacatccttccctttcaacaccacggctactctggacctaacgaacgaacaacattttggcatgggtctaatgagggggctgtgagcctgttgctgaggtattgcgcgtag

SEQ ID NO: 26462 - DNA, 384 bp, Artificial Sequence
  Description of Artificial Sequence: Synthetic coding sequence
atgcggcccctggacatcgtggagctggccgagcccgaggaggtggaggttctcgagccggaagaagattttgagcagtttttattaccggtgattaacgagatgcgagaagatattgcctccctgacgcgggaacacgggcgtgcctacctgcgcaatagatccaaattgtgggagatggacaatatgcttatccagatcaaaactcaggtggaggcatccgaggaatctgcgctgaaccatctgcagaatcctggtgacgctgcagaggggagagccgccaaaaggtgtgaaaaggcagaagagaaggccaaggagattgcaaaaatggcagaaatgctggttgagctcgtgcgcaggatcgagaaatccgaatctagttag

SEQ ID NO: 26463 - DNA, 426 bp, Artificial Sequence
  Description of Artificial Sequence: Synthetic coding sequence
atggtgatggagaagcccagccccctgctggtgggccgggagttcgtgaggcagtattatacactcctgaacaaggccccagaatatctccaccgcttttacggacggaactcatcttacgtccacggtggtgttgatgcctcaggaaagccccaggaagccgtgtacggtcagaacgacatccaccacaaggtgctctcactcaacttcagtgaatgtcacaccaaaatacggcatgttgacgcacatgccaccctgtcagatggggtggtggtgcaggtgatgggtctgctctctaactccggccagcccgagaggaagttcatgcagacatttgtgttggcgcctgaaggctccgttccgaacaagttctatgttcataacgacatgtttagatacgaggatgaggttttcggggattcctag

SEQ ID NO: 26464 - DNA, 135 bp, Artificial Sequence
  Description of Artificial Sequence: Synthetic coding sequence
atgctgctgctggactgcaaccccgaggtggacggcctgaagcaccttctggagacaggcgcgagtgtcaatgctcctcctgatccctgtaagcaatcacctgttcatctagctgctggctccggactcgcgtag

SEQ ID NO: 26465 - DNA, 399 bp, Artificial Sequence
  Description of Artificial Sequence: Synthetic coding sequence
atgaagcggggccggctgcccagcagcagcgaggacagcgacgacaacggtagcctgtcaaccacttggtcccaaaacagcaggagccagcacagacggtcttcctgttcacgacacgaggaccgtaaaccaagcgaggtgttcaggacagaccttattaccgccatgaagcttcacgatagctaccaactgaatcccgatgagtactacgtccttgccgacccctggagacaagaatgggagaaaggggtgcaggtacccgtgtcaccaggtaccataccacagccggtcgctcgtgtcgtgtccgaggagaaatccctaatgtttatcaggcctaaaaaatacatagtgagcagtggtagcgagccccctgagctcgggtatgtggacattcgttag

SEQ ID NO: 26466 - DNA, 972 bp, Artificial Sequence
  Description of Artificial Sequence: Synthetic coding sequence
atgcggaccgccgaccgggaggcccggcccggcctgcccagcctgttgctgttgcttttggcaggcgccgggctgagcgcggcctctccccctgccgcacccagattcaacgtatctttggactcagtccctgagctgagatggttgcctgtgctccggcactatgacctggacctggtgcgagccgcaatggcccaggtcatcggggaccgcgtaccaaagtgggtccatgtgctgattgggaaggtggtgttggagcttgagcgcttcctgccacagcccttcacaggagaaattagagggatgtgcgacttcatgaatctgtccctagccgattgcctgctcgtgaatctggcctatgagagctcggtgttttgtacgtccatagtcgctcaggactctaggggccatatctatcatggtcgcaatctcgattaccccttcggtaacgtactgagaaaactgactgtcgatgtccaatttctgaagaacggacagatagccttcactggaacaacttttatagggtacgtgggattgtggaccggccagtcaccccataagttcactgtttccggcgacgaaagagacaagggatggtggtgggaaaatgccattgctgctctgtttcgaagacatatccctgtgtcatggttgatcagggccaccctttccgagtcagagaacttcgaagcagccgtggggaagctggcgaaaactcctctaatcgcagatgtgtattatattgtcggaggcacctccccccgggagggcgtcgttataacaaggaacagagatggtcccgctgatatctggccactcgaccccttgaacggcgcttggtttcgggttgagactaattacgatcattggaagcccgccccaaaggaagacgacagaaggacttccgctatcaaggcactcaacgcgaccggccaggccaacttgtctctcgaggccctcttccagtag

SEQ ID NO: 26467 - DNA, 312 bp, Artificial Sequence
  Description of Artificial Sequence: Synthetic coding sequence
atggcccagaccgacaagcccacctgcatcccccccgagctgcccaagatgctaaaggaattcgcaaaagcggcaatcagggctcagcctcaggaccttatccaatggggagccgattacttcgaagcattatctaggggtgagaccccccctgtgagagaaaggtctgagagagtggccctttgcaactgggcagagttgacccctgaactgttgaaaatactacatagtcaggtggccggacggttaatcattcgggccgaagagctggcccaaatgtggaaagttgttaacttgcctaccgacctgtag

SEQ ID NO: 26468 - DNA, 540 bp, Artificial Sequence
  Description of Artificial Sequence: Synthetic coding sequence
atggaggacggcacccccaagcacatcatccagatgaccggcttcaaaatggaggaaaaggaagccttggtgaaactcttgcttaaactcgactgcaccttcattaagtctgagaagtacaagaattgcacccacttgatcgctgagcgcctctgcaaaagcgagaaattcctcgctgcatgtgctgcaggaaagtggattctaacaaaggattatatcattcactccgcgaaaagtgggagatggctcgacgagactacttacgagtggggatacaagatcgagaaggactcacggtacagtccccagatgcaaagcgcgccgaaaagatggcgggaggagttaaagagaaccggggcacccggagcatttcaccgctggaaggtggtgcttcttgttaggactgacaaaagatccgattcccttattagaaaaaagtttaggatgatgaagattcctaagcccattctgttcgggctgaatatagcgatgaagaagcagacgaagatttctgggaagatgcaggacttcctaaagtag

SEQ ID NO: 26469 - DNA, 453 bp, Artificial Sequence
  Description of Artificial Sequence: Synthetic coding sequence
atggaggccgacatcatcaccaacctgcggtgccggctgaaggaggcggaggaagaacgcctaaaggcagcacagtatggactgcagcttgtggagagtcaaaatgagttacagaatcagctggacaagtgtaggaatgaaatgatgacgatgactgagtcctatgagcaggagaaatataccctgcagagagaggtggagttgaagtccaggatgttagagtcactttcttgcgaatgtgaggccattaaacagcagcagaagatgcacttggagaagctggaggaacagctaagtaggagtcacggccaggaagtgaacgaactgaaaactaaaattgaaaagctgaaggtggagctggacgaagctcgcctgtctgaaaaacagctcaaacaccaggtggaccatcaaaaagaactactgtcctgtaaaagtgaggagctgcgagtgtag

SEQ ID NO: 26470 - DNA, 738 bp, Artificial Sequence
  Description of Artificial Sequence: Synthetic coding sequence
atgaacggccgggccgacttccgggagcccaacgccgaggtgcccaggcctattccacacatcggtccagactatattccaactgaggaggagcgtagggtgtttgccgagtgcaacgacgaatcattttggttcaggtccgtcccactggctgccacatccatgttgataacacagggactgatttcaaagggtattctttcttcacacccaaagtatggttccatccccaaacttattcttgcctgcataatggggtactttgcaggcaagctgagctacgtaaagacatgccaagagaaatttaaaaagctagagaacagccccttgggcgaggcgctacgttcgggtcaggcccgcaggtcatcaccccctgggcactactatcagaaatcaaagtacgattcttccgttagtggccagtcctccttcgttacatctccagccgctgataatatagagatgttgccccactacgagccgatccctttctcaagctctatgaacgaaagcgctccaaccggcataacggaccacattgtgcagggtcccgatcctaacttggaggagagtcctaaacgcaagaatatcacatatgaagagctcaggaacaagaaccgggaaagttatgaggtgagcttgacacagaaaacagatccgagcgtgcgccctatgcacgaaagggtcccaaagaaagaagtcaaagtaaataagtacggcgatacctgggatgagtag

SEQ ID NO: 26471 - DNA, 180 bp, Artificial Sequence
  Description of Artificial Sequence: Synthetic coding sequence
atggtgatggagaagcccagccccctgctggtgggccgggagttcgtaagacagtattacacactgctaaataaggcacctgagtacttgcatagattctacggccgtaacagctcatatgttcatggcggtgtggatgctagcggaaaaccccaggaagctgtgtatggccagaactag

SEQ ID NO: 26472 - DNA, 597 bp, Artificial Sequence
  Description of Artificial Sequence: Synthetic coding sequence
atgggcaccacctgcctgcacctgggcaccctggagcagagcctggtcttcgagaataaggtcaatagcgagaaggtgaagctgagcctgcggaatttccctcacaacgactatgaggacgttttcgaggaacccagcgaatccggttcagatccctctatgtggaccgcccgtggtccattcagaagagatcgatggagcagtgaagatgaggaagccgccggaccttcccaggctctgtcacccctcctatcggatacgaggaagattgtatccgagggtgagctcgatcaattagcccagattaggcccctcatcttcaattttcatgaacagaccgccattaaagactgccttaaaattctcgaggaaaaaactgctgcgtacgacatcatgcaggaattcatggccctagaactgaagaaccttccaggagagttcaacagtggaaatcagccatctaaccgagagaagaataggtatcgggatatactgccatttcaacaccatggctatagcgggccgaatgaacgaacaacattctggcacgggtcaaatgaaggtgctgttagcttattgctgagatactgcgcatag

SEQ ID NO: 26473 - DNA, 465 bp, Artificial Sequence
  Description of Artificial Sequence: Synthetic coding sequence
atggccagcgccagcgcccggggcaaccaggacaaggacgcccactttcccccaccctccaaacagtctttattgttttgcccgaaatcaaaactgcacattcaccgtgcagaaatatctaaaattatgagggagtgccaggaggagtcattttggaaaagagccctgcccttttccctggttagtatgctggttacccagggcctggtgtatcagggttatctggcagcgaactccagatttgggagccttcccaaggtagccctggctgggctgctcgggtttggcctgggaaaagtgtcctatattggcgtctgccagtctaaattccactttttcgaggaccaattaagaggcgcgggcttcggccctcaacacaaccggcactgtcttctcacttgtgaggagtgcaagatcaaacatgggctgagcgagaaaggtgacagtcaacctagtgcctcttag

SEQ ID NO: 26474 - DNA, 2520 bp, Artificial Sequence
  Description of Artificial Sequence: Synthetic coding sequence
atgagcgtggtgggcatcgacctgggcttcctgaactgctacatcgctgtagcccgcagcgggggcatcgagactatcgcaaatgagtactccgacaggtgcacaccagcctgcattagcctcgggagccgcaccagggccatcggcaacgccgccaagagccagattgtaactaatgtgcgaaacacaattcacgggtttaagaagctgcatggaaggtcattcgacgaccctatagtgcagactgaaagaatccgacttccctacgagctacagaaaatgccaaatggaagcgccggggtcaaggtgcgctacctggaggaagagcggccttttgcgattgaacaggtaacgggaatgctgctggcgaagctgaaggagacgtctgaaaacgcgttgaaaaagcccgtggcggattgcgtgatctcgatcccaagcttctttacagacgcagagcgaaggtcagtgatggccgcagcgcaggtcgccggcttgaattgtctgagactgatgaacgagacaaccgccgtggctttggcttatggcatctataagcaagatttaccgccactggatgaaaagcctcgcaatgtggtatttattgatatgggccactcggcatatcaggtcttagtgtgcgctttcaacaagggtaaactaaaagttctggcaacgactttcgatccatacctcgggggccggaacttcgatgaggccctggtcgactatttttgtgatgagttcaagaccaaatacaaaattaacgtgaaggaaaattcacgcgcgttgctgcgcctctatcaggagtgcgaaaaactgaagaaactgatgtccgcgaatgcatctgatttgcccctcaacattgaatgttttatgaatgatcttgacgtgtcttcaaagatgaatagagcccagttcgagcagctctgcgctagcttattggccagggttgagcctccattgaaggctgttatggaacaggcgaatcttcagcgagaggatatttcttctatcgagattgtggggggcgccactcggatcccagccgttaaagagcagataacgaagttcttcctcaaggacatctccacaacacttaacgctgatgaggccgttgcacgtggctgcgccctgcagtgcgccatcctgtcccccgcgttcaaagtgagagagttctctattactgacttggtgccttattcaatcactttgcggtggaagacgagttttgaagatggtagtggggagtgtgaggttttttgtaagaatcaccccgcaccatttagcaaggtcataacctttcataaaaaagagccatttgaactggaggcattctacacaaatctacacgaagtaccctaccccgatgcgagaatcggatccttcactatacaaaacgtattcccccagtccgacggtgactcaagtaaagtgaaggtcaaggttagagtgaacattcatgggattttctctgttgcctctgccagtgtgattgaaaagcagaatctggaaggtgaccattcagatgctcccatggagacagagacttccttcaagaacgagaataaagacaacatggataagatgcaggtggatcaggaagaaggccaccaaaaatgccatgccgagcacaccccggaggaagagatcgatcacactggggccaagacaaaaagtgctgtcagtgacaagcaggaccgactcaaccagactctgaagaaggggaaggtgaaatcaattgatttgcccatacagagtagcctgtgtaggcagctaggccaggatctgcttaacagctacattgagaatgaagggaagatgatcatgcaggacaaattagagaaagagaggaacgacgctaagaacgcagttgaggagtacgtgtacgatttccgggatcggctgggaaccgtgtacgaaaaattcattactccagaggatttgtctaagctgagtgctgtgcttgaggatacagagaactggctttacgaagatggtgaagatcagcccaaacaagtgtacgtagataaactccaggaactaaagaaatacggtcagcccatccagatgaagtatatggagcacgaggagcgtcccaaggctcttaacgaccttggcaaaaagatccagttagtgatgaaagtaattgaagcataccgtaacaaggacgaacgctacgaccatctcgaccctaccgagatggaaaaagtcgagaaatgcatttccgatgccatgagttggctgaactcaaaaatgaatgcgcaaaacaagctcagtctcactcaggacccggtggtgaaggtttccgaaatagtggctaaatcaaaagagctcgacaatttctgcaatcccatcatctataagcccaagccaaaggccgaagtgccagaagataagcctaaggcgaactctgagcataatggacctatggacggacagtcaggcactgagaccaagagcgactccaccaaggattccagtcagcataccaaatcaagcggagaaatggaggtggattag

SEQ ID NO: 26475 - DNA, 54 bp, Artificial Sequence; identical to SEQ ID NO: 12927
  Description of Artificial Sequence: Synthetic coding sequence

SEQ ID NO: 26476 - DNA, 2394 bp, Artificial Sequence
  Description of Artificial Sequence: Synthetic coding sequence
atgggcgtgagccggctgatggacctgctggccgacagccgggaggtgattagaaacgatggtgtactgttacttcaggctctcacccggagcaatggcgcaatccagaaaatcgtggcttttgagaacgccttcgaacggctgttggacatcatttctgaagagggcaactcagatggtggtatcgtggtggaggattgtttgatcctattgcagaatctgctcaagaataacaatagcaatcaaaatttcttcaaagaggggtcttatatccagcggatgaagccctggttcgaagttggagatgaaaactcagggtggtcggctcagaaggtgacaaatctgcacttgatgctgcagttggtgcgagttctggttagtcctaccaatcccccaggggccacatcctcttgccagaaagctatgttccagtgcggcctacttcagcagctttgcaccatcctgatggccacaggcgtgcctgcggacattctgactgaaactatcaataccgtgagcgaggtcattagagggtgccaagtaaatcaggactatttcgcttcagttaatgcgccttcgaacccacctcgccccgctatagtggtcctcttgatgtccatggtgaatgaacgccagccttttgtgttacggtgcgcagtgctctattgctttcaatgcttcttgtacaagaatcagaaagggcagggtgagatcgttagcacactcctgcctagcaccatcgacgccacaggcaactccgtctccgctgggcagctcctctgcggcggactgttctctaccgattctctctcaaactggtgcgctgcggtcgccctggcacacgcactgcaagaaaatgccacacagaaagaacagctactacgcgttcagctggccacttccattggcaatcccccagtgagcctcctgcagcagtgtacaaacatcttgagtcaggggagcaagatccagacacgggttgggctcttaatgctattatgtacctggctcagcaactgccctatcgctgtcacgcacttcttgcataacagtgctaatgtgccctttctgacaggccaaatcgccgagaacctaggagaagaggaacagctcgtgcaggggctctgcgccctgctgctgggaatttccatttatttcaatgataacagcctcgaatcctacatgaaggagaagttaaagcagcttatagaaaaaagaattgggaaggagaattttattgagaaactgggatttatctctaaacatgaactgtatagcagggccagccagaagcctcaaccaaacttcccatcaccagagtacatgatttttgatcacgaatttacgaaattggtcaaagaactggagggcgtgatcactaaagcaatctacaagtcgagtgaagaggataaaaaggaggaggaggttaagaaaacactagagcaacacgataacatcgtaacccactacaagaacatgattcgggagcaggacttgcagctggaggagctacgtcagcaggtgagtaccctgaaatgccagaatgagcagcttcagaccgctgttactcaacaggtttctcagattcagcagcacaaggatcagtacaatttattaaagatccaactgggaaaggataatcagcaccaggggtcctattctgagggcgcccaaatgaatggcatccagccagaggagatcggcaggttgagggaagaaatagaggaactgaaaaggaatcaggaactcttacagagccagctgaccgagaaggactccatgatcgagaacatgaagagtagccagaccagtggcaccaatgaacagtcttccgctattgttagtgcgcgcgacagcgagcaggtggctgaactgaagcaggaacttgcaaccctcaagtcccagctgaactctcagagcgttgagatcacaaaactgcagacagaaaaacaggagctcctgcaaaaaaccgaggccttcgccaagtctgtcgaggtgcaaggtgagactgagacaatcatagccacaaaaacaaccgacgtcgaaggacggctgagtgctctactccaagaaacaaaagagttgaagaacgagataaaggcgctgtccgaggagcgaacagctattaaggagcagctagacagctccaactccacaattgcaattctccagacagagaaagataaactggaactggaaattaccgacagcaagaaagaacaggatgatctgctggttctcctagcagatcaggatcaaaaaattctgagcctcaaaaataaactaaaggaccttgggcatcccgttgaagaagaagatgagttggaaagcggcgaccaggaagacgaggacgatgaatctgaggatcccggcaaagatttagaccacatatag

SEQ ID NO: 26477 - DNA, 441 bp, Artificial Sequence
  Description of Artificial Sequence: Synthetic coding sequence
tgacggcacctgcgggccacccccaacacccggggcagcgcccggctcctttgcgcagagatgcccaagaaggcaggagctaccacaaaaggcaaatcgcaaagcaaggaacccgaaagaccgctaccccccctgggaccggtcgctgttgatccaaaggggtgtgttaccatcgctatacacgctaagcccggttcgaaacagaacgcagtgaccgaccttaccgctgaggccgttaacgtggctattgccgccccccccagtgagggcgaggccaacgccgaactgtgtcgatacctgagcaaagtgctagagttgcggaagagtgatgtggtcctggataaaaagttgcgtgacctgttgaagatcgtgccgtgtaagctggccacaaggacacagattctcggcttgctggtcgagtgcagcttctctaggctttag

SEQ ID NO: 26478 - DNA, 243 bp, Artificial Sequence
  Description of Artificial Sequence: Synthetic coding sequence
atgaacggccgggccgacttccgggagcccaacgccgaggtgccccggcctattcctcacatcggtcctgactatattccgaccgaggaggaaagaagagtgttcgcagagtgcaatgacgaaagcttttggttcaggtcagtgcctctcgcggctactagtatgcttatcacacagggactcatcagcaaagggatactgagttcccatcctaagtacgggagcattccgaaattaatttag

SEQ ID NO: 26479 - DNA, 360 bp, Artificial Sequence
  Description of Artificial Sequence: Synthetic coding sequence
atgaagcggggccggctgcccagcagcagcgaggacagcgacgacaatgggagtctgtccacaacctggagccagaatagcagatcacagcatcgccgcagttcctgctccagacatgaggatcgcaagccttccgaagtctttcggaccgatcttattactgctatgaagctccatgacagctaccaattgaaccccgatgagtattatgtactcgcagatccctggcggcaggagtgggaaaagggtgtccaggtacccgtctcacccggaacaatccctcaacccgtcgctcgcgtggtgtctgaggaaaagtctcttatgtttattcgaccgaaaaaatacatcgttagcagctag

SEQ ID NO: 26480 - DNA, 69 bp, Artificial Sequence
  Description of Artificial Sequence: Synthetic coding sequence
atggccaagtacaacaccggcggcaaccccaccgaggacgtgagcgtcaactcaagaccattcaggtag

SEQ ID NO: 26481 - DNA, 1059 bp, Artificial Sequence
  Description of Artificial Sequence: Synthetic coding sequence
atggccgccgccgtgcggcaggacctggcccagctgatgaacagctctggtagccataaggatctcgcagggaaataccggcagattttagaaaaggcgatccagctgtcaggagcggagcagctcgaagctcttaaggccttcgttgaagccatggtgaacgagaacgtgagtctggtgattagtcggcagttactcaccgacttctgcacccacttgcctaatctgccagattccacggccaaggaaatctatcatttcactttagagaagattcaaccccgggtcatcagcttcgaggagcaagtcgcctcaatccggcagcacttagcttctatttatgaaaaagaagaagactggcgtaatgccgctcaggtgcttgtcggcattccgctggagaccggccagaaacaatataatgttgattataagcttgaaacatacctcaagatcgcaagattatacctggaagatgacgatcctgtacaagctgaggcctacattaaccgggcttccctgctgcagaatgaatctacaaacgagcaattgcagatacattacaaagtgtgctacgcccgagtgctggattacagacgcaagttcatcgaggcagcacagcgttacaatgagctatcttataaaactatcgtgcatgaaagcgagaggctcgaggcactcaaacacgctctccactgtacgatattggcttccgccgggcagcagaggtctcggatgttggcaaccctgttcaaagacgaacggtgccagcagcttgcagcatatggtattctcgaaaagatgtacctagacagaatcatcaggggaaaccaattacaggagttcgctgccatgctgatgcctcaccagaaagctacgaccgctgacgggtcctctatattggaccgcgcagtgattgagcataatttgctctccgcctccaagctgtataacaatataacattcgaagaactgggcgcccttctggagattcctgccgctaagcatgaaaaaccttgccaacgagggattagccggtctaaccatttcgttagtaaatag

SEQ ID NO: 26482 - DNA, 378 bp, Artificial Sequence
  Description of Artificial Sequence: Synthetic coding sequence
atggtgatggagaagcccagccccctgctggtgggccgggagttcgtccggcagtactacaccttgctgaacaaagcccccgagtatctgcacaggttttacggtcgcaattcctcatatgtgcatggtggagtggacgctagcggaaaaccacaggaggccgtgtacggtcagaacgacatacaccacaaggtcctgtcactcaatttctcagaatgccatactaaaattcgccacgtggatgcccacgcaactctcagcgacggcgtggttgtccaggttatgggactgctgagtaattcagggcagccggagagaaagtttatgcaaacttttgtcctggcccccgaaggctccgttcccaataaattctattag

SEQ ID NO: 26483 - DNA, 657 bp, Artificial Sequence
  Description of Artificial Sequence: Synthetic coding sequence
atgaacggccgggccgacttccgggagcccaacgccgaggtgccccgacccatcccccccgtacctttggctgcgacgtctatgcttattacacagggactcatctccaagggcatactctcctcccatcccaaatatggatcgataccaaaactgatacttgcttgcattatgggatactttgctggaaaactaagctacgtcaaaacctgccaagagaaatttaagaaactcgagaattcacccctgggagaggcgctgagatccggacaggcccgtcgatcatccccccctggtcattattaccagaagagtaagtacgattctagtgtatccggacagtcaagctttgttactagtccagccgctgacaacattgagatgctgcctcactatgaacctatacccttttcatcaagtatgaacgagagcgcaccaaccggaattacagaccacatagttcaagggccagaccccaacctcgaagagtctcccaaaagaaaaaatataacatacgaggagctgcgtaacaagaatcgagaatcatatgaggtctctctcactcagaaaaccgacccatctgtgagacccatgcacgaaagggtgcccaagaaagaggtcaaagttaataagtatggagacacttgggacgaatag

SEQ ID NO: 26484 - DNA, 243 bp, Artificial Sequence
  Description of Artificial Sequence: Synthetic coding sequence
atgaacggccgggccgacttccgggagcccaacgccgaggtgccccgacccattcctcatatcggacctgattacatccctacggaggaggagagaagggttttcgctgagtgcaacgatgagagtttctggttcaggagcgtcccgctggcggccacctctatgctgatcactcaggggctgatttctaaagggattttgagctcccacccaaaatatgggagcatcccaaagctaatttag

SEQ ID NO: 26485 - DNA, 654 bp, Artificial Sequence
  Description of Artificial Sequence: Synthetic coding sequence
atgatcgtgaacgactacgagggcaacgacagcgaggccgaggacctcaacttcagagagacactgcctagtagctcacaggaaaacactccccgctccaaggttttcgaaaacaaggttaattctgagaaggtgaaactctccctccgcaatttcccacacaacgattacgaggacgtttttgaagagcccagcgagtctggctcagatccttctatgtggacagctaggggccccttccgaagggatcggtggtcctccgaagacgaggaggctgccggcccttcacaggcactgagcccactcctctctgatacacgcaaaatcgtgtccgagggggaattggatcaactcgctcagatccgcccattaatctttaacttccacgagcaaaccgccattaaagactgcctcaagatcctcgaagagaagaccgccgcctacgacatcatgcaagagttcatggcccttgagttgaaaaacctccccggcgagttcaactccgggaaccagccgagcaaccgggaaaaaaatcgctacagagacatattacctttccaacaccatggatattccggcccaaacgagcgtaccactttctggcatggcagcaatgagggcgcagtgtcattattgctgagatattgcgcctag

SEQ ID NO: 26486 - DNA, 351 bp, Artificial Sequence
  Description of Artificial Sequence: Synthetic coding sequence
atgggccggctggacggcaaggtgatcatcctgaccgccgccgcccaggggattgggcaggcggcagctctcgcttttgcacgcgaaggtgcaaaagtaatcgccaccgatataaatgaatcaaagctgcaagaactcgagaagtaccccggtatccaaactagggtattggatgtcactaagaaaaagcagatcgatcagtttgcgaacgaggtggaacgcctggatgtcctctttaatgtggctggcttcgtccatcacggcacagtgctggactgtgaagagaaagactgggatttcagcatgaacctgaacgtgagatccatgtatctgatgattaaggcattctag

SEQ ID NO: 26487 - DNA, 504 bp, Artificial Sequence
  Description of Artificial Sequence: Synthetic coding sequence
atgaaggccatcaagaagagcctgaccgaggaggagtacctgtacctagacttttcacaccagacggaaggatgcatctttccgctccacacctctgttaccctgtttttgctgtcttattgcgactgtaaaatctttaagatctgcctggtggtgaccaaagaggtgtcccgggacagctccctcctcagagatgacctgatccaggatgtggaaattcagataatttctcggcaagagctgccgcccatcgtccagaactgttgcctcccagctgtcgtggaacgttccgataacttctgccgcgcagggctcgcagtcgtcttacgccacataatccagaaatcgtatgaggcggatccgctcaaaaaagagctgctcgagttgctggggttcaagaaaacttgtctcaaggcctgtgcggaagtgtcgcagtggacacggctctgcgagttgaccatcccattagccatagagaactttctgcgcgagtcaagtgattag

SEQ ID NO: 26488 - DNA, 933 bp, Artificial Sequence
  Description of Artificial Sequence: Synthetic coding sequence
atgagccagcagctgaagaagcgggccaagacccggcaccagaaggggctcgggggacgagctccttctggtgctaagccccgacagggcaaatcctcccaggatctgcaagctgaaatcgagccggtctccgccgtttgggcgctgtgcgatgggtacgtctgttatgagcccggcccacaggcattgggcggagacgactttagcgactgttacatcgagtgtgttattcggggcgagttttctcagcctatcttagaagaggattcgcttttcgagtctctggagtatctcaagaaaggaagtgaacagcagttatctcagaaggtattcgaagcatcttccttagagtgctctctggagtatatgaaaaagggggtcaagaaagagcttcctcagaaaatcgtgggagagaactccctggaatattcagaatacatgactgggaagaagctcccaccaggcggaatccccggtatcgacctgtccgaccctaaacagctcgcagagttcgcacggaagaagcctcctattaataaggagtatgattcgctttcagccatagcatgtccacagagcggctgtaccaggaagctgcgcaatcgcgcggctttacggaaacatttattgattcacggtcctcgcgatcacgtgtgtgccgagtgcgggaaggccttcgtggagtctagcaaactgaaacggcacttcttagtgcacacgggagagaaaccatttagatgtacctttgaaggatgcggaaaacggttttctttggactttaacctacgcacacacgttagaatacatactggtgagaagcgctttgtatgccctttccagggatgcaatcgtcgttttatccagagtaataacttgaaagctcacatactcacacacgccaatactaacaaaaatgagcaagaaggaaagtag

SEQ ID NO: 26489 - DNA, 237 bp, Artificial Sequence
  Description of Artificial Sequence: Synthetic coding sequence
atggtgatggagaagcccagccccctgctggtgggccgggagttcgtacgacagtactatacccttctcaataaggctcctgagtacctccataggttttatggtcggaatagctcctacgtccatggcggagttgatgcatccgggaaaccgcaggaagcagtttacggccagaatgatattcatcacaaggttctgagtctgaacttttctgagtgtcacaccaaaattaggtag

SEQ ID NO: 26490 - DNA, 681 bp, Artificial Sequence
  Description of Artificial Sequence: Synthetic coding sequence
atgagcagcccccgggacttccgggccgagcccgtgaacgactacgagggcaacgactctgaggcggaagatcttaacttccgagagacccttccgtctagctcacaggagaacaccccacgctccaaagtttttgagaataaagtgaatagtgaaaaggtcaagctgtcattacgaaactttccacataacgactatgaagacgtgttcgaagaaccttccgagtcaggcagcgatcctagcatgtggacagcccggggcccttttagacgcgaccgctggagcagtgaggatgaagaggctgccgggccttcgcaggcgctatcgccactactttctgatacgcgtaagatcgtcagtgagggtgaactggatcagctggcccagattcggcctttgattttcaacttccacgagcagacagccattaaagattgcctgaagatcctggaggagaagacggccgcttatgacattatgcaagagttcatggccttggagctgaaaaatctgcccggggagtttaatagtggaaaccagccaagcaaccgagaaaaaaacagataccgggatatcctgccattccagcaccacggatactctgggccaaatgaacgcacaactttttggcatggctctaatgagggcgccgtatctctgcttctgcgatactgtgcctag

SEQ ID NO: 26491 - DNA, 1020 bp, Artificial Sequence
  Description of Artificial Sequence: Synthetic coding sequence
atgtggaccgcccggggccccttccggcgggaccggtggagcagcgaagacgaggaagcggcaggccccagccaggccctctcccccctccttagcgacactaggaaaatagtatctgagggtgagctggaccagctggcacagatcaggccacttatcttcaatttccacgagcagaccgcaataaaggattgcctgaagatcttggaggagaagaccgcagcctacgacattatgcaggagttcatggccttggaattgaaaaacctgcctggcgagttcaactcgggtaaccagccttcgaacagggagaaaaataggtatcgcgatatactgccatatgactccacaagagtgcccctggggaaaagcaaggactacatcaatgcctcttatattcgaatcgtaaactgtggggaagagtatttttacatagccacacagggcccattgctctccactatcgacgatttctggcaaatggtgttggaaaataatagtaatgtgatcgccatgattacgagagaaatcgagggtggcatcattaaatgttatcattattggcccatatccctgaagaagcctttggagctgaagcactttcgagtatttttagagaactatcagattctgcaatatttcataattcggatgttccaagtggtcgagaagtccactggaacaagccactccgtgaagcagctgcaatttaccaagtggcccgatcacggcactcccgccagcgccgacagtttcatcaagtatatcaggtatgcacggaagagtcacctcactggaccaatggttgtgcattgctctgccgggataggacgtaccggagtattcctgtgtgttgacgttgtgttttgcgccattgtcaaaaattgttccttcaacatcatggatatagtcgcccagatgcgggaacagagatctggtatggttcagacaaaggagcaataccatttttgctatgatatcgtgctcgaggtcttacggaagctgctaaccttggattag

SEQ ID NO: 26492 - DNA, 1179 bp, Artificial Sequence
  Description of Artificial Sequence: Synthetic coding sequence
atgggcaccacctgcctgcacctgggcaccctggagcagagcctggtgtttgagaataaggtgaacagtgagaaggtgaagctgagcctgcgtaacttcccacacaacgactatgaagacgtcttcgaggagccctccgaaagtggcagcgacccaagtatgtggacagctaggggcccttttagacgcgataggtggtcaagcgaggacgaagaggccgcagggccctcgcaggctctctcacctcttctgagcgataccaggaaaatagtgagcgaaggcgaattggatcagttggcccagattcgacccctgatttttaacttccatgaacagaccgctatcaaggactgtctgaaaatcctggaagagaagactgctgcctatgatatcatgcaggaattcatggccttggaactcaagaacctgcccggagaatttaactctggaaatcagcccagcaatcgggaaaaaaacaggtaccgggatatactgccctacgactctacccgagtgcccctcggcaagtcaaaggactacattaatgcctcctatatcaggattgtgaattgtggcgaagaatacttctacatagccacccaaggtcccctgctgtctacaatagatgacttttggcaaatggtgttggaaaacaactcaaacgtgatcgccatgataacccgagagatcgaaggggggatcattaagtgctaccattactggcccatcagtcttaagaagccactggagttgaagcattttcgcgtattcctggaaaactaccagattctgcagtactttatcatacgtatgttccaagtggtggaaaaaagtaccggaacctctcactcggtgaaacaattgcagtttacaaagtggcctgaccatggaacccccgcctcggccgacagttttattaagtacataaggtacgctaggaaatcgcacttgaccgggcctatggttgtgcattgttccgctggtatcggcagaactggggtgttcctctgcgtagacgtggtcttctgtgccatcgtgaaaaattgcagctttaatattatggacattgtggcccagatgcgagagcagcggagcggaatggtgcagaccaaggagcagtatcatttttgttacgatattgtactggaggtgctccgcaagctgctgaccctggactag

SEQ ID NO: 26493 - DNA, 654 bp, Artificial Sequence
  Description of Artificial Sequence: Synthetic coding sequence
atgatcgtgaacgactacgagggcaacgacagcgaggccgaggacctgaattttcgagaaaccctcccctccagttcgcaggaaaacactccaaggagtaaggtctttgaaaataaggtaaattccgaaaaagtaaagttgtccctccgcaacttccctcacaatgactacgaagacgtatttgaggagccctctgagtctggctcggacccctccatgtggacagctaggggtccctttaggagggatcgctggtcgagtgaggatgaggaggctgctggcccaagccaggccctctctcctctgctgtcggatacacgcaagatagtgtcggagggcgagctggaccaactggcacagattcgccctctcatctttaactttcatgagcagacagccataaaggactgcttaaagattctggaggagaaaacagccgcttatgatatcatgcaggaattcatggcgctggagctgaagaacttgccaggagaattcaactcaggcaaccagccatccaacagagagaaaaatcgctaccgcgatatactaccatttcagcaccatggctactccgggcccaatgaacgaactacattttggcatggcagcaacgaaggagccgtctccctcctcctccggtactgcgcttag

SEQ ID NO: 26494 - DNA, 438 bp, Artificial Sequence
  Description of Artificial Sequence: Synthetic coding sequence
atgtggaccgcccggggccccttccggcgggaccggtggagcagcgaagatgaggaggctgcagggccaagtcaggcactgtcaccactgctctccgatacgcggaaaatcgtgtcagaaggggaactggaccagctcgcccagataagacccttaattttcaacttccatgagcaaacagcaattaaggattgcctgaagatcctagaagagaagacagcagcgtatgatataatgcaggagtttatggctttagaactaaaaaacctcccaggagaattcaattcagggaatcaaccatccaacagagagaaaaacaggtatagagatattctcccctttcagcatcacgggtactcaggccccaacgagcggacgacattctggcatgggtctaatgaaggtgctgtgtcattacttctgcgatactgcgcctag

SEQ ID NO: 26495 - DNA, 207 bp, Artificial Sequence
  Description of Artificial Sequence: Synthetic coding sequence
atgagcagcccccgggacttccgggccgagcccgtgaacgactacgaaggtaatgacagtgaggctgaggatctaaatttcagggagactctcccaagttctagccaggagaacacaccccggagcaaggttttcgaaaacaaggtgaatagcgaaaaggtgaaactgtcgctgcgtaacttcccccacaacgactacgaggattag

SEQ ID NO: 26496 - DNA, 525 bp, Artificial Sequence
  Description of Artificial Sequence: Synthetic coding sequence
atggccaagtacaacaccggcggcaaccccaccgaggacgtgagcgtgaactcccgcccattcagagtcacggggccaaacagcagctctgggatccaggccagaaagaatctatttaacaatcagggaaatgcttcacctccagctggcccatcaaacgttccaaagtttggatcccctaaacctcccgtggctgtcaaaccttcttccgaagaaaagcccgacaaagaaccgaaacctccatttctgaagcctaccggcgccggccagagatttgggacaccagctagtctcacaactcgggaccccgaggccaaagtgggcttcctaaaacctgtgggtccaaagcccattaacctgcctaaagaggatagtaagccaacctttccttggccccctggcaataagccctctcttcactccgtaaaccaggaccatgatctgaagcctctgggcccaaaatccggtcctacaccacccacatctgagaatgaacaaaaacaggcatttcccaaactgacatag

SEQ ID NO: 26497 - DNA, 405 bp, Artificial Sequence
  Description of Artificial Sequence: Synthetic coding sequence
atgagcgacgacgccggcgacaccctggccaccggcgacaaggccgaggttacagagatgcccaactcggatagcctgccggaggacgctgaagtgcattgcgatagtgccgccgttagccatgaacctactcccgccgatcctcgcggggaagggcacgagaatgctgctgttcagggggctggggcagcggcaattggccctcccgtgcagccccaggacgccaacgctctcgaaccgcctctcaacggcgacgtgaccgaggacacacttgcagagtgcatcgactccgtatccctcgaggctgagcctagaagcgaaatcccccttcaggaacagaattacctcgccgtggattcacccccttcaggtggcggttgggctggttggggctcttggggatag

SEQ ID NO: 26498 - DNA, 432 bp, Artificial Sequence
  Description of Artificial Sequence: Synthetic coding sequence
atgaagcggggccggctgcccagcagcagcgaggacagcgacgacaacggttctctaagcaccacatggagtcagaattcccgatctcaacatcggcgatcctcatgtagcagacatgaggatcgtaagccctcagaggtgttccggaccgatcttatcactgccatgaagcttcacgattcctatcagctgaaccccgatgagtactacgtccttgcagatccgtggaggcaggaatgggaaaagggcgtacaggttccagtgagccccggtacaataccccaacctgttgcgcgggtggtttctgaagagaaatcactcatgttcatccggcccaagaaatatatcgtgagctccggaagcgaacccccagaattgggatatgtggatattcgcacattagccgatagtgtatgcagatatgacctgtag

SEQ ID NO: 26499 - DNA, 1200 bp, Artificial Sequence
  Description of Artificial Sequence: Synthetic coding sequence
atggacttcttcagcagccacctgctggccgacagcagcagccccgcaaccaatagcagtcataccgacgcccatgaaatcttggtgagtgacttcctagttagcgatgaaaacctgcaaaagatggaaaacgttctcgatctttggtctagcggcctgaaaacaaatatcattagcgaactaagtaagtggcgcctcaactttatcgactggcacagaatggaaatgcgcaaggagaaagaaaagcatgcagcccatctcaaacagttatgcaatcagatcaatgagctcaaggaactgcagaaaacctttgaaatatccatcggccgaaaagacgaagtaatttcttccctgtcccacgcaatcggaaaacaaaaagaaaagatcgagctcatgcgaaccttcttccattggcgcatcggtcacgttcgcgcccgacaggatgtctatgaggggaaattagcagaccagtactaccagcgcacactgttgaagaaggtttggaaagtttggagatctgtggttcagaagcaatggaaagacgtcgtcgagcgggcttgccaggctcgggcagaagaggtgtgtattcaaatttcaaatgactacgaggcaaaagtagccatgctgtccggcgcgctagaaaatgccaaggctgaaattcagcgcatgcaacacgagaaggagcacttcgaggactctatgaagaaggcttttatgcgcggtgtctgtgctctgaatctggaggcaatgaccatattccagaaccggaatgatgccggtatagacagtacaaataacaagaaggaggagtacggcccaggtgttcagggaaaagagcactccgcccatctcgacccctcagctcctcccatgccccttcccgtaacatcacccttgctcccctcacctccagctgcggtcggcggggcttccgctacagctgtgccttctgccgcgtccatgacttccacaagggccgcatcagcgagctccgttcacgtgcccgtctccgctttgggagccggctccgcagccacggctgccagtgaagagatgcaaactattccacaagcgacagcagcaaagtacccacggacaatccatcctgagagcagtactagcgctagccggtctctagggacgcgatctgcgcatacacagtcattgacaagtgttcactcaatcaaagtggttgactag

SEQ ID NO: 26500 - DNA, 240 bp, Artificial Sequence
  Description of Artificial Sequence: Synthetic coding sequence
atggacgagagcgccctgctggacctgctggagtgccccgtgtgcctcgagagactggacgcaagtgctaaagtgctgccatgccagcataccttctgcaagaggtgcctcctgggtatagtgggatcacgaaacgagctgaggtgccccgagtgtcggactctcgtggggagtggagtagaggagcttccttcaaatatcctgctggtgagacttctcgatgggatcaagcagaggtag

SEQ ID NO: 26501 - DNA, 621 bp, Artificial Sequence
  Description of Artificial Sequence: Synthetic coding sequence
atgagcagcccccgggacttccgggccgagcccgtgaacgactacgagggcaatgattctgaagcggaggaccttaattttcgcgagactctcccctcttcctctcaggaaaatacgccgaggtctaaggtgtttgagaacaaggtgaactccgagaaggtaaagctatcactgcggaactttccccacaacgattacgaagacgtgttcgaggagccaagcgagagcggaagtgatccctccatgtggactgcccgggggccctttcgacgggaccggtggagcagcgaagatgaagaggctgcggggcctagtcaggccctgtctcccctcctgtcagacaccagaaagatcgtttccgagggcgaactggatcagctggctcagatcagacccctgattttcaacttccacgagcaaaccgccatcaaggattgcctcaaaatattggaggaaaaaactgccgcctacgatatcatgcaggagtttatgtttaacatcatggatattgttgcccagatgcgcgagcagcgcagcggaatggtgcaaacaaaggagcagtaccacttctgctacgacatcgttcttgaagtattgagaaaactgctgacactggactag

SEQ ID NO: 26502 - DNA, 501 bp, Artificial Sequence
  Description of Artificial Sequence: Synthetic coding sequence
atgaaggccatcaagaagagcctgaccgaggaggagtacctgtacttagacttttctcaccaaaccgaaggatgtatatttcctctccatacatctgttactctcttcttacttagctactgtgattgcaaaatttttaaaatttgccttgtcgtaaccaaagaagtaagtagagactcatctcttctaagagacgatctgatccaagacgtggagatacagattatctccagacaagaattgcccccgatcgtacagaattgctgtctacccgctgtggtggagcgctcggacaatttttgccgggcagggctggccgtggtacttaggcacattatccagaagtcctacgaagcagatcccctcaagaaagagctgctcgagctgctcgggttcaaaaagacatgtctgaaggcgtgtgcagaggtaagtcagtggacgagactgtgcgaacttaccattccactcgctattgagaacttcctgcgcgagagctcttag

SEQ ID NO: 26503 - DNA, 363 bp, Artificial Sequence
  Description of Artificial Sequence: Synthetic coding sequence
atgtggaaggtggtgaacctgcccaccgacctgttcaacagcgtgatgaatgtcgggcggtttactgaggagattgaatggcttaagtttttagctttagcatgttcggccttgggtgtcaccatcacaaaaacacttaagatcgtctgcgaagtactctcctgcgaccacaacggaggacttcctcgtatccccttctccactttccagttcctctacacatacattgccgaggtcgacggagagatctgcgcttcccacgtcagccgaatgcttaactacatcgagcaggaagttatcggtcccgacggtctgataactgtgaacgactttactcagaacccacgagtgtggcttgagtag

SEQ ID NO: 26504 - DNA, 351 bp, Artificial Sequence
  Description of Artificial Sequence: Synthetic coding sequence
atggtgatggagaagcccagccccctgctggtgggccgggagttcgttcgacagtactataccctacttaacaaggcgcctgagtacctgcatcgcttttacggtcggaactccagctacgtgcacggcggcgtcgacgcaagcgggaagcctcaggaagcggtttatggacaaaacgatatacaccacaaggtgctctccctgaacttttctgagtgtcatactaagattagacacgttgacgctcatgctaccctgagtgacggagtggtggtccaagtcatgggactgctgtcgaattccggccagcccgagaggaaatttatgcagaccttcgtgctcgccccctag

SEQ ID NO: 26505 - DNA, 480 bp, Artificial Sequence
  Description of Artificial Sequence: Synthetic coding sequence
atgagcgaccaccggtacggcgacggcggcagcaccttccagagcaccacgggacattgcgtccacatgagaggccttccataccgcgccactgagaatgatatttacaacttcttctcgccccttaaccccgtcagagtgcacatcgagattgggcccgatggccgtgtgacaggcgaggctgacgttgagtttgctacccacgaagacgcagtggcggcaatgtccaaagacaaagctaacatgcagcaccgttacgtggaacttttcctgaactccacagctggggccagcggaggagcttacggatcgcagatgctggggggcatgggattgtcaaaccaaagtagctacggggggcccgcatctcagcagctcagtggcggttacggaggagggtacgggggacagtcatcaatgtcgggctatgatcaggtccttcaggagaactcttccgacttccagtccaacatagcatag

SEQ ID NO: 26506 - DNA, 411 bp, Artificial Sequence
  Description of Artificial Sequence: Synthetic coding sequence
atgatcgtgaacgactacgagggcaacgacagcgaggccgaggacctaaatttccgcgagaccctgcccagctcctctcaggaaaatacccccagaagtaaagtgttcgagaataaagtgaatagcgaaaaggttaagctgtctttacgaaatttcccacataatgattacgaagacgtattcgaagaacctagcgagtccggaagcgatccgtcgatgtggacagcccgtgggccctttagacgggacagatggagcagcgaggacgaagaagccgcaggcccgagccaggcactaagccctctgttaagcgtgcagcatcatggatattctggccccaatgaaagaacaactttctggcacggttccaatgaaggagcggtctctctcctcctccgatactgtgcctag

SEQ ID NO: 26507 - DNA, 462 bp, Artificial Sequence
  Description of Artificial Sequence: Synthetic coding sequence
atgaagctgaccagcgagaagctgcccaagaaccccttctacgccagcgtcagccagtatgcggctaaaaatcagaaatttttccagtggaagaaagagaaaacagactatacccacgcgaatttggtcgataaagccctgcagttacttaaggaaaggattctcaagggggataccctcgcctatttcctcaggggtcagctgtattttgaggagggatggtatgaagaggccctcgagcagtttgaagagatcaaggagaaagatcaccaggccacctatcaactgggcgtgatgtattacgatggcctgggcaccaccctcgacgcagaaaaaggggtcgattacatgaagaaaattttggactccccatgcccaaaagcaagacatttgaagtttgccgcagcgtacaatctgggacgtgcttactacgagggtaagggcgtgaaacggagtaactag

SEQ ID NO: 26508 - DNA, 489 bp, Artificial Sequence
  Description of Artificial Sequence: Synthetic coding sequence
atggaggccctgctggagggcatccagaaccggggccacggcggcggttttctcacatcatgtgaggccgagcttcaggagctgatgaagcagatcgatattatggtcgcccacaaaaagtccgagtgggaaggccggactcatgcactagagacatgcctcaagatccgcgagcaggagctgaagtctctgcgttctcagctcgacgttacacacaaagaagtcggaatgttgcatcagcaggtggaagagcatgaaaaaatcaaacaagagatgacaatggaatataaacaggaactgaaaaagctgcacgaagagctatgcatactgaaaaggagctacgagaaattgcaaaagaagcagatgagggagtttcggggcaatactaaaaaccaccgcgaggatcgttctgagatcgaacgcctcactgccaagatcgaggaattccgccagaagtctctcgattgggaaaaacagagactgatatag

SEQ ID NO: 26509 - DNA, 1530 bp, Artificial Sequence
  Description of Artificial Sequence: Synthetic coding sequence
atgaagcggggccggctgcccagcagcagcgaggacagcgacgacaatggcagtttaagcaccacctggagccagaattccagatcccagcacaggaggagctcttgcagtcgacatgaagatcgcaaaccgagcgaagtattcaggactgatctcatcaccgctatgaaactccacgattcataccagttaaaccccgacgaatactacgtgctcgcagacccctggcgacaggagtgggagaagggggtgcaggtccccgttagcccagggaccattccacagccagtcgccagagtggtgtccgaagagaagagtttgatgttcattcgacccaaaaagtatattgtgtcaagtggtagcgagccccctgagctgggatacgtggacatccgcaccctggcagattctgtttgtaggtacgatctgaacgacatggacgctgcttggctggagctgactaacgaggagttcaaggagatgggtatgccggagcttgatgaatacacaatggaacgggtgctggaggaatttgagcaaagatgctatgacaatatgaaccatgctattgaaacggaagagggtcttgggatagagtatgacgaagacgtcgtgtgtgatgtatgccagtctccagacggggaagatggcaatgagatggtgttttgcgacaagtgtaacatctgcgtgcaccaggcctgttatggtatcctgaaggtaccagaaggatcttggttgtgccggacttgtgctttgggggtccagcctaaatgtctgctttgtcccaagaagggcggcgcaatgaagccgacccggtctggtaccaaatgggtgcacgtttcctgtgcactctggatcccagaagtgtcaattggatcgccagaaaagatggaacccattaccaaggtctcacatatccccagcagccgatgggccctggtttgttcgttgtgcaatgagaaattcggtgcctctatacagtgttctgtgaagaactgccgtactgctttccacgtcacctgcgctttcgacagaggactcgagatgaagaccatcctggcagagaatgatgaggtcaagtttaaatcttattgccccaagcattcctctcacagaaaacccgaggagagtctcggtaagggtgccgcccaggaaaatggcgccccggagtgtagtcctaggaatccgttagagccattcgcttcattggagcagaacagagaggaggcacatagagtcagcgtgcggaagcagaagttgcagcaattagaagacgaattttacacttttgttaatctgcttgacgtcgctagggccctcaggctccccgaagaagtggtggactttttgtatcaatattggaagctaaaacgaaaggtcaatttcaataaacccctcatcaccccaaagaaagatgaagaggacaatctggctaagagagagcaagatgttttgttccgcagactgcagctgttcacccacctcagacaagatttggagagagtgatgattgacaccgacacgctatag

SEQ ID NO: 26510 - DNA, 90 bp, Artificial Sequence
  Description of Artificial Sequence: Synthetic coding sequence
atgaacggccgggccgacttccgggagcccaacgccgaggtgcccaggcccataccacatatcggacccgattacatccccacagaatag

SEQ ID NO: 26511 - DNA, 1236 bp, Artificial Sequence
  Description of Artificial Sequence: Synthetic coding sequence
atgatcgtgaacgactacgagggcaacgacagcgaggccgaggacctgaattttcgagaaaccctaccaagtagttcccaggaaaatacaccaaggagcaaagtattcgaaaacaaggtgaactcggaaaaagtgaagcttagcctccgaaattttccacataacgattacgaagacgttttcgaggagccgtcagaaagtggttccgacccctccatgtggaccgcaagaggtccatttaggagggaccgctggtcgtccgaggacgaagaagccgccggcccctctcaagcactgagccccctcctaagcgatacccggaagattgtgtctgagggagaacttgatcaattggcacaaattagaccactcatctttaactttcacgaacagacggccatcaaggattgccttaaaattctggaagagaaaaccgcggcttatgatatcatgcaagagttcatggcccttgaactgaagaacctccccggagaattcaactcagggaaccagccatccaaccgcgaaaagaatcggtatcgtgacatactgccctatgacagtacccgggtaccacttggcaagagtaaggattatattaatgccagttacatccggatagtgaactgcggcgaggaatatttttacatagctacccaaggtcctcttctttccacgatcgacgacttctggcagatggttctcgagaacaattcgaacgtgatcgcgatgataacgagagagattgaaggaggcatcattaaatgctaccactactggcccataagcctgaaaaagccattagaattgaaacactttcgggtgttcctagagaattaccagatactacagtactttatcataaggatgtttcaggtcgttgaaaaaagtaccggtacgtcccatagcgtaaagcagttgcagtttactaagtggccggatcacggcactcccgctagcgctgacagtttcatcaagtacatccgatatgcccgaaagtcccatctgacgggcccgatggtcgtgcattgttctgctggcataggtagaacgggtgtgttcctgtgtgtagacgtggtgttttgtgccatagtaaaaaactgcagctttaacatcatggacattgtcgcccaaatgagagaacagagatccggtatggttcagaccaaagagcaataccacttctgctacgatatcgtgcttgaggtcctgaggaaactgctgacgcttgactag

SEQ ID NO: 26512 - DNA, 300 bp, Artificial Sequence
  Description of Artificial Sequence: Synthetic coding sequence
atggtgatggagaagcccagccccctgctggtgggccgggagttcgtgagacagtactacaccctgttgaataaggctcccgagtatctgcaccgattctatggcaggaactcttcctacgtgcacgggggcgttgacgccagtggtaagccccaggaggccgtgtacggccaaaatgacattcatcataaagtcctgtcactgaatttttctgagtgccatactaagattcgccatgtcgacgcacatgcgactctgagcgacggggtcgtggtgcaagttatgggtcttctctcctag

SEQ ID NO: 26513 - DNA, 705 bp, Artificial Sequence
  Description of Artificial Sequence: Synthetic coding sequence
atggccagcagcgccaagagcgccgagatgcccaccatcagcaagacagttaacccaacgccagaccctcaccaagaatatttggatcctagaataacaatcgcactattcgagatcggatcacactccccctctagctggggctcactgcctttcttaaagaattcctcgcaccaagtcaccgaacagcaaactgcgcagaagtttaacaacttgctcaaagagattaaagacatcttaaagaatatggccggcttcgaggaaaagattaccgaagccaaagagctcttcgaggaaacgaatattaccgaagacgtctccgcacacaaggagaacattcggggtctggacaagatcaatgagatgctctcaactaatctgcctgtgtcactcgcaccagaaaaggaggataatgagaaaaagcaggagatgattctggaaaccaacataacagaggacgtaagcgcacataaggagaacattcgcgggctggataagatcaacgagatgctctctactaatcttccggttagcctggcccccgaaaaagaggacaacgagaagaaacaacaaatgattatggagaaccagaactcagagaacacagcccaggtgttcgcaagggacctcgtcaaccggctggaagagaaaaaagtgttgaatgagacccagcagtcacaagagaaggctaagaataggctgtag

SEQ ID NO: 26514 - DNA, 1095 bp, Artificial Sequence
  Description of Artificial Sequence: Synthetic coding sequence
atgtacttctgctggggcgccgacagccgggagctgcagcggcggcgcacagcagggtctccaggtgctgagttgctgcaggctgcttccggagagcgacattccctgctcctgcttacaaaccaccgggtgctcagctgcggggacaactctcgcggtcagctgggaaggcgtggcgcccagcgtggcgagcttccggagcccatccaggcactggaaacactaattgtggatctcgttagctgtggcaaggaacacagtctggctgtttgccacaaaggacgcgtcttcgcctggggtgctggaagtgaagggcagttgggcataggggagttcaaagaaatttcatttacgcctaagaagattatgaccctgaatgatattaaaattattcaagtgtcctgcggccattatcacagcctagcactatctaaggacagccaagtgttctcatggggcaagaattcccatggtcagttaggactgggcaaagaatttccttcccaggctagccctcagcgcgtgcgttcactggaaggaataccacttgcacaggtggctgcaggaggtgcccattcttttgcactatctttgtgcgggaccagctttgggtggggttctaactctgccggtcagctcgccctgtcaggccgcaacgtcccagttcagtctaataagcccctgtcagttggagccctgaagaatctgggagtcgtttacatttcatgtggcgatgcccataccgctgtgcttacacaggacggtaaggtgttcacctttggcgacaaccgaagtgggcaactgggctactcccccacaccggagaagaggggccctcagctggttgaaagaatcgatggcctcgtcagtcagatcgactgcggctcttatcatacactcgcttatgtgcacacaacaggtcaagtggtgagcttcgggcatggcccaagtgacacttccaaacctacacacccagaggcattaacagagaactttgacataagctgcctaatttccgccgaagacttcgtggacgtacaagtgaaacacatcttcgccgggacttacgccaacttcgttaccacgcaccagtag

SEQ ID NO: 26515 - DNA, 348 bp, Artificial Sequence
  Description of Artificial Sequence: Synthetic coding sequence
atggccaagtacaacaccggcggcaaccccaccgaggacgtgagcgtgaacagccggcctttccgggtgacgggacccaatagctccagtggtatacaagccagaaagaacttatttaataaccagggtaatgcttccccgcctgctgggcctagtaacgtgcccaaattcggctctcccaagccgcctgttgccgtcaagccaagcagtgaggagaagcccgataaggagccaaagcccccattcctcaagccaaccggcgccgggcagcgttttggaactccagcatctctgaccacaagagatcccgaggccaaggtggggtttcttaagcctgtaggaccctag

SEQ ID NO: 26516 - DNA, 486 bp, Artificial Sequence
  Description of Artificial Sequence: Synthetic coding sequence
atggccggcatcctgcggctggtggtgcagtggccccccggccggctgcagaccgttactaaaggtgttgagtcccttatctgtacagattggatccggcataagtttactcggagcaggatcccagaaaaggttttccaggcgtcccccgaggaccacgaaaagtacggaggcgaccctcagaacccacacaaactgcatattgtgaccaggattaagtccactcgccgccgtccttactgggagaaggacattatcaaaatgctgggactggagaaggcacataccccgcaggtacataagaacataccctccgttaatgcgaaacttaaagttgtgaaacaccttatcagaatcaagcccttgaaattgccgcagggtttgccagctgaggagaacatgtccaatacatgtttaaaatccaccggagagctggtggtgcagtggcacttgaagcctgtggagcagaaggctcacgagtcctag

SEQ ID NO: 26517 - DNA, 516 bp, Artificial Sequence
  Description of Artificial Sequence: Synthetic coding sequence
atgaacggccgggccgacttccgggagcccaacgccgaggtgccccgacctatcccccatatcggcccggactacatcccaaccgaggaggaacgcagagtgtttgcggagtgtaatgatgagtcgttctggttcaggtctgtgcccctggctgcaacttcaatgttaattacccagggcctgatttccaaaggaattttgtccagccaccctaagtacggctcaattccaaagttaatccttgcgtgtatcatgggctattttgctggaaagttgtcctacgtgaagacatgtcaggagaaattcaagaagcttgagaactccccactcggcgaggccctgagatccggtcaagcacggcggagcagtccgcctggacactattatcagaagagtaagtatgattctagcgtgtctggacaatcatcctttgtgacttctcccgctgctgacaacatcgaaatgctgcctcactatgagcctattccattctcctcttctatgaatgagtcgtag

SEQ ID NO: 26518 - DNA, 438 bp, Artificial Sequence
  Description of Artificial Sequence: Synthetic coding sequence
atgagcagcccccgggacttccgggccgagcccgtgaacgactacgaaggcaacgattccgaggccgaggacctcaacttccgggagacattgccatccagctcacaggaaaatacacctaggtcaaaagtctttgaaaataaggtaaactcagaaaaggtcaagctgagcctgagaaattttccacataatgactatgaggacgtgttcgaagagccttcagagtcaggctctgatccctccatgtggactgctaggggccccttccggcgtgacagatggagttccgaggacgaggaggctgccggccctagtcaggctctgtcccctctcctgtccgtgcaacatcacggatattccggtcctaatgaacggaccacgttctggcacggtagcaacgaaggagccgtctcattgttactgcgctattgtgcctag

SEQ ID NO: 26519 - DNA, 243 bp, Artificial Sequence
  Description of Artificial Sequence: Synthetic coding sequence
atggtgaccagcctgaacgaggacaacgagagcgtgaccgtggagtggattgaaaacggagacactaaggggaaggagatcgatttggagagtatctttagcctgaacccggacctcgtacctgacgaggagattgaacccagccctgaaaccccgccaccgcctgcaagcagtgcaaaggtgaataagatcgtcaaaaaccgcaggactgtagcctccattaagaacgacccaccatcatag

SEQ ID NO: 26520 - DNA, 123 bp, Artificial Sequence
  Description of Artificial Sequence: Synthetic coding sequence
atgaaggccatcaagaagagcctgaccgaggaggagtacctgtaccttgatttcagccatcagacagagggatgtatttttcccttgcatacaagcgtaaccctgtttctgctgagttattag

SEQ ID NO: 26521 - DNA, 192 bp, Artificial Sequence
  Description of Artificial Sequence: Synthetic coding sequence
atggaggccctgctggagggcatccagaaccggggccacggcggcgggtttctgactagctgtgaggccgagcttcaagaactgatgaagcagatcgacatcatggtggcccacaaaaaatcagaatgggaagggagaacccacgctttggaaacttgcctcaaaattagagaacaagagttaaagtcttag

SEQ ID NO: 26522 - DNA, 594 bp, Artificial Sequence
  Description of Artificial Sequence: Synthetic coding sequence
atgtggaccgcccggggccccttccggcgggaccggtggagcagcgaagacgaggaggcagcgggacccagccaagcccttagccctctgctttccgacactaggaaaatagtttctgagggggagctcgaccagctggcccagattcgccctttaatcttcaatttccatgagcaaactgccatcaaggactgtttgaaaatattggaggaaaagacagctgcgtacgacatcatgcaagagttcatgaccggaacctcccactccgttaaacagttgcagttcactaagtggcctgatcatggaacgcccgcatcagctgactcattcatcaagtatatacgctatgcccgcaaatcacacctcacgggtcccatggtggtgcattgttccgccggcattgggaggacgggcgttttcctgtgtgttgacgttgtgttctgcgctatcgtgaagaactgctctttcaatatcatggacattgtggctcagatgagagagcagagatctggaatggtgcagaccaaggaacaataccacttttgttatgatattgtccttgaagtgctgcggaagctactcactctcgattag

SEQ ID NO: 26523 - DNA, 2529 bp, Artificial Sequence
  Description of Artificial Sequence: Synthetic coding sequence
atgaagcggggccggctgcccagcagcagcgaggacagcgacgacaacggttcgctttctacaacttggtctcagaattccaggagtcagcaccggcgaagcagctgctctcgacacgaggacaggaaaccttccgaagtgttccgcactgacctgattacagcaatgaaactccatgacagctatcaactgaaccctgatgaatattatgttctagctgatccttggcggcaggagtgggagaagggcgtacaggtcccagtctcccctggaacaattccacaacccgtcgcccgggtggttagcgaggaaaaaagtctcatgtttatacggcccaagaagtacatcgtgtcatctggatccgaaccgcccgaattgggctacgtggacattcgcactcttgcagacagtgtgtgcaggtatgatttaaacgacatggacgctgcttggctggagctgacaaatgaggagtttaaggagatgggaatgcctgaactggatgagtacacgatggagcgggttctggaggagtttgaacagaggtgctacgataatatgaaccacgctattgaaactgaggagggactcgggatagagtacgacgaagatgtcgtgtgcgatgtctgccagtcccccgacggcgaggatgggaacgagatggtgttttgcgataagtgcaatatttgcgtgcaccaggcttgctatggaatactgaaagtgccagagggttcttggctctgtcgcacatgcgcattaggggtgcagcctaagtgtctcctgtgtccaaaaaaaggcggcgccatgaagcctacccgatctgggactaaatgggtccacgtcagttgcgctctttggatccccgaggtctctatcggttcgcccgaaaagatggagccaattaccaaggtgagccatattcccagttctcggtgggcactggtctgctcactgtgtaatgagaagttcggagcctctatccagtgtagcgttaaaaactgtagaacagcatttcacgtgacttgtgctttcgatcgaggacttgaaatgaagacaattctggcggagaacgatgaagtgaaatttaagagttactgtccaaaacacagctcgcaccggaagcctgaagagtccctgggcaagggagccgcgcaggagaatggggccccagaatgcagtccgcggaatccgctagagccctttgcaagcctggaacaaaacagggaggaggcacatcgagttagcgtccgtaagcagaaactgcagcagttagaggatgagttttacacctttgtcaacctgctggacgtcgctcgcgctttaagacttccagaggaagtcgtggattttctctaccagtactggaaattgaaaaggaaggtcaacttcaataaacccctgatcacccccaagaaagacgaagaagacaacctggctaagagggaacaggacgtgttgttcagacgcttgcagctcttcactcacctgcgccaggatttggagagagtcagaaatctgacttatatggtgacccggagggaaaaaataaagagatcggtttgcaaggtgcaagagcagatcttcaatctgtacacaaaattactggagcaggagagagtcagcggcgttccctccagttgttccagctctagtctggagaacatgctgctgttcaacagcccctctgttggacccgatgcaccgaaaatcgaggatttaaagtggcactctgccttctttaggaagcagatgggaacatcactggtccattcattaaaaaagccccacaaaagggaccctcttcagaatagcccgggttcggaaggcaagaccttgctgaagcaacccgacttgtgtgggcgtagggagggaatggtggtgcctgagagtttcctagggctggagaaaacattcgctgaggcccggctgatctccgctcagcagaagaacggggtcgttatgccggaccatggcaaacggcgagacaataggttccactgcgatctcataaaaggcgatcttaaagataaatctttcaaacaaagtcacaagcctctgcggagtactgacgtttcccagaggcacctcgataatacccgcgccgctaccagccccggagtgggtcagtcagctccagggacacgaaaagaaattgtgcccaagtgcaacgggtctttaattaaagtgaactataaccagactgctgtcaaggtccccaccactccagcgtcaccggtgaaaaactgggggggattccggattccaaaaaagggtgagcgccagcagcagggagaggcacatgatggagcgtgtcaccagcacagtgattatccttatcttggcttaggccgggtccccgcaaaagaacgcgccaaaagcaaactgaagtccgacaatgagaacgacggatacgtgccggacgtggagatgtctgacagtgagtccgaagccagtgaaaagaaatgcatccacacaagcagcaccatctcccgaagaactgacatcattagacggtccatccttgcatcatag

SEQ ID NO: 26524 - DNA, 2490 bp, Artificial Sequence
  Description of Artificial Sequence: Synthetic coding sequence
atggccaagtacaacaccggcggcaaccccaccgaggacgtgagcgtcaattcaagaccttttcgtgtgacaggccctaacagttcctccggcatccaggcaaggaaaaatttgttcaacaatcagggcaacgcgagccctccagctggaccttccaacgttccaaaattcggctcccccaagccacccgtggcggtcaaaccctctagcgaggaaaaacctgacaaagagcccaagcctccattccttaaacctactggagcaggacaacgttttggaacccctgcatccctgaccaccagggaccctgaagcgaaggttggcttccttaagcccgtgggccccaaacccatcaacctgcctaaagaggatagcaagcccacatttccctggcctcctggaaataagccatcattgcacagcgtgaatcaggaccatgacttaaagccacttgggcccaagagtgggcccaccccccccacctcagaaaatgagcagaagcaggcctttcccaaactcaccggagtgaaggggaagtttatgtcagcaagccaggatctggaacctaaacctctgttcccgaagccggcatttgggcagaaacccccactcagcacagaaaactcacacgaagacgaatccccaatgaaaaacgtttcatcttccaaaggctctcccgctccactgggcgtccgcagcaagagtggtcctctgaagccagcacgagaagactctgaaaataaagatcatgctggagagatttcatctctccccttccctggagtcgttctgaaacccgccgcaagccgcgggggaccaggactcagcaagaacggagaggagaagaaagaagaccggaagatcgacgctgccaagaatacttttcaaagcaaaataaaccaggaggagctggcgagtggaacccctcccgcccgttttccaaaggcccccagcaagctcaccgttggaggtccgtggggccagtcccaggaaaaggagaagggggataagaactccgcaacccccaagcaaaaaccccttcctcccctgttcacgctgggcccacctccgccaaaaccaaaccgcccgcccaatgtggacctcaccaaattccataaaacgtctagcgggaatagcactagtaaaggacagacatcctatagcaccaccagtttacctcctccgcctcctagccatcctgcttcccaacccccattaccagcgtcgcacccctcacagcccccagttccctctctacctccgagaaacatcaaaccccccttcgatctgaagagtccagtcaatgaggacaaccaggacggagtcacccactcagacggggcgggcaacttagacgaggagcaggacagtgagggtgagacctacgaggacattgaagcttcaaaggaacgagagaagaagcgggaaaaagaggagaaaaagagactggaattagaaaagaaggagcaaaaagaaaaagagaagaaagagcaggaaatcaagaagaagttcaaactcactgggccgatccaagtcattcatcttgctaaggcttgctgcgacgtcaagggcgggaaaaatgaactgtccttcaaacagggggagcaaattgagattatacgaatcaccgacaatcctgaaggcaagtggctggggcgtaccgctcgcgggtcttacggctatattaagaccaccgctgtggagatcgactacgactcactgaaactcaagaaagattctcttggagcaccttcaagacccatcgaggatgatcaagaagtgtatgatgacgtcgccgagcaggatgacattagctcccactcacaatctggcagcggaggcatattccccccaccccctgatgacgacatctacgatggtatcgaggaggaggacgcggacgacggaagcaccctccaggtgcaagaaaagtccaacacttggagctggggcatcttgaaaatgctgaagggcaaggatgatagaaagaagtctatcagagagaaaccgaaggtcagcgatagcgacaacaacgagggaagtagtttcccagccccccccaaacaattggacatgggtgatgaagtgtacgatgatgtggacaccagtgactttcccgtaagttccgcggagatgagccaaggaacaaacgttggaaaggccaaaacagaggagaaggaccttaagaaactcaagaaacaagaaaaagaagagaaagactttcgcaaaaagtttaagtacgacggagagatcagagttttgtacagcaccaaagttactacatctataacatcaaagaaatggggtacgcgcgatctgcaagtgaaacctggcgaatccctagaggtcattcagacaacagatgacactaaagttctttgccggaacgaagaaggaaaatacggctacgtgctgaggtcgtatttggcggataacgatggcgagatatatgatgacattgccgacggctgcatctatgacaacgactag

SEQ ID NO: 26525 - DNA, 810 bp, Artificial Sequence
  Description of Artificial Sequence: Synthetic coding sequence
atgatcgtgaacgactacgagggcaacgacagcgaggccgaggacctgaattttagggagacactaccgtcctcgtcccaggagaataccccacgttccaaagtgtttgagaataaggtgaatagcgagaaggtgaagttatcactgcgcaactttccacacaacgattatgaggacgtgttcgaagaaccaagtgagtctgggtctgatccctcaatgtggactgctcgtggcccattccgcagagataggtggtcttcagaagacgaggaggctgccgggcctagtcaggccctgagcccacttctctccgacaccaggaaaattgtgtccgagggagagttggatcagttggctcagatacggcccctgatcttcaacttccacgagcagaccgctataaaagattgtttaaagattttggaggagaagactgcagcttatgatattatgcaagagtttatgacaggcacaagtcactccgtaaagcagcttcagtttaccaagtggcctgaccatgggactccagcatctgcggattcttttatcaaatacatcagatacgcaaggaagtcccacttgacgggaccgatggtggttcattgtagcgcgggcattgggcgcaccggcgtgttcctctgcgtcgatgtggtcttttgtgctatcgtcaagaattgtagttttaacatcatggatattgtagcccagatgagagagcagcgctctggcatggttcaaacaaaagagcagtaccacttttgctatgacatcgtgctagaagtactccgcaagctgttaactctcgactag

SEQ ID NO: 26526 - DNA, 492 bp, Artificial Sequence
  Description of Artificial Sequence: Synthetic coding sequence
atgatgctgggcaccgagggcggcgagggcttcgtggtgaaggtgcgggggcttccgtggtcatgctctgccgacgaggtgcagcgattcttctctgattgtaagatccagaacggcgcacagggcatacgattcatctatacccgcgaaggtaggccatcaggcgaggcgtttgtcgaactggaatctgaagacgaagtcaagctggcattgaaaaaagatagagaaacaatgggacacagatatgtggaagtgtttaagtcaaataatgtggagatggattgggtgctaaagcatacaggaccaaactcacccgacaccgccaacgacggcttcgtacggttaaggggcttgccgttcggttgttcaaaggaagagatcgtgcagttcttctctggcctggaaatcgtcccgaatggaataacgctgccagtagatttccaaggaagaagtaccggcgaagcgttcgtgcagttcgcctcacaggagtag

SEQ ID NO: 26527 - DNA, 759 bp, Artificial Sequence
  Description of Artificial Sequence: Synthetic coding sequence
atggccgccaccgcccgggaggacggcgccagcggccaggagcggggacagcggggctgtgaacattatgacagaggatgccttctcaaagccccttgttgtgacaaattgtacacatgtaggttgtgccacgataataacgaggaccaccagcttgaccgtttcaaggtgaaggaagtgcaatgcatcaattgcgagaaaattcagcatgcacagcagacttgcgaagagtgttccacgctcttcggcgagtactattgcgacatatgtcacctgtttgacaaggataagaagcagtatcattgcgagaactgcggcatttgccgaataggaccgaaggaggatttcttccattgccttaagtgtaacctctgtttggcaatgaatcttcagggtcgccacaaatgtatcgaaaatgtaagtcggcagaactgccccatctgtctagaagacattcatacttctcgagttgtcgcacatgtattgccatgtggccatctcttgcaccgtgggtaccgttgtccgctctgcatgcatagcgctctggatatgaccagatattggagacagctggatgatgaagtcgcacagacacccatgccgagcgaatatcagaacatgaccgttgacattctgtgtaacgattgtaatggccggagtacagtgcaattccatatactgggcatgaaatgtaagatttgcgaatcctacaacacggcgcaagccggcggaaggaggattagcctggaccagcaatag

SEQ ID NO: 26528 - DNA, 594 bp, Artificial Sequence
  Description of Artificial Sequence: Synthetic coding sequence
atgtggaccgcccggggccccttccggcgggaccggtggagcagcgaggacgaagaggcggcagggccttcccaagccttatcccccctgctgagcgacaccaggaagatcgtgagcgaaggggagctggaccaattggcgcaaatcaggcctctcatctttaactttcacgaacagacagctataaaggattgtctgaagatcttagaggaaaaaaccgcagcatatgatatcatgcaggaatttatgaccggcacttcacactcagtgaaacagttgcagttcacaaagtggccggaccacgggactccagcatcagctgacagctttatcaagtacattaggtatgctcgaaagagtcacttaactggcccaatggtggtccactgctcagccgggatcggaagaaccggggtatttctctgcgtggatgtggttttttgcgcgattgttaaaaactgtagcttcaatatcatggatattgtcgcgcagatgcgcgagcaacggagcggtatggtgcagacaaaagagcagtaccatttctgctacgatatcgtcctggaagtcctgaggaagctcctgaccctggactag

SEQ ID NO: 26529 - DNA, 4203 bp, Artificial Sequence
  Description of Artificial Sequence: Synthetic coding sequence
tgacccccccccccccccccccccatgtggaaccccatgatccccgcttttgatttgtttcagggcaatcatggttttgtggcacctgtcgtcactacagccgcacactggcgcagcgtgaattatacttttcccccttcagttatcagtcacacctccccaacgaaggtatggcggaacaaggacggaacctccgcatatcaggtccaggagacacccgtgtctcaagttgtccgtaaaaaaacttcctatgtgggacttgtgctggtcctgcttcgaggtttgcccgggtccgggaagagcttcctggctcggactctccaggaagataatccgtcaggcgtgattctgtctacagatgactatttctacattaatggtcaataccaattcgacgtcaagtaccttggcgaggcccacgagtggaatcagaaccgcgcaaaggaagcttttgagaaaaaaatttcccctatcattatcgacaacaccaatctgcaagcctgggaaatgaagccatacgtcgcactgagtcagaaacacaaatataaggtgttgttcagagagcccgacacatggtggaaatttaaaccaaaagagctcgcacgccgcaatattcatggagtgagcaaggagaaaataactcggatgcttgaacactaccagaggttcgtttctgtccccattattatgagcagtagtgtgcccgagaagatcgagaggatagagctgtgtgcttatagttgtgaggatcgcagcacttctccccgggacgatgaggatattatcagcgagaaagaagaaaatattctgtcactatccttgaagcacctggagttcacagaggagaaaaatttagatgttacaaaggagaccatgttgcctgagaacgtggcctacctgagtaacgcagatctcaacaagcgccgcaaagaaataagcgatatgaatccaagcatccagtctgccctgatactggagacccctcatatgtacttttcagactctgaaagcaaactccaggctaccgacaaatccgaaaacgagcagatcgaaatggttgccgtgaagggctatagtaaaactgacaccgattcctcaatggaaagggtcagcccttcgacttgttgcagcgagaacaatcaagaggactgcgacctggctaacagcggcccactgcagaacgagaaatccagtccaggcgagattgtggaggagcgggcaacagtcacgaagaaagcattcggtaagcagaaaagcaagagcaccctggagaaatttccccgacatgaactgtccaattttgtgggggactggcctgttgacaaaacaattggccagagaactaagcgaaaccgaaagaccgaaaaaacttcgtctgtacagagtgacaagaaatataactatccccagtcccacaaactggttaactctgtctctgttaacactgactgcgtgcagcagcggggcagccctcatgaatctgtcgaagacggccgcaaatctcagtgcgacgatgccagcgaacctctgaactcctataagtatgatgcctataaaaatatcgacaagaatagcttcaacattatgggcgattggccaagcagcgactcactggctcagagagagcataggagccggatgcccaagacaggtctgagcgaaccaaatctggaaattgggacaaatgataagatgaatgagatcagcctcagcacagcacatgaagcctgttggggaacaagttcacaaaaactgaagacattaggaagctcaaacctcggatccagtgaaatgctcctatctgagatgacctgcgagtcccaaacctgcttgtccaagaaaagccatggccagcacacctccctgcctctgacattcactaactctgcaccaacggtatcaggggtggttgaaccccagacacttgccgaatgccaggaacagatgccaaagcgtgaccccggaaaagaagtgggtatgtgcacacaaacggagccccaagatttcgccctcttgtggaagatcgagaagaataagattagcatcagtgactcaattaaagttcttacgggacgccttgatggctttaagcccaaggtattcaatattaacaccaaatcagacgtgcaggaggcaattccctatcgcgtcatgtacgacaaatctactttcgttgaggagtctgagttgactagcgcagacgagtcggagaatctcaatatcctgtgcaagctctttggaagtttttccctcgaagcactaaaagatctatacgagaggtgtaacaaagacatcatttgggcaacgagcctccttttggacagtgagactaagctctgtgaagataccgaatttgaaaatttccagaagtcctgcgacggatcccaaataggtcctttcagcctggggctcaatctaaaagagatcattagccagcggggaaccctcgagaatagcaactcccccgtgccagaattctcacacggaattgggatctcaaacgccgacagtcagtctacatgtgacgccgagagaggcaactctgagcaggccgagatgcgggcagttactcctgagaatcatgaaagcatgaccagtatcttccccagtgcagcagtgggcctaaagaacaataacgatatccttcccaacagccaagaagaactactctactccagtaagcagtcttttccgggaatcctcaaggcaactaccccgaaggatatgagcgaaaccgaaaaaaacttagtggttacagagaccggggacaatatccactctccctcacacttcagcgacatttttaactttgtgtcgagcaccagcaacctcgagctcaatgaggagatttattttacagacagtcttgagattaaaaggaacgagaactttccaaaagactacgttaaatttagcgatgaggaggagtttatgaacgaagatgaaaaggaaatgaaagagatcctgatggcaggatcctcactgtctgctggagtgagtggggaggacaaaactgagatcctcaaccccactccagctatggcgaaatccctgaccatagactgcctggagttagctcttccaccagaactggcctttcagctgaatgaactgttcggcccagtcggaatagacagtgggtctcttactgtcgaggactgtgtggtgcatatcgacctaaatctggcaaaggtgatccacgagaaatggaaagaaagcgtaatggagagacaacgacaggaggaagtttcctgcggcaagttcatgcaagacccctcattggtggggcacaccggattggataatccagaacagaaaagtagtcagcgcactggaaagaaactcttgaagacgctgaccgcatctgaaatgctgcctctgctggatcattggaatacgcaaactaaaaaagtctcgttacgcgagatcatgtccgaggaaatagctttgcaggagaagcataacctgaaacgtgagaccctgatgttcgaaaaggattgtgccactaaactgaaagagaagcagttattcaagatctttcctgcaatcaaccagaacttcctggtggatattttcaaagatcataattacagtctcgaacacacagtgcaattcctgaactgcgtacttgaaggagatcctgtgaaaaccgttgtggcccaggagttcgtccatcagaatgaaaatgtcactagtcacactggacaaaagtctaaagaaaaaaaagacttcgagtatcccgactacgatgactatcgcgctgaagcgtttctgcaccaacagaagaggatggaatgctactcaaaggcaaaagaggcctaccgaattgggaagaagaatgtggctactttttacgctcagcagggcaccctccacgaacagaagatgaaagaagcaaaccacctggctgccatagaaatctttgaaaaggttaatgcttctctgctgcctcaaaatgtgctggacctccatggtctgcacgtcgacgaggctttggaacacctgatgcgggtgctggagaaaaagaccgaggagttcaagcagaacgggggaaagccctacctttctgtcatcaccgggaggggcaatcatagtcaggggggagtggcccggatcaaaccagccgtgataaaatacctgatctcccattcatttcgattcagcgaaatcaaaccaggttgcctgaaagtgatgttaaaatag

SEQ ID NO: 26530 - DNA, 237 bp, Artificial Sequence
  Description of Artificial Sequence: Synthetic coding sequence
atgctgtgctggggctactggagcctgggccagcccggcatcagcaccaatctgcaaggaattgtggccgagccacaagtatgtggtttcatcagcgacagatctgtaaaggaagtcgcctgcggcggcaaccatagcgtgtttttgctagaggacggtgaggtctatacatgcggcttgaatactaagggacagttaggtcatgaaagagaggggaacaagccagaacaaatttag

SEQ ID NO: 26531 - DNA, 738 bp, Artificial Sequence
  Description of Artificial Sequence: Synthetic coding sequence
atgaacggccgggccgacttccgggagcccaacgccgaggtgccccggcctatcccccacataggacccgactatatccccacagaagaagaaagaagagtcttcgccgagtgcaatgacgagagtttttggttccgatctgtgccactcgctgccacaagtatgctgatcacgcaggggctgatcagcaaaggtatactgtccagccaccccaagtacggtagcattcctaagcttattctggcatgcatcatgggatatttcgcaggtaaactttcatacgtaaagacatgtcaggagaagttcaagaagctggagaattccccattgggggaagccctgcgcagtggacaggcaaggcggtcaagtcctccaggacactattatcaaaagagcaagtatgatagttccgtgagcggccagtcttccttcgtgaccagccccgcggcagacaatatcgagatgctcccccattacgaacctattccattctcatcatcaatgaacgagtccgcccctaccgggatcaccgatcacattgtccaaggcccagaccccaatcttgaggagagccccaaacgtaagaatatcacttatgaagaactgagaaataagaaccgagaaagctacgaagtatcactgacccagaaaacagacccttcggtgcgcccaatgcacgagagagtccccaagaaggaggttaaggtaaataagtatggcgatacttgggacgagtag

SEQ ID NO: 26532 - DNA, 2112 bp, Artificial Sequence
  Description of Artificial Sequence: Synthetic coding sequence
atggaggccctgctggagggcatccagaaccggggccacggcggcgggtttctgacctcatgcgaagccgaactccaggagctgatgaaacaaattgatatcatggtcgcccataaaaagagcgagtgggaaggcagaacacacgccctggaaacctgcctgaagattagggagcaggaactgaaatcactgcggagtcagttagacgtcacacataaggaagtgggcatgctgcaccagcaggtggaggaacatgaaaagattaagcaggaaatgaccatggagtataagcaggaactaaaaaaattgcacgaggagttatgcattctgaaacggtcctacgaaaagctgcagaaaaagcaaatgcgcgagtttcgcggtaacacgaagaaccatagggaggataggtccgagatcgaaaggctgactgccaagatcgaggagtttaggcagaagtctctggattgggaaaaacaacgcctgatctatcaacagcaagtctcgtcccttgaggcacagcgtaaagcactggctgagcagagtgagatcatccaggcccagctcgttaaccgtaaacagaaacttgagagcgtagaactgagttcccagtctgaaatccagcacttgtcttcaaaactcgagcgtgcaaacgataccatctgcgctaatgagctcgagatcgaaaggctgaccatgagagtcaatgacctcgtgggtacatccatgaccgtgcttcaggaacaacagcagaaagaagagaaactccgggaaagcgaaaagctgttagaagcactccaagaggaaaaacgggaattgaaggccgctcttcagtctcaggaaaatctgattcacgaggcccgcattcagaaagagaaactgcaagaaaaggtcaaggctaccaatactcagcatgcagtggaggccatccggccacgtgaagaatcactggcggagaaaaagtatacctcacagggccagggtgatctcgatagcgtcctgtcacagttgaactttactcacacctcagaggacctcctacaagcagaggtgacttgtctggagggcagcctggaatcggttagtgcgacttgcaagcaacttagccaagagttgatggagaagtacgaggagctcaagcgcatggaagcgcataacaacgaatataaggccgagataaaaaaattaaaagaacagattttgcaaggagaacaatcttattcttccgccctcgaaggaatgaagatggagatcagccacctgactcaagagttacaccaaagagacattacaatcgcgtctactaaggggtctagtagtgatatggaaaaaagactgagagccgagatgcagaaagctgaagacaaagctgtggagcataaagaaattctagaccagcttgaatctctgaagctggaaaatcgacatctgagcgagatggtaatgaagttggagctgggcctgcacgaggccaaagagataagtttggcagatcttcaggagaactacattgaagcacttaataagctcgtttcagaaaatcagcagttgcagaaagacctcatgaacaccaaaagtcagttagagataagcacccagatgtgtaagaaacagaacgacaggatttttaagccaactcattctcggacaactgagttcaaaaacaccgagtttaaacccacacacggacagcacaggcacgatggcattaaaacggagcattacaagactgatttgcactccccaagagggcaagcctccgattctatcaacccaatgtcccgagtgctgtctccgttgtcacctcagatttccccctgcagctccacccgctcgcttacttcttactcactctgcaagacccattcacttcccagcgctcttgacaccaacgaggcgaatttctctgacacaatgagcgagtctatgaacgatcaggaggagtttataagctcgtgctctttgccggtgagcccactggggtcaatcgcgacccgctttctggaagaagaggaactccgctcacaccacatccttgaaagattggatgcccatatcgaagagctaaagcgagagtccgagaaaacagtaaggcaatttaccgcactgaagtag

SEQ ID NO: 26533 - DNA, 573 bp, Artificial Sequence
  Description of Artificial Sequence: Synthetic coding sequence
atggccggcaccgcccggcacgaccgggagatggccatccaggccaagaagaagttgaccacagctaccgatcccattgagagactcagacttcagtgcctcgcccgggggagtgccggcatcaagggacttggcagagtctttaggatcatggatgacgataataaccggacccttgatttcaaggagtttatgaaggggctgaacgattacgctgtcgtgatggaaaaagaagaggttgaggaactattccgaagatttgataaagacggaaatggaacaatcgactttaatgagttcctcctgaccctacgtccccctatgagccgcgcaagaaaggaagtgattatgcaagcttttagaaagctggacaaaaccggagacggagtgatcactattgaagatcttcgcgaagtgtacaacgccaagcaccaccctaagtatcaaaacggagaatggtctgaagagcaggtgttcaggaagttcctcgacaactttgatagtccatacgataaagacggactggtgacccccgaagagttcatgaactactatgcaggagtgagcgcctag

SEQ ID NO: 26534 - DNA, 231 bp, Artificial Sequence
  Description of Artificial Sequence: Synthetic coding sequence
atgacccccccccagcagcccccccccctgcggagcgagcccggcactttgggctcggccgcttcctcatattccccactgggccttaatggagtacctggtagtatttgggatttcgtgagtggctcattttctccgtcaccctctccaatcctgagcgccgggcccccgtcctcaagtagcgcttctccaaatggggcagaactcgctcgagtgaggcgccagctttag

SEQ ID NO: 26535 - DNA, 108 bp, Artificial Sequence
  Description of Artificial Sequence: Synthetic coding sequence
atggccaccctggtggtgaacaagctgggcgccggcgtggacagcggtagacagggctcccgaggtacggcggtcgtgaaagtgctagagtgcggagtctgcgaatag

SEQ ID NO: 26536 - DNA, 477 bp, Artificial Sequence
  Description of Artificial Sequence: Synthetic coding sequence
atggaggccgacatcatcaccaacctgcggtgccggctgaaggaggccgaagaagagaggctgaaggcagctcagtacgggctacagctcgtggagtctcagaacgaactccagaaccagttggataaatgtcgcaacgagatgatgacaatgaccgagagttatgagcaggaaaaatacaccttgcagagagaagtagaacttaaatcacggatgttagaaagtctgtcctgcgaatgcgaagcaatcaaacagcaacagaaaatgcaccttgagaagttggaggaacagttgagccgctctcacgggcaggaggtcaacgagttgaagacaaaaatcgagaagctcaaagttgaactcgatgaggcaaggctgagtgaaaagcagctaaagcaccaggtggaccaccaaaaagagttactttcctgtaaatctgaggagctgcgggtcatgtcagaacgggtgcaagaaagttag

SEQ ID NO: 26537 - DNA, 393 bp, Artificial Sequence
  Description of Artificial Sequence: Synthetic coding sequence
atggcccagaccgacaagcccacctgcatcccccccgagctgcccaagatgctcaaagagtttgcgaaggccgccattagggcacagccacaagacctgatccagtggggagccgattactttgaggcactcagcagaggtgagacccctcctgtgcgggaaaggagcgagagagtcgcactctgtaactgggctgaacttactccagagttattgaaaatcttgcactcacaggtggctggtcggctcattatacgcgcagaggagctggcccagatgtggaaagtagtcaatcttccaacagatctctttaacagcgtcatgaacgttggccgcttcaccgaggagatcgaatggctcaagttcctggccctggcttgttccgcactttag

SEQ ID NO: 26538 - DNA, 693 bp, Artificial Sequence
  Description of Artificial Sequence: Synthetic coding sequence
atggaggccgacatcatcaccaacctgcggtgccggctgaaggaggctgaggaagagcggttgaaagcagcgcaatatggcttgcaactggttgagtcccaaaatgagctgcaaaaccagctggataagtgccgaaatgagatgatgactatgactgagtcatatgagcaagagaagtacactctgcagcgcgaagtggagttgaagagtagaatgttagagagcctctcgtgtgaatgtgaagctattaagcaacagcagaagatgcacctggagaagctcgaagagcagttgagtcgcagccacggccaagaggtgaacgagctgaaaacaaagatcgagaagttgaaggtggaactggacgaggcacgcctctcagagaaacagctgaaacaccaggtggatcatcagaaggaactcctcagttgcaaatccgaggaactccgtgtaatgtcagagcgggtacaggagagtatgtctagtgaaatgctggctcttcagatcgaactgacggagatggaaagcatgaagacaactctaaaagaagaggttaacgagttacagtatagacaggaacaactggaactcttgatcacaaacctgatgcggcaggtggatcggttaaaagaggagaaagaggagcgtgagaaggaggctgtgagttattacaacgcactggagaaagctaggtag

SEQ ID NO: 26539 - DNA, 639 bp, Artificial Sequence
  Description of Artificial Sequence: Synthetic coding sequence
atggcccagaccgacaagcccacctgcatcccccccgagctgcccaagatgttgaaggaattcgcgaaggctgcaataagggctcagccacaggacttgatccagtggggggccgactactttgaagccctgagcagaggtgaaacgccccccgtgcgggaaaggagtgaacgcgttgctctctgtaactgggcagagttgacccctgagctactcaaaatcctgcatagccaggttgcaggcaggctcattattcgtgccgaggagctggcccaaatgtggaaagtggttaatctgcccactgacctcttcaacagtgttatgaatgtcggtcggtttacggaggagattgaatggctgaagttcctggccctggcgtgctctgctctgggagtaactatcacgaagactctcaaaatcgtgtgtgaggtgctgtcgtgcgatcacaacggcggattaccccgcatccccttttccacattccagtttctctacacttacatagcggaggtcgacggagaaatttgcgcctcacacgtcagcagaatgcttaattatattgaacaggaggtcatcggaccagatggtcttatcacagtcaacgatttcactcagaacccacgggtctggctggaatag

SEQ ID NO: 26540 - DNA, 2844 bp, Artificial Sequence
  Description of Artificial Sequence: Synthetic coding sequence
atgaacttcctgcggggcgtgatgggcggccagagcgccggcccccagcatactgaggccgagactgttcgcggcgctgctgaccccaaagttacatccagctgcggcctaaaatttcggcactcattccgtctggtgaaacacatactgtatcacgtgaccatcaacgtatattccgatagtgaaatcattggctatgcactggacaccctgtacaatatcattagtaatgaagaggaggaggaagtggaggagaatagtacgcggcagtcagaagatctcggctctcagttcaccgagattttcataaagcagcaagaaaatgtaactcttctgctctccctccttgaagaatttgacttccacgtgcggtggcctggggtcaaactgctcacttccctactcaagcagctgggccctcaagtccagcagatcatcctggtgtctccaatgggagtgtcccggttgatggaccttctcgcggacagtagagaggtcataaggaatgacggagtgctcctgttgcaggccctgaccagatcaaacggtgctattcagaagattgtcgcgtttgaaaatgcttttgagcgcttgcttgatatcatcagcgaggaaggcaacagcgacggaggtatcgtagttgaagactgtcttattttgcttcagaacctgctgaaaaataataactccaaccagaatttcttcaaagaaggaagctatattcaacgcatgaagccttggtttgaggttggcgatgagaactctggctggtcagctcagaaggtgactaatctgcatctgatgctccaactggtcagggtgttggtctcacctacaaatccccctggcgcaacttcttcctgccaaaaggctatgtttcagtgcggccttctccagcagctgtgcactatattgatggccactggggtccctgcagatatcctcaccgaaacaattaataccgtgtccgaggttatccgcggctgccaagtgaaccaagattatttcgcaagcgttaacgcaccctctaacccaccgcggccagccattgtggtgttgttaatgtcaatggtgaatgaacgccagccgtttgtgctgagatgcgccgtgctctattgcttccagtgttttctttacaaaaatcagaaaggtcagggagagatcgtcagcaccctcctccctagtacgatcgacgccactgggaactctgtcagcgccggacagctgctctgcgggggccttttctccaccgactcactatccaactggtgcgctgccgttgcactggctcacgctctccaggaaaatgcaactcagaaggaacagctcctgcgggtgcaactggctactagcatagggaatcctcccgtcagtctactccagcaatgtactaacattttgtcccagggatctaaaatacagaccagggttgggctgcttatgctgttgtgcacttggctgagtaattgcccaatcgctgtgacccactttctgcacaactccgcaaatgtacctttcttgaccggccaaattgccgagaatctgggcgaagaggaacagctcgtccagggtctctgcgccttgttgttagggatctctatatatttcaatgataattctttggagtcttatatgaaagaaaaactcaaacagcttattgagaaaaggatcgggaaggagaatttcatcgagaagctggggtttatctcaaagcacgagctttattctagagccagccagaaacctcagcctaatttcccttcgcccgagtatatgatctttgaccatgaattcacaaagctggtgaaggaactagagggcgttatcaccaaagccatttataagtcgagcgaggaggacaaaaaagaggaagaagtaaaaaagacacttgagcagcatgataacatcgtgactcattataagaatatgatccgcgaacaggacctgcaactggaggaactgaggcaacaggtttcaactttgaagtgtcagaatgagcaattacagacagctgtaacccagcaggtatcacagattcagcagcataaggatcagtataacctgctgaagatccagcttggaaaagataaccagcaccagggttcttacagcgagggagctcagatgaacggaatccagcccgaagaaattggccgccttagggaagagatcgaggaacttaaacggaatcaggaactgcttcaaagtcagcttactgagaaggatagcatgatcgaaaacatgaagtcatctcaaacctcaggcaccaacgagcaatcgagcgccatcgtgtccgctagagattccgagcaggtggctgaacttaagcaggagttagctactcttaagtcgcaactaaactcccagagcgtggagattaccaaattgcaaacggagaagcaagagctcctccagaagactgaagcctttgctaaatccgtggaggtgcagggagagaccgaaaccattatcgctaccaagacgaccgatgtggaggggagacttagcgcacttttgcaggagacgaaggagctgaaaaacgagattaaggccctgagtgaagaacggactgccattaaggagcaattggacagctcaaactccaccattgcgatcctccagaccgagaaggacaaattggagctcgagatcaccgacagtaagaaggagcaggacgatctcctggttttgttagccgaccaggaccagaagatcctgtcactaaagaataagctgaaggatctggggcatccggttgaggaggaagatgaactagaatctggcgaccaggaagacgaggatgatgagagcgaggatcctgggaaggatcttgaccacatctag

SEQ ID NO: 26541 - DNA, 1095 bp, Artificial Sequence
  Description of Artificial Sequence: Synthetic coding sequence
atggtgaagctgttcatcggcaacctgccccgggaggccaccgagcaagagatccgatcactgtttgagcagtacggcaaggtgctggagtgcgatattattaagaactatggcttcgtgcacattgaggacaagacagccgccgaagatgcaataagaaatctgcatcattacaagctccatggcgtgaatatcaacgtagaagcctccaaaaataagtccaaaacgtcaacaaagctgcacgtgggcaatatcagcccgacttgcacgaacaaagaactgcgcgccaaattcgaggagtatgggccggtaatcgaatgtgatatcgtgaaagactatgctttcgtgcacatggagcgggccgaggacgccgtggaggccatccgggggctggataacacggagttccagggtaagaggatgcacgtgcaactctctaccagtcggctgcgaacagcccccggtatgggtgaccagtcagggtgttaccgctgtggaaaagagggacattggtcgaaagagtgcccgatcgataggtctggccgggtggcggacctcacagagcaatacaacgaacaatacggtgccgtgcgaacgccctatacgatgtcttacggggacagcctctattacaacaatgcctatggcgctttggatgcctattacaaaagatgtcgggcggcacgttcctatgaggctgtagccgccgccgcagcatccgtctacaattacgccgagcagactctgagtcaactccctcaagtccagaacacagctatggccagtcatctaactagtacctctctagacccatacgaccgacatctgctgcctacatcaggcgcggctgctacagctgccgcagccgccgcggcagccgcagccgtgaccgccgccagcacaagctattacgggcgggataggagccctctgagacgtgcaacagcgcctgtccctacagtcggcgaggggtatggctatggccacgaaagcgagcttagccaagcctccgccgctgcccgaaattctctttatgacatggcaaggtacgagcgggagcagtacgccgatcgggctagatacagcgctttctag

SEQ ID NO: 26542 - DNA, 1236 bp, Artificial Sequence
  Description of Artificial Sequence: Synthetic coding sequence
atgatcgtgaacgactacgagggcaacgacagcgaggccgaggacctgaattttcgggaaacgctccccagttctagccaagagaacacaccacgaagtaaggtcttcgagaacaaggtgaatagcgaaaaggtcaaactctccctgagaaacttcccacataacgactatgaggatgtgttcgaagagccgtccgagtcaggaagcgatccttctatgtggaccgcacgaggcccatttcggcgcgaccgctggagcagcgaggacgaggaggccgctggcccgtcacaagctctgagcccactgctgagcgacacaaggaaaatcgtctccgaaggcgaactggatcagctggcacagattaggccccttatttttaacttccacgaacaaactgccatcaaggattgcctgaagatccttgaagaaaagacagcggcgtatgatattatgcaggaatttatggccctcgaacttaagaatctgcctggcgaattcaacagtgggaaccagccttcaaatcgtgagaagaacagatatcgcgatattttgccctacgactccaccagggtccccctagggaaatccaaggactacatcaacgccagctacatccgcatcgtcaattgtggagaggaatatttctacatcgcaacccagggtcccctgcttagcaccatcgatgacttttggcagatggttcttgagaataattcaaatgtgatcgcgatgatcacaagagagatcgaaggcggtatcatcaaatgttaccactactggcccattagcctcaaaaaacccctggagctcaagcactttcgtgtgtttttggagaactatcaaatcctacagtattttattatccgaatgtttcaggttgtggaaaagagcacaggcacgagccatagcgtgaaacaattgcaattcacaaaatggccagatcacgggacgccggcctctgccgactctttcattaagtacatccggtatgctaggaagtcacacctgactggtccaatggtggtgcattgttccgcgggtattgggagaacgggagtgttcctgtgtgtagatgtagtcttttgcgctattgtgaagaactgcagttttaatattatggatattgttgcacagatgcgtgagcagcggagcgggatggtacaaaccaaggaacaataccacttctgttatgatattgttttggaggtcctgaggaaattattgacattagactag

SEQ ID NO: 26543 - DNA, 810 bp, Artificial Sequence
  Description of Artificial Sequence: Synthetic coding sequence
atgatcgtgaacgactacgagggcaacgacagcgaggccgaggacttaaatttccgtgaaaccttaccttcaagctctcaggagaatacacccagatcaaaagtctttgagaacaaggtgaatagcgaaaaagtgaagctgagcctccgaaacttcccacacaacgactatgaagacgtgttcgaagagccgtcagaatccggaagcgatccctccatgtggaccgccagagggcctttcaggcgcgatcgatggtcatccgaagacgaagaagccgctggcccgtcacaagccctgtccccattactgtctgacaccaggaagatcgtgtcagaaggcgagctcgaccagttggcccagattcggcctctgatatttaatttccacgagcagacagctatcaaagattgcctgaaaattcttgaagaaaagactgcagcgtacgacattatgcaggaattcatgacaggtaccagtcactctgttaaacagttgcaattcacgaagtggccagatcacgggaccccagccagcgctgactctttcattaaatacatcaggtatgcccggaagtcacacttgaccggacccatggtagtccactgcagcgctggcatagggaggaccggggtgttcctgtgtgtggacgtggtcttttgtgctatcgtcaaaaactgtagtttcaatatcatggacattgtggcccagatgcgggagcaacgctcaggcatggttcagactaaagagcagtaccatttttgctacgacatagtgctggaagtactacgcaaactcttgacactggattag

SEQ ID NO: 26544 - DNA, 360 bp, Artificial Sequence
  Description of Artificial Sequence: Synthetic coding sequence
atggccagccagctgcaggtgttcagcccccccagcgtgagcagctccgcattttgttccgctaagaagcttaaaatcgagccatccggatgggacgtctcgggacaatcatcaaatgataaatattatacacactctaaaacccttcctgcaactcagggacaggctaatagctcccaccaggtggccaattttaacatcccagcttacgatcaagggcttttgctgccggcacccgctgttgagcatattgtggttacggccgctgattcctcaggatcagcggctacctccaccttccaaagcagccaaacgctcacacataggagcaatgtcagcctcctagagccctatcagtag

SEQ ID NO: 26545 - DNA, 339 bp, Artificial Sequence
  Description of Artificial Sequence: Synthetic coding sequence
atggccaccggcgacctgaagcggagcctgcggaacctggagcaggtactgagattactgaactatcctgaggaggttgactgtgtgggcctgatcaagggggatcctgcagccagcctccccatcatcagctactctttcacgtcttactccccttatgtaactgagctgatcatggaatctaatgtagagctcatcgcgaaaaacgatcttaggttcatcgacgctgtttacaagctgctgcgtgaccaattcaactataagcccatactgaccaagaagcagttcattcagtgtggcttcgccgagtggaagatccagattgtgtgcgatatttag

SEQ ID NO: 26546 - DNA, 54 bp, Artificial Sequence
  Description of Artificial Sequence: Synthetic coding sequence
atgaagcggggccggctgcccagcagcagcgaggacagcgacgacaatgggtag

SEQ ID NO: 26547 - DNA, 810 bp, Artificial Sequence
  Description of Artificial Sequence: Synthetic coding sequence
atgaaccaggaggacctggaccccgacagcaccaccgacgtgggcgatgtgactaacacagaagaggagctgatcagggagtgtgaagagatgtggaaggacatggaggaatgccagaacaaactgtccctgatcggcaccgagacccttacagacagtaacgctcaactgagtttactgattatgcaagttaaatgtctgacagcagagctgtcacagtggcagaagaagaccccagagacaatacctctcacagaggacgtgttaatcaccctggggaaagaggaatttcagaagctccggcaggacttggaaatggttttgtctactaaggaaagcaaaaatgaaaagctaaaagaggatctcgagcgggagcagcggtggctggacgaacaacagcagatcatggaatcactcaacgtgttgcactcggagctaaagaacaaggttgaaacttttagtgagtcccgaattttcaacgagctcaaaactaagatgttaaacattaaagaatataaagagaaactcctgtcaaccctgggcgagtttctggaggatcatttccccctcccagacagatccgtaaaaaagaagaaaaagaacatccaggagagcagcgtgaatctgataacgctacatgaaatgctggagattctcatcaacagactgttcgacgtgcctcatgacccctacgtgaagatcagcgacagcttctggccgccatatgtcgagctgttgttgcgtaacgggatagctcttcggcaccccgaggaccctacgcggatacgcctggaggcctttcatcagtag

SEQ ID NO: 26548 - DNA, 339 bp, Artificial Sequence
  Description of Artificial Sequence: Synthetic coding sequence
atgaacggccgggccgacttccgggagcccaacgccgaggtgcccaggcctattccacatattggaccagattacatccctaccgaggaagaaaggagggtatttgctgaatgcaatgacgaatccttctggtttcgttcagttccactggctgccacaagcatgctcatcacgcaaggtttgatatccaaagggatcctcagcagtcaccctaaatatggctctatccctaagttgatcctcgcatgcatcatgggttacttcgcagggaagctgtcatatgttaagacatgtcaggagaaattcaagaagttagaaaactctccactaggggaatag

SEQ ID NO: 26549 - DNA, 687 bp, Artificial Sequence
  Description of Artificial Sequence: Synthetic coding sequence
atggaggagcagccccagatgcaggacgccgacgagcccgccgactccgggggggaaggcagagcaggaggcccaccccaggtggccggagctcaggcggcttgttcagaggatcgcatgacactcctgttgcggctgcgggcccagactaagcaacagttactcgagtacaagtcaatggtggatgccagtgaagaaaaaacgccagagcaaatcatgcaggagaagcagatcgaagcaaagattgaggacctggaaaacgagatcgaagaggtcaaagtagccttcgaaatcaaaaagttagcactagactccgtgctgatggacaatatgaaacacttgctggagctgaataagctgataatgaagagccagcaggagtcctgggacctggaagaaaagctgctcgatattcggaagaaacggctgcaacttaagcaggcctcagagtctaagctgcttgaaatccagacagaaaagaataagcagaaaatcgatctggacagcatggaaaatagcgaacggatcaaaattattcgacaaaacttgcagatggaaattaagatcacaaccgtgattcaacatgtgtttcaaaacctgattcttggaagtaaagtgaactgggcagaagatcctgctctcaaggagatagttctccagctggaaaagaatgttgacatgatgtag

SEQ ID NO: 26550 - DNA, 2352 bp, Artificial Sequence
  Description of Artificial Sequence: Synthetic coding sequence
atggccaagtacaacaccggcggcaaccccaccgaggacgtgagcgtgaacagtcgaccgtttcgcgtcacaggacctaacagcagctctggtattcaggcaagaaagaatttgtttaataatcagggaaacgccagtccacccgctgggccctcaaacgttccaaaatttggatctccaaaacctccagtggccgtaaaaccatcatcagaagagaaaccagacaaggagcccaagccacctttcctgaagccaacaggcgctggccagcggtttggaactcctgccagtcttaccacccgtgacccagaagcgaaagtggggttccttaagccggtcggacctaagccaatcaacttacctaaggaggacagtaagcccacttttccgtggcctcctgggaataagccctccttacacagcgtaaaccaagatcacgatctgaagccactgggacccaaatctgggcccaccccccctacctcggaaaacgagcagaagcaggcctttccaaaattaacaggcgtgaagggcaagttcatgtctgcgagtcaggacctggagccaaaaccacttttccctaaacccgcctttgggcaaaaacctcctttgtcaactgagaactcacatgaggacgagagtccgatgaagaatgtttcctcaagtaaaggtagcccagctcccctcggcgtccgatcgaagtcgggccccctgaagcctgccagagaggattccgaaaacaaggatcatgcaggagagattagttcactaccctttccaggggtcgtgctgaagccagccgcaagccggggcggacccgggctctccaaaaatggtgaagaaaagaaagaggaccggaaaatcgacgctgcgaaaaacacctttcagagtaagattaaccaggaggaactcgcttccggcacccctccagcgagattccccaaggctcctagcaaactgactgttggcggaccatggggacagtcccaagagaaagaaaagggcgataagaatagcgccacacctaaacagaaacccctgcctccgcttttcacattaggtcccccccctccaaaacccaaccgccctcccaacgtggatttgacaaagttccataagactagcagtggcaacagcacttctaaagggcaaaccagctattcaaccaccagtctgcctcccccacctcccagccaccccgcttcgcagcctccgctgcctgcctctcacccttctcagcccccggtgccatctctcccccctcggaatattaaaccgccgttcgacctgaaatcaccggttaatgaggataaccaggacggcgtgactcactctgacggagctggtaatctggacgaagagcaagacagtgaaggagagacctatgaagatattgaggcgtcaaaggagcgagagaagaaaagggagaaagaggaaaagaaacgccttgaacttgagaagaaggagcaaaaagagaaagagaagaaagaacaggagatcaaaaagaaattcaaactgactggtcctattcaggtgatccaccttgcaaaggcttgttgcgacgtcaaaggaggaaaaaacgagttgagttttaagcagggcgaacagatcgaaattatcaggatcacagataatccggagggcaaatggctcggcagaaccgcgagagggtcttacggctatattaagacgacagcggtcgagattgattatgattccctcaagctgaaaaaagactccctcggcgctccgtctcgtcctattgaggatgaccaggaggtctatgacgatgtcgccgagcaggacgatattagcagccattctcagagtggatccggcggcatcttccctcctccaccagacgatgacatttacgatggtattgaagaggaagatgccgacgatggcttccctgctccgcccaaacaactagatatgggagacgaggtgtacgacgacgtcgacacctctgactttccggttagttcagccgagatgtcccagggcaccaacgtgggcaaagcgaaaactgaggagaaggatctgaaaaaactcaagaagcaggagaaggaggaaaaggatttccggaagaagttcaagtacgacggggaaatcagggtcctgtactcgaccaaggttaccacctctatcacgtcgaaaaagtggggcacccgcgacctgcaggtgaagcccggggaatccctggaggtgatccaaaccaccgacgatacgaaggtgctctgtaggaatgaagaaggcaaatacggctacgtcctcaggagctacctcgccgataacgatggagagatctacgatgatatcgctgatggctgtatttacgacaacgattag

SEQ ID NO: 26551 - DNA, 393 bp, Artificial Sequence
  Description of Artificial Sequence: Synthetic coding sequence
atgatgctgggcaccgagggcggcgagggcttcgtggtgaaggtgagagggctcccttggtcttgcagtgccgatgaggtgcagcgatttttttcagactgtaaaatccaaaatggcgcccagggcatacgctttatctacaccagggagggaaggccgtcgggcgaggcattcgtggagctcgaaagcgaagatgaggtgaagttggcgctgaaaaaagaccgcgagactatgggccataggtacgtggaagtgtttaaatctaacaatgtcgaaatggactgggtcttgaaacacaccggcccaaattcacccgatacggcgaatgatgggttcgtccggctgagggggcttcctttcgggtgttctaaggaagagattgttcagttttag

SEQ ID NO: 26552 - DNA, 267 bp, Artificial Sequence
  Description of Artificial Sequence: Synthetic coding sequence
atggaggccgacatcatcaccaacctgcggtgccggctgaaggaggcagaggaggagcgactgaaagccgcccagtacgggttacagctcgtcgaatctcagaacgagctgcagaaccagctagataagtgtaggaacgagatgatgactatgacggaatcatatgaacaggagaagtataccttgcagcgcgaagtagagctgaaatcccgaatgctggagagcttgagttgtgaatgtgaggcaattaagcaacaacagaaatag

SEQ ID NO: 26553 - DNA, 1902 bp, Artificial Sequence
  Description of Artificial Sequence: Synthetic coding sequence
atgaaggccatcaagaagagcctgaccgaggaggagtacctgtaccttgatttttcacaccagaccgaggggtgtatattccccttgcacaccagcgtaactttatttctactatcttactgcgattgtaagatattcaaaatctgcctagtggtaacgaaggaagttagtagagactcttccttactgagggatgatcttatccaggacgttgaaatccagatcatttctaggcaggagcttccacctatcgttcagaattgctgtctccccgcagtcgtggaaaggagcgacaatttctgtcgggccggcctggccgtggtgttaaggcacattattcagaaatcttatgaagcagacccactgaagaaggaattgctggaactgctgggattcaaaaagacctgccttaaggcctgcgcggaagtcagtcagtggacccgcttgtgtgaactgacaatcccccttgccatagagaacttccttcgcgaatcttccgaccagccccctacaattccggtcgagatcctgcagctggagaaaaagttgtctgagccagtgcgagtgcacaatgacgacaagttgcggcgacagaagctcaaacaacagaaggccgatggcgttggcccccccctgacaaaaggcaaggcaaaaagcaaggttcatacgcaggagacatccgagggcctggatagcagttcgaaatcactggagctcaaggtggcctttagcaaacttaccgtccaggaagaacccgccacaaccaatagagaacctagtcatatccggaaggctaaagcttccgatctgccgcctctcgaacacgtgttcgcagagggtctgtattttacgctggctgatatcgtcttgctcccctgtattcatcactttcttgttataatctcacgaaaattctccgaaaaacttgtcgaattcccactcctcgccagctggtatcaacgtattcaggaggttcctggcgttaagacagccgcctccaaatgcggaatacagttcttacacctaccaaagttgttgaccacgtccactgagcagcaccccaatctctgcgaggtgccaggagtggaggagcagtctgaccctctcttcatcggcggtccccgaccaaccatggcaaagctgatggaaaaaggaatcgaagtgatgttttctccacatccctgtccaacttggacgctggactggaacgttttaccagctgcggtgagcccaaaggaagggaaaatgagctcagacagggctctcagaaagcaacagcagctcaataatctggtgtacgtggtgaccaatcaggcaaagcctggtgatcggattgtcgatttttgttctggggggggccacgtgggtatcgtgctagctcacatgctgccatcttgccaggtgactctgattgagaacaaggaactgtcactgattagagccaagaagcgatccgatgagttgggtctgagtaatatatggttcatccaggctaacatggaatactttactgggatgttcaacattggcgtagctctccacgcatgcggagtggccactgacatggtgattgagcattgtatcaagacaagggcctcattcgtcacctgcccctgttgctacggatttatccagaacacatctaagttcaacttcccaaagtctgaacagttcaagaaaaccttatcctacaaggaacacatgatattatgccgctttgctgaccagactgcggtacagctaccgcctcaaagaagacttatcggcaaacaatgtatgtgcctggtcgatttggaccgggcccgagctgctgaggagtgcggttacagcgttcaggtaatttccatggaacctgagtcatgttctccaaagaacaatatgatcgtgggcgttccgatttag

SEQ ID NO: 26554 - DNA, 597 bp, Artificial Sequence
  Description of Artificial Sequence: Synthetic coding sequence
atggccaccggcgacctgaagcggagcctgcggaacctggagcaggtccttagactgctcaactatccggaggaagttgactgcgtgggactgatcaagggggatcctgctgcgtcactacccattatctcctactcatttacctcatactccccatacgtgaccgagctgattatggagtctaacgtagagttgatcgccaaaaatgatctgaggttcatcgacgctgtatataaacttttgagggatcagtttaattataagccaattctgactaaaaagcagtttatccagtgtggctttgcagagtggaagattcaaatcgtctgtgacatcctgaattgcgtgatgaagaaacacaaagagttgtcctctctgcagaaaatccccagccagcagcggaaaaagatcagtagcgggaagtccgagccaccactcggcaatgagaagatcagcgctgaggctgtaggcgtggacatatccggtcggttcatgacaagcggaaagaaaaaggccgtggtgatccgccatctttacaatgaagacaacgtggatatctccgaagacactctctctccaatcacggatgtaaattag

SEQ ID NO: 26555 - DNA, 336 bp, Artificial Sequence
  Description of Artificial Sequence: Synthetic coding sequence
atggtgatggagaagcccagccccctgctggtgggccgggagttcgtgaggcagtactatactttacttaacaaggccccagagtatctgcatagattttacggcaggaattcttcttacgtacatggcggtgttgatgctagcggcaagcctcaggaagctgtgtatggacaaaatgatatccatcacaaagtacttagcctgaatttttctgagtgccacacgaagattcgccacgtcgacgcacacgcaactttatcagatggagtcgttgtgcaggtaatgggattgctgagcaacagtggccagccagagagaaagtttatgcagacgtag

SEQ ID NO: 26556 - DNA, 681 bp, Artificial Sequence
  Description of Artificial Sequence: Synthetic coding sequence
atgagcagcccccgggacttccgggccgagcccgtgaacgactacgaaggaaacgattccgaggcagaagacctgaattttagagagacacttccgagttcctcccaggagaacactccccggtcaaaagttttcgagaacaaggttaactctgaaaaagtgaagttaagcctgcgaaactttccacacaatgactacgaggatgtcttcgaggagcccagcgagagcggctccgaccccagcatgtggacagctcgagggcctttcagaagagatcggtggagctcagaggacgaagaagccgccggacccagtcaggccctgagcccactgctgagtgacacaaggaaaatcgttagcgaaggggaactagatcaactcgcacaaattcggccactcatttttaattttcacgagcagactgccatcaaagactgcctcaagattctcgaggagaagaccgctgcttacgatatcatgcaggaattcatggctctggaactcaaaaatctcccaggcgagttcaactctgggaatcaaccatccaatcgcgagaagaacagatatcgcgatattctgccttttcagcaccatggctattccggtccaaacgagagaaccaccttttggcacggatccaatgaaggcgcagtttctttgttgctccggtattgtgcctag

SEQ ID NO: 26557 - DNA, 1872 bp, Artificial Sequence
  Description of Artificial Sequence: Synthetic coding sequence
atgagcgacgaggtgttcagcaccaccctggcctacaccaagagccctaaggtgacaaaacggaccacatttcaggacgagctgatccgcgctataacggctcgcagcgcaaggcagcgtagctccgagtattctgatgattttgatagtgacgaaatcgtgtccctgggggacttttccgatacgtcagccgacgaaaatagcgtaaataaaaagatgaacgacttccacataagtgatgatgaggaaaagaatccaagtaaactactgtttctcaaaacaaataaatctaatggcaacatcacaaaggatgagccggtgtgcgccatcaaaaatgaggaggagatggcccccgatggctgcgaagacatcgtggtgaagtccttttccgagtctcagaataaggatgaggaattcgagaaggacaaaatcaaaatgaagccaaaacctaggattttgtcgattaaaagtaccagctcagcggagaataatagcctggacaccgacgaccacttcaaaccatctccacgacctcggtctatgctgaagaagaagagtcacatggaggagaaggacggattagaggacaaggagacggccctgagcgaggagctcgaactgcactcagcgccatcatcactcccaacacctaacggtatccagcttgaagcggagaaaaaagccttcagtgaaaatctggaccctgaggatagctgtcttacaagcctcgcaagcagtagtcttaagcagatactaggagattccttttcccccgggtccgagggaaatgcatccggaaaggcggatcatgtgactacagcggtggagaagtctaaagaatcccaggtaacagcagacgaccttgaggaagagaaagcaaaggctgaactgatcatggacgacgaccgcaccgtggatcctctgctgagcaaatcccagtcaatccttatctccacgtctgcaacggccagtagcaagaaaaccattgaggatagaaacatcaaaaataagaagtctactaataatagggcaagcagcgcctccgcacggctcatgacgtccgagttcttaaagaagtcgagtagcaagaggcgaacacccagcactactacttccagccattacctgggaaccctgaaggtgctagatcaaaagccttcacagaaacagagcatagagccagatcgagcagataatataagggcagcagtgtaccaggaatggctggaaaagaaaaacgtatacttacacgagatgcatcggatcaagcgcatagagtcagagaacctgcgcattcagaatgagcagaagaaagccgcaaagagggaggaagccctggcatctttcgaggcgtggaaagccatgaaagagaaagaagccaaaaaaatcgccgcaaaaaagaggttggaggaaaaaaacaaaaagaagaccgaggaagagaatgctgcccgcaagggggaggcacttcaagctttcgagaagtggaaggaaaagaaaatggagtacctaaaagagaagaatcggaaagaacgtgaatatgagagagctaaaaaacaaaaagaagaggagacggtagctgagaagaaaaaggacaatcttaccgccgtggagaaatggaatgaaaagaaggaggcattttttaagcagaaagaaaaagagaaaatcaacgagaaaagaaaggaggagctgaagagagccgagaagaaagacaaggacaaacaggccatcaatgagtacgagaagtggttggaaaacaaggaaaagcaggaacgcatcgaacgcaagcagaaaaagcgacactcatttctggagtccgaagctctaccaccttggtcaccgccttcacgcactgtgtttgccaaggtgttctag

SEQ ID NO: 26558 - DNA, 255 bp, Artificial Sequence
  Description of Artificial Sequence: Synthetic coding sequence
atgatgctgggcaccgagggcggcgagggcttcgtggtgaaggtgaggggcctgccttggtcctgttccgctgatgaggtgcagcggttctttagtgattgtaaaattcagaatggagcacagggcattcgatttatatacacacgcgaaggcaggccatccggggaagctttcgtggagctcgagtcagaagatgaagttaaactggcattgaagaaagaccgggagactatggggcaccggtacgtggaatag

SEQ ID NO: 26559 - DNA, 993 bp, Artificial Sequence
  Description of Artificial Sequence: Synthetic coding sequence
atggaccagggcgacacccccaccctggaggaggacctgaagaagttacagttaagcgagttcttcgatatttttgagaaagagaaggtggacaaggaagcattagcactctgtaccgaccgagacctgcaggaaattggaatacctctgggccctcggaagaagattttaaactattttagcacgagaaaaaattccatgggcatcaaacggcccgccccccaacccgcatcaggcgctaatatcccaaaagagagtgaattttgctctagttccaacactagaaatggcgactatttggatgtgggcatcggccaggtgagcgtcaagtatccgaggctcatctacaagcctgaaatcttttttgcgtttggaagcccgattggaatgttcctgactgtgcggggactgaagagaattgatcccaattatagattcccaacctgtaagggcttttttaatatctaccacccctttgatccagtggcctatcgtatagagcccatggttgtcccaggagtcgaattcgagccaatgctcattccccaccataaagggcgaaagcggatgcacctggagctcagggagggcttgacgagaatgtctatggatcttaaaaacaatctcctcggtagcctccggatggcctggaaaagctttacacgggccccctacccagcactgcaagcatccgaaacaccagaagagactgaggccgaacccgagtctaccagcgagaagccgtctgatgtaaatacagaagagacaagcgtggctgtgaaagaggaggttcttcccatcaacgttggtatgcttaacggcggacaacgaatcgattacgtacttcaggagaagccgatagaaagctttaacgaatatctattcgcgctccagagccacctctgttactgggagtcggaagacactgtacttctggttctaaaggagatctaccagacacaaggtatctttcttgaccagccccttcagtag

SEQ ID NO: 26560 - DNA, 1383 bp, Artificial Sequence
  Description of Artificial Sequence: Synthetic coding sequence
atggacagcgagctgatgcacagcatcgtgggcagctaccacaagccaccagagcgggtgtttgtacctagcttcactcagaacgaaccttctcagaattgtcacccagccaatttggaggtgacctccccaaagatcctgcatagccccaattcacaggctttgatcctggctttgaaaaccttgcaggagaagattcacagactcgaactagaaaggacacaggctgaggataatctgaacattctctccagagaagctgcccagtataaaaaagctctggaaaatgagacgaacgaaagaaatttagcgcatcaggaactgatcaagcagaaaaaggacattagcatacagctgtcgagtgcacaatccagatgcacactcctggaaaaacagctggagtatacaaaacgtatggtgctcaatgttgagagggagaagaatatgatactggaacagcaggcccagctgcagcgggaaaaagaacaggatcagatgaaactgtacgccaagttagaaaaactggacgtcctagaaaaggaatgctttcgcctgactaccacccaaaaaacggcagaggataaaataaaacatctcgaggaaaaactgaaggaagaggaacaccaaagaaaattgttccaggacaaagcctctgagctgcaaaccggcttggaaatttctaaaattataatgtcttctgtaagtaatttgaaacactctaaagagaaaaaaaagtcttctaagaaaacaaaatgcatcaaacgccggcctccgtggcagatttgttcgaagttcggggcgctcccctttgtggccgaaaaaatgaggcaacatcgcgatccacacatcctacagaagcccttcaatgtgacagaaacaagatgcctccccaagccaagccgtaccacttcctggtgtaaagctatccctcccgactccgagaagagcatctccatttgcgacaatctgtcagagctgctgatggccatgcaagatgagctggatcagatgtcgatggaacatcaggagctcctaaagcagatgaaagagaccgagagtcatagcgtttgtgacgatatcgaatgtgagctggagtgtctgctgaaaaagatggagataaaaggggagcaaataagtaaattgaaaaaacaccaggattccgtgtgtaagctgcagcagaaggtccagaattcaaagatgtctgaagccagtggcatccagcaagaggatagctatccgaaaggcagtaaaaacatcaaaaactccccacgcaagtgtctgactgacacaaatctctttcagaagaacagcagctttcacccgatacgagtgcataacctccagatgaaactgagacgagatgacatcatgtgggagcagtag

SEQ ID NO: 26561 - DNA, 1068 bp, Artificial Sequence
  Description of Artificial Sequence: Synthetic coding sequence
atgaccggcagcgccgccgacacccaccggtgcccccaccccaagggcgccaagggcacaagatccaggagttctcacgcccgtccagtgagcctggctacaagcggcggttccgaagaagaggacaaggacggcggagttctgttccatgtcaacaaaagcggttttcccatcgattctcacacgtgggagcgcatgtggatgcacgtggcaaaggtacaccctaaaggcggagaaatggttggcgccatccggaacgcagcattcctcgccaaaccatcgataccccaagtacccaattacaggttatcaatgactataccggactggctccaggccattcagaactatatgaaaactctgcagtataatcatacaggcacgcagttttttgagatccgcaagatgaggcctctgtcagggctgatggagacagcaaaggagatgacccgagagtccttacccattaaatgtttagaggcagtaatactgggtatctacctgacaaatggtcagcccagcatcgaacggttccctatatcttttaagacctacttctctggcaactactttcaccatgtcgttcttggaatatactgcaacggcaggtacggtagcctcgggatgagtaggcgggctgaactcatggataaaccgttgacatttcgcaccctctctgatcttattttcgacttcgaagattcctataaaaaatatttacacaccgtgaagaaggtgaagataggactgtatgttccacatgagcctcatagcttccaacctatcgagtggaaacaattggtacttaatgtcagcaaaatgttgcgtgctgacatcaggaaggagcttgaaaagtatgccagagacatgaggatgaagatcctgaaacccgcatcagcccactcacctacacaggtgcggagccgtgggaaaagcctatcacctagacgacgccaggccagccccccacgacgcctcgggagacgtgagaagtctccggccttaccagagaagaaagtggcagacttatcaacactaaacgaggtcgggtatcagatcagaatctag

SEQ ID NO: 26562 - DNA, 384 bp, Artificial Sequence
  Description of Artificial Sequence: Synthetic coding sequence
atggccagcaaccacaagagcagcgccgcccggcccgtgagccggggtggggtggggctgactggacgccccccaagtggcataagacccctctcaggtaacatcagagtggccaccgctatgcctcccgggaccgcccgcccagggagccgggggtgcccaattggcactgggggggtcttgtcttcccagatcaaagttgcccatcggcccgtgacacaacagggcctgacaggcatgaaaactggaactaagggaccccagcggcagatcctggataagtcctattacctggggctgctccggagtaagatcagtgagcttactactgaggtgaacaagttgcaaaaaggcattgagatgtacaatcaggagaactcatag

SEQ ID NO: 26563 - DNA, 510 bp, Artificial Sequence
  Description of Artificial Sequence: Synthetic coding sequence
atgcacaagctgcagagcggcatcggccggctgatcctgaaggaggagatgaaggctcgcagctcaagctatgcagacccttggaccccaccacgttcctccacctcttcaagggaggctttgcacacggccggatatgagatgtccctgaatggtagtcctaggtcacattacttagctgattccgatccacttataagtaaatccgcttccctgcctgcataccgaaggaacgggctccaccggactccctctgctgatctgttccattacgattccatgaacgccgtgaactggggcatgcgggaatataagatctatccgtacgagcttctcctggttactacaaggggcaggaacaggttgcctaaggacgtggacaggacacgtttggagcggcatttgtcacaggaagaattctatcaggtattcggaatgaccattagcgagttcgatcgcttagccctatggaagcgcaacgaactcaagaaacaggccaggctgttttag

SEQ ID NO: 26564 - DNA, 144 bp, Artificial Sequence
  Description of Artificial Sequence: Synthetic coding sequence
atggccagcgtgctgagccggcggctgggcaagcggagcctgctgggtgcgcgagtgcttgggccttccgcctccgaagggccaagcgccgctcctcccagcgagccactgctggagggggctgccccccagccgtttacttag

SEQ ID NO: 26565 - DNA, 558 bp, Artificial Sequence
  Description of Artificial Sequence: Synthetic coding sequence
atggacgacagcatcaacaaccggttcagctacgtgacccacgaggacatctgtaactgttttaatggcgacaccttgctggccatccaagcccccagcgggacccagcttgaagtgcctatacccgagatggggcaaaacggtcagaagaaatatcaaataaacctgaaatcacatagcggccctatccatgtcctgctgattaacaaggagagctccagttcaaaaccagtcgtatttccagtccctcctcccgatgatctgacccagccaagttctcagagtctcacccctgtgacacctcagaagagctctatggcaactcagaaccttcctgagcaacacgtttcggagaggagccaggcattgcagcagacctcggctacagacatctcttctgcgggtagcatttcgggagacatcatcgacgaattgatgagctcagacgtctttcctctgctgcgcttatcccctacccctgccgatgactataactttaatctagacgacaacgaaggtgtgtgtgacctattcgatgtgcagatcttgaactactag

SEQ ID NO: 26566 - DNA, 492 bp, Artificial Sequence
  Description of Artificial Sequence: Synthetic coding sequence
atgcccagcatcaagctgcagagcagcgacggcgagatcttcgaggttgatgtggaaattgctaaacaaagtgttacaatcaagaccatgctcgaggatcttggcatggatgacgaaggggacgacgacccagtccccttgcccaatgtgaatgccgctattttgaagaaggtgatccagtggtgcacacaccacaaggatgacccacctccacccgaggacgatgaaaataaggagaagcggactgacgacatcccagtgtgggaccaagaatttctaaaagtggatcaggggacactctttgaactgattctggcagcgaattacctggatataaagggcctcctcgacgtgacatgcaagactgttgcaaatatgatcaagggaaagacccccgaggaaatacgaaagacttttaatattaaaaacgacttcacagaagaagaagaggcacaggtcaggaaggaaaaccagtggtgcgaggaaaagtag

SEQ ID NO: 26567 - DNA, 915 bp, Artificial Sequence
  Description of Artificial Sequence: Synthetic coding sequence
atgagcaagcggcggcggctgaagcagggcgagcccatcatgaccggcaaaacacagacgagcaatgtaactaataaaaatgatccaaagagcatcaacagtagagtgtttattgggaacctgaatacagccatagtgaagaaagtagacatagaggcgatctttagcaaatacggcaagattgtgggctgctccgttcacaaaggatacgcctttgtgcaatatatgtctgagagacacgcgcgggctgctgtagccggcgaaaacgcgcgcgtcatcgcaggccaaccactggatatcaacatggccggtgagccaaagccctacaggcctaagccaggtaataagcggcccttgtctgctctgtacaggcttgaaagtaaagagcctttcttgtcggttggaggatatgtgttcgattatgactactatagagacgatttctacaatagactgttcgattaccacggcagagtgcctcctcccccacgcgccgtgatcccactaaagaggccccgggtggcggtcacgacaacaagacgcgggaagggagtgttttcaatgaaaggagggtccagaagcacagctagtggcagcactggctctaagctaaagtcagatgagttacagaccattaagaaggagctgacccaaattaagaccaaaattgactcactcctgggtcggttagagaagattgagaaacagcagaaggcggaggccgaggcccaaaagaaacaactggaagaatctctggttctgatccaggaagagtgcgtatcagaaatcgcagaccattctaccgaggaacctgccgagggagggccagacgccgatggggaggaaatgacagacggcatcgaagaggattttgatgaagacggcggacacgaactcttcttgcagataaagtag

SEQ ID NO: 26568 - DNA, 405 bp, Artificial Sequence
  Description of Artificial Sequence: Synthetic coding sequence
atgcccagcgccgaggccaagctgaagaagaaccggtgcgccaactgcttcgattgccccggatgcatgcacactctgagtactagggccacttcaatctccactcagttgccagacgatcctgcgaagacaacaatgaagaaggcatactacctggcctgtggtttctgtaggtggacatcaagagatgtcgggatggcggacaaatccgtggctagtggtggatggcaggaacctgagaaccctcatacccagcggatgaataagctgatagagtattaccagcaacttgcgcagaaggaaaaggttgagcgcgacagaaagaagctggcgagacggaggaattacatgcctcttgcttttagcgataagtatggtctgggaacaagactgcaacggccctag

SEQ ID NO: 26569 - DNA, 1230 bp, Artificial Sequence
  Description of Artificial Sequence: Synthetic coding sequence
atgtggcgggtgatcgagcccccctgccccggcgcccccagcaccgagaacggtaagagcgttcattggaaactcggggcagataaggaggtatgggtgtgggtgatgggtgagcaccacctggacaaaccgtatgacgtcctttgcaacgagatcattgccgaaagggcccgcctgaaagcagaacaggaggcggaggagcctaggaaaactcacagcgaagaattcaccaactctctgaagactaagagtcagtaccacgacctgcaggctcccgataatcagcagacgaaggacatctggaagaaggtcgcagaaaaagaagagctagaacagggatctagacctgcacctaccctggaagaagaaaaaataagatcgctttcaagctcctcacggaacattcagcagatgttggccgacagcataaatcggatgaaagcatacgctttccaccagaaaaaagaatccatgaaaaagaagcaggacgaagagatcaatcagattgaagaagagcgcactaagcagatttgcaagtcgtggaaggaggactctgagtggcaggccagtctgagaaagtccaaagctgctgacgagaaacgaaggagtctggccaagcaagcccgggaggactataagcggctctccctgggagcacagaaggggcggggcggagaacgactgcaatctcccctgcgcgtgccacagaagccagaaagacccccactgcccccaaaaccccaatttttgaactccggtgcctatccacagaagcctctgaggaaccaaggcgtggtgcgaaccttgtcttccagcgctcaagaggatattatccgctggtttaaagaagagcaactaccacttcgtgctggctaccagaagacttccgacactatcgctccctggtttcatgggatcctcacgctcaagaaagcaaatgaactgttactttccactgggatgccaggaagctttctgatccgcgtgagcgaacgcataaagggctatgcactgtcctacctgtccgaagacgggtgcaagcacttcctgatcgacgccagcgcagacgcctatagcttcctgggcgtcgaccagttacagcacgctactttggctgatcttgtcgagtaccataaggaggaacctatcaccagtctgggtaaagagttactgctctacccctgcggtcaacaggatcagctccctgactacctcgagctctttgagtag

SEQ ID NO: 26570 - DNA, 390 bp, Artificial Sequence
  Description of Artificial Sequence: Synthetic coding sequence
atgagcgacaagagcgacctgaaggccgagctggagcggaagaagcagcggttggcgcagatacgtgaggaaaagaagaggaaagaggaggaacggaagaaaaaagaggccgacatgcagcaaaaaaaagaacctgtgcaagatgactctgatcttgaccgcaaacggcgcgagacggaagcgctgttgcaaagcattggcatcagccccgagccacctctggtgccaacccccatgtcgccgtcgtcgaagtctgtgtcaacgccctcggaagccgggagtcaagacagcggcgatctcggtcctctgaccagaaccctgcagtgggacaccgatccttcagtgctgcagctgcaaagcgattcagagctcggctacatgtccgcctag

SEQ ID NO: 26571 - DNA, 780 bp, Artificial Sequence
  Description of Artificial Sequence: Synthetic coding sequence
atggtgggccgggagaaggagctgagcatccacttcgtgcccggctcttgtaggctcgtagaagaggaagtgaacattcctaataggagagtgctcgttacgggagctactggactcctgggccgagcggtacacaaagaatttcagcaaaacaattggcatgctgtggggtgcggtttccggcgcgcacggcctaagttcgaacaagtcaacctgcttgattccaacgccgttcatcatattatccacgactttcaaccacatgtcattgtgcactgcgcggccgagaggaggcccgatgtggtggaaaaccagcccgatgctgctagtcaattgaacgtggacgcctccggcaacctggccaaagaggccgccgcagtgggcgcctttctcatttacatttctagcgactatgtgttcgatggaactaatcccccataccgggaggaggacatccccgctcccttgaacctttatgggaagacaaaactggatggggagaaagctgttctggaaaataaccttggggccgctgtgttaagaattcctatactgtacggtgaagtggagaaactggaagaatccgcagtgacagttatgttcgacaaagtccagttttcaaacaagtcggcaaatatggaccattggcagcagagatttcccactcatgtaaaggacgttgctacagtgtgtcgacagttagccgagaagcgcatgctggtgcgcagaataccagaatcctgtctctctgaggggcctctgtgcctcttccacgcttag

SEQ ID NO: 26572 - DNA, 549 bp, Artificial Sequence
  Description of Artificial Sequence: Synthetic coding sequence
agctacgacagcaccttcagctacgtgacccacgaggacatctgcaactgctttaatggagatacccttctggccatccaggctcccagtgggacacagttggaggtgccgattccagagatgggtcagaacggtcagaagaaatatcaaattaacctgaaatcacactctggtcctattcatgtgctactcattaacaaagagtctagcagctcaaaacccgtcgtatttcctgtgccccctccagacgacctgactcagccaagttctcagagcctcacccctgtcacacctcagaagagctctatggctactcagaatttaccagagcaacacgtgtctgaaaggagccaggcactgcagcagacgtccgccacagacatatcctcagcaggcagtatttccggcgacatcatagatgagctgatgtcctcagacgtctttccgctattacgactgtctccgacacccgcagacgattataattttaatctcgacgataatgaaggcgtgtgcgacctgttcgacgttcaaattctcaattattag

SEQ ID NO: 26573 - DNA, 162 bp, Artificial Sequence
  Description of Artificial Sequence: Synthetic coding sequence
atggacagcgagctgatgcacagcatcgtgggcagctaccacaagccaccagaaagggtcttcgtgccctcctttactcagaacgagcctagccagaactgtcatcctgctaaccttgaagtgacttccccgaagatcctccactctccaaactcacagtag

SEQ ID NO: 26574 - DNA, 3018 bp, Artificial Sequence
  Description of Artificial Sequence: Synthetic coding sequence
atggccggcgccctgcggcggggccgggccctgggcagccggcccagcggccctactgtgagtagccgcaggagtcctcagtgccctgtggcccaggaaggcctgggagccaggtctcgaccccgcgtagccccccgctcccttgcacgatgtgggccctcatctaggcttatgggatggaaaccaagcgaggccaggggccagtctcagtccttccaggcttccggacttcaaccgcgatccttgaaggcagcgcgcagggctacaggccggcctgaccgatcccgagccgccaggcccactatggatccgtccgcccataggagccgggccgctccccctaatatggatccggatccacaggcaggtgtgcaagttggaatgagagtggtccgtggggtcgactggaagtgggggcaacaagacggcggcgaagggggggtcgggacagtcgtggagcttgggagacatggatcgccatctactccagataggaccgtggtggttcaatgggaccaggggaccagaaccaactacagagctggctaccagggggcgcacgaccttctcctctacgacaatgcccaaattggcgtgagacaccccaatattatctgcgactgctgcaagaaacacggcctgcggggtatgaggtggaagtgtagggtttgtcttgactatgatctgtgcacgcaatgctatatgcataataagcatgaacttgcccatgcctttgatagatatgaaacagcacactccagacctgtcaccctgtcacctcgtcagggtctgccccggatcccccttcgcgggatcttccagggagccaaagtagtgaggggtcccgattgggagtggggttcgcaggacgggaaacctgctgaacttcagaggcgcgtgtccgccgatagccagccctttcaacacggagacaaagtgaaatgtcttctggacaccgacgtgttgcgggagatgcaagagggccacggcgggtggaacccacggatggccgaattcatcggccaaacagggacggtgcacaggatcacggacagaggtgatgttcgtgttcagttcaatcatgaaactagatggaccttccacccaggcgcattaactaagcaccacagcttctgggtgggcgacgtagtgagagtgattggggaccttgacacagtgaagagactgcaggcaggccacggagagtggaccgacgacatggctcctgcactgggccgtgttggtaaggtggtaaaagtgttcggagatggcaaccttagagtcgccgtcgcaggccagcgttggaccttttcaccatcgtgcctggttgcatatcgtcctgaggaggacgccaacctggatgttgctgagagggccagagaaaataaaagctccctgtctgtcgcacttgacaaactgagagcccaaaagtccgacccggaacaccctggacgactggtagtcgaggttgccttagggaatgctgcccgcgctcttgatcttctcaggaggaggccggaacaggtggacacaaaaaaccagggccggaccgccctgcaggtcgcagcctacctaggacaggtggagctgattcgtctattactccaggcacgggccggggtggatctcccggacgacgagggaaacacggctcttcattatgccgcgttaggaaatcaacctgaggcgactagagtcctgctgtctgctggatgcagagccgatgccatcaactctacccagagtaccgccctccacgtggctgttcagaggggttttctcgaggttgtcagggcactgtgcgagcgcggttgtgacgtgaatctgcctgacgcccatagtgatactcctctgcacagcgccattagtgccgggaccggagcctctgggattgtggaagtgctcactgaagtccctaatatcgatgttactgccactaactcacagggattcactctgttacatcatgctagcttgaagggacatgctctagctgtgcgaaaaattctggcacgtgctcggcagctcgttgacgccaagaaggaggacgggttcactgctttgcaccttgctgctctgaacaaccaccgcgaagtagcacaaattctcattagagaggggaggtgtgacgtgaacgtgagaaatcgaaagcttcagtcacctctacatttagctgtacagcaggcgcatgtgggattggttcccctgctggtcgatgctgggtgtagtgtgaacgctgaagatgaggagggtgataccgcattacacgtggctctacaacgacatcagttgctccccctggtggcagacggggccgggggagacccagggcctctgcaactcttaagtaggttgcaggcttcaggtcttcccggtagcgcagaactcaccgtcggagccgccgtagcttgctttttggccttggagggagccgacgtatcatacaccaatcaccgaggcagatccccccttgatctggccgccgaggggcgggtcttgaaagcccttcaggggtgcgcacagcgctttcgcgagcgccaggcgggaggtggtgcggcaccaggccccaggcagacactaggcacgcctaacaccgttacaaatctgcacgtgggtgccgcacccggcccagaggccgcggagtgtctggtgtgctctgagctggctctccttgtcctgtttagcccctgtcagcacaggacggtttgtgaggaatgtgctcgacgcatgaaaaagtgcatccgctgtcaggtggtggtgtccaagaagctcaggccagatggctctgaggttgctagcgccgcacccgctccaggaccaccacgccaattggttgaggagctgcagagtcgttaccgtcagatggaggagaggataacctgtccaatttgcatcgactcccacatcagactggttttccagtgtggccatggagcatgcgccccctgtggctctgccttgagcgcgtgtccaatctgcagacagcccattcgtgacagaattcagatctttgtgtag

SEQ ID NO: 26575 - DNA, 294 bp, Artificial Sequence
  Description of Artificial Sequence: Synthetic coding sequence
atggccagcagcgccgagctggacttcaacctgcaggccctgctggaacagctatcacaggacgagctgagtaaatttaaatctttgatacggaccataagtttggggaaggagctacaaaccgtgccccagaccgaagtggacaaggcaaatgggaaacaactcgtagaaatttttaccagtcactcctgctcttactgggccggtatggccgcgatacaggtgttcgaaaagatgaaccagacacacctctcaggacgggccgatgaacactgcgtaatgccccccccgtag

SEQ ID NO: 26576 - DNA, 693 bp, Artificial Sequence
  Description of Artificial Sequence: Synthetic coding sequence
atggacagcgagctgatgcacagcatcgtgggcagctaccacaagccaccagagagggtctttgtacctagctttacacagaacgaaccctcacagaattgccaccccgcaaatctggaagtgacctcccccaagatactgcactcaccaaattctcaggcactgattctggcactcaagacactccaggagaaaatccaccggcttgaattggaacgtacgcaagctgaggataacctgaacattttgtcgcgcgaagcagcgcaatacaagaaggctctggaaaatgaaaccaatgagaggaatcttgcccaccaggagcttatcaagcagaagaaggacatctctattcagctgagctcagcccagtcccgatgtacactcctagaaaagcaactcgagtatactaaaaggatggtcttgaatgtggagcgcgagaagaatatgatcctcgagcagcaagcccagctgcagagagagaaagaacaggatcaaatgaagctgtatgccaaactggagaaactggacgtgctcgaaaaggaatgctttcggctgaccaccactcagaagaccgcggaggacaagatcaagcacctggaggaaaagctgaaagaggaggagcaccagcgcaagctgttccaggataaagctagcgagctgcagactgggttggagatctctaagataatttag

SEQ ID NO: 26577 - DNA, 624 bp, Artificial Sequence
  Description of Artificial Sequence: Synthetic coding sequence
atggaccggggcgagcagggcctgctgcggaccgaccccgtgcccgaggagggagaggacgtggctgccaccatatcggcaaccgaaaccctgtccgaagaagagcaggaagaactcaggagggaactggctaaagtggaagaggaaatccagaccctgtcacaagtgctcgcagccaaggaaaagcatcttgcagaaatcaagcgtaaattaggtataaactcactgcaggaattaaagcaaaacattgcgaaggggtggcaagacgtaactgctacttccgcttataaaaaaacttccgagactctaagccaggccggtcaaaaagccagcgccgcgttctcttctgttggaagtgtcataacaaagaaactggaagacgttaagctgcaggccttttcccactcctttagtattcggagcattcaacactcaatcagcatgccagctatgagaaattcacccacattcaagagtttcgaggagaaggttgagaatctgaaatccaaagtcggcggcacgaaacctgccgggggagatttcggggaggtcctgaactccgcagcaaatgcaagcgctactacgacagagcccctccctgagaagacacaggaaagtctgtag

SEQ ID NO: 26578 - DNA, 387 bp, Artificial Sequence
  Description of Artificial Sequence: Synthetic coding sequence
atgaagttcaaccccttcgtgaccagcgaccggagcaagaaccggaaacgacactttaatgccccctctcatgtaagaagaaagataatgagctcgcctcttagcaaggagctgaggcaaaagtataatgtgcggtcgatgcctatcaggaaggacgatgaagtgcaggtcgttagaggacactataagggccagcagatcggcaaggttgtgcaggtgtacaggaagaagtatgtgatttacatcgagagagtgcagagggaaaaagcaaatggcacaacagtgcacgtgggaatccacccttctaaagttgtcattacaaggcttaaactggacaaagaccgaaaaaagatcctggagcggaaagccaagagccggcaggtatag

SEQ ID NO: 26579 - DNA, 126 bp, Artificial Sequence
  Description of Artificial Sequence: Synthetic coding sequence
ggcctgaccaagcagctgctggacgacaccatcggcatccaccccacgtgcggggaggtcttcactaccctggagattactaaaagttccggcctggatatcacccagaaagggtgtugaggctag

SEQ ID NO: 26580 - DNA, 1365 bp, Artificial Sequence
  Description of Artificial Sequence: Synthetic coding sequence
atgctgaagcagatcctgagcgagatgtacatcgaccccgacctgctagcagaactgtcagaggaacaaaaacagatcctcttcttcaagatgagggaggagcagatcaggagatggaaagaaagagaagcggcaatggagcgtaaggaaagcctgcctgtgaagcctcgccctaaaaaagaaaatgggaagtccgtacattggaagttgggcgccgacaaggaagtttgggtgtgggtcatgggcgagcaccacctagataagccctatgatgtcctttgtaacgagatcatcgctgagagagcgcgcctgaaggcagaacaggaggccgaagagccacgtaaaacacactctgaagagttcacaaatagccttaagactaagagccaatatcacgacctgcaggcccctgataaccagcaaacaaaggatatttggaaaaaagtggccgagaaggaggaactcgaacagggaagtaggcctgcccctactctcgaagaggaaaagattcgcagcctgtcatcctccagcagaaacatccaacagatgttagccgattcgattaaccggatgaaagcctacgccttccatcaaaagaaggagagtatgaagaagaaacaagacgaggagattaatcagattgaagaagaacggaccaaacagatctgcaagtcgtggaaggaggactccgaatggcaagcatctttaaggaagtcaaaagcagccgacgagaagaggcggagtctggccaagcaggcccgtgaggattataagcggctgagcttgggtgcccagaagggccggggaggggaacgccttcagagcccgctgcgagtgccacagaaacctgagcgaccacctctgcccccaaagcctcagttcctgaactccggagcctaccctcagaagccactacgtaatcagggagtcgttcgaacactctctagctccgctcaggaggatatcatacgttggttcaaggaggaacaactgcccctgcgcgccgggtaccagaaaaccagcgacactatagccccctggtttcacggcatcctcacgttaaagaaggcgaatgagctgctgctgtccacggggatgccgggttcgttcctcatacgggtgtcagaacggattaaaggctacgctttgagttatttgtcagaggacgggtgcaaacactttctcattgacgcttcagcggacgcatacagctttcttggagtggaccagctccaacacgccacactggcagatctggttgaataccacaaggaggagccgattacgagtctgggtaaagagctcttgctctacccatgtggccagcaggatcagttgcctgactacttggaattattcgaatag

SEQ ID NO: 26581 - DNA, 438 bp, Artificial Sequence
  Description of Artificial Sequence: Synthetic coding sequence
atgaagttcaaccccttcgtgaccagcgaccggagcaagaaccggaagcgccactttaacgccccatctcacgtgcggcggaaaattatgtcaagtcctctgagtaaggaattgagacaaaagtataacgttcgcagtatgccgattaggaaggatgatgaagtgcaggtcgtgagggggcactataaaggtcaacaaattggcaaagtcgtccaggtttatcgcaagaagtatgtgatttatattgaaagagtccaacgggagaaagcaaatggaaccaccgttcacgtggggatccatcccagcaaggttgttattacacggctgaaactggacaaggacaggaagaaaatattggagcgcaaagccaaatcaaggcaggtaggaaaagaaaagggaaaatacaaggaagagcttatcgagaagatgcaggaatag

SEQ ID NO: 26582 - DNA, 621 bp, Artificial Sequence
  Description of Artificial Sequence: Synthetic coding sequence
atggacagcgagctgatgcacagcatcgtgggcagctaccacaagccacctgaacgagtctttgtgccatcattcacacagaacgagccttcccaaaattgccaccccgctaacctggaagttacatctcctaagatcttacactcacctaattcccaggctttgatcctggcactgaagacactacaggagaagatccaccgtctggagctcgagcgcacacaggctgaagataacctcaacattttgtcccgcgaggcagctcagtataaaaaagccttagaaaatgagacgaatgagcgtaatctggcacaccaggagctgattaaacagaaaaaggacatctctattcagctgtcaagcgcccagtctcgctgcacattgctagaaaagcagttagaatacacaaaaaggatggtactcaacgtagagcgagagaaaaatatgattcttgaacagcaagcgcagctccaaagggagaaggagcaggaccagatgaagctgtatgcgaagctggagaaactcgacgtcctggagaaggaatgttttaggctcactaccactcagaagaccgccgaagacaagattaaacacctggaggagaagctgaaggaggaatag

SEQ ID NO: 26583 - DNA, 1050 bp, Artificial Sequence
  Description of Artificial Sequence: Synthetic coding sequence
atggaggacccccagagcaaggagcccgccggcgaggccgtggccctggccctcctggaaagtcctcgacccgagggtggagaagagcccccccggccctcaccagaagaaacccagcagtgcaagtttgatggtcaggaaactaaaggcagcaagtttataaccagttcagcctcagacttttccgaccccgtatataaggaaattgccatcacaaatgggtgcattaaccgcatgagcaaagaggagctgagagcaaaactctctgagttcaaactggagactcgaggcgttaaggatgtcctcaagaagcggcttaaaaactactacaaaaaacagaagctgatgctcaaggaaagtaatttcgcagacagctactacgactatatttgcattatcgattttgaggctacctgtgaagaagggaaccctccagagtttgtgcatgagatcattgaatttccggtggtgctcctgaatacccacaccctcgaaattgaggatactttccagcagtatgtgcggcctgagattaacacgcagctgtcagacttttgcatatctctaacaggtattactcaagaccaggtggaccgagccgacacatttccacaggtgttgaaaaaggtcattgattggatgaagctgaaggagttaggaacgaaatacaaatactccttactaacggatggatcatgggacatgtcaaagtttctcaacatccagtgtcagttgtcccgcttgaaatatcctcccttcgccaaaaagtggataaacatccggaagtcatacggcaacttttataaagtccctcgcagccagacgaaactaacaattatgctcgagaaactgggaatggactacgatggaaggccgcactgcgggttggacgacagcaagaacatagctcgcatagcagttaggatgctccaagacgggtgtgaacttagaatcaacgaaaagatgcatgcagggcagctgatgagtgtgtcaagctctctgcccatcgaggggacccccccaccgcagatgcctcatttccggaagtag

SEQ ID NO: 26584 - DNA, 429 bp, Artificial Sequence
  Description of Artificial Sequence: Synthetic coding sequence
atgcccagcatcaagctgcagagcagcgacggcgagatcttcgaggtagatgtcgagatcgcgaaacaatcagtgacaatcaaaactatgctggaagatctgggaatggacgatgagggagacgatgatcctgtgcccctgcctaacgtcaatgcagccattctgaagaaggtgattcagtggtgtactcaccacaaagatgacccgcctccacccgaagacgatgagaataaggaaaagcggacagacgacattcctgtctgggaccaggagtttctgaaggtcgatcaagggacactgttcgagctgatcctggctgcaaattacctggatattaaagggttactggatgtaacttgtaaaacagtggccaatatgatcaagggaaagactcccgaagaaattcgcaaaacatttaacatcaagtag

SEQ ID NO: 26585 - DNA, 375 bp, Artificial Sequence
  Description of Artificial Sequence: Synthetic coding sequence
atgagcgccaccgtggtggacgccgtgaacgccgcccccctgagcggctccaaagaaatgtcccttgaagagcccaaaaaaatgaccagagaagactggcgtaaaaagaaagagctggaagagcaaagaaagctgggtaacgctcctgccgaggtcgacgaagagggcaaagacattaatccacatatcccccagtacatttcttcggtaccctggtatatcgacccaagcaagcgacctaccctgaaacatcagcggccccagccagagaagcaaaagcagttcagttcctctggcgaatggtataaacgcggagttaaggagaattccatcattacaaagtaccgcaaaggggcctgcgaaaattgtgggtag

SEQ ID NO: 26586 - DNA, 750 bp, Artificial Sequence
  Description of Artificial Sequence: Synthetic coding sequence
atggtggaccggctggccaacagcgaggccaacacccggcggatctccattgttgaaaattgctttggagccgcaggtcaacctctgacgatcccagggcgcgtacttattggcgagggagtgttgaccaaactctgccggaagaagccaaaagctcgacagtttttcctttttaatgatatccttgtgtatggtaacatagtgatccagaagaaaaaatacaacaaacagcacattattccgctggaaaacgtaactatcgactccattaaggatgagggcgacctacgaaatggctggctcatcaagactcccaccaaaagtttcgccgtctacgctgccacagctacagagaagagcgagtggatgaaccacattaataagtgtgtgactgacctgctcagtaaatccggcaagaccccctccaacgagcatgctgcggtgtgggttcccgattcagaagcaactgtctgtatgaggtgtcaaaaggcgaagtttacacctgtgaataggcgccaccactgtcgaaaatgcggattcgtcgtctgtgggccctgttccgagaagcgcttcttgctcccatctcagtccagtaaaccagtgcgtatttgtgatttttgctatgacttactcagtgcaggtgacatggcaacctgtcagccggctcgttcggattcctactcacagagtctgaagtcccccctgaatgatatgagcgacgatgacgacgatgacgattccagtgactag

SEQ ID NO: 26587 - DNA, 120 bp, Artificial Sequence
  Description of Artificial Sequence: Synthetic coding sequence
atgaagttcaaccccttcgtgaccagcgaccggagcaagaaccggaagcggcacttcaacgccccaagtcacgttcggcgtaaaatcatgagttcgccactgtctaaagagctgagatag

SEQ ID NO: 26588 - DNA, 1401 bp, Artificial Sequence
  Description of Artificial Sequence: Synthetic coding sequence
atgggctggatcaccgaggacctgatccggcggaacgccgagcacaatgactgtgttatcttttccctcgaagagctgtctctgcatcagcaggaaatagaaaggctggaacatatcgataaatggtgccgggacctgaaaattctctatttgcaaaataatttaattggtaagatcgagaatgtgtccaaactcaagaagctcgaatacctgaatctggccttaaacaacatcgaaaaaattgaaaacctggaaggctgtgaggaacttgccaaactagatctgactgtgaactttattggagaattgtcctccattaagaaccttcagcacaacatccaccttaaggaattgttccttatgggcaacccctgcgccagtttcgaccactaccgtgaatttgtggtggcgactcttcctcaattaaagtggctggatggaaaagaaattgagccctcggaacgtataaaggctcttcaggattactctgtcatcgaaccccaaatcagagagcaggagaaagaccactgcctcaaacgcgccaagctgaaagaggaagcccagagaaaacatcaggaagaagataagaatgaagataagcgaagtaatgccgggttcgacgggcgatggtataccgatatcaacgccaccttgtcttcgctcgagtcaaaagaccacctgcaagcccctgacacagaggaacacaacacaaaaaagttggataactccgaggatgacttggagttttggaacaagccatgcttattcactcccgaatcccggcttgagacactgcgccatatggagaagcagcgcaagaagcaggagaagctgagcgagaaaaagaaaaaggtgaaacctcctcgtaccctcattacagaagacggcaaggctcttaatgtgaacgagcctaagatcgacttttcactcaaagacaacgagaagcaaatcatcctggatttggcagtttatcggtatatggacaccagcctcatagacgttgacgttcagcccacgtatgtcagagtgatgataaaggggaaacctttccaactggttctgccagccgaagtgaaaccggatagcagctctgcaaaacgcagtcagaccaccggtcacctcgttatctgtatgcccaaggtgggagaagtgataaccggcgggcagagagctttcaagtcaatgaaaacgacttccgatagatcccgggagcaaactaacacccggtcaaagcatatggagaagctagaagtggacccttccaaacacagctttccagatgtgacgaatattgttcaagagaagaagcacacacctaggcgtcgccctgagcccaaaatcatcccttctgaagaagatccaacctttgaagataacccagaggtgccccccctcatctag

SEQ ID NO: 26589 - DNA, 528 bp, Artificial Sequence
  Description of Artificial Sequence: Synthetic coding sequence
atggccagcaaccacaagagcagcgccgcccggcccgtgagccgggggggcgttggcctgaccggccggcccccatcaggtattcggcctctgagcggcaatattagggtagcaactgccatgcccccagggaccgcacggccgggctctcggggttgcccaatcggcacaggaggcgttctgagtagtcaaatcaaagttgcacatagacctgtgacacagcaaggtttgactggcatgaagacaggcacaaaagggccccagaggcagatcctggataagtcttactatctcggtttgttgcggtcaaagatttccgaactcactacggaggtgaacaagctgcagaaaggaatagagatgtacaaccaggaaaatagcgtatatctatcgtacgagaaaagggcagaaaccctggccgtggagattaaggaactgcagggacagctcgctgattacaatatgctcgttgacaagctcaacactaataccgagatggaagaagtgatgaatgactataatatgtag

SEQ ID NO: 26590 - DNA, 438 bp, Artificial Sequence
  Description of Artificial Sequence: Synthetic coding sequence
atgaagttcaaccccttcgtgaccagcgaccggagcaagaaccggaaaagacactttaacgccccttcacacgtccgcaggaaaattatgtcttcaccactgtctaaagaactcagacagaagtacaacgtgaggagcatgccgatcaggaaggatgatgaagttcaggtggtcaggggacattacaagggacagcagattggtaaggtggtgcaagtgtaccgcaagaaatacgtgatctacatcgagcgtgtgcagcgcgagaaggcgaacggcaccactgttcatgtcggcatccacccgtctaaggtggttattactagactcaaactggacaaggacagaaaaaagatccttgaaaggaaggcgaaatcccgccaagtgggtaaagagaagggcaaatacaaggaagaactgattgaaaagatgcaggaatag

SEQ ID NO: 26591 - DNA, 2136 bp, Artificial Sequence
  Description of Artificial Sequence: Synthetic coding sequence
atgagcagcgtgcagagccagcaggagcagctgagccagagcgaccccagtccaagccctaatagctgcagcagtttcgagctgattgacatggacgcgggttccttatatgaacccgtgagtccccattggttctactgcaagatcatcgactccaaggaaacatggattccttttaactctgaggatagccagcaattagaggaggcctattctagtgggaaaggatgcaatgggcgcgttgttccgactgacgggggtagatacgacgtccatctaggggagaggatgcgatatgccgtttattgggacgaactggcaagcgaggttaggcgctgtacgtggttctataaaggagacaaggacaacaaatatgtgccttactcagagtcttttagccaggtcctggaagagacctacatgttggcggttaccctcgatgagtggaagaagaaactagaatctccaaacagagagataattattttgcacaatcccaaattaatggttcattatcaaccggtagccggttcggacgactgggggagcacacctaccgaacaaggccggccccggactgtgaagcggggagtggagaacatctcggtggatattcattgtggagaacccctgcagatagaccacttggtgtttgtcgtacacggtatagggcctgcctgtgacctccggttccggtcaattgtccagtgcgtgaatgacttccgtagcgtgtcactcaacctcctgcagacacattttaaaaaggcacaggaaaaccagcagatcggacgagtggagttcctccccgtgaactggcactccccactgcacagcacgggtgtagatgtagatttgcaacgcattaccctgccgagcattaaccggttgaggcatttcacaaatgataccattctggatgtgttcttctataactctcctacctattgccagacaatcgtggacactgtcgcgagcgagatgaaccggatttacacactgttcctgcaacgaaatccagacttcaaaggaggcgtcagcatcgctggacattctttgggctcacttatattgttcgacatcctaactaatcaaaaggattcactcggtgacattgacagcgagaaagatagcctaaacatcgtaatggaccagggcgacaccccgactctggaagaggatctcaaaaagctgcaactgagtgaattttttgacatttttgaaaaggaaaaagtcgataaggaggccctcgctctctgtacggatagagacctgcaggagattggcatccctctgggtccccggaaaaagatcctgaattatttcagcactcgaaagaactccatgggcatcaaaaggccagcgcctcagccggcaagcggggcaaacatcccgaaggaaagcgaattttgttcttcgtctaacacgagaaacggggactacctggacgtcggcattgggcaggtctctgtgaagtacccgcggctgatttacaagcctgagattttctttgcgttcgggtcccctatcggaatgttcttaacagtccgaggcctgaagcgcatcgacccgaactaccgcttcccaacatgcaaaggattcttcaacatctaccatccctttgaccccgtggcttacaggatcgaaccaatggttgtacctggcgttgaattcgaacctatgctcatcccacatcacaaaggccgaaagcgcatgcaccttgaactccgtgaaggcctaacacgcatgtctatggacctgaagaataatcttctaggaagcctgaggatggcatggaaatcattcacgagagccccttaccctgctttgcaggcgtcggaaacccccgaggagacagaagcagagccagagtctaccagtgagaagccctctgacgttaacactgaagaaaccagcgtggcggtaaaagaggaggtcttaccaattaacgtggggatgctaaacggggggcagcggatagattacgttctgcaggaaaagcctatcgagtccttcaatgagtatctgtttgccctgcagtcgcatctctgctactgggaatcagaggatacagtactgctcgttttgaaagagatttatcagactcagggaatttttctggaccagcccctacagtag

SEQ ID NO: 26592 - DNA, 471 bp, Artificial Sequence
  Description of Artificial Sequence: Synthetic coding sequence
atggccagcgtgctgagccggcggctgggcaagcggagcctgctgggagctagggtcctgggacccagcgcatctgagggacctagcgctgctcctccttctgagccactgctggaaggtgcagcaccccaaccatttacaacctcagacgacactccatgccaggagcagcctaaagaggtgctgaaggcccccagcacaagcgggctccagcaggtggcattccagccaggccaaaaagtgtacgtatggtatggcgggcaggagtgtaccggactggttgaacagcattcttggatggagggacaggttacagtctggcttctggaacagaagcttcaggtctgctgcagggtggaagaggtgtggctcgccgagctccagggcccctgtccccaggcaccccccctagaacccggcgctcaggcacttgcataccggccggtctccagaaacatagatgttccctag

SEQ ID NO: 26593 - DNA, 309 bp, Artificial Sequence
  Description of Artificial Sequence: Synthetic coding sequence
atgcccagcatcaagctgcagagcagcgacggcgagatcttcgaggtggatgtggagatcgctaagcaatctgtgacaattaaaacgatgctggaagatctgggcatggacgacgagggcgatgacgatccagttcctctgccaaacgtcaacgcagccatcctaaaaaaagtgatccagtggtgtactcaccacaaggatgaccccccccccccagaagatgacgagaacaaggaaaagagaaccgacgacatccccgtttgggatcaggaattcttaaaggtcgatcaagggaccttgttcgagtag

SEQ ID NO: 26594 - DNA, 465 bp, Artificial Sequence
  Description of Artificial Sequence: Synthetic coding sequence
atggccgacgacctggacttcgagaccggcgacgccggcgccagcgcaaccttccctatgcagtgttcggcgctgaggaaaaatggatttgtcgtgctcaaggggtggccttgcaaaattgtggagatgagcgcgtcgaaaaccggcaaacacggccatgccaaggtccatcttgtggggattgacatctttaccggcaagaagtatgaagatatttgcccttccacgcacaacatggacgtgccaaacatcaagaggaacgactttcagctgatcggcatacaggacggatacttatctcttctgcaagactctggtgaagtgccagaggacctccgtctccctgaaggcgatttaggtaaagagattgaacagaagtacgactgcggcgaagaaatattgataaccgtgctcagtgctatgaccgaggaggctgctgtcgcaatcaaggctatggcgaagtag

SEQ ID NO: 26595 - DNA, 306 bp, Artificial Sequence
  Description of Artificial Sequence: Synthetic coding sequence
atgagcgccaccgtggtggacgccgtgaacgccgcccccctgagcggaagcaaggagatgagcctggaagagccaaaaaaaatgacacgggaggattggaggaaaaagaaagagctagaggaacagcggaagttaggaaacgctccagccgaggtggatgaggaaggcaaggacatcaatccgcatattccacagtacataagcagcgttccttggtatattgaccctagtaagcggcccacccttaagcaccagcgcccgcaacccgaaaagcaaaagcagttcagcagctccggcgaatggtag

SEQ ID NO: 26596 - DNA, 3201 bp, Artificial Sequence
  Description of Artificial Sequence: Synthetic coding sequence
atggccggcgccctgcggcggggccgggccctgggcagccggccctctggcccaaccgtcagttcaagacgatctcctcagtgcccagtggcccaagaaggactgggagcgagaagccgcccgagggtcgccccacgctccttagctcgatgtgggccaagcagtagactaatgggctggaagccttcagaggcccgcggccagtcacagtcctttcaagctagcggcctccagccaaggtctctgaaagctgctcgccgtgctactggccggcctgatagatcacgggcggcaagacctaccatggacccctccgcccatagatcccgggctgcccctccgaacatggaccctgacccacaggcaggcgtccaggtcgggatgagggtggtgcgaggcgttgattggaagtgggggcaacaggacggtggagaaggcggggtcggaacagtcgtggagctggggcgccacggtagtccctctacgcctgacaggacagtggtggtacaatgggatcaagggactaggacaaactatagagccggttaccaaggcgctcatgatcttctgctgtatgataacgcccaaattggggtgaggcatcccaacatcatttgtgattgttgcaagaagcatgggctaagaggcatgagatggaaatgcagggtatgtctcgattatgacttgtgtacgcagtgctacatgcacaacaaacacgagctggcacatgcctttgaccgatatgaaaccgcccacagcagaccagtcactctgagtccgagacaaggactgccacggatcccgcttcggggtatcttccaaggagccaaggtcgtgcgaggacccgattgggagtgggggtcccaggacggtggcgaggggaaacccggaagggtcgtcgacattaggggttgggacgttgagaccggccggtccgtcgctagtgtgacttgggcagacgggactacaaacgtgtatagagtcggacacaagggtaaggtcgatctcaagtgtgtgggggaggcggccgggggcttctactacaaggatcacctcccaaggctgggcaaacctgcggaactacagagaagggtgagcgccgacagccagcctttccagcatggggacaaggtcaagtgcctattggacacagatgtgctgcgtgaaatgcaggagggccacggcgggtggaatccacgcatggctgaaaccggaactgtgcatagaatcacagaccggggcgacgtcagggtgcagtttaaccatgagacaaggtggacgtttcatcccggagccctgactaagcatcactctttctgggttggggacgtggtgagggtcatcggcgatctggacaccgttaagagattacaggccgggcacggtgagtggactgacgatatggctccagccttgggaagagtaggaaaagtggtgaaagtgtttggtgatggaaatctgagagtcgcggttgcaggtcagagatggacatttagtccatcttgtctcgtcgcatatcgacctgaagaagatgccaacctggatgttgcagagcgggcgcgcgaaaataaaagctccttaagtgttgccctagataagctgagggctcagaagtctgatcccgagcatccaggccggttagtggtggaggtggccctcgggaatgcagcacgtgccctagacctgcttcggaggcgccccgagcaagtcgataccaagaaccagggccgtacagcccttcaagttgctgcctatcttggtcaagtcgaactgatcagactgttacttcaagcacgagctggcgtggacctgccagacgacgagggtaataccgccctacactacgccgccctgggcaaccagcctgaggcgaccagggtcctgttatctgctggatgtcgtgccgatgccatcaattccacccagagcaccgctcttcatgtcgccgtgcaacgtggcttcttggaggtggtgagagctctgtgtgaacgtggctgcgacgtcaacttacctgacgcccattccgatactcccctgcatagcgccatatcagctgggacgggagcctccggtatcgtcgaggtactaacagaagtgccaaacattgatgtgaccgccacgaattctcagggattcacgttactccatcatgccagtctgaaaggccatgcattagccgttaggaaaatactcgctcgagccagacaactagtggatgccaagaaggaagatggctttacggccctgcacttggcggcattgaacaatcacagagaagtcgcgcaaattctaattagagaagggagatgcgacgttaatgtacgtaacagaaaactccagagccctttgcacctcgcagtccagcaggcccacgtgggtctggtacctctgctcgtcgatgctggttgctctgttaacgccgaggacgaggaaggggatacagccttgcatgttgcgctgcagaggcatcaactcctcccactggttgccgatggcgccggaggggatccagggcccctacagcttttgtcgagactccaagccagcggtctccccggaagcgctgagttgacagtgggggccgcagtggcttgtttcctagcacttgaaggcgctgatgtgtcctacactaatcatagggggagatctccacttgatctggcagctgagggacgtgttttgaaagctctccagggatgtgcacagcgcttccgggaacgacaggccggcgggggtgccgctcccggcccacgccagacactggggacccctaatactgtgacaaatttacatgtgggtgccgcacctggcccagaggctgccgagtgtttggtttgtagcgaactggctcttctggtgctgttttccccctgtcagcacaggacagtttgcgaagagtgtgcccggagaatgaaaaagtgcattcgatgccaggtggtggtgtctaagaaactgaggccagacggaagtgaggttgccagtgcggcccctgctcccggtcccccccgacagctggtggaagagttgcagtcccgctatcgccagatggaggaaagaatcacctgtcctatatgtatcgattcacacatccgcctggtgttccagtgtggccatggagcatgcgcaccctgcggttcagctctttcggcatgtccgatttgtcggcagcctatacgggatcggattcagatcttcgtttag

SEQ ID NO: 26597 - DNA, 348 bp, Artificial Sequence
  Description of Artificial Sequence: Synthetic coding sequence
atgatgctgggcaccgagggcggcgagggcttcgtggtgaaggtgagaggacttccatggtcttgtagcgcagacgaagtgcagcgctttttctctgactgtaagatacagaacggggctcagggaatccggttcatatatacccgcgaggggagaccctccggcgaggcatttgtggaactggaatctgaggacgaggttaaactggctctgaagaaggatagagaaactatgggacaccggtatgttgaagtgtttaagtccaacaatgtggaaatggactgggtgctcaagcatacaggacctaacagccctgatactgccaacgacgggttcgttagactctag

SEQ ID NO: 26598 - DNA, 375 bp, Artificial Sequence
  Description of Artificial Sequence: Synthetic coding sequence
atggccagcgtgctgagccggcggctgggcaagcggagcctgctgggcgcgcgtgtgctgggaccgtctgcctctgagggaccgtcagccgccccccctagcgaacccttgttggaaggagcggcaccgcagcccttcaccacttccgatgacacaccctgccaggagcagcccaaagaggtgctcaaagcccccagcactagtggcctgcagcaggttgctttccagcccgggcagaaggtctatgtttggtacggcggacaagaatgtactggactagtcgagcaacatagttggatggaagggcaagtaacggtatggctactggagcagaaactgcaggtttgttgccgggtcgaggaagtctggctgtag

SEQ ID NO: 26599 - DNA, 438 bp, Artificial Sequence
  Description of Artificial Sequence: Synthetic coding sequence
atgaagttcaaccccttcgtgaccagcgaccggagcaagaaccggaaaagacacttcaacgccccgagccatgtcaggagaaagatcatgagctcaccacttagcaaagagcttcgtcagaaatataacgtcaggagcatgcctattcgcaaggacgacgaggtgcaggtcgtgaggggccactacaaaggccagcaaatcggtaaagtcgtgcaggtgtatcgcaaaaaatatgtgatatatatcgagcgcgtgcagagagagaaggccaacgggacgacggtgcacgtcggcattcatccttcaaaggtggtgataacccggttaaaattggacaaggatagaaagaagatattagagcgcaaagctaagtctcggcaggtggggaaggaaaaaggaaagtataaagaagaactgattgaaaaaatgcaagagtag

SEQ ID NO: 26600 - DNA, 339 bp, Artificial Sequence
  Description of Artificial Sequence: Synthetic coding sequence
atggacagcgagctgatgcacagcatcgtgggcagctaccacaagcctcctgagagggtgtttgtgccctcattcactcaaaacgagccttcacagaactgtcaccctgccaatttagaagtgacaagcccaaagatactacatagccccaattcacaggcattgatcctcgctcttaagactctccaggaaaaaatccacaggctggaactggagcgaacacaagccgaggataacttaaacatattaagtagggaggctgcacagtacaagaaagctttagagaatgagaccaacgagcggaacttagcacaccaggagctcatcaaacagaagtag

SEQ ID NO: 26601 - DNA, 345 bp, Artificial Sequence
  Description of Artificial Sequence: Synthetic coding sequence
atgcccagcgccgaggccaagctgaagaagaaccggtgcgccaactgtttcgattgcccaggatgcatgcacacactctcaaccagagccaccagcatttctactcagctgccagatgatcccgcgaaaaccactatgaaaaaggcgtattatctggcgtgtggcttctgtagatggacgagccgggatgtgggcatggccgataagtccgtggcatccggcggttggcaggaacccgagaacccacacacacagcgcatgaataaactgatagaatattaccaacagctcgcacagaaagagaaggtggagagagatcgcaagaagctcgccaggcgccggtag

SEQ ID NO: 26602 - DNA, 648 bp, Artificial Sequence
  Description of Artificial Sequence: Synthetic coding sequence
atgcccggcgaggccaccgagaccgtgcccgccaccgagcaggagctgcctcaaagtcaagcggagacaggatccggtactgcaagcgatagtggggagtccgtaccaggcattgaagagcaggattcaactcaaactacgacacagaaagcttggctggttgctgcagccgagatcgatgaggagccagtcggtaaagccaagcagtcaaggagcgagaaaagagctaggaaggccatgtcaaagttaggcctgcttcaggtgactggtgtgacaagagtcacaatttggaagtcaaagaatattttatttgtgattacaaaactggacgtttataaatcgccagccagcgacgcttacattgtgtttggagaagccaaaatccaggacctttcacaacaggcacaactggcagcagctgagaagtttcgcgtacagggggaggccgtaggaaatatccaggaaaatacccagacccctaccgtgcaggaagaatctgaagaggaggaggtggatgaaactggagtcgaagtgaaggatgtgaaactcgtgatgtcccaggcaaatgtttcccgcgccaaagcggtgcgtgccctcaaaaataattcgaacgacattgttaacgcaatcatggaactcacagtatag

SEQ ID NO: 26603 - DNA, 432 bp, Artificial Sequence
  Description of Artificial Sequence: Synthetic coding sequence
atgagcgccaccgtggtggacgccgtgaacgccgcccccctgagcggatccaaggaaatgtctctggaggagcctaagaaaatgacacgggaagattggaggaagaaaaaggagctggaagaacagcggaagcttggaaatgctcctgctgaagtcgacgaggaaggtaaagacatcaatccgcacataccccagtatatctcatccgtcccgtggtatatcgacccgagcaagaggcctacactcaagcaccagcgacctcagcctgagaagcagaaacagtttagttcatccggcgaatggtataaacggggtgtcaaggaaaattcgatcattactaaatacagaaaaggcgcttgcgagaactgtggagctatgacacacaaaaaaaaagattgtttcgaacgccctcgaagagtgggtgccaaatag

SEQ ID NO: 26604 - DNA, 567 bp, Artificial Sequence
  Description of Artificial Sequence: Synthetic coding sequence
atggccagcgtgctgagccggcggctgggcaagcggagcctgctgggcgctagagtgctggggccttctgcctcagagggaccctctgcagcacctccttctgagcccctccttgaaggcgccgctccccagccatttaccaccagtgacgacactccttgtcaggaacagcccaaagaagtactgaaggctcctagtacatcaggactgcagcaggttgcttttcagcccgggcagaaggtgtacgtttggtacggaggtcaagagtgtacaggcctggttgaacagcattcatggatggaaggccaggtgacagtgtggctacttgagcagaaactccaagtatgttgtagagtcgaggaagtgtggctcgccgagctgcaaggcccgtgtccccaggcacctcccctagaacccggtgctcaggccctggcctatcgccccgtctctcgaaatatcgatgtgcctaaaagaaaatccgatgccgtggagatggatgaaatgatggcggcaatggttttgacatcactgagttgctccccggttgtgcagagccccccaggctag

SEQ ID NO: 26605 - DNA, 87 bp, Artificial Sequence
  Description of Artificial Sequence: Synthetic coding sequence
atgatgctgggcaccgagggcggcgagggcttcgtggtgaaggtgagaggtttaccatggagttgtagcgctgacgaggttcagtag

SEQ ID NO: 26606 - DNA, 87 bp, Artificial Sequence
  Description of Artificial Sequence: Synthetic coding sequence
atggacagcgagctgatgcacagcatcgtgggcagctaccacaagcctccagaaagggtgttcgtgccttcctttacccagaactag

SEQ ID NO: 26607 - DNA, 1074 bp, Artificial Sequence
  Description of Artificial Sequence: Synthetic coding sequence
atgggcggcgccgtgagcgccggcgaggacaacgacgacctgatcgataatctgaaggaggcccagtacattcggaccgagcgagttgaacaggcgtttagagccatagacagaggtgactactaccttgaaggctatcgcgataacgcttataaggacctagcatggaagcatggaaacattcacctgtccgccccatgtatctactcagaggtgatggaagcactgaagctgcagccagggctaagttttctgaacctgggctcagggaccggctacctgtcaaccatggtaggcctgattctgggtccgttcggcatcaaccatggaatagagctgcattccgatgtggtggagtacgctaaagaaaaactagaaagttttataaagaactccgacagcttcgacaagtttgagttctgcgagcctgcattcgttgtggggaattgcctgcagattgcttcggattcacatcagtacgaccggatttactgcggcgcgggggtccagaaagatcatgaaaattacatgaagatattgcttaaagtcgggggaatactggtgatgcctatagaggaccaacttacgcagataatgagaacaggccaaaacacttgggaaagcaaaaatatactcgcggtgtcctttgcacctttagtccagcctagtaagaacgataacggtaagccagactctgtgggacttccaccatgcgctgtccgcaacctgcaggatctagccagaatttatatccgtaggacactgaggaacttcatcaacgacgagatgcaggccaaagggataccacagcgcgctcctcccaagaggaaacgcaagagagtcaaacagaggatcaatacatacgtattcgtgggaaaccaactgattccccagcctctagacagtgaggaggatgaaaagatggaagaggataataaggaagaggaagaaaaggaccataatgaggccatgaaaccagaggaacccccacaaaaccttttgcgcgagaaaatcatgaagctgccactacccgagtcactgaaagcgtatctgacatattttcgagacaagtag

SEQ ID NO: 26608 - DNA, 483 bp, Artificial Sequence
  Description of Artificial Sequence: Synthetic coding sequence
atgcccagcatcaagctgcagagcagcgacggcgagatcttcgaggtagacgtggagattgctaaacaatctgttaccatcaaaactatgttggaggacctcggcatggacgatgagggtgatgatgatccagttcccctccccaacgtcaacgcagccattttgaaaaaagtgatccagtggtgcacccaccacaaggacgacccaccacccccggaagacgacgagaacaaagaaaagagaaccgatgatattcctgtctgggaccaggaatttctgaaggtggatcagggcacgctgtttgagctgattctagctgctaattacctggacatcaaaggactgctggatgtcacctgcaagacagttgctaacatgatcaaaggaaaaaccccggaagagatcaggaagacgttcaacatcaaaaacgatttcacagaggaagaagaggcccaggtggggtcaacgcagttttgcttatag

SEQ ID NO: 26609 - DNA, 342 bp, Artificial Sequence
  Description of Artificial Sequence: Synthetic coding sequence
atggacagcgagctgatgcacagcatcgtgggcagctaccacaagccccccgaacgagttttcgtgcctagttttacccaaaatgagccgtcacaaaactgccatcccgccaatttggaggtaaccagtccaaaaattctgcactctcctaattcccaggcgttaatcttagctttgaagactctccaggagaaaatccatagactagaactggaacggacacaggccgaggacaacctgaatatcctctcgcgggaggctgctcaatacaagaaagccttggaaaacgagaccaacgaacgcaatctcgctcaccaggagctgattaagcagaaaaaatag

SEQ ID NO: 26610 - DNA, 309 bp, Artificial Sequence
  Description of Artificial Sequence: Synthetic coding sequence
atggccagcgtgctgagccggcggctgggcaagcggagcctgctgggcgcccgggtgcttggcccctccgccagcgaaggcccttcagctgctccacccagtgagcctctgctagaaggcgcagcccctcagccatttaccaccagtgacgataccccctgccaagaacagccgaaagaagtcctaaaggccccttctacgtcaggactccagcaggttgcattccaacctggccagaaggtatacgtgtggtatggggggcaagagtgcaccgggctggtggagcagcacagctggatggaaggttag

SEQ ID NO: 26611 - DNA, 492 bp, Artificial Sequence
  Description of Artificial Sequence: Synthetic coding sequence
atgcccagcatcaagctgcagagcagcgacggcgagatcttcgaggtggacgttgaaattgccaaacagagcgtgaccattaaaacaatgctggaggacctggggatggacgatgaaggcgacgacgaccctgtcccactgcctaacgttaatgcagccattctgaaaaaggtaatccagtggtgtacacaccataaagatgatcctccccccccagaggatgacgagaataaggaaaaaaggacagatgatattccagtgtgggatcaggaattcctgaaggtggaccagggcacactgttcgagctgatactggcagccaattatttggacattaagggcttgttggacgttacttgcaagaccgtcgctaatatgatcaagggaaagactcctgaagaaattcgcaaaacattcaacatcaagaatgacttcacagaggaagaggaggctcaggtgcgtaaagaaaaccaatggtgtgaggagaagtag

SEQ ID NO: 26612 - DNA, 441 bp, Artificial Sequence
  Description of Artificial Sequence: Synthetic coding sequence
atgtgccccggcaactggctgtgggccagcatgaccttcatggcccgctttagtagatcaagctcacgctcacccgtcagaacacgcgggaccctcgaagaaatgcctactgtccagcacccctttctgaacgttttcgaactggaaaggctgttgtacacaggtaagacagcgtgcaaccatgctgacgaagtgtggccaggtctctatctgggcgaccaggatatggccaacaaccgaagagaactgaggagactcgggatcacccacgtgcttaacgcatctcattcccgctggcggggaacccctgaagcatacgaagggctaggcatacggtatctgggtgtggaggctcatgactcccctgccttcgatatgagtattcattttcagactgcggccgatttcattcaccgggccctgtcacagcccggcggctag

SEQ ID NO: 26613 - DNA, 1542 bp, Artificial Sequence
  Description of Artificial Sequence: Synthetic coding sequence
atggccagcgtgctgagccggcggctgggcaagcggagcctgctgggcgccagagtgcttgggccttccgccagtgaaggcccctctgccgctccgcctagtgaaccccttctggagggcgcagctccacaacctttcaccacaagtgatgataccccttgtcaggaacagccaaaggaagtgttgaaggccccaagtacttctggccttcaacaagtagcctttcagccaggtcaaaaggtctacgtctggtacggtgggcaagaatgtactggacttgtggagcagcattcttggatggaaggacaagtcactgtctggcttctggaacagaaattgcaggtctgttgcagggttgaggaagtgtggctggcagagcttcaggggccgtgtccccaggcccctcctcttgaacccggcgcccaagccctcgcgtaccgcccagttagccggaatatcgacgttccaaagcgcaaatcagacgccgttgagatggacgagatgatggcagctatggtgctaacctcactgtcttgtagcccggtggtgcagtcccctcctggcacagaagcaaatttctctgcctctcgagctgcatgcgacccttggaaggaatcaggcgacatatccgattctggcagttccaccacaagtggacattggtccggctcttctggggtatccacgccttccccaccccacccgcaggcatctcccaaatatctgggtgacgcatttgggtctccacaaacggatcacggtttcgaaaccgatccagatcctttcctgctggatgagccggccccgcgaaagcgtaaaaacagcgtgaaagttatgtacaagtgtctttggcccaactgcgggaaggtgctgaggtctatcgtaggaataaaaagacacgtcaaagctctgcacttgggcgacacagtggattccgaccaatttaagcgcgaagaggatttctattatacggaggtccagctcaaagaggaatctgccgcagctgctgctgccgctgcagccggaactcccgtgcccgggacccctacgtccgaaccagcccccacacccagtatgacgggcttgccactgtccgctttgcctccaccacttcataaagcccaaagttcagggcctgagcacccgggtccagagtcaagccttccctctggggcactctctaaaagcgcgcctggttctttttggcacatccaggccgatcatgcttatcaggcacttccttcatttcaaattcccgtgagtccccatatctacacaagcgtgtcttgggctgcagcccctagcgcagcttgttcccttagtccagtgaggagccgcagcctcagcttttccgaaccccagcagcccgctcctgccatgaagagccacttgatcgtgacaagccccccacgcgcccagtcgggggcaagaaaggcccgcggcgaagccaaaaaatgtaggaaagtgtacggtattgagcacagagaccaatggtgcaccgcatgcaggtggaaaaaggcttgtcaacgctttctcgactag

SEQ ID NO: 26614 - DNA, 438 bp, Artificial Sequence
  Description of Artificial Sequence: Synthetic coding sequence
atggccgtgagcaccggcgtgaaggtgccccggaacttccggctgctggaagagctagaggaggggcagaaaggagtgggggatggcacagtgagttggggtctcgaagatgatgaggatatgaccctgacccggtggacaggcatgatcatcggcccaccccgtacgaattatgaaaaccggatctactctttgaaggtcgaatgtggccccaagtatcctgaagccccaccaagtgtcagatttgtgacaaagatcaacatgaatgggatcaacaacagttcagggatggtggacgcaagatccatcccagtacttgccaaatggcagaatagctattcaattaaagtagtgctgcaggaattaaggcgactcatgatgtccaaagaaaacatgaagctgcctcagccccctgaagggcagacctacaataattag

SEQ ID NO: 26615 - DNA, 1542 bp, Artificial Sequence
  Description of Artificial Sequence: Synthetic coding sequence
atggccagcgtgctgagccggcggctgggcaagcggagcctgctgggggcacgggtgctgggacctagcgccagtgaagggccctcagcagccccccctagcgaacccctgcttgagggtgccgccccacagccattcaccaccagtgacgacacaccgtgccaagagcagccaaaagaggtgctgaaagccccatcgacgtctggattacagcaggtcgccttccagcccgggcagaaagtgtacgtgtggtacgggggccaggaatgcacaggtctcgtcgaacaacactcttggatggagggccaggtcacagtctggctcctggaacagaaactgcaggtgtgctgccgcgttgaagaagtgtggctcgcggagctacagggtccttgtccacaggcgccaccactagagcctggtgcacaggcactagcatatcggccggtcagcagaaacatcgatgtgcctaaaagaaaatcagatgccgtagagatggacgagatgatggcagcgatggtcctgacctcactatcctgctcccccgtcgtgcagagcccccctgggacagaggccaatttctctgctagccgggctgcctgcgatccttggaaagagtccggggatatctctgacagcgggagctctacaacaagcggacattggagcggatcctctggcgtgagcactccctctccaccacatccgcaagcgagccctaaatacttgggagatgcctttggtagcccacagacagatcacggattcgagacagacccagaccccttcctactggacgagcccgctcccagaaagaggaagaattcggtgaaggtaatgtataagtgtctgtggccaaattgcggaaaagtgttaaggtccattgtggggatcaagagacacgtcaaagcgctgcatctgggcgacacggtggactcagatcaattcaagcgagaagaagatttttactatactgaggtgcagctcaaagaggagagcgctgctgccgcggcagcagcagccgctggtaccccagtgcccggaacccccacctccgagccagctccaacaccatccatgaccggcctgcctctgtccgccctcccccctccactgcataaagcacagtcctctggtcccgagcacccgggaccggaatccagcctgcccagcggcgccctctccaaaagtgctccgggaagcttttggcacatccaggcagatcacgcctaccaagcactccccagctttcaaattcccgtgtcacctcacatttatacttctgtcagttgggcggccgccccaagtgcggcatgcagcctgtcacctgtcagatctcgatcactctcatttagtgagcctcaacagccggctcctgccatgaagtctcacttgatagtcacttctcctccgagagctcagagcggagccagaaaggctcggggagaggccaagaagtgtagaaaagtttacggaatcgagcaccgggaccaatggtgcactgcatgtagatggaagaaggcttgccagcgcttcctggactag

SEQ ID NO: 26616 - DNA, 57 bp, Artificial Sequence
  Description of Artificial Sequence: Synthetic coding sequence
atgcccagcatcaagctgcagagcagcgacggcgagatcttcgaggtcgatgtctag

SEQ ID NO: 26617 - DNA, 1935 bp, Artificial Sequence
  Description of Artificial Sequence: Synthetic coding sequence
gtggccagcgagggcagcgtgcggcggcccagcggccccgtgcccgccccccagcctccggcctttcgcttcgtgagtaggcccggtagagcaaggtccgagagcgaaactctggagagatcaccaccacagagcccgggccctggaaaagctggggatgcaccaaacaggaggtcaggtcacgtccggggtgctcgggtcctgagcccaccaggcaggcgcgcccgcttgagctccccaggccctagtagaagctctgaggccagagaggaacttcggcggcacttagtggggctcatcgaaagatcccgagtggtgatcttctcaaaatcctattgcccccatagcacccgtgttaaggagcttttcagctccctgggggtagagtgtaacgtactggaattggatcaagtcgacgacggggcccgcgtgcaggaagttctgtcagaaattaccaatcagaagacggtgccaaatatcttcgttaataaggtgcatgtcggagggtgtgaccagacttttcaggcctatcagagcggcttgttgcagaaattactccaagaggacttggcatacgattatgatctgataatcatagggggcggctcaggggggctgtcttgcgcgaaggaagcagcaatactcgggaaaaaggtgatggtgcttgatttcgtggtgcctagtccacagggcacatcttgggggctcggcggaacatgcgtgaacgtgggctgcattccaaagaagctcatgcaccaggcggccctgttgggccaggcactgtgcgattctagaaagttcggatgggagtacaatcagcaagttaggcacaattgggagacgatgacgaaagccattcagaaccacatttcaagcctgaattggggctacagactgagtttaagggagaaggcggttgcgtatgtgaattcatacggcgagtttgtcgagcatcacaagattaaggccacgaataaaaagggccaggagacctattatacagccgcgcaatttgtgattgccacgggcgaacgccctcgatacttggggatccaaggagacaaggaatactgcatcacatcggacgatctgttttctctcccttactgcccaggaaagacactggtcgtcggggccagttatgtggcgctggagtgtgcagggtttctggctggattcggcctggatgtcaccgttatggtgagatcaatactattgaggggtttcgatcaagaaatggcagagaaggttgggtcatatatggagcagcacggggtcaaattcctgcggaaattcatcccagtaatggtgcagcagcttgaaaaagggagtcccggcaagctaaaggttctggcaaaatccacagaagggacagagactattgaaggcgtttataatactgtgctgttggccatcggcagagatagttgtacaagaaaaatcggcttggagaaaattggcgtcaagatcaacgagaagtccgggaaaatcccagttaatgacgtggaacagacaaatgtgccatatgtctacgccgttggtgatatcctggaagacaagcccgaactcaccccagtggcaattcagtcgggcaagctgttggcccagcgcctgtttggagccagcctagagaaaatctaccatactctcttttggccattagagtggacagtagccgggcgggaaaataatacctgctatgctaagatcatttgtaataagtttgatcacgaccgggtgatcgggttccatatattgggaccaaacgctggcgaagtcacacagggcttcgcagccgccatgaagtgcggcttgacgaaacagctgctggatgacaccattggaattcacccaacctgtggcgaggtgttcactacactggagattacaaagtcaagtggactcgacataactcagaaggggtgcugaggatag

SEQ ID NO: 26618 - DNA, 1338 bp, Artificial Sequence
  Description of Artificial Sequence: Synthetic coding sequence
atgaacaagggcatcagcagcatccccatcaacctgcgggtgtactccccccacgtgctcaacctcactctcattgatctccccgggattactaaagtgccagttggtgatcagccaccggatattgaataccagataagggaaatgatcatgcagtttattactagggaaaactgccttatcctagcggtgactcccgcaaatactgacttggctaacagtgacgccctgaagctcgccaaggaggtcgacccacagggcctgcgcactattggggtaatcaccaagttagatcttatggatgaggggactgatgctcgggatgtgctcgaaaacaagttgctgcccctccgacgcggctacgtgggggtggtaaacagaagccagaaagacatcgacggcaagaaagacattaaggccgcgatgcttgcagagcgtaagttctttctatctcaccccgcttaccgtcacatcgccgacagaatggggacacctcatttgcaaaaagtgctgaatcagcagctcacaaatcacattagagacactcttcccaacttccggaataagttacagggacagctcttgagtatagagcacgaagtcgaggcttacaaaaatttcaaaccagaggacccaactcgcaagactaaagctttactgcagatggttcagcagttcgcggttgatttcgagaagagaatcgaagggtcaggagaccaggtggacaccctggagctatcgggcggagcgaagattaaccgaatcttccatgaacgcttcccattcgagatcgtcaagatggagttcaatgagaaggaactgcggcgggaaatcagttacgcaatcaaaaacattcacggtatccgaaccggcctgttcactccagatatggctttcgaagcaattgtgaagaagcaaatcgttaagctgaagggcccctctctgaagagtgtagatctagtgatacaggaactcattaacaccgtgaagaagtgcacaaagaaacttgcaaattttcccaggctctgcgaagaaactgaaaggattgtcgccaatcacatccgggaacgcgagggaaaaaccaaagaccaggtgcttctactgatcgacattcaggtgtcttacattaacacaaaccacgaagatttcattggctttgccaatgcccagcaacgttcttcccaagtccacaagaaaaccacagtgggaaatcaggtgatccgtaaggggtggttgacaatatcaaatatcggcatcatgaaagggggctctaaaggatactggtttgtgctcacggccgagtccctcagttggtacaaagatgatgaggagaagtag

SEQ ID NO: 26619 - DNA, 1560 bp, Artificial Sequence
  Description of Artificial Sequence: Synthetic coding sequence
atgctgcagctgatggacagcggcatcaccatctgcctgcggaacggggcagcatccgtgttcaagaagaaggagtggtccacccagggcgaggaaaacaaacaagactccaagctcaaaaaactttctgaagattccctcaccaagcagccggaggaggtttttgatgtgttagagaaactgggggaaggctcctacgggagcgtcttcaaggccattcacaaggagagcggccaggtcgtcgccattaagcaagtgccggtcgagtctgaccttcaggagatcattaaagagatttccattatgcaacagtgtgactcaccctatgtggtgaagtattacggatcgtatttcaagaatacagacctttggattgtcatggaatattgcggcgcgggttcggtctcggacatcattcggctccgaaacaaaactttaatcgaggacgagatcgccaccatcctgaaatccactctgaagggcctggagtacctccactttatgcgaaaaatccacagggatattaaggccggcaatattctgctcaatacggaggggcacgccaagctcgctgactttggtgtcgccggacagctgactgacacaatggccaagcgtaacacagtcatcggaacccccttctggatggcacccgaggtgatacaagaaatcggctacaattgcgttgccgacatctggtctctcggcatcacgagtatcgagatggcagaggggaagccgccatatgctgacatacatccaatgagagccattttcatgattcccacgaatccgccaccaacattcaggaagcctgaactgtggagcgacgatttcactgacttcgtcaagaagtgtctagttaaaaacccagaacagagggctacagcaactcaactcttgcagcatcccttcatcaaaaatgctaagccagttagcattttgagagacctgattaccgaggcgatggaaattaaagccaaacgtcacgaagagcagcagcgggaacttgaggaggaggaagagaactcggatgaagatgaactggattcacacacaatggtcaagacctccgtggagtccgtgggaaccatgcgagccactagcaccatgtccgagggcgctcaaactatgatcgagcataacagtactatgctcgaaagtgacctgggtactatggtgatcaacagcgaagacgaagaggaggaggatgggactatgaagcgaaacgctacttcacctcaggtccagcgcccctcatttatggattacttcgataaacaggacttcaagaacaagtctcatgaaaactgcaaccagaacatgcacgagcccttccccatgtcaaaaaacgtgttcccagacaattggaaagtgcctcaggatggtgattttgatttcctcaaaaatctgagcttagaagagctgcagatgaggcttaaagcccttgaccctatgatggaaagggagattgaggagctgcggcagaggtatactgccaaaaggcaaccaatcctggacgccatggacgccaagaaaagacgccaacagaacttctag

SEQ ID NO: 26620 - DNA, 1392 bp, Artificial Sequence
  Description of Artificial Sequence: Synthetic coding sequence
atgaagatcatggacagcgagctgatgcacagcatcgtgggcagctaccataagcctcccgaacgagtcttcgttccctccttcacccagaatgagccatctcagaattgccatcccgccaaccttgaagttacgtctccaaaaatcctgcactcacccaatagccaagctctgatcttggccttaaaaaccctgcaggaaaaaatccatagactggagttggagaggacacaagcagaagataacctgaacatcctgtcccgcgaggccgcacagtataaaaaggcactcgaaaatgagactaatgagcgaaaccttgcccaccaggaactcatcaagcagaagaaggatattagcatacaactgagttcggctcagtcccgctgcacgctcctggagaagcagctggaatacacaaaacggatggtactaaatgtcgagcgagagaaaaacatgattctagagcaacaggcccagctgcagcgagagaaagaacaggaccaaatgaagctttacgctaaactggagaaactggatgtccttgagaaggaatgcttccgcctgacaacgacgcagaaaactgccgaggacaagattaaacacctggaagaaaagctaaaggaggaggaacatcagcgaaaactcttccaggacaaagctagcgaacttcaaactgggctcgagatttccaagataattatgtcttccgtgtcaaacctcaagcactccaaggagaaaaagaaatcctccaagaaaaccaagtgtattaagcgcaggccaccgtggcagatctgttccaagttcggggccctgccctttgttgctgagaagatgcgccagcaccgggatccccacatcctgcagaagccattcaatgtgaccgaaacacgctgcctacctaagccctcaaggaccaccagttggtgtaaggctattcccccagactccgagaaaagcatctcgatctgcgataatctgtccgagctgctgatggcaatgcaggacgagctcgaccagatgtcaatggagcatcaggagctgcttaagcagatgaaggaaacggagtcacattcggtctgcgacgacatcgagtgtgagctcgagtgcctgttgaaaaagatggaaataaagggagagcagatcagcaaactgaaaaaacaccaggacagtgtttgtaagctgcagcagaaagtacaaaatagcaagatgtctgaagcatctggcatccaacaagaggatagctatcctaaaggcagcaagaacatcaagaactctccaaggaaatgtctgacggatacgaacctgttccagaaaaactcctctttccatccgatcagagtccacaatctgcagatgaagctgcggagagacgacataatgtgggagcaatag

SEQ ID NO: 26621 - DNA, 1050 bp, Artificial Sequence
  Description of Artificial Sequence: Synthetic coding sequence
atggaggacccccagagcaaggagcccgccggcgaggccgtggccttagctctcctggagtcccctaggccagagggcggcgaagagccccctcggccctccccagaagagacccaacagtgcaagttcgacggacaggaaaccaagggaagcaagtttataacatcctccgccagcgatttcagtgacccggtctataaggagatcgcgatcacaaatggctgtattaatcgaatgagcaaagaggaactgcgcgcgaaactcagcgagttcaaactagagacaagaggagtgaaggatgtgttaaagaaacgcttgaagaactactacaagaaacagaaacttatgctcaaggagtcaaatttcgcggattcctactatgactacatttgtatcattgactttgaagctacatgtgaggagggaaatcctccggaatttgtgcatgagatcatagagttcccggtggtgcttcttaatactcatactctggagattgaggacacttttcagcagtacgtgaggcccgaaatcaacacacagctgtctgacttctgtatcagtctaactgggatcacccaggatcaggtggatcgggctgatacatttccccaggtgttaaagaaggtcattgattggatgaagctcaaggagctaggtactaaatacaagtatagcttactgaccgatggaagctgggacatgtccaagtttttgaatatccagtgccagcttagcagattaaagtaccctcccttcgcaaaaaaatggatcaacatcaggaaatcttacggcaacttctacaaggtcccccgcagccagacaaaactcacaattatgctggaaaaactgggaatggattacgacgggagaccccactgtggactcgacgactctaagaatatcgcacgaattgcagtgaggatgcttcaagatggatgcgaactccggattaacgaaaaaatgcacgcagggcagcttatgtctgtgtcctcgtctctgcctattgagggcacaccccccccccagatgccacattttcgtaagtag

SEQ ID NO: 26622 - DNA, 636 bp, Artificial Sequence
  Description of Artificial Sequence: Synthetic coding sequence
atgtgccccggcaactggctgtgggccagcatgaccttcatggccaggttcagccgcagctcatccaggagtcctgtgcggacccggggaaccctagaagagatgccaaccgtgcagcatccttttctaaatgtgttcgaactcgagaggctcctgtacacggggaagacagcgtgtaaccacgccgacgaggtgtggcccggcttgtacctcggcgatcaagacatggccaataataggcgtgagctgcggagattggggattacccatgtgcttaacgcgtcacactctcgttggcgcggcactccagaagcttacgaggggctaggcatcaggtacctcggcgttgaggctcatgacagtcctgccttcgacatgtctattcactttcaaaccgccgctgactttatacaccgagcactgagtcagcctggcgggaaaatcctcgtgcattgcgccgtcggagtgagtagatctgctactctcgtcctggcgtaccttatgttgtaccatcacctgaccctcgtcgaagccattaagaaggtaaaggatcatcgcggcattataccaaacagaggattcttgcgccagctactcgctctggataggagactcaggcaaggcctcgaagcttag

SEQ ID NO: 26623 - DNA, 438 bp, Artificial Sequence
  Description of Artificial Sequence: Synthetic coding sequence
atgatccccatctggaagcagcaggcccggcccggcgacggccccgtgatttgggactaccatgtggttctcctccatgtgtcatctggcggtcagaattttatctacgacttagatacagtactgccttttccttgcttgttcgacacctatgtcgaagacgcctttaaaagcgacgacgatatccatcctcagtttcggagaaaattccgggttatccgtgcagatagttacctcaagaatttcgcaagcgaccggagccatatgaaagacagctcagggaactggagagagcctcctcccccctatccttgtatcgaaaccggagactccaagatgaatctgaatgacttcatctcaatggatccgaaggtcggatggggtgccgtgtatacattgtccgagtttacccaccggtttggctcaaaaaactgctag

SEQ ID NO: 26624 - DNA, 258 bp, Artificial Sequence
  Description of Artificial Sequence: Synthetic coding sequence
atgagcgacaagagcgacctgaaggccgagctggagcggaagaagcagcgccttgcacagattagggaggaaaagaaacgaaaggaggaagaacgaaagaagaaggaagccgatatgcagcagaaaaaagaaccagtgcaagacgattccgacttggacaggaagcggcgcgaaactgaagcactgctacagagtattggaattagtcctgaaccaccgcttgtgcccaccccaatgtcgccatcctctaaaagctag

SEQ ID NO: 26625 - DNA, 588 bp, Artificial Sequence
  Description of Artificial Sequence: Synthetic coding sequence
atggacagcgagctgatgcacagcatcgtgggcagctaccacaagccgcccgaacgagtattcgttccatcttttacacaaaatgagccttcacagaactgtcaccctgcaaacttggaggtgacctcccccaaaattcttcactcaccaaattcccaggctctcattctggccttgaagacattgcaagagaagattcatcggcttgaattagaacgtacccaagccgaggataacttgaacatactgtctagggaagccgctcagtataaaaaagcactcgaaaatgagactaatgaacggaacttggctcaccaggaactaatcaaacagaagaaggatatcagcatacagctttcatcggcccagagccggtgcaccctacttgaaaagcaacttgagtacacaaagagaatggtcttaaacgtcgagcgcgaaaagaatatgatccttgagcagcaggcgcaattgcaaagagaaaaagagcaagatcagatgaagctctacgcgaaattagagaagctggacgtcttggagaaggaatgctttagactcacaaccacgcagaagaccgccgaggacaagtag

SEQ ID NO: 26626 - DNA, 1272 bp, Artificial Sequence
  Description of Artificial Sequence: Synthetic coding sequence
atggaggacaagcggagcctgagcatggcccggtgcgaggagcggaactcccgaggtcaagaccacggcctggagcgagttccatttccgccccagctgcagtcagaaacttatctgcaccctgccgacccaagtcccgcctgggatgacccagggtctacagggagccctaacctgaggttgttgacagaagagatcgcgtttcaacctttagccgaagaagccagttttagaagaccccatcccgatggtgacgttcccccacagggagaagacaatctgctatcgctaccatttcctcaaaagctctggagactggtaagctctaatcagttcagcagcatctggtgggacgacagcggcgcctgtagagtgataaatcaaaagctgttcgagaaggagatactgaaaagagatgtggcccataaagtattcgctacgaccagcatcaagtcgtttttcaggcagttgaatctgtacgggttccgcaaacgccgacagtgcacctttagaacttttacacgcatcttttcagcaaagcggttagttagcatcttgaacaagttggagttctattgtcatccgtatttccagcgtgacagcccacaccttctggtccgcatgaagcggcgagtgggcgtaaagtctgcacctagacaccaggaagaggacaaaccggaagctgcgggatcatgtcttgctccagctgatacagagcagcaggaccatacaagccccaacgaaaatgatcaggtgaccccgcagcacagggagccggccggaccaaacacacagatacgctctgggtccgcccccccagccacccccgtgatggtcccggattccgccgtggcttctgacaactccccagtgacccagcctgccggcgaatggtctgaaggaagccaggctcacgttacccccgttgccgcggtccctggaccagccgctctcccattcctgtacgtccccgggagtcctacccaaatgaattcttacgggcctgtcgtggccctgccaactgcctcccggagtacactggcaatggatacaaccggtctccctgcgccaggaatgctgcccttctgccacctgtgggtgcctgtcaccctcgtcgctgcaggagccgcccaaccagccgcttccatggttatgtttccacaccttcccgccctgcaccaccattgtcctcactcccaccggactagccaatacatgcccgcatcagacggaccccaggcttatccagactatgctgaccagtccacctag

SEQ ID NO: 26627 - DNA, 2097 bp, Artificial Sequence
  Description of Artificial Sequence: Synthetic coding sequence
ggcgtgggcggccggggcgagcggctgccccggggcttcgcccgggtagtccgcgtggcatccgaagggtccgtgcgcaggccctcagggcctgtgccggctccgcaaccccctgcgttcaggtttgtttcccgccctggaagggccagatccgaatccgagaccttggagcggagccctccgcagagccccggacccgggaaagccggggacgcccccaatcggagaagtggacatgtccgaggtgcacgggtactgagcccaccggggcgaagagcacgattgtctagtcccgggccctctaggagttcagaggctagagaagagttgagaaggcatctggtaggactgattgaacggagccgcgtggtgatattctcaaagtcctattgccctcacagtactagggtaaaagaactcttctcaagtctgggcgttgaatgcaacgttctcgagctggatcaggtggatgacggcgcacgcgtccaggaagtgctgtccgaaataacaaatcagaagacagtcccgaatattttcgtgaataaggtacatgtcgggggatgcgaccagacgttccaggcctaccaaagcgggctgctccaaaagctgcttcaggaagacctagcatatgactatgacctcatcattatcgggggagggagtggaggtctgtcttgcgcaaaagaggctgccattctcggtaaaaaagttatggtgcttgattttgtagtcccaagcccacagggtacctcctggggcttaggcggaacctgcgtcaatgtcggttgcatcccaaagaagttgatgcaccaggcagccctgctgggtcaggcactgtgtgacagcagaaaatttgggtgggagtacaaccagcaggtgcgtcacaactgggagactatgacaaaggctatccagaatcacatttcttctctcaactgggggtaccggctttcactgcgtgaaaaagccgtggcctatgtgaactcttacggcgaattcgtcgaacaccataaaataaaggccaccaacaaaaaaggccaagaaacatattacacagctgcacagttcgtgattgccacgggcgaacgaccgcggtacctgggcatccagggcgacaaagaatattgtatcacctcggacgatttgtttagcctgccctattgccccgggaagacactagtggtgggcgcatcctacgttgccctggaatgcgcgggattcctagctgggtttggtctagacgtgaccgtgatggtccgctctattctgctgagaggcttcgaccaggagatggccgaaaaggtgggctcctacatggaacagcatggagtgaaatttctgcggaagtttattcctgtgatggtccagcagctcgagaaggggtctcccggtaaactgaaggtgttagccaagtccacagagggaaccgagaccattgaaggcgtttataacacggtgctcctggcaatcggaagagactcttgtacacgcaagattgggttggaaaagatcggagttaaaatcaacgaaaagagcggcaaaataccagtaaacgacgtggagcagaccaacgttccatatgtctatgccgtgggcgacattttggaggataagcccgaactgacacccgtagctatccagtctggcaagttgctcgcccagagactgttcggtgccagcctggaaaaatgcgactatataaatgttcctaccacggtcttcacgcctctggagtacggctgttgtgggcttagtgaggaaaaagcaattgaggtgtacaaaaaggagaacctggagatctaccacacactgttttggcctcttgagtggacagtggccgggagggagaacaatacctgctatgcaaagattatctgtaacaagtttgaccacgaccgcgtaatcggcttccatatccttggcccaaacgctggggaggttacccagggcttcgccgccgcaatgaagtgcgggctcacaaagcagctactggacgacacaatcgggatacacccaacatgcggcgaggtgttcacgaccctggaaattacgaagagctctgggctcgacattacccagaagggttgcugaggctag

SEQ ID NO: 26628 - DNA, 609 bp, Artificial Sequence
  Description of Artificial Sequence: Synthetic coding sequence
atgaccggcagcaacagccacatcaccatcctgaccctgaaggtgctgccgcacttcgagtcattgggcaagcaggaaaagattcccaacaaaatgagtgcctttcgtaatcactgtccgcatctggacagtgtgggcgagataactaaagaagaccttatccagaaaagcctggggacgtgccaggactgcaaggtccagggaccaaatctgtgggcctgcttggaaaaccgatgtagctatgttggttgcggggagagtcaagtggatcatagcactattcacagtcaggagacaaagcattacctgactgtgaacctcactacactgcgagtatggtgctatgcctgctccaaggaagtgttccttgaccgaaaactcggcacccagccatccctgcctcatgtgcggcagccgcaccagattcaagagaacagcgtgcaagattttaagatacctagcaacactacgctgaagactcccctggtcgcggtgtttgatgatctggacattgaggcagatgaggaggatgagttgcgagcaagaggactgactggactgaagaacatagggaatacatgctacatgaacgccgccctccaggcctag

SEQ ID NO: 26629 - DNA, 1443 bp, Artificial Sequence
  Description of Artificial Sequence: Synthetic coding sequence
atggagaccgacctgaacagccaggaccggaaggacctggacaagtttattaagttctttgcgctcaagacagttcaggtcatcgtgcaggcacgtctcggcgaaaagatttgcacacggtcttcctcatcgcctaccggcagtgattggttcaatttggctattaaagacatacccgaggttacccatgaagcgaagaaagccctagcaggacagctgcctgccgtgggccggtccatgtgcgtggaaatctccctgaaaacatcggagggagactctatggagctcgagatttggtgtctggaaatgaacgagaaatgcgacaaggaaatcaaggttagctacacagtctataataggctctctctgcttctgaagtcccttctcgcaatcactagggtgacacccgcctatagacttagtagaaaacaagggcacgaatatgtcattttgtataggatttacttcggggaagtccaactttcgggcctgggcgaggggttccagaccgttcgtgtgggaaccgtaggcacccccgtcggaaccattaccctgtcatgtgcatatcgaatcaacttagccttcatgtctaccaggcaatttgaaaggaccccaccaatcatggggattataatcgatcattttgtagacagaccttatccatccagtagcccgatgcacccctgtaactacagaaccgccggtgaagacaccggagttatctacccctcggtggaggactctcaggaagtctgcacaacaagcttctccacctctccaccctctcagctcatggtgcccggtaaggaaggcggcgtaccactcgcccctaaccaacccgttcatgggactcaagccgaccaggagaggctggcaacttgtacgcctagcgaccggacacactgtgcagcgactcctagcagctccgaggataccgagaccgtgagcaacagtagcgagggccgggcatccccacatgatgtgctggagacaatctttgtgagaaaagttggagcctttgtgaacaaaccaattaatcaagtgactctgacttctctcgacataccattcgcaatgttcgcacctaagaacctggagctcgaggacacggatcctatggtgaatcctcccgattcccctgagactgaaagcccacttcaggggagccttcactcagacggatcaagtggaggctcaagcggaaacactcatgatgatttcgtaatgatagatttcaagcccgcctttagtaaggacgacatcctacctatggatttggggaccttctaccgcgaattccaaaatcccccacagctgagttcactgtcaatcgacattggtgcacagagcatggccgaagatctcgactcgctccccgagaagctggcggtgcacgaaaagaacgtccgtgaattcgacgcgttcgtcgagactttgcaatag

SEQ ID NO: 26630 - DNA, 309 bp, Artificial Sequence
  Description of Artificial Sequence: Synthetic coding sequence
atgctgagcgaggaggagaaggaggagctgaaggccgagctggtgcagctcgaagatgagatcacgactttaaggcaggtcctcagtgcgaaggagaggcaccttgtggaaatcaagcagaagctcggaatgaacttgatgaatgagctgaaacagaatttttcaaagagttggcatgacatgcagaccactaccgcctacaaaaagactcacgagaccctgtctcatgcaggtcagaaggctactgccgctttttcaaacgtaggtacagctattagcaagaagttcggagacatgaggaggaagtag

SEQ ID NO: 26631 - DNA, 318 bp, Artificial Sequence
  Description of Artificial Sequence: Synthetic coding sequence
atgagccagagcggcgccgtgagctgctgccccggcgccaccaacggtagtctgggacgcagtgacggcgtcgccaaaatgtcgcccaaggacctgtttgagcagcgtaagaagtattcaaactccaacgttattatgcatgagacaagccagtaccatgttcaacacctggcaacattcattatggacaagagcgaggccatcacaagcgtagacgacgcaatacggaaacttgtgcagctgtccagtaaagagaagatatggactcaagaaatgcttctacaggttaacgaccagtccctgaggctcctggactag

SEQ ID NO: 26632 - DNA, 222 bp, Artificial Sequence
  Description of Artificial Sequence: Synthetic coding sequence
atgagcgccttccggaaccactgcccccacctggacagcgtgggcgaaattaccaaagaggatttaatccagaagagcctgggtacttgtcaggattgcaaggtccagggccctaatctgtgggcgtgccttgagaatcgatgcagctatgtcggctgtggcgagagccaggttgatcattcaacgatccacagccaggagactaaacattatctgacatag

SEQ ID NO: 26633 - DNA, 276 bp, Artificial Sequence
  Description of Artificial Sequence: Synthetic coding sequence
atggccatgaccgtggtgaccaaggagaagaacaagaaggtgcccacgatctttctgagtaagaagccccgtgaaaaggaggtggatagtaaatcccaggtcatagaaggaatttccaggctgatatgctctgctaagcagcagcagacaatgttgagggtttcaatcgacggcgtggagtggtccgacatcaagttcttccaactagccgctcagtggcctacacacgtgaagcattttcctgtcggccttttcagcggcagtaaggccacttag

SEQ ID NO: 26634 - DNA, 2535 bp, Artificial Sequence
  Description of Artificial Sequence: Synthetic coding sequence
atgttctggaagttcgacctgcacagcagcagccacatcgacaccctgctcgaaagggaagacgtgactcttaaggagctaatggatgaggaggatgtactacaggagtgcaaagcccagaatcgcaaactaatcgagttcctattgaaggccgagtgtctggaagatctcgtctccttcatcatagaggaaccacctcaggatatggacgagaagatccgctataaatatcctaacatttcttgtgagcttttgaccagcgacgtatcgcagatgaacgatcgcttgggagaggacgaatcattactgatgaaactctattcattcttgctcaatgattcacctttaaacccacttctcgcgagcttcttttctaaggttctcagcattctgattagccggaagccggaacagattgtcgacttcctcaaaaagaagcatgattttgtggatctcataattaaacatatcggaacctctgcgatcatggatttgctgttgaggctgctgacatgtatcgagcctccacagcctaggcaggatgtgctgaactggttgaacgaggaaaagatcatccaacggctggtggagatagttcacccaagccaggaagaagaccgacacagtaacgcctctcagagtctctgcgaaattgtacgattgagcagggaccagatgctgcaaatccagaattcaacggagcctgatccactgctcgccacactcgagaaacaggaaattattgagcaattattgtccaacatcttccacaaagaaaagaatgagtctgctatagtctctgccatccagatccttctgacactccttgagactaggcggcctacctttgaaggacacatagagatctgcccccccggcatgtcccactcagcttgttctgtcaataaatccgtcctggaggcaatcagaggccggctggggagttttcacgagctgctcctagaaccgcccaagaagtcagtcatgaagaccacctggggggtgctggatcctcctgttggcaacacaagactgaatgtaatcagacttatttcctcgttgctccaaaccaacacatcaagcattaacggggatctcatggaattgaattccatcggtgtcatattaaacatgttcttcaaatacacttggaacaactttctgcacactcaggtggaaatctgcattgccttgatcctggctagtcccttcgaaaacacagagaatgctactataactgaccaggacagtaccggtgataatctcctactgaaacatctgtttcagaaatgccagcttattgaacgcattctggaggcatgggagatgaacgaaaaaaaacaggccgaggggggcagaaggcacggctacatggggcacctcactaggattgctaattgtatcgtacattctaccgacaagggaccaaattccgccctggtgcaacagttaatcaaagatctaccagatgaggtcagggaacggtgggaaaccttttgtactagtagcctgggtgagactaacaaaaggaacacagttgacctggcattctctgattatcagatgcagcagatgaccagtaactttattgatcagttcgggtttaatgatgagaagtttgctgatcaggatgatatcggcaacgtcagttttgatagggtttctgacatcaactttacgctcaacaccaatgagagtgggaacattgccctctttgaagcctgttgtaaggagcggatccagcagttcgacgatggcggatctgatgaggaagatatctgggaggagaagcacattgcttttacgccagagagtcagcggaggagctcctcagggtcgacagatagtgaagagtcaacagattcagaggaggaagatggcgctaagcaggatctgttcgaaccgagttcggctaatactgaggacaaaatggaggtggatttatcggagccacccaattggagtgctaacttcgacgtccccatggagacgacccatggagctcctctggactctgtaggatctgacgtgtggtctacagaggagccaatgcctaccaaggagaccggttgggcgtccttcagcgagttcacctctagcctttccacaaaggactccttgagatctaatagccccgtagaaatggagaccagcaccgaacctatggaccccttaacccccagcgctgccgctttggcggttcagcctgaggcagctggttcagttgctatggaggcttcctcggatggcgaggaagacgccgagtcaaccgacaaagtgacggaaaccgtcatgaacggtggtatgaaagaaaccctgagcctgaccgtggatgccaaaaccgaaaccgccgtgtttaagagtgaagaaggaaagctatccacctcgcaagacgccgcttgtaaggacgccgaagagtgtcctgagaccgccgaagcaaaatgtgcggctccacgcccacccagctcctctccagaacaacgcacaggccaacctagcgctccaggggacaccagcgtaaacgggccagtttag

SEQ ID NO: 26635 - DNA, 2604 bp, Artificial Sequence
  Description of Artificial Sequence: Synthetic coding sequence
atgttctggaagttcgacctgcacagcagcagccacatcgacaccctgttggaaagagaagatgtgaccttgaaggagttgatggatgaggaggatgttctccaagaatgcaaggcacagaatcgaaaactgatcgagttccttctgaaggcagaatgcctggaagatttagttagctttatcatcgaagagcctcctcaggacatggacgagaaaattcgctacaaatatcctaatatttcgtgcgagcttctgaccagcgatgtgtcccagatgaacgatcggctgggcgaggacgaaagcctactaatgaagctctacagtttcctcctgaatgatagtccattaaaccctctgttggccagcttctttagcaaggttctgtcaatcttaatttcccgtaaacccgagcagattgtagacttcttaaagaaaaaacatgacttcgttgacctgatcatcaaacatatcgggacttcagcaatcatggacttgctgttgagattgttaacctgtatagagcccccacaaccccgccaggacgtccttaattggctcaacgaagagaagatcatacaaagactggtagaaatcgtccacccatcccaagaagaggacagacattccaacgcttcccagtcgctctgtgagattgtgcgtttgtcgcgggatcaaatgctgcagatccagaatagtacagagcccgaccctctgctggcaacattagaaaagcaggagatcatagaacagctactgtcaaatatctttcacaaggagaaaaatgagagcgcaatcgtgagtgccattcagatactccttacattgcttgagacacgtcgccctactttcgaaggccacatcgagatatgtccgccaggaatgagccactctgcttgcagtgtaaacaagtccgtgctggaggctattcggggacgcctcggctcatttcacgaactccttctagagcctcccaagaagagcgtgatgaagacaacctggggtgtgctggaccccccagtgggtaacactagactaaacgtgatccgccttatctcatcactcctgcagaccaatacttcatccatcaacggggacttgatggagctgaactccatcggagtgattttgaacatgttcttcaagtatacatggaataactttcttcacacccaggtagagatctgtattgctcttatcctggctagtccgttcgaaaacacggagaacgcaactattacggatcaggattcaacgggagataatctccttcttaaacacctctttcaaaaatgtcagctgatcgagagaatcttggaggcttgggagatgaacgagaagaagcaggctgagggcggtcgaagacatgggtacatgggacatctgacgcgtatcgctaattgcattgttcattccacagataagggtccaaactctgcattggtccagcagctgataaaggacctgcccgatgaggtaagggagcggtgggagacattctgtactagcagcctcggggagactaacaagcggaataccgtggacctagttaccacttgtcatattcactctagctcagatgacgagatagatttcaaggagacaggtttctcacaggactcctcacttcaacaaatgcaacagatgacttccaatttcatagatcagtttgggtttaatgatgagaaattcgctgaccaggacgatatcgggaatgtttcattcgatcgcgttagtgacattaacttcaccctcaacaccaacgagtccgggaatatagctctgtttgaggcttgctgcaaggaacggatccaacagttcgatgatggagggagcgatgaagaagatatttgggaggaaaagcacatcgctttcacgcccgaatcccagcgtcgttcctcctcaggatctacagattctgaggagtcaacagacagcgaggaggaagacggggccaagcaggacctatttgaaccttcatctgccaatacagaagataaaatggaggtggacttatccgagccccccaattggagtgcaaactttgatgtacctatggagaccacccacggagccccactcgattctgtggggtccgatgtgtggagcactgaggaaccaatgccaaccaaggagacaggatgggcttcgttctctgaattcacttcttcactgagtactaaggacagcctgcgcagcaacagtccagtggagatggagacctccacagagccaatggaccctctgacaccatcagctgccgcactggccgtccaacccgaagcggctggcagcgtggccatggaagcctccagcgacggtgaggaggacgccgaatcgacagacaaagtgaccgagacagtcatgaatggcgggatgaaggagactttgagcctgaccgtcgacgccaaaactgagaccgccgtgttcaagagcgaagaaggaaagcttagtacttctcaggacgcagcatgtaaggatgccgaagagtgtccagagactgctgaggcaaaatgcgccgccccccgcccaccaagttcctctccagaacagcggaccggccaaccatcagcacctggtgatacctccgtcaatggtcctgtttag

SEQ ID NO: 26636 - DNA, 174 bp, Artificial Sequence
  Description of Artificial Sequence: Synthetic coding sequence
atgaccagcaagaagctggtgaacagcgtggccggctgcgccgacgatgccttggcagggctagtggcctgtaatcccaacctgcagctcctgcagggacatagagtggctcttcgaagcgatttggactccctcaaaggtcgcgttgccctactttcaggcggaggctcctag

SEQ ID NO: 26637 - DNA, 2709 bp, Artificial Sequence
  Description of Artificial Sequence: Synthetic coding sequence
atgttccccgccctggagacccacctgaagcagaccatccccgacccctacgaagatttcatgtacaggcacctgcagtattacggctatttcaaggcccagagaggttctctgccaaactccgcaacgcatcagcatgtccgaaagaataacccgcaatgtttattaaacgggagcctcggcgagaaggatgatctgatccccgacacgctgcagaaggaaaagctactctggccaatcagcctgagctccgctgtgcacagacaaattgaagctatcaatcgtgactttcactcatgtctgggttggatgcaatggcggggactatccagtctgcagcctccaccccctcggttcaaagactccccagcctctgccttcagagtggccgggatcaccgactctcacatgttaagccttccacatttacgaagccggcagcttctgtatgatgagctcgatgaggtcaatccaaggctcagagagcctcaggaacttttttctattctctccacaaagcgcccgctccaagctcctcggtggcccatcgagtgcgaagttatcaaggaaaacattcatcacatcgaatgggcccccccccagcctgaatacttctatcaacctaagggcaacgagaaggtgcctgagatcgtcggtgagaagaaagggacggtagtttatcagctggatagcgtgcccatcgagggcagctactttacgtcgagtcgcgtcggaggtaagcgaggaatagtgaaagaactggctgtaacgctacagggtccagaggacaacacactgctctttgaatcgcgttttgaatccggcaatctgcaaaaggccgtaagggtcgacacttacgaatatgaactgacactgcgcactgacctgtatacaaacaagcacacacagtggttctactttagggtgcagaatacccgcaaagacgctacttataggttcactatagtcaacctcctgaaaccaaagtcactttacaccgttggtatgaagcctctgctgtacagccagctggacgcgaatacccgaaatatcggttggcgccgagaagggaacgaaattaagtattataaaaataacacagatgatggtcagcaaccattttactgcctgacctggaccattcagttcccatatgatcaggacacatgtttttttgcccacttctacccatatacatacacggacctgcaatgttacctgctgtcggtagctaacaaccccatacagtcccaattttgcaaattgcaaaccctgtgtcgctctctggccggaaacaccgtctacttgctcacaattaccaacccatcgcaaaccccccaggaagcagccgccaaaaaagccgtcgtcttgagcgcacgcgtacaccccggcgaaagcaatggctcatgggtcatgaagggcttcctggacttcatactctcaaatagcccggacgcccagttgttgcgagatatcttcgtcttcaaagttctacctatgctaaacccagatggcgtgatagtcggcaattatcggtgctcattggccgggagagacctgaacagacattataagacgatcctcaaagagtcctttccgtgcatttggtacacccgcaatatgattaaacgtctgctggaggagcgcgaagttctgctgtactgtgattttcacggtcatagtcgcaagaacaatatcttcctctacgggtgcaacaacaacaaccgtaagtactggcttcacgagagggtctttcccctcatgctctgtaaaaacgccccggacaagttctcctttcattcctgcaacttcaaggtgcagaagtgcaaggaaggcacggggcgtgtggtaatgtggcgtatgggaatcctgaacagttacactatggaaagcacttttggggggagcacactcggaaataagcgcgacacccactttactatcgaagacctgaagtccctgggataccacgtctgtgatacattgcttgacttctgtgatcctgatcagatgaaattcacacagtgcctggccgaactgaaggaactgctcagacaggaaattcacaaaaagttccacgaactcggccaggacgtggacctggaggggagctggtccgacatttcactgagtgacatcgaatccagcacatctgggagtgattccagcctgtccgatggtctgcccgtccatctagcaaatattgctgacgagctaacccaaaagaaaaagatgttcaaaaaaaaaaagaagaaatccctgcagacgcggaagcagcggaacgaacagtaccagaaaaagaatctgatgcaaaagttgaaacttacagaagacacatctgagaaggccgggtttgcctcaacccttcagaagcagcctacgtttttcaagaattctgaaaactctagctttttacccatgaagaatgagaatcccagacttaatgaaacaaacttgaaccgccgagataaggataccccgctggacccctcaatggccactttaattctccctaagaataagggacggatgcaaaataaaaagcctggctttacagtgtcgtgctccccaaagagaaccatcaacagttcccaggaacccgcacccggaatgaagcctaattggcctcgaagccgttaccccgccaccaaacgagggtgcgccgcaatggctgcctacccgagcctgcacatctatacatatccgtag

SEQ ID NO: 26638 - DNA, 537 bp, Artificial Sequence
  Description of Artificial Sequence: Synthetic coding sequence
atgaaccggcggcggaagttcctgctggccagcgtgctggccctgcagaacagctctttcatctacccctcatgccaaaaatgttttagtcggataatcttggtgtctaagaggtcaaactgccctaagtgcgggtcgactggagaatccggcaatgctaactatcgatacaagctctccctgaaagtggcagagtcgaataagcttttcgtcatcactgtttttggaagctgtcttgatactttctttggcctcaccgctaccggtttgcaccgatacatccaggacccaaacaaaattccggaaacgctggataacgacaccacacagaacctgctcactaaggctgtggaaacatgttttgtaggacagagctttattttcggcgtgaccaattttgagaatcagcctggtcagggaagcgacgcttcaaacttcttgcagcagtgttctgaccataaaagaaaggctaaggccctcgtggcttgtcaaattgttctgccagatcccgcaacacaggatgccaagaccaaatag

SEQ ID NO: 26639 - DNA, 441 bp, Artificial Sequence
  Description of Artificial Sequence: Synthetic coding sequence
atggtggccatggccgaggccgaggccggcgtggccgtggaggtgaggggcttgccgccagctgtcccagatgagctgctcacactatacttcgaaaacagaagacgcagtggcggtggccctgtcctgtcgtggcagcggttgggctgcggcggggtgctgacctttcgagagcctgcagacgcagagagagttttggcacaggccgaccacgagctgcacggggcccagctcagcctgcgccctgccccaccacgggcacctgcccgcctgctgctccaggggcttccacccggcactactccacagcgtttagagcagcacgttcaggccctcttgcgcgccagcggtttgcctgtacagccttgctgcgccctggctagcccgcggcctgaccgagctttggtgcagctgcccaagccactctctgaggcaggttag

SEQ ID NO: 26640 - DNA, 348 bp, Artificial Sequence
  Description of Artificial Sequence: Synthetic coding sequence
atggccggccggcccctgcggatcggcgaccagctggtgctggaggaggactatgatgagacctatattccctcggaacaggagatcctcgagtttgctagggagataggaatagaccccattaaggagccagaacttatgtggctggcacgtgaggggatcgtcgcacccctgcctggagaatggaaaccatgtcaagacatcacaggcgacatttattactttaacttcgcaaacggacagtccatgtgggaccacccatgtgacgaacactacagatcattggtcatccaggagcgagctaaactgtctacatccggcgcgatcaagaaaaaaaagaagaagtag

SEQ ID NO: 26641 - DNA, 1191 bp, Artificial Sequence
  Description of Artificial Sequence: Synthetic coding sequence
atgcggaccagctacaccgtgaccctgcccgaggacccccccgccgcacccttcccagctctggccaaggagctgaggccgagatcccctctgagcccctcgcttctgctatcaaccttcgtaggactgcttctgaataaagcgaagaacagcaagagtgctcagggcctcgctgggcttcgcaatctgggaaatacttgttttatgaattccatcttgcagtgtctgtccaatacacgggagctgcgagattactgtctccaacggctgtatatgagagatctccatcacggaagcaacgctcacacggcgctcgtggaagagtttgccaaactcatacaaacaatttggaccagctcccctaacgatgtcgtgtccccttctgaattcaaaacacagatccagcggtacgcacctcgcttcgtcgggtacaaccagcaggatgctcaggagtttctacgatttttattggacggcctccacaacgaagtaaaccgggtcactctccgccctaagtccaatcccgagaatttagatcatctgcccgacgatgagaaggggcggcagatgtggcgcaaataccttgaaagggaggactctagaatcggtgatctgtttgtgggacagctgaagagcagtttaacatgcactgactgtggctattgcagcaccgtgtttgatcccttctgggacctgtccctgccaatcgcgaagagaggctaccccgaagtgactctcatggactgcatgaggctgtttactaaagaggacgttttagacggggatgaaaaacccacgtgctgccgatgtcgcggcagaaagcgctgcattaaaaaattctcaatccaacgattccctaaaattctggtccttcacctgaagagattcagcgagagtcggatccgtacctcaaaactaactacgttcgttaacttcccacttagggatctcgacctccgcgagtttgctagcgaaaatactaaccacgcggtctacaacttgtatgctgtgagcaatcattcaggaacaactatgggaggccattacaccgcttattgtcgttcaccaggaacgggcgagtggcacaccttcaacgattcatccgtgacccccatgagttcttctcaggtcagaacctccgatgcttacctattgttctatgagctggcaagtcccccatcaaggatgtag

SEQ ID NO: 26642 - DNA, 633 bp, Artificial Sequence
  Description of Artificial Sequence: Synthetic coding sequence
atggccgccagcgtggagcagcgggagggcaccatccaggtgcagggccaggctttgtttttccgcgaggcactgccaggctcgggtcaggctcgattctcagtactgcttttacatggcattcgttttagctctgaaacctggcagaacctcggaactctccaccggctcgcccaggccggctacagagccgtggctatcgatcttccggggctcggacatagcaaggaagccgccgctccagcgcccattggggaattagccccgggctccttcctggctgctgttgtggacgccctggagttaggccctcctgttgttatctcaccctcactctctgggatgtactcactcccatttctcacagcacctggaagccagttgcctgggtttgttcctgtggcacccatctgcacagataagatcaacgccgccaattatgccagcgtaaaaacgccagccctgatcgtgtatggtgaccaggaccccatgggtcaaacatccttcgagcatctcaagcaactgcccaaccacagagtgttgatcatgaaaggcgccgggcatccatgttatctagacaagcctgaggagtggcacactggtctgctggattttctgcaggggctgcaatag

SEQ ID NO: 26643 - DNA, 1428 bp, Artificial Sequence
  Description of Artificial Sequence: Synthetic coding sequence
atggagctgtggcaggccgccctgagcaccctgaaccccaaccccaccgattcatgtcccctgtacctgaattatgctaccgtggctgcattgccttgccgggtctcacgacacaattcaccaagtgcagcccattttatcaccagactggttagaacctgcctcccacctggggctcatcgttgtattgttatggtgtgtgaacagcctgaggtattcgcctctgcttgcgccctcgcccgcgctttcccactctttacccataggagtggagcaagcagacggcttgaaaagaaaaccgtcacggtcgagttttttctggtcgggcaggacaacggacctgtggaagttagtacattgcaatgtttggccaatgctactgacggagtcaggctagctgcccgcatcgttgatacgccatgcaacgaaatgaacacagatacattcctcgaggaaatcaataaggtcgggaaggagctgggaatcattcctacaataatcagggatgaggaacttaaaactaggggcttcggcgggatttatggcgtggggaaagcggcattacaccctccagcactcgcggtgctgtcacataccccggacggtgccactcaaacaatcgcatgggttggcaagggaatcgtatatgatacgggagggttatctatcaaaggaaagacgacaatgcccgggatgaagcgcgattgtggaggtgccgctgctgtactgggtgcctttcgagctgcgattaaacagggtttcaaggacaatctgcacgccgtcttctgtctggccgaaaactcagtcggccctaacgctacccgccccgatgatattcatctgttatacagtggaaagacagttgagataaacaatacagacgccgagggaagactcgtgctggccgacggagtgtcctatgcctgtaaggatctgggggcggacattattctagatatggcaacgctgaccggggcccagggcatcgcgaccgggaaataccacgcagctgtgttaaccaattcagccgaatgggaagcggcttgtgtcaaggccgggaggaaatgcggcgacctcgtccatccactcgtgtattgcccggaactgcatttttctgaattcacgtccgcggtggccgacatgaagaacagcgtagcagacagggataatagtccctcgagctgcgcaggtctctttatcgcttcacatatcggcttcgattggccaggagtctgggtgcatttggatattgccgcccccgtgcacgccggcgagcgcgcaacggggttcggagtcgccctgctattagccttgtttgggagggcctccgaagaccctctactaaatcttgtaagtcctctgggctgcgaggtagacgtcgaagagggggaccttggtcgggactctaagaggagacggcttgtgtag

SEQ ID NO: 26644 - DNA, 537 bp, Artificial Sequence
  Description of Artificial Sequence: Synthetic coding sequence
atggtggccatggccgaggccgaggccggcgtggccgtggaggtgcgcggtttgccgcccgctgtgcctgacgagttgctgacactgtacttcgagaaccgtcgcagatcagggggtgggcctgtgctgtcatggcagcgacttgggtgcgggggggttttgacgtttcgggagccagcagacgctgagcgggtgctggcacaggcggatcatgaacttcatggtgcccaactgagcctgcgccccgctcccccacgagcccccgctagactgctgttgcaagggctgcctcctggaacgacaccccaaagattggaacagcacgtgcaggcactgttacgtgctagcgggcttccagtacagccatgttgtgctctcgcatcccctcggcccgacagggctctcgtgcagctgcctaaaccactctcagaagctgacgtaagggtgctcgaagaacaggcccagaacctgggcctcgagggtacattggtgagtctcgctagggtgccccaagcccgcgccgtccgggttgtgtag

SEQ ID NO: 26645 - DNA, 1893 bp, Artificial Sequence
  Description of Artificial Sequence: Synthetic coding sequence
atggagaaggtgctgggctgcgagctgctgaagggcctgaacgtgctagaccttggtcttaacatggagatcctggaggagcagatgctacatgagatcctgtgtagagagtaccccgaactggaaacccgatggcaggatcttaagattagggcattggacacctgcaaggctgtggaagccgcggaggagcgactgcttactatgttgctgtttcagaaccccaagagacaaaagccagccaagtttctccggaatattgtgcgggcgcaggggaaactgtgccagttgcgtgcacattgtgaagagctggaggggcaaaagctccaggaaatggtgctctgggcaccctacagaccagtcgtgtggcatggaatggcaatggttaaagctctgtcacagcttcagaatctgttgcctctgttttgtatgtccccagaaaattggttggcggtaactaagcaggccctggactccatgaaaccgagggagataaatcacggcgaggatctggcgtctcacctcctgcagctgcgggctcacttgactcggcagctgctaggaagcacggtgactgctctgggcctgacacaggtaccacttgtgggcgcacttggtgcccttgctctgcttcaggccaccggcaaggcttctgagctcgaaagactggcgctttggccgggacttgcggctagcccatcaaccgtacattctaagcctgtgagcgacgtggcccggcccgcttggctgggaccaaaggcctggcacgaatgtgaaatgctggagttgttgcccccatttgtaggtctctgcgcctctcttgctggccactccagcgcttggcaagcctatctctccctctcctccacggtccttgggcccgcacccggccccggtcctgaaccgttaagtctgctgcagaagctgattctgtggcgggtgctgcggccagaatgcttagctggggcattggctgactttacgacctcactgttgggccggcccctggatgagaatacatatgccccgactatgccttttaaacattctcaagcaacccaaccaatgttaatcctgctaccccccccgggacatcccagcgccactctgcaccccttaacagtgatccagaagcttgctgcgaagtaccagcaggggcagaaacaattgcaagtgatcgccctgggatccgaagcatgggatcctgtgtccgtggtcgtgtctacactgtcccaagccatgtatgaaggacactggctcgtgttagataactgtcacctgatgccccattggccgaaagagctcctccaactacttctcgaactcctggggagagcaaaagtcgtagccgacctggagtcggaacagctgctagatcagcctgaaagtcggaatgtttccacagtgcacagggatttccgactctggctcattgtgcccgctgagagctcagcgtcactaccagccgttcttactcagcactccatgcctgtcttttggaaccaatctctggaacttgggcatgtgttaatagatagtgtggagctggcccaacaggttttgtatatgcagcctcctacccaggccctgccacttctgctgctccatggactactgctccatcgacaactctacggcacacggcttcaggcgcaccgtggcaggtggagccaggttaccctgacccaggtgttacagacacaggatcagctgtgggccagcttgtcaaatccacgggcagcaatgcaggaacttgctggtgaaacgttgcctctccctctgggagtgatctccccacaggagagcctggaagagggagggggagggattcagtttaccgccctagtgctcgcagtggtggaaactgaaggaacggggaccgagagattatag

SEQ ID NO: 26646 - DNA, 1488 bp, Artificial Sequence
  Description of Artificial Sequence: Synthetic coding sequence
atggagctgcacggcggcaaccggggcggctaccagcccaaggccttagagcagagtggctgttggttgtggcaggcagcactgtctacactgaacccgaacccaacagatagttgtcccctttacctgaattatgctaccgtagcggcgctaccttgtcgtgtatcacgacataatagccccagtgctgctcatttcattacacgactcgtgcgaacgtgcctcccacccggtgcgcaccggtgcattgttatggtgtgtgaacagcccgaggtgtttgcatcagcttgtgcactagctcgagccttccctttgtttacgcaccgctctggggccagcaggcggctggagaagaaaaccgtgaccgtcgaatttttcctcgtcggacaggataacgggcccgtggaagtttctaccctacagtgccttgctaatgcgaccgatggggtgaggctggcggctcgtatcgtagacactccatgtaatgaaatgaataccgacacgttcttagaggaaataaacaaggttgggaaggagctcggcatcatacctacgatcatccgagatgaggaattaaagactagaggttttggcgggatttatggagtgggcaaggctgcgctgcatccgcccgctctcgcagtgcttagccacacgccagatggggctacccagacaattgcgtgggttggcaagggcatcgtctatgatacaggcggtctctccatcaaggggaaaactacaatgcccgggatgaaacgagactgtgggggcgccgcagccgtgctgggtgcatttagggccgccattaagcagggctttaaagataacctgcacgctgtcttctgtctggctgagaatagcgtaggccccaacgcaacgcgtccagatgatatacatcttttgtattctggtaagacagtcgaaattaataacaccgacgcagaaggccgcctcgtgttggccgacggcgtctcgtatgcatgcaaggatttaggagcggacattattcttgacatggccactctgaccggtgcgcagggcattgccacaggtaagtatcacgcagctgtgctgacaaactccgccgagtgggaagccgcttgcgttaaagcaggtcgaaagtgtggggatctcgtccaccctttggtgtattgcccagaactacactttagtgaattcacaagcgccgttgccgatatgaaaaactctgtcgcggatagggacaattccccatcgtcctgtgcggggctctttatcgcttcccacatagggtttgattggcctggagtgtgggtgcacctcgacatcgccgcccccgtgcatgcgggcgaaagagcgaccggctttggcgtcgcgctgctgcttgcacttttcggtcgggccagcgaggacccattactgaatctggttagccccttgggctgtgaggtcgacgttgaagaaggcgacctggggagggatagcaagcgtcgtaggctcgtgtag

SEQ ID NO: 26647 - DNA, 618 bp, Artificial Sequence
  Description of Artificial Sequence: Synthetic coding sequence
atggagaccgacctgaacagccaggaccggaaggacctggacaagttcattaaattcttcgctctcaaaactgtgcaggtgatagtacaggcccgtctaggcgagaaaatctgcactcgtagcagctcttcacctacagggagtgattggtttaatctggcaattaaggacattccggaagtgacccacgaggccaagaaggcacttgcaggccagttaccagctgtagggcgaagcatgtgcgtggaaatcagtttgaagacttcagagggagacagtatggaactcgaaatctggtgtttagagatgaacgaaaagtgcgacaaggagataaaagtttcttataccgtctataataggctgtcgctactgctgaagagcctcctggccattacacgcgtgaccccagcctacaggctttcccgaaagcaaggccatgagtacgtgattttgtaccggatttactttggagaggtgcagctatcagggctcggggagggttttcagactgtacgggtgggaacagtggggactcccgtcgggacaattacgctgagttgcgcctatcggatcaaccttgcctttatgtcaactagacaattcgaacggaccccctag

SEQ ID NO: 26648 - DNA, 117 bp, Artificial Sequence
  Description of Artificial Sequence: Synthetic coding sequence
atggccgccttcaagctggacttcctgcccgagatgatggtggaccattgcagcctcaacagtagtcccgtcagcaagaagatgaatggcacccttgaccatcccgatcagccatag

SEQ ID NO: 26649 - DNA, 1554 bp, Artificial Sequence
  Description of Artificial Sequence: Synthetic coding sequence
atggagaccgacctgaacagccaggaccggaaggacctggacaagttcataaagttcttcgcactgaaaacagtccaggttatcgtacaggctagactgggggaaaagatttgcacccggtcgtcctcctcccctactggcagtgactggttcaatcttgccattaaagatatacctgaggtgacgcacgaggctaaaaaagctctcgcaggtcagcttcctgctgtcggacgttccatgtgcgtggagatctcacttaagacaagcgagggggattctatggaactggagatttggtgtctggaaatgaatgagaaatgtgacaaggagattaaggtttcctacacggtctacaatagattgtctttactcctcaaaagcctgctggcgatcacaagagtcaccccggcctataggcttagccgaaaacagggtcatgagtatgtcatcctgtacaggatttacttcggagaggtgcagctctctggcctgggtgaaggctttcagacggtgagggtcggaactgtcggcacgcccgtgggtacaattacgctgagttgcgcttatcggatcaacctggcctttatgagcacaaggcagtttgagcggaccccaccaatcatgggtataatcatcgatcactttgtggacaggccttaccccagctcgtcaccaatgcatccctgcaattataggactgctggcgaagatacgggcgtgatctatccctctgttgaggatagccaggaggtgtgcaccacatctttctctacatcccctccctcccaactatccagcagcagactgtcttaccagcccgccgcacttggggtcggctctgctgacctggcgtatcctgtggtgttcgccgcagggctgaatgcaactcacccgcaccagctaatggttcccggaaaggaaggaggtgtacctttagctccaaaccagcccgtccacgggacacaggctgatcaggaacgcctggctacgtgtacgcctagtgatagaacccactgtgcagccactcctagcagcagtgaggatacagaaactgtatctaatagttccgagggccgggcaagtccccacgatgtgctcgagacaatctttgtgaggaaggtcggcgcgtttgtgaacaaacctattaatcaagtaaccttaactagccttgacatacctttcgccatgttcgcccctaagaatctggagctcgaggataccgatccgatggtaaaccctcccgactcaccagagactgaatctcctctgcaggggagcttgcattccgacggtagctccggcggctcttccgggaacacacatgatgatttcgtaatgattgactttaagccagcgttctccaaagatgacattctgcctatggacctgggaactttttaccgcgagtttcaaaatccaccacagttgtcttctctctcgattgacatcggggcacagagcatggcagaggacttagacagcctccccgagaaattggccgttcatgaaaagaacgtaagggaatttgacgcttttgtggagacccttcagtag

SEQ ID NO: 26650 - DNA, 768 bp, Artificial Sequence
  Description of Artificial Sequence: Synthetic coding sequence
atggagcggagcggccagcgggtgaccacctgggactgcgaccagggcaagcactctgactccgcccagaagaacgaaagagaaagtatcagacagaagctggccttgggctcattctttgatgacggccccggaatctacacttcctgttccaaatccggtaagccctcgcttagcagcaggctccaatccggaatgaatcttcagatatgtttcgtgaatgattccgggtccgataaggactccgacgccgacgatagcaagaccgaaacaagccttgataccccactgtctcctatgagtaagcaatctagctcctacagcgacagggacaccaccgaggaggaatctgaatcgttagatgatatggactttctgacgaggcagaagaaactccaagcagaagcaaagatggcgctagccatggcaaaaccaatggccaagatgcaggtggaggtggagaagcaaaacagaaagaagagcccagtggctgatttgttgccccatatgcctcacataagtgaatgtctgatgaaaaggagcctgaaacccacagatcttcgggacatgaccattggccaactgcaggtgattgttaatgatctgcattcacagatagagagcctgaacgaagaactcgtccaattgctactcatacgggatgagcttcacacagagcaagacgccatgctggtggatattgaagatctcacccggcacgctgagtctcagcaaaaacacatggcggaaaagatgccggctaaatag

SEQ ID NO: 26651 - DNA, 78 bp, Artificial Sequence
  Description of Artificial Sequence: Synthetic coding sequence
atgagccagagcggcgccgtgagctgctgccccggcgccaccaacggatcccttggcagatccgacggagtggcttag

SEQ ID NO: 26652 - DNA, 360 bp, Artificial Sequence
  Description of Artificial Sequence: Synthetic coding sequence
atggtgctggagggcaaccccgaggtgggcagcccccggaccagcgacctccagcacaggggaaataaagggagctgcgtgctctctagcccgggtgaagatgcccaaccaggggaagagcctattaagtatggcgagcttatcgtgttgggatgttgcgaagagggcggggaggagaccgaagctcagcgaggagaggtcaccggcccccgggcccacagctgctataacggctgcctagcatctggggacaaagggcgccgtaggagccggctcgccctgtctcgacggagtcacgctaacggagttaaacccgatgtcatgcatcatataagcaccccattggtgtctaaagcatag

SEQ ID NO: 26653 - DNA, 348 bp, Artificial Sequence
  Description of Artificial Sequence: Synthetic coding sequence
atggccggccggcccctgcggatcggcgaccagctggtgctggaggaggattatgacgagacctatatacccagtgagcaagaaatactggaatttgcaagagagattgggatcgaccccatcaaggaacccgagctcatgtggttagcgagagaaggaatagtggcacctctgcctggcgaatggaagccgtgtcaagacattacgggggatatttattactttaacttcgcaaatggccaaagcatgtgggatcacccttgcgatgaacactataggtcccttgtcatacaggaaagagcaaaactcagcacgagtggagccattaaaaaaaagaaaaagaagtag

SEQ ID NO: 26654 - DNA, 471 bp, Artificial Sequence
  Description of Artificial Sequence: Synthetic coding sequence
atgagcagcgtgcagagccagcaggagcagctgagccagagcgacccttcaccgagccccaacagttgttcttcctttgaactgatcgatatggacgccggttccctctatgaaccagtttcccctcattggttttactgtaagattatcgacagcaaggagacgtggatcccattcaattctgaagacagccagcagctggaggaagcctatagttctgggaagggatgcaatggtcgggtcgtgcctacggatggcggacggtatgatgttcacctcggcgaaaggatgcggtacgccgtttattgggatgaactggcctcggaggtcaggaggtgcacgtggttctacaaaggtgacaaggataacaaatacgtgccatatagcgagtccttctcccaggtgctggaagagacatacatgctcgccgtcactttggacgaatggaaaaagaaactggagagcccatag

SEQ ID NO: 26655 - DNA, 14262 bp, Artificial Sequence
  Description of Artificial Sequence: Synthetic coding sequence
atggtgcccgaggagcggcgggtgggcctgagcagcgacgagacctcgagcgattctctcaaatcttggcattcaatttgcgtactggattcaaaagaacagcctctggcctgccagcagaagcaacggcaattcgtcaaaccagtgaccgagtcggagcaacccacagtactggaactactcttggcagagctgaggactctgttcagtgcggtcctgcaggattcttccccggcggcttggaggtacctccacgcggtcctagggctgctgccaccgtaccgcgagctcctagtgggacatctcgatctgctgccttttttggagcagctgtattgctgggccccctgggtacagacgcacctccacctggacctgttgggagcaatagtgcaggcatttccacccgattccagtctcttggattcagcgagccatgctgactgttgcccacagaaaaggcgactgcatcaccgcccaccctgcccggcctgcccctttgtacaggcccagtggtctcggcaacaggtcaaggaagaattggccacatggctccgtcccctgacgctccccgagctgcagagatgcctgggaatcgtgggagcgcaggtggccttagaagaagcggtgtggctcgacggacttagcttgctgcctctggccctggccgcagatataccagtacgctacgaaagcagtgatacagacaacgctgaggtggagcccgtgggcagaaaggagaccagaagtcagttagattacgaagtaccccgcgagaaagcattccagaaaagctctactgggtttagtccggagacatccttcttggattcccaggtgatgacggccttaaagatggaaaggtatctcaagaaaatccactttctctatttgaatgttgcacctagtagatacttccggccatactcgttaatggttgttcctccagacaaagtgaatccggaacattacatcttttcgccattcggaattttgcacgttcaccccgtggaagggtccgagacgatgacactggggacgtggcatcatcattgtgttctctggcagcagctgcagttcataccattcttcaagtattgcttgctgcgcaaatctttcacatgttggaagaagaacgtgaggttgcaggggctccaccgtctgcaaaagttcctggagaaccatcttctactggcagtcccgcatttcggcgctgggcttctccatatctcccgtctgctgcaagaactacatagtgtcagctggttgcctcaggagctggatcggtgctatgaattgcttgatctccaaacagcactggcagaagaaaagcacaaagcattacggctgctacatcgatgcctgaatctgtgtacgtccatcctgagactcgtgcacgaagacacctaccatatgcagcagtgcttacaggaaagagtccagaactgcgaccgaatacggacaggacagggcagtatctatctacaacgagtgcagcacaaacaactggaacagaaactgaagcaggcagaagcttggtggctccagctgggaaagttcgcaaggctcgtggactacatgatttgccagtccctgatctcggttctcgaggaacagatcacatccttcgtggctaacatactgcaggctcctagacagaagcccttcctgtccagtcaactggtgttcgatgatcacggtcaactgtcccacgtgccatgtgtcgagaatatgatccaaactcttactggcgggctgcagtcagtaaagacaagcgctctgcaggtggtccagagcgccgacctgaagacaagttctgattctttatactccgaggaagaggacgaagaggaggactccaaagatgagtttctcatgcctaagtttcagggccagccttccgatgcagtctcaatcttttgcggtcccaacgtgggcttagtctggccatggaagtcccatcccattgctggcattctcgaggtgcgaggatgtaggctgcgagggcaatattttccccataattataagcaattggaggaggatctggataataatcccaagatccagcaggctctaaatatacagcaggtccttctggagggtgtgctgtgcaaggttcaagagttctgtcgggaacaccattggattacgggcatctacgaattcctgcagtcatggggcccccagaaattggaagacatgcgcggcggtcccattaaaaactacgtaaccctcgtgagccgcctgaatgtatggcaggctcgagtcagcagcatgcccattgaactgctgaccaaaggtggcctgctcctgttgagctgtcacgacgttcaggccgaaatggaaagcaagctaaacagtatcaggaaggacatcctagcccacgtccaaaatgaatgctggaatctaagccagcaacttatgaccgagcttaccgatttcatgcatatctttagaacgattaacagcgatattcatgccatagcgcagtgtactcagaagttaaatgaggccaacgaacagtacgtggaactcgaggagcggatggagtatgtgcgggcactgcacgagctgattaggaaccatttttctctcttctcggccgaaaatgaggccctcgacatcagcgtgcgcagacagtttggggaatcccctataccaccttgtccgcccccacctcagcctcatctgctgcactgtcctctgcttgcaccacagctcctggacatgtgggaagccttccagttcgagaagtctcaggcctctgagttcctgttgtccaagagacacgctatcatgcccaagttgcagcagcttatggcagccgccctggccgagttggagggcctcctagctaaggctctttctggacccttcatggatcccacacaagaccagcgatccactgaacatcagctggtcagcctggaaaggcagttccaaaacaccgtctctgatctgagtgaattacatcacgcatatgcgatattcactgaagatgagacacctgttccactgcctatctgcggcactcggcctatagttcaacagcaaaggatatggcatttataccgggttatttctgaaaatattagtgaatggaagtgcatggccttcgcaaagttctcccccgctatggcgcaggaaaagacagagggttggctgactgaggccgcccgaatgtctactacgcttgagctgcatagcccggtcctccagcactgcatgcggattctaggcgaatttcgttcatatctccctctgctgactaagctgggctcactgcatcctcagtccctgaactgccagtgcttactacgggctttaggcctgggctctcttcagactatagagctgctgaccttagggcaacttctgacttatcctctgctggagtttgcagacagaattaatcaggtgtggcagaacgagaacgagcgcattcacgcacaggagactatccgtcggctgcagcgttactgggaagcacgccaactccggcttctgaactttattctccacgtaccgtatgaaccacccgcatccgaaaggtcaaagaggcaggtccttcgaagcccccagtgggaggtggtagacaaagactccggaacgttcatactgtctgactattccaacctgcaggatagcatccaggagtctttgcaggtgctctctaagattctcgctatcgaaaaaagcggggacctcaataagattgccctagaatgggtcgccattatgcatggtctgggagctctccttgaagtatggctaactttccagcagaaatggatctttttgaataaggttcttcatgaaatgaagattcagttcccaaatgccgatctgaacagtcggttcaaggtgatggacgatcagtacaggactctcatgcgcatctccgttgcagatccgatggtactgtctctggtggtcccgtccgccgaacggagcccttacttccagggtcaacagctccagcagttacttcaggccgggtctgtggaactcgagggtattatcatgtctctggagtcagtgctgtacggcgtgtgtgctcactttccgagactatttttcttgagcgactccgagcttgttgccctgctggccgccaggctggagtcttgcgaggcacaactttgggttaggcgttgctttccgcacgtccacgccgtttcctttcggtcttgcccaaccggtgaaaaaaatacagatgattgggagagctcccctaatactcagacacaggtggaggctctcgccgtcttgggggctggtggagaagaagtgaaactccagggccccctcccactgcaccccgatctgccgaagtggctcgctagcctggagaaatgtcttcggctcgctctggtgcatatgctgcagggatgtgtcgctgccagactcgctagaggcccaagcttgggggaggctctgaagcagctacctaagcaaaataaactgtacctgcagctgtacgtccaacactggatcgatctcgtgcaggccttcccttggcagtgtgtgctggtggccgaagaggtcgtgtggagggcagagatggaggaagccctgctggagtggggcacgctggccatggtatctatgcatatgaggaagttagaggttctggtgaatttcatgagagcacagcgcgcctcccaggggggtcagtccttgccatctgttcgccagacaagtttgctgagcgctctgctggtgatggcagtaactcacagggacatcgcccaactcctggagcaacaccaggtgtccgatctgaccgactttcattgggtgcgccagctcaaataccatctgggatctccacatatcatcccaaaaagcccgctgcaatccctgaaaactattgcttcgagcgagccctccctcagtcccgccgcgtgctggatcgatgttcttggtcggtctttcctgtacaactatgagtacctcgggccaagactaggtccccttcccagtctactgccagagagacctgctttggttctcctgttggcactcgaggaggtggcatgcggcaccgtgttagggccgaatggggtgggcaagagggctattgtaaattcgctcgcacaggcgctcggacggcagctcgtgatgttgccttgttctccccagatagaagcgcaatgcttaagcaattacctgaatggagcactgcaaggcggagcttggctactgctggagaaggtacatcagctgccaccggggttgctgagcgccctaggccagcgccttggagagctacaccacctatatgcccctctttaccaggaagccagtcgcaacacgtccaccattgacccaacgcagccacagctgctcgggtcgtcgttcttcgaaaagcaccatgtgtctgtcagactggggtacggctgtctgctcgtgttgagagccttatccagtgctgtgcccgctaacctccacctgctgctcagacccgtcgccctcgctttacctgatctcaggcaggtagccgagcttaccctcctcggcgcgggcatgagagacgcctttcagatggcaactcgactcagtaaattctttagtcttgagcgggagttggtgtcaggacccctgccttgtagactgccactgcttaaacagattcttgaggacacgatacgaacacttaacgtcacaaaggaagaaccaaagtgccagaaacctcgtagcctggcagcgatcgaggaagccgctctgttaagatctcctctctttagcatcctcaacggcctgcatctgcacaacctgcggggcctgctatgcgccctctttccttccgcttcccaggtgttggccgagcccatgacatataaactgatgaaacccctggtggtcgaggagctgcaacaagtgggtctggatccctcccctgatatcctagggtcattggaacaactgtctcaggcgttgtcacgagctagcgggatcttgttgttgggacctgccgggagtggcaaaacaacatgctggcacagcctgttcaagatccagaataggttggccgctatggaggatacttcgacacagggttgtcaaccagttgaaattacccatctgtacccatctgggcttagccctcaggagttcctgggctggctcgaagggtcctgttggcaccacgggatcttccctaaagtgctccgagccgcggggcaatgcaacaatatgggccagaaaagacagactgaggagagcatcggaatacagcattggattatatgcgatggggcatccaatggtgcctggctggatagcatcacctgcctcctgtcagagctgccgcaactgtcccttccttctggccagcagatagcccgcccgcccggaacctttctactgatggaggttgctgataccaccgggatttcgcctaccgtggttggctgttgcgctctggtgtggtgtggcggagagcagacgtggcagtgtatcttgtccgccctgatggcctcgctcccatatgagtaccgcctgcaacatcggaccgtagctgaactgaaccacatggcagaggtgttagtcccagccacactacgtttcctgacatgtcaaggcgtgagctccctcctgcaggttcatggtcaacaggctgtttgcgccggggtggctgaggtgacgagcatggctaggatcctgcacagccttctcgacctgcatctccgtctgaaggaggaaaaggctccgggacctgaagatctgagctattctgaccccgtggcacaatcctttcggtcctctaagagcagcttcctgaaccggagccaagtcgacagcgatgatgtccccgacaaatgtcgagagcacttgctggccgttagtagctttttattcgcattaatttgggggtttggggcacacctgccctctagattctggcctatcttcgatactttcataagggactcaatttcgcgcctcagcaactatcccgaacccccgccctctgcgcttgtgtttgatctccacgtgagccctgaagacggtaccctggtgccatttacggggcagtacttgagcagtcacataaagggcactcttggtacctttcaccccagcattcaaactgaacgtttactttacgtggttgaccttttgttgtccggcggtcaaccagtgctcctagccggcgaagccgcgaccggaaagtccgcgttcgtggaagtgctggtagagccccaccacccctacatatactcgcctatccacccagcattctcctcctcgcacctccgtctgcttctgtctcgcgggattcaaggacagacacaggcatcccctcagccaggacatcaccaggattcaaaaccgtctctgctgtttctactggaagacctgcacctggcaacaagcgaccccgaaaagtcctgtcagccagttttagaaacgctgagacaggccatggatggtaccgtctacgcccactctaccctagaactacagaccctgcaacctaccgtgaacttcttagccactgtgactgtgcccggttactgtgagcggcctctctgtccccgcctgttcagattgtttactgtgctggcccttgaatccatgacccaggcaacactgctggagcggcacgttcccattatccaggcctggctggagagattcccatcggtggaacgagaaagagctttagccagaggtctcgtccgggcttccgtcgaggcctgggaggcggtatgcaactgctttatgccttcgccgttacatccccattaccactttagcctccactccgtctctcacctgctctcaagcctgcagcttctgccaaaccggacaggctctagagggtttgtcgattaccctaatcaccaggaacatcttagaagggtctcaggactccgtggtacgtgtctgaccgtcatgatggccactcgcaacgtcgtgaggctgtggcttcatgaggctcagaggactttctgcgatagactggactcaccgagggaacgttcgtattgcgctaaactgctcctggtcgtggcccagtctgtcttctgttgtggccccgggccacaacacttgggtaaggaccaccaagagtcagaagaggaagaagaggaggagcgcgttcctgaggtggaaagtgaaggggaactagctcagtgggaagacttctccaatagcaattccgaaacggaagaggaagaagagccatatggcctacaggttgccagagtgagtaactccagagatccctcactaacaccttccatcgggcctgtgtcccggggcatgaaggagagcatcagccataagataagacaagaaaaagggacccgcgcttccaactacaggctgcaggtgagacgtagctttaagacatggtggcagaaaaagccacagatggacctcattagtcccctgctgttgccggtgctgttgcttcacccccaggaaaagccatccgacttggtgttctcccaggaattgatccttggccctaatagcgagaccccaaatctctacctggagcgccagtgggaaaagctggaggagcagctcgccacaagtgcagcccagctcaaactaagcccacatcttgcccgctgtcacagcatggctcaacacgtcgctcggcttgtacgtgtcctcgctcgtcctaggcagcacggcctgctactatccggggcgctcgggactgggcgccacacggctattaccttggcaagttcaatatgtcaagcccatttcttccatctgccctctggtagtgaagaagccatcctccagtgcctgagggacgcatcctggcatgctggtatgctgagccagcctgtggctctcctggtacccagcggggtcgacttaaccacgcttcaccggctcctcgccctggctacctcggggagtttcccggggcagtataccgaagcagatttagatcgtatcggcgagcatctccctagagaaaacctgggcgtgaaacagaacattaagaaggagatggtcttacagcggtttcatcagcaggtttgtagccaccttcacttgttctttctcatcggggacaagcaagcacacaagcaacttccctctaccttgttcctgcgcctgctccagttggctactgctagcatcgatagatatgaaccttgggatcaggccgcactcgcgaaagtggcacagcaccacctcgagggagcccagtccgtgcctttggacgacggatcatggaagtatcctgacctgcaggccagcattccgagcgtcgctaaagcgatggcactaattcacctgagcgctactcactaccacgaacacttatgccctgcactgcctctggtcactcctaagactttccttgatttcctagacacgtttttgatgctgcagcagcagacaatacttaagattaagaacaaggcacagagggtgcagaatgcactggagaacttaaggatgctgatcaaagaacacgggacccacgcgaatttgatattcgaccttgaacagcagctgaaagactctgggaagtctctgtcgatgttccagcagcagctggaacagtcgaaactcctgtacaagcaacaattggaagaatgcaggcatcaagaaaaccttatcgagaacctggctaggcagagagatgcactgcaggctcagcgggaggcctttctggagcagatgagtaaagccttcttggagcctctgagtcaattgcaagttgcagactttgaagagataaggagctaccgcgcccctcccgagtcagtcgtgagggtgacagacgctatgtgcgacctttttcaccatgaaaccggctgggcctccgccaaacaactgttgtgtacagaagacttttaccaggaactcgtattcttccctaaggagaagatcacagatagcgaattaattaaactccacctgattcttaaggcacctggcatggacgacgctgctcttcgtgcagttagccgacccgcagcaagcctggcagcatggttgtgggccgttcttcactacggcctggctcactgcaggggtttgcccacagatctgctattacagcaagtggaagctactctcacaagggagcaggcccgtctcggctattaccaatttcaggctcaggaaactctcgagcataatttggcccttgctaagatggtagaagacgcccaagcctcgcacaactgtgtagctaagactctgtctcaggctcagtgtgggcaatatcataagtggcccatgaaggcagcccttttgacccccatgcgggcttggaccacccaactgcagaagttgaaaggacggtgcatgaccgtctttggggacactctcttatgctctgccgccattatatacctgggtcccttcccaccacttaggcggcaggaactccttgatgagtggctggccctgtgcaggggcttccaggaggcactgggtcctgacgacgtggcccaggcactgaagagaaagcagaagagcgtgagtatacctcccaaaaaccctcttctagccacccactcccctttctctatcttatcgctactttcaagcgagtccgaacagtatcagtgggatggaaaccttaagccacaggccaaaagcgcacacttggccggtttactgctgcggtctcctacccactacagcagttgtagatggccacttctcctcgacccaagcaatgaagcactgatttggctggaccctttgcccctggaggagaatcgtagtttcgcccctgctctaaccgaaggccgcgggaagggtctaatgcgaaatcaaaagcgcgaaagcaagaccgacatgaaggaagaggacgatgagtccgaagaatctaatgaagctgaggatcagaccaaagaacagaaagcggaagagagaaagaatgagcaggaaaaagagcaggaggagaatgaagagaaggaggaagagaaaacagagtcacaggggtctaaacccgcatacgagactcaactgccaagcctgccctatctgtcggtgttaagtggcgccgaccccgagctcggttctcagttacaggaagcggcagcttgcggactaccagtgctgttaaccaatgtagaactggggctgggctgcgaagaactgcagtggttactacagagggagcagctgagcccgccacaagtgcagccggggttctgcctctacttaagcactacccttagcctctgcgctatggaaaaggttctggggtgtgagttgttaaaaggactaaacgtcctcgacctgggattaaatatggagattctggaggaacagatgttgcacgaaattctgtgtcgcgagtatccagaactggaaacgcggtggcaggacctgaagattcgagccctagacacatgcaaggctgtggaagcagcagaggagcgccttttaactatgctgctcttccagaatccaaagcgccagaagcctgccaagtttctgcggaatattgtcagggcacagggaaaactctgtcagctgcgcgcacactgcgaagagctcgagggccagaagttgcaggaaatggtgctgtgggcgccctatagaccggttgtgtggcatggaatggcaatggtgaaggccctctctcaattgcaaaatctacttcccctgttttgtatgtcccccgagaattggcttgctgtgactaaacaagcactggattccatgaagcccagagagatcaatcacggcgaggacctagcctcgcatctgctgcagctgcgtgcccacttaacccggcaattgttgggctcgacagtcacagcgctcggactgacacaagtgcctctggtgggtgctctgggcgccctggcacttcttcaagcgacaggcaaagcctccgaactggaacgcctagctctttggcccggcctggctgcaagcccctctactgtgcactcaaaaccagtttccgatgtggcccggccagcctggttgggccccaaagcttggcacgaatgtgaaatgctagagctgttgcccccttttgtgggtctctgtgctagtttggcagggcactcttctgcttggcaggcctacttgtcccttagctccacggtgctcggccccgcacccggccccggtccagagcctctcagcttacttcagaaactcatcttgtggcgtgtactgcgtccggaatgcctggcaggcgcactggctgactttacaacatcgctcctgggccgacccttggacgaaaatacatacgcacccacaatgccattcaagcatagtcaggccactcaacctatgctgatcctgctgcctccacccggccatccgtctgctaccttgcatccccttaccgtcattcaaaagctcgctgctaaatatcagcagggacaaaaacagctgcaggtgatcgctctgggatcagaggcgtgggaccccgtcagcgtagtagtctcgaccctttctcaggcgatgtacgaggggcactggctggtcctcgacaactgccacctgatgccacattggcctaaagaattgctacagctgctcctggaactgctaggacgagccaaggtggtcgccgaccttgagtctgagcagctgctcgaccagccggaaagtcggaacgtgtctactgtgcatagggactttaggctgtggctgatcgtgccagctgagtcatctgcaagcctgccagccgtgctgacacaacactctatgcctgtgttctggaatcagtccttagaactcggacacgtcctcattgactcagtggaacttgctcagcaggtgttatacatgcagccacccactcaggccttgccactgctcctcctgcacgggctcctgcttcataggcaactctacggaacccgactgcaggcccatcgggggcgatggagtcaggtgacactcactcaagtgctgcagactcaggatcagctgtgggcctccctcagtaatccccgggctgccatgcaagagctggccgctagtgtcttttacggaggtccactgggagatactgaggacagggaggcactgatttcgctgactcaggcttgcctctctccctcatctggcagctgggtgcagcctcacactcctcaatccctgcttgccacactgatgcccctcccggaattaagagaattagacgctatggcagagtgcaaggcacaaatgcacttactgccaagtcctccagagcctaggctatgcgggctgtccgaagggcctcaggcctggctcctgcggaggcagagtagagctttattgtccgccctgcagcgcagctccccagtgtgggtgccggaatcgagacggggtgctcagctggcagagaggcggttgcggcaacgactcgttcaggtcaatcgcagactggaaagtcttcaagaccttctaactcacgtaataagacaggacgaatctgatgcaccatggtctgtactggggcctaacgccagaaggcctctggagggagtgctggaaaccgaggccttggagctgtcacagctcgtcggaactcttcagagagacctcgactgtctactgcaacaactgaagggcgcacctccttgtccaagcaggagatgcgccgccgtggcgcatgctctctggaccgggcggttgccgctcccatggaggccgcacgcgcctgctgggccacagcccccttggcattggctgaggcagctgtcacgccgcggccagctgcttgttcggtatttaggtgttggagccgatgcatcttcagacgtaccagaacgcgtgttccacctgagtgctttccgccaccccagacgactcttactcgctctgagaggagaggccgctctggaccagaatgtgccgtcttcaaatttcccagggtccagggggtctgtgagtagtcaactacagtataagagactggaaatgaacagcaatcccctccatttccgcgttgaaaatggaccaaatccaactgtgcccgaacgaggcctcctcctcatcggcctacaggttctgcatgccgaatgggatccaatcgcaggcgcccttcaggacagccctagctcacagccctctcccttacctcctgtatccatatccacacaggctcctggaacttcagacctgcccgcccctgctgatctgactgtgtattcctgtccggtttacatgggcggccccctcgggacggcaaaactgcagtcaagaaatatcgtgatgcacctccccctgccgacgaagctgacacccaacacttgtgttcagaggagggtacatgtttgcagtccccccctgagctag

SEQ ID NO: 26656 - DNA, 390 bp, Artificial Sequence
  Description of Artificial Sequence: Synthetic coding sequence
atggtggccatggccgaggccgaggccggcgtggccgtggaggtgcgcgggctgccaccagctgttcccgacgaacttctgacactgtattttgaaaatagacgccgtagtggaggaggccctgtactgagctggcagaggctgggctgtggaggagtcttaaccttcagagagcctgctgatgcagaaagggtcctcgctcaagctgaccacgagctgcacggcgcccaattgtccctgcgcccggctcccccccgggctcccgcgcgcctgctgctacaaggcctgccccccgggacaacgccccagcggctggaacagcacgttcaggcactcctaagggcaagcggattaccagttcagccatgctgtgccctggctagtccgtag

SEQ ID NO: 26657 - DNA, 867 bp, Artificial Sequence
  Description of Artificial Sequence: Synthetic coding sequence
atggagcgggagcccagcgccagcgaggccgcccccgccgccgccgctttgtttgcttggggcgctaactcttacggacagcttggcctcggacataaggaggacgtcctgctccctcagcagctgaatgatttctgtaagcccaggagcgtgcggagaatcactggcggaggtggacacagtgctgtggtgactgacggcggggatttgtttgtgtgtggtttgaataaagatggtcagttgggactgggccatacggaagacattccctattttaccccttgtaaatcacttttcggatgtcctatccaacaggtcgcttgtggttgggacttcaccatcatgctgaccgaaaacggccaagttctcagttgcggctccaattcctttggccaactaggagtgccgcacggcccaaggagatgcgtggtgccccaggccattgagctgcacaaagaaaaggttgtgtgtattgccgccggacttcgccacgcggtcgctgcaaccgcctccggcattgttttccagtgggggactggcctcgccagctgtggacgacggctgtgccctgggcagacactgcccctctttttcaccgccaaagaaccttctagagtaactggactggagaacagcaaagctatgtgtgttctggccggatctgatcacagtgcatcactaactgatgctggcgaggtttacgtgtgggggtccaataaacacggccagctggctaacgaggccgcgttcttgccagtccctcagaagatcgaggctcactgtttccagaatgaaaaggttactgccatctggtcaggatggacacatctcgtggctcagacggggctcctgtggctccgagcttag

SEQ ID NO: 26658 - DNA, 372 bp, Artificial Sequence
  Description of Artificial Sequence: Synthetic coding sequence
atgaaccggcggcggaagttcctgctggccagcgtgctggccctgcagaactcctcatttatctatcctagttgtcagaagtgcttttcacggatcattctggtgagcaaaaggagcaactgtccaaaatgcggcagcaccggcgagtccgggaacgcaaattatcgatataagcttagcctaaaggttgcagagtctaacaagctttttgtcattacggtcttcggtagctgcctggataccttctttggcttgaccgccacaggtttacacaggtacatccaggatcccaataagattcccgagacactcgacaatgacactacccagaacctcttaacaaaggccgtggagacgtgctttgttggctag

SEQ ID NO: 26659 - DNA, 324 bp, Artificial Sequence
  Description of Artificial Sequence: Synthetic coding sequence
atgctgcggctgtaccccggccccatggtgaccgaggccgagggcaaaggagggcccgaaatggcaagcctgagttcaagtgtcgtgcctgttagtttcatatccacactgcgggagtcagtcctcgaccctggcgtgggtggtgagggtgctagtgataagcagcgatcaaagctgtccctgagtcattctatgatcccagctgccaagatccatacggagttatgcctgccggcctttttctccccggcaggaacacaacgccggtttcagcagccgcaacaccatttgacactttctataatccacacagccgcacgctag

SEQ ID NO: 26660 - DNA, 1653 bp, Artificial Sequence
  Description of Artificial Sequence: Synthetic coding sequence
atggagaccgacctgaacagccaggaccggaaggacctggacaagttcattaaattcttcgctttaaaaacagtgcaggtcatcgtgcaggcaagactgggcgagaagatttgcacaagatcctccagctcaccaacagggtccgactggttcaatctcgccatcaaagatatacccgaggtgacccacgaggccaaaaaggctctggctgggcaactaccagctgtcggtaggtccatgtgcgtcgaaatcagtctgaaaactagtgaaggtgatagcatggaactggaaatctggtgtctcgagatgaacgagaaatgtgacaaagagataaaagtctcctataccgtgtacaatagactaagtctgttactcaagtccttattggccataactcgcgttacacccgcttacagacttagtcgcaagcaagggcacgaatatgtgatcctctatcggatatacttcggtgaagtccagctttctgggctgggcgaaggcttccagaccgtgagagtgggcacagtaggcactcctgttgggaccattacactaagctgtgcttatcgcatcaatctggccttcatgagtacaagacaattcgagcggacgccccccatcatggggattatcatagaccatttcgtggaccggccatacccttcgtcttcccctatgcacccatgcaattaccggacagcaggcgaagacactggggtgatatacccgtccgtcgaggactcccaggaagtgtgcacaacgtcctttagcacctcccccccgagccaatgcgtttttaccgtgactaaggcccactttcagactccaacccccgtagtaaccgacacattaagagttcccatggctgggttggccttctcgcaccagcttagctcatctcgtctgtcttaccagccagctgccctaggggtggggtctgctgacctggcctatcccgtcgtgttcgctgccgggcttaacgcgacccatccacaccagctcatggtcccagggaaggaaggaggggttccgctggcgcccaaccaacccgtgcacgggacccaggctgatcaggagcgtctggccacctgcactcctagtgaccggactcattgcgctgccactcctagtagctctgaggataccgaaaccgtcagcaattcttctgaaggaagggcaagtccacatgacgtgctcgagaccattttcgtgcgaaaggtcggcgccttcgtgaacaagcccattaatcaagtgacactgactagcttggatattccgtttgccatgtttgcaccaaaaaacctggagctcgaagataccgatccgatggttaatccacctgacagcccagaaacagaatccccgttgcagggcagtctgcacagtgatggctctagtggaggctcaagtggtaacacccatgacgactttgtgatgatcgacttcaagccggcgttcagtaaagatgatattctcccgatggaccttgggactttctaccgcgaatttcagaatcccccccagctaagttccctgtcgatagacataggagcacaaagcatggctgaagatctcgattcgctaccagagaagctggccgtccacgaaaaaaatgttcgggaatttgacgcgtttgtggaaaccctgcagtag

SEQ ID NO: 26661 - DNA, 4104 bp, Artificial Sequence
  Description of Artificial Sequence: Synthetic coding sequence
atgggcaacagcgacagccagtacaccctgcagggcagcaagaaccattctaatactataacaggtgcaaagcagattccatgctccctgaagatcaggggtattcacgcgaaggaggagaagtctctgcacggctggggccacgggagcaacggcgccggctacaaatcgagatcattagccaggagttgcttgagtcactttaaatcgaatcagccctatgcaagccggctgggagggccgacctgcaaagtttctagaggcgtggcctactcgacacacaggacaaatgcgcctggtaaagactttcaaggcatcagtgcagccttcagcacagagaacgggttccactcggtcggccatgagctggcggataatcacataactagtcgcgactgtaacggacacctgctaaactgttacggccgtaacgaatcaatcgctagtacccctcccggagaagaccgcaagtcgcccagggttctaatcaaaacgctcggaaaactagacgggtgtcttagagtcgagtttcacaatggaggaaaccctagtaaggtacccgcagaagattgctccgaacctgtgcaacttctgagatacagccctaccctcgccagtgagacctcaccagtccccgaggccagaagagggtcttctgctgacagccttcctagtcatcgccctagcccaaccgactccagactgagatcttccaagggctctagtcttagcagtgaaagttcctggtatgattcaccgtggggcaacgcgggggaacttagtgaagctgaaggatccttcctcgcaccagggatgcccgatccctctttgcacgcttcattccctcctggcgatgccaaaaagccttttaaccagtcatccagcctgtctagcttacgtgaactgtataaagatgccaatttgggttccctttcacctagcgggatccgcctcagtgatgagtacatgggcacccatgccagcctgagcaacagggtatccttcgcctctgatattgacgtgccatctcgcgtggcgcatggagaccctattcaatattcaagcttcacactcccatgccgaaagccaaaggcatttgtggaagacaccgccaaaaaggattcgctgaaggcacgaatgagaaggatttccgattggacaggctccctttcacgcaagaagcgcaaactccaagagccgagatccaaggagggatctgactacttcgattccaggagcgacggacttaacacagacgtccaggggagcagccaggcgtccgccttcctttggagcggcggctcaacccagatcttaagccaaagatccgagtctacgcacgccatcggctcggaccctttgaggcagaacatctacgaaaatttcatgagagagctggaaatgtctaggaccaatactgagaatatcgagacgtccacagagacagccgaaagctcttccgagtccctgagctctctggagcagcttgatttgctgtttgaaaaagagcagggcgtggtccgaaaggccggttggttgtttttcaaaccgttagtcacagtccaaaaagaacgaaagctggagctcgtggccagaaggaagtggaagcagtattgggtgaccctgaaggggtgcaccctgttgttctatgagacctacggcaagaactcaatggatcagagtagtgcacccagatgtgcgctgtttgccgaggattcaatcgtgcagagcgtcccagagcaccctaagaaagagaacgtcttttgcctttctaacagttttggcgatgtttacttattccaggccacgtcccagacagaccttgagaattgggttacagcggtccacagcgcgtgtgctagcctttttgctaagaagcatggcaaagaagataccctaagacttctgaaaaatcagaccaaaaatttgcttcagaaaatagatatggactctaaaatgaagaagatggctgagctgcagttaagcgttgtgtcggatcccaagaatagaaaagcgatcgagaatcaaattcagcagtgggagcagaatctcgagaaatttcatatggacttgttccggatgcgatgctaccttgcatcactacagggtggggagctccctaatcccaaaagtctactggctgcagcatcaaggcctagtaaactggccctgggccgactggggattctgtcagtttcctccttccacgcactggtttgctcccgcgacgacagtgcattgagaaaaaggactctctctttgacccaaaggggccggaataagaagggtatattttcgtctctgaaagggctggatacccttgcacgtaagggtaaggaaaaacggccctctataacacaggtggacgaactgctccatatctacggtagtactgtcgacggtgtcccccgggacaacgcctgggagatacagacatatgtccatttccaggataaccacggcgtcactgtgggcataaagcccgagcaccgcgtggaagacattcttactctggcctgtaaaatgaggcagctggaaccaagccactacggtttacagctgcgaaaactggtcgacgataacgtcgagtattgtatcccggctccgtacgagtatatgcagcagcaggtgtacgatgagatcgaagtgttcccccttaatgtgtacgacgttcagctgactaagacagggagcgtctgcgatttcggatttgcagtgaccgcccaggtagacgagaggcagcatttgtctcggatcttcataagcgatgtgctccctgacggtctggcatacggcgagggccttcggaagggaaatgagatcatgactcttaatggggaggccgtcagtgatctggatctcaagcaaatggaagctctcttctccgagaagtcagtcggtctcaccctgattgcccgccctcctgacaccaaagccaccttatgcacctcgtggtccgacagcgaccttttttctcgggaccagaaatccctgctccctccgccaaatcagtcccaacttttagaagagtttcttgacaatttcaaaaaaaacacggctaacgacttttcaaacgtccctgacatcactaccggccttaaacgcagccagacagatggaacactggaccaggtgtctcatcgcgaaaagatggaacaaacatttaggtccgcagagcagatcactgccctatgcagatcctttaacgactctcaggccaacgggatggaaggccctagagagaaccaggacccacctcctcgatccctagctcgccacctttcggatgcagaccggcttaggaaggtgatccaggaacttgttgatactgaaaaatcatacgtgaaagacctatcctgcctcttcgagttgtatctggagcctctccaaaatgagactttccttacccaggacgagatggagtcactcttcggctccttacccgaaatgctggaattccagaaggttttccttgaaactttggaggatggaatttctgctagttccgacttcaatactctcgagactccctcccagtttcggaaactgttgttttccctgggagggagcttcctatattacgctgaccacttcaaactgtattccggcttctgcgcaaaccacattaaggttcagaaggttctggagagagcaaagaccgacaaagccttcaaggcattcttagatgcacggaatccaacaaagcagcacagctcaaccctcgagtcttatctgatcaagccggtgcagagagttctgaagtatcctctgctgctcaaggagctggtgtcattaaccgaccaagagagcgaggagcactaccaccttaccgaggcgctgaaagcgatggaaaaggtggctagccacataaatgagatgcaaaaaatttacgaagactacggaacggttttcgaccagctggttgcagaacagagtggaactgagaaggaggtcacagaactcagtatgggggagttgctcatgcactccactgtatcctggctcaacccctttctgtccctcggcaaggctcggaaagaccttgaactcaccgtctttgtgttcaagagagctgtgattctcgtgtacaaggaaaactgctag

SEQ ID NO: 26662 - DNA, 45 bp, Artificial Sequence; identical to SEQ ID NO: 13114
  Description of Artificial Sequence: Synthetic coding sequence

SEQ ID NO: 26663 - DNA, 519 bp, Artificial Sequence
  Description of Artificial Sequence: Synthetic coding sequence
atggtggccatggccgaggccgaggccggcgtggccgtggaggtgaggggcctaccaccggcagtacccgatgagctgctgacattgtatttcgaaaacagaagaagatcgggtggcgggcccgtcctatcatggcagcgtcttggttgtggtggggtgcttacattccgcgagccagctgatgccgagagggtgctggcccaggcagatcacgaactgcatggcgctcagctttcccttcgcccagcccctccccgcgcacctgcaagattgctcttgcagggattgccccccgggactactccgcagaggctggagcaacacgtgcaagccctgttaagggcttctgggctcccagtgcagccctgctgtgctcttgcatctcctaggccagatcgggctctggtccagctgcccaaacctctgtctgaagccgatgtccgagtactggaggaacaggctcagaacttgggactggaggggacactggtttcactggcccgggttcctcaagcttag

SEQ ID NO: 26664 - DNA, 27 bp, Artificial Sequence
  Description of Artificial Sequence: Synthetic coding sequence
atgttctggaagttcgacctgcactag

SEQ ID NO: 26665 - DNA, 411 bp, Artificial Sequence
  Description of Artificial Sequence: Synthetic coding sequence
atggtggccatggccgaggccgaggccggcgtggccgtggaggtgcggggactccctccggctgtgccagatgaattactcaccctgtactttgaaaacagaagaagatcaggaggtggcccagtgctcagttggcagcgactgggatgcggaggcgttctgacctttagggaaccagccgacgccgagcgggtgctcgctcaagctgatcatgaacttcatggggctcagttgtcccttaggccagctcctccacgtgcaccagcccggttgctgttgcagggactgcccccagggaccactcctcagagattagaacagcatgtgcaggcactgctgcgggcctctgggctccctgtccagccttgctgtgctctggcttcgccccggcctgatcgtgctctggtgtag

SEQ ID NO: 26666 - DNA, 5844 bp, Artificial Sequence
  Description of Artificial Sequence: Synthetic coding sequence
ggccggcccatcgacccccgggagggccccggccggccccccctggatggccgagaccattttggtaggccaccggttgatataagagagaacctcgtccgaccaggaatcgaccatctgggaaggcgcgatcacttcggattcaacccagagaaaccttgggggcaccgaggcgactttgacgagcgggagcatcgagttctgcccgtctatggcggccctaagggactgcacgaggagcggggccgtttcaggagcggcaattaccgctttgatccccgctctggaccttggaacagaggatttggacaggaagttcaccgtgattttgacgaccgcagacggccatgggaacggcagagagacagagacgatcgtgactttgatttttgccgagagatgaacggtaaccgactgggccgcgaccgcattcaaaacacatgggtgcctccacctcacgccagagtgtttgactatttcgagggagcaaccagccagagaaagggtgataatgttccacaggttaacggagaaaatactgagagacacgcccaacctcccccgatcccagtacagaacgatccagaattgtatgaaaagcttacatcatccaacgaaattaacaaggaaaaaagtgataccgttgctgatatcgagtccgaacccgtagtggagtctacggagaccgaagggacaccattgacaagcctgactgccgagacgcggcggcaagttaagatggggaattccgatagtcagtatactttgcagggcagtaaaaatcactcaaacaccataactggagcgaagcaaattccttgttctttgaagatccgcggaatacacgccaaggaagagaaatcactacacgggtggggccacggatccaacggagctggctacaaaagtcgaagcctggcccgtagttgcctgagtcatttcaagtcgaaccagccatatgctagccgcctggggggaccaacctgcaaggtatcaaggggagtggcttatagcacccacaggaccaacgccccaggcaaagatttccaggggatcagtgctgctttctcaaccgagaatggatttcactccgtgggccacgagttagccgataatcacatcacctcacgagactgcaacggccatctgctgaattgctacggccgaaatgaaagcatcgctagtacaccaccaggagaggatcgtaagtcaccacgcgtgctaattaaaacactcggtaagctcgacgggtgcctgagagtcgagttccataacggtggtaatccttccaaggtgccagccgaagattgcagcgaaccagtccagctgctaaggtatagccccaccctggccagtgagacgtccccagtgcccgaagcacgcaggggctctagcgcagatagcctgccctctcacaggccctcacccacagattcacggctacggtctagtaaagggagcagtcttagcagcgagtcaagctggtacgacagcccatggggaaacgctggggagctgtccgaagccgaggggagcttccttgctcccggcatgcccgatccatccctccacgccagcttccctcccggagacgccaagaaacccttcaatcagagcagctcactctcttccctgagagagctgtataaggatgcaaatcttggttctctgtccccatccggtatcagactttccgatgaatacatgggaactcacgcctctctgagcaatcgcgtgagttttgcttccgatatcgatgtgcctagtcgtgtagcgcacggtgacccaatccagtactcatcttttactcttccatgtagaaagcccaaggcgtttgtggaagacacagccaagaaggactctcttaaagctcgaatgaggaggatctcagattggactggctctctctccagaaaaaaaaggaagctgcaggaaccccggtccaaagagggctctgactattttgattcacgttccgacggtttgaacactgatgtgcagggaagctcccaggcaagcgcctttctctggtcaggcggttccacccaaatactctcccaacggagtgaatctacccatgccattggatccgaccctctgagacagaacatctatgagaatttcatgcgggagctcgaaatgtccaggacgaacaccgagaacatcgaaacaagcaccgaaactgccgagtcttcctcagagtcgctctcctcccttgaacagcttgatctgctctttgagaaggaacagggggtggtgaggaaagccggctggctgtttttcaaaccgttggtgacagttcagaaagagagaaagcttgagctggtcgcccggagaaagtggaaacaatattgggtgaccctgaaaggctgcacacttctgttttacgaaacttacggtaaaaactcaatggaccaaagtagtgctccgaggtgtgccctattcgcagaggactctatcgtacagagcgtccccgaacacccaaaaaaggagaacgtgttctgtctttctaattcctttggggatgtctatctctttcaggctacgtcccaaacagaccttgagaactgggtcacagcagtacacagtgcatgcgcatctctgttcgcgaaaaagcacggaaaagaggacacccttcggcttttgaaaaaccagacgaagaatctgctgcagaagatagatatggattccaaaatgaaaaaaatggccgagctccagctgagtgtagtttcagatccaaaaaatcggaaagctatcgaaaaccagatacagcagtgggagcagaatcttgaaaaattccacatggacctattcagaatgaggtgctacctggcctcactccagggaggggagctgcctaatcccaagagtttgctagccgctgcatctcgtccatccaaactggctctgggcaggctgggcatactgtctgtctcatcattccatgctctcgtctgttcgagggatgacagcgccttgaggaagcgaactttgtccctgacgcaaagaggcagaaataagaagggaattttttcttccctgaaaggactcgacaccctagctagaaaaggaaaggagaagagacccagcattacccaggtggatgagctgctccacatctatggaagcacggtggacggtgtgcctagggataacgcctgggagatccaaacttacgtgcattttcaggacaaccacggcgtgaccgtgggcatcaagcccgagcacagggtcgaggacatcctgacactagcctgcaaaatgcgccaattggagccatcgcactatggcttacaactcaggaagctggtcgacgacaatgtggagtattgcataccagcaccctatgagtatatgcagcagcaagtgtacgatgaaattgaggtgtttccgcttaatgtctatgacgttcagcttactaagaccggtagcgtgtgcgacttcggttttgcggtgacagcccaggtggatgagagacaacacttgagcaggattttcataagcgatgtgctgcctgacggcctggcctatggggaggggctgagaaaaggaaatgagatcatgactctgaacggagaagccgtatcagatttggacctgaaacagatggaagccttgttttcagagaagtctgtcgggctcaccttaattgcaaggccgcctgacacgaaggccaccctctgtacgtcatggagcgatagcgacttgtttagtcgagaccagaagtccctgctccctccacctaatcagagccagctgctcgaggaattcctcgacaattttaagaaaaataccgcgaatgacttcagcaacgtccctgacattactacaggtctcaaaagatcccagacagatggtacactcgatcaggtgtcacatagggagaagatggaacaaacctttcggagtgctgagcagataactgcactgtgtaggtcatttaacgattcccaggctaacggaatggaaggcccccgggagaaccaggaccccccaccccgctccctggcacggcatttatcagatgccgacagacttaggaaggtcatacaagagttggtggatactgagaagagctacgtcaaggacctgtcatgcctcttcgagctgtatctggaacctttacaaaacgaaacgtttctgactcaagacgaaatggaaagtttgtttggctcccttcccgagatgttggagtttcagaaggtgtttctggaaactttagaggatggcatttctgctagctccgatttcaacactctggagactcccagccaatttcgaaagcttctgtttagcctgggggggtcctttctgtattacgcagaccacttcaagctgtattccggcttttgcgccaaccatatcaaagttcagaaggtgctggagagagccaaaaccgacaaagcatttaaggcatttctggacgcccggaatcctactaagcaacattcctctacactggagtcatacctgatcaagccagtacagagggtcctgaagtacccccttctgctaaaagaactggtgagtttgaccgaccaggaaagcgaggagcactaccatctgactgaggccctcaaggccatggaaaaagttgcgagtcacataaacgaaatgcagaaaatttacgaggactacggcacagtcttcgatcaacttgtggccgagcagtccggtactgaaaaggaagtgaccgagctatcaatgggcgaactcctgatgcacagtaccgtatcgtggctgaatccctttctaagtctcggaaaggcccgcaaggacctcgagctgaccgtgttcgtgttcaaaagggccgtgattcttgtgtataaggagaattgtaaactgaaaaaaaaactacccagtaacagccgtcccgcccacaactcaaccgaccttgatccctttaaattcagatggctcatccccatcagtgccttacaagtcaggttgggaaatccagcgggaactgagaataattctatctgggagctgattcataccaaaagcgagatcgaagggcgtcccgagactatctttcagctgtgctgttccgacagtgagagtaagacaaacatcgttaaggtcatacgcagtattctgcgtgaaaacttcaggcgacatattaagtgtgaactgccattggagaagacatgtaaagaccggttggtccctctgaagaatcgggtccccgtgtctgctaagctcgctagcagccggagtctgaaagtgctgaagaactcctcctctaacgagtggactggagaaactgggaaggggactcttctagactcagacgaaggatctctttctagcggaacacagagcagcggctgtccaaccgcagaaggaagacaggactcgaaaagtacatctccaggtaaatacccacatcctggactggctgattttgccgataacctcattaaggagagtgatatcctcagtgatgaagatgacgaccaccgacagaccgtcaaacagggaagccccacgaaggacattgaaattcaattccagcgtctacgtatcagcgaagatccggatgtgcatccggaagctgaacagcagcctggaccggagtcaggggaaggacaaaagggaggcgagcagcctaagttagtcagaggccacttctgtcccatcaagcggaaggctaacagtaccaagcgcgaccgcggtacactgctgaaagcacagattagacaccagtcactggattctcagagtgagaatgccaccatagaccttaacagtgtgctggagagagaattctctgttcagtctttgactagcgtcgtgagcgaggagtgcttctacgagactgagtctcacggtaagtcatag

SEQ ID NO: 26667 - DNA, 294 bp, Artificial Sequence
  Description of Artificial Sequence: Synthetic coding sequence
atggaggccgccgacgccagccggagcaacggcagcagccccgaggccagggacgcgcgaagcccgagtggaccttctggttctttggaaaatggcactaaggccgacggaaaggacgcaaagaccacaaacgggcatgggggtgaagctgccgagggaaaaagtctgggcagcgccttgaaacccggcgaaggtagatcagccctctttgccggtaacgaatggcgacgaccaatcatccagttcgtggagtctggggacgacaaaaattctaactacttttcgatggactag

SEQ ID NO: 26668 - DNA, 117 bp, Artificial Sequence
  Description of Artificial Sequence: Synthetic coding sequence
atggaggccgccgacgccagccggagcaacggcagcagccccgaggcaagggatgccagatccccctctggtccatctggatcactcgaaaatgggactaaagccgatgggaagtag

SEQ ID NO: 26669 - DNA, 1455 bp, Artificial Sequence
  Description of Artificial Sequence: Synthetic coding sequence
atggccatcggcaagcggctggccaccctgcccaccaaggagcagaagacacaaaggctcatatcagagctgtctttattaaatcataagcttcccgcacgggtgtggctgccaactgcagggttcgatcaccacgtcgtgcgggttccacacacacaagcagtcgtgctgaacagtaaggataaggcaccgtatctgatttacgtcgaggtcttagaatgtgaaaatttcgacacaacgtcagtgcccgccaggattcctgagaacagaatcagaagtacgcgctcagtggagaatttaccagagtgcggcatcactcacgagcaaagagccggcagctttagcacagtgccaaactacgacaacgacgacgaagcttggagcgtggatgacattggcgaactgcaggttgagctacctgaagtgcacaccaactcgtgtgataacatttcccagttctcagtagactccattacttctcaggaaagcaaggagccagtcttcatagctgctggcgatattcggcggcgtctctccgagcaattagcgcacacaccaacagctttcaaaagggatcccgaggaccctagcgcggtggcattgaaggagccctggcaggagaaggtacgaagaatccgagagggctcaccctacggccacttacccaattggcgacttttgtcagtgatagtgaaatgcggcgatgatttgcgccaggagctcttggcctttcaagtcctgaaacagctgcagtccatctgggagcaagagcgcgttcctctatggatcaaaccatataaaatccttgtaatttctgctgattccgggatgattgaacctgtggtgaacgctgttagcattcaccaggtgaagaaacagagccagctctcattgctggactacttcctccaggagcatggatcttataccactgaagcatttctttctgctcaaaggaattttgtccagagctgcgcaggatactgcctggtatgctacctgctgcaggttaaggacaggcacaatgggaatattctgctggacgctgaagggcacattatccacattgactttggattcatcctttcttcatcccctaggaaccttggctttgaaactagcgcatttaaactcacaacggaatttgtagatgtcatgggggggctggacggcgatatgtttaactactataagatgctgatgctgcagggactgatcgccgcacggaagcacatggataaagtggtgcagatcgtagaaatcatgcagcaggggagccagttgccctgttttcacgggtcatcaacaatcaggaatctcaaggaacgctttcatatgtcaatgaccgaggagcagctgcagctcctcgttgaacagatggtcgacggctcaatgcgttccatcaccacaaagctttatgacgggttccaatatctcactaacgggatcatgtag

SEQ ID NO: 26670 - DNA, 228 bp, Artificial Sequence
  Description of Artificial Sequence: Synthetic coding sequence
atggccatccccatcaccgtgctggactgcgacctgctgctgtacggccggggccacaggacactggatcgcttcaagctggatgacgtcaccgatgaatacctgatgtccatgtacgggttcccgagacagttcatttattatctggtcgagctgttgggagctaatttgtctcgtcccacgcagcgtagtcgtgccataagccctgagacacaggtgctggcctag

SEQ ID NO: 26671 - DNA, 2754 bp, Artificial Sequence
  Description of Artificial Sequence: Synthetic coding sequence
atggacggcgccgccggccccggcgacggccccgcccgggaggccctgcagagcctctcacagagactgcgtgtccaggaacaggagatggagctcgtaaaagcagccctcgcagaggcactgagacttctgcgtctccaggtgcccccctctagtctacaaggatcggggaccccagcacctcccggagacagtctggctgcccctccaggtttgcctcccacttgcacaccctctctcgtaagtagaggaacccagacagagaccgaagtggagctgaagtcttcccccggtccccccgggctgagtaatggacctcctgccccgcagggagcttccgaggaaccctctggtactcagagtgagggaggaggaagcagttcatccggggccggctcccctgggccaccggggatactgagacctctgcagcctcctcagcgagctgacactccccgacggaactcgtcatctagtagctcaccatctgagaggccgaggcagaagttgagccggaaggctatctcttctgcgaaccttttggtgcgcagcggttccacggaaagtcggggcggcaaggatccactaagcagcccaggaggcccgggtagcagacgatcaaactacaacctggagggcataagtgtgaaaatgttcctccgcggccgtcccatcacaatgtacataccctcaggcatccgcagtctagaagaactcccttccggtcctccacccgagaccctcagcttggactgggtctacggctataggggccgagactcacggtccaacttattcgtgctcaggtctggggaggtcgtctacttcattgcttgtgtcgtcgttttgtacagacccggaggcgggcccggcggcccaggcggagggggccaaaggcattaccgtgggcataccgactgtgtgcgctgcctggccgtccaccctgacggggttcgtgtggccagcgggcaaactgcaggggtcgacaaggacgggaagccattgcagcccgtcgtccatatatgggacagtgagaccctcctcaaactgcaggagattgggctaggcgcattcgaacgaggggtcggtgccctggccttcagtgcggccgatcaaggggctttcctttgcgtcgttgatgactccaacgagcacatgctttcagtgtgggattgttctcggggaatgaagctcgctgaaattaaatccacaaacgattccgtcttggccgtagggtttaatccccgagattctagttgtatcgttacttccggcaagtcgcacgtgcacttttggaattggagcggcggcgtcggggtgccgggaaatgggacactgacaaggaagcagggcgtgttcggcaagtataagaaaccaaagtttattccctgttttgtgttcttgcctgacggtgacatcttaaccggcgatagtgaggggaacattctgacctggggtcggtctccaagcgactccaaaacaccggggcggggaggcgcgaaagagacttatggaatcgtcgcccaggcccacgcgcacgaaggttcaatctttgccctgtgcctccggagagatggaaccgttctgtcgggcgggggtcgggaccgccgactggtgcagtggggaccaggtctggtcgcgcttcaggaggccgagattcccgagcattttggggccgtcagggcaattgctgagggtctcggaagcgagctgttggtgggcacaaccaagaatgctctgctccgaggagatttagctcagggatttagcccagtgatccagggccatacagatgagctctggggcctgtgtacacaccccagccagaatcggtttctgacttgtggtcacgaccggcagctatgtttgtgggatggagaaagtcacgcattggcttggtctatagatttaaaagagaccggactgtgtgccgactttcacccaagtggcgccgtcgtcgccgtggggctgaacaccggcaggtggctggttctggacactgagacccgtgaaattgtatccgacgtcatcgatgggaacgagcagctgtccgtcgttcgttactcacccgacggcctatacttagcaataggatcccacgacaacgtgatctatatctacagtgtctcctcggacggggctaaatcttcacggtttggtagatgtatgggacattcaagctttatcacccacctggattggtccaaagacgggaacttcatcatgtccaatagcggggactacgagatcttgtactgggacgtggctggggggtgcaagcaactgaaaaataggtacgagagtcgggaccgggagtgggctacctatacttgtgtactggggttccatgtctacgtgcccgtgcgatcttgccaaggggctgaaccacacgtgcggggccctcgtcagcctcgggaccagagaccaattcacgccagacggctggcgcctagactcgcaggtcgccaggggcgccagcatctgcctgtggcttctgcagggagatggggccgcggggccggggcccggcacgccctcagcaacccgctgcctgtacctagactgctgcctagaagactaatcgcagcctggagagaccggctggcccggcgccgggggcctgcaccaccatgcccatctctggcacaatcgcccacaacacgcggtaggctgtttcccgggttgacttccagacactccagatcccggatctttttggagggcgccaatggtgcccccgctcacacagtgtag

SEQ ID NO: 26672 - DNA, 321 bp, Artificial Sequence
  Description of Artificial Sequence: Synthetic coding sequence
atggtggccatggccgaggccgaggccggcgtggccgtggaggtgaggggcctcccccctgccgtcccagacgaattactcaccctctatttcgagaataggcgtcgcagcggtggagggcctgtgttgagttggcaaaggttaggatgcggcggagtgctgaccttccgcgaaccagcagacgccgaacgggtgttagcccaagctgatcatgagttgcatggggctcagctgagcttgagaccagcgccgccaagggctcctgctcggttactgctgcaggggctcccaccaggtactacccctcagaggttagaatag

SEQ ID NO: 26673 - DNA, 228 bp, Artificial Sequence
  Description of Artificial Sequence: Synthetic coding sequence
atgttctggaagttcgacctgcacagcagcagccacatcgacaccttgcttgagagggaggacgtgactttaaaagagctcatggacgaagaagacgtccttcaggagtgcaaagcccagaacaggaagttgatcgagttcctcctcaaggcagaatgcctcgaggatctggtcagcttcatcattgaggaaccgccacaagatatggacgaaaaaatcaggtattag

SEQ ID NO: 26674 - DNA, 1275 bp, Artificial Sequence
  Description of Artificial Sequence: Synthetic coding sequence
atggaccagcccagcggccggagcttcatgcaggtgctgtgcgagaaatattcaccagagaatttcccatacaggcgaggaccaggaatgggtgtacatgtgcctgccactccacagggttccccaatgaaagatagactcaacctcccctccgtgctagtcctgaactcatgcggcatcacctgcgccggagacgaaaaagaaatagcagcgttctgcgcacacgtgtccgaactcgacttgagtgacaacaagcttgaagattggcatgaagtgagcaaaatcgtgtccaatgtaccacagctggagttcctgaatctatccagcaaccccctgaacctttcagtcctggagaggacatgtgccgggtctttctccggggtgcgtaagctggtgctgaataatagcaaagctagctgggagacggtccatatgattctgcaggagctgccggatttagaggagctgttcctttgcttgaatgattatgagactgtgtcctgtccctccatctgttgtcactcgctcaaactcttgcacattactgacaataatctacaggattggactgaaataagaaagctcggagtgatgtttccttcactcgatactctcgtgctggctaacaaccatcttaacgccatcgaagagccagatgactcactagctcgtctcttccccaatctaagatccatcagcctgcacaagtcaggcctgcagtcctgggaggatatcgataaactcaattccttccctaagctcgaagaggtacgcctcctggggatcccccttctccagccttacacgaccgaggagagacggaaactagttatcgcacggctcccttccgtgtcgaagcttaatggcagcgttgtcaccgacggcgagcgggaggactccgagcgcttcttcattcgatattacgtcgatgtgcctcaagaggaagtccccttcagataccacgaactaatcaccaagtacggtaagttggagcccttggctgaagtggacttgcgcccccagagcagtgcgaaggtcgaggtgcacttcaacgaccaagtggaggaaatgtccatacgtctagatcagacagttgcggaattgaagaagcagcttaaaacactcgtgcaactccctacatcgaacatgctgctatattactttgaccatgaggcaccattcggacccgaagagatgaagtacagctcacgtgcattgcactccttcggaatccgggacggagataagatctatgtggagagcaagaccaaatag

SEQ ID NO: 26675 - DNA, 288 bp, Artificial Sequence
  Description of Artificial Sequence: Synthetic coding sequence
atggaggccgccgacgccagccggagcaacggcagcagccccgaggccagggacgctcgtagcccttcgggtccgagtgggagcctggaaaatggaaccaaggccgacggaaaagatgccaagaccacgaacggccatgggggcgaggccgcagaggggaagagccttggtagcgccctgaagcccggggaaggcagaagtgccttgttcgccgggaacgagtggagacggcccattatccaatttgtggaatcaggcgacgacaagaactctaactattttagctag

SEQ ID NO: 26676 - DNA, 3144 bp, Artificial Sequence
  Description of Artificial Sequence: Synthetic coding sequence
atggccccccggctgcagctggagaaggccgcctggcggtgggccgagacagtgaggcctgaagaggtttcacaagagcacattgagaccgcttatcgcatatggctggagccctgtatcagaggcgtctgtagacgcaattgtaagggcaacccaaactgcctcgtcggtataggcgagcacatctggctcggcgaaatcgacgagaattcctttcataatatcgacgacccgaactgcgagaggcggaagaaaaatagctttgtcggactgactaacctcggagccacttgttacgtcaatacctttctgcaggtgtggttcttgaacctcgagctgaggcaggcattgtacctgtgccctagtacctgctctgattatatgcttggcgatggcatccaggaggaaaaagattatgaaccccagacgatctgcgaacacttgcagtatctgttcgctcttctgcaaaattctaatagaagatatattgaccccagtgggtttgtgaaagccctcggactcgatactggacagcagcaagacgctcaagaattctctaagctctttatgagtttgcttgaagacactctgagcaaacagaagaacccagatgtgcgaaacattgtccaacagcagttttgcggagagtatgcgtatgtgactgtatgtaatcagtgcggccgagaatccaaactactgtccaaattctacgaacttgagctcaatattcagggacataaacagctcacggattgtatctccgaattcctgaaagaggagaagttggaaggggacaataggtatttctgcgagaactgccagtctaagcagaacgccacgaggaagattaggctcttgagcctgccttgcacgcttaatctgcagctcatgaggttcgttttcgatcgacaaacaggccataagaaaaaattgaacacatacatcgggttttctgaaatccttgatatggagccctacgttgagcataagggcggcagttacgtctatgaactgtcagctgtcctcattcacagaggagtgagcgcatattccggacactatatcgctcatgtgaaggacccgcagtccggggagtggtataagtttaatgacgaggatatcgaaaagatggagggtaagaagctccagcttggtatcgaagaggacttggaaccatcaaagtctcagacgcggaaaccgaaatgcggaaaaggaacacactgcagcagaaacgcgtacatgctggtttacaggctacagacccaagaaaagccaaacacaacagtccaggtcccagccttcttgcaggagctcgtcgacagggataactcaaagtttgaagagtggtgcatcgagatggcagaaatgcgcaaacagtccgtggacaaaggtaaggcgaaacatgaggaggtgaaagagctgtaccaacgcctgcccgccggcgctgaaccttatgaatttgtgagcctggagtggctacaaaaatggctagacgagtccacaccaacgaagcctatcgacaaccacgcgtgtctatgttctcacgacaagctgcacccggacaagataagcataatgaaaagaataagtgaatatgcagctgatatcttctattcccgctacggcggggggcctcgactaaccgtgaaggcattatgcaaggagtgcgttgttgagaggtgccgtatactccgtttgaagaatcagttgaatgaggattacaagactgttaacaatctgctcaaggcagcggtaaaaggctcagacgggttctgggtgggcaaaagtagtctccgctcatggcggcaactcgcccttgagcaattggatgagcaggacggggatgccgaacagtctaacggcaagatgaacggaagcacattgaataaagacgagtccaaagaggaacgtaaagaggaggaagaactcaattttaatgaagacattttatgcccacacgcggtgttcttcttttccaagtacatcttcctgaacagtggtgagctgtgcatcagcgagaatgaaagaagactcgtcagtaaagaggcttggagtaagctacagcaatatttccccaaggctccagagtttcccagctataaagaatgttgctcccagtgtaaaattctggaacgagagggggaggaaaacgaggccctacataagatgatcgcgaatgagcagaagacttccctgccgaatctttttcaggacaagaatcgaccctgtttgtcaaattggcctgaggacacggatgtgctctacattgtctcccagtttttcgtggaagagtggaggaaatttgtgcgcaagcctaccaggtgctcaccagtgtctagcgtcggaaatagcgccctgctgtgcccacacggcgggctaatgttcaccttcgcaagcatgaccaaagaagatagtaaactcattgctctaatctggcccagtgaatggcagatgatccaaaagctcttcgtcgtggaccatgtgattaagattactcggatcgaggtgggcgatgtgaaccctagtgaaacccagtacatcagtgaacctaaattgtgtccagagtgcagggagggactactatgccagcagcagagggacctgagggaatatacccaggccactatatacgtccacaaggtcgtggataacaaaaaggtgatgaaagattccgccccagagctcaatgtgagtagctccgaaactgaagaggacaaggaagaagctaaaccagatggtgagaaggatccagacttcaaccagagcaacggagggactaagaggcagaaaatttcgcatcaaaattatatagcgtatcagaagcaggttatcaggagatctatgagacaccgtaaagttcgcggggagaaggcgctgttggtgagtgctaatcagactctaaaagaactgaaaatacagattatgcacgccttcagcgtggcacctttcgatcagaacctcagcatcgacggtaagatcctgagcgacgactgtgccaccttggggaccctcggcgttataccggagtccgttatccttttgaaggccgatgagccaatcgccgactacgccgcaatggatgatgtaatgcaggtgtgcatgcctgaagaggggttcaaaggcactggcttgctaggacactag

SEQ ID NO: 26677 - DNA, 1443 bp, Artificial Sequence
  Description of Artificial Sequence: Synthetic coding sequence
atggagaccgacctgaacagccaggaccggaaggacctggacaagttcatcaagtttttcgcactcaaaaccgtgcaggtgatagttcaggcaagactgggcgaaaagatttgcactcgcagtagcagctcccctacaggctccgattggttcaatctggccatcaaggacattccagaagttacccatgaggccaaaaaggctctcgctgggcaactccctgcagtagggcggtctatgtgtgtagagataagtctgaaaacaagtgagggggacagcatggagctcgagatttggtgcctggagatgaatgaaaagtgtgacaaagaaatcaaggtgtcctacaccgtgtacaatagactctcactcctcctcaagtcgctccttgccattactagagtcactccggcataccgactttccaggaagcagggtcacgagtatgtgatactgtatcggatatatttcggggaggtgcagctatctggattgggcgagggttttcaaactgttcgggtgggcacagtgggaacacccgtcggaactattactctttcatgcgcatacagaataaacctcgcatttatgagcacaaggcagttcgagagaacccccccgattatgggcatcataatcgatcacttcgttgacagaccgtaccctagttcttcccccatgcacccctgcaattaccgaactgccggggaagacactggggttatttacccttccgtagaggattctcaggaggtgtgtacaacatccttttctacttctcctccatcacagctgatggtccccggtaaagaggggggtgtgcccctggctcccaatcagcccgtgcacgggactcaggcagatcaagaaaggttggccacctgcacaccctcggaccggacccactgcgcagcaactccttcatcctccgaggacactgagacagtgtctaatagctcagaagggcgagcgagtccccacgatgttctggaaactattttcgttcggaaagtcggtgcctttgtaaacaagcccatcaaccaagtgaccctgaccagtcttgatatccccttcgctatgtttgctccaaaaaatttggaattggaggataccgaccccatggtgaacccgccagatagtcccgagacggaatctccgcttcagggctcgctccattccgacggcagttcgggcggttcatctgggaacactcacgacgacttcgtgatgattgattttaaaccggcatttagtaaagacgacatcctcccgatggatctgggcaccttttaccgggagttccaaaatccccctcagcttagctccctgtcgattgacattggggcacagtctatggccgaggacctggacagccttcccgagaagctagctgtgcacgagaaaaatgtgcgtgaatttgacgcctttgtggaaacgctccaatag

SEQ ID NO: 26678 - DNA, 2376 bp, Artificial Sequence
  Description of Artificial Sequence: Synthetic coding sequence
atgttctggaagttcgacctgcacagcagcagccacatcgacaccctactggaacgtgaagatgtgactctcaaggaattgatggatgaggaagacgtactccaggagtgtaaggctcaaaaccgcaaactaattgaattccttctgaaagcagaatgcctggaggatctcgtctcctttattatcgaagaaccaccacaagacatggacgagaagattagatataagtatcctaatatctcctgtgagctgctgacttcagatgtgtctcagatgaatgatcgtctgggcgaggatgagtcccttctaatgaagctctattccttcctgttgaatgattctccactgaaccccctgcttgcaagtttcttttcaaaggtgctgagcatcttgatcagccggaagcctgagcagatcgtggatttcctgaagaagaaacacgattttgttgaccttataataaaacatattgggactagtgctatcatggatctgctgctcagactcctgacatgcatcgagcctccgcagccacgacaggacgttctcaattggctaaatgaggagaaaattattcagcggctggtggaaatcgtacacccttctcaggaggaagataggcatagcaacgcgagtcagagcctctgtgagattgtgaggctctccagggaccaaatgctccagattcagaatagcaccgaaccagaccccctcttggccacactcgagaagcaagaaattattgagcaactgctttccaatatttttcacaaagagaaaaatgaatccgccatcgtgagcgctatccagattctcttgacactcctcgaaacccggcggcccaccttcgaaggccatatcgaaatatgcccacctgggatgtctcacagcgcttgttcagtcaacaagagtgttttggaggccatcaggggacggctgggctcttttcatgagttactgctggaaccccctaagaatatgttctttaaatacacctggaataatttcctacatacacaggttgagatctgcatcgccctgatccttgcctctccattcgagaataccgagaacgccacaattaccgatcaggacagtacaggggacaatctgcttctgaaacacctcttccagaagtgtcaactcattgaacggatcctggaagcctgggaaatgaatgagaagaagcaggccgagggaggccgcaggcacggatatatggggcatttgactcgtattgctaattgtattgtgcacagcactgataaagggcctaactccgccctggtgcagcagttaattaaagatctacccgatgaggtgagagaaaggtgggaaactttctgcacttcgagcctgggagagacgaacaagcgaaataccgtcgacctggcgttcagtgactatcaaatgcagcagatgaccagcaattttatagaccaattcgggttcaacgatgagaagttcgccgaccaggacgacataggcaacgtcagcttcgaccgggtcagcgacataaatttcactctgaacacaaacgaatccggcaacatagcattgttcgaggcatgttgcaaggagagaattcaacagttcgatgacggggggtcggacgaggaagacatttgggaagagaaacacatagcttttacccccgagtcccagaggagatcatcctctggatctactgattcggaggagtctaccgacagcgaagaagaggacggcgctaagcaggacctgttcgagcctagtagcgcaaatactgaagataagatggaggtcgacctgtccgagcctcctaactggagcgccaattttgatgtccccatggaaactacccatggggcaccacttgactctgtcggatctgatgtgtggtccacagaagaacccatgcccacaaaagagacaggatgggctagcttcagcgaatttacctcatctctgagcaccaaggatagcctacgcagcaattcgcccgttgagatggaaacctccactgaaccaatggacccgcttactccttcagctgctgcactggcagtgcagccggaggccgcgggttccgttgctatggaagcatcttccgacggcgaggaagatgcagagtcaaccgataaggtcacagaaactgtgatgaacgggggaatgaaagagacccttagcctgacagtggatgccaagaccgaaacggcggtttttaaaagcgaggagggtaagctgtccacgagtcaggacgcagcttgcaaagacgctgaagagtgcccagaaaccgctgaagcgaaatgcgccgcaccacgaccgccttcttcctcacctgaacaaagtggcgtggaaatacccgctctccctggacagtggagccagcagtag

SEQ ID NO: 26679 - DNA, 1500 bp, Artificial Sequence
  Description of Artificial Sequence: Synthetic coding sequence
atgttcggcgacgccagcaccagcctggtggtgcccgagaaggtgaaaacacctatgaagagctccaagacagatctccagggctccgcgtccccttccaaggttgagggagttcataccccgaggcaaaagcgcagcacccccttgaaagagagacaactctctaaaccgctatcggagcgaacaaactcttccgattctgaaaggagccccgacctcggtcattctacgcagataccaagaaaagtagtgtatgaccaacttaaccagatcttagtgagcgatgccgctttgcccgaaaatgtgatcctggttaatacaaccgactggcagggtcagtacgtcgccgagctcctgcaggaccagcgcaaacctgttgtttgcacttgctcgacagtcgaggttcaggccgtcctgtctgctctgttaactagaatccagcgttactgcaactgcaacagtagtatgcctagacccgtgaaggtcgctgccgtgggaggccagtcttatctgtcttcaattctgagattctttgtgaaatctttggcaaacaagacatctgactggttagggtacatgaggttcttgatcatccctctgggcagtcaccctgttgctaagtatctgggttccgttgattccaagtactctagttcatttctagattccggctggagagatctgttctcaaggagtgagccacctgtgtccgaacagctggacgtcgccgggagagttatgcagtacgtcaatggcgccgctaccacccatcagctacctgttgcagaggcgatgctgacttgtcgacataaatttccggacgaggatagctatcagaagttcataccttttataggtgtggtaaaagtgggcctggtagaagacagcccgtcgactgcgggtgacggggacgattctccagtggtatccctcactgtgccgagtactagcccaccaagcagttcgggcctgagcagagatgctacagcaacccccccctcctctcctagtatgagttctgccctcgcaatcgtgggttcccccaactcaccttacggcgacgttatcgggctgcaggtggactactggttgggccaccccggagagagacggcgcgagggggataagcgagatgcaagctcaaaaaatacgctcaaatctgtgttccgtagtgtacaggtctctcgcctgccacacagtggtgaggcacagctgtcgggcacaatggccatgacagtcgtgactaaagagaagaataagaaagtcccgacaatattcttgtctaagaagccccgcgaaaaagaggtcgatagtaagtctcaggtcatcgaaggaatctccagactaatatgctctgccaaacaacagcagaccatgctaagggtgagcatcgatggggtggagtggagcgacatcaaattctttcagcttgctgcccagtggcccacacatgttaagcacttcccagttggcttgttctctggatctaaggcgacttag

SEQ ID NO: 26680 - DNA, 435 bp, Artificial Sequence
  Description of Artificial Sequence: Synthetic coding sequence
atggtggccatggccgaggccgaggccggcgtggccgtggaggtgagaggcctcccacctgccgtccctgacgagctattgaccctgtatttcgaaaatagacgcagaagtggaggcggcccagtcctgagctggcagaggttagggtgcggtggtgtgctgacctttagggagcccgcagacgctgagcgtgtgctggctcaggctgaccacgagttgcatggagcccaactctctctacggcctgcaccacccagggcgcctgccaggcttctcttgcagggactgcctccaggtacgacaccgcaaagattggagcagcatgttcaggccctgctgcgggcatccggcctccctgtccaaccatgttgcgctctggcttcgccacggcccgaccgcgcacttgtccagctcccaaaaccattgagtgagtag

SEQ ID NO: 26681 - DNA, 513 bp, Artificial Sequence
  Description of Artificial Sequence: Synthetic coding sequence
atggccagcgaggccgagaagaccttccaccggttcgccgccttcggagaaagcagttcttccggaacagagatgaacaataagaatttttcaaaactctgcaaggattgcggtatcatggacggcaagacagtcacctctacagacgtggatattgtttttagtaaagtcaaagccaaaaatgcacgaaccattacttttcagcagtttaaggaggctgttaaggaactcggacagaagagattcaaaggaaaatcccccgatgaggtgctggagaacatctacggtctgatggagggtaaagacccggcaacgactggcgcaacgaaggctaccacagtgggggctgtggacaggctcacggatacgtcaaaatatacaggcacacataaggagcgtttcgatgaatcaggaaaagggaaggggatcgccggtcgagaggaaatgacggataacacagggtatgtgtcaggttacaagggatccggtacgtatgacaaaaagacaaaatag

SEQ ID NO: 26682 - DNA, 270 bp, Artificial Sequence
  Description of Artificial Sequence: Synthetic coding sequence
atggtggccatggccgaggccgaggccggcgtggccgtggaggtgaggggtctcccccctgcagtcccagatgagctcctgactctgtacttcgaaaatagacgacgctcaggaggcggtccggtactgtcgtggcaaagactcggctgtgggggcgtgttgacctttcgggaacccgcagatgctgaacgtgtgctggcacaggccgatcacgaactacacggcgctcaactctctctcagacctgcccctcccagagcccctgcctag

SEQ ID NO: 26683 - DNA, 1206 bp, Artificial Sequence
  Description of Artificial Sequence: Synthetic coding sequence
atgtgcgtggagatcagcctgaagaccagcgagggcgacagcatggagctggagatttggtgcctggaaatgaatgagaaatgtgataaggagatcaaagtttcctatactgtgtataatcgattatccctgcttctgaagtccctcttggctattacccgtgttaccccagcctacagactgagtaggaagcaggggcacgaatatgtgatactttatcgtatctattttggagaggttcaactttccggtctgggagaagggtttcaaaccgtacgcgtaggtaccgtcggcactcctgtcggaactattactctaagttgtgcctatcggattaacttagcctttatgtccacacgccagtttgagcgcacaccaccaataatgggaatcatcattgaccacttcgtggatcgcccttacccatcttcaagcccgatgcatccttgtaattacaggaccgctggcgaagacactggtgtgatctatccttccgtggaggactctcaggaggtgtgtaccacaagcttctccacatccccaccatcacaattgatggtgcccggtaaggagggtggggtacccctggcacctaatcagcccgttcatggcactcaggcggaccaagagcggctggcgacatgcacaccctctgataggacccattgtgctgccacaccctcctctagcgaggatactgaaactgtgtccaactcctctgaaggccgggcttcgcctcacgacgtcctggaaaccatcttcgttcggaaggtgggcgcgttcgtgaacaagcctatcaaccaggtgacgctgacatcgctcgacatcccttttgccatgtttgctccaaagaatttggaactcgaggatactgatccaatggtgaatccccctgactcaccagaaaccgagtcccctttgcagggctccctgcactctgatggctcatctggcgggtctagtggcaacacacatgatgacttcgtgatgattgacttcaagccagcttttagcaaggacgacatccttccaatggatttgggaaccttctatcgggagttccaaaaccccccacagttgtcgagtttaagtatcgatataggggcacagagcatggccgaagacctcgatagcctgcccgaaaagctggccgtgcacgagaaaaatgtaagagagtttgacgcttttgtcgagaccttgcagtag

SEQ ID NO: 26684 - DNA, 2148 bp, Artificial Sequence
  Description of Artificial Sequence: Synthetic coding sequence
atgagccagagcggcgccgtgagctgctgccccggcgccaccaacggctccctggggcgtagtgacggggtggcaaagatgtctcccaaggatttgttcgagcaaagaaagaaatactctaatagcaatgtaattatgcatgagacctcccagtatcatgtgcagcacctggcaacctttatcatggacaaatccgaagccatcacttctgttgacgacgcaatcagaaaattggttcaactgagcagtaaggagaagatttggacacaggagatgctgctccaggtcaatgatcagagtctgagattgctcgacatcgagtcgcaggaagagcttgaggatttcccactcccgacggtgcagaggtcacagacggtgttgaatcaactgcgctacccctctgtgcttctgctggtctgccaagacagcgagcagtctaaaccagacgtgcacttctttcattgcgacgaggttgaagccgaactagttcatgaggatattgaaagcgccttggcagattgccgtcttggcaagaaaatgagaccccagactctcaaaggacatcaggaaaagatacggcaaaggcagtccatcctccccccgcctcaaggtcctgcgccaattcccttccagcaccgcggaggcgatagtccggaggccaagaaccgggtcgggcctcaggtccctctctccgagcccggatttcgccgacgggagagccaggaggaacccagagctgtacttgctcagaaaatcgaaaaagagacacagatcctgaactgcgctttggatgacattgagtggtttgtggcgagactacaaaaagcagccgaagcttttaaacaactgaatcagaggaagaaggggaagaaaaaaggtaagaaagcacccgccgagggagttttaacgctgagagcccgcccacccagtgagggggagttcatcgactgcttccagaagataaagcttgccatcaacttactcgccaagcttcagaagcacatccagaacccatcagccgccgagctagttcacttcctcttcggacccctggatctgattgtcaatacctgctccgggcctgatattgcgcgctcggtaagttgtccactactaagcagagatgctgtggattttctacggggacatttggtgccaaaagaaatgagtttgtgggagtcgcttggcgagtcttggatgagaccccgctctgagtggcctcgggaaccccaggttcccctgtatgtgccaaaattccatagtgggtgggaaccacccgtggatgtgctccaagaagcgccctgggaggtcgaggggctggcgagtgctccaatcgaagaggtatctcctgtgtcgcgccagtctatccgaaatagtcagaaacactctcctactagtgagcctacccctccaggagatgccctgcctccggtctccagcccacacacccatagggggtatcagccaaccccagctatggcaaaatatgtgaaaatcctgtatgactttacagccagaaatgctaatgagctgagtgtgctcaaggatgaggtattggaagtgctggaggatgggagacaatggtggaagttgaggagccgaagcggacaggccggctacgtcccttgcaatatcctgggcgaggctaggccagaggatgcaggcgcacccttcgagcaggccggccaaaagtattgggggccagctagcccaacccacaaacttccaccttcattccccggcaacaaagacgagttaatgcagcacatggacgaggtgaatgacgagctgattagaaaaattagcaatattcgcgctcagcctcagagacacttcagggtcgagagatctcaaccagtgtcccaaccactcacctacgagagcggacccgatgaagtacgagcctggcttgaggcaaaagccttctcccctcgtatcgtggaaaatctgggaatcctaaccgggccccagctgttctccctgaataaggaggaactaaaaaaggtgtgtggggaggagggggtgagagtgtatagtcaattgactatgcaaaaggcattcctggaaaagcagcaaagcggttcagagctagaagagttaatgaataagtttcacagtatgaatcagcggcggggtgaagacagttag

SEQ ID NO: 26685 - DNA, 336 bp, Artificial Sequence
  Description of Artificial Sequence: Synthetic coding sequence
atgaccggcagcaacagccacatcaccatcctgaccctgaaggtgctgccacactttgagtcgctggggaaacaggagaaaattcccaacaagatgagcgcatttaggaaccattgtccacatcttgactctgtcggcgagatcacgaaggaggacctgatccaaaagagtctggggacctgccaggactgtaaggttcagggaccaaatttatgggcttgtctcgaaaacagatgctcatacgtcggttgcggcgagagtcaggtcgatcactccaccattcactcccaggagacaaaacactatttgacggtgaatcttacaactcttcggtag

SEQ ID NO: 26686 - DNA, 228 bp, Artificial Sequence
  Description of Artificial Sequence: Synthetic coding sequence
atggccggccaggaggaccccgtgcagcgggagatccaccaggactgggctaatagggaatacattgagattattacctccagtatcaagaaaattgccgattttctgaatagcttcgacatgagctgcagaagccgcttggccactctgaatgaaaaactaacggctttagaacgcaggattgagtacatcgaggctcgcgttaccaagggcgagaccctgacatag

SEQ ID NO: 26687 - DNA, 348 bp, Artificial Sequence
  Description of Artificial Sequence: Synthetic coding sequence
atgcggtacgtggccagctacctgctggccgccctgggcggcaactccagtccgtcggctaaggacattaagaagatcctggattctgtaggaatcgaagcggatgacgatcgactcaataaagtgatatccgagttaaatggcaagaatattgaggacgtgattgctcaaggaatagggaaactcgcctctgtgcctgccggcggcgccgtcgccgtgtcagctgcccccggttcggcagctcccgccgccggttccgcccccgctgccgcagaagaaaagaaagatgagaagaaagaggagtctgaggaatccgatgacgatatggggtttggtcttttcgactag

SEQ ID NO: 26688 - DNA, 1077 bp, Artificial Sequence
  Description of Artificial Sequence: Synthetic coding sequence
atgcccggctgcgagctgcccgtgggcacctgccccgacatgtgcccagccgcagagagggctcagcgggagagagaacatcgactccataggctggaggtcgtgcctggatgccgccaggatccccccagagctgacccacagagggccgtcaaggaatattcgaggcccgcggccggaaaaccccgacccccgcccagccagttacggcccccttcagtccttctcgccacggtgcgatacctggctggagaggtggccgagagtgccgacatcgcaagagctgaggtggctagcttcgtggcagatcgtctgcgggccgtgctcctagacctggctctgcagggggccggcgacgctgaggccgccgtggtcctggaagcagctctcgccactctcctaaccgtggtggcacgcttgggccccgatgcagcaagaggaccagcggatccggttctgcttcaggcccaggttcaggaaggattcggatcactgcgcaggtgctatgctcgcggcgcaggtcctcatccgcgacagcccgcgttccagggcctgttcctgttgtataatctggggagtgtggaggctcttcatgaagtcctgcagctgcccgccgctctgcgggcgtgtccccctcttcgcaaggctctggctgtcgatgcagcgtttagagagggcaatgcggcacggctgttcaggcttttgcagaccttgccatatttgccttcatgcgccgtacagtgccacgtcggtcatgcccggcgagaggccctggctcgcttcgcccgtgcattcagcacacctaaaggccagaccttgcccttgggctttatggtgaaccttctggcactcgatggactgcgtgaggccagggatctgtgccaggcacacggcctccctttggatggtgaagagagggttgtatttcttaggggacgatatgtggaggagggtctcccccccgcttccacttgcaaggtgctcgtggaatctaagttacggggccggacactcgaggaggtcgtgatggccgaagaagaggacgaaggaaccgatcgaccgggttcaccagcctag

SEQ ID NO: 26689 - DNA, 4047 bp, Artificial Sequence
  Description of Artificial Sequence: Synthetic coding sequence
atggccgacaccgacctgttcatggagtgcgaggaggaggagctggagccctggcagaagatctctgacgttatagaggactctgtcgtggaggactataactccgtggacaagaccaccaccgccggtaaccctctcgtccagcagggcgggcagccactgatactgacacaaaaccctgcgcctggtctgggaaccatggtgacgcagcctgtgcttagacccgtccaagtcatgcagaacgcaaaccacgtaacctccagcccagtcgcctcccagcctatcttcataacgacacaggggttcccagtgcgcaatgtacggccggtgcaaaacgccatgaatcaggtgggcattgtgttgaacgtacaacaagggcaaacagttagaccaataactttggtgcccgcacccggtacccaattcgtgaaaccaaccgtgggggtgccccaagtgttctcccaaatgaccccagttcgccccggttccacaatgcccgtcaggcctactaccaataccttcacgaccgtaattcctgctactctgaccatacgctcaactgtcccgcagtctcagtcccagcagaccaagagcacgccatctacttctaccacacccacagcaacccagcctacctctcttggccagctcgctgtgcagtcccctgggcagtctaatcaaaccacgaaccccaaactcgtgtcaatcgcatcgttcgtaacagtgaagaggcctggcgtgaccggagaaaattccaacgaagttgcaaagctggtgaatacccttaacactatcccatctctgggccagtcacctggaccagtggtcgtatctaataacagtagcgcgcacggatcgcagaggacaagcggaccagagagtagtatgaaggtgacctccagtatccctgttttcgacctgcaggatgggggccggaagatttgtcctagatgcaacgcacagttccgggttacagaggctctgcggggccatatgtgttactgttgccccgagatggtagagtatcagaagaaggggaaatcacttgattctgaaccatcagtgccgtcagcagctaaacctcctagtcctgaaaagacagcccctgtggcgtctactccctccagcacccccattccagccctgagccctcccacaaaggtccctgagccgaacgagaacgttggcgatgccgtccagacaaagttaataatgctggtcgacgacttctattacggccgggatggcggcaaagtcgcccaactgaccaattttcccaaggtggctacctcctttcgatgtccccactgtaccaagcggttaaaaaataatattagattcatgaaccatatgaaacaccatgtcgagctggatcagcagaatggtgaagtggatggccataccatatgccaacactgttaccgtcagttctctacgccatttcagctccaatgccatttggaaaacgtgcattctccatacgagagtactaccaaatgcaaaatttgtgagtgggcatttgaatcggagccactgtttctccagcacatgaaagatacccacaagcccggagaaatgccttacgtttgccaggtttgtcaataccgaagttccctgtatagtgaggtcgatgtccatttccggatgattcacgaggacacgagacacttgttatgcccctactgcctcaaagtattcaagaacgggaacgctttccaacagcactacatgcgtcatcagaaacgaaatgtctatcactgcaacaaatgccggctccagttcttgttcgctaaggataaaattgaacataagttgcagcatcataagaccttcagaaaacccaagcagcttgaaggcctgaagccaggcacaaaggtaaccatccgggcctccaggggccagcctcgcacagttcctgtcagcagtaatgacacccccccctccgccctccaggaggccgcaccactgacatcttctatggaccctctgccggtgttcttgtatcctccagtgcaaagatccattcaaaaacgcgccgtcaggaagatgagtgtcatgggaaggcaaacatgtctggagtgtagcttcgaaattcctgacttccctaaccatttccccacatatgtacactgcagcctatgtagatatagcacttgctgttcaagagcatacgctaatcacatgataaataaccatgtgccaagaaagagcccgaagtatcttgctttgtttaaaaacagtgtgagcggcatcaagcttgcttgcactagctgtactttcgtcacttccgtgggcgatgcaatggctaagcacctagtgttcaaccccagtcataggtcatcttctatcttacctaggggcctgacatggattgcccatagccggcacggccagactcgagatcgagtgcatgacaggaatgtcaagaacatgtacccaccgcccagcttcccaactaacaaagcggccacggtaaaatccgccggggcgacacccgccgagcctgaggaactgctgacacctcttgcacctgcactgcctagccccgcttctacagcaactccccctccaactcccacccacccccaggccctggccctcccacccctagccacagaaggtgctgagtgtttaaatgtggatgaccaggatgaagggtcaccagtgacccaagagccggagctggccagcggcggaggcgggtccggcggagtggggaagaaggagcagctgtccgtaaaaaaactccgggtcgtgctatttgccctgtgttgcaacaccgagcaagctgcagagcacttcaggaaccctcagcgcaggatcagacggtggctgcgccgctttcaggcctcccagggcgagaatctggaaggcaagtacctttcattcgaagctgaggagaagttggctgaatgggtactgacacagcgtgagcagcagctccctgtaaacgaggagacgttattccagaaggccactaaaatcgggcggagcctggagggaggatttaagattagctatgaatgggccgttcggtttatgctaagacaccacctgaccccccatgcccgccgagcggtcgcacacacgctccctaaggatgtggcagagaacgcaggcctgttcattgacttcgtgcagaggcagatccataaccaagacctcccgctgtcaatgatcgtcgccattgatgaaatcagtctgtttctcgatactgaggtgttgagtagcgacgacaggaaggagaatgcattacagactgtgggaaccggcgaaccatggtgcgatgttgtgctggccattctggccgatggcacggttctccccacccttgtgttttaccgcggccaaatggaccaacctgctaacatgccggacagcattttacttgaagccaaagagtctgggtatagcgacgatgaaatcatggaattgtggagcacccgggtttggcagaagcatacggcgtgccagcgcagcaagggaatgctggtcatggactgccaccgcactcacctgagcgaggaggtgctcgcgatgctgagtgccagtagtacactacccgctgtggtgccggccggctgtagttcgaagatccagccgctggacgtatgcatcaagagaactgtaaagaatttcttacacaagaaatggaaggaacaggcccgggagatggccgacacagcctgcgactccgacgttttactgcagctggtcctggtctggctgggcgaggtgctcggggtgattggagactgtccagaactcgtgcagcggtccttcttagtcgcatctgtcctccccggcccagacggaaatatcaattctcccacccgaaacgccgacatgcaggaggagctgatcgctagccttgaggaacaactgaaactgtctggcgagcactccgaaagttcaactcctcggcctagatccagcccggaggaaactatcgagcccgagtccttacaccagctgtttgaaggcgaatccgagactgaaagcttctacggctttgaggaggcagatctcgatttaatggaaatctag

SEQ ID NO: 26690 - DNA, 561 bp, Artificial Sequence
  Description of Artificial Sequence: Synthetic coding sequence
atgttctggaagttcgacctgcacagcagcagccacatcgacaccctcctggaaagagaggacgtgacactaaaagaacttatggatgaggaggatgtgctgcaagaatgtaaagcacaaaaccggaagcttatcgagttcctgctcaaggccgagtgtctcgaggacctggtctctttcatcattgaagagccccctcaggacatggatgaaaaaattcggtacaagtacccgaacatctcatgcgagctgctgacttccgacgtatcgcagatgaatgatcggctcggcgaggacgagtccttgcttatgaaactgtatagtttccttttaaatgattcgccgctaaaccctctgctagcttccttcttttcaaaggtactctcgatccttatttctaggaagccagaacagatcgtggacttcctgaagaaaaagcatgattttgtcgatctcataatcaaacatatcggcacatccgcaattatggatctgttgcttcgtttactcacctgcatcgaaccccctcagccaagacaggatgtgctcaattggttgtag

SEQ ID NO: 26691 - DNA, 288 bp, Artificial Sequence
  Description of Artificial Sequence: Synthetic coding sequence
atgagccagagcggcgccgtgagctgctgccccggcgccaccaacgggtctctcggccggagcgacggagtggcaaaaatgtctcctaaggacctgttcgaacagcgaaagaaatacagcaattccaacgtgatcatgcacgagacctctcagtatcatgtgcagcacttggctacattcatcatggataagtctgaggccattacatccgtcgatgatgccattcggaagctagtgcagctgagttcaaaggagaagatttggactcaggagatgcttttgcagtag

SEQ ID NO: 26692 - DNA, 1740 bp, Artificial Sequence
  Description of Artificial Sequence: Synthetic coding sequence
atggacgacagcaagcaggagagcaccaccagcaaggaggaggagactaacataatatcatccatcgttcccagtacgcaggatatctaccaaagacagaattcgagtgatgtacacaaatcactgctcccggcagtggacgagactacgtgcggacatacacacttccagcagatgatcgataagtacataaacgaagctaatctgattcccgagaagaccgacttgcaggagctggagcacatttttcccaatctgcaccaccagcttttcaagcctctcgaaccccaccctgatttcgatctcagctcttcctctagcgggatttctccagataacagggacttttaccagcgttcagacagctcttccgagagccattgcgctaccggactgtccaagtctactgtttattttacagcactgcgtcggacctccatgcactctagcctgaacacgagccctaatcagcaacctgacacgaacttggcccatgtcggagcccacagcttcgctaccgaaaatataatcggtggatccgagcagtgtttcgagcagctgcaacccgagtacagtagccaggaagagtcccagcacgctgacctcccctcgattttctcaatcgaagctcgggactcttcacaggggatgaagaaccaaaactatccaagtgaggaacacacagaaattctccagaataagaaaaaaatcgtacattttcagctctctatcggtaatttgagcagcgtatactcatccagtgacgaagcaaatgtgttcgatcagctgaatgtccaacattccacaccctgtgggagtaacagcagtgagtgttccacaaaacatcagttggagtctcgaaaggaaagcatgggtttcgaggagctgagcaagcggggtgtcgtgacgatgctccagtctcagggacttattgaagacaacaagaatgagacttgccgggtcctggacatcaatccccaagtggaggaaacagacagccgtttgtgcgtgaggacggttgagatgggaacatccattcaggccccttattcattgacaactcagaacgaaaagtactttgagaattctgctgaaacagatatccctaagattacaaagaagttaagtcagttaggcgagtcagagctgttcgcaagctccgggtctttcagcctgcagagttctatccccgtgtgggaaactgaaacgggccatggtataatggaggagcccgagctgactctcatctctacaacagatacctccatcgcggaaatggactttgcgaatttaactctcgaggaaaagtcagagaacgaagcgaagtgtttcttccaggtctctgagtttcttcccctggtgagcgctaccgaggcgtcagactaccctgcagtgagcgaactgtctatcgaaaaaccaaggactgcttccacagcagagacacccagacgacttacgccagtacctggctcccttcaggaggcgtttatcaaaaggaaaaaatcttttatggaacgcagccaccagagacagaaggaaatacggaataaaattcacgtgtcggaaaactcccagatcaaaactgtcaaggaaaagccgtcaatttccagctccgtttcaagacttaagggagttaataaggtaagagcaagctttcctgaagaccgcaaaaccacccaggctctgcgacatcaacgggggcttaggctgtacaatcagctggccgaggtaaagcagtag

SEQ ID NO: 26693 - DNA, 435 bp, Artificial Sequence
  Description of Artificial Sequence: Synthetic coding sequence
atggtggccatggccgaggccgaggccggcgtggccgtggaggtgcgggggctacctccggcagttcccgacgagctattaacgctgtattttgagaatagacgcagatcaggcggaggccccgtgttatcatggcagcgtttagggtgtggaggggtgcttaccttcagggaacctgctgacgccgaaagggtgttagcccaggccgaccacgagttacacggggcccagctcagtctgagacccgcaccacccagggcccccgccaggttgctcctgcagggcctgccaccaggtacaacaccgcagagactggagcagcacgtgcaggccctgctgcgcgcaagcggccttccagttcagccttgttgcgcattagcctccccccggcctgatcgcgcattggtacaactacccaagccattgtcagaatag

SEQ ID NO: 26694 - DNA, 246 bp, Artificial Sequence
  Description of Artificial Sequence: Synthetic coding sequence
atggtggccatggccgaggccgaggccggcgtggccgtggaggtgaggggccttcctccagctgtgccagatgaactgcttactctttattttgagaaccgacggaggagcggtggaggacctgtgctctcttggcagcgcctcggctgcggcggggtcctgacgttcagagaaccagccgatgccgaacgagtactcgcccaggccgatcatgagctccatggagcacaactgagcttacgctag

SEQ ID NO: 26695 - DNA, 1539 bp, Artificial Sequence
  Description of Artificial Sequence: Synthetic coding sequence
atggccgccttcaagctggacttcctgcccgagatgatggtggaccattgtagccttaacagctctccagtgagtaaaaaaatgaacggaacactggaccaccccgatcagcccgaccttgacgctatcaagatgtttgtgggtcaagtgccccgaacatggagtgaaaaagatttaagggaactgttcgagcagtatggagctgtgtacgaaattaacgtgttgcgggataggagtcagaatccccctcagtccaaggggtgttgcttcgttaccttttacacacgaaaggccgccctcgaagcacaaaacgcccttcacaacatgaaggtgctgcccggcatgcaccaccccattcagatgaagcccgctgatagcgaaaagaataacgtggaagaccggaagctcttcattggcatgatctccaagaaatgcaccgagaatgacattagagtaatgttctcttccttcgggcaaattgaggaatgccgcatcctcagaggtccagatggcctgtcccgtggctgcgctttcgtaactttcacgacccgcgcaatggcacagacggcaatcaaggcaatgcaccaggcccaaaccatggagggctgttcctcaccaatggtcgttaaatttgcagatactcagaaagataaggagcagaaaagaatggctcagcagctgcagcagcagatgcagcagatctccgcggcttccgtctggggaaacttggctggacttaatacactgggccctcagtaccttgctctctaccttcaactgcttcagcagactgcctcttctgggaacctcaacacattatcttccctgcatcccatgggcggcctgaatgccatgcaactccagaacctggcagcattggccgctgccgcttccgctgcccagaacacgccatccggaactaacgctttaacaacttcgagcagccccctgagcgtgctgacaagtagtgggtcgtcaccatcttccagttcttctaacagcgtgaacccaattgcaagccttggcgctctgcagacactagctggtgccacagcaggccttaatgttggatccctggctgggatggcagcactcaacggtggactggggtcaagtggactctctaacggcaccggcagcaccatggaggccctcacacaggcatatagcggcattcagcagtacgcggccgccgccctgcctacactctacaaccaaaatttactaactcaacagtctataggggccgcaggttctcagaaggaggggcccgaaggggctaatcttttcatttatcatctgccgcaggagtttggcgaccaggacctgctccaaatgttcatgcccttcggcaacgtggtgtcagccaaggtgtttattgataaacagaccaatctgagcaaatgttttggctttgtctcatacgacaaccctgtaagcgctcaggctgccatccagagtatgaatggtttccaaattggaatgaaaaggctgaaggtgcagctgaaaagaagcaaaaatgatagcaaaccctattag

SEQ ID NO: 26696 - DNA, 1131 bp, Artificial Sequence
  Description of Artificial Sequence: Synthetic coding sequence
atgaaggacgtgcccggcttcctgcagcagagccagaacagcggcccgggccagccagccgtctggcaccggctagaggagctttacaccaaaaagctgtggcaccagttgacgctgcaggtattagattttgtgcaggacccttgtttcgcacagggcgatgggttaatcaaactctatgaaaattttatctcggagttcgaacacagagttaacccactgagcctggtcgagatcattctgcatgtggttcggcagatgaccgaccctaatgttgccctgactttcttggagaaaactagagagaaggtcaagtctagcgatgaggcagtcattctttgcaagaccgccattggtgcactgaaactgaatattggcgacctgcaagtcactaaagagacaatagaggatgtggaagagatgctcaacaacctaccaggagttacgagtgtgcattcacgcttctatgacctgtcttccaagtattaccagaccatagggaatcacgcttcctattataaggatgctctcagattcttaggatgtgtagatatcaaggatctgcccgtgtcagagcagcaggagagggcgttcactctggggcttgctggtcttctgggtgaaggcgtgtttaacttcggcgagttgttgatgcatcctgtgctggagtctctccgcaatactgatcggcagtggctaattgataccttgtacgcgttcaactctgggaacgtcgagcggttccagaccctgaagaccgcctggggacagcaaccagacctcgctgccaacgaagcccaactcctaagaaagatccaactgctctgcctgatggagatgacattcacacgacccgctaatcatcggcagctgacatttgaagagatcgcgaagtctgccaagatcactgttaacgaagtcgagttgcttgtgatgaaagccctctccgtgggactcgtaaaagggagtatcgatgaggtcgacaagagagtgcatatgacgtgggtgcagccccgggttctggaccttcagcaaatcaaaggcatgaaagatagactggagttctggtgtaccgatgtcaaatcaatggaaatgctcgtggagcaccaagctcatgatatcctgacttag

SEQ ID NO: 26697 - DNA, 489 bp, Artificial Sequence
  Description of Artificial Sequence: Synthetic coding sequence
atgaccagcaagaagctggtgaacagcgtggccggctgcgccgacgatgcacttgcaggcctggtcgcctgcaatccaaacttgcaactgctgcagggacacagagtggccctgcggagtgatcttgactccctaaagggaagggtggcgctgctttctggtgggggaagtggccatgagcctgcccatgctgggttcattggtaaagggatgctcacgggagtcattgccggagccgtttttactagtccagcagtgggatctatcctggccgcgatccgtgccgtcgcccaggctggcacagtcggcacactgctgatcgtgaaaaattacactggagaccgcttgaactttggcttggcgcgcgagcaagcacgtgccgagggtatccctgtggagatggtagtcatcggtgatgattcagcctttacagtgttaaaaaaggctggaaggaggggcctgtgcgggaccgttttgatccataaatag

SEQ ID NO: 26698 - DNA, 7854 bp, Artificial Sequence
  Description of Artificial Sequence: Synthetic coding sequence
atgctgaccgacagcggcggcggcggcaccagcttcgaggaggaccttgactcggttgccccccggagcgcaccagcgggggcaagtgagcctccaccccctgggggagtcggtctcgggatccggaccgtacggctgtttggcgaggcaggaccagctagtggcgtggggtcctcaggaggcggcgggtcaggtagcggcacaggggggggagacgctgctttggatttcaaactggccgctgctgtgctaaggacaggcggcggcggcggggcaagcgggtccgacgaggacgaagtcagtgaggtggagagcttcatccttgaccaggaggatctggacaatccagttttaaaaacgacttcggagatctttctcagcagcacagctgaaggggctgatcttcggacagtagatcccgagacacaggccaggctcgaagcgcttctggaagcagccggaatcggcaaactgtcgacagctgatgggaaggccttcgcagatcccgaagtgttacgccgcctgactagctctgtttcttgtgcgctggacgaagccgcggccgcactgactaggatgaaggccgagaactcccataatgccggacaggtggacacacgctccctggccgaagcatgctcggatggggatgtgaacgccgtgcggaagctcctcgacgagggccggtctgtcaacgaacacaccgaggaaggggaatcactcctttgcctggcttgcagtgctgggtactacgaactggctcaggtgctgctggcaatgcatgccaatgtcgaagaccgcggcaacaaaggcgacatcacaccgctgatggcagcgtccagcgggggatacttagacattgtcaaactgcttcttttacatgacgcagacgtgaacagtcagagcgcgacgggaaatactgctttgacctacgcttgtgccggaggtttcgttgacatcgtcaaggttctactcaatgagggcgccaacattgaggatcataatgagaatggccataccccacttatggaagccgcctcagccggtcatgttgaggtggcaagagtactgttagaccatggcgccggaattaacacccactctaatgaatttaaagaaagcgcactgacactggcctgctacaagggtcacctggacatggtgcggtttctgttggaagccggcgccgatcaagaacacaaaacagacgagatgcataccgctctaatggaggcttgcatggacggacacgtggaggttgccaggcttttactggacagtggggcacaggtcaacatgcctgccgactcctttgaaagccccctgacactcgctgcctgcggcgggcatgtcgaactggccgccttgctgattgagcgcggagccaatttagaagaagtgaacgacgaaggttacaccccgcttatggaagctgctagagagggacatgaggaaatggttgccttattgcttgcgcagggtgctaacataaatgctcagacagaggaaacccaggagacagcgctcactctcgcttgttgtgggggtttctcggaagtggcagactttcttattaaagctggcgccgacatcgagcttggctgcagtacacccctgatggaagctagtcaggaaggtcatctcgagctggtgaagtacctcctggccagtggagctaacgtgcacgcaaccacagctacgggagatacggccctcacctacgcctgcgaaaacggccacaccgatgtggctgatgtcctcctacaggcgggcgctgacctggaacacgaaagcgaagggggacgaaccccgctcatgaaagctgcccgagcaggccatctgtgcacagtgcagtttttgatctccaaaggggcaaatgtgaatagggccacagcaaacaacgatcacaccgtggttagcctcgcctgtgcgggaggtcacttggctgtggtggaattgttgctagcacatggggccgatccaacccatcgccttaaggacggaagcacaatgctcattgaggccgccaaaggaggccacaccaatgttgtgagttacctcctggattatcccaacaatgtgctaagcgtgcctactactgatgtgtcccagttacctccaccctcgcaggaccaatcacaggtcccacgagttcccacacatacgctggccatggtggtcccgccgcaagagccggacaggaccagtcaggaaaatagcccagccttgcttggcgttcagaaaggaacatcaaaacagaagagttcaagtctccaggtggccgatcaagacttgttaccttctttccacccttaccagcccctcgaatgcatcgtagaggagacggagggtaagctgaatgaactgggtcagcgaatttctgcgatcgaaaaagcacagctgaaatcattagagttgattcagggcgagcccctgaacaaggacaagattgaggaactgaagaagaatagggaggaacaggtacagaaaaagaaaaagatcctgaaggagttacagaaagtggaaagacaattgcagatgaagacgcagcagcaattcactaaggagtacctggaaacaaagggccaaaaggatacagtttcactgcaccagcaatgctctcaccgcggcgtcttcccggagggagagggcgatgggagcctacctgaggaccatttctccgagcttcctcaggtggatacaatactgtttaaagataacgacgtggacgacgaacaacagagcccacccagcgcagagcagattgactttgtgcccgtgcagcctctctcctctcctcaatgcaacttttccagtgatctggggtcaaatggcacaaacagccttgagctgcagaaggtctcgggcaaccaacagatagttgggcagcctcagattgcaattactggtcatgatcaagggttgcttgttcaggaaccagatggcctcatggtggcaactcccgcccagacactcacggacactctagacgatttgatagccgccgtgtccactagagtaccaaccggaagcaattcaagttcacaaacaactgaatgtttgacacccgagtcctgctcacagaccacctcaaatgtggcatcacagtctatgccccccgtctacccaagcgtggatatcgatgctcataccgaaagcaaccatgacactgccctgacattggcttgcgccggcggtcacgaggaactggtgtcagttctgattgcccgtgacgctaaaatcgagcaccgagacaagaaggggtttacacctctcatactggccgctactgcaggacacgttggggttgtcgagatccttctagacaaagggggggatattgaggcacaatcagagcgaactaaggatacacctctctcccttgcatgtagcggtgggcggcaagaagtggtggacctcctgctcgccagaggcgccaataaggaacatagaaacgtatcagattataccccacttagtctggcagcctccggtggatatgttaacattatcaagatactgttgaacgctggagcagaaatcaattccaggaccggctcaaagctcggcatatcccccttaatgctcgcagccatgaatgggcacgtgccagcagtgaagctgttgttggatatgggtagtgatattaacgcacagatcgagaccaataggaatactgcgctgactttggcttgcttccagggtagagctgaggtggtcagcctcctgcttgatcgcaaagctaacgtggagcatagagccaaaaccggtctgacaccgttgatggaagctgcctcaggaggctacgctgaagtagggcgtgtgttgctcgataaaggggctgacgtcaacgcacccccggtaccttctagccgggacactgccctcactatcgcagcggacaaagggcattacaagttctgtgaactgcttattcatcgtggggctcatatagacgtcaggaataaaaaaggcaatacccccttatggttggcctctaatggagggcattttgacgtcgtgcaactgctggtgcaggcaggagccgacgtcgacgccgccgataacaggaagattacacctttgatgtcggccttccgcaagggccacgtcaaggtggtgcaatacctcgtcaaggaagtgaatcagttcccatccgatatcgagtgtatgagatacattgccaccatcactgataaagaattactgaaaaagtgccatcagtgtgtggagacgatagtaaaagccaaagaccagcaggccgccgaggctaacaagaacgcatccattctgctcaaggaactagacctggagaaatcccgagaggagtcacgtaagcaggcactcgctgccaaacgagaaaagaggaaagaaaaacggaagaaaaaaaaagaggaacagaagaggaagcaggaggaagacgaggagaataagccaaaggagaattccgaactgccagaagatgaggacgaagaagaaaatgatgaagacgtcgagcaggaggttcccatcgaacccccctcagccaccacaactactaccatcggcattagcgcgacgtctgcaacttttacaaacgttttcggtaagaagagggctaacgtggttacaaccccttccaccaataggaagaacaaaaaaaataaaacaaaggagaccccacccaccgctcacttgatccttccggagcagcatatgtctttggcgcagcagaaagctgataagaacaagattaacggggagcctcgagggggcggagccggtggcaactcggacagcgacaatctggacagtacagactgtaatagcgaatcttcatcagggggtaaatctcaggaacttaatttcgttatggatgtcaattcttccaaataccctagccttctgcttcatagccaggaagagaaaacttcaacggcgaccagcaagacgcagacgcgccttgaaggagaggtgaccccaaactcactttccacctcttataagacagtatctctgcccctctctagtcctaatatcaaactgaatcttacttctccgaaacgtgggcagaagagagaagaggggtggaaagaagtcgtcaggcggagtaagaagcttagcgtaccggcttctgtagtctcccgcattatggggcgtggagggtgtaatatcacagccattcaggatgtcacaggagcccacattgatgtggataaacagaaagacaagaatggagagaggatgatcactatcagagggggcacagagtccacaaggtacgccgttcagttaataaatgctttaattcaagacccggcaaaggaattggaagacctgattccaaaaaaccacatcaggacacctgccagtacaaagtctatacacgccaatttcagtagcggggtgggcaccactgccgccagctctaagaatgccttcccgctgggtgctcccactctggtgacgtctcaagccacgacactgagtacgttccagccagcaaacaagctgaacaaaaacgtccccacaaacgttcgctcgtcattccctgtgagcctgcctctggcctaccctcacccccactttgctctcctcgcagctcagacaatgcagcagatcagacacccgaggttgccaatggctcaattcggggggactttttcccccagtcccaatacctgggggccatttccagtgagaccagtcaatccaggaaatactaactcttcaccaaaacataacaacacttctcggttgcctaaccagaacgggacggtgctcccctctgaaagcgctgggctcgctacagcgagctgccctataacagtttcgagcgtcgttgccgcctcccagcagctctgtgtgaccaatacacgtaccccctcctctgtccggaaacagctcttcgcctgcgtaccgaagacgagccctcctgcgacagtcatttctagtgtgacctctacttgttctagcctgccatctgtgtcttccgcccccatcacctccgggcaggcccctaccacgttcctgccagcttccacgtcccaggcgcaactgtcgtctcagaaaatggagagttttagtgcagtgcctcctactaaagagaaggtgagcacccaggatcaaccaatggccaacctttgtaccccaagttctactgccaactcttgctctagcagtgccagcaatacccccggcgcacccgaaacacatccgtcttcaagtccaaccccgacaagcagtaatacacaggaggaggcccagccctcctctgtttcagacctgagccccatgagcatgccattcgcttctaattccgaaccagcccctctgacgctaacttctcccagaatggtggccgccgataaccaggatacaagcaatttaccacagctggctgtgccagcacctcgggtttcacaccgaatgcagcctagggggtctttttattcaatggtccctaacgcaacaattcatcaggatcctcagagcattttcgtgaccaaccctgttacactgactcctccacagggtccccctgctgctgtgcagttgtcttccgcagtaaatataatgaacggttcacaaatgcacattaaccctgccaataaaagccttcctccaaccttcggacctgccaccttgttcaatcacttctccagcctgtttgactcatcccaggtgcccgccaaccagggctggggggacgggcccctgagtagtcgggtggcgactgacgcatcctttacagttcagtccgctttcctggggaacagcgttctcggacatttagagaacatgcacccagacaactcaaaggccccagggtttcggccccccagccaacgcgtgtctacctcacccgtgggcctgccgtccatcgacccaagcggctccagtccgagtagcagcagcgcaccgcttgccagtttcagtgggatccctggaactagggtgtttctgcagggccctgcacccgtgggtacgccttcatttaatcggcagcacttcagcccgcatccttggacctccgctagcaacagcagcacctctgccccccccaccctggggcaacccaagggggtgagtgcgtcacaggatcgcaaaatccctccacctattgggaccgaaagacttgctagaatcaggcaggggggttccgtcgcacaggcacccgccggcacaagttttgtcgcacctgttggccattcaggaatctggagttttggcgtgaacgcggtgagcgaggggttgtctgggtggtcccaatccgtgatgggtaaccatccaatgcaccagcagctgtccgatccctcaactttttcgcagcaccagcccatggagagggatgatagcggtatggtagcccccagcaacatctttcaccagccaatggcctcaggattcgtggacttcagcaagggactgccgatctccatgtacggaggaaccataatccccagtcacccacagttggcagacgtccctggcgggcccctgtttaatggtctacataatcccgatccagcctggaatcccatgatcaaggtgatacaaaacagcaccgagtgtaccgatgcacagcaggccagtttgctgccttctgtgcctgccctgaagggcgaaattccctcaccccagctaaccaggccaaaaaagcgtatcggcagaccaatggtggcaagccccaaccagagacaccaggaccacctgagaccaaaggttcctgccggggtccaggagcttactcactgtcccgacactcctctgcttccaccatccgactcccgggggcacaacagcagcaactcacccagtctgcaggctggcggcgccgaaggagccggcgaccgtgggagagacacgcggtag

SEQ ID NO: 26699 - DNA, 753 bp, Artificial Sequence
  Description of Artificial Sequence: Synthetic coding sequence
atgggcgacatccccgccgtgggcctgagcagctggaaggccagccccggcaaggtgacagaggcggtgaaagaagcaattgacgcagggtatcgacactttgactgtgcctacttttaccacaacgagagggaggtcggcgcggggattaggtgcaaaattaaagagggagctgttcgccgggaagatctgttcatcgccactaagctgtggtgtacctgtcacaagaagtctctggtcgagacagcgtgtaggaaaagccttaaagcactaaaactgaactatctggacctttatttaattcattggccaatggggttcaaaccaccgcacccagagtggataatgtcctgctcggagctctcattctgtctgtcccatccgcgggtgcaggatcttccactagacgaatcaaatatggtcatcccctccgatactgacttccttgacacctgggaagccatggaggacttagtcatcaccggattggtgaagaatataggagtgtccaactttaaccacgagcagttggagcggctgctaaacaagccaggcttaaggtttaagcctctcactaatcaaatccttatacgcttccagatccagaggaatgtgatcgtgataccggggagcataactccttctcacattaaggagaatatccaggtgttcgactttgagctgacccagcatgacatggataacattctctccctgaatagaaacctgcggctggccatgttccccatgtag

SEQ ID NO: 26700 - DNA, 525 bp, Artificial Sequence
  Description of Artificial Sequence: Synthetic coding sequence
atgctgaccgagaacggccaggtgctgagctgcggcagcaacagctttggccagttgggggtaccacacggtcccaggcgctgtgtggtcccacaagcaatagagcttcataaagagaaagtggtgtgcatcgcggccgggctgaggcatgctgtcgccgccacagcaagcggtatcgttttccagtggggaaccgggctggcctcctgtggacgaagactctgtccaggtcagacactgcccctgtttttcaccgcaaaggagccgtcgagagtgacagggctcgagaactccaaggctatgtgtgtattagctggaagtgaccacagtgctagccttaccgatgccggagaagtgtacgtgtgggggagcaataaacatggacagttggctaatgaggccgccttcctccctgttcctcagaagatcgaggcccactgcttccagaatgaaaaagtgactgcaatttggtctggctggacccacctggtggcacaaacagggttactgtggctccgtgcctag

SEQ ID NO: 26701 - DNA, 228 bp, Artificial Sequence
  Description of Artificial Sequence: Synthetic coding sequence
atgaaccggcggcggaagttcctgctggccagcgtgctggccctgcagaacagctctttcatctatccctcatgtcaaaaatgctttagccggatcatactcgttagtaagcggagcaattgccctaaatgcggttcaaccggtgagagtggcaatgcaaactatcggtataagcttagtttgaaagttgccgaatcaaataagcttttcgtgattactgtcttctag

SEQ ID NO: 26702 - DNA, 252 bp, Artificial Sequence
  Description of Artificial Sequence: Synthetic coding sequence
atggtggccatggccgaggccgaggccggcgtggccgtggaggtgcggggtctgccccccgcagtccccgatgaacttctcactctatatttcgagaacaggagaaggtccggggggggacctgtgctttcttggcaacgcctcggctgtggaggagtgttgactttcagggagccagccgacgcagagagggtgttggcacaggccgaccacgaacttcacggggcacagttaagtctcaggcctgcctag

SEQ ID NO: 26703 - DNA, 528 bp, Artificial Sequence
  Description of Artificial Sequence: Synthetic coding sequence
atgctgagcgaggaggagaaggaggagctgaaggccgagctggtgcaactggaagatgagattacgaccctgaggcaagtgctgtctgcaaaggaacgacacctggtggagatcaaacagaaactaggaatgaaccttatgaacgagttaaagcaaaatttttcaaagagctggcacgatatgcagactacgacggcgtataaaaagactcacgaaactcttagtcacgcggggcagaaggctactgctgcctttagtaatgtgggcacagccatcagcaaaaagtttggcgatatgtcgtatagtattcggcactctatctctatgcctgccatgcgcaattctccaacatttaagtcattcgaggagcgcgtcgagaccactgtaacctccctaaagactaaagtagggggaacaaatcccaatggcggcagctttgaggaagtcttgtccagtacagcccacgctagtgcccaatctcttgcaggcgggtcacgccggacaaaagaggaggaactgcagtgctag

SEQ ID NO: 26704 - DNA, 231 bp, Artificial Sequence
  Description of Artificial Sequence: Synthetic coding sequence
atgaaccggcggcggaagttcctgctggccagcgtgctggccctgcaaaacagtagcttcatatatccctcttgtcaaaaatgcttctctcgtattattttagtgtccaagcggtcaaattgtcctaagtgtggtagtaccggggagagcggcaatgctaactacaggtataagctgtcgctcaaagtcgctgaatctaacaaattatttgtaatcaccgtattcggttag

SEQ ID NO: 26705 - DNA, 456 bp, Artificial Sequence
  Description of Artificial Sequence: Synthetic coding sequence
atgagcatccccttcagcaacacccactaccggatcccccagggctttggtaacttgctcgaaggactgacaagggagatcctgcgcgagcaacccgacaacattccagctttcgctgccgcttacttcgagagtttgctggaaaagcgggagaagactaatttcgatccagctgagtggggaagcaaagttgaggacaggttttataataaccacgcatttgaagagcaggagcctcccgagaaatcagacccaaagcaggaggaaagccaaatctccgggaaagaagaagagaccagtgtcactatcctggactcgagcgaagaagataaggagaaagaggaagtcgctgcagtcaagatccaagctgcctttcgggggcacatagcccgggaggaagccaagaagatgaagaccaattccctccaaaacgaggagaaagaagagaacaaatag

SEQ ID NO: 26706 - DNA, 270 bp, Artificial Sequence
  Description of Artificial Sequence: Synthetic coding sequence
atggaggccgccgacgccagccggagcaacggcagcagccccgaggctagagacgctaggagccctagcgggccgagcggcagcctggaaaatgggaccaaggcggatggcaaagacgctaagactactaacgggcacgggggcgaggccgcagagggcaagagccttggctctgcactgaaacccggcgagggcaggtctgcattgtttgctggcaatgagtggcggcgccccatcatccaatttgtggaaagcggagatgacaaatag

SEQ ID NO: 26707 - DNA, 1542 bp, Artificial Sequence
  Description of Artificial Sequence: Synthetic coding sequence
atggaggtgggcatcaccatccagcacgcctacgagaagcagcacccctggatcgacttaaccagcatagggttctcgtacgtgattgatttcaacaccatgggccagatcaatagacagactcagaggcagcgaagagtccggcgacgactagacctgatataccccatggtgacaggtaccttaccgaaagctcaaagttggcctgtgtctccaggtccagctacctcccctccaatgagtccgtgtagttgcccgcagtgcgtgctcgtaatgagtgtgaaggccgcagttgttaacgggtccaccggaccgctgcaactcccggtaactcggaaaaacatgccccctcccggtgttgttaagctgccaccactccctggcagcggcgccaagccactggattcaacaggcactatcagaggacctctcaagaccgctccctcgcaagttattcgaaggcaggcctcctccatgcccaccggaaccacgatgggaagccctgcatcccctccaggaccaaatagcaagactggaagggtggctctggccactctcaatagaactaacctacaaaggttggctatagctcagagccgggtgctgattgccagcggcgttcctacagtccctgtaaaaaatctgaatgggagctcaccagtgaacccagcactggccggtatcactggtattctgatgagcgccgctggcctcccagtttgcctgacccggcctcctaagctggtactccaccctccacctgtgtcaaagtccgagatcaagagcatccccggtgtaagtaacacttcgcgaaagactaccaaaaagcaggctaaaaaaggcaagacgcccgaggaggtgctgaaaaagtatctgcagaaagttcgccacccacccgatgaggattgcactatctgcatggaaagactgactgctccatcaggatataaagggcctcaacccactgtgaaacctgatctggtgggtaaactctctcgatgcggtcatgtatatcacatctactgcctggtggccatgtataacaacggaaacaaggatgggtccctgcagtgcccaacatgtaaaaccatatacggcgttaaaacagggactcagccccccgggaagatggagtaccacttaattccgcactccctgcccggacatcccgattgcaagaccatcagaatcatctattctattccccccggcatccaaggccctgaacaccccaaccccggcaaatcattctctgccagaggctttcccaggcattgttatctgcccgatagtgagaaaggtcggaaggtcctgaaactattgctagtggcctgggaccgtagactgattttcgcgataggcacgtcctctaccaccggagagtcggacacagtcatctggaacgaagtgcatcataagaccgagttcggcagcaatttaactggccatggctatcccgacgctaactacttggacaatgttctagcggagctggccgcacaggggataagcgaagacagcactgcacaagaaaaagattag

SEQ ID NO: 26708 - DNA, 414 bp, Artificial Sequence
  Description of Artificial Sequence: Synthetic coding sequence
atgagcagcgtgcagagccagcaggagcagctgagccagagcgaccccagcccatcgcctaattcctgttcttccttcgaactgattgatatggatgccggcagcttgtatgaacctgtcagccctcactggttctactgcaagatcatagatagcaaagaaacatggatccctttcaacagcgaggatagccaacagctggaggaggcctattcttcaggcaaagggtgtaatgggcgtgtagtgcctactgacggtgggcgttacgacgtacacctgggggaacgcatgcggtatgcagtgtattgggatgagctcgccagcgaagttcggaggtgtacatggttctacaaaggagacaaggacaataaatacgtcccttactccgagtctttctcccaggtgctcgaatag

SEQ ID NO: 26709 - DNA, 120 bp, Artificial Sequence
  Description of Artificial Sequence: Synthetic coding sequence
atgttctggaagttcgacctgcacagcagcagccacatcgacaccctcctagaacgcgaagatgtcactttgaaagaactgatggatgaggaagacgtgttgcaggaatgcaaagcttag

SEQ ID NO: 26710 - DNA, 2157 bp, Artificial Sequence
  Description of Artificial Sequence: Synthetic coding sequence
atgctgatgaccctggagatgaccgagctgaccgacccccaccacaccatgggcgactacaaagttgctcacccccaggatccccatcacccatccgaaaagcccgtgatacactgccacaaatgcggggaaccctgtaaaggggaggtgttaagggttcaaaccaagcactttcacatcaaatgctttacctgtaaagtatgtgggtgcgatctggctcaagggggtttctttataaagaacggggaatacctgtgtactctggattatcagaggatgtacggtacacgttgccacggctgcggggaattcgtggagggggaggtggtaacggctctgggcaaaacgtatcacccgaactgcttcgcttgtaccatttgcaaacggcccttcccccctggggatcgggtgacattcaacgggcgcgattgtctgtgccagctgtgtgctcagcccatgagcagcagtcctaaggaaacaaccttctcaagcaactgcgcagggtgtgggcgggacataaaaaatggtcaggccttgctagcacttgataagcaatggcatctgggctgctttaaatgcaaaagttgcggcaaggttctaacgggcgagtatatttccaaagacggggccccatattgcgaaaaggactatcagggcttgttcggtgtcaaatgtgaggcttgtcaccagtttatcactggcaaggtgttggaggctggcgacaaacactaccacccttcatgtgcccggtgttcacgctgcaatcagatgtttaccgagggagaggaaatgtacttgcaaggctccacagtgtggcaccctgactgcaaacaatctacaaagacagaagaaaaactcaggcccacgaggacgtcctcggaaagtatctactctagacctggctcgtcaatcccggggagcccagggcacacaatctatgccaaggtcgacaacgaaatcctcgactacaaagatctggccgctattcctaaggtcaaggcgatttatgatatcgaacggccagatcttattacttatgagccattctacaccagtggctacgacgacaagcaggaacgccagagccttggcgagagccctcggacgctatcccctacaccaagcgcggaaggctaccaggacgtcagggacaggatgattcatcgaagcacttcccaagggtccatcaactcaccagtttactcccgccactcctacacccctactacatcaaggtcacctcagcacttccacagaccgggaaacgaaccctcatctggtcgcaacagtccattaccatacaggcctgacagtcgccccttaacccctacatacgcacaggcacccaaacactttcatgttcccgatcaaggaataaatatctaccgtaagccaccaatctacaaacaacacgctgctctagctgctcagagtaagagttctgaggacattattaaattttctaaattcccagctgcacaggcgcccgatccgtctgaaactcctaaaatcgagaccgatcactggccagggccccccagcttcgctgtggtaggcccagatatgaaacgacggtcatcaggcagagaggaagacgatgaagagcttctgagacggcgacagttacaggaggaacagctgatgaagctgaatagcgggcttggccagctgatcttgaaggaagaaatggagaaagagtctagagaacgctcatccctgctagcaagtcgttatgacagccccattaatagcgcctctcatatccccagtagcaaaaccgccagcctgcctggatacgggcggaatggacttcatcggcctgttagtaccgactttgctcagtacaattcttatggtgatgtttctggtggtgtacgcgattttcagacactgcccgatggccatatgccggccatgcgaatggacaggggagtgtcaatgcctaatatgctggaacctaagattttcccatatgaaatgctgatggtcacgaaccgaggtcggaacaaaatcctacgcgaagtggatcggacgcggctggaaagacatttagcaccagaggtattccgggaaatattcgggatgagcatccaagaatttgataggctaccactttggaggcgcaacgatatgaagaaaaaggctaagctcttttag

SEQ ID NO: 26711 - DNA, 2148 bp, Artificial Sequence
  Description of Artificial Sequence: Synthetic coding sequence
atgagccagagcggcgccgtgagctgctgccccggcgccaccaacgggagtctgggtcgaagtgatggggtcgctaagatgtcccccaaagacctcttcgaacagcggaaaaaatatagcaactccaacgtaattatgcacgagacctcgcaataccatgtccagcacctggccacttttatcatggacaagtcggaggccatcacgtcagtggatgatgctataaggaagctggtgcagctctcatcaaaggagaaaatctggacccaggagatgctcttgcaggttaacgatcagtccctgcgacttcttgacatcgagtctcaggaggaactggaggattttccactccctacagtacaacgtagccagactgtgctaaatcagttgaggtacccttctgtcctccttctggtatgtcaggatagcgagcaatctaagcccgacgttcatttctttcactgtgatgaggttgaggctgagctagtacacgaggacatcgagagtgccttagccgactgcaggctcgggaagaagatgagaccccagacattgaaaggccaccaggagaaaattcgtcagagacagagcattctgcctccacctcaggggccagccccaatcccatttcagcatcgaggtggggacagtccagaagccaaaaatcgggtcggccctcaggttccactgtccgagcccgggtttcggcgcagggagtcacaggaggagccacgggccgtgctggcccagaaaatcgaaaaggagacacagattctcaattgtgccctggacgatatcgaatggttcgtagctcgcttacagaaggctgctgaggccttcaaacaacttaatcagagaaagaaaggtaagaaaaaaggcaagaaggcccccgcagagggtgttttaacccttagagctaggccaccatctgagggggagtttatcgactgcttccagaagatcaaactcgcaattaacctcttggcaaaacttcaaaaacatatccaaaacccttccgccgccgagcttgtgcactttctctttggacccctggacctgattgttaatacatgcagcggccctgatattgcacgaagcgtttcttgcccattgctctcccgggatgctgtcgatttcctcagaggccacctggtgccaaaggagatgagcctgtgggaatctctcggcgaatcttggatgcggccacgctcagaatggcctcgcgagccccaggtgcccctttacgtccccaagtttcacagtggctgggagccgcccgtcgacgtcctgcaagaggcaccgtgggaggtcgagggacttgcgagcgcccctattgaagaggtgtcaccagtgtcaagacaaagcattaggaattctcagaaacactcgcctacatcggagcctacacccccaggggacgccctgccccctgtttccagcccccacactcatcggggctaccagcctaccccggccatggccaagtatgtcaaaatactctacgatttcacagcacgcaatgctaacgaactctcagtcctgaaagatgaagtcctggaagtgctggaggatggtagacagtggtggaagctacggtcacgaagcggccaggcaggatacgtgccatgcaacatactcggcgaggcacgacccgaggatgccggagcgccattcgagcaggctggacagaagtattgggggcccgcctcgcccacccataaactacccccttcttttcctggcaacaaggacgagttgatgcagcacatggacgaagtgaatgatgaacttatcagaaagatcagcaacatccgcgcccaaccccaaagacattttcgggtggagaggtcacagccagtgagccagcctctgacctatgaatccgggccggacgaggtcagggcctggctcgaagctaaggccttttcaccacggatcgtggagaacctcggcattctaacaggcccacagctgttttccctgaataaagaggaactgaagaaggtttgcggggaggagggcgtccgagtatattcccagttgactatgcaaaaggccttcttggagaaacagcaaagcggaagcgaactcgaggagttaatgaacaagttccatagtatgaatcagcggcggggcgaagactcatag

SEQ ID NO: 26712 - DNA, 360 bp, Artificial Sequence
  Description of Artificial Sequence: Synthetic coding sequence
atggagaccgacctgaacagccaggaccggaaggacctggacaagttcattaaattttttgcactgaagactgtgcaggtcattgtgcaagcccggctgggcgaaaaaatctgcaccagaagctcaagttctccgacaggcagtgactggttcaaccttgcaattaaggatattcctgaggtgactcatgaagctaagaaagcgttggccgggcagctgcccgcggtggggagatctatgtgtgtggaaatatctctcaaaacctcagaaggggacagcatggagctggaaatatggtgcctcgaaatgaacgagaaatgcgataaggaaattaaagtttcgtatacagtgtataactag

SEQ ID NO: 26713 - DNA, 420 bp, Artificial Sequence
  Description of Artificial Sequence: Synthetic coding sequence
atggccgacaccgacctgttcatggagtgcgaggaggaggagctggagccttggcagaagatcagtgatgtcatcgaggatagcgttgtcgaggactataacagcgtcgataagactacgacggtctctgtgtcccagcaaccagttagcgcacctgtgcctatcgccgcccatgccagcgtcgcaggacacctgtccacatcaaccacggtgagcagttctggtgcccagaacagtgactccaccaagaagactcttgtgaccctcattgcgaacaataacgcaggcaaccctttagtgcagcaggggggccagccccttattctgacacagaatccagccccaggcctcggtaccatggttacacaacccgttctgaggccggtgcaggtgatgcagaatgctaatcacgttacttag

SEQ ID NO: 26714 - DNA, 492 bp, Artificial Sequence
  Description of Artificial Sequence: Synthetic coding sequence
atgcacgacaagggcatcaccaccgccgccgtgtgcgtgtaccccgctcgagtttgtgacgcggtgaaggccctaaaagctgctggctgcaatatacccgtggcgagcgttgctgccggatttcctgctggtcagacccatttgaagacacggttggaagagatccgtctggcagtggaagacggtgccaccgaaattgacgtagtgatcaacaggtcgttagtgttaactggccagtgggaagccctgtatgacgaaattaggcagtttcggaaggcttgtggggaagcccaccttaagactatccttgccacaggcgagctgggtactttgacaaatgtgtacaaggccagcatgatcgccatgatggctgggtcagatttcatcaagacaagcacagggaaggaaacggttaacgccacattcccggtagccatcgtgatgctgcgcgcaataagagatttcttctggaagacgggcaacaaagtgtag

SEQ ID NO: 26715 - DNA, 456 bp, Artificial Sequence
  Description of Artificial Sequence: Synthetic coding sequence
atggccgacaccgacctgttcatggagtgcgaggaggaggagctggaaccatggcagaagattagcgatgtaatcgaagattcagtggtggaggattataacagcgtagataagacaactactgtgtcagtttctcagcagcccgtctctgcacctgttcccatagctgctcatgcttctgttgctgggcacctgtctacttccaccacagtcagcagctctggagcccagaactctgattcgactaaaaaaacgctggttaccctgatcgccaacaacaatgccggcaatccactggtgcagcaagggggccagcctctgatcctcacacagaatcccgccccggggctgggcaccatggtgacccaacccgtgctccggccagtgcaggtgatgcagaatgccaatcatgttacatctagtcctgtggcctctcagccgatatttatcacttag

SEQ ID NO: 26716 - DNA, 252 bp, Artificial Sequence
  Description of Artificial Sequence: Synthetic coding sequence
atgagccagagcggcgccgtgagctgctgccccggcgccaccaacggctcactcggcagaagcgacggggtggcgaaaatgtcgccgaaagacctctttgagcagcgaaaaaaatactctaatagtaatgtgattatgcatgaaacaagccagtaccacgtgcagcacctcgccacctttattatggacaagagcgaagccattacctccgtcgacgatgccataaggaaactggtgcagctgtccagttag

SEQ ID NO: 26717 - DNA, 366 bp, Artificial Sequence
  Description of Artificial Sequence: Synthetic coding sequence
atggccggccggcccctgcggatcggcgaccagctggtgctggaggaggactatgacgagacttacatcccttctgagcaggaaattctcgagtttgccagggagattgggatcgaccccatcaaggaaccagagctcatgtggctcgcccgcgaagggattgtggctcctttgcccggcgagtggaaaccttgtcaggatatcacaggtgacatttattacttcaacttcgccaatggacagagtatgtgggaccatccttgtgacgagcattaccggtccctggttattcaggagagggccaaactgagcaccagtggcgctataaagaaaaaaaaaaaaaagaaggagaagaaggacaaatag

SEQ ID NO: 26718 - DNA, 2997 bp, Artificial Sequence
  Description of Artificial Sequence: Synthetic coding sequence
atgaaccggcggcggaagttcctgctggccagcgtgctggccctgcagaactcaagctttatctatccctcttgccagaagtgtttctcccgcattatcctcgtgtctaagcgctctaactgtccaaaatgcggctcaacgggagaatcaggcaacgcgaattaccgctacaagctctccctgaaggtggcagaatcaaataagctgttcgtgattaccgtgtttggctcctgtttggacactttttttggcttgaccgcaaccggtctccatcgctacatccaagaccctaataagatcccagaaactctggacaacgacacaacccagaatcttctcacgaaggcagtggagacctgctttgtcggccagagtttcatcttcggggtcacgaactttgagaaccaacccggccagggttccgacgcctctaacttcctacagcaatgttccgaccataagcgaaaagccaaagcccttgtggcatgccagatcgttcttcctgaccccgggatcgctggctttaccgtaattgactattttcatcagctactgcaaacctttaactttcggaagctacagtgtgactcacaggcccctaacaaccacctcctggcactcgatcactctaactccgaccttagttccatatacacaagcgactctacctccgactttttcaagtcatgtagcaaggatacatttagcaagttctggcagccttctctggagtttacatgtatcgtgtcacagctgacagacaacgatgactttagtgcttccgagcagtccaaggcgttcgggactttgcagcaaaatcgaaaaagtatcagtattgccgaagctaccgggtcgagctcatgtcacgaccccattcaggattcttggtctcttgtgtcctatatggataagaagagcactgccgagaaactgggcaaggagctcggactgcaggcaaaagagctgtccgctgttcactcaagtcatcacgaaattggagtcaacgactcgaacctattttccctggaaatgagggaacctctagaaagttctaataccaaaagctttcactcagctgtcgagatcaagaacagatcacaacacgaactgccgtgtttccagcaccacggaatcgatacacctaccagcctccagaagcgttcggcttgctgcccaccctctcttcttcgcctggaggaaaccgcatcatcctcccaagatggggatcctcagatctgggacgatttgcctttcagtgagagcctcaataagtttttagcagttctcgagagtgaaattgctgtcacacaagcagacgtcagcagtcgcaaacaccatgtggataacgatattgacaagttccacgccgaccacagtaggctctcggtcacaccgcagaggaccaccggcgcgctgcacactcctcctatcgccttacgttcatcacaggtcattgtgaaggctaactgttcaaaggatgacttcttgtttaactgtaagggaaatctgagtccaagcgtggagaaggaatcacagcctgataacaaagtcgaggctgtgtccgttaaccacaatggaagggacatgagcgagtacttcctccccaacccatacttgtctgcgttgtcaagctcctctaaggacctggagacaattgtcacgttgaagaagacaattcgcatcagcccacaccgcgagagcgaccacagtagcttgaacaacaagtatttgaatgggtgcggggaaatatcagtatccgaaatgaatgaaaagctgacaaccctgtgctaccgcaagtacaatgacgtgagcgatctatgtaagctagaaaacaaacagtactgcaggtggagcaagaaccaggacgactcattcactatttgcaggaaactgacctaccccctcgagacgctgtgcaactcacctaaccgctccacaaacactcttaaagaaatgccttggggccatatcaacaacaatgtcacccagagctattccatcggatacgaaggaagttatgacgcatccgctgaccttttcgatgatatagccaaggaaatggatatcgctactgaaattacaaaaaaatctcaggacatcctgctgaagtgggggacaagcctggcggagagccatccaagcgagagtgacttttctctgaggtcactgtcagaagatttcattcagccaagtcagaaattgtcactgcaatcactaagtgacagccgccacagccgtacctgtagccccaccccccatttccaatctgactccgagtacaactttgagaacagtcaggactttgtcccatgtagccagtctacccccatttcggggttccatcagacgcgcattcatggcattaacagagcatttaaaaagcctgtgttctatagtgatctggatggcaactatgagaagatccgaatatttcccgaaaacgacaaacagcaggcatctccttcatgtccgaaaaacatcaagacaccctctcagaagatcaggtcccctattgtctcaggagtgagccagccagacgtcttcaatcattaccccttcgccgagtgccatgaaaccgactccgatgagtgggtccctccaacgacacaaaaaattttcccatctgatatgctgggttttcaggggataggacttggaaagtgcctcgccgcgtatcattttccagaccaacaggaactcccgcggaaaaagttaaagcacatcagacagggtaccaacaagggccttattaaaaaaaaactgaagaacatgctcgcagcggttgtcactaaaaaaaaaacccacaagtacaattgcaaatcctctggttggatttcaaagtgtcccgatatccaagtgcttgcagccccccaactacatcctattctgggccctgattcgtgtagcgaggtgaaatgttgcctgccctttagcgagaaaggccccccctctgtttgcgagactcgctccgcctggtcacctgaactgttttcctag

SEQ ID NO: 26719 - DNA, 504 bp, Artificial Sequence
  Description of Artificial Sequence: Synthetic coding sequence
atgggcaccaccgcccccggccccatccacctgctggagctgtgcgaccaaaagctgatggagttcctttgtaacatggataataaggacttggtctggcttgaggagatccaggaagaagcggaacgaatgttcacccgtgaattttccaaggaacctgaactcatgccaaagacacccagccaaaagaaccggagaaagaagaggaggatcagctacgtgcaggatgaaaacagagaccctatcaggcggcgactgagcaggcggaagtcccgttcgagccagctttcttcccgccgattacggagtaaagattctgtggaaaagttggcaacagtggtcggtgaaaatggaagcgtgcttaggcgggtcacccgggctgccgcagccgctgccgcagccaccatggcactggctgccccatccagccctaccccggaatctccaaccatgctcacaaagaagccagaggacaaccacacacaatgccaactcgtgccttag

SEQ ID NO: 26720 - DNA, 615 bp, Artificial Sequence
  Description of Artificial Sequence: Synthetic coding sequence
atggaggcccaggcccagggcctgctggagaccgagcccctgcaggggacagacgaggacgcggtggcgtcggccgatttcagttctatgctctctgaggaggagaaggaggagctgaaggccgagctggtgcagctggaagacgagattacaactcttcggcaggtgttgagcgcgaaggagaggcatctcgtggagatcaaacaaaaactggggatgaatctgatgaatgagctaaagcagaatttctccaagagctggcacgatatgcagacaaccaccgcttataaaaaaacgcacgaaacattatcccatgcaggccaaaaggccacagcagcctttagcaatgtcggtactgctatctctaagaagttcggtgatatgtcatactctatcagacattcgatttcaatgccggcaatgcgcaatagcccaacatttaagagcttcgaagaaagagtggagactaccgtgacatctctgaaaaccaaggtggggggcacgaatcctaacgggggaagttttgaagaggtcctttcatccactgcgcacgcctctgcgcagtcccttgcaggggggtccagaaggaccaaggaagaagagctgcagtgctag

SEQ ID NO: 26721 - DNA, 1023 bp, Artificial Sequence
  Description of Artificial Sequence: Synthetic coding sequence
atggccgccgcccgggacccccccgaggtgagcctgcgggaggccacccagaggaaactgcgaaggttctcagagctgaggggaaagctggttgcgaggggagagttctgggacattgtggccatcaccgcagcggatgagaagcaggaactggcctataatcagcagctctccgagaaactcaagcggaaggaactgcctctgggagtgcagtaccatgtgttcgtcgatcccgcgggagcaaaaataggcaatgggggctcaactttgtgtgcactgcagtgcctggaaaagctgtacggcgacaagtggaattcatttacgatcctcttaatccactccggcggttattcccagaggttacccaacgcttctgccctgggaaaaatctttacagccttacccttagatatcccggaatgttctggcaagacctcttgcattatccagagcattctggactcacgctgttcagtcgctcctggatcagtggtggaatatagcaggctggggcctgacgtctctgtcggtgaaaactgtatcatcagtggcagctatattctcacgaaagctgctctgcccgcacattcgttcgtgtgttcattgagcctcaaaatgaatcggtgcctgaagtatgcgaccatggctttcggagtccaagacaatcttaaaaaatccgtgaagacattgtcagatatcaagctcctgcagttctttggcgtctgtttcttgtcttgccttgacgtgtggaacttaaaggtaacagaagaactgttctccggtaataagacgtgcctatccttgtggaccgctcggatcttccctgtctgcagtagcctgtcagattccgtgatcacctcgttaaagatgctcaacgccgttaaaaacaaatcagcgtttagcctaaacagctacaaacttctctcaatcgaggagatgctgatttacaaggatgtggaagatatgataacttatagggagcagattttcctggagatcagcttaaagtccagtctgatgtag

SEQ ID NO: 26722 - DNA, 873 bp, Artificial Sequence
  Description of Artificial Sequence: Synthetic coding sequence
atggccgagctgaccgccctggagagcctgatcgagatgggcttccccagagggagggccgaaaaagcactagccttgaccggcaaccagggcattgaggcagccatggattggttgatggagcacgaggacgatcctgatgttgacgaaccactcgagacgccccttggtcatattttggggagggaacccacatcttctgaacagggtggcctggagggatcgggatctgctgctggggagggaaagcccgctctctccgaggaggagcgccaggagcagactaagcgtatgctggaactcgtagcccagaaacaaagggagagagaggagagagaggagcgcgaggccctggagagagagaggcagcgccgcaggcagggccaggagttatctgcagccaggcaaaggcttcaggaggatgagatgcgcagagctgccgaggagaggcgacgcgaaaaggctgaggagttggcagccaggcagagagtccgagaaaagatagaacgggacaaggctgagagagcaaaaaaatacggcgggtcagttgggagccagccaccccccgtggctcctgaacctggccctgtgccatcatctccctcccaggagcctccaacgaagcgagaatacgatcaatgtcgtatacaagtccggttacccgatggtacaagcctgacacagaccttccgggctcgcgaacagctggccgcagtgcgcctttatgtggagttgcatcggggagaggagttgggcggcggacaggacccagtccagctgctgtccggatttccaagaagggccttctctgaggccgatatggagagaccacttcaggaactgggtctagtcccttccgctgttctcatctag

SEQ ID NO: 26723 - DNA, 309 bp, Artificial Sequence
  Description of Artificial Sequence: Synthetic coding sequence
atgctgagcgaggaggagaaggaggagctgaaggccgagctggtgcagcttgaggatgaaataactaccctgagacaggtgctgtcagcgaaagaacggcacttggtcgagatcaagcagaaattgggcatgaaccttatgaatgaattaaagcagaacttctccaaaagctggcacgacatgcagacaaccactgcatataagaagacacacgagacgcttagtcatgctgggcaaaaagctacggccgccttttcaaatgtcggcaccgcaatctctaagaaattcggtgacatgaggaggaaatag

SEQ ID NO: 26724 - DNA, 279 bp, Artificial Sequence
  Description of Artificial Sequence: Synthetic coding sequence
atgctgagcgaggaggagaaggaggagctgaaggccgagctggtgcagcttgaggacgaaataacaaccctgaggcaggtactgtcagccaaggaaaggcacttagtagagattaagcagaagttaggcatgaatttaatgaatgagctgaagcagaatttcagcaaaagttggcatgatatgcagaccaccaccgcctacaagaagacccacgaaacactgtctcacgcagggcagaaagccaccgcagccttttcaaacgtgggaaccgctatttag

SEQ ID NO: 26725 - DNA, 3735 bp, Artificial Sequence
  Description of Artificial Sequence: Synthetic coding sequence
atgctgatcaaggagtaccacatcctgctgcccatgagcctggacgagtatcaggtcgctcagctgtatatgatacagaaaaagagccgcgaagaatcttccggcgaggggtcaggtgtggagatcctggccaacaggccgtatacagacggccccggtggctctggtcagtatactcataaagtctaccatgtcggctcacacatccctggctggtttcgcgccctgctcccaaaggcagccttgcaagtagaagaggagagttggaatgcgtacccatatacccggacgcgttacacatgcccctttgtggagaagttcagtatcgaaattgagacatactatctgcccgacggcggccaacagcctaatgttttcaatctgagcggggcagaaagaaggcaacgtatactggacacaatcgacattgtaagagatgccgtcgctccaggggagtataaggcagaggaggatcctcggctctatcactccgtcaaaacagggcgcggtccgctctcagatgattgggctaggactgccgcccagacagggcccctgatgtgtgcctataaactctgtaaagtcgaattccggtactggggaatgcaggccaaaatcgagcagtttattcatgacgtgggcctgcgcagagtgatgctgcgcgcacaccggcaggcttggtgctggcaggacgagtggaccgagctcagtatggcggatatacgcgcgttggaggaagagaccgcacggatgctcgcacaaaggatggctaaatgtaacaccggcagcgaaggcagcgaggctcagcccccgggtaagccttccacagaggcccggtcagcagcaagcaacaccggcacccccgacggacctgaagcaccgcccggacccgatgcttctccggacgcctccttcggcaaacagtggtccagttcgtcgcggtcatcctacagctcccagcatgggggagctgtctctcctcagtccctgagcgagtggcgcatgcagaatatcgcaagggactctgagaattcctctgaagaagaattttttgacgctcacgagggcttctccgactcagaggaagtcttccctaaggaaatgaccaagtggaactcgaacgactttattgatgccttcgcttcgcctgtagaggccgagggaacccctgagcctggcgccgaggccgccaagggcatcgaggacggtgcccaggctccccgggattcagaaggactggacggagccggggaacttggggccgaggcatgcgccgttcacgcactgttcctgatcctgcatagcggcaatatcctagatagcgggcctggggatgccaacagtaagcaagccgacgtccagaccctgtcatcagcattcgaggctgtgacaaggatccacttccccgaggcactcggccatgttgctctgcgtctcgtcccctgccccccaatttgcgcggccgcctacgcactggtgagcaatctgtctccgtactcacacgatggcgactcccttagtcgctcgcaggatcatataccactcgctgcactcccactgcttgccacaagcagctcgcgatatcagggcgcagtcgcgacagtgattgcgcggacaaatcaggcctactctgcatttctgcgttccccagagggagccggcttctgcggccaggttgctttgataggggacggcgtgggaggaatccttggcttcgacgctctgtgccatagcgctaacgcaggtaccgggtccaggggtagcagtaggcggggttctatgaacaacgaattactctctcctgagttcgggcctgtgagggatccccttgccgatggagtcgagggtctcggccggggaagccctgagccaagcgccctccctccccagaggattccttcagacatggcaagtcccgaaccggagggatctcagaactcccttcaggcagccccagccaccacttcctcttgggagccccgtagggcgtcaactgcattttgccccccagctgccagttctgaggcccccgatgggccttcctccaccgcacgtctggatttcaaagtttccggcttcttcctcttcggcagcccattaggactcgtgctggcactgcggaagaccgtgatgcctgccctggaagcggcccagatgaggcctgcatgtgagcaaatttacaacctgtttcacgctgcagatccatgcgcaagccgactggaacccctccttgcacctaagtttcaggccatagcccctctgacagtcccccgataccaaaagttccctctgggcgatgggtccagcctccttctggcggacacactgcaaacccatagcagcctcttcctggaggaactagagatgttagtacctagcactccgacttctacgtccggggcattctggaaaggttctgagctggctacagaccctccggcccagccggccgcgccgtctactacttccgaggtagtcaaaatcctggagcgatggtgggggacaaagcgaattgattattctctgtattgtccagaagcactgactgccttccccaccgtcaccctcccccatctcttccacgcaagctactgggagagcgccgatgtggtcgctttcatcctgcgccaggtgattgagaaagaacgccctcaactggccgaatgtgaggaaccaagcatatattcacccgcctttccccgggaaaaatggcagaggaaaaggacacaggtgaagatccgcaacgtgacctcaaaccatagggcttccgacaccgttgtgtgcgagggccgacctcaggtgctcagcgggcggttcatgtacggtccccttgacgtcgtaacgcttacaggcgagaaagtagatgtgtatatcatgacacagcccctttctgggaaatggatccactttggaactgaggtgacgaacagcagcgggcggcttacgttccccgtaccaccagagagagctctgggcatcggagtatatccagtgaggatggtggttaggggagatcatacatatgcagaatgctgcctgacagtggtggcccgaggtacggaggctgttgttttctctattgatggctcgttcacggcatccgtctctattatggggtcagatcctaaagtaagggccggcgctgtcgacgtggttaggcattggcaggattccggatatttaatagtatacgtcaccgggcgacccgatatgcagaagcacagggtggtcgcatggctgtcacagcataacttccctcatggcgttgtgtcgttttgcgacggcctaactcatgaccctttgcggcagaaagctatgtttttgcaatcgctggtgcaagaagtcgagcttaacattgtggctggctacggctcccctaaagatgtggccgtgtatgccgcgctgggcctgtctccaagccagacctatattgtaggccgtgctgtcagaaagttgcaagcacagtgtcagttcctgtccgatggctatgtagctcacttgggccagctggaagcaggatcacatagtcacgcatccagtggtcctcccagagccgcacttggaaagtcctcgtacggagtagcagccccagtggactttctgagaaagcaaagccagctgctgagatctagaggtccttcccaagctgagagagaaggacccggcacaccacctaccaccctcgctaggggaaaagctcggtccataagcctgaagctggactcggaggaatag

SEQ ID NO: 26726 - DNA, 2676 bp, Artificial Sequence
  Description of Artificial Sequence: Synthetic coding sequence
atggaccagcccgaggccccctgcagcagcaccggcccccggctggccgtcgctagagagctgctgctggcggcactagaggaattgagccaggagcagctgaagaggtttagacataagttgagggatgtggggcccgatggaaggtctattccttggggaaggttggaaagagctgatgcagtggaccttgcagaacaactggcccagttctatggccctgaacccgctcttgaagttgccaggaagaccctcaaacgggccgacgccagagatgtcgctgcccagctgcaggaaagaaggttgcagcgattgggccttgggagtgggaccttgctctccgttagcgaatataagaaaaaatacagagaacacgtgttgcagctgcacgcgcgcgtaaaagagcggaatgctcggtcagtcaagatcacaaagcggttcactaaactgctgattgccccggaatccgcggcaccggaggaagcaatgggccccgctgaagagccagaacctggtagggctcgaagaagtgacacacacactttcaaccgcctttttaggagagatgaggagggccgtaggcctcttaccgtagtactgcagggtcctgctggtattggaaaaactatggcagctaagaagatcctctatgattgggcagctggcaaactctatcagggccaggtggatttcgctttctttatgccctgtggagaacttctggaaaggccaggaactaggagccttgccgacctgattctggatcagtgcccagacaggggtgctcccgtgccacagatgctggcccagccacagcggttgctatttattttggacggtgcggacgagctccccgcattggggggtccggaggcggccccttgcactgatccttttgaggccgccagcggtgctcgagtgttaggaggccttctgagcaaagcacttttgcccactgccctcctgctggttaccacccgcgctgcagcccccgggaggttacagggcagactgtgttctcctcagtgcgccgaagtgagagggtttagcgacaaggataaaaaaaagtacttctacaaatattttcgtgacgagcgtcgcgcagaacgtgcctacagattcgtcaaggagaacgagactctctttgcactctgcttcgtgcctttcgtctgttggatagtgtgtaccgttctgcggcaacagcttgaactagggcgagacttgagccggactagtaaaacaacaaccagcgtgtaccttttgtttattacctctgtcctatcgtctgctcccgtggcggatggaccacggttacaaggcgacctacgcaacctttgcagactggcgcgggagggagttctgggaaggcgcgcccagtttgccgaaaaagagctggagcaactcgaactacgtggttctaaggtccaaactctgtttctctctaagaaagaattacctggggtccttgagacagaggtaacataccaattcatcgaccagtcattccaagaattcttggctgccctgagctacctacttgaggatggcggtgtgcctcgcactgctgctgggggcgtcggtacactgttgcgcggagacgcccagccgcactcacacctcgttttgaccacaagattcttattcgggctgttatccgccgaaagaatgagggacatagagcgccacttcgggtgcatggtttcagaacgagttaagcaggaagccctccggtgggttcaggggcaggggcagggctgtcccggggtcgcccccgaggtgacagagggagccaaggggcttgaagataccgaagagcctgaggaggaggaagagggtgaggagcccaactaccctctggagctcctttattgtctctatgaaacgcaggaggacgcttttgtgcgccaagctctctgtagattcccagaactcgccctgcagcgcgtacgattctgcagaatggacgtggccgtattgtcgtactgcgtgcgttgttgccctgcagggcaggccttgagactgattagttgcaggctggtggctgcacaggaaaagaaaaaaaagtcactaggaaaaaggctgcaggcaagtctagggggaggctctagtcaaggcactaccaagcagctcccagcatctctgctgcacccactcttccaggcaatgacagatcccctctgccacctgtcctcactgacactgtcgcattgcaaactccctgacgcagtctgcagagacttgtccgaagcactgcgagccgccccagccctgaccgagttaggccttctccacaaccgcctgtcagaagcgggcctgcgcatgctgagtgagggcctcgcctggccccagtgcagggtgcaaactgtgcgggtccagctcccagatcctcagcgtgggctccaatacttggtggggatgttgagacaaagtcctgccctgaccactttggacttgagtgggtgccagctcccagcacccatggttacctacctctgtgccgttctccagcaccagggttgcggactgcagaccctgtcactcgcttctgtcgagctgagcgaacagtcacttcaagaactgcaggcagtgaagagagcgaagcctgacttagtgatcacacatcctgccctcgacggacacccacaaccccctaaagagctgatcagtacgttctag

SEQ ID NO: 26727 - DNA, 240 bp, Artificial Sequence
  Description of Artificial Sequence: Synthetic coding sequence
atgagccagagcggcgccgtgagctgctgccccggcgccaccaacggttctcttggccgttccgacggagtggccaagatgtctcctaaggatctgtttgagcagagaaaaaagtattccaactctaacgttattatgcacgaaacttcgcagtatcacgttcagcatctcgcaacatttatcatggacaaaagtgaggcaattacaagtgtggatgatgcgattaggaagctcgtctag

SEQ ID NO: 26728 - DNA, 543 bp, Artificial Sequence
  Description of Artificial Sequence: Synthetic coding sequence
atgggcgacaagaagagccccacccggcccaagcggcagcccaagccttcatcagatgagggctactgggattgttccgtgtgtacatttcgaaacagcgccgaggcctttaaatgcatgatgtgcgacgtccgaaagggtacgtctacaaggaagcctcgccctgtgagccagctggtggcacagcaggtaacacaacaattcgtgcctccaacccagtccaagaaagaaaagaaggacaaagtggaaaaagaaaagtccgaaaaggaaactacttcaaaaaagaactcccataagaaaacaaggcctaggctgaagaacgtggatcgctcttctgcacagcatctggaggttaccgtgggtgacctgacagtgatcatcacggactttaaggagaaaacaaaaagcccacccgcttcaagcgccgcctccgccgaccaacacagccaaagcggctcttcctcagacaatacggaacgcggaatgtccaggtctagctccccgagaggcgaggcgtccagcctcaacggggagtctcactag

SEQ ID NO: 26729 - DNA, 2196 bp, Artificial Sequence
  Description of Artificial Sequence: Synthetic coding sequence
atgggcagcggcgaggagcccggccagagcggcgccagcctgcggacaggcccaatggttcaggggagaggaattatgacaacggggagcggacaagaacccggtcagtctggtacaagcctgcgaactggcccgatgggctcactgggccaagctgaacaggtctcatccatgcccatggggagtctggagcacgagggactggtgtcactgcgaccagtgggcctgcaggagcaggaaggcccaatgtccctagggcctgtgggcagtgcaggcccagtagagacgagtaaaggcttgttggggcaggaaggtctggtggagatcgccatggacagtcctgagcaggaaggcctcgttggccctatggagatcacaatgggctctctggaaaaagccggacctgtctctccaggatgcgtcaaactggcaggtcaagagggactggtggagatggtgctgctgatggagccaggggctatgcgattcttgcagttatatcacgaagacttgttagctgggttgggtgatgtcgcactgttgcctctggaaggtccggacatgaccgggttcagattgtgtggggcacaggcttcatgccaggccgccgaagaattcctgagatcattactcggttcgatctcttgtcacgtcctttgccttgagcacccggggtcagctaggtttctgctcggtcccgaaggtcaacaccttctgcagggcctggaggcccaatttcagtgcgtgttcgggacagagaggctcgccacagccacactcgacactggactggaggaggttgaccccaccgaagctctgccagtcttgcccggtaatgcgcacacactgtggactccggatagcactgggggtgaccaggaggatgtgtcgcttgaagaggtaagggagctcctggcaaccctggaagggctggacctggacggggaggactggctccctcgggagcttgaggaggaggggccccaagagcagccagaggaagaggtaactccgggccacgaagaagaggagcctgtggcccccagcacggtggctcctcggtggctcgaggaggaggcagctctacagctggccctgcaccgctcccttgaaccccagggacaggttgccgaacaggaggaggcagccgccctgcgccaggcccttacacttagcctcctcgaacaaccacccttagaagctgaggagccacctgacggcggcaccgacggcaaagcacagctggtagtgcattctgccttcgaacaggacgtggaggagctcgaccgcgccctgcgcgcagccctcgaagtgcacgtacaggaggaaaccgtaggcccgtggcggagaaccttgccagctgaactgcgagctcggctcgagaggtgtcacggcgtcagcgtggccctgcgaggcgactgcacgatccttcgcggctttggagcccatccagcccgggcagcacggcacttggtggcccttttggcaggtccatgggatcagagcctcgcgtttcctctagccgcatcaggaccaacgctagcgggtcagaccctcaaaggcccttggaacaatctcgagaggcttgccgagaacacaggtgaatttcaggaagtggtgcgtgccttctacgacactctggacgctgcaaggagctccatacgggtggtccgcgttgagagagtgagccatcctcttctccagcagcagtatgaactttatagagaacggcttcttcaaagatgcgagcggcggccagtggagcaggtgctctatcatgggactaccgctcccgctgttcctgatatatgcgcacacggctttaaccgatccttttgcgggcggaatgcgaccgtctacggaaagggagtgtactttgcaagacgcgcatcgctgtccgtccaagaccggtactccccccccaatgccgatgggcataaagccgtgttcgtagccagggtactcaccggagattacgggcagggtcggaggggcttgagagcacctccccttcgcggtcctggccatgtgttgctgcgatacgacagtgccgttgactgcatctgccaaccttccatttttgtcatttttcatgacacacaggccctacccacccacctgataacttgtgaacatgtaccacgcgcgtctcctgatgacccatccggcctgcccggacggtccccagacacgtag

SEQ ID NO: 26730 - DNA, 1083 bp, Artificial Sequence
  Description of Artificial Sequence: Synthetic coding sequence
atgcaggtgtacgagggcctggacatcatcaccaacaaggtgagcgcacaggaacaaaggatctgcagacaccacatgattagtttcgtggaccctttggtgactaactacaccgtggtggacttcagaaaccgggccactgccctgatttacctgcccgagacaaaattcctgttattatgggaagagcccattataaccctgaatttatgttctggcaagttcttatccatcccccgctccctgcaggtgttcgaggaaaccggtatcagccattccgagttcctgcaccgtcaacataccgaggagggcggggggcccctcggcgggcccttaaagttcagtaacccatgtatcctctggctccacgccgaccaggcagttctcgatgagcggttggataagagagtggacgatatgctcgcagctgggctgttagaagagcttagagatttccatagaaggtataaccagaaaaatgtctctgaaaacagccaggattaccagcatggcattttccaatctattggttttaaagagttccatgagtacctgattaccgaggggaaatgcaccctcgagaccagcaatcaactgctcaagaaagggatcgaggccctgaagcaagttacaaaacgctatgcccggaagcaaaaccggtgggtcaagaaccgatttctgtctaggcctgggccgatagtgcctccagtctacggcctggaagtttccgacgttagcaaatgggaggagtctgtgctggagcctgctctggagatcgtgcagtcctttatccagggccacaagccgaccgctacacctatcaagatgccatataacgaagccgagaataaaagaagctatcacctttgtgacctgtgtgacaggattatcattggggatagagagtgggccgcccatatcaaatcaaaatcccaccttaaccagctgaagaaacgtagaaggttagattcagacgcagtcaacactattgagagccaatctgtgagtccagatcataacaaggagccgaaggaaaagggtagccctggccagaatgaccaggagcttaagtgttccgtgtag

SEQ ID NO: 26731 - DNA, 828 bp, Artificial Sequence
  Description of Artificial Sequence: Synthetic coding sequence
atgagcgccgaggtgaaggtgaccggccagaaccaggagcagttcctgcttctggctaaatcagctaaaggggctgccctagccactttgatccatcaggtgctggaggctcctggtgtctacgtcttcggcgaactgctggacatgccgaacgtgcgtgagctggctgagagcgattttgccagtactttcaggctgcttaccgtgttcgcctatggaacctacgcagattacctggcagaggccaggaatttgccccccctgactgaggcccaaaagaataaattgcgccacctgtcagttgtcaccctagcagctaaagtaaaatgcatcccgtacgccgtgctgctggaagctctcgccttaaggaatgtacgccagcttgaagatcttgtcattgaggccgtgtacgccgacgtactgagaggaagcctggaccagaggaaccaacggctggaagtagactacagcatagggcgagacattcagcggcaggatctctctgcgatagctcggaccctccaagaatggtgtgtgggttgtgaggtagttctgtcaggtattgaggagcaggtttcccgcgctaaccagcacaaagaacagcaactggggcttaagcagcaaatcgaaagcgaggttgccaacctgaagaaaaccattaaggttactaccgctgctgcagccgctgccacatctcaggatcctgaacaacatctgacagaacttagggaacccgccccggggacaaaccagcgacagccttccaagaaggccagtaagggaaaaggactgagaggcagcgctaaaatttggtccaagtcgaactag

SEQ ID NO: 26732 - DNA, 1692 bp, Artificial Sequence
  Description of Artificial Sequence: Synthetic coding sequence
atggagaccgccaagcagaaggccctggaggtggccaaccggctgtaccaaaaagatttgcgcgccccggacgtcgttatcggcgcagacactatcgtcaccgtcgggggactaatactggagaagccagtggacaagcaggatgcttacagaatgctatcccggctctccggaagggaacattccgtgttcaccggtgtggctatagttcactgttccagcaaggaccaccagctcgataccagagtcagtgagttttacgaggaaaccaaagtcaagttctccgagttatctgaggagctgctctgggaatacgtgcacagtggcgaacccatggataaagcgggtggatacggtatacaggcactgggaggaatgttggtggaatcagtgcacggagactttcttaacgtagtaggtttccccctgaaccacttttgcaagcagctcgtcaagctgtattatcctcctcgccctgaagatctgcggaggagtgttaaacatgattccatccctgccgctgacactttcgaagatctgagcgacgtggagggcggaggctccgaacccacacagcgggacgcaggatcgcgggacgagaaggctgaagcaggggaagctggacaagcaacggccgaggcggagtgccatcgcactcgtgagacacttccaccttttccaacccgactgctggagctgatcgagggtttcatgcttagcaaaggtcttttaacagcttgtaagctgaaagtctttgacttactgaaggacgaggccccacagaaggctgccgatatagcctctaaggtggatgcatccgcctgtggaatggaaaggctgcttgatatctgtgctgccatggggttgttggaaaaaaccgagcaaggatactcgaacacagaaacagctaatgtatacctcgccagtgatggtgaatacagtctacacgggttcatcatgcacaacaacgacctcacttggaacttattcacctacctggagtttgccattagggagggcaccaatcagcaccacagagccctggggaaaaaggccgaggacctgtttcaggatgcatactaccagtctcctgaaaccagactcagattcatgagagccatgcacgggatgactaaactgacggcctgtcaagttgccaccgcattcaacctttcccgattcagctctgcatgcgacgtcggtggatgtaccggcgccctagcaagggagctggctagggaataccccaggatgcaggtaaccgtgttcgatctccctgacattatagaactcgccgcccattttcaaccaccaggcccccaggccgtccagattcactttgctgcaggcgattttttcagggatcctcttccctctgcggaactgtacgtcctgtgccgaattctacatgactggccagacgacaaggtgcataaactcctttcaagggtcgctgaaagctgtaagcccggtgctggtcttctgttggtggagaccttgttggacgaggaaaaacgcgttgcacaaagagccctgatgcagagtttaaatatgcttgtccaaaccgaggggaaagagcggagtctgggtgaataccagtgcctccttgagttgcatggtttccatcaggtgcaggtggtacacttaggaggcgtgctggatgccatactggcaactaaggtggcaccctag

SEQ ID NO: 26733 - DNA, 828 bp, Artificial Sequence
  Description of Artificial Sequence: Synthetic coding sequence
atgagcgccgaggtgaaggtgaccggccagaaccaggagcagttcctcctgctggccaagagtgcaaagggagccgcgctggctactctgattcatcaagtcctcgaggctcctggagtctacgtgttcggtgagctgctggacatgcccaatgttcgcgaattggcagagtccgatttcgcttccacttttcgcttgttgacagttttcgcttatggcacatacgcagattatcttgcggaggctcgcaatttgcctccccttaccgaagctcaaaagaacaagttgagacacctttctgttgttacattggcagccaaggtgaaatgtatcccctatgcagttctccttgaggccctggctctcaggaatgtccgtcagttagaagatctggttatcgaggccgtctatgccgacgtcttgcgcggatccctggatcaacgtaatcagcggctcgaagtagattattccatcggtcgtgacattcagcggcaggacctttctgcaatcgccaggaccttacaagaatggtgcgtgggttgtgaggttgttttgagtggcatcgaagagcaagtatccagggccaaccagcacaaagagcagcagctcggactgaagcagcaaatcgaatctgaggtcgcaaatttgaaaaaaacaatcaaagtaactacggctgctgcagctgcggcaacatctcaggatcccgaacaacatttaacagagttgcgggaacctgctcctggcacaaatcagcggcagccgtcgaagaaggcctctaagggcaaagggctgcgggggtcagcgaagatctggagcaaaagtaattag

SEQ ID NO: 26734 - DNA, 999 bp, Artificial Sequence
  Description of Artificial Sequence: Synthetic coding sequence
atggagtacctgggcggcggcagcgccctggacctgctgaagcccggaccactggaggaaacgtatattgcaaccattctgagggaaattctgaaaggcctggattacctccattcggagcggaagatccatcgcgatataaaagcggctaacgttctgcttagcgaacaaggggacgtgaagctcgccgactttggggtggctggtcaattgactgacacacagatcaagcggaacacatttgtaggtactcccttttggatggccccagaagtgatcaaacagagcgcatatgatttcaaggcggacatctggagcttaggaatcacggccattgagctcgcaaagggagagcctccaaattcagacctgcacccgatgagagttctgtttctgatccctaagaactctcctccaacactggaggggcaacatagcaaacctttcaaagaattcgtggaggcttgcctcaataaggatcctcgcttccggcctacagccaaggagctgctcaaacataaattcatcactcggtacacaaagaaaacaagctttctgactgaattaatagatcgctataagagatggaagtccgaaggccatggggaggaatcaagttctgaagacagcgatatcgatggtgaggccgaagacggcgaacaaggacccatctggacctttcctcctaccattcgccccagtccccatagcaagttacataaggggacagcattgcactcaagccagaaaccagccgagcccgtgaagagacagcctaggtcgcagtgtctaagcacactcgtgagacctgtatttggcgagctcaaagaaaaacataaacaaagcggcggcagcgtcggagcactggaagaactagagaatgcatttagtttagctgaagagagctgccccggcatctctgacaagctgatggttcacctggttgagcgagtgcagcggttctctcataacaggaaccatctcacctccacgagatag

SEQ ID NO: 26735 - DNA, 279 bp, Artificial Sequence
  Description of Artificial Sequence: Synthetic coding sequence
atgaacttcacccccacccacacccccgtgtgccggaagcggaccgtggtaagtaaacgcggggtcgcggtgagcgggcccacaaagagaagaggcatggccgatagcctggagagtacgccgctaccttccccggaggatcgcctcgctaaactgcacccttccaaagaactgcttgaatactaccaaaaaaagatggctgaatgcgaagcagagaacgaggacttgctgaagaaactcgagctgtataaggaagcatgcgaaggtcagcataagtag

SEQ ID NO: 26736 - DNA, 429 bp, Artificial Sequence
  Description of Artificial Sequence: Synthetic coding sequence
atggcccagaaggagaacagctacccctggccctacggccggcagaccgcgccgtccggattgagcaccctccctcagcgtgtgctcaggaaagagcccgtgacacccagcgcattggtattaatgagccgctctaacgtgcagcctactgctgctcccgggcagaaagtgatggagaattcgagtggcaccccggacattttgactcggaggcacttcacaatcgacgatttcgagatagggcggcctctgggcaagggaaaattcggaaatgtttatctagcacgggagaagaaatcccacttcatagtcgccctgaaggtgctcttcaaatcgcagatagaaaaggagggcgtggaacaccagctgcgccgggaaattgaaattcaggcccatttacaatcttggagaagttggcagatgctgtag

SEQ ID NO: 26737 - DNA, 501 bp, Artificial Sequence
  Description of Artificial Sequence: Synthetic coding sequence
atggaccaggaggacagcgagagcaagaccgtgagcgagcacggcgagcgggattggatgacagccaagaagttttggaaaccgggcgattctctggcccccccagaggtagactttgatagactgctggctagtctccaggaccttagtgagcttgtggtcgagggcgatacccaggttacacccgtgcctgggggcgcgcggctacggacccttgaacccattcccctgaagctgtaccgaaatggcatcatgatgttcgatgggccgttccagcctttttatgacccaagcacacagaggtgtctgcgggatatcctggacggcttcttcccaagcgagctgcaacggctatatcccaacggcgttccgttcaaagtgatcagctgctccagcaaccacacgttcggcgacttcgaaggatccggcgatactcaaccaccacaaacaccacccattctaagggggtctaggtgcacgccttgggggacccccgtgtag

SEQ ID NO: 26738 - DNA, 1473 bp, Artificial Sequence
  Description of Artificial Sequence: Synthetic coding sequence
atgcagagcctggacgacgccaccaagcagctggacttcacccggaagaccttggccgaaaagaaacaggaacttgataaactgaggaacgaatgggcaagccacacggctgcactgaccaataagcatagccaggaactaaccaacgagaaggaaaaggcgctgcaggcacaggtccaataccagcagcagcatgagcagcagaagaaggacctggagattctgcaccagcagaacatccatcagttgcagaacaggctgtcggaacttgaggccgctaataaggatctgacagagagaaagtataaaggcgatagcacaattagagaattaaaagctaagttgagcggcgtggaggaggaactgcagcgcacaaagcaagaagtgctatctctgagaagggaaaattccaccctggatgttgaatgccatgaaaaggagaaacatgttaatcagctacaaaccaaggtagcagtgctggaacaggaaataaaagataaggaccagctcgtcttacggacaaaagaagcatttgacacaattcaggagcagaaggtggtattagaagaaaacggcgaaaagaatcaagtccagctcgggaaactggaggctaccattaaatctctctccgccgaattgctgaaggccaacgaaattatcaaaaaactgcaaggcgacttgaaaactctgatgggtaaacttaagctaaagaacactgtgaccatccagcaggagaagctcctggctgaaaaggaagagaagctacagaaagaacaaaaagaactacaggacgtcggacagagcttgcggatcaaggaacaggaagtctgcaagcttcaggaacagctcgaagcaaccgttaagaagctggaggagagcaagcaactgcttaagaataatgaaaagctcattacttggctcaacaaagagctaaacgagaatcaactcgtgaggaagcaggacgtcttgggaccctcaacaacgcccccggcgcactcctcgagcaacacaatccgcagcggcatttccccaaatttgaacgtagtggacggccgactgacctatcctacttgcggaattggctaccctgtttcttctgctttcgcattccagaacaccttcccccactccattagcgcaaagaatacaagccatcccggaagcggcactaaggtgcagtttaacttgcaattcaccaaaccaaacgccagtctgggagatgtgcagagcggtgctaccattagtatgccttgctccaccgataaggagaacggggagaatgtgggtctcgagtctaagtacctcaaaaagcgcgaagacagcatccccttaagaggcctttcacagaatctgttctccaactccgatcatcagcgggacggaactctgggagctctgcacacatccagcaagcccactgcattaccttctgcatccagcgcatactttccaggccaactgcccaacagctag

SEQ ID NO: 26739 - DNA, 3015 bp, Artificial Sequence
  Description of Artificial Sequence: Synthetic coding sequence
atgctgcggaccgccggccgggacggcctgtgccggctgagcacctacctggaggaactcgaggccgtggagctgaaaaagtttaagctctatttggggaccgccaccgagctgggcgaaggcaaaatcccctggggctctatggagaaggctggacctctcgagatggcccagcttctgatcacacacttcggcccagaagaggcttggcgactggccctgtctacatttgaacgcattaataggaaagatctgtgggagcgcgggcagcgtgaggatctggtccgcgataccccccccgggggcccctcttcccttggaaaccagtctacctgtctgttagaagttagcctcgtcactcccagaaaggacccacaagagacttaccgagattacgtgcgcagaaaatttcgattaatggaggatcggaacgccagattgggcgagtgcgttaacctgagccacagatacacaaggctgctgctcgtgaaggagcattccaaccccatgcaagtgcagcagcaactgctggacacagggagggggcacgcacgaacggttgggcaccaggcatccccaattaagatcgaaaccctgtttgagcccgacgaggagcggcctgaaccccctcgtaccgttgtcatgcagggcgctgcgggcatcgggaagtcaatgctcgctcataaagtgatgctcgactgggcggacggcaagctttttcagggaagattcgactatctgttttacatcaactgtagagagatgaaccaaagcgccacggagtgctctatgcaagatctaatcttctcttgctggccagaaccctcagctccactccaggaactgattcgggtgccagagcggctactgttcataatcgacggtttcgatgagctaaagccctccttccatgatccccagggaccttggtgcctttgctgggaggaaaagagacccaccgaacttttattgaatagcctcattcgaaagaaattattaccagagctgtccttgttaatcaccacaaggcctaccgccctggagaagctgcataggctgcttgagcatccccgccatgtcgagattctggggttcagcgaagcagagcgaaaagaatatttctataagtacttccacaatgctgaacaggccgggcaagtgttcaactacgtcagggataatgagcccctgtttaccatgtgtttcgtcccattggtgtgctgggttgtctgtacgtgtctgcagcagcagctggaggggggtggactactgagacagacatccagaaccacaacagctgtatacatgctctatctcctgagcctcatgcaacctaagcccggtgcccctcgtttgcagcccccacctaaccagcgagggttgtgttccttggcggccgatggcctctggaaccagaagatcctttttgaggagcaggatctacgcaagcacgggttagacggggaggacgtctcggcattcttgaatatgaatatctttcagaaagacatcaattgcgaaagatattactccttcattcacctgagtttccaggagttctttgctgcaatgtattacatcctcgacgagggcgaagggggggcggggccggatcaggatgtgacacgcctcttaacggaatatgcatttagcgagcgctctttccttgccttgacttcacgttttctctttggactcctgaatgaagaaactagatcacacctggagaaaagcctgtgttggaaagtaagccctcatatcaagatggatctgttgcagtggattcagtcaaaagcccagtcagatggctccaccctgcagcaaggttccctggagttcttctcctgcctctatgaaattcaggaggaggagttcatccagcaagccttgtctcactttcaggtgatcgtggtttccaacatcgcgagtaaaatggagcatatggttagcagcttttgtctgaaacggtgtcgaagtgctcaggtcctgcatctctacggagctacctacagcgcagatggcgaagatcgggctaggtgcagtgctggagcccataccctcctggtccagctgcccgaacggactgtcctgcttgacgcatatagcgaacacctggccgccgcactttgcactaacccaaatctgattgagttaagcctgtaccgcaacgctctggggagccgcggggtgaaattactctgccagggcttgaggcatcctaactgcaagctacagaacttacgccttaaaagatgtcggatatccagcagtgcatgtgaagacctcagtgctgctctgatcgctaataagaatctgacccgcatggacctcagtggtaacggggtaggattccctggtatgatgctactgtgtgagggtctcagacacccccagtgcagactgcagatgatccagctgcggaaatgtcagttggagagtggcgcatgccaggagatggcttctgtactcggcaccaacccccacctcgtggagttggacttgactggaaatgcattagaagaccttggccttcggcttctgtgtcagggtctgagacacccggtgtgtaggctgagaacactgtggctcaaaatctgtcgtctaactgccgcggcgtgcgacgagctggcgagtaccttgagtgtgaaccagagtcttagggagcttgacctgagtctgaacgaattaggggatctaggggtgctattattgtgtgaggggcttagacacccaacttgtaagctacagacgctaaggctcggaatttgcagactcggatcagccgcgtgtgagggactgagcgtggtcttgcaggctaatcataatctgcgagaactggatctctccttcaatgacctaggtgattggggtctgtggctgctggccgaaggtctacagcatccagcctgcaggctccaaaaactctggctgtttggaatggaccttaataagatgactcattccagattagcggctctcagggtcacaaaaccctatctggacattgggtgttag

SEQ ID NO: 26740 - DNA, 2517 bp, Artificial Sequence
  Description of Artificial Sequence: Synthetic coding sequence
atgaccggcgccgagatcgagcccagcgcccaggccaagcccgagaagaaagctggcgaagaagtgatcgctggcccagaacgagaaaacgacgtgccgctagtggttcggcctaaagtccgcactcaagccactaccggcgcccgccctaagactgaaacaaagtctgtgcctgctgctagacccaagactgaagcacaggcgatgtccggagcccgtccgaaaactgaagtccaggtgatgggcggcgcccgcccgaagaccgaggctcaggggattactggagccaggccaaagaccgatgcacgagctgtgggcggcgctcgatcaaaaacggacgccaaggccatccctggcgcgagaccaaaagacgaagcgcaggcctgggcccaaagcgagttcggcacagaggccgtctctcaggctgagggagtttcacagacaaacgccgtggcttggccattggccaccgctgagagcgggagcgtgactaagtccaagggcctgtcgatggatagggaactcgtcaacgtagacgcagaaactttcccaggtacacaggggcagaaaggaattcagccttggtttggcccaggggaagagacaaatatgggctcgtggtgttactccagacccagagctcgggaggaggcgtccaatgagtccgggttctggtccgcggatgagactagcactgcatcatcgttctggacgggagaggagacttccgtgagatcttggcctcgtgaggaatccaacacccgatctagacacagggcaaagcaccagaccaatcccaggagtcgcccacgttccaaacaggaggcatatgtcgattcatggtccgggagcgaggatgaagccagcaatcccttcagcttttgggtgggcgagaacacgaataatttgttccggcccagggtacgagaggaggctaacataagatcaaagctgcgcaccaacagggaagattgctttgagtcagagagcgaggatgaattttataaacagtcctgggtgctacccggtgaggaagccaactctcgttttagacaccgggataaggaagatcccaacactgccctgaagctcagggctcagaaagatgttgattcggacagggtgaaacaagagcccaggtttgaagaagaggttattatcgggtcatggttttgggccgagaaagaagctagccttgagggaggagcaagtgcgatctgcgagagcgaacccgggacggaggaaggggctatcggagggtctgcatactgggccgaagagaaatctagcctgggggctgtagcccgggaggaggcaaagccagagagcgaggaagaggccatcttcgggagctggttttgggatcgcgacgaggcctgtttcgatcttaacccttgtcccgtctacaaagtcagcgatcggttcagggacgccgcagaggagctcaatgccagttctagaccccagacctgggacgaggtcactgtggaattcaagccgggactgttccatggagtgggctttaggtccaccagcccctttggtataccagaagaagcgagcgagatgcttgaagccaaaccaaagaatcttgaactcagtccagaaggagaggaacaagagagcttgctacagcctgatcagccaagtcccgaattcactttccagtacgatccctcttacaggtcagtgcgggagatccgggagcacctccgcgctcgcgaatcagctgagtctgagtcatggtcatgtagctgcatccagtgtgagcttaagataggatccgaagaattcgaagaatttctgctgctgatggacaaaatcagagacccatttatccatgagatcagtaaaatcgctatgggtatgcgcagtgcaagccagtttacacgcgactttatacgggactcaggcgtcgtatctctgatcgagacactcttaaactatccctcttctcgcgtgaggacttcctttctagaaaatatgatacatatggctcctccttatcctaacttaaacatgatagaaactttcatatgtcaagtatgcgaggaaactctggcacacagtgtagactctctggagcagctcaccgggatccgcatgttgcggcacctgaccatgaccattgactatcacaccctgattgccaattacatgtcagggttcctgagtcttcttacaaccgctaacgcaagaactaagttccatgtgctgaagatgctgcttaacctcagcgaaaaccctgctgtagcaaagaaactgttttccgcgaaagccctgagcatatttgtgggcctttttaatatcgaagaaaccaatgataacattcaaattgtgattaaaatgtttcagaatatcagcaacattatcaaatcgggcaaaatgtcactaatcgatgatgacttctcgctggaaccacttatttctgctttccgggaattcgaagagctagcaaaacaactgcaggcccagattgacaatcaaaacgacccagaagtagggcagcagtcctag

SEQ ID NO: 26741 - DNA, 165 bp, Artificial Sequence
  Description of Artificial Sequence: Synthetic coding sequence
atgggcaacagcgacagccagtacaccctgcagggcagcaagaaccattccaataccataacgggagccaagcagattccttgtagcctaaagatacgcggtatccacgctaaggaagagaagtcattacacggatgggggcacggttctaacggcgctggttag

SEQ ID NO: 26742 - DNA, 1269 bp, Artificial Sequence
  Description of Artificial Sequence: Synthetic coding sequence
atggccagcctgagccgggccctgcgggtggccgccgcccacccccgtcagtccccaaccagaggaatggggccctgcaatttatctagcgccgcaggaccaaccgctgagaagagtgttccgtaccaacgtactctgaaggaggggcagggtacatcagtcgtcgcccagggcccatcaaggcccttgccctcaactgcaaatgtcgtagtaatcggcgggggctccctgggctgccagactctgtatcacctggccaaactgggaatgagcggcgctgttttactggagcgagaacggctcacatccgggaccacttggcatacagctgggctactttggcaactgaggccctcggatgttgaagtcgaactgctggcccacaccaggagagtggtctctcgggaactggaagaagagaccggactccacacgggatggatccagaatggaggcctgtttatagcaagcaaccgccagaggctggacgagtataaacgtctcatgtcactgggcaaagcatacggcgtggagagccatgtgctctcccccgccgagacaaagaccctgtaccccctcatgaatgttgatgacctgtacggcacactgtacgtccctcacgacggaacaatggatcctgccggcacttgtactactttagcgcgggcagcctcggccaggggagcccaagtgatagagaactgccccgttacaggcatcagagtgtggaccgacgacttcggggtgcggagagtggcaggcgtggagacacagcatggatcaatccaaactccttgtgttgttaattgcgcgggtgtgtgggccagtgccgtaggacgaatggcaggggtgaaggtccctttggtcgccatgcaccacgcatacgttgtgacggagcggatagagggcattcagaacatgcccaacgttagagatcatgatgcctctgtttatttgcgccttcagggggacgctctgtccgtgggagggtatgaggccaatcccattttctgggaagaggtctctgacaaatttgctttcggactcttcgacctcgactgggaggtctttacacagcacatagagggcgctattaatcgagtgccagtgctcgaaaagacaggcattaagtcaacagtgtgcggacctgagtcatttactcccgaccataaacccctgatgggggaggctcccgagttgcggggattcttcctaggctgtggattcaatagcgctggggagagtggtcaggcgctcctcgctccgtag

SEQ ID NO: 26743 - DNA, 327 bp, Artificial Sequence
  Description of Artificial Sequence: Synthetic coding sequence
atgagcatgctgaagcccagcggcctgaaggcccccaccaagatcctgaagccgggtagcaccgccctgaagacacctacagccgttgtcgcccccgtcgagaaaacaattagcagcgagaaagctagcagtactccatccagcgagacgcaggaagagttcgttgatgacttcagagtgggcgagcgcgtctgggtaaacggtaacaaacccggcttcatccaattcctgggagagactcaatttgcgcccggtcaatgggctggaatcgtgttagacgaaccaattggcaaaaacgatggctcggtggccggagtccggtattag

SEQ ID NO: 26744 - DNA, 2148 bp, Artificial Sequence
  Description of Artificial Sequence: Synthetic coding sequence
atgaagcggggccggctgcccagcagcagcgaggacagcgacgacaacgggtctctgagtaccacatggtcccagaatagcaggtctcaacataggaggagcagctgctctaggcacgaagaccggaagccttcagaagtgtttcgtactgatctgataactgcaatgaagctgcatgactcctaccagctgaaccctgacgagtattacgtgctggccgacccgtggcgccaagagtgggaaaagggcgtgcaggttcctgtcagtccaggaaccatcccacaacccgttgcccgcgttgtcagtgaggagaaatccctgatgttcattcggcccaagaaatatattgtaagcagtggctctgagcctccagagcttggctatgttgatattcggacattagcagacagcgtgtgtcgctacgacctcaacgatatggatgcagcttggctggagctcaccaacgaggagtttaaggagatggggatgcccgagttggacgagtatacaatggagagggttctggaggagttcgaacagcgctgctacgacaatatgaaccatgctatcgagaccgaagagggtttgggtattgaatacgatgaggacgtggtgtgcgatgtttgccagtcacccgatggggaggatggcaatgaaatggtgttttgcgataaatgcaacatttgcgtgcaccaggcctgttacggcattttgaaggtgccagaaggttcctggttatgtcggacctgcgctctcggcgtgcagcctaagtgtctcctgtgccctaagaaggggggagctatgaaaccaacaagaagcggcacaaaatgggtccacgtttcttgcgcattgtggatacccgaggtctccatcggatccccagagaaaatggagcctatcactaaggtgtcccacatcccaagttctaggtgggcactggtttgttcactgtgcaacgaaaagttcggagcatctatccagtgctcggtgaagaactgcagaaccgccttccatgtcacctgcgccttcgacaggggactggagatgaagacaatcttggccgagaacgatgaggttaagtttaagtcgtattgcccaaagcattccagccacaggaagcccgaggagagcttgggcaagggagcggcacaggagaacggggcacccgaatgtagccctcgaaatccactcgaaccgttcgctagccttgaacagaatagagaagaggctcatcgagtatccgtgcggaagcagaaactgcagcagctggaggacgagttctacacttttgtgaacctattagatgtagcacgagctcttcgcctgcctgaggaggtggttgacttcctctaccagtactggaagctgaagcgaaaagttaacttcaataaaccgttgatcacgcccaaaaaagatgaagaggataacctcgcaaaaagagagcaagatgtcctgtttcggcggctccagctgtttacccacctgagacaggacctggagcgggtgcgcaaccttacctacatggtaactcgaagagagaaaattaagcgatcagtgtgtaaagtccaagaacagatattcaatctctacactaagctgctggaacaagagagggtgtctggggtgccttcctcgtgcagctcgtcctcactggagaatatgttgctgtttaactcccccagcgtgggccctgacgctcctaaaattgaagacttgaaatggcacagcgccttttttcggaagcaaatgggaacaagcctggtccactccttgaagaagccacacaagagagatcccttgcagaacagccccggctccgaaggtaaaactttgctgaagcagcctgacctttgtggacgccgcgagggaatggttgtgcctgaatcatttctcggcttggagaagaccttcgccgaggcacgtctgatatctgcacagcagaagaatggcgtggttatgcctgatcacggaaaacggagggataaccggttccattgtgatctgataaagggagacttgaaggacaaatctttcaagcagtctcacaaaccactgcgctccaccgacgtttctcagaggcatctggataacactagggccgctgcaatttggcgttttcgagttatctggcagggtcccgctgcctag

SEQ ID NO: 26745 - DNA, 162 bp, Artificial Sequence
  Description of Artificial Sequence: Synthetic coding sequence
atgggccggcggagcaccagcagcaccaagagcggcaagttcatgaaccctaccgaccaggctcgtaaagaggccagaaagagagagctgaaaaagaataagaagcagagaatgatggtacgcgcagccgtgttgaaaatgaaggaccccaagcagatttag

SEQ ID NO: 26746 - DNA, 1035 bp, Artificial Sequence
  Description of Artificial Sequence: Synthetic coding sequence
atgaccacccggagcgtgctggacgtggagaccttcgtggccgacattctcaaaggtgagaatctaagcaaaaaggcaaaagaaaagcgcgagtcactgattaagaaaattaaggacgtcaaatctatttatctgcaggagttccaggacaagggggatgcggaggacggtgaagaatacgatgaccccttcgctggccccccagataccatatccctagcgagcgaaagatacgacaaggacgacgaagctccgagtgatggggcacagttcccgcctatcgcggctcaggatctgccttttgtcctcaaggcaggataccttgagaagaggcgaaaggaccattcattccttggcttcgaatggcagaaaaggtggtgcgctctttcaaaaactgtgttttactactatggaagcgataaggataagcagcaaaaaggcgagtttgccattgacggctactccgtgcgcatgaacaacaccctgagaaaggatggcaaaaaggattgctgcttcgagatctccgcacccgataagagaatataccaatttacagcagcgagtcccaaagacgctgaagaatgggtgcagcagctgaaattcgttttacaggatatggaaagtgatatcatacctgaagactatgatgaaagaggtgaattgtatgatgacgttgaccatccacttcctatttcaaatcccctcacaagctctcaaccgatagacgacgaaatctatgaggagctcccggaagaggaggaggacagcgcacctgtaaaagttgaagaacagcggaaaatgagccaggatagcgtgcaccatacatcgggcgacaaaagcactgactacgccaatttctatcaggggctatgggactgtacgggggcgttttcagacgagctgagcttcaagagaggggatgtcatatacatcctctccaaagagtataaccgttacggatggtgggttggagagatgaaaggagctattgggctcgtgcctaaggcatatattatggaaatgtacgatatctag

SEQ ID NO: 26747 - DNA, 2868 bp, Artificial Sequence
  Description of Artificial Sequence: Synthetic coding sequence
atggaggtgggcagcgaggaggagaagtgggagaagctggacgccgaatttgatcactttgttgtagatatgaaaccatttgtcctcaaactgccccatcggactgaacgacagcgatgcgcgctgtggattcggaagctctgtgagccctcaggaaccggtgcaggcatcatgggcagaaaaaatcggaatctctatgcaaagctccttttgcatatgctcaagagaggcgcacttgaaggaccctttactcatagaccagagcccggcacattgaagatccttccatcttatatgtctatctacttcgacgagccgaacccggcaagggcaaagggctcctctcccgagggtttacctgcctgggtcctcggcgagttagagacctctgaacataaattaaatgagagctggaagctcagctctggcgaggataacacgctggtacagtcgcccactgacgtgtactcaagggaacagtataccggcaaattgcgcgtaagatcacactcattgtcgcctacccacagagaagatgggcagaacatcacacctaagatatgcgaggtgtactcgaagaagagtccggtgtctctcgatgacagtgatatcgaggcgagactcaactcttggaatctcgggatcgaaaatccacgatacttacgccagaagcccatcccggtgtccctcatgacccccaagtttagtctgcgaaaaagcagttcattccatgatgatcattttcttagtaggatcagagaaaaagagttggacatgaaaacaaagatgatggaggcaaagtttcacgaggaaaaacttaagcttcagcagaaacatgacgccgacgtgcagaagatcctcgagaggaaaaacaatgaaatcgaagagcttaagactctctaccgctccaaacagcacgagaccgaagagacgattagaaagctcgaaaagaaagtgcagactctcatccgcgactgtcaggtgattcgcgaaaccaaggaggaccagatcgctgagctcaaaaaaatttgcgagcagagtaccgagagccttaacaacgactgggaaaaaaagctgcacaatgctgtagccgagatggaacaggagaagtttgaccttcagaaacagcacacagaaaatattcaggagctactggaagacacaaatgtccgattaaacaagatggagtcagagtatatggcccagacccagtccacaaaccacatgattaaggagctagaggccagagtgcagcagcttactggagaagccgagaactccaatctacagcgtcagaagctgatccaggaaaaggccgagctggagagatgctaccagattacctgtagcgagctgcaggaggtaaaagctcgcaggaacactctgcataaggaaaaagaccaccttgttaacgactacgagcagaatatgaaactgctccagacaaagtacgacgccgatataaatttactaaagcaggaacacgccctgtcagcctccaaagcttcttctatgattgaggagctggaacagaacgtttgccagctcaaacagcagcttcaggaatcagagttgcaacgaaagcaacagctgcgagaccaggagaataagttccagatggaaaaatcccacttgaaacacatctatgaaaaaaaggcccacgacctccagtccgagctagataagggcaaagaggacacgcagaagaaaatacacaagttcgaagaggccctgaaagaaaaagaggagcagctgacccgggtcaccgaagtgcagcgactgcaagcccaacaggccgacgccgcgctcgaagagtttaagcggcaggttgaactcaattccgaaaaggtctacgctgagatgaaagaacagatggaaaaggtcgaagccgatctgacaagaagtaaatcactgcgtgaaaagcagagcaaggaatttttgtggcagctcgaggacattcggcagcggtacgaacaacagatagttgagctgaaacttgagcacgaacaagagaagactcacctgcttcaacagcacaacgccgaaaaagactctttggtgagagaccacgagcgcgagatcgaaaatcttgagaaacagctgagagccgctaacatggaacatgagaaccaaatccaggagttcaagaagagagacgcgcaggttatagctgacatggaagctcaagtacacaagctaagggaagaacttatcaatgtgaattcacagcgaaagcaacagttagtcgagctgggtctcctccgcgaggaggaaaagcagagggccactcgcgaacacgagattgtggtaaacaaattgaaagccgagtctgaaaagatgaaaatcgagctgaagaagacacacgctgcagaaacggaaatgacgctggagaaggcaaatagcaagctgaagcagatcgaaaaagaatatactcaaaagctcgccaaatcctctcaaatcatagccgaactccagactaccatttcttcgcttaaggaagagaactctcagcagcaattggccgccgagaggcgcctgcaggatgtgagacagaagttcgaagacgaaaagaagcagcttataagggataatgaccaggcgataaaagtgctccaagatgaactggaaaacaggtccaaccaagtgcgatgtgccgagaaaaaactacagcacaaggagcttgagtcacaggagcaaatcacatacatccgtcaagaatacgaaactaaactcaagggactaatgccagcctcgctcagacaggaactggaggatactatctcttcactgaagtcccaggttaattttctccagaagagggccagcatcctgcaggaagaactaacaacataccaggggcggcggtag

SEQ ID NO: 26748 - DNA, 834 bp, Artificial Sequence
  Description of Artificial Sequence: Synthetic coding sequence
atgctgagccagaaggaggtggccgtggccgacgccaagaagagccttgaactgaaccccaacaattccaccgcaatgctgaggaaaggaatctgtgaataccacgagaagaattatgcagcagccttggagacattcacggaggggcagaagctggactctgctgacgccaatttcagcgtgtggataaagcgctgtcaagaagcccaaaacggtagcgaatcagaggtgtggacccaccagtcgaagatcaagtatgactggtatcaaactgagtcccaggtggtgatcactctgatgatcaagaatgttcagaagaacgatgtcaacgtagaattctcggagaaagagctgagcgccctggtgaagttgccttcgggagaggattataatctgaagctcgagctgctccatccaattatccctgagcagagtacgtttaaggtcctctccaccaagattgagattaaactcaagaagcccgaagctgtgcgctgggagaaactagaaggtcaaggagatgtccctactccaaaacagttcgtcgctgatgtgaagaatctgtatcccagctcaagtccatatacccgaaactgggacaagctagtgggtgaaattaaagaagaagaaaagaacgagaaactggagggcgacgctgccctgaatcgcttatttcagcagatatacagcgatgggagtgacgaggtgaagagggctatgaacaaaagcttcatggaaagcggcggaacggtgctatccaccaattggtccgacgtggggaaaagaaaggtggaaattaacccgccagatgacatggaatggaagaaatactag

SEQ ID NO: 26749 - DNA, 807 bp, Artificial Sequence
  Description of Artificial Sequence: Synthetic coding sequence
atgggcagcgccaagagcgtgcccgtgacccccgcccggccccccccacacaacaagcacctggcaagagtagccgaccctaggtccccctcggcggggattctgcggacacctattcaggtcgagtcctctccccagccaggcctaccagccggcgagcagctcgagggcctgaagcacgcgcaagacagtgacccccgtagtccaaccctaggaatcgctcggacccctatgaagacctccagcggtgatcccccgtccccgttagtgaagcagttatctgaagtttttgaaactgaggactccaagagcaaccttccccctgaaccggttctgcctccggaggccccattgtctagcgagctcgacctgccactcggcactcaactgagcgtggaagaacagatgccaccatggaaccaaaccgaattcccttccaagcaggtgttcagcaaagaggaggcaaggcaaccaacggaaaccccagtggcctcgcagagcagcgacaagcccagcagagaccctgaaacacctaggagttccggctcaatgaggaatcgatggaaaccgaactcttctaaagtattgggaagaagcccattgacaatccttcaggatgataactcacctgggaccctgactctacgacagggtaagagaccatctcctttatctgagaacgtttccgagcttaaagagggagctatcctaggcacaggtcggctgctgaaaacaggtggccgggcatgggagcagggacaggaccatgataaggaaaatcagcacttcccccttgtggagtcatag

SEQ ID NO: 26750 - DNA, 1140 bp, Artificial Sequence
  Description of Artificial Sequence: Synthetic coding sequence
atggtgttcaagctgaagaccaaggaggagcagcacagcatgctggggtctggcttcaaagccgagcggctacgcgtgaaccttcggcttgtgattaatagattgaaattgttggaaaaaaagaaaactgagctcgctcaaaaagccagaaaagagattgctgattatctggctgccggcaaagatgaacgggcacggattcgcgtggaacatatcatcagagaggactatcttgttgaagctatggagatcctcgagctgtattgtgatctattgctcgctcgattcggcctcattcagtccatgaaggagttagactcaggtcttgccgagagtgtcagcacactgatttgggccgccccacgcctgcaatccgaagttgcagaactcaagatcgtagcagaccagttatgtgcaaagtatagcaaagagtacgggaaactgtgtcgcaccaaccagatcggcacagtgaacgatcgcctcatgcataagctgagcgttgaagccccaccaaagattctggtggaacggtaccttatcgaaatcgccaaaaactataacgtgccttacgagcccgacagtgtcgtcatggcagaagcccccccgggcgtcgaaaccgacttgatcgacgtcgggttcaccgatgatgtcaaaaagggaggacccggaagaggtggctccggcggcttcacggccccagttgggggccccgacggcacagtacccatgcctatgcccatgccgatgcccatgccaagcgctaacactccctttagctatcccctaccaaaaggccccagcgactttaacgggctgcccatgggcacctaccaggctttcccaaatattcacccaccacagattcctgccactcccccatcttatgaatctgtggatgatatcaatgctgataaaaacataagttccgcccaaattgtcggtcccgggccaaagcccgaggcctccgctaagttgccctccagacccgctgacaattacgacaacttcgttctgccggagctgccttccgtcccagacaccttgcctacagcttctgcaggcgctagcaccagcgcatccgaggacatcgattttgacgatcttagtagaagattcgaggagctgaaaaaaaaaacctag

SEQ ID NO: 26751 - DNA, 903 bp, Artificial Sequence
  Description of Artificial Sequence: Synthetic coding sequence
atggcccggcccctgagcacccccagcagcagccagatgcaggcccgcaagaagcacagagggatcattgaaaaaaggcgacgggatcgtattaattctagtctgtctgagctgagacggttagtcccaacagcttttgagaaacagggcagctccaagctcgagaaggcagaggtactgcagatgacggttgaccatctgaaaatgctgcatgccacaggcggtaccggtttcttcgatgcccgagcacttgcagtcgatttccggtccatcggtttcagagagtgtttaactgaggtgattcgctatctgggggtccttgagggcccttctagcagagccgaccccgtccgcataagactgttaagccacctaaattcctatgccgcagagatggaaccttccccgacaccaaccgggcccttggcctttccggcttggccgtggagctttttccactcatgccctggactgcctgcgctgtcgaatcagttagctatcctggggagggttccttcgcccgttctccctggcgtcagctctcctgcctaccccatccccgcactcaggacggcccccctgaggcgcgctaccggcatcattctccccgcccgccgcaacgtgttgccgtcacgtggagccagtagtacccggagagcaaggcctctggagagaccggccacacccgtcccagttgccccctcatcccgcgccgcccgtagttcccacattgccccattgctccagagcagttccccaacaccgccgggccccacaggttcggcagcctatgtggctgtacccacacccaacagttcaagtccgggccccgccgggcggcctgctggagccatgctctaccattcctgggtgtctgagattaccgagatcggtgcattctag

SEQ ID NO: 26752 - DNA, 318 bp, Artificial Sequence
  Description of Artificial Sequence: Synthetic coding sequence
atgagcgtggtgccccccaaccggagccagaccggctggccccggggtgtcactcagttcggcaacaaatacattcaacagactaagcccctgacccttgagcggaccatcaacctttaccctctcacaaactacacctttgggacgaaggagcccctgtacgagaaagactcttctgtggccgcacgatttcaacggatgcgggaagaatttgataaaatcggaatgcgaaggaccgtggaaggcgtgctaatcgtgcacgagcatcggttgccccatgtgctacttctttctcgcttcaatttcatttataattag

SEQ ID NO: 26753 - DNA, 588 bp, Artificial Sequence
  Description of Artificial Sequence: Synthetic coding sequence
atgggcaacagcgacagccagtacaccctgcagggcagcaagaaccatagtaataccatcacaggagccaaacaaatcccctgctctctcaagattcgggggatccacgccaaagaggaaaaaagcctgcacgggtggggccacggttccaatggtgcaggctacaaatcacggagtctggcgaggagttgtctgtcacatttcaagtctaaccagccttacgcatcacgccttggcggccccacctgcaaagtgtcccgaggcgtggcctattccacacatcgcaccaatgcacctggaaaggactttcaaggcatcagcgctgccttcagcactgagaatggattccacagcgtaggccatgaactggccgacaaccacatcacctccagggattgtaatgggcatctgttaaactgttatggcaggaatgaaagtattgctagtacccctcccggcgaggaccggaaatctcccagggtacttatcaaaacgctgggtaagctggatggttgtctaagggtcgagtttcataacggagggaatccttctaaagtgccagcagaggactgtagtgagccagtgtag

SEQ ID NO: 26754 - DNA, 1581 bp, Artificial Sequence
  Description of Artificial Sequence: Synthetic coding sequence
atggtgcccggcgaggagaaccagctggtgcccaaggaggacgtgttctggcgttgtaggcagaacatttttgacgagatgaagaagaagttcttacaaatagaaaacgccgctgaggaaccccgtgttctctgcattatacaagacaccactaacagcaaaaccgtgaatgagcgcataacactgaatcttccagcaagcactcctgtgcgtaaattgttcgaggacgtagccaacaaggtaggctatatcaacggaaccttcgatctggtgtggggtaacgggattaataccgccgacatggcaccactggaccacacctctgacaaatccctgctggacgcgaacttcgaaccaggcaagaaaaacttcctccatctaactgacaaagacggagaacagccacagatcctacttgaggacagttcagccggggaagattccgtacatgaccgtttcattggacctctcccccgcgagggctcggggggtagcacgagcgactatgtgtcacagtcctatagctactctagcatcctgaataagagtgagaccgggtacgtcgggcttgtgaaccaagccatgacgtgctacctgaacagcctcctccagacccttttcatgacgccggagttccgaaatgcactctacaaatgggaattcgaggaatcagaagaagaccctgtcaccagtataccttaccagctccaaagactttttgtgctgttacaaacttctaagaagcgggcaatcgagactacagatgtaacacgctcctttgggtgggattccagcgaagcttggcagcagcacgacgttcaggagttatgtcgggtcatgttcgacgcactggagcagaagtggaagcagactgagcaggctgacttgattaacgagctgtatcagggaaagctaaaagattacgtcagatgcttggaatgcggatacgaaggctggagaatcgatacatatctggacatccccctcgtgattcgtccgtatggatcctcacaggccttcgcctcagtcgaggaagccttgcacgcctttatacagcctgaaattttggacggacctaaccagtacttctgcgaaaggtgcaaaaagaagtgcgatgcgcggaaaggcctacggtttctccactttccctaccttttgacactacagctcaaaaggtttgatttcgattacacgactatgcatcgcattaaattgaacgatcggatgacgttcccagaggagctggacatgtctacatttatagacgtcgaggacgagaagtccccacagactgaaagctgcacggactccggagctgaaaacgaaggtagttgccatagtgatcagatgtccaatgacttctccaacgacgacggagttgatgaaggaatttgcttggagactaactcaggcaccgaaaagatctcgaaaagcggccttgagaagaactctctgatttacgagctcttcagtgtgatggtgcactccggatccgcagcgggggggcattattatgcttgcatcaagtctagcgtgatgagctcaggtacagctagcatgattaacatgtcggccggttag

SEQ ID NO: 26755 - DNA, 963 bp, Artificial Sequence
  Description of Artificial Sequence: Synthetic coding sequence
atgggcaaggagcaggagctgctggaggccgcccggaccggccacctccccgccgtcgaaaaactgttatcagggaagcgcctttcttccggcttcgggggtggtggtggtggcggctcgggagggggcggtggcggtagtgggggggggggcgggggcctggggtcaagctctcatcccctgtccagtctcctatccatgtggcgaggcccgaatgttaactgcgtagactccacagggtatacaccacttcatcacgcagcccttaacggccataaggacgttgtggaggtcttgctgcgaaacgacgctttgacaaatgtggccgattccaagggctgctatcccttacatttggccgcatggaagggcgatgcccagatcgtcagactgctgatccatcaaggcccctcccacacacgcgtcaacgagcagaataacgacaacgagacagctctgcactgtgccgcccagtatggtcacactgaggtcgtgaaagtcctgctggaagagctcaccgatcccacgatgcgcaacaacaagttcgaaacaccgctggacctcgctgctttgtatgggcgactggaggtcgtgaagatgctgctgaatgctcatccgaatctgctctcctgtaacaccaagaagcacactcctctgcacctggccgcgagaaatgggcacaaagccgttgtgcaggtgctgttagatgctggcatggattccaattaccagaccgagatgggcagtgccttgcatgaggctgccctgttcggcaaaacggacgtggttcaaatcctccttgccgccggtactgacgttaacatcaaagacaaccacggcctgactgccctcgacaccgttcgcgagctgccatcgcagaaatcccaacagatcgctgctctgattgaggacctggatacactccagttctattttatttcttgccctttccagggtctgtag

SEQ ID NO: 26756 - DNA, 660 bp, Artificial Sequence
  Description of Artificial Sequence: Synthetic coding sequence
atggtgatccacaagaacccccccgacacccccaccgagagccagttcacccgtttcctgtgtagcagtcccttagaggctgagacaccccctaacggtcccgattgcggctatggcagttttcatcagcagtactggttggatggcaagatcatcgctgtgggggtcattgatattctgccgaactgtgtttcatctgtatacctctactacgacccggactattcttttttgagtttgggcgtctattctgcgttgcgtgagattgcatttactcggcagttacacgagaaaacgtcgcagctctcttactactatatgggtttttatatacatagctgccctaagatgaaatacaaaggccagtacaggccctcagacctcttgtgtccggaaacgtacgtgtgggtcccaattgagcagtgcttgccctcactcgaaaattctaagtactgtagattcaatcaggaccctgaggcagttgacgaagatcgcagcaccgagcctgatcggctacaagtattccacaagcgggcaatcatgccttacggcgtctacaaaaaacaacagaaagacccatctgaggaggcggccgtgcttcaatatgcatctttggtgggccagaagtgcagcgagcgaatgctgttgttccggaattag

SEQ ID NO: 26757 - DNA, 1791 bp, Artificial Sequence
  Description of Artificial Sequence: Synthetic coding sequence
atgcagcagaaggagctgggcaccttcgcccagagcagcatcgccctgcatcaccagtacaaccccaagttccagacacttttccagccttgtaacttgatgggggctatgcagctaatcgaggatttcagcacccacgtgagcattgattgttcgccccataaaacagtgaaaaagactgccaacgaattcccgtgtctgccaaagcaggtggcctggatattagccaccagtaaagtctttatgtatcccgagctgctccccgtatgttccctgaaggcaaagaacccccaggataaaattctgttcaccaaggccgaggacaataagtatctcctaacatgtaaaacagcaagacagctaaccgtccgcattaaaaacctgaacatgaatcgcgctcccgacaacatcattaaattttataagaaaaccaagcagcttccggtgctgggtaagtgttgcgaggaaatccagccccaccagtggaaacctcccatcgagcgcgaggagcacagactgcctttttggctcaaggcctcactcccttccatccaggaagagttgcggcacatggcagacggtgcgcgggaggtcggaaatatgacaggcactactgaaataaactcagaccaggggctcgaaaaggacaactccgagctgggctcggaaaccagatatcccttgttgttgccaaaaggagtggtgctgaaattgaaaccagtcgccgatcggtttcctaaaaaagcttggagacaaaaacggagcagcgttttaaaacccctgctgatacagcccagtccaagccttcagccttcattcaatcctggaaagactcccgcccagagcacacacagtgaagctcccccaagcaagatggtgctgcggatccctcatcctatccagcctgctactgtcctccaaacagtgccaggggtgcctcccctgggagtgagcggtggtgaaagctttgagtcccctgctgcactccccgccatgccaccggaagcccgcaccagctttccattgagcgagagccagactcttctgtcgagtgccccagtgcctaaggtgatgatgcctagtccagcttcgtccatgtttaggaagccctatgtgcggagacgaccatccaagagacgcggtgcccgtgctttccgctgtataaagcccgctcccgtcattcaccctgcgtctgtgatttttacagtccctgctactaccgtcaagatcgtctcactcggtggaggttgcaatatgatccagcccgttaatgcagccgttgcgcaatcccctcagaccatacctatcgccacactcttagtcaaccctaccagctttccttgccctctaaaccaacccttggtggcttcaagtgtgtcccccctgattgtgagcggcaattccgtgaatctcccaatccctagcacacctgaggacaaagcacacatgaatgtggatatcgcttgcgccgttgcggacggggaaaacgcttttcagggactcgaacccaaactggagccccaggaactgtctcccctttcggccaccgtgtttcctaaggttgaacacagccccgggccaccgcctgtggataagcagtgccaggagggcttgtctgaaaacagtgcctaccgatggacagtggttaagaccgaagaggggcgtcaggccctcgaacccttaccccaaggaatccaagaatccctgaacaactcaagtccaggtgatctagaagaagttgtcaaaatggaacccgaagacgctaccgaagagatttcaggctttctttag

SEQ ID NO: 26758 - DNA, 912 bp, Artificial Sequence
  Description of Artificial Sequence: Synthetic coding sequence
atggccgacaagagcaagttcatcgagtacatcgacgaggccctggagaaaagcaaagaaaccgctctcagccatctgttcttcacataccaggggatcccataccccattactatgtgcacgagcgagactttccaggctcttgatacttttgaggccagacacgatgatatcgtgctggcatcctatccaaaatgtggcagcaattggattctgcacattgtctccgagctgatttatgccgtatccaaaaagaagtataagtacccagaatttcccgtcctggagtgcggagacagcgagaagtaccagcgaatgaagggtttcccctccccaagaattctggctacgcatttgcactatgataaacttcctggtagtatctttgaaaataaggcaaagattctcgtgattttccgtaatccaaaggataccgccgtatcctttctgcacttccacaatgacgtcccagatatcccttcttacggctcttgggacgaattcttcaggcagtttatgaaaggacaggtctcgtggggacggtatttcgacttcgccattaattggaacaaacatctcgacggagataacgtgaagtttatattatatgaggatctgaaggagaacttagccgcaggtataaaacagatcgccgagtttctgggattctttcttaccggcgagcagatccagaccatctctgtacagtcaactttccaggctatgcgcgctaaaagtcaggacactcacggggctgtcggaccgtttctgtttcggaagggagaagtgggcgactggaagaatttattcagcgaaattcagaatcaggagatggacgaaaaattcaaggagtgtctcgcaggcactagccttggcgctaagcttaaatatgagtcatattgtcagggatag

SEQ ID NO: 26759 - DNA, 366 bp, Artificial Sequence
  Description of Artificial Sequence: Synthetic coding sequence
atgggcgtgcccgagatccccggcgagaagctggtgaccgagcggaacaaaaagagactcgagaaggaaaaacacgaaaaaggagctcagaagacagattgccagaaaaacctcggaacggtgggcgctgtggccctcgactgcaagggcaatgttgcctacgcgaccagtacaggggggattgtcaataagatggtagggcgagtaggggatagtccctgtctggggcgcactaaaggatgtttgctacctctccctttattctcaagaccccaggccttcttgaccttgtattccctccctttatccgtgtcttgttgcgtgccttttctgctgttggtgcagctacaggacgtctgggagtag

SEQ ID NO: 26760 - DNA, 579 bp, Artificial Sequence
  Description of Artificial Sequence: Synthetic coding sequence
atgaccctgggcagcaagagccagcagccccccgaggacatcaaggccctgagctggaaccgccaagctcagcatatcctttcttccgcgcaccctagtggcaaagctgtggtctgggacttgcgaaaaaatgaaccaatcataaaggtgagcgaccactcaaatcggatgcattgtagtgggctagcctggcatccggatattgcaacacagttagttctctgttccgaggatgaccgcctccccgttatccagctctgggatctcagatttgcaagcagccccctcaaggtgctggaaagccacagtcggggcatcctgagtgtgtcttggagccaagccgacgccgagctgttgctaacctccgcaaaggacagccaaatcttgtgtagaaatttgggtagcagtgaagtagtatacaagttacccacacagtcctcttggtgttttgatgttcagtggtgcccacgcgatcctagcgtttttagtgcggcctcgttcaatgggtggatcagcctctacagtgtcatggggaggagttgggaggtgcaacacatgagacaggctgataaagtgtag

SEQ ID NO: 26761 - DNA, 621 bp, Artificial Sequence
  Description of Artificial Sequence: Synthetic coding sequence
atgaaggacgtggacaacctgaagagcatcaaggaggagtgggtgtgcgagactgggagcgataatcagccgttgggcaacaaccagcagagtaattgtgagtacttcgtggattccctatttgaggaagcccaaaaagtgagctctaaatgtgtgtctcccgcagaacagaaaaagcaggtagatgtgaacatcaagctatggaaaaacgggttcactgtgaacgacgattttcgtagctactctgatggagctagtcaacagtttttaaatagcatcaagaagggcgagctgccttctgagctgcaaggcatttttgataaggaggaggttgacgttaaagtggaggataaaaaaaacgagatatgtttgtcaaccaaacccgtgtttcaaccctttagcgggcagggccatagactgggacgggtgtctcatattaaggacttcatcgagaagtatcagggctctcagcggtccccccccttttctttggctacagccctgcctgtactgcgattgcttgatgagacactgaccctggaagaggcagatcttcagaacgctgttatcattcagcggttacagaagacagcgtctttcagagagctgtccgagcactag

SEQ ID NO: 26762 - DNA, 1359 bp, Artificial Sequence
  Description of Artificial Sequence: Synthetic coding sequence
atgcggggctgcagctacggcctgtgccggcggggcctgctgttctgtgtcattctcgatgatcagagtggaaagaagtccgttaacgataaaaatctgaagaaaaccgtagaggatgaggaccaggatagtgaggaggagaaagacaatgactcgtacattaaggagaggagcgatatcccgtccggtacgagtaaacatcttcagaagaaggctaagaagcaggctaagaagcaggccaagaaccaacgacgacaacagaaaatacaaggcaaggtgttgcatctgaatgacatctgcaccatcgaccaccccgaagactccgaatacgaggccgaaatgtcgttgcaaggggaggtgaatattaaatctaatcatattagccaggagggagtgatgcacaaagaatactgcgttaatcaaaaagacctgaatggacaagccaaaatgatcgagagcgtgacagacaaccaaaagagtaccgaggaggtggacatgaaaaacatcaatatggataatgacttggaagtcctgacatcgagtccgacaagaaatcttaacggagcctacctgacagaaggcagtaatggagaggtggatattagtaacggcttcaagaacctgaacctgaatgccgcactgcatcccgatgaaattaatatcgagattctcaacgactcacatactcctggcactaaggtgtatgaagtggtgaacgaggacccagaaaccgcattttgcaccctggctaatcgagaggtctttaatacagacgaatgcagcatccagcactgcctgtatcagtttactcggaacgagaagctaagagacgctaataagttgctttgcgaggtctgtactcgacggcagtgcaacggacccaaggccaacattaagggtgagcggaagcatgtgtatacgaatgcgaagaagcaaatgctcatctcattggcccctcccgtgttaactcttcatcttaagagattccaacaggcaggctttaatctccggaaagtgaataaacatatcaagttccccgagatccttgacctggctcccttctgcaccctcaaatgtaaaaatgtcgcagaagaaaacaccagagtcctatattctctgtatggagttgtcgaacactcaggaaccatgcggtctggccactatacagcttatgctaaagctcgcaccgccaacagtcatctgtctaacctggtactccacggtgacatcccacaggactttgagatggaaagtaaaggtcagtggttccatatttctgatacacatgtccaagccgttccaactaccaaagtgttgaactcgcaggcgtacctgcttttttatgaacgtattctgtag

SEQ ID NO: 26763 - DNA, 450 bp, Artificial Sequence
  Description of Artificial Sequence: Synthetic coding sequence
atggagcggatcgagggcgccagcgtgggccggtgcgccgccagcccttacctgcgccctttgactctccattaccgtcagaatggggctcaaaagagttgggattttatgaagacgcacgactctgtgactgtcctgctgtttaatagcagccgtcggagcctagtgctggtcaagcagttccggccagcagtctacgcgggggaggtagagaggaggtttccagggagcttggcagctgtggatcaggatggacctcgggaacttcagcccgctctcccaggcagcgccggcgtaaccgtggaactgtgtgcagggctagtggaccagcccggtttgagtctagaggaagtggcctgtaaggaggcttgggaagagtgcgggtaccatctagccccatccgatctgagaagggttgccacctattgggatgctaccatgggtagttag

SEQ ID NO: 26764 - DNA, 489 bp, Artificial Sequence
  Description of Artificial Sequence: Synthetic coding sequence
atgaacagcaacgccagcgagcacaccggcatgctgcggacctgctggtcacactctcactgggatcctttttctagcgggagcgtgacagctatgtgggcaacccactctcctacttcaaaagcgtgggccggtattcagggaagaggaagatgggctctcggtttcccctggcggggtcaaggggttctccacgtcatcgcttcccagaaagcagctgtgacggaggccgttgatctgcgtacgggcgcggcctcacaggcaatgtccgaggcctttgttaggtcagggatgttctatctgcgtccagcattcgtccttctgtgctacaagtgggggaagctgaggcacagtgaggtgtccaatctcctaggagtggcctggccagtttctgaagaagcatgtatgggcacttgggggtccctggcagtcgccgtgaccttaccagcccaggggctgggtacctgggggcgcgatgagggtgagtag

SEQ ID NO: 26765 - DNA, 1320 bp, Artificial Sequence
  Description of Artificial Sequence: Synthetic coding sequence
atggtgcccagccgggaggccctgctgggccccggcaccaccgccatccgctgccccaagaagttgcagaaccagaattacaaaggccacggccttagtaaggggaaagaaagggaacagcgggcgagtatccggtttaaaacaaccctaatgaacaccctcatggacgtgctgagacacagacctgggtgggtcgaggtgaaggatgagggggagtgggacttctattggtgtgatgtgtcgtggctgcgggaaaattttgatcacacatacatggatgaacatgttcgaattagtcattttaggaaccactacgaactgacgcgcaaaaattacatggtaaagaatttgaaacgattccggaagcagctggaacgcgaggcgggcaagttggaagcggccaaatgcgacttttttcctaagacctttgaaatgccatgcgaataccacctatttgttgaggaattcagaaaaaatcctggcatcacatggataatgaagcccgtcgctaggtctcaagggaaagggatctttttatttcggagactgaaagacattgtggattggcggaaagatactaggagcagtgacgatcagaaggacgatataccagtcgagaattacgtagcacagagatacatagagaatccttatttgatcggcggccgtaagttcgacctgcgggtctatgtgctggtcatgtctgtgtttgccgaatgtctgctgtggtctggtcataggcggcaggatgtgcacctgaccaatgtggcagttcaaaaaactagccctgattaccaccctaagaaaggctgtaagtggactctccagagatttagacagtatctggcgtccaagcatggtcccgaggctgtggaaacactgttcagggatatcgacaacattttcgtcaagtctcttcagagtgtacagaaggtaatcatatcagataaacactgtttcgagctctatgggtacgatatccttattgaccaggaccttaagccatggctgctggaagtcaatgcgagccccagtcttaccgcatcttctcaggaggattatgagcttaagacctgtctgctcgaggacaccttgcacgtggtcgatatggaagcgcgcctgaccggaagggaaaagagagtgggtggtttcgacctaatgtggaatgacggacccgtgtctagggaggagggtgcgcctgatctgagcggtatgggaaattttgtaacaaatactcacttaggctgtgtcaacgacagaaagaaacagctgaggcaattgttctgttcactgcaggtgcaaaaaaaggcatcatcctag

SEQ ID NO: 26766 - DNA, 867 bp, Artificial Sequence
  Description of Artificial Sequence: Synthetic coding sequence
atggccaagtggggcgagggcgacccccggtggatcgtggaggagcgggccgacgctaccaacgtcaacaattggcactggaccgaacgcgatgcctcaaattggtctactgataaactcaaaaccctgttccttgccgtgcaggtgcaaaatgaagagggaaaatgcgaggtcacagaagtgagcaaactcgatggcgaagcgtccatcaacaacaggaaagggaagcttatattcttctatgaatggtctgttaagctgaactggactggaacaagtaagagcggcgtgcagtacaagggccatgtggaaatccctaacctgtccgacgagaactcagtcgatgaggttgagattagtgtatctctagcaaaggatgagcccgatactaatctggtggctctgatgaaggaagaaggggttaagctgttacgcgaagccatgggaatttacatcagcacactgaagacggaattcacacaggggatgatcctccccacaatgaacggcgaatctgtggatcctgtggggcaaccagctctcaaaacagaagagaggaaggccaagcctgccccgtccaagacccaggctaggcctgtgggggtgaaaatccctacctgtaagattaccctcaaagaaacatttctgacctctcccgaggagttgtacagggtttttacaacacaggagctcgtgcaggccttcacccatgcaccggccactcttgaagctgatcggggcggcaaattccacatggttgatggcaatgtttcgggggagttcaccgatctcgtgccagagaaacatatcgttatgaaatggaggttcaaatcttggccagagggatcccactgccacagtgggtag

SEQ ID NO: 26767 - DNA, 1053 bp, Artificial Sequence
  Description of Artificial Sequence: Synthetic coding sequence
atgcccagcttcatccggcacggccccaccatcccccggcggaccgatatatgtctgccagatagctctccaaatgcatttagcacatcaggcgatgttgtgtctaggaaccaaagtttcctgaggacacccatccagaggacacctcatgagatcatgagaagggaatccaatcgtctttctgcgcctagttacttagctagatcactggccgatgtacccagggagtacggatcttcacagtcgtttgttacagaggtgagcttcgcagtggaaaacggcgatagtggctccagatactattatagcgacaatttctttgatggtcagagaaagagacctctaggcgaccgagctcatgaggattaccgctattatgagtacaatcacgacctgtttcagcgaatgccccagaatcagggacgccacgcctctgggatcgggcgagtagccgcaacaagcctaggtaatcttacgaaccacggcagcgaagacttgcccctgcctcctggatggtccgtggactggactatgcgtggacgaaagtactacatcgatcataacacaaacacaacccattggtctcatccactggagcgcgagggcctcccgcccggctgggaacgggtggaatcatcggagttcggcacctactatgttgaccatacaaacaaaaaggcccagtacaggcacccgtgtgctccctcagtccccagatacgaccagcccccgcccgtaacttatcagccccagcagaccgagcggaatcagagtctgcttgttcccgccaacccatatcacaccgcagaaatccctgattggctccaagtgtacgctagagcccccgtcaaatatgatcacatcctgaagtgggaacttttccagcttgcagatctggacacttatcagggaatgctgaaactactgttcatgaaagagttggagcagatcgtgaagatgtatgaggcatacagacaagccctgctgaccgaactagagaacaggaagcagcgtcagcagtggtacgcccagcaacatggcaaaaatttctag

SEQ ID NO: 26768 - DNA, 537 bp, Artificial Sequence
  Description of Artificial Sequence: Synthetic coding sequence
atgaccttccgggagggccaccagtgggagaagatccccctgagcggcagtaaccaggagatccgaaggcaaaaggagaggataaccgagcaacccctgaaagaggaagaagacgaggatcggaaaaacaagggacaccaggccgccgagatcgagtggctcggcttccgcaagccatcacaggctgatatgctgcattccaaacatgacgaggagcagaaagtttgggacgaggagatcgatgacgatgacgatgataattgtaacaatgacgaggatgaggtgagggtgatcgagttcaaaaaaaagcatgaggaagtaagccagttcaaagaagaaggtgacgcgtctgaggatagccccctgagcagcgcgtcctcccaggctgtgactcccgatgagcagccaacccttggtaaaaagtcagacataagccgcaacgcgtatagcagatacaataccatttcgtaccgaaaaatccgaaagggcaacacaaaacagaggattgatgaattcgagagcatgatgcacctgtag

SEQ ID NO: 26769 - DNA, 312 bp, Artificial Sequence
  Description of Artificial Sequence: Synthetic coding sequence
atggccgccttcaagctggacttcctgcccgagatgatggtggaccactgctccttgaactcttccccagtaagcaagaagatgaatggaacactggatcaccctgatcagcccgacctcgatgcgataaaaatgtttgtcggacaggtgcccagaacatggagcgagaaggatctgcgagagcttttcgaacaatatggcgctgtgtacgagattaacgtgcttagagatcggtcccagaatcctccacagtcaaaggggtgttgctttgtcaccttttatacgcggaaagcggccctcgaggcacaatag

SEQ ID NO: 26770 - DNA, 1917 bp, Artificial Sequence
  Description of Artificial Sequence: Synthetic coding sequence
atgccccccatcaacctgcaggagaagcaggtgatctgcctgagcggtgatgatagcagtacatgcattggaattctggccaaagaggtggagattgtcgcatcttccgactcctcaattagctcgaaagctagaggctctaataaggtgaaaatccaacccgtcgcaaaatatgattgggagcagaaatattactatgggaatctcatcgccgtgtcaaactcatttctggcatacgcaatccgggccgccaacaacggatctgccatggtgagggtaatctcggtctccaccagcgaaagaaccctgctgaaaggatttacaggtagcgttgctgatctggcttttgctcatctcaattccccacagcttgcctgccttgatgaggccgggaaccttttcgtgtggcgattggccctggtaaatgggaaaatccaggaagagatcttggtccacatccgtcaaccagaaggtactccgctaaatcattttcgccgcatcatctggtgtcctttcattcctgaagaatcagaagattgttgcgaagagtcttccccaactgtggcattgttgcacgaggatagagcggaagtctgggatcttgacatgctccggtcgagccattcgacctggcctgtggacgtgtctcaaattaagcagggctttatcgttgtgaaggggcattctacttgtctgagtgagggggccctgtcaccagacgggacagtcttagcgaccgcctcacacgatggctatgtcaagttttggcagatttatatcgaaggccaggatgagccaaggtgcttgcatgagtggaaaccccacgatggccgccccctctcctgtttattgttttgtgacaatcacaagaagcaggatccagacgtgccattctggcgctttctgatcactggggccgatcagaacagggaattaaaaatgtggtgtaccgtgtcttggacgtgcttgcaaacaatcaggttcagtccagatatcttctctagcgttagtgtgccaccctccctgaaggtctgcctggatctgtccgccgagtatctcatcctgagcgacgttcagaggaaggtgctctacgtcatggaacttctccaaaaccaggaggagggtcatgcatgcttttcttccatctccgagtttttgctgactcatcccgtgttgtctttcggtattcaggtcgtctcccggtgcagactcaggcacaccgaggtgctgcctgcagaggaggaaaacgatagtctgggagctgacggcacccacggagccggcgcgatggagagcgctgccggagtgttgattaaactcttctgcgtacacacgaaggctctccaagatgtgcagatacgtttccaaccacagcttaaccctgacgtggtggcccccctgccaacccacacagcccacgaggattttaccttcggtgagtctcggccagaacttggttccgagggtctaggctctgctgcacacggctctcagccagacttgagaagaatagtggagcttccagcaccagccgactttctgagcctatcttccgagacaaagcccaagctaatgaccccagacgcctttatgaccccctccgcttcattacagcagattacggcctcgccaagcagttcaagctctggttcctcctcttcttctagctcatctagttcttcattaacagcggtttccgctatgtcctcaacgtccgctgtcgatcccagcttgacacggccacctgaggagctaactctatcaccgaagctgcagctggacgggagcctgaccatgtcatcatctgggagtctgcaggcatcaccgcgcggtcttctgcctgggttacttcccgcacctgcagataagcttactcctaaggggcctggacaggtttgcgactgggtgtgcgtgtag

SEQ ID NO: 26771 - DNA, 495 bp, Artificial Sequence
  Description of Artificial Sequence: Synthetic coding sequence
atgcggatcctgatcctgggcctggacggcgccggcaagaccaccatcttgtatcggctgcaagtcggggaagttgtgaccacaattccaacaataggattcaatgtcgagaccgtcacttacaaaaacctcaaatttcaggtctgggatctgggcggccagacatccatcaggccctactggcgttgctattacagtaataccgatgccgttatttatgtggtggattcctgtgaccgcgaccgcatcgggatttccaaaagtgaactggtggccatgctagaggaagaggagttgcgaaaagccatcttggtcgtgttcgcaaataaacaggatatggaacaggctatgactagctctgaaatggctaacagcctcggactccctgcccttaaagatcggaaatggcagatttttaagacttcagcaactaagggaacaggactcgacgaagctatggagtggctggtggagactttgaagagcagacaatag

SEQ ID NO: 26772 - DNA, 1944 bp, Artificial Sequence
  Description of Artificial Sequence: Synthetic coding sequence
atggcccagggcagcgtgagcttcaacgacgtgaccgtggacttcacacaagaggagtggcaacatttagatcatgcccagaagacactctatatggacgttatgctggagaactactgccacctcatctccgtgggttgccatatgaccaagccagacgtaatcctgaaattggagagaggagaagaaccttggacctcatttgcaggccacacatgtttagaggagaactggaaggcagaggacttccttgttaaatttaaagaacaccaggaaaagtacagccggagtgtagtgagcatcaatcacaaaaaattagtcaaggagaaatcaaagatttatgaaaaaaccttcaccctggggaagaacccagtgaacagtaagaacttgccacccgagtatgacacacacggaagaattctgaagaacgtcagcgaactgattatctccaatcttaatcccgctagaaaaagattatcagaatataacggttacggaaaatcattgctgtcaacaaagcaggagacaacacaccccgaggttaagtctcacaaccagtctgcccgggccttttcacacaacgaagtactgatgcagtaccagaagactgagacacctgcccagtctttcggatataatgactgcgagaaaagttttctgcagcgggggggccttattacacactccagaccatacaaaggtgagaatccctcagtctataataaaaaacgcagagccacaaatatcgagaagaagcatacatgtaatgaatgtggcaagagcttttgcaggaaaagtgtgcttatcctgcaccagggaatccattcggaagagaagccatatcaatgtcaccagtgtggtaacgcattcagacgaaagtcatacctgatcgaccatcaacgtactcacacaggggagaagccgttcgtttgcaatgaatgtggaaagtcattccgattgaaaactgcgcttacagaccaccagaggactcacacaggtgagaaatcttacgaatgtctccaatgccgtaatgcctttaggcttaagtcccacttaatccgacaccagcggacgcacacaggagaaaagccttacgaatgcaatgactgtggcaagtcctttagacagaaaactaccttatctcttcaccagcggatacacacaggcgagaaaccatacatctgcaaggagtgtggtaagtcatttcaccaaaaagcaaatctcacagtccaccagcgtacccacacaggggagaagccttacatctgtaacgagtgcggcaagtcattttcacaaaagacgacattagccctgcacgaaaagacccacaacgaggaaaaaccatacatctgttccgagtgcggcaagagctttcgccagaaaactacactcgtggcgcatcaacggactcacactggcgaaaagtcatacgagtgtcctcactgcggtaaagctttccgtatgaagtcataccttattgatcatcaccgaacccatacaggagagaagccatatgagtgcaatgagtgcggaaagtccttctcacaaaagaccaacctgaacctgcaccaaagaatccatacaggggaaaaaccttatgtctgtaacgagtgcgggaaatcgttcagacagaaggccaccctgactgtgcaccaaaagattcacacgggacagaagtcatacgagtgtccccagtgcggcaaggcgttttctcgaaagtcatatctaatccaccatcaacgcacacataccggcgaaaaaccatacaagtgttctgaatgtggaaagtgcttccggcagaagacgaacctgatcgtgcaccaaagaacccacactggcgagaaaccatatgtttgcaacgaatgcggcaaatctttcagctacaagcgaaacctgatcgtccaccagcgcactcacaaaggagagaatatagagatgcagtag

SEQ ID NO: 26773 - DNA, 3570 bp, Artificial Sequence
  Description of Artificial Sequence: Synthetic coding sequence
atgaagctggagtgcatccccgcccccatcacccccagcaccgtgccctcctttccccccaccccccctaccccccccgcctctcctcctcacacacctgtgattgtccctgccgctgcaaccactgtgagctctccttcagccgctatcaccgtccagagggtacttgaggaggacgagtctatcagaacctgcctgtccgaggatgctaaggaaatccagaataaaatagaggtggaggctgacggacagaccgaagagatcctggattcccaaaacctgaacagcaggcgtagcccggtgcccgctcagattgcaatcaccgttcctaaaacttggaagaagcccaaggatcggacgaggacaacagaggagatgctagaggccgaactggagcttaaggccgaggaagagttatccatcgataaggtgctcgagtccgaacaggacaagatgagccaggggtttcaccctgagcgggaccctagcgatttaaagaaggtcaaggccgtggaagaaaacggcgaagaggcggaaccagtgcgaaacggcgccgagagcgtgtctgagggggaaggcattgacgctaatagcggctccaccgattccagcggggacggcgtcacttttccttttaaacccgagagctggaagcctactgacacagaagggaagaaacaatatgacagggaatttctcctggatttccagttcatgccggcctgcatccagaagcctgagggtctcccccccatctcagatgtagtgctcgataaaattaaccaacccaaactccctatgcggactctggatccccggatcctgccgaggggcccagactttacgcccgccttcgcggatttcggaagacagacccctgggggacgtggggtgccactactgaacgtggggagccggagatcgcagccaggccagagacgcgaaccccgtaagatcataacggtgagtgtgaaggaggacgttcacctcaagaaggcagaaaacgcctggaaaccatcacagaaaagagattcccaggctgacgaccctgagaacatcaagacacaagagctgttccggaaagtgcgctccattttgaataaactgacaccgcagatgtttaatcaactaatgaaacaggtaagcggtctgaccgtggatacagaagaaagactgaaaggcgtgattgatctggtctttgaaaaagccatcgacgaaccttccttttccgttgcctatgcaaatatgtgtcggtgcttggtcactctcaaggtaccgatggctgataaacccggtaacaccgttaatttcagaaaactgctcctcaatcggtgtcagaaggaatttgagaaggataaggctgatgacgacgtattcgaaaagaaacaaaaggagcttgaggcagcctccgcccctgaagaacgtacaagactccatgacgaacttgaagaggctaaagacaaagcgaggcgccgcagtatcggcaatattaaatttatcggggaactgttcaaactaaaaatgctgactgaggcaattatgcacgattgtgttgtcaaactgttgaagaaccatgacgaagagtccctggagtgcctgtgccgcctgctgactactatcggcaaagacctagactttgaaaaggccaagccgcggatggatcagtactttaatcagatggagaaaatcgtcaaggaaagaaaaacgagctctcgcataagattcatgctccaggacgtgatcgacctgagactgtgcaattgggtttctcggagagcagatcagggacctaaaacgattgagcagattcataaagaggcgaaaatagaggagcaagaggagcagaggaaggtccagcaacttatgacaaaggagaaacgccgccccggcgtgcagcgcgtggacgaaggcgggtggaatacggtgcaaggagctaaaaattcaagggtgcttgatccatccaaattcctgaagatcaccaagcccaccattgacgagaagatacagcttgttccaaaagctcagttaggctcttggggtaagggctcctcaggtggggctaaggctagtgaaacagatgcattgcggtctagtgcctcctctctcaatagattttcagccctgcaacctcctgccccatcaggaagtactccctctacaccagtggagtttgattcaagacgaacacttacttccagggggagcatggggcgagaaaaaaatgataagccgctgcccagcgccaccgcgagaccgaataccttcatgagaggcgggtcaagcaaagacctgctggacaatcaatcccaggaggaacagcgacgggagatgctcgagacagtgaaacaactcaccggaggagtggatgtggagcgaaactctaccgaggccgagaggaataagacccgggagtcagctaagcctgagatctccgcaatgagcgcacacgacaaagccgccctatccgaggaagagctcgagcgcaagtccaaatccataattgacgaatttctccacatcaacgattttaaagaggccatgcaatgcgtggaggagttaaacgcccaaggcctactccacgtgtttgtacgggtaggcgtggagtcgactttggaaaggagtcagatcactagagatcacatgggccagttactctaccagttggtgcagtccgaaaagctgagcaaacaggatttctttaagggtttctctgagactttggagctggccgacgatatggctatcgatattcctcacatctggctatatttggccgagctcgtcactcctatgcttaaggagggtggtatctcgatgagggaactcaccattgaattcagcaaacccttgctccccgtaggtcgggccggcgtgttgcttagcgagatcctgcacctgctttgcaagcaaatgtcacacaagaaagttggcgccttgtggcgcgaagccgatctgtcctggaaagactttcttccagagggtgaagacgtacacaattttctcctggagcagaagctcgattttatcgagtcagactccccctgtagctctgaagccctgagtaagaaagagctatctgcggaagagctctacaaacgcttggagaaactcattatcgaagacaaggccaatgacgaacagattttcgactgggtggaggctaacctggatgaaatccagatgtcatcgccaacttttttgcgggcccttatgacagccgtatgtaaggccgctatcatcgctgattcctctacattccgcgttgacacagctgtgattaaacagcgggtcccaatactgctgaagtacctggactccgacaccgagaaggaactacaggctctgtacgccctacaagcttctattgtaaaactggaccagcccgcgaatctgctgagaatgttcttcgactgcctgtacgacgaagaagtcataagtgaggacgccttctataaatgggaatcctctaaagacccagcagaacagaatggaaaaggcgtagccctaaagagcgtcactgcctttttcacctggctacgcgaggcggaggaagagtccgaagataattag

SEQ ID NO: 26774 - DNA, 591 bp, Artificial Sequence
  Description of Artificial Sequence: Synthetic coding sequence
atgtggagcgtgctgcaggacggccccatcagccgggtgatcgtgttttctctctcagcagccaaagaaacaaaagatcggcctctgcaggacgaatactccgtgttggtcgcatccatgcttgaaccagcggtagtgtatcgtgatctcctgaatcggggattagaggaccagctgttgctgccaggatccgaccagttcgactccgttttatgtagtcttgtgacggacgtcgacctagatggcaggccggaggtccttgtagcaacctacggtcaagagctcctatgctacaaatacagggggcccgagagcgggttgccagaggcccagcatggctttcatttgttatggcagcggtcattcagctcaccccttttagccatggcccacgtggacctgaccggggacggcttgcaggagctggccgtggtgtcattaaagggggttcatatcctccagcactccttgatccaggcctccgagctggtgctcactcggctaaggcaccaagtggagcagcgtaggcgtaggctacagggcctggaagatggagctggggccggccccgccgaaaacgctgccagctag

SEQ ID NO: 26775 - DNA, 1056 bp, Artificial Sequence
  Description of Artificial Sequence: Synthetic coding sequence
atggtgagccacaccttccacatgcggaccgaggagagcgacgcctctcaggagggggacgatttacccaagtcctcggctaacacaagtcacccgaaacaagatgacagtccaaagtccagcgaggagactattcagcccaaagagggcgatattcccaaggccccagaggagactattcaaagcaagaaggaagacctacccaagtccagtgaaaaagccattcagcccaaggagtctaacatacctaagagttccgctaagcctattcagcccaaactgggaaacatccctaagacatccgttaaaccttcccagcccaaggaaagcgacatccctaagagtccagaagaggcaatccagccgaaagaaggggatataccaaagagcctcgaggaggccattcaacctaaagaaggggacattcccaagagccccgaggaaaccattcaaccgaagaaaggggatattccaaaatctcctgaagaagccatccagccaaaagaaggggacatccctaaatctcccaaacaggccatccagccgaaagagggcgacatccccaaatcactcgaggaagctattccacctaaagagatagacatacccaagtcccccgaggagacaatccagccaaaagaggacgacagccctaaatcgctggaggaagccaccccaagcaaggagggtgatatcctgaagccagaggaggagaccatggagttcccagaaggagacaaagttaaagtgatactcagcaaggaagattttgaagccagtctgaaggaggcaggagaacggctggtggccgtggatttctccgccacttggtgcgggccttgtcgtacgattaggccatttttccatgcattgtctgttaagcacgaagatgtcgttttcctggaagttgatgccgataactgtgaagaggtggtgagagaatgtgctatcatgtgtgtgcccacatttcagttctacaagaaagaagaaaaggtcgacgagctttgtggcgcactgaaggagaaactagaagcggtgatcgccgagctcaaatag

SEQ ID NO: 26776 - DNA, 1473 bp, Artificial Sequence
  Description of Artificial Sequence: Synthetic coding sequence
atgcccgacggcaagatccagaagctgatcatcaccgaggagaccgccaaaatcagaccattcgccgtagccgcagttctgaggaatattaagttcaccaaggaccgttatgactctttcatagagctacaagagaaactgcatcagaacatttgtcgtaagagagcgttagttgctataggtactcatgatctcgacaccctatcaggcccattcacctacaccgcaaagcgccctagcgacattaagttcaaaccactgaataaaacaaaggagtatactgcctgcgagctcatgaatatctacaaaacagacaaccacctaaagcactacctgcacattattgagaacaaaccgctgtaccccgtgatctatgattccaacggagttgttctcagtatgccacccatcatcaacggtgaccatagcagaattactgtcaacacacggaacatcttcatcgaatgcactggaacagattttaccaaagccaagattgtgctggacatcatcgtcactatgtttagtgagtattgcgagaatcaatttaccgtggaagctgccgaggttgtcttccccaacggaaagagccatacgttccccgaactggcctacagaaaggagatggtccgggcagacctgatcaacaaaaaagtcggcattcgcgaaacccccgagaatctcgcgaaactgctgactcggatgtatcttaagagcgaggtgataggcgatggcaaccagatagaaatagagatcccccccactagggctgatatcattcatgcctgcgacattgtcgaggatgccgccattgcctacggttataacaacattcagatgacgctccccaagacgtatactattgcgaatcaatttcctttgaataagctgacagaactcctgcgacacgacatggccgccgctgggtttaccgaagccctgaccttcgctctctgctcacaggaggacatagccgataagttaggtgtggacatctccgcgaccaaagctgtgcatatatccaatccaaaaacagccgagttccaggtggcccggaccactctactgcctggtctgctgaagaccatcgcggcaaatcgaaagatgcctttgccacttaagttatttgagattagcgacatcgttataaaggattcaaacaccgacgtaggagcaaaaaattaccgtcacctatgcgctgtgtattacaataaaaatcctggcttcgaaattatccacggactgctggaccgcattatgcaactgctcgatgtgccccccggtgaagacaaaggggggtatgtgatcaaagcctcagaaggcccggcgttctttcccggccgctgtgcagagatcttcgccaggggccagtccgtgggaaaactcggagtgctccacccagacgtgatcaccaaatttgaacttaccatgccatgctcttcccttgagatcaacgtgggaccttttctgtag

SEQ ID NO: 26777 - DNA, 1458 bp, Artificial Sequence
  Description of Artificial Sequence: Synthetic coding sequence
atggccgccgagctgtacgcccccgccagcgccgccgccgccgacctcgcgaactcaaatgcaggggctgccgtgggccgcaaggcgggtccaaggtcccctcccagcgcgccagccccggccccaccgccacctgctcctgccccaccaacgctcggaaacaatcaccaagagtctccaggatggcggtgctgtaggcccactctgagagaaagaaatgccctgatgttcaataacgaactgatggctgacgttcacttcgtggtgggaccgccaggggccactagaaccgtcccagcacacaagtacgtactcgctgttggtagttcagtgttttatgctatgttctacggtgatctcgccgaggtgaagtccgagattcacatcccggacgtggagcctgcagcctttctaatcctgctgaagtacatgtacagcgacgagattgacctggaggcggatactgtcctggctacactatatgcggccaagaaatatatcgtgccagccttagccaaagcctgtgtaaactttctcgaaacctctctcgaggcaaagaatgcatgtgtcctgctcagtcagtcgagactctttgaagagccagaactcactcagagatgttgggaggtgatcgatgcacaagccgagatggcgctacggagcgaggggttttgtgaaatagaccgtcagaccctggagataatagtcactcgcgaggctctgaacacgaaggaagcagtcgtgttcgaagcagttctcaattgggccgaggctgaatgcaagcggcaaggcctgccaatcacacctcgaaacaaacggcatgtactcgggcgggccctgtacctggtgaggatccccaccatgactctggaagaatttgcaaatggtgcagctcagtccgatatactgacactcgaagaaacacattccattttcctgtggtataccgccacaaacaagcccaggctggactttcccctgaccaagagaaaaggcctggcccctcagcgatgtcatcggttccaaagctccgcctaccggtctaaccagtggcgctacaggggccgctgtgattccatccaatttgctgtggaccgcagggtgtttattgctggcctggggctgtatggcagcagcagcggcaaggcagagtattcagtcaaaatcgaattgaaacgcctgggggtggtgttggcgcagaacctgactaaatttatgagcgacgggagctcaaacacgttcccggtttggtttgaacacccggtgcaggtggaacaggacactttttacaccgcctctgcggttcttgacggatccgaactgtcctacttcgggcaggaaggaatgacggaagttcaatgcggcaaggtcgctttccaattccaatgttctagcgactccacaaacggcacaggcgtccagggcgggcagattccagagctgattttctacgcctag

SEQ ID NO: 26778 - DNA, 204 bp, Artificial Sequence
  Description of Artificial Sequence: Synthetic coding sequence
atggccctgctggccgagcacctgctgaagcccctgcccgccgacaaacagatagaaaccggaccctttcttgaggccgtgtcacaccttcctccattttttgactgtcttgggtcacctgtgtttacacccatcaaggcggatatatctggcaatattacaatgcggaagctgagacttagaggtgtggagggcctggcctag

SEQ ID NO: 26779 - DNA, 816 bp, Artificial Sequence
  Description of Artificial Sequence: Synthetic coding sequence
atctgcgagcggatccggagcaccgtggacgagaaggagcagaagcaactcctgatggacctggatgtcgtcatgaggagctccgactgcccttatatagtccagttctacggtgctctattccgggaaggggactgttggatctgtatggagcttatgagcacctcctttgacaaattttacaaatacgtttacagtgtcttagatgacgttattcccgaagaaattctcggaaaaatcactctggccacagtgaaggcacttaatcacctcaaagagaaccttaagatcatccaccgggacattaagccctccaatattctgctggataggtctggaaatattaagttgtgcgattttggcatctcagggcaactggtcgatagtatcgccaaaacacgggatgccggctgtcgaccttatatggcccctgaaagaatcgacccctcagcaagccgtcagggatacgatgtgagaagtgacgtctggagcttaggcattaccttgtatgagctcgccaccggccgatttccctaccctaaatggaatagcgtgtttgaccaactaacccaggtcgttaagggggaccccccccagctaagtaattcagaggaacgcgagtttagcccctctttcataaatttcgtgaacctgtgcctcaccaaggacgagagcaaacggccaaaatacaaagaactgcttaaacatcctttcatactgatgtatgaggagcgggccgtggaggtcgcttgttacgtctgcaaaattctggaccagatgccagcaactccgtctagtccaatgtatgttgactag

SEQ ID NO: 26780 - DNA, 291 bp, Artificial Sequence
  Description of Artificial Sequence: Synthetic coding sequence
atgagcgagaaggtggactggctgcagagccagaacggcgtgtgcaaagtggacgtgtacagcccaggggacaatcaggcccaagattggaagatggacacctccaccgatcccgtcagagtcttgtcctggttacgacgggacctcgagaagtcgaccgctgaatttcaagacgtccggttcaaacccggggagtctttcggaggcgaaacctctaattccggtgaccctcacaaaggattttctgttgactattataatacaacaacgaagggaacccccgagcggtag

SEQ ID NO: 26781 - DNA, 792 bp, Artificial Sequence
  Description of Artificial Sequence: Synthetic coding sequence
atgctgagcagcaagggcctgaccgtggtggacgtgtaccagggctggtgcggcccatgtaagcccgtcgtttcattatttcagaagatgcgcatcgaagttggactagatcttctacatttcgccctggccgaggccgatagattggatgtccttgagaaataccggggtaaatgcgagccgacgttcttgttctacgcgatcaaggacgaagctctgtcagacgaagacgaatgcgtatcccacggcaagaacaacggtgaggatgaagacatggtctcaagcgaacgcacatgtactttggccattatcaaacccgacgcagtggctcatggtaagaccgatgagatcattatgaagatccaggaggccggttttgagattctgaccaacgaggaacggaccatgacggaggctgaagtgcggcttttctaccagcacaaagcaggtgaagaagcttttgagaaactggtacatcatatgtgttcaggcccaagccatctgctgatccttactcgcaccgaaggatttgaggacgtcgtgactacttggcggacagtgatgggccctagagacccaaacgtggccagaagggagcaacctgagtcacttcgggcacagtatggcacggagatgccctttaacgcagtgcacggatctcgtgatagagaggatgccgacagagaactggctttgctcttcccgagcctgaagttctccgacaaggataccgaggcacctcagggcgagagctctacacagcccagactgaaaatcaccgatctggattag

SEQ ID NO: 26782 - DNA, 867 bp, Artificial Sequence
  Description of Artificial Sequence: Synthetic coding sequence
atgagcagcagcatgtggtacatcatgcagagcatccagagcaagtacagtttaagcgaacgcctgattagaacaattgccgccatcagatccttccctcatgataacgtggaagacctgatacgcgggggtgccgatgtgaactgcacccatggaactctgaagccgctgcactgtgcctgtatggtcagcgatgcagattgcgtggaactgcttctcgaaaagggggcagaggttaacgcccttgatgggtacaaccgcacagctctgcattacgccgctgaaaaagatgaagcctgcgtggaggttttgctcgaatacggggctaaccccaatgctctagacggtaatcgcgacaccccccttcactgggccgctttcaaaaataatgccgaatgcgtgagagccctgctcgagtctggagcgtcagttaatgctctcgattataacaacgatactcccctttcgtgggccgcaatgaaaggtaacttggagtcagtcagtattttgctggattatggcgctgaagtgagagtgatcaatctgatagggcagactccaatatcccgcctcgtggcattgcttgttcgcggactggggacagagaaggaagattcttgtttcgaactgctgcacagagctgtcggccattttgaactacgtaaaaatggcactatgccaagagaagtggcacgcgacccgcagctctgcgagaaattaacggtcctatgtagtgcccccggcacattgaagacattggcccgttatgctgtccgtcgatccttgggcctccagtatctcccagacgccgtcaaggggctcccactgcctgcttccctgaaggagtacctcctgttgctcgagtag

SEQ ID NO: 26783 - DNA, 549 bp, Artificial Sequence
  Description of Artificial Sequence: Synthetic coding sequence
atgcccatcccccccccccccccccccccccccggcccccccccccccccaaccttccaccaggctaataccgaacagcccaaactgagccgagacgaacaacgcgggcggggtgctctgctccaagatatttgcaaaggcactaagctcaagaaagtcaccaatataaatgatagatcggcacccatcctcgagacacccccacctcccccacccgtcatacggaatggggcacgggacgccccccccccaccacctccgtaccgcatgcacgggtctgaacctccaagccgcggcaagcctccaccacccccaagtcgcacccccgctggcccaccgcccccaccacctccccccctgagaaacggacaccgggacagcatcaccacagtgaggtccttcttggatgactttgagagcaagtattcctttcacccagtcgaagatttccccgcgccggaagaatacaaacacttccagagaatatacccgtccaaaactaatcgggcagcacgcggagcacctccactgccgcccatccttcgctag

SEQ ID NO: 26784 - DNA, 999 bp, Artificial Sequence
  Description of Artificial Sequence: Synthetic coding sequence
atggaccagcccgccggcctgcaggtggactacgtgttccggggcgttgaacatgcagttagggtcatggtgtcgggccaggttctagaattagaggtggaggacaggatgaccgcggaccagtggcgcggggaattcgatgcaggatttattgaagatctaactcacaagactggtaacttcaaacagtttaatatcttttgtcacatgttagagtcagccctgactcagagcagtgagtcagttactttggatcttctgacctacaccgatctggaatccctgcgcaatcgcaagatggggggtagacccggctcactggcccccagaagcgcccagctgaattcaaagcggtatctgattttgatttatagtgtggagttcgatcgaattcactatccactacctctcccgtatcagggtaagccagaccctgtcgtgctgcagggcattatcagaagcctgaaagaggaattgggtcgtctgcaggggctcgacggacagaataccagggacacaagagagaacgaaatatggcatctcagagagcagcagcagcaaagaaacaggctcggatccggaggttctggagatggcccgtccgtcagttggagtagacagacacagcccccagctgccttgaccggacggggggacgctcctaaccggtcgagaaatcgcagcagttcagtggattccttcagatcgcggtgctcctctgcctctagctgttccgacctggaggatttctccgagtctctgtctcgtggtggacataggagacgcggcaagcctccttcccccaccccgtggtctggatctaacatgaagagtcctcctgtagaacgatctcaccaccagaagtcccttgccaattcaggggggtgggtgccaattaaagaatactcttctgaacaccaggctgccgacatggcggaaattgacgccaggctcaaggctctgcaggagtacatgaacagacttgacatgcgaagctag

SEQ ID NO: 26785 - DNA, 516 bp, Artificial Sequence
  Description of Artificial Sequence: Synthetic coding sequence
atgagcagcaagcggaccaagaccaagaccaagaagcggccccagagagccacttcaaacgttttcgccatgttcgatcagagccagattcaggagttcaaggaggctttcaacatgatagatcagaaccgagatggctttattgacaaggaggacctgcatgatatgctggcctctcttgggaaaaacccgactgatgagtacctcgatgccatgatgaatgaggcaccaggacctatcaactttaccatgttcctgacaatgttcggcgagaagctgaacgggacagaccccgaggacgttattagaaatgcattcgcctgctttgacgaagaggccactggcaccattcaggaggattatctgcgagagctgttgacgaccatgggagaccgatttactgacgaggaagttgacgaactctatagagaggctcctattgataaaaaagggaatttcaattacattgagttcacacgtatcttaaagcacggggccaaggataaggatgactag

SEQ ID NO: 26786 - DNA, 2391 bp, Artificial Sequence
  Description of Artificial Sequence: Synthetic coding sequence
atgagcctggacgacaacctgagcggcaccagcggcatggaggtggacgaccgggtcagcgctctcgagcaacggctgcaattacaggaagacgagttagcagtgctgaaggccgcactcgctgacgcactgcgaaggctcagggcatgcgaagaacagggggctgccctccgagccaggggtacccccaaaggaagagcccctccccgcctgggcaccaccgcctccgtttgtcaactcctcaagggcttgccaacccgcacacccttgaatgggtctggccccccgcgtagggtggggggatacgcaaccagcccatcgagtcccaagaaggaggcgactagcggacgctcgtccgtgcggcgatatctctccccagaaagactggctagcgtacgccgggaagatcctcgttctcggactacatctagcagctcaaattgctctgcaaagaaagaaggaaaaacaaaagaggtgatcttctccgtagaagacggatccgtgaaaatgttcctcaggggacgccctgtccctatgatgatccctgacgagctggcccctacatattctctagacacgaggagcgagctgcctagctgtaggctgaaactggagtgggtctacggctacaggggcagggactgcagagctaacttgtatctgctgcctaccggagagattgtgtacttcgtggcaagtgtggccgtcttatacagtgtcgaggagcagaggcaacggcactatcttggacacaacgacgacatcaaatgcctcgctatccatcccgacatggtaacaattgctacaggccaggtggccggcacaaccaaggaagggaaaccactgccgccacacgtgagaatttgggatagcgtgtctctgagtaccttacatgtgttaggtctcggagtcttcgatagggcagtgtgttgtgtgggattttctaaaagtaatggggggaatctgctttgtgctgtggatgagagcaacgaccatatgctgagcgtgtgggattgggccaaggaaacaaaggtggtggacgtgaagtgctctaatgaagccgtactggtcgccaccttccatcctactgatcccacggtcctgataacatgtggcaagagtcacatctacttttggaccctcgagggaggatcactcagcaagagacagggcctgtttgaaaagcacgagaaacctaagtatgtcctttgcgttacttttctcgaagggggagacgtggtgacaggtgattctggaggtaacctctacgtctgggggaagggaggcaataggatcactcaggccgtcctgggtgctcatgatggcggcgtgttcggtttgtgtgccctgagagatgggaccctggtgtctggcggggggcgcgaccggcgtgttgtgctgtgggggtccgactactccaagcttcaggaagtggaagtgcccgaggattttggacctgtcagaaccgttgcagagggccacggagacacgttatacgtgggaaccacccgtaactcaatcctccaaggatctgtgcatacaggcttcagcctgctggtccaggggcacgtagaggagctttggggattggccacgcacccttcaagagcacagttcgtcacatgtggccaagacaaattggttcacttatggtcaagtgactctcaccagcctctatggtcaaggatcattgaggatccagctaggtcagccggatttcaccctagtggctctgtgctcgcagtcgggactgtaacagggcggtggcttctgctggacacggagactcacgatctagtcgctatacatactgatggaaatgagcaaatcagtgtggtgagtttttctcctgacggggcatacctagccgtcggttcgcatgataacttagtgtatgtgtacactgttgatcagggcggtagaaaggtcagtcgactaggcaaatgttcaggacatagcagtttcatcactcatctggactgggcccaggatagcagttgcttcgttactaattctggggattatgagattctctattgggatccagccacgtgcaagcagataacatcagcagatgccgttagaaacatggaatgggccaccgccacatgtgtgctcggcttcggcgtctttgggatttggagcgaaggtgccgacgggacagacatcaatgccgtggctcgatctcatgacggcaagctgctcgcctctgctgatgacttcggtaaagttcacttgttcagctatccctgctgccagccacgcgctctctcccacaaatatggcgggcatagctctcatgtgaccaatgtggcatttctttgggacgattcaatggccctgaccacaggcgggaaggatacttctgtgctgcagtggcgcgttgtctag

SEQ ID NO: 26787 - DNA, 1059 bp, Artificial Sequence
  Description of Artificial Sequence: Synthetic coding sequence
atggccctgctgggccaggccctgaagtggcagcagcaccagggcttactgcccccggggatgactatagatttatttaggggaaaagccgccgtgaaagacgtggaagaggagaaattccctactcagctgtcaagacatatcaagttcggtcagaaaagccatgtggagtgcgcccgattctcgcctgacgggcagtacctcgtgactggatccgtggacggtttcatcgaggtatggaattttaccacagggaagattcgaaaggaccttaagtatcaggcgcaggacaactttatgatgatggacgatgccgtactgtgcatgtgtttctccagggacaccgagatgctggctaccggagcacaggatgggaaaattaaggtctggaaaatccaatcagggcagtgcttgagacgattcgagcgcgcccattctaaaggggtgacctgtctgtccttttcaaaggactcatcccagatcttgagtgcttccttcgatcagacgattcgcatccacggactaaagtccggcaaaaccctcaaggagtttagggggcattcgtcctttgttaacgaagccaccttcacacaggatggacactacataataagcgcgagctctgatggaacggtgaaaatctggaatatgaaaaccaccgagtgttcaaacaccttcaaatcactgggatccaccgccggaacagatatcacagtaaactctgtgatccttctgccaaagaacccagagcattttgtggtttgcaaccggagtaacacagtggtgattatgaacatgcagggccaaatcgtacgatcctttagctcaggaaagcgcgaggggggcgattttgtttgttgcgcgctatcccccaggggggaatggatttactgcgtgggcgaagactttgttctgtattgcttcagtacggtgactggtaaacttgaacgcaccctgacggttcacgagaaagacgttatagggattgctcaccatcctcaccaaaaccttattgccacgtatagcgaagatggactgcttaagttgtggaaaccttag

SEQ ID NO: 26788 - DNA, 951 bp, Artificial Sequence
  Description of Artificial Sequence: Synthetic coding sequence
atgcagagctgggtgctgatcagcaaggagctgatcagcctgctgcaccttagtttgctgcacctggaggaagataagaccaccgtgtcgcaggaaagtagacgggcagagacactggtgtgttgttgtttcgacctgctcaaaaagctccgggctaaactgcaaagtctcaaagcggaaagggaagaggcccggcaccgggaggagatggcgctcaggggtaaggatgctgccgagattgtgttagaagctttctgcgcacacgcgagccaaagaatcagccaactagagcaagatctggcatcaatgcgcgagttccgagggttgctcaaggatgcacaaacccagctggttgggctccatgctaagcaggaggaactagtccagcagaccgtgtcactgacgtcaaccctacaacaagactggcgctcaatgcaactggattacaccacatggactgccctgctcagccggagcaggcagctgactgagaagttaaccgtaaagtcccagcaggcgctacaggagcgcgatgtggctattgaggagaagcaagaggttagccgggtgctggagcaagtttctgcccagctggaagagtgcaaggggcagaccgaacagctggagttggaaaacagcaggctggctaccgacctcagggcccagctccagatcctcgccaatatggattcccaactgaaggaacttcagagtcagcatacccactgcgcccaggacttggcaatgaaggatgagctactgtgtcagcttacacagagcaatgaagagcaggcagcccagtggcaaaaagaggagatggccctcaagcatatgcaggctgaactgcaacagcagcaggctgtgttagccaaggaggttcgagatttgaaagagacactggagttcgccgatcaagagaaccaagtcgcacacttagagcttgcctggtag

SEQ ID NO: 26789 - DNA, 597 bp, Artificial Sequence
  Description of Artificial Sequence: Synthetic coding sequence
atgaccctgcggtgcctggagcccagcggcaacggcggcgagggcaccagatctcagtggggcactgccggttctgctgaggagccgtctccccaggctgccaggctcgcaaaggctctgcgagagttgggccaaacaggatggtattgggggtccatgacagtcaatgaagcaaaggagaaactgaaagaggcccctgagggaacttttcttatacgggattcttctcacagcgattacctcttgacaatttccgtgaagacttcagcaggtccaactaacctgcgaatcgaatatcaggatggtaagtttagactcgattctatcatttgcgtgaagtctaaactcaaacagttcgatagcgtggtgcatctaatcgattattacgtacaaatgtgcaaagataaaaggacaggcccagaggcccctaggaatggcactgttcacctgtacctcacaaagcccctgtacacctccgccccctccctccagcacctgtgccgcctgaccatcaataagtgtaccggtgccatctggggtctccccctgcctaccagattaaaggattatctcgaagagtacaaattccaagtgtag

SEQ ID NO: 26790 - DNA, 591 bp, Artificial Sequence
  Description of Artificial Sequence: Synthetic coding sequence
atggtgccccggccctggagcggcagccccggccccggcgagtgcctccactctcttctctctgagagactgtggatctgtcgtgatattagcgcccaaagaagatccgctccaggaagccccagaccctccgactgccagcagctttctttcctccctgggaatcagcctacgtttttgtgcttacaggccctcgcagctctggtgcctggggtgacccaggtggacaataagagcggatttctgcagaagagaccccaccgccaacatccaggaattctcaagctgccccacgtccggctgccacaggcgcttgccaacggagcacagctgctgctacttgggtcagcggggcctacaatggagaatcaggtccagacactaactagttacctttggagccggcacctccccgtggaaccggaggaactccagagaagggcaaggcacctggaaaagaagttcctcgaaaatcccggacctgatttccaatcattattttcaccccagacttacctccgccaacggcggaacttcgtggagcaatgctacacgcactatgtgaagctgccaaccatcgggaagaactag

SEQ ID NO: 26791 - DNA, 1131 bp, Artificial Sequence
  Description of Artificial Sequence: Synthetic coding sequence
atgcccgacgtggtgcagacccggcagcaggcctaccgggacaagctggcccaacagcaggccgcagcagcagctgcagccgcagcagcagcctctcagcaaggatcagccaagaacggagagaacacagctaacggagaggaaaacggcgcgcacacaatcgcccggatatggaacctcagcgaaaatagcaccagcggaagcacccagctcgtgctacgtcattgcatccgagaagggggccaggacgtgcccagtaacaaggacgttactagtctggactggaactctgaggggacactcctggcgacaggctcgtatgatggctttgcccgtatttggaccaaggacgggaatctggcttccaccttgggtcaacacaaaggcccaatctttgccctaaagtggaacaaaaagggcaactttattcttagcgctggagttgataagactacaataatctgggatgcacataccggagaggccaagcagcagttccctttccactccgcacctgccctggatgtcgactggcagtcaaacaacacctttgcaagctgcagtaccgacatgtgtatccatgtttgtaagttggggcaggaccgcccaatcaagacatttcaaggacacactaacgaagtaaatgccataaaatgggatcccactggcaacctcctggcttcctgctccgacgatatgaccttgaagatctggtcgatgaaacaagataattgtgttcatgatctccaggcacacaacaaggagatatatactattaaatggagtccaactggacctggcaccaataaccctaatgctaatctcatgctggcttcagcatcttttgactcaactgtcaggctgtgggatgtcgacaggggcatttgcatccatacacttacaaaacatcaggaacctgtctattctgtggcattttctcctgacggccggtatcttgcaagcggctcgttcgataagtgtgtacacatctggaacacccagactggtgccctggtgcattcttatagagggacaggaggcattttcgaggtgtgctggaatgcggccggagataaagtcggcgcatcagccagcgacggatccgtttgcgtgctcgatctgcgcaagtag

SEQ ID NO: 26792 - DNA, 1116 bp, Artificial Sequence
  Description of Artificial Sequence: Synthetic coding sequence
atgcacatcaagagcatcatcctggagggcttcaagagctacgcccagcgcactgaagttaatgggttcgacccgttatttaacgcaatcaccggactgaatgggagtggcaaatctaacatcctggactcaatctgttttctcctcggaatctctaaccttagccaggttcgtgctagtaacctccaggacttagtgtataagaatggccaagccggtataacaaaggcctccgtttcaattacttttgataactcggacaagaaacagagtccgctggggttcgaagtgcacgacgaaatcacagtgaccagacaggtagtgattggggggcgaaacaaatatttgatcaacggcgtgaacgcgaataacacaagggtgcaggatctattctgcagcgtgggcctcaatgtgaataacccccatttcctgatcatgcaaggacgaatcacaaaggtgctgaatatgaagccacccgaaattctgagcatgattgaagaagccgccggaacacgaatgtacgaatacaagaagattgcagcacagaaaacaattgaaaaaaaggaagctaaacttaaggaaataaagacaatcctcgaggaggagatcaccccaactatacaaaagttaaaagaggaaaggtcttcttacctcgaataccagaaggtcatgcgtgagatcgagcacttaagtcggttgtatattgcttatcagttcctgcttgcagaggacaccaaagtccgcagtgcagaggaattaaaggaaatgcaggacaaggtaatcaagctccaagaggaactatcagaaaatgacaaaaaaattaaagctttgaatcatgaaatcgaagaactggagaaacgtaaggacaaagaaaccgggggcatcctgcgaagcctggaggacgctcttgccgaagcccaacgtgttaacaccaaaagccagagtgcctttgacttgaaaaagaagaacctagcttgcgaagaaagcaaacggaaggaactggagaagaatatggtggaggattctaagaccctggccgcaaaagaaaaggagaagataaagagaaaagctttctggaagagtgccggcagctgcttggtgatattagtggactag

SEQ ID NO: 26793 - DNA, 507 bp, Artificial Sequence
  Description of Artificial Sequence: Synthetic coding sequence
cacaagctgcagagcggcatcggccggctgatcctgaaggaggagatgaaggcccgatcctcgtcatatgctgacccttggacccctccgcggtcgagtacaagcagccgggaagccttacacactgccggctacgagatgagtctgaacggcagtcctaggtcccattaccttgctgattccgaccccctcatctccaaatcagcttccttgcccgcctaccgcagaaatggcctccatcggacgccttcagcagacctgtttcactatgactccatgaatgcagtaaattggggaatgcgcgagtacaagatttacccctatgagctactcctcgtgactactagagggcgcaatcgactgccaaaggatgtggataggacccggttggagcgtcacctctcgcaggaagaattctatcaggtctttggcatgacaatcagcgagttcgatcgactggcactctggaagcggaatgaactgaagaagcaagctaggttattctag

SEQ ID NO: 26794 - DNA, 1770 bp, Artificial Sequence
  Description of Artificial Sequence: Synthetic coding sequence
atgagcgtgagcgtgcacgagacccggaagagccggagcagcaccggttcaatgaatgtcactctgtttcacaaggcctcccacccagattgcgtcctggctcacttaaatacactacgcaaacactgcatgttcactgatgtgacactttgggcgggcgatagagcttttccatgtcacagggcagtgctcgccgcttcctctagatattttgaagccatgttctcccacggtttgcgcgaaagcagagatgacacggtgaacttccaggacaacctgcatcctgaggtattagaactgctgctcgattttgcctacagctcccgcatcgctattaatgaggaaaatgcagagtcactgttggaggcaggtgatatgctccagttccacgacgtgcgggacgctgctgctgagtttctagagaaaaacctctttccgtctaattgccttgggatgatgcttttatctgacgcgcaccaatgtcggagactgtacgaattcagctggaggatgtgtcttgtccactttgagacagtccgtcagagcgaggactttaacagcctatctaaggatactctgcttgatctcattagtagcgacgagctagaaactgaagatgaaagggtggtttttgaggcaattcttcagtgggttaagcatgatctggagccccgaaaagtccacctgcccgaacttctccggagcgtgcgtcttgctctgcttccctccgattgtcttcaggaggctgtaagctcagaggccctgcttatggccgacgagcgcaccaagctgatcatggatgaagctctgaggtgcaaaacccgcatcttacagaacgacggcgtggtcaccagcccatgcgctcgcccccgtaaagccggccacactctcctaattttaggaggccagaccttcatgtgtgataagatttatcaagttgatcacaaggccaaagagatcatcccgaaggcggacctccctagtccaagaaaggagtttagcgcatccgctattgggtgtaaagtatacgtcaccggcgggagaggaagtgaaaatggggttagcaaggatgtatgggtgtatgacacagttcatgaggagtggtccaaggcggcacccatgctgatcgccaggtttgggcatggctccgcagagctagagaattgcctctatgttgttggagggcacacttcactggccggtgtgttccccgccagcccaagtgtgtcattgaaacaagtcgaaaaatacgacccgggggcaaacaaatggatgatggtggcgcccctcagggacggagtgagtaatgccgctgtggtatccgccaaactcaagctgtttgttttcggcggcacatctattcatagggatatggtctccaaagttcagtgttatgacccaagcgagaaccgttggaccattaaagccgagtgcccacagccctggcggtacacagcagccgccgttttggggtctcagattttcattatggggggcgatactgaatttacggccgcctcagcttatagattcgactgcgagaccaaccaatggacccggatcggagacatgactgcgaaaagaatgtcctgtcatgccctggcttcggggaacaaactgtacgtggtcggcggatactttggtactcaaaggtgtaaaactttggattgctatgatccaactagtgatacttggaattgcatcactacggtcccctactctctgataccaactgcatttgttagcacttggaagcacctgccagcatag

SEQ ID NO: 26795 - DNA, 1287 bp, Artificial Sequence
  Description of Artificial Sequence: Synthetic coding sequence
atgagcatgctgaagcccagcggcctgaaggcccccaccaagatcctgaagcctgggtcgaccgccttaaagactccgaccgctgtcgtcgcccctgtggagaaaactataagcagcgagaaagcttcctcaacaccctcatccgaaacccaggaggagttcgtggacgattttagggtaggggagcgcgtgtgggtcaacggaaacaagccgggtttcattcagttcctgggggagacccagttcgcaccgggccaatgggccggtatcgtcctggatgagccaatcgggaaaaatgatggctcggtcgccggagtccgatactttcagtgcgaacctctgaagggcatctttactcgcccaagtaagctgacaaggaaagtgcaggccgaggacgaggcaaatggcctgcagaccacccccgctagtcgtgctacttccccattatgcactagtaccgcttcgatggtttcctcttcacctagcaccccctctaatatcccccagaaaccgagccagccggcggccaaggagcctagcgcaacaccccccatcagcaacttgactaagacggcctctgagtccattagtaatctgtcggaggccgggtcaattaagaagggcgagagggagttgaaaattggagatagagtcctggtgggcggcacaaaggcaggagttgttcggttcctcggggaaacggatttcgcaaagggcgagtggtgtggcgtggagctcgacgaaccgctagggaaaaacgatggagcggtcgcgggcactcgatattttcagtgtcaacccaagtacggtctgttcgctcccgttcataaagtgactaaaatcggcttcccctctacaactcccgctaaagccaaggctaacgctgtgaggcgtgttatggcaactactagtgccagcctcaagagaagcccatcagcctccagcctgagtagcatgagcagtgtcgcatcctcagtatccagcaggccaagtcggaccggcttgcatgtgctggagctcgaggcgaaaatggatcagctccgtactatggtggaagccgcggatcgcgaaaaggtggagctcctaaatcagctagaggaggaaaaacggaaagtagaggatcttcagtttcgtgtcgaggaggaatcaataactaaaggtgacttggagcagaaatctcaaataagcgaagatcctgaaaacgtaagaggccatcttaccgtttggatatttcccctattaaccaagattgaccaccggctgaaatgtcttttaatatactcgtag

SEQ ID NO: 26796 - DNA, 3483 bp, Artificial Sequence
  Description of Artificial Sequence: Synthetic coding sequence
atggtggtgaccctgggccccggccccgactgcctgatcctggaggcctcaagacagccccagttggtgcccaagcccgagcgcatggcaagtgatggcgctagcgcactgcccggccccgacatgagtatgaagccttctgcagctccaagcccgagccctgctttgccttttctccccccaactagtgacccaccagaccacccccctcgtgagccaccccctcaacccatcatgccatctgtgtttagtccggataatccattaatgctttctgcctttccctcctcgctcctggtgactggcgacgggggcccttgtttgagtggagcaggcgccgggaaggtgatagtgaaagtgaagaccgaaggcggttctgctgaacctagtcaaactcagaattttatcctgacacagaccgcattgaattccacagcccccgggactccatgtggcggactagaaggccccgccccgccatttgtgaccgcttccaatgtgaagaccatactgccatctaaagctgtgggagtgagccaggagggtccacctggcctgcctccccagccccctccacccgttgcacaacttgtgccaattgtgcctcttgagaaagcatggccgggcccacatggcactacaggggaagggggacccgtcgccaccctgtccaagcccagcctgggagatcgctcgaagataagcaaagacgtttacgaaaactttcggcagtggcagcggtataaggcccttgcacggcgccatttgtcacaaagtcccgatacggaggccctaagttgcttcttgatccccgtgctccgctcactggcacgcctgaagcccacgatgaccctagaagaaggcctacctctggccgtgcaggagtgggaacatacaagcaacttcgatcgaatgatattttacgagatggcagagcgctttatggagttcgaggccgaggagatgcagattcagaatactcagttgatgaatggctctcagggcctttccccagccacccctttgaagttggatccacttgggcctctggcctctgaggtctgccagcagccagtgtatatcccaaaaaaagcggcttcgaagacccgagcacctcggagaagacagagaaaagcccagcgaccgccagccccagaggcaccaaaggagattcctccggaagccgtgaaagaatatgtggacattatggagtggctagtgggcacacatctggcaactggagagtctgacgggaaacaggaagaagagggacagcagcaagaagaggagggaatgtatccggatccaggattactttcatacattaacgagttatgttctcaaaaagtgtttgtcagtaaggtcgaggctgtgatacacccacaatttctcgctgacctcctctcacccgaaaaacaacgcgacccgctggcgctgatcgaagaactagaacaggaggagggactgactctagcgcagctcgtccagaagaggctgatggccctggaagaagaggaggacgctgaggctcccccctctttctcgggagctcaactcgacagctctccttctggcagcgtggaagatgaggacggagacggacgtttgaggccatcccctggcttacaaggagctggaggggcagcatgcctgggtaaggtatcatcgagtggcaaacgagcgcgggaggttcacggggggcaggagcaggcacttgatagcccccgcggtatgcacagagacgggaacactctgccttcgccaagtagctgggaccttcagcctgagttggccgcgccgcagggcacgccagggccactgggggtcgagaggaggggatccggcaaagttatcaatcaggtgagcctgcaccaagatggtcatctggggggggccggaccacctggtcactgtctcgttgctgaccggaccagcgaagctctgcccctgtgttggcaaggggggttccaacccgaatctacaccaagcctggacgccggactggcagagctcgcaccactgcagggacaggggctggagaagcaggtcctcggactgcaaaaagggcagcagactgggggacggggcgtgctgccacaaggtaaggagcccctggctgtcccctgggaaggaagttcaggcgctatgtggggtgatgacaggggtacgcctatggcccagagctatgaccagaatccctcaccaagagctgccggggaacgcgacgacgtgtgtttgtctccaggtgtctggttgagtagcgaaatggatgccgttggactggaacttccggtgcagatagaagaggtgatagagagcttccaggttgagaaatgcgtgactgaatatcaagaaggctgtcagggacttgggtcccgtggaaatatttcgctggggccgggggagaccctggtcccgggcgataccgaatccagcgtcatcccttgcggcggaaccgtggcagctgccgccctggagaaacgaaattactgctcactgcctggccccctgcgggccaatagtccgccccttcgtagcaaagaaaatcaggaacaaagctgtgagaccgtgggacatccatccgacctatgggcagagggttgctttccgttactggagtccggcgacagcacactgggaagtagtaaggaaactcttccccctacatgccagggcaacctattgattatgggaacagaggacgcttcctctttgcccgaagcttcgcaggaggcaggctcaaggggcaacagcttctccccacttcttgaaaccattgagccggtgaatattttggatgtcaaggatgactgtggccttcagctgagagtgtcagaggacacatgtccccttaacgttcactcttacgatccccagggcgaaggccgcgttgacccagacttgagcaaacccaaaaacctggcccccctgcaagagagccaggaatcgtacacaacaggaacgccaaaagcaacctctagccaccagggcttggggtcgaccttaccccgtcgtgggaccaggaacgctattgtgccacgcgaaacttcagtgtccaaaacccaccgctctgccgaccgcgccaaagggaaagagaaaaaaaaaaaggaagccgaagaggaggacgaggagctgtccaacttcgcctacttgctcgcctccaaactgagcctaagtccccgagaacatcccctttctcctcatcacgcctccggcggccaaggtagtcagcgggcctctcatctactgccagcgggagctaaaggcccttctaaattaccttatccagtcgccaagtctggaaaacgcgcactcgctggagggcctgcgccaaccgagaagacaccacactctggagcccagctgggagtgcctcgcgagaagccactggctctcggtgtggtgagaccttctcaacccaggaaacgccggtgtgattcctttgtaacaggcaggcgaaagaaacgcaggcgctcccagtag

SEQ ID NO: 26797 - DNA, 1548 bp, Artificial Sequence
  Description of Artificial Sequence: Synthetic coding sequence
ctgaacagccagtgccggaacaagaaccccttcgccgccggcccccgcccgcctcaccatcagtttttccagaggccacaaattcaacccccccgggcaacaataccaaattcctccccctctattcgcccgggggcccaaacacccactgccgtctatcaggccaaccagcacatcatgatggtgaaccatctgcccatgccataccccgtcccgcaaggcccacagtactgcattcctcaatataggcacagtggtcctccatacgtcggacctccccagcagtatcctgtgcaaccgccgggacctgggcctttctaccccggcccaggcccaggggactttccaaacgcctatggtactccattttacccctcacagcccgtgtatcagtcagcccctattatcgtgccgacacaacagcaaccaccgccagctaagcgcgaaaagaagaccatcaggataagagatcccaatcaagggggcaaagacatcactgaggaaattatgagtggaggcggttctagaaatccaacccctcccatcggtaggccaacctcgacccctactcccccacagcagctgccgagtcaggtgccagaacattcacccgtggtgtacggtaccgtggaatccgcacatctcgccgcttctacaccagtgaccgctgcatccgatcagaaacaggaagagaaaccaaaacccgatcccgttctgaagagccctagccccgtcctgaggctggtgctctccggtgaaaagaaggaacaggagggacaaaccagcgagacaaccgcaatcgttagcattgcagaactgccccttcctccatctcccacgaccgtgtcttcagtggcgaggagcacaatcgctgcgcccacaagttccgccctgtcttcacagccaatttttacaacagcaatcgacgaccgctgtgagctgtcatctccaagagaggatacaattcctattccttcattaacttcctgtacagaaaccagtgatcctctacccacaaacgaaaacgatgacgacatttgtaaaaagccttgcagcgtggccccaaatgacatccccctcgttagcagcaccaacctgattaacgagatcaacggagttagcgaaaagctgagtgctaccgagtccatcgtggagattgtgaaacaggaggtgctgccgctgaccttggaactcgagatcctggaaaacccgcccgaggaaatgaaacttgagtgtattccggccccaatcacccccagtaccgtaccctcattccctcccacaccccctacgcctcctgccagcccgcctcacacgcccgtgattgtgcccgccgccgccacgacagtgtcctctccttcagcagcaatcacagtgcagcgtgtcctcgaagaagacgagagtatcagaacatgcctttccgaagatgccaaagagattcaaaataagatcgaggtggaggcagatggacagacagaagaaattttagactcacagaacttgaactccagaagaagcccagtgccagagacaagtaatgagtgttag

SEQ ID NO: 26798 - DNA, 204 bp, Artificial Sequence
  Description of Artificial Sequence: Synthetic coding sequence
atggccctgctggccgagcacctgctgaagcccctgcccgccgacaagcagatcgagacaggcccgttcctggaggcggtgagccacttaccacctttcttcgactgtcttggatctccagtgttcacccccattaaagctgatatcagcggtaacatcactatgcggaaactgcggctgcgaggtgtggaaggcctagcttag

SEQ ID NO: 26799 - DNA, 2418 bp, Artificial Sequence
  Description of Artificial Sequence: Synthetic coding sequence
atgatgcagaacgtgcacctggcccccgagaccgacgaggacgacctatactctgggtataacgattacaaccctatttatgatatagaagagctagaaaacgatgccgcctttcagcaggccgtacgcacgagtcacggaaggcgccctcccagcaaaacttcactcgcgtcctccattggccgacctatgactggcgccatccaggatggggttactcggcccatgacagccgtgagggctgctgggtttaccaaggcagccctgcgcggctcagcattcgacccactttcccagtctcgcggaccagcgagcccactggaagcaaaaaaaaaagactcacctgaagagaagatcaagcagctcgagaaggaggtgaatgagctcgtggaggagtcttgcattgccaatagttgcggagatctcaaactggccctggagaaggcaaaggacgcgggccgcaaagaacgcgtactggttagacagcgggagcaggtgacaacacccgaaaacatcaacctggatctgacatatagcgtcctgttcaatttggcgtcacagtattctgttaacgaaatgtacgccgaggctctgaatacctatcaagtcattgtcaagaataaaatgtttagcaacgctgggatcctcaagatgaacatgggcaatatctacctgaaacagcgtaattattctaaagcaatcaagttctatcgtatggcactagatcaggtgccctcagttaataagcaaatgcggatcaagattatgcagaatatcggcgtcacctttatccaggctggacagtatagcgatgctataaacagttacgaacatatcatgtccatggcacccaaccttaaggcaggatataacctcacaatctgttattttgccatcggagatcgcgaaaaaatgaaaaaggcctttcagaaactgataactgtgcctctcgagatcgacgaagataaatatattagtccgtctgatgacccacacactaacctggtgacggaagcgatcaaaaacgaccacctgagacagatggaaagagagaggaaggccatggccgaaaagtatatcatgactagcgccaagctcatagcgccagtcattgagacctcttttgctgctgggtacgattggtgtgtggaagttgtgaaggcctctcaatacgtggagctggccaacgacctcgaaatcaacaaagccgttacgtatctcagacagaaagattacaatcaggccgtagaaatcttgaaggtactggagaaaaaagactcaagagtgaaatctgccgcagccaccaaccttagcgccctgtactacatgggaaaagatttcgctcaggccagctcctatgccgatatagctgtcaattctgataggtacaacccggcggcactgaccaataaaggaaacaccgtgtttgccaacggggactatgaaaaggccgccgaattctacaaggaagccctgcggaatgattcctcgtgtacagaggccctgtacaatattggattaacctacgaaaaactgaataggttggacgaagccttggattgtttcctcaaactgcatgccattttgagaaactcagccgaggtgctgtaccagatcgctaatatctatgagctgatggaaaatccttcacaggccatcgagtggctgatgcaggtggtgtccgtcataccaactgatcctcaggtgctaagtaagcttggggagctttatgatcgcgagggcgacaaaagccaggcattccagtactactatgagtcttatagatacttcccttgtaacatcgaggtgatcgagtggcttggagcgtactatatagatactcaattttgggaaaaagccattcagtacttcgaaagagcatctctgattcagccgacacaggtaaagtggcagttaatggtagccagttgctttcgtcgttccggcaactatcagaaagctcttgatacctacaaggatactcaccgaaagtttcctgaaaatgtggagtgcctcagattccttgtcagattatgcacagatctgggcttgaaggacgcccaggagtacgcacggaaactaaaaaggctggaaaaaatgaaagaaatccgggagcagcggattaaatccgggcgggacggctccggaggctctcgcggaaaacgggaagggtccgctagcggcgattctggtcagaattattcggcaagttcaaaaggggaacgccttagtgcccggttgcgggccttgccagggaccaatgaaccctatgaatcttcctctaataaggaaatcgacgcgagttacgtggatcctctcggccctcagattgagaggccaaaaaccgccgctaaaaaacgcatcgacgaggacgacttcgcggatgaggagttgggtgacgatcttctgcccgagtag

SEQ ID NO: 26800 - DNA, 765 bp, Artificial Sequence
  Description of Artificial Sequence: Synthetic coding sequence
atggcccccggcagcttcgccgagtacaccgtggtgcccgccagcatcgcaacccccgtgccctcagtcaaaccagaatatttgactctgcttgtgtcaggcactacagcttatatttccctgaaggagctgggcggacttagcgaagggaagaaggtgttagtgacagctgctgcaggtggcacgggacaatttgctatgcagctgagtaaaaaggccaagtgtcacgtgattggcacctgcagttctgatgaaaagtcagcctttcttaaaagccttggttgtgataggccaatcaattacaaaacagaacctgtcggtactgtgctcaagcaggaatatccagagggcgtcgatgtggtgtatgaaagtgtggggggcgcaatgtttgatctggctgtagatgccctggcgacaaagggacgcctgattgtaatcggattcatttctggatatcagacgcctaccgggctgtcgccagtaaaggccggcacgctccccgccaaactccttaagaagagcgcatccgtgcaggggtttttcctgaatcactatctctctaagtaccaggcagccatgagccacctgctcgaaatgtgtgtgagcggcgacctcgtgtgcgaggtcgacctgggagatctgagcccagaggggcgctttacgggattagagagcatcttcagggccgtaaactacatgtatatgggcaagaacacagggaaaatagttgtggagttgccccacagcgtgaatagcaagctgtag

SEQ ID NO: 26801 - DNA, 1212 bp, Artificial Sequence
  Description of Artificial Sequence: Synthetic coding sequence
atgcaccaccccatccagatgaagcccgccgacagcgagaagagcaatgctgtagaagatcggaagctctttataggcatggtgtccaagaagtgtaacgaaaacgacattcgtgtgatgttctcccctttcgggcaaattgaggagtgtcgcatacttcgggggcccgacggactctctcgggggtgtgcctttgtgacattctcaacacgcgctatggcacagaatgccatcaaggctatgcatcagtcacagaccatggaaggctgcagttccccaatcgtggtgaaattcgctgatacacagaaagataaagaacaacggaggctgcagcagcagttggcccagcaaatgcagcagttaaacacagcgacttggggaaacctgactggtctgggcggtttgacaccacagtacttggccttgctacagcaggcgacaagcagttctaacctcggcgcattctctggcatccagcagatggccggcatgaatgcactgcaactgcaaaacttagcaactctggccgctgcagcagccgctgcccaaacaagtgctacatctaccaatgccaacccgctgtctaccaccagtagcgcgctgggcgcactgacatcaccggtggcggcatctactccaaactctaccgctggggccgctatgaattcactcacctcacttggtaccctccagggactcgctggcgcaaccgtaggtcttaataatattaatgcgttggctgtggcacaaatgctgtccggcatggccgccttgaatggagggctgggcgcaacaggactgaccaacggtactgcaggaacaatggatgccctcacccaggcctatagcggaattcagcagtacgcagccgctgcgctgcctacactatatagccaaagtctgctgcaacagcagagcgcagccggcagccagaaagaaggtccagaaggcgccaaccttttcatttaccatcttccacaggaatttggagatcaggacatccttcagatgttcatgccattcgggaacgtcatcagcgcaaaagtgtttatcgataagcagacaaatttatctaaatgctttggctttgtgtcatacgataatccagtctccgcccaagccgctatccaggccatgaatggattccagattgggatgaagagactcaaggtgcagctgaagcggagcaaaaacgattccaagccttattag

SEQ ID NO: 26802 - DNA, 1332 bp, Artificial Sequence
  Description of Artificial Sequence: Synthetic coding sequence
atggccgagttcctgaagcaggtgaagccctacgtggaggagggcttgcacccccagattataattcgggccttccgcacagccacacagctcgcggttaacaagataaaggagatcgcagtgacagtaaaaaaagccgacaaggtggagcagcgaaaactcttggaaaagtgcgcaatgaccgcactatcctcaaaactgatatcccagcagaaagcgttttttgctaaaatggttgtggatgcggtaatgatgctagacgacctgctgcagctaaagatgatcggcataaagaaggtccagggaggggccttggaagactcacagcttgtagccggggtggctttcaagaaaacgttctcctatgctggttttgagatgcagcctaagaagtaccataatcctaagatagcattacttaacgtggagctggagttaaaagccgagaaggataacgccgagatccgggtgcatacagttgaagattaccaggccattgtagacgctgaatggaatatcctctatgacaagttggagaagattcatcatagcggtgccaaggtggtactgagcaaactcccaatcggagatgtagccacccagtattttgcggacagagatatgttttgtgctgggcgtgtgcctgaggaagacctgaaacgcaccatgatggcttgcgggggaagcatccagactagtgttaatgccttatcagctgatgtcctgggccggtgtcaggtgtttgaggaaacgcagataggaggcgaacgctataactttttcaccgggtgtccaaaggcaaagacttgtacttttatactgcgcgggggggctgaacagttcatggaggagactgaaaggtctctccacgacgctatcatgattgtaaggcgggccattaaaaacgacagcgtggtcgcaggcggcggtgccatcgaaatggagctctccaagtacctgcgggactacagccgcacaataccaggaaagcagcagctcctaatcggcgcctatgctaaggcgctcgaaattattccacggcagctttgtgacaacgcaggctttgacgcaaccaatatcctaaataaactgagggccaggcacgcccagggcggtacatggtacggagtcgatattaataatgaagacatagcagacaactttgaagcttttgtgtgggaacctgcaatggtacgcatcaatgcccttacagctgcctctgaagccgcttgtctgatcgtcagcgtggatgagaccatcaagaacccgagaagcaccgtggacgcgcctactgccgcaggccgtgggagagggcgagggcggccccactag

SEQ ID NO: 26803 - DNA, 2193 bp, Artificial Sequence
  Description of Artificial Sequence: Synthetic coding sequence
atgcagctgttcgagcagccctgccccggcgaggacccccggcccggaggccagatcggagaggtagagttgtccagctacactcctccagctggcgtgcctggcaaaccagcagctccccactttcttcctgtcttatgttccgtgagcccctctggatccagggtcccccacgaccttctcggggggagtggcggctttactctggaagacgcgctctttgggctcctcttcggggcagacgccacattgctccagtcgccagtggttttgtgtgggctgccggacgggcaattgtgctgtgttattctgaaggcactggttacctcacggagcgcacccggcgatcccaacgctttggttaagatccttcatcatctcgaggaacccgtgatctttatcggcgcactcaaaaccgagcctcaggcagctgaggctgccgaaaacttcctgcctgacgaagacgtgcattgtgactgtctggtagctttcggtcaccacggacggatgttagctatcaaagcctcttgggatgaatcaggtaaattggtgcccgaattaagagaatactgtctgcccggacccgtgctctgcgccgcctgcgggggcggaggtcgcgtgtaccactccaccccatctgatctgtgcgtggtggatctcagcaggggaagtaccccacttgggccagaacaacctgaagaagggccaggaggactcccgcccatgctttgtcccgctagcctaaacatttgctccgtggtgagcctgtcagcctctcctagaacccatgaaggaggaacgaagttgctggccctgagtgcgaagggacggttaatgacatgcagcctggacctcgacagcgaaatgccgggacctgctagaatgacaaccgagagcgctggccaaaagatcaaggagctgctttcggggatcggaaacatctccgagcgcgtgagttttcttaaaaaagctgtggaccagcggaacaaagcccttacctctcttaatgaggcaatgaacgtgagttgtgccctccttagttcagggacagggcccagacctatctcttgtaccacctcgaccacctggtctcggttgcagactcaagatgttctcatggcaacatgtgtactcgagaactcctcgagtttcagcctcgaccaagggtggactttgtgtatccaggtcttgacatcgtcatgtgccctggacctcgattctgcttgctctgccattacctatacaatccctgtggaccaactggggcctggcgcacggcgcgaggttactctgccattaggcccaggagagaatggtggtctggacttacctgtgaccgtgtcgtgtacactcttctactctctgagggaagttgtcggtggggcgctggcaccgagtgatagcgaggatcctttcttggacgagtgtccttctgacgtcctgcccgaacaagaaggggtgtgtctgcccctgtcccgacatacagtggatatgctacagtgccttcgcttccctggactagccccaccacacacaagggcacccagcccactcggtccgaccagggaccctgtggctacattcttagaaacgtgcagagaacccggaagccagcctgcgggaccagcaagtcttagagccgaatacctgcctccctccgtagctagcattaaagtctctgccgagctcctacgcgctgccctgaaggatggccattctggcgtgcccctgtgttgcgctaccctgcaatggctacttgctgaaaacgcagcagtcgacgttgtgagagctagagcactgagcagtatccagggcgtcgcacctgacggagcgaacgtgcacttgatcgttcgcgaggtggctatgacagatctttgccctgccggcccaattcaggccgttgagattcaggtggagtcctcatcgttggcagatatttgtagggcccatcatgctgtcgttggaaggatgcagaccatggttacagagcaggcgactcagggctcttcagcgcccgatttacgcgtacagtacctgaggcagatccacgcaaatcacgagaccctccttagggaggttcagactctgcgtgataggctgtgcactgaggatgaagccagcagttgcgccacagcacagaggcttttgcaagtttacaggcagcttagacatccaagcctgattctgctgtag

SEQ ID NO: 26804 - DNA, 4179 bp, Artificial Sequence
  Description of Artificial Sequence: Synthetic coding sequence
atgagcatgctgaagcccagcggcctgaaggcccccaccaagatccttaagccaggctcgacggccttgaaaacgcccacggcggtagtcgcaccagtagagaaaaccattagtagcgagaaggctagctctactccttcaagcgagacgcaagaggagtttgttgacgattttcgggtaggggagagggtgtgggtcaacggaaataaacccggatttatacaatttttgggtgagacacagttcgccccaggacagtgggccggcattgtcttggatgagcccattgggaagaatgacgggtcagtggctggggttagatatttccagtgtgagccacttaaaggcattttcacaaggccttctaaactcacacgaaaagttcaggctgaggatgaggcaaatggcctgcagactactccggctagcagggctacgtcccccctctgtacgagcactgcttccatggtctctagcagcccctccacacctagtaatatacctcagaagccgtcccagcccgcggcgaaggagccttcagcaaccccccccatcagtaaccttaccaaaacagcgagcgaatctatatcaaacctgagcgaagccgggagcatcaaaaagggcgaaagagagcttaaaatcggcgatcgcgtcctggtaggcggtacgaaggccggcgtcgtccgatttttaggcgaaacagattttgcaaagggtgaatggtgtggtgtcgaattggacgagccactgggaaaaaatgacggcgccgttgcaggaactagatactttcagtgtcagcccaaatatggtctgttcgcaccagtgcataaggtgactaagataggattcccttctactaccccagcaaaagcaaaggccaacgctgtcagacgggtcatggccacaaccagtgcaagtctcaaacgcagtccatcagcatcaagtctctctagcatgagctcagttgcttctagcgtctcctctcgtccttccaggaccggactcttgacggaaaccagctcccggtacgcccgcaaaatttcaggcacaacggctctgcaggaagctctcaaagaaaaacagcagcacattgaacagctgctggcagagagagatctggagcgtgccgaagttgctaaggccacttcccacgtcggggagattgaacaggaactcgccttggcacgtgacggacacgaccaacatgttctggagctcgaggcaaaaatggatcagcttagaacaatggtcgaggccgcggaccgagaaaaagtagaactcctgaaccagctggaggaggagaagcgtaaggttgaagatttgcaatttagggttgaagaggaaagtatcaccaagggcgatctcgaggtggctaccgtgagtgaaaagtctcggatcatggaacttgaaaaagatcttgcattgcgtgtccaggaggtcgcggagcttagacgccggctcgagtctaacaaacctgccggagatgtggacatgagtttgagcctactccaggagatcagctccctgcaggagaagttggaggttaccagaaccgaccatcagagagaaattacctcacttaaggaacactttggagcgcgcgaagagacccaccagaaggagataaaggcgttatacactgcgaccgagaagctttctaaagaaaacgagtccctgaagtcaaagctggagcacgctaataaagagaattctgatgtgatcgctctctggaaatccaaactcgaaaccgccattgccagtcaccagcaagctatggaggagctcaaggtaagcttctccaaaggattgggcaccgagaccgctgaattcgctgagctcaagacacaaatcgagaaaatgaggctggattaccagcatgaaattgaaaatttgcagaatcagcaggactccgaacgggccgcccacgccaaggagatggaggctctcagagccaaactcatgaaggttatcaaggagaaagagaactccctggaagctatccggtctaaacttgataaagctgaggatcagcaccttgtagaaatggaggataccctgaataagttgcaggaggcagaaattaaggtgaaagaattagaggttcttcaggcaaagtgcaatgagcagacaaaggtcatcgacaacttcacttctcagcttaaggccactgaggagaagctgctcgacttggatgccctgaggaaagcatcatccgaaggcaagagcgaaatgaagaaactgcgccagcagctcgaagctgcagagaaacagatcaagcacctggagatcgaaaagaacgccgagagttctaaagcttcgtcgatcacccgagaacttcaaggcagggaactcaagctgacaaatttgcaggaaaacctgtccgaggtgagccaggttaaagagacattggaaaaggagctccaaattctgaaggaaaagttcgccgaagcctccgaggaggcagtgtccgtgcagaggtccatgcaggagacagttaataagctgcaccagaaagaggaacagtttaacatgctctccagtgatctcgaaaagctccgcgaaaatctggccgacatggaagccaagttcagagagaaagatgagcgagaagaacagctcatcaaagctaaggaaaagctggagaatgacatagctgagataatgaaaatgagcggcgacaatagcagtcaactgactaaaatgaacgacgagcttagactaaaggagcgagacgtcgaggaactgcagctcaaattgacaaaagctaatgaaaacgctagcttcctgcaaaagtccattgaagacatgaccgtcaaggctgagcagtcacaacaggaggcagccaaaaagcatgaggaggagaagaaagaattggagaggaagctctccgatctcgagaagaaaatggagaccagtcacaaccaatgtcaggaactaaaggctcggtatgaacgagcaacttcagaaaccaaaacaaaacatgaggaaattctgcagaatctgcagaaaacccttctggacacagaagacaagctcaaaggggcgcgtgaggagaactcaggtctcctgcaagagcttgaagagctgcgcaagcaggcagataaagccaaagccgcccagacagccgaagatgcgatgcagatcatggagcaaatgaccaaagagaagaccgagacacttgcaagtctggaggataccaagcagacgaacgcaaaactgcagaatgaactggatacattaaaggaaaacaacttgaagaatgttgaggaactcaacaaaagtaaggagctattgaccgtggagaatcagaagatggaggagtttaggaaagagattgaaactttgaagcaggccgccgctcagaagagccaacagttatcggccttacaggaggaaaatgtgaaactcgctgaagaactgggtcgcagtagagacgaagttaccagtcaccagaagctcgaagaagaacgaagcgtgctgaataatcagctgctggagatgaagaaacgagagagcaagttcattaaagatgctgacgaggagaaagcatcccttcaaaaatctatttctattactagcgctttgcttaccgaaaaggatgccgagcttgagaagctcagaaacgaggtgactgtgttgagaggagaaaatgcttctgccaagtccttacattccgttgtacagaccttagagtcggataaggttaagctggaactgaaggttaagaacttggaactgcaacttaaggaaaacaaaaggcaattgtcctctagctcggggaacacggacacacaagccgatgaggacgaacgggcccaggagagtcaaattgactttttgaactcagtcattgtggacctccagcggaagaatcaagacctgaagatgaaggttgagatgatgagcgaggcggcactaaacggaaacggagatgacctaaataactatgactcagatgaccaggaaaagcagagtaaaaaaaagccacggctattctgcgacatctgtgattgcttcgatctgcacgacactgaggactgccctactcaggcacagatgagcgaagaccccccacactcaactcaccatggctctcggggggaggagcgaccatactgcgagatctgtgaaatgtttgggcactgggccacaaactgcaacgatgacgagaccttttag

SEQ ID NO: 26805 - DNA, 492 bp, Artificial Sequence
  Description of Artificial Sequence: Synthetic coding sequence
atgttccggaagatcggcatcgaggccctgaagcaggtgaccaagagatatgctcggaagcaaaatcgatgggtgaagaataggtttctgtcaagacccggacctatagtcccccccgtgtatgggctcgaggtcagcgatgttagtaaatgggaggagagcgtgttggaaccagccttggaaattgttcagtctttcatccaggggcataaaccaacagccacacctataaagatgccttacaacgaggccgagaacaagagatcttatcacctgtgcgatctctgtgacaggataattataggagatcgcgagtgggcagcgcatataaagagtaaatctcacttaaaccagctgaagaagcgtcgaaggcttgacagtgatgcagtcaacacaattgagtcccagtctgtgagcccagaccataataaagagccgaaagagaagggatctccagggcagaacgaccaggagcttaaatgtagtgtttag

SEQ ID NO: 26806 - DNA, 1602 bp, Artificial Sequence
  Description of Artificial Sequence: Synthetic coding sequence
atggccagccccggcaaggacaactaccggatgaagagctacaagaataacgctctgaatccagaagagatgcgacgaaggcgcgaggaagaaggcatccaactacggaaacagaagagggagcagcagttgtttaagagacgaaacgtggagctgattaatgaggaagccgcaatgttcgattccttgctgatggatagctatgttagctccacgacaggtgaaagcgtgataacacgagaaatggtggaaatgctattctcagatgattcggacctgcaacttgcaacgactcagaagtttcggaagctactgtctaaggagccctcaccccctatagatgaagtgattaacacaccacgtgtggtagatagattcgttgagtttctgaaacgtaacgagaattgtaccctgcagtttgaagcggcgtgggcactcacgaacatcgccagtggcacatcccagcagaccaaaatagtcattgaagccggggccgtgccaatatttatcgagctgctcaactcggatttcgaggatgttcaagagcaggcagtgtgggcactggggaacatcgccggggactcgtcggtctgtcgcgattacgtgttgaattgctctatcctcaaccctctcctgaccttgctgacaaagtccaccagactcacgatgacacgcaacgccgtgtgggcactgtccaatctgtgtagaggaaagaaccctccacccgaatttgcgaaggtgagcccttgcctgcctgtcctgagtaggctcttattctcttcggacagcgacctcctggccgatgcgtgctgggctctgtcatatctctccgacggaccaaacgagaagattcaggcggtgatcgacagcggagtgtgcaggcggcttgttgagctgctcatgcacaacgactacaaagtggcaagccctgccctgagagctgtcgggaacatcgtgacaggcgatgacatacagactcaagtcatcctcaactgcagtgcactaccatgcttacttcacctcctatcctcccccaaagagtctatccgcaaagaagcatgttggacaatttctaatatcacggccggcaatagggcacagattcaggccgtcattgatgccaatatcttccctgtcttgattgagatcttgcagaaagccgaattccgtactcgaaaggaggcggcttgggccattacaaacgccacttccggtgggaccccagagcagattagatatctcgtttcgctcggatgcattaaaccgctgtgtgacttgctaacagtgatggacagtaaaatcgtgcaggtcgcactcaatgggctggagaatatccttcgcctgggggagcaggaaggaaaaaggtcgggcagcggcgtaaacccttactgcggactcatcgaggaagcatacggattggacaagatagagtttctccagagtcacgaaaatcaggaaatttaccagaaggccttcgatctgatagaacattacttcggtgtggaggatgacgattcctcgttagccccccaggtggatgagactcagcaacagttcatattccagcagccggaagcacctatggaagggttccagctctag

SEQ ID NO: 26807 - DNA, 993 bp, Artificial Sequence
  Description of Artificial Sequence: Synthetic coding sequence
atggagcggttcatggagcaggtggtgttcaagtacctgcgggccgaacctgaggaccactacttcttgatgacagagcctccccttaatacaccagagaatagggaatacctggcagaaatcatgtttgagtctttcaacgtgcctggtctctacattgccgtccaggctgtgttagctttggccgcaagctggacatcccgccaggtcggcgagcgaacgctgaccggaatcgttattgatagcggcgacggagtgacgcacgtgattcccgtggctgaaggctacgtcatcggctcttgcataaagcacatccccatagctggacgggacattacttattttattcagcagcttttgagagaacgcgaggtagggataccaccggagcagtctctggagaccgcaaaggccatcaaggagaagtattgttacatctgccccgacatagttaaggaattcgccaaatatgatgtcgacccacggaaatggatcaagcagtacaccggaattaacgccatcaatcagaagaaatttgtgatagacgtggggtacgagcggttcctggggccggagatcttctttcatccagagtttgccaaccctgacttcatggaatcaatttccgatgttgttgatgaggtaattcagaattgtcccattgacgtaagacgacccttgtacaaaaacgtagtactctccggggggtccactatgttcagggatttcggaaggagactgcagcgagaccttaagcgcgtggtggatgccagattaaggctcagcgaggaattatcaggcggccgaataaagcccaagcctgtcgaagtccaagtggtcacccaccacatgcagaggtacgcggtgtggtttgggggttctatgctggccagcacaccggaatttttccaggtgtgccacactaaaaaggattatgaggagtacgggcctagtatttgtagacacaaccctgtgtttggggtcatgagttag

SEQ ID NO: 26808 - DNA, 576 bp, Artificial Sequence
  Description of Artificial Sequence: Synthetic coding sequence
atgagccgggagcggggcagccggagcgaggagcccggcgccggcaaccgggaaagcggatccagagagccaggtctcgccgccgccgccatgtccaccgtggatcttgcccgcgtaggagcttgtattctgaaacatgccgttacaggggaggccgtggagctccgatcattgtggagagaacacgcatgtgtagtggctggactcaggcgcttcggatgcgtggtctgtcggtggattgcgcaggacttgagcagcctggccgggctgctggatcagcacggtgtgcgacttgtaggtgtgggtccagaagccctgggcctccaagaattcctcgacggggactactttgccggggagctgtacctggacgaatccaagcagctgtataaagagttagggttcaaacgatataactctcttagcatcctcccggcagctctgggcaagcctgttagagacgttgctgctaagtcacccggggactacgtacctaaagagcatattcttcaagtcctcgggattagcgccgaggtatgcgcctctgatcctcctcagtgcgaccgggaggtctag

SEQ ID NO: 26809 - DNA, 1050 bp, Artificial Sequence
  Description of Artificial Sequence: Synthetic coding sequence
aacaccatccacgacgtgctggacgtggaggccgccgtggtgaacctggacaactctgtcgtagatctcgagaccctccaggccctatatgaaaacagagctcaatcagacgagcttgagaagatcgaaaaacacggccgaagcagtaaggataaggaaaatgctaaatctctggacaaaccagaacagttcctctatgaactaagccttataccaaatttcagcgagcgggtcttttgcattttatttcagagtacatttagcgaatcgatctgctccatccgaagaaagcttgaactgttgcagaaactgtgtgaaaccctgaaaaatggacctggcgtcatgcaggttctgggcttggtcctcgcatttggtaactatatgaatggcgggaataagaccagaggccaggctgacgggtttggcctcgacatactccctaagctgaaggacgtgaaaagttcagacaactcaagaagcctcctcagttatattgtgtcttattatctgcgcaatttcgatgaagacgctggaaaagaacaatgtctattccctctgccggagccccaggacctgttccaggcctcgcaaatgaagttcgaggactttcagaaagatctccgtaagcttaagaaagacctgaaggcatgtgaggtggaggcaggcaaggtttaccaggtgagttcgaaggaacacatgcagccgtttaaggaaaatatggaacagttcatcattcaggcaaagattgatcaggaggctgaagaaaattctttaactgaaacacataagtgttttctagagacaaccgcctatttcttcatgaagcctaagcttggagagaaagaagttagtccaaatgcatttttcagcatttggcacgagtttagcagcgatttcaaagacttttggaagaaagagaataagctcctgttgcaggaacgcgttaaggaagcggaggaagtctgccgccaaaagaaaggcaagtcgctgtataaaataaaaccaagacatgactcgggtattaaaaacaataattctatgcatacatag

SEQ ID NO: 26810 - DNA, 570 bp, Artificial Sequence
  Description of Artificial Sequence: Synthetic coding sequence
atgaccgccagcgccagcagcttcagcagcagccagggcgtgcagcagccttccatctatagcttctcccagatcacaaggagcctgtttcttagcaatggcgtggccgccaatgacaagcttcttttatcgagtaatcgcataacagccatcgttaatgccagcgtggaaggtcagagaattctgagaggcatccagtacattaaagtccctgttaccgatgcaagggattcacgcctctacgacttctttgaccctattgcagatctcatccacaccattgacatgcggcagggtcgcactctcctgcattgtatggctggggtgtctaggtctgccagtctgtgtcttgcctacctgatgaagtaccactccatgagtctgttagatgcccacacatggaccaagtcacggagacccataattaggcccaataacggattttgggagcagctgatcaattacgaattcaagcttttcaataacaatacggtgcggatgattaactctcctgttggcaatattcccgatatttatgagaaagacctgaggatgatgatcagcatgtag

SEQ ID NO: 26811 - DNA, 549 bp, Artificial Sequence
  Description of Artificial Sequence: Synthetic coding sequence
atgagcggccggagcgtgccccacgcccaccccgccaccgccgagtatgaatttgcgaatccttctcgattaggggagcagcgcttcggcgaagggctgctgccagaggagatccttacacccacgctttaccatggctactacgtcaggccacgtgccgctcccgccggggagggtagccgtgccggagcctctgagctgaggctgtcagagggaaagttccaggctttcctggatgtgtcccactttacccccgatgaagttacagttagaaccgtggataatctgctggaagtgagcgcccggcatccccagaggctcgaccgccacggttttgtctcaagagaattttgcaggacttacgttctaccagccgacgtcgacccgtggcgggtgcgcgccgctctcagtcacgatggcattctgaacctggaggctccaagagggggacgtcatctcgacacagaggtgaatgaagtgtacatctcactgctacccgctcctcctgaccccgaagaggaagaggaagctgcaatcgtggagccttag

SEQ ID NO: 26812 - DNA, 387 bp, Artificial Sequence
  Description of Artificial Sequence: Synthetic coding sequence
atggtgttccggcggttcgtggaggtgggccgggtggcctacgtgagctttggtcctcacgccggaaaactcgtggctatagttgatgtgatagatcagaatcgagcgcttgtcgacggaccctgcactcaagtacgacgccaagccatgccttttaaatgcatgcagctcacagactttattttaaagtttcctcatagcgcccaccagaaatatgtgcgccaggcttggcagaaggccgatattaacacaaaatgggcggccacccggtgggccaagaaaatcgaggcacgcgagcgaaaggccaagatgaccgacttcgacagattcaaggtaatgaaggctaagaagatgagaaaccggattatcaaaaatgataccaggtag

SEQ ID NO: 26813 - DNA, 492 bp, Artificial Sequence
  Description of Artificial Sequence: Synthetic coding sequence
atgttccggaagatcggcatcgaggccctgaagcaggtgaccaagcgctatgcacgaaaacagaatcgctgggtaaagaatcgctttctctccaggccgggaccaatcgttcccccagtatatggtctggaggtaagtgacgtatccaaatgggaggagtctgttctggaaccggcactggagatcgttcagtcctttatccaagggcacaaacccacagcaactccaatcaagatgccctacaacgaagccgaaaacaagaggtcatatcatctctgtgatctttgtgaccgcatcatcataggggatcgtgagtgggccgctcacatcaaaagtaaatcccacctcaaccaactgaaaaaaaggagacgcttggattccgacgccgtgaatacaatagagagtcagagcgtgtccccagaccataacaaggagcctaaggaaaagggctcccccggacagaatgatcaggagctcaagtgtagtgtgtag

SEQ ID NO: 26814 - DNA, 1224 bp, Artificial Sequence
  Description of Artificial Sequence: Synthetic coding sequence
atggccgccgagctgtacgcccccgccagcgccgccgccgccgacttagctaatagcaacgctggggccgccgtgggccggaaggctggcccaaggagtccacctagtgcgccagcacccgcaccaccacctccagccccagccccgcccacccttggtaacaaccaccaggagtctcctggatggcggtgctgtcgcccaacccttcgtgaacgcaatgcactcatgttcaacaatgagctcatggctgacgtgcactttgtagtgggtcccccaggggcaacacggactgtacccgcccacaaatatgtcctggcggtcggtagcagtgttttttacgctatgttttatggagatctagccgaggtgaagagcgagatccatataccagacgttgaacccgctgcttttctgatcttgctgaaatatatgtattccgatgagattgatctcgaggccgacactgtgcttgccactctgtatgccgccaagaaatacattgtccccgccttggccaaagcctgcgtcaactttctggagacatccctggaagcaaagaacgcttgcgtactgctgtcacagtctaggctgttcgaggaaccggagctgacacaaaggtgctgggaagttattgacgcccaggccgaaatggcgttgaggtctgaaggcttttgtgaaatcgatcggcaaactttagaaatcattgtgaccagagaagctctgaacactaaagaagctgttgtgtttgaggctgtcctgaactgggcagaggccgaatgcaagcgacagggcctccccataactcctcgaaataagcgacatgttcttggccgcgccttgtaccttgtccgtatccccacaatgactttagaggaattcgccaatggcgccgctcagagtgacatattgaccttagaggaaacacacagcatttttttgtggtacaccgcaaccaacaagccccgcctcgacttccccctcaccaaacggaaggggttggccccacagcgttgccaccggttccagtcttctgcctatcgttccaatcaatggagataccgcggaagatgtgactccatccagttcgctgttgaccgccgcgtgttcatcgctggccttggtctgtacggatcttcttctggaaaagccgagtattcagtcaagatcgagctgaagcgccttggcgtggtcctcgcacaaaacctaaccaagtttatgagttag

SEQ ID NO: 26815 - DNA, 603 bp, Artificial Sequence
  Description of Artificial Sequence: Synthetic coding sequence
atgctggagctggtggcccagaagcagcgggagcgggaggagcgggaggaacgcgaagcgctagaaagagagcgtcaacgccgcaggcagggacaggaattgtctgcggcccggcaacggctgcaggaagacgagatgcgccgggcggctgaagagcgtcggagggagaaagccgaggagctcgcagcccgtcaaagggtgcgagaaaaaatagagcgcgacaaagccgaaagggctaaaaaatatggaggatccgtgggatcccagccgccgccagtcgctcctgagcctgggcccgtgccatcatccccaagtcaggaacctccaactaagcgagaatatgaccagtgtaggattcaagtaaggctccctgacggcacctctctaacacagacctttagagcaagagagcaactggctgctgttaggctttacgtagaactgcaccgcggggaggagcttggtggaggacaggaccctgtgcaactgctttctggctttcccagacgcgcatttagtgaggcggacatggagcgccccttgcaggaattaggactcgtcccatccgcagtgttgatcgtggccaaaaaatgcccatcttag

SEQ ID NO: 26816 - DNA, 885 bp, Artificial Sequence
  Description of Artificial Sequence: Synthetic coding sequence
atgggcctggccagctggagccagctggccagcaccccccgggccccaggatccagggacgctcggtgggagcggagagagcccgcacttagaggtgcaaaggacagacttaccatcggaaagcatctggacatggggtctccccagctacggacccgtgaccgcggctggccatcccccaggcccgaacgcgagaagcgtacatcccaaagcgctagaagacctacgtgcactgagtcccggtggaaatccgaggaagaggtcgaaagcgacgatgagtacctagccctgcccgcccggctgactcaggtaagcagcctggtttcatatctggggagtatctctactctggtcaccctgccaaccggggatatcaagggacagagcccactcgaagtaagcgattccgatgggcctgcatcgttccccagcagttccagccagtcccagctgcccccgggagccgcgcttcagggttccggagaccctgaaggccagaacccctgcttccttcgctctttcgtccgagcccacgattcggccggcgagggatcattgggcagctctcaggcactgggcgtgtcctccggtctgctgaagacaaggccaagtctgccagcccgtctggatcgatggcccttttccgatccggatgtggagggccagctgcctagaaagggcggcgagcaagggaaagaatccttagttcagtgtgtgaaggtgatgacacttaacgttaggaagctgtgtgtacaggtgagctgtctctttccacagtccaccaacatcatcatcaagcacgtgcatgtggaccaagcactttttatgtgccaagccttgtgttgtactctttcttactccgtactgactacattcacgaggtag

SEQ ID NO: 26817 - DNA, 354 bp, Artificial Sequence
  Description of Artificial Sequence: Synthetic coding sequence
atggtgcggaagatcaccctggtgagcgccgcccccggcaaggtgatctgcgaaatgaaagtcgaagaggaacacactaacgctattggtaccctgcacggcgggctgacagcaacgctggtagataatatttccaccatggcactgctgtgtacagaacgcggcgcaccaggagtgtcagtggatatgaatatcacctacatgtcgccagcgaaactgggcgaggacattgtcattaccgcccacgtactaaagcagggtaaaactctcgctttcactagcgtcgacttaacaaataaggctactgggaaactgatcgcccaggggcggcacactaagcacttaggcaattag

SEQ ID NO: 26818 - DNA, 840 bp, Artificial Sequence
  Description of Artificial Sequence: Synthetic coding sequence
atgaccagcggcaagatcaagaagttcatccaggagaacatcttcggcatctgtccacacatgacggaagacaataaggacctgattcagggaaaagatctactcatcgcctactatgatgtggattacgagaaaaatgccaagggtagcaattattggcggaaccgcgttatgatggtggccaagaaattcctggatgctggacacaaactgaacttcgccgtggcctccagaaaaaccttttctcatgagctctctgacttcgggcttgagtcaaccgccggagaaatccccgttgtggctatcagaacggctaagggagagaaatttgtgatgcaggaagaattctcaagagacggcaaagcccttgagcgctttcttcaggactacttcgatgggaacttgaagcgctacctgaaaagcgaaccaataccagaaagcaatgacggtcctgtgaaggtagtggtagcagagaatttcgatgaaatcgtgaacaatgaaaacaaagacgtgttaatcgagttttacgctccctggtgtgggcactgtaaaaacctcgaacccaagtacaaagaactgggtgagaagctttcgaaagatcccaatattgtaattgccaagatggatgctacagccaatgatgttccctctccttacgaggtgagaggatttcccacaatctatttctcgcctgctaataaaaagttgaatcccaagaagtacgaaggaggccgagagttgtcagacttcattagctacctccagcgagaagctacaaacccccccgtcattcaggaggagaaaccaaagaagaagaagaaggctcaagaagatttgtag

SEQ ID NO: 26819 - DNA, 3228 bp, Artificial Sequence
  Description of Artificial Sequence: Synthetic coding sequence
atgagccagggcttccaccccgagcgggaccccagcgacctgaagaaagtgaaggcggttgaggagaacggtgaagaggctgagccggttaggaacggcgccgagtcagtaagcgaaggggagggaatagatgcgaattctgggagcactgactcttcaggggatggggtaacattccccttcaagcccgaaagttggaagcccactgatactgaggggaagaaacagtatgacagggagttcttgctggattttcaatttatgcctgcgtgtatccagaagcccgaaggactgccaccaatctcagacgttgtgctggataagatcaaccagcccaagctacctatgaggactttggacccacggattctaccacgaggtcctgatttcacccctgctttcgccgattttggccgtcagacaccaggagggagaggcgtcccgatctgtaaagtgcaaagccggcatggcctgccgattctggagcaaagtaaagcccctacatgcccacccctcgttatgtcccatcctccaatgaagtcacttccacttggactcctcaacgttggtagcaggcgatcccaacctggccaaaggagggaacctcgcaagatcattaccgtgtctgtgaaggaggacgtgcacttgaaaaaggccgagaacgcctggaagccaagccagaagcgtgattcccaagcagatgatccagagaacatcaagacgcaggagctgtttagaaaggtgagaagcattctgaataagctgacgcctcagatgttcaatcagctcatgaagcaggtcagcggcctgaccgtagatacggaggaaaggcttaaaggcgtgatcgacctcgtgtttgagaaggcaattgatgagcctagcttctccgtagcttacgctaatatgtgtcgatgtctggtgactctgaaggtaccaatggccgacaaacccgggaatactgttaatttccgtaagctcctcctcaatcgctgtcagaaagagtttgaaaaagataaagctgacgacgacgtgtttgaaaagaagcagaaagagctggaggcggcgagtgctccagaagagagaacaagactccacgatgaacttgaggaggccaaagataaggctcggcgaagaagcatcgggaatatcaagtttattggtgaactgttcaaactgaagatgctcacagaagccatcatgcacgattgcgttgttaagctgcttaaaaaccacgatgaagaaagcctagaatgtctgtgtaggctgttaacaaccatcggcaaggatttagactttgaaaaagccaaaccccgcatggatcagtactttaatcaaatggagaagattgtgaaggagcgcaagacttctagtcgtattaggttcatgttacaggacgtaatcgacctcaggctttgcaactgggtatcccgcagggccgatcaggggcctaaaacgatcgagcagattcataaagaggccaagatcgaagagcaagaagaacagaggaaagtccagcagttaatgacaaaggagaagcggcgccccggggtacaacgggtcgatgagggcggctggaataccgttcagggcgcaaagaatagccgtgtgctggacccatccaagttcctgaagattacaaaaccaactattgatgagaaaatccaactcgtccccaaagcccaactcggcagttgggggaagggctcaagcggcggggctaaggcgtcagagacagatgccctccgaagttccgcaagttccctgaacaggttttctgcactccaacctcctgctccatctgggagtacacctagtacacctgtcgaattcgattctaggagaacactgacgtccaggggctccatgggtcgcgaaaagaatgataagcccctgcctagcgccaccgcgcgacctaatacattcatgagaggaggcagctccaaggatctgctcgataatcaaagccaggaggagcaaagacgtgagatgttggaaaccgtaaaacagctcactggaggagtcgatgtcgaacgaaacagcacagaagccgagagaaataaaacacgtgaatctgccaagcccgagatttctgcaatgagtgcccacgataaggctgcactgtccgaggaagaacttgagagaaaatccaaatcaataatagatgaattcctccacataaacgacttcaaggaagcaatgcagtgtgtcgaggaattaaacgctcagggattgctacacgtgttcgttcgggtcggcgtggagtccacactggaaaggagtcagatcacacgcgaccacatgggccagttgctgtaccagctcgtgcaatcagaaaagctgtctaagcaggacttctttaaggggtttagtgagaccctcgagctggcggatgacatggctatagacatcccacatatttggctctatctggcagaattggtaaccccgatgctcaaagagggaggcattagcatgcgggaactgaccatagaatttagcaagccactgctgcctgttggccgggcgggcgtcctgctctctgaaatcttgcacttactgtgtaaacagatgtcccataaaaaagtaggagcactgtggagagaggcagatttgtcttggaaggattttctgcctgagggggaagacgttcataacttccttcttgagcagaagctggactttattgaatccgactccccctgctcctcggaggctctgtcgaagaaggaactgtccgctgaggaactctacaagaggctggaaaagttaatcattgaggacaaggctaacgacgagcagatttttgattgggtggaggctaatttggacgagattcagatgtcttcgccgacattcctgagagccctgatgaccgcggtgtgcaaggcggctatcatcgctgactcgtccacatttagggtggatactgccgttattaaacaaagagttccaatcctcctcaaataccttgatagcgacacagaaaaggagcttcaagccctgtatgccctccaagcttcaattgtgaagctcgaccagcctgccaatcttttgaggatgttctttgactgcctttacgacgaagaagtaatttccgaggacgctttttacaaatgggagagctcaaaagaccctgccgagcagaacggaaagggcgtggcactgaaaagcgttacagcttttttcacctggttgagagaagcagaggaggaatccgaggacaattag

SEQ ID NO: 26820 - DNA, 474 bp, Artificial Sequence
  Description of Artificial Sequence: Synthetic coding sequence
atgaagtgcatcccctacagcgtgctgctgaaggacctggagatgaggaatctccgcgagctcgaggacctgattatcgaagcggtttacactgatattatacaggggaaactggaccagaggaaccagcttctggaagttgacttctgtatcggacgagatatccgtaagaaggacatcaacaatatcgtgaaaaccctgcacgagtggtgcgatggatgtgaggcagttcttttaggcattgagcagcaggttcttcgggctaaccagtacaaggaaaatcataatagaacgcaacagcaggtggaagccgaagttacgaatattaaaaagaccctgaaggcaacagcatcttccagcgctcaggagatggagcagcagttagctgaacgggagtgcccccctcacgcagaacaacgtcagcccacaaagaagatgtctaaagtgaagggcctcgtttcatcgaggcactag

SEQ ID NO: 26821 - DNA, 837 bp, Artificial Sequence
  Description of Artificial Sequence: Synthetic coding sequence
atggactgccgggagatggacctgtacgaggactaccagagccccttcgatttcgacgcaggggttaacaagtcctatctgtacttatccccctccgggaatagttctccaccaggttctcccacgctacagaaattcggattgctcagaactgaccccgtaccggaggagggagaagacgtggccgcgactatttcggccaccgaaacacttagcgaggaggagcaggaggagctccggcgtgagctggcaaaggtagaagaggagatccaaaccctttcccaggtgctggctgctaaggaaaaacacctggcagagataaagaggaagctggggatcaatagtctccaggagcttaaacagaatatcgccaagggatggcaagatgtcaccgcaacctccgcatataagaagaccagtgagactctctcgcaggctggtcagaaagcttcagcagccttttcttcggttggtagtgtcataaccaagaaactggaggatgtgaaaaactcccctaccttcaaatcattcgaggaaaaagtcgaaaatcttaaagggtctcccaagaatgttgagagcttcgcctctatgctgcgccattctcccctgactcagatgggacctgccaaagacaaactggtgataggaagaattttccatatcgtggagaatgatctatacatcgacttcggcgggaaatttcactgtgtatgtcgtagaccagaggtggatggcgagtctccaatctcatggtacgccgtgtggcgcagatttagtcaagtaatgataacgtgtttcagctctaattcagatttcggcaagcatcgcaaacggtag

SEQ ID NO: 26822 - DNA, 3123 bp, Artificial Sequence
  Description of Artificial Sequence: Synthetic coding sequence
atggtgagcagcgcccagatgggcttcaacctgcaggccctgctggagcagctgtctcaggatgagctgagtaagtttaaatacctgattactactttctccctggcccatgagctgcagaagattcctcacaaggaggttgataaggccgatggaaaacaactggtggaaatacttacgacccactgcgactcgtattgggttgaaatggcgtccctccaagtgtttgagaaaatgcaccgcatggacttgagcgagcgagcaaaagatgaggttcgtgaggctgccctgaaaagctttaataagagaaagcccttgtccctgggaattaccagaaaagaacgcccaccattggatgtggacgaaatgttggagaggttcaaaaccgaagcacaggacaaggataaccgatgtcggtacatcctgaagaccaagtttagggaaatgtggaaaagttggccgggggattcaaaagaggtccaggtgatggctgaaaggtacaagatgctgattcccttcagcaaccctagagttctgcctgggccattcagctatacagtggttctgtacggccccgctgggctgggcaagacgaccttagctcagaagttgatgttggattgggctgaagacaacctcattcataaatttaaatacgcgttctatctttcttgtcgagaattgtccaggctgggtccatgttcctttgctgagctagtgtttagggactggccagaactgcaggacgacatcccacatatcctagcccaagctcgcaagatcctgttcgtgatcgatggctttgacgagctgggggcagctccaggggccctgatcgaagatatctgcggtgactgggaaaagaaaaagcctgtgccggtgctcttgggctccttgcttaacagggtgatgctgcccaaagctgccctgctggtgacgacgcggccgagggccctgagggacctacggatcttagccgaggagccaatttacatacgcgtggaggggttcctcgaggaagaccggcgtgcttactttctccgtcactttggcgatgaagaccaagctatgcgcgcgtttgagctgatgcggtcaaacgctgccctttttcaactcggaagtgcccccgccgtttgttggattgtctgcactacactgaagctgcagatggagaaaggggaagacccggtgccgacctgcctgacacggactggtctctttctccgctttctatgttcaagatttcctcaaggcgcgcagttgcgcggcgctcttcgcaccctgtccctgctggccgcgcagggactatgggcacaaacctcagtgcttcaccgcgaggaccttgaacggctgggagtgcaggagtcagacttgaggctctttttggacggtgacatactgagacaggatcgcgtttcaaaggggtgctattccttcatccacctgtctttccagcagttccttaccgccttgttctacactctagaaaaagaagaagaagaggacagggatggccacacttgggacattggggacgtgcagaagctcctcagcggggtggagcgcctcaggaacccagatctgattcaggccggctactactcatttggactggctaacgaaaagagagcaaaagagctcgaggccacattcggctgccgtatgtcacctgacataaaacaggaactcctgcgttgcgatatttcctgtaagggtgggcatagcacggtgaccgatctgcaggaactgcttggctgtttgtatgagagccaagaagaagaattagtgaaagaggtgatggcgcagtttaaggaaatatctctgcatctgaatgcagtagacgtggttccctcaagcttttgcgtgaagcattgtcggaacttacagaaaatgtccttgcaggttataaaagagaacctgccggagaatgtaacggccagcgaatccgacgcagaggtggagcgctctcaggatgaccaacacatgctaccattctggacagacctctgttccatcttcggatccaacaaggatttgatggggcttgctattaacgactccttcctgtctgcgtccctggtacggattctatgtgagcagattgcgtctgacacttgccacctgcagagagtcgtgtttaagaatatttcccccgccgatgcacaccggaacctatgccttgctttgagaggccacaaaacggtaacttacctgaccttacagggaaacgatcaggatgatatgtttcccgccctgtgcgaggtcctgaggcaccccgaatgcaacctcaggtaccttggtctggtatcctgctcagcgacaacgcagcagtgggccgatttatcactggcactggaggtgaatcagtcactgacttgtgtgaacctctccgataatgaactgttggacgaaggggcaaaactgctttatacaactttgcgccatccgaaatgcttccttcaaagattgtccctagagaattgtcacctcactgaagctaattgtaaagatttggccgctgtcctcgtagtttccagagaactgactcacctgtgcctcgctaaaaaccctatcgggaacacaggagtgaagttcctatgtgagggtctgcggtatcctgaatgcaaactgcagactcttgtgctctggaattgtgacattacctctgatgggtgctgtgacctcaccaagctgctgcaggagaagagttccttactgtgtctggatctgggcctgaaccacatcggggtcaagggcatgaagtttctgtgtgaggccctcaggaaacccctctgtaacctgagatgtctttggttatggggctgcagtatccctcctttctcttgcgaggacctgtgttccgcgcttagctgtaatcagagcctcgtgacactggatctaggacagaatcccctgggctcaagcggagtgaagatgctgtttgagaccctgacgtgctcaagcggaactctgaggacactgagattaaagatagatgacttcaatgacgaactaaacaaactacttgaagaaatcgaagagaagaacccacagcttattattgacaccgaaaaacaccacccttgggccgagcggccctcatcccacgacttcatgatctag

SEQ ID NO: 26823 - DNA, 1809 bp, Artificial Sequence
  Description of Artificial Sequence: Synthetic coding sequence
atgagcgacaagagcgacctgaaggccgagctggagcggaagaagcagcgactggctcaaattcgcgaggaaaagaaaagaaaggaagaggaacgcaagaagaaggaggcagatatgcagcagaaaaaagaacctgtccaggatgatagcgatctggatcggaagagaagggagactgaggctcttctgcaaagcatcggcatcagcccagaacccccattggtaccgactcctatgtctcctagcagtaaatccgtgtcaactccttcagaggccggatcccaggattctggcgatctcggacctttaaccaggcgccgattgcataaactgggcgtcagtaaggttacacaggttgatttcttgccacgcgaagtggtaagctattcaaaagagactcaaacacctctggctacacatcagagtgaagaagacgaagaggatgaagaaatggtggaatctaaggtcggccaggactcggagctggaaaaccaggacaagaagcaagaggtgaaagaggcccccccgcgagagttgactgaggaagaaaaacagcaaatcctgcattctgaagagttcctgattttttttgaccgaaccattcgcgttattgaaagagctctggccgaagattctgatatcttcttcgattactcaggacgagaactggaagaaaaggatggcgacgtgcaggctggcgctaatctgagcttcaacagacagttttatgatgagcactggtcgaagcatagggtggtgacttgtatggattggtcattgcagtaccctgaattgatggtggcatcatacaacaacaacgaggacgccccacatgagcccgacggggtagcactcgtttggaacatgaagttcaaaaagactactccagagtacgtatttcattgccagtcatcggtcatgtctgtgtgttttgctaggttccacccgaatctcgtggtgggtggaacatattcagggcagatcgttttatgggataatcggtcccaccgtcggacacctgtacaaaggacccccctttctgctgcagctcacacgcatccagtgtactgcgttaatgttgtgggaacccagaatgcccataacttgattacggtaagtactgacggtaaaatgtgttcttggagcctagacatgctgtcgaccccacaggaaagtatggaactggtgtataacaaaagcaagcctgtggcggtaacggggatggcttttccaacaggcgacgtcaacaacttcgtggtcggtagtgaggaggggaccgtctacacagcctgccgccacggcagcaaagccgggataggggaagtgtttgaaggtcatcagggtcccgtgaccggtatcaactgccacatggcagttggccccatagatttctcccatctctttgtgaccagtagtttcgactggacagttaagttgtggaccacaaagcacaacaagcccctgtactctttcgaggataatgcggactacgtgtacgacgttatgtggagccctgttcaccccgcactgtttgcctgcgtcgacggcatgggccggctcgatctgtggaatctaaataacgataccgaagttccaaccgcctctgtcgctattgagggagcctccgcactgaaccgggttagatgggcccaggcggggaaagaagtagctgtaggagatagcgaaggcagaatttgggtctacgatgttggcgaaggtctggccatgctccccggctggtcacagaacagctggacccaggccatccttctgtgctggcccccaaaagttctgggattacagacttag

SEQ ID NO: 26824 - DNA, 2847 bp, Artificial Sequence
  Description of Artificial Sequence: Synthetic coding sequence
atgtacggcagcgcccggagcgtgggcaaggtggagcccagcagccagtccccaggacgttcacctaggctgcctaggtcaccgcggctcgggcatcggcgcactaacagcacaggcggctcgtcgggatcatccgttggggggggttccggaaagactctctctatggaaaacattcagtctctgaatgcagcctatgccaccagtggacctatgtacttgtctgaccacgagaacgtggggtccgaaacccctaaaagcaccatgacgctcggacgcagtggcgggcggctgccgtatggggtccggatgacagcaatgggcagctctccaaatatcgccagcagcggggtggcctctgacacaatcgcgttcggagaacaccatctccctccggtatcgatggcttccactgttccccactccttaagacaagcgagagacaacaccataatggacctgcagactcagttaaaggaagtcttacgtgaaaatgacctgctacgaaaggacgtcgaggtcaaggaatccaagctgtcctcctcaatgaacagcatcaagactttctggtcccccgagttaaagaaggagcgagccctacggaaggacgaggcctccaaaattacgatctggaaagaacagtatcgagtggtgcaggaagaaaaccagcatatgcagatgactatccaggcattacaggatgagctcagaatccagcgtgaccttaatcaactgtttcagcaagactcctccagcagaaccggggagccctgtgtggctgagctcaccgaagagaatttccaaagattgcatgccgagcacgaacgccaggccaaggaactgtttttgctgcgtaagacactggaagagatggaacttcgcatagaaacccagaagcagacactaaacgcccgtgacgagtcgataaagaagctcttggagatgctgcaatcgaaggggctgtcagccaaagcaactgaagaggatcatgagagaacccggcgattggccgaggctgaaatgcatgtgcatcacttagaatctctgctcgagcagaaggaaaaagagaattcgatgctgcgggaggagatgcatcgacgattcgaaaacgcccctgattccgcgaagacaaaggcattgcagacagttatcgagatgaaagactctaaaatcagctccatggaaagggggctgcgcgacttggaggaagaaatacagatgttgaaatcaaatggggccctgtccacagaggaaagagaggaagaaatgaaacagatggaagtttaccgtagtcactccaaatttatgaaaaacaaaattggccaagtgaagcaggaattgagccggaaagacactgaactgctggcactgcagacaaagctggaaactctgactaatcagttttctgatagcaagcagcacatcgaggtactgaaagaaagtttgaccgccaaagaacagcgggctgctatcctacagacggaggtcgacgcactgcgcctgcgcttggaggagaaggaaaccatgctgaataaaaagacaaagcagattcaggacatggcagaagagaaggggacccaggcaggagagatacatgatctgaaggatatgctggacgtcaaggaacgaaaagtcaatgttctgcagaaaaaaatcgagaatctccaggaacagctgcgcgacaaagaaaagcaaatgagttcactgaaagaaagagtgaaaagcctgcaggctgacacgacaaatacagataccgctttaactacccttgaggaggcactcgccgaaaaggaacgaaccattgagcggctaaaggagcagagagatagagacgaacgtgaaaagcaggaagagatcgataactacaaaaaggacctcaaggatctcaaggagaaggtgtcactgttgcagggcgacctgtctgagaaggaggcttccctacttgatctgaaggagcatgcgtcatcactggccagttctggtctcaaaaaggactcccgcctaaaaacattggagatcgccttggagcagaagaaggaggagtgcttgaagatggagtcccagctgaagaaggcacatgaggctgctctggaagcccgcgcaagcccagaaatgtccgatcgtatccagcacttagagcgcgagatcacacgctacaaagatgagagcagcaaagcccaggcggaggtagaccggcttcttgagattttaaaagaagtagagaacgagaagaatgataaggataaaaagatcgcagaactggagagcttattcagtcgtcaggtgaaggatcagaacaagaaagtcgccaatttgaagcacaaggaacaggttgaaaaaaagaagtctgcacagatgctggaagaggcaaggcgacgcgaggataatctgaatgactcatcacagcaactacaggtcgaggagctccttatggccatggagaaggtcaagcaagagctggagtctatgaaggcaaaactgagcagcacccagcagagccttgccgaaaaggaaacccatcttacaaacctaagagcggagaggcggaaacatctggaggaggtgctggagatgaaacaggaagctctgttggccgctatttccgaaaaagacgcaaacatcgcattactggagctgagcagttctaagaagaagacacaggaagaagttgcagcactgaagagggagaaagacagacttgtgcagcagctgaaacagcaaacacagaatcgcatgaagctgatggctgataattacgaagacgaccactttaaaagcagccattccaaccagactaaccacaaaccttcccctgaccaggacgaggaagagggcatatgggcttag

SEQ ID NO: 26825 - DNA, 2742 bp, Artificial Sequence
  Description of Artificial Sequence: Synthetic coding sequence
atggaggtgggcagcgaggaggagaagtgggagaagctggacgccgagttcgaccacttcgtggtggacatgaagccatttgtgctgaagctgccccaccgcaccgagcgccagcgttgcgctctgtggatccgtaaactctgtgaaccgagcgggacaggggcgggcatcatggggagaaagaaccgtaatttgtacgctaagctcctgctccatatgctgaagagaggggccctggaaggtccatttacccatcgacccgaaccgggaacgttgaagattctgcctagctacatgtccatctattttgatgagcccaatcctgcgcgggccaagggctctagccctgagggattgcctgcctgggtgctcggtgagctggaaacttcggaacataaactgaacgagtcttggaaactctcaagtggcgaggacaacactttggtacaatcccccactgatgtgtactctcgggagcaatatacaggaaagctgcgcgttagatctcactccctgtcccccactcaccgcgaagacggccagaacattacccccaagatttgcgaggtgtactcaaagaagagcccagtgtccctggacgacagtgatatagaggcccgtctcaattcctggaatctgggccttgatatgaagacaaaaatgatggaggccaaattccacgaagagaaattgaaattgcagcaaaaacatgatgctgatgtccaaaagattctggagcgcaaaaacaacgaaattgaagaattgaaaactctgtaccggtctaagcaacacgaaactgaggagacaatccgcaagctcgaaaagaaggtccaaactcttattagagattgtcaggtgataagagagaccaaggaggaccagatcgcggagctgaaaaaaatctgcgagcagagcacagaatctttaaataacgattgggaaaagaagctgcataatgcagtcgcagagatggagcaggaaaaattcgatttacagaagcagcacaccgagaatatccaggaactgctggaagacacaaacgtgcgtctcaataagatggaatcggagtacatggcacagacgcaaagtaccaaccatatgattaaagagctagaggccagggtacaacagcttactggcgaggcagagaactcaaaccttcagagacagaaattgatacaggaaaaggcagagctcgagcgatgctaccagataacctgttcagaactgcaggaggttaaagcacggcgaaacactttgcacaaagaaaaggaccatctggttaacgattatgaacaaaatatgaagctcctccagaccaagtacgatgccgacatcaatttgctgaaacaggaacacgctctgagcgcgtcgaaggccagctcaatgattgaagagctcgagcagaacgtgtgtcagctcaagcagcagctacaggaaagcgaactacaaagaaagcaacagctcagggatcaggagaacaagttccaaatggagaagagccacctgaagcatatttacgaaaagaaagcccatgacttacagtctgagttagacaagggcaaggaagatactcagaagaagatccacaagttcgaagaggcactcaaggagaaagaggaacagctgacccgagtcaccgaggtccaacgcttgcaggcgcagcaggcggatgcagcactcgaagaatttaaacggcaggtagagttaaattccgaaaaagtgtatgcggaaatgaaggagcagatggagaaagtagaggcagacctgacccggtcaaaatccctgagggagaagcaaagcaaagaatttctatggcaactggaggacatccgacagaggtatgagcagcagatcgtagagctgaaactcgaacacgaacaggaaaaaacccacctcctccagcagcataatgccgagaaagattccctagtccgggatcacgagagggagattgagaatctggaaaagcaattgcgggctgccaatatggaacatgagaaccaaattcaagaatttaagaagagggacgctcaggttatcgccgatatggaagcgcaggttcataaattgcgagaagaactgataaacgtaaacagccagcggaagcaacagctggtggaacttggcctgcttagagaagaagagaaacagagagcaacccgggaacacgagatcgtggtgaacaaattgaaggccgaaagtgagaaaatgaaaattgagttaaaaaagacacacgctgccgagaccgaaatgacactcgaaaaggctaattccaagttgaaacagatcgagaaagaatacacacaaaaattggccaagagctcccaaattatagctgagctgcagacaactatatcttctctaaaagaggaaaattcgcagcagcagttggccgccgagcgaagacttcaagatgttagacagaagtttgaagatgagaaaaaacagctaatcagggacaatgatcaggccatcaaggtgctgcaagatgagctcgagaaccggagcaatcaggttaggtgtgctgaaaaaaagctgcagcacaaggaacttgaaagccaagaacagatcacatatattcgccaggagtacgagaccaaactcaaaggcctcatgccggccagcctccgccaagagctggaggatacaatctccagtctgaaatcccaagttaactttctgcagaagcgcgcaagcatcctgcaggaggaactcactacttaccaaggacggaggtag

SEQ ID NO: 26826 - DNA, 825 bp, Artificial Sequence
  Description of Artificial Sequence: Synthetic coding sequence
atgcaggacgagaagctgcgggacgagaccgagcagcccgtgagcaaggtgatcgagaggaatcgtctgagaacagtcctcaaaaacctgtctctcctgaaactgttaaagtctagtaaccgaaggattcaggagttgcacaaacttgccaagcggtgttggcactcccttctcagcgttccgaagattctccggatttccagcggagaaaattcagcctgtaataaaaccaagcagaataatgaggagttccaagaaatcggctgttcagaaaaggaattaaagagtaaaaagcttgaaagtacaggtgatccaaaaaagaaagagtacaaggagtggaaatcacaagtgcagtctggaatgaggaataaagagaaaaccagtctggcggcgatgcctaggaaggagaagcacatcgagccagaagttcccaggacgagtagagatgactctctcaaccctggcgtgcagggacgccagcctctgaccgaaggaccacgcgtgatctttattaagccttaccgtaatcgcacgcccatgggacacatgaagcagctggatgtagccgaccagtggatttggttcgaaggattgcccacacgcatacacctgccagcccctagagtcatgtgccggagcagcaccctgagatgggtcaagcgacggtgtactcgattttgctccgctagcctcgaaatgccgatgtggcacccttataaggttgacgtaacttggacccgtgcacgtggagcgagcagaggatggcggagccgccaccagttgaaggggcgcaatggctggcggaatagtcgtgtatacaagtag

SEQ ID NO: 26827 - DNA, 156 bp, Artificial Sequence
  Description of Artificial Sequence: Synthetic coding sequence
atgcagctgcggcacatcggcgacaacatcgaccaccggatggtgcgggaagacctacagcaggacggcagagatgctctcgatcatttcgtcttctttttctttcggcgggtccaagtccttctccattttttctggaacaaccacctgttgtag

SEQ ID NO: 26828 - DNA, 444 bp, Artificial Sequence
  Description of Artificial Sequence: Synthetic coding sequence
atggccggcggcgcccgggaggtgctgaccctgcagctgggccactttgcaggttttgtgggagcacactggtggaaccagcaggacgccgcccttgggagagcaactgactctaaagagccacccggtgagctgtgccctgacgttctgtacaggacaggccggacactacatggacaagagacctacactcctcgccttatcctcatggacctaaagggctctctgtcatctctgaaggaagaggggggcctgtaccgtgataagcagttagacgcagccattgcctggcagggcaaactgacaactcacaaggaggaactttaccctaagaatccatacctgcaggattttctttctgctgaagtaagagcctccgtgctgaatttcctcactcgctgccacaacttgagagtctcaatcggggcggggagcgccgaatag

SEQ ID NO: 26829 - DNA, 1677 bp, Artificial Sequence
  Description of Artificial Sequence: Synthetic coding sequence
atgagcgtgagcgtgcacgagacccggaagagccggagcagcaccggatctatgaatgttaccttgtttcacaaggcctcgcatcccgactgcgtgctggcggctagcagcagatacttcgaagcaatgttctcacacggactgagggagagccgcgacgatactgtgaattttcaggacaatctccaccctgaggtcctcgaattgctgttggattttgcctattcttctaggattgccatcaacgaggaaaacgctgagtccctcctggaggccggcgacatgctgcagtttcatgacgtccgtgacgccgccgctgagttcctcgaaaaaaacctgtttccctcaaattgtctggggatgatgctattaagtgacgcgcaccagtgtagacggctctatgagttctcctggaggatgtgtctggttcactttgagacagtgcggcagtccgaagattttaacagcttgtccaaagatacacttctggacttaatcagtagtgacgaactcgagaccgaggatgagagagtcgtgtttgaagcaatcctccaatgggtgaaacatgacctggaaccccggaaggtccaccttccagaactgctacgatctgtgcgcctcgcattgcttccttctgactgcctccaggaggccgtgtcttccgaggcgctgttaatggctgacgagaggacaaaactgattatggatgaggcactgcggtgtaagacacgcatcttgcagaatgacggagtggtaacctcgccgtgcgctcggccacgtaaagccgggcatacactacttattcttggaggtcagacatttatgtgtgacaagatttaccaagtcgaccataaagcaaaggaaattatcccgaaagccgaccttccatctccaaggaaagagttctcagcgagcgccatcggctgtaaagtatatgtgaccggggggcggggttccgagaacggcgtgtccaaggacgtgtgggtctatgatactgtccatgaagagtggtcaaaggctgctccgatgttgatcgcgcgtttcgggcacggctcagctgagttggagaattgtctgtatgttgtaggcgggcacactagcctggccggggtattcccggctagcccctcggtgagtttaaagcaggtggaaaaatacgaccccggagctaataaatggatgatggtggcccccctccgcgacggtgtaagcaacgcagccgtggtgtctgctaagcttaagctgttcgtattcggcggcacaagtattcatcgggacatggtctccaaagttcagtgttacgatccatcagagaatagatggactattaaagctgaatgcccacagccttggaggtatacagccgccgctgtcctgggctcacagatttttattatgggaggtgacaccgaatttaccgcggccagcgcttatcgattcgactgtgagaccaaccagtggacacgcatcggtgacatgaccgccaaaaggatgtcatgccatgcactcgcatccgggaataagctgtacgtcgtcggaggctacttcgggactcagaggtgcaagaccctggactgctatgacccaaccagtgacacttggaactgtattacaacagtgccctattcacttatccctacagccttcgtttccacgtggaagcatctgcccgcatag

SEQ ID NO: 26830 - DNA, 2916 bp, Artificial Sequence
  Description of Artificial Sequence: Synthetic coding sequence
atgaacttcctgcggggcgtgatgggcggccagagcgccggcccccagcataccgaggctgaaaccgtaaggggagccgccggcctcgggttgggcaaggggtccggccagggtaggggaagatctaccaggagaccagaagagtgtggactgaagttccgacacagttttcgtcttgttaaacatattctctatcacgtcacaatcaacgtctcagacagcgaaattattggttatgccttggacacgctctacaatatcatatcaaatgaggaggaggaggaggtggggggctcccaagaagagaacagcaccaggcagagcgaggatttgggtagtcagtttaccgaaatttttatcaaacaacaagaaaatgtgacactgctactctccctgctcgaagagtttgactttcacgttcggtggccgggggtgaagctgctgacttctttacttaagcagctagggcctcaggtgcaacagataattctggtctccccaatgggcgtgtccaggcttatggatcttcttgctgactcccgggaagtgatccgaaacgacggtgtgcttctgctgcaggccctcaccaggtcaaatggcgctatccaaaaaatagtggcctttgagaacgcctttgagcgcttacttgacatcatcagcgaagagggaaattctgatggcgggatagtcgtggaagattgcctcattttgctccagaacctgctcaaaaataacaactcgaaccaaaacttttttaaggagggaagttacattcagaggatgaagccctggttcgaggtcggagatgagaactcagggtggagcgctcaaaaagtaaccaacttgcatttaatgcttcaattagtaagggtgctcgtgtctcctaccaatccgcccggagcaacgtcctcctgtcagaaggctatgttccagtgcggactgttgcagcagctgtgtaccattcttatggcgactggggtgcctgcagacatccttaccgaaacaattaacaccgtgtcagaggtgattcgcggttgccaggttaaccaagattactttgcatctgtgaacgctccgtcgaaccccccgaggccggctatagttgtgctcctgatgagcatggtcaatgagcgacagcctttcgtcctccgttgcgccgttctgtactgcttccaatgtttcctgtacaaaaatcaaaagggacagggcgagattgtttcaacgcttctgccaagcacgattgatgctacaggcaattccgtatctgctggtcaacttctatgtggtggcctttttagtacggatagcctgagtaattggtgtgctgccgtggccttggcccatgctctgcaagagaacgcaactcagaaggaacaactgctcagggtccaactggcgacctccattggcaacccccctgtgtcccttctgcagcagtgcacaaacattttgagccaaggcgacaagatcgacaggcggggcagcaagatccagacacgcgtggggctgctcatgctgctatgtacatggttgtccaactgccctatcgcggttacccatttcctgcataattccgccaatgttccgtttttaacaggacaaatcgcagagaatttaggcgaggaagagcagctggtccagggactgtgcgcccttctgctgggcatttcaatatatttcaatgataatagtctggagtcatatatgaaagaaaagcttaaacagctgatcgagaagcgcatcggcaaagaaaacttcatcgagaagctggggtttatctcaaagcacgaattatacagtcgggcaagccagaaaccccagcctaactttcctagtcccgagtacatgatcttcgaccacgagtttaccaaacttgtgaaagaactcgagggggttattacaaaggccatctataagtctagcgaggaggataaaaaggaggaggaggtcaagaaaactttagaacagcacgataacatcgttacacactataagaacatgattcgggagcaagacctccagctggaggaactccgacagcaggtgtcaaccctgaaatgtcagaatgaacagctacagacagcggtgacacaacaagtgtctcagatccagcagcacaaggatcagtataatttactgaaaattcagcttggcaaggataaccagcaccagggctcatacagcgagggcgcccaaatgaatggcatccaaccagaggagatcggcaggctccgagaagaaatcgaggagcttaaacggaaccaggagttgctgcagtctcagttaacagagaaggattcaatgattgagaacatgaagtcctcacagacttcaggtacaaatgagcagtcttccgctattgtctccgccagagattcggagcaggtcgctgagcttaagcaagaactggcaacactcaagtcgcagttgaactctcagtctgtggaaattactaaattgcagacagagaagcaagagctgctccagaaaacagaggcctttgcgaagagtgtggaggttcagggtgaaaccgagacaatcatcgcaacaaaaactacagacgtggagggtcgcctttcagcgctgttgcaggagactaaggaactgaagaatgagattaaagcactgtccgaagagcgaacagccattaaggagcagctcgatagctctaatagcacgattgcaattctgcagaccgaaaaagacaaactcgagcttgaaatcactgactcaaaaaaggagcaggatgatcttctagtcttgctggctgatcaagatcaaaaaatcctgtcacttaaaaacaagctgaaggacctcggacatccagtggaggaggaggacgagttggagtctggagatcaggaagatgaagacgatgagagtgaagacccggggaaggaccttgaccacatttag

SEQ ID NO: 26831 - DNA, 258 bp, Artificial Sequence
  Description of Artificial Sequence: Synthetic coding sequence
atgggcaacagcgacagccagtacaccctgcagggcagcaagaaccatagtaacactatcactggtgctaagcaaattccatgctcgttgaaaatcagaggaattcatgcgaaggaagagaaatccctacacggatggggacatggctcgaacggagcaggatacaagagccgcagtctggccaggtcctgtttgagccatttcaaatcaaaccagccctatgccagtagacttggtggccctacttgcaaagtctag

SEQ ID NO: 26832 - DNA, 174 bp, Artificial Sequence
  Description of Artificial Sequence: Synthetic coding sequence
tgaggccgggcccccggccccgccatcggcggccggcgggccggcgactcatgtcctggatggaggcggcggagcagaagtagggggcgaggccaacggttaagccatggccccaggcggaggcctcagcttctgactgaaacccggcggccggtgctggtccaatggttatag

SEQ ID NO: 26833 - DNA, 936 bp, Artificial Sequence
  Description of Artificial Sequence: Synthetic coding sequence
atggtgagcctgcgggtgaaccccctgagcctggtggagatcatcctgcacgtagtgagacaaatgaccgatcctaacgtcgctctcacatttctcgagaaaactcgcgaaaaggtgaaaagcagcgatgaggccgtcattctctgcaaaacggccataggggctttaaaattgaacatcggcgacctacaagtaaccaaggagactattgaggatgtggaggaaatgctcaataatctgccaggagtgacctctgtgcactcaaggttctacgatttgagtagcaaatattaccagacaatcgggaatcacgccagctactataaagatgcactacgttttctggggtgtgttgacatcaaagacttgcctgtcagtgagcagcaggagcgtgccttcactctgggcttagctggactcctgggggagggtgtgtttaatttcggggagcttctcatgcacccggtactggaatccctaagaaacaccgaccggcagtggctgatcgacaccctgtacgccttcaacagtggtaacgttgagaggttccagactctaaaaaccgcctggggtcaacagcccgatctcgccgcaaatgaagcccagctcctgcgaaaaattcagctactctgtctgatggagatgacatttacacgccctgctaatcaccggcagctcacattcgaggagatcgccaaatcagcaaagatcacagtgaatgaagttgagctacttgtgatgaaagccttgtctgtggggctggtcaagggttcgattgatgaagtcgataagcgcgtgcacatgacctgggttcagcccagagtcttagacctgcagcagattaagggcatgaaggacagactggaattttggtgcaccgatgtcaagagtatggaaatgctggtggaacaccaggctcacgatatcttaacctag

SEQ ID NO: 26834 - DNA, 1161 bp, Artificial Sequence
  Description of Artificial Sequence: Synthetic coding sequence
atgaagagcctgaaggcctgcaagcgggagatcaagagcgtgatgaacaccgccgggaattcggccccatcattgttcttgaaatcaaattttgaatacctcaggggcaactatcgtaaggccgttaagttgttgaacagctcaaatatcgccgaacatcctgggttcatgaaaacgggagagtgccttagatgcatgttttggaataatctaggttgcatccatttcgccatgagtaagcacaatctcggaatcttttactttaaaaaagctcttcaggagaacgataatgtgtgtgcccagttgagcgccgggtcaaccgaccctggcaaaaagttttccggccgcccaatgtgcaccctactgaccaacaagcggtacgagctgctgtataactgtggaatccagctgctgcatattggcaggccactggccgcattcgaatgtcttattgaagctgttcaggtctaccatgctaacccgcgtctgtggcttcgactcgcagagtgctgtattgccgctaacaaaggcacctcggagcaagaaactaaggggctgccttcaaaaaaaggtattgtccagtctatcgtcggccaaggctaccatcgcaagatagttctagcaagccagtcaatccagaataccgtctacaacgatggtcagtctagtgctatacctgtggcgtccatggagttcgcggcaatatgtctcagaaacgctctgttgctgctgcctgaggagcagcaggacccgaagcaggagaatggggcgaagaatagtaaccagctgggaggtaacactgagagctctgagagctccgaaacatgcagttcaaagtctcatgatggagataagtttatccctgccccaccttcatcccctctgcgaaagcaagagctcgaaaacctcaagtgctctattttagcctgtagtgcctatgtcgctttagcacttggcgataacctcatggcccttaaccatgccgataaactcttgcagcaacccaagctgagcggctcactcaagtttctcggacacttatacgctgcagaagcactcattagtcttgacaggatatctgatgccatcacgcatttaaacccagagaacgtcactgatgtgtcactgggaatcagctccaatgagcaggatcaggggtag

SEQ ID NO: 26835 - DNA, 1596 bp, Artificial Sequence
  Description of Artificial Sequence: Synthetic coding sequence
atgctgcaggagctgaacttcggcgcctacctgggcctgcccgccttcctgcttccgttgaatcaggaggacaataccaacctggcccgggtgctgaccaatcacatccacacgggccaccattcgtccatgttttggatgagagtgccgctggttgctcctgaggacctgagggatgacattattgagaacgcccccactacccacactgaagagtactccggtgaggagaaaacctggatgtggtggcataacttccgcaccctgtgtgactacagcaaacgtatcgccgtggccctggaaattggggccgatctcccctctaatcacgttatagacaggtggctcggcgagcctatcaaggctgccatccttcccacttccatctttctgacaaacaaaaaaggattccccgtgctttcgaaaatgcaccagcggttgatcttcaggctgcttaaactggaagttcagttcattattaccggaaccaatcatcactccgagaaggaattttgttcctatctgcaatatctcgagtacctcagccagaatagacctccccccaatgcgtatgagctgtttgcaaagggctatgaagattatctgcagagcccattgcagccactgatggacaaccttgaatcacaaacctacgaggttttcgagaaagatcctatcaaatattcacaataccagcaggccatttataaatgcctgctggaccgggttccggaagaggaaaaggatacgaacgtgcaggtgctcatggtcctgggagcagggcgtggacctttggtgaacgcgtccttaagagcagcgaaacaggccgatagaagaattaagctgtatgcggtggagaaaaatcctaacgcagtagtcacactcgagaactggcaatttgaagagtggggatcccaggttaccgtcgtctcatccgatatgagggagtgggtcgctcctgagaaggccgatatcattgtttccgagttgttgggaagctttgccgacaatgaacttagtcctgagtgcctggatggagcacagcacttccttaaagatgacggagtttccatccccggcgaatatacatcattcctggctcctataagcagcagcaagttatacaacgaagtgcgggcgtgtagggagaaagaccgggatccggaagctcagttcgagatgccatatgtggtgagacttcacaacttccaccagctgtcagcgccacaaccctgttttacgttctctcatcctaaccgggacccaatgatcgataacaaccgttattgtactctggaatttcccgtggaagtaaacaccgtcctgcatggtttcgcaggctactttgaaaccgtactctatcaggatatcactctgagcattcgacccgaaactcacagcccgggaatgttcagctggttcccaatcctcttcccgatcaagcagcccatcaccgtgcgagaaggccagactatttgtgtccgcttttggcggtgctccaacagcaaaaaggtgtggtacgagtgggccgtcaccgcgcccgtgtgctcagcgatccacaaccccacaggccggagctacaccatcggcttatag

SEQ ID NO: 26836 - DNA, 789 bp, Artificial Sequence
  Description of Artificial Sequence: Synthetic coding sequence
atggccctgagcctgggctggaaggcccaccggaaccactgcggcctcttactgcaggccctgagatccagcggactgctgttgtttccatgtgggcaatgtccttggcgaggcgctggctctttcttggaccctgaaatcaaagcattcctggaggaaaatacggaggtgacttcgagcggaagtctcacacctgaaatacagctgcgcttgttgactcctcgctgcaaattttggtgggagagggccgacctgtggccccactctgacccctattgggctatctattggcccggagggcaagcgcttagtaggtacttgttggataatcctgacgtggtgcggggtaagagtgttcttgatctcggcagcggatgcggtgcaacagctattgcggccaagatgtccggcgctagccgtattctggcaaacgatatcgatcccattgccggcatggctataacactcaactgcgaactgaatagactaaatccgtttcctatcctgattcaaaatattttaaacctggaacaagacaagtgggatctcgttgtgctcggggacatgttttatgacgaggatctggctgattcactacaccaatggctcaagaagtgcttctggacctacagaacacgcgtactcattggggaccccgggcgaccacaattctccggacactccattcagcatcatttgcataaagtggtggaatactctctcctggaaagtacgcggcaggagaattccggccttactacttccacagtgtggggcttccagccttag

SEQ ID NO: 26837 - DNA, 1131 bp, Artificial Sequence
  Description of Artificial Sequence: Synthetic coding sequence
atggccgcccccagccccagcggcacccccgtgagcagcatgcaggggaagagaaaagcgttgaagctgaacttcgccaacccacctttcaagtctaccgcgcggttcactctcaatcccaatcccaccggcgttcagaatccccatattgaacggctgaggacccactcaatagaatcgagtgggaaattaaaaatctcacccgaacagcattgggactttactgctgaagatctaaaagacctgggagaaattggccgcggcgcctacggatccgttaacaagatggtccacaagcctagcggacaaattatggcagtgaagaggataagaagtaccgtcgacgagaaagagcagaaacagttgttgatggacctggacgtggttatgagatcctctgactgcccttatatcgtccagttctacggtgccctttttcgcgaaggcgattgttggatctgcatggaactcatgtccaccagctttgacaaattttataagtacgtttatagcgtgctcgatgacgttattcctgaggaaattcttggaaagattaccttggctaccgtcaaggccctgaaccatctgaaagaaaaccttaagattatccaccgggatatcaagcctagcaacattttacttgacaggtctggcaacattaagctctgcgattttgggatctctggccaattagtggatagtatcgctaaaacccgggacgccggatgtagaccctatatggccccagaaagaattgatccttccgcgtccaggcaagggtacgacgtgcgctccgacgtgtggtcgttaggcattactctttacgagctggccaccggcagatttccttacccgaaatggaactctgtgttcgatcagttgacacaggtcgtgaaaggggaccctcctcaactcagcaattcagaagaacgcgagttttctcctagtttcatcaacttcgttaatctgtgtcttacaaaagatgagtccaaacggcccaaatacaaggaactcctcaagcacccattcatcttgatgtacgaagaacgggctgtggaggtggcctgctacgtttgcaagatacttgatcagatgcctgccacgccctcttcacccatgtacgtggactag

SEQ ID NO: 26838 - DNA, 1035 bp, Artificial Sequence
  Description of Artificial Sequence: Synthetic coding sequence
atggccggcagcggctgcgcctggggcgccgagcccccccggttccttgaggcattcggaagactctggcaggtacagtcccgactgggctccggcagtagcgcctcggtgtatcgcgtgcggtgttgcgggaacccaggttccccccctggagctctgaagcaatttcttccacctggaaccacgggagcggccgctagcgcagccgaatacggtttcagaaaagagcgcgccgccttggaacaactccagggccataggaatatcgtcaccttatacggggtattcacaattcacttctctcccaatgtgccctcacgctgtctgttactggaactactcgatgtctctgtgagcgaactgctgttgtactcgtcacatcaaggttgctcaatgtggatgatacagcactgtgctcgggatgtgctggaggctctggcgtttcttcatcatgaaggctacgtccatgctgacctgaagccaagaaatattttgtggtctgcggaaaatgagtgtttcaagcttattgactttggtctgtcatttaaggagggcaaccaggatgttaagtacatccaaaccgacggctatcgggcccctgaagctgagctccagaattgcctggcgcaagctggcctgcagtcggacactgaatgtacctccgccgtggacttgtggtcgctcgggataatcttactcgaaatgttttcgggcatgaagcttaagcatactgtcagatcccaggagtggaaggccaattctagcgccattatcgatcacattttcgcgtcaaaagccgtagtgaatgcggccatcccagcgtatcaccttcgggacttgattaaatccatgcttcacgatgacccttccagacgtatacctgctgagatggccctatgctccccgtttttctccatcccatttgcccctcatatagaggacctggtgatgctaccaactccagtgctgcggcttctgaatgtgctggacgatgactacctcgagaatgaagaagagtacgaggggctatgttag

SEQ ID NO: 26839 - DNA, 1467 bp, Artificial Sequence
  Description of Artificial Sequence: Synthetic coding sequence
atggccctgaagatgaacaccctgagcagcaaccgggccaacatgcttaaggaagtacaactgatgaatcgtctgagccaccccaacattctgagatttatgggagtgtgcgttcatcagggccagctacatgccttaaccgaatatatcaatagcggcaatctggaacaactcttggattcaaatctgcatctgccgtggacagtcagagtgaagcttgcttacgacattgctgtggggctatcctatctgcactttaagggcattttccaccgcgacttgacctcaaagaattgtctgatcaagcgggatgaaaatgggtacagcgccgtggtggccgattttgggctggcagagaagattccagacgtgtccatggggtcggaaaaactggctgtagtgggcagcccattctggatggcccccgaagtgctcagggatgaaccctataacgagaaagccgatgtgttttcatacggaatcattctgtgtgagatcatagcccgaattcaggccgatcccgactatcttcctcggacagagaatttcggtctggactacgacgcctttcaacatatggtgggcgactgccctccagactttctacagttgacatttaactgttgtaacatggatcctaaactgcggccatctttcgttgagatcgggaagacgctagaggagattctgtctcggctccaggaggaggaacaggagagagatagaaaactgcaacctacggcgagagggttattggaaaaagcccctggagtcaagcgcctgtcgtctctcgatgataagatccctcacaagagcccttgtccaaggaggacgatttggctttctaggtcccagtcagacattttctctaggaagcccccccgcactgtctcggtcttggatccctattacaggcccagggatggtgctgctcggacccccaaagtgaatccattttccgctaggcaggatctcatgggagggaaaatcaagttcttcgacctgccatctaaatcggtaatcagtctggtgtttgacttggatgctccaggtcctgggaccatgcctctggcagattggcaagagcctttggctcccccaataagaagatggcgctcactccctggttcccccgagttcttacatcaggaagcctgcccatttgttggacgcgaggaaagcctgtctgatggcccgcctcctaggctctcctccctgaaataccgggtgaaggaaatccctccctttcgcgcatctgcactgccagccgctcaggctcacgaagctatggattgcagcatcctgcaagaagaaaacggctttggaagccgcccccagggaacctctccatgccccgccggtgcctccgaggaaatggaggtcgaggaaaggcccgcaggtagcacccctgccactttcagcacttccggcattgggctgcagacccagggaaagcaggatgggtag

SEQ ID NO: 26840 - DNA, 1458 bp, Artificial Sequence
  Description of Artificial Sequence: Synthetic coding sequence
atgaccctgtggatcctgcccaagttcaaggccgtggacttcagccccagtttggctgcttatacccacacgtggctgttacctaggtttctagagattctcatccaatgcggacactgcaagaggctggcgcccgaatatgaagctgctgctactagactcaagggaattgttccactcgcgaaagtggattgtaccgcgaacacgaatacatgcaataagtatggcgtgagcggctaccccacactgaagatctttcgtgacggtgaggaggctggagcttatgatggccccagaacagctgatggcatcgtttctcatctgaagaagcaagcaggcccagcctcagtgcccctcagaaccgaagaggaatttaagaagtttatttccgataaggatgccagtatcgtcgggtttttcgacgatagctttagcgaggcacattccgagtttctgaaggctgcgtctaatttaagagataattaccggttcgcccatactaacgtggagtcactggtgaatgaatacgacgataatggagagggtattatactgtttcgcccgtcacatctgacaaacaagtttgaggataaaactgtggcatacacagaacaaaaaatgacctccggcaagatcaaaaagttcatacaggaaaacatatttggcatttgtccacatatgactgaagataataaagatcttatccaagggaaagacctgctgatcgcttactatgatgtggactacgaaaagaacgcaaaaggatcaaattactggaggaacagagtgatgatggtggccaaaaaattcctggatgccggccacaagcttaatttcgctgtggcaagtaggaagacattttctcacgagcttagcgattttggtctggaaagtacagcgggggaaatccctgttgtggcaatccggacagccaagggggaaaagtttgtgatgcaggaggaatttagccgagatggtaaggcactagaacgatttttacaggactacttcgatggaaacttgaaaagatacctgaagtccgagcctatccccgaatctaacgatggacctgtcaaagtggtggtggccgagaattttgatgaaattgtgaacaatgagaataaagacgtgctcattgaattttacgcaccatggtgtgggcattgtaagaatctggaacctaagtataaggaactaggagaaaagctgtccaaagaccctaacatagtgattgccaagatggacgccacggcaaacgacgtgccttccccgtatgaagtcaggggctttcctacgatctacttttccccagcaaataagaagctgaatccgaagaagtacgaaggaggaagagagctgtccgatttcattagctacttgcagagagaggctacaaaccctccagtgatccaggaagaaaaaccaaagaaaaagaagaaagcccaagaagacctctag

SEQ ID NO: 26841 - DNA, 885 bp, Artificial Sequence
  Description of Artificial Sequence: Synthetic coding sequence
atgagcgcccagcacttcgtgagcaccgagcaggtggagctgcccggtcctgggcagtgggtggtagccgaatgcccagcgcgggttgatttctctggtggctggagcgacacacccccgttggcatatgagctgggaggggctgtgttgggcctggccgtgcgcgtggacggcaggaggccaatcggggccagggcacggagaattccagagccggagctgtggctggctgtaggtcccagacaggatgagatgactgtgaagatcgtgtgcagatgtttggcagacctcagggactattgtcagccacacgcccccggggcactcctgaaagcagctttcatttgcgcaggtatcgtgcacgtacatagcgagctccaattgtctgagcagttgctccgaactttcggaggtggattcgaattgcacacatggtccgagttaccccacggatctggtctcggtacaagttccatattggccggaaccgccctcgctgccctgcagcgggccgcaggaagggtagtgggcacggaagctctgatccatgctgttctacacttggaacaggtgctgacaacgggagggggttggcaggatcaggtgggaggccttatgcctgggatcaaggtggggcggagcagggcgcagcttcctctaaaagtggaggtggaagaggttactgtgcctgaggggttcgtccagaagctgaatgaccacctgctgctggtgtatacggggaagacaaggctggctcgaaatcttttgcaggatgtcttgcgatcttggtacgctagactcccagcagttgtgcaaaacgcacatagtttggtacgacaaaccgaagaatgtgccgagggctttagacaaggatcccatatttag

SEQ ID NO: 26842 - DNA, 945 bp, Artificial Sequence
  Description of Artificial Sequence: Synthetic coding sequence
gtgggccggatggagggctgcagcagccccatcgtggtgaagttcgctgacacgcagaaggacaaggagcaacgacggttacagcagcagctggcccagcagatgcagcagttgaatacagcaacctgggggaacctgaccgggctgggaggactcactccccagtatctggccctgttgcagcaggctacatcttcaagtaatttgggcgccttctccggaattcagcagatggcaggtatgaacgccctgcagctgcagaacttagctactcttgccgccgccgctgccgccgctcagactagtgcgacttcaaccaatgcaaaccccctctctactactagcagcgctcttggggctcttacttctcccgtggcagcctctacacccaactccacggcaggggccgcaatgaacagcctgacttccctcggaaccctgcaaggcctggcgggagctactgtgggcctgaataatattaatgccttggccggaatggcggctcttaatggagggctgggagcgaccggactcactaacgggactgccggtaccatggatgctctgactcaagcatacagcggcatccaacaatatgctgctgcagcattgccgaccctttatagccagagccttctacagcagcagtcggctgctggctcacagaaggagggccctgagggagctaatctatttatctatcacttaccacaggaattcggcgaccaggatatcttgcagatgttcatgccgtttggaaacgtgatctccgccaaagtgtttattgacaagcaaacaaatctttccaagtgcttcgggttcgtaagttacgataatccagtctccgcgcaagccgctatccaggccatgaatggatttcagatcggaatgaagagattgaaggtccagcttaaaagaagtaaaaacgactccaaaccttattag

SEQ ID NO: 26843 - DNA, 1083 bp, Artificial Sequence
  Description of Artificial Sequence: Synthetic coding sequence
agcatggagaagacctacaccagcaccagcaacaacagcatcagcggttccctgaaaagactggaggatacaactgctaggttcactaacgcaaattttcaggaagtgagcgcccacacttcctcagggaaagacgtgagcgagactcgaggcagcgaagggaaaggcaagaaatctagcgcgcactcttcgggacagcgtggaagaaaacccgggggcggccggaacccaggcacaaccgttagtgcagctagtccttttccccaggcaggctataagcgcgcccagacatctggtatcgaggaggagactgttaaggagaaaaagcgtaaggggaataaacagagcaagcacgggcctggccgtcccaaaggcaataaaaaccaagagaacgtgtcacatctctctgtctcgagcgcgagcccaactagctctgtcgctagtgccgccggctccatcacctcaagcagcctgcagaaatcacccaccttgctcaggaacggttcgctccagtccctctccgtcggctctagccccgtggggtccgagatttcaatgcagtaccgccacgatggagcttgccctacgaccacattttccgaactgctgaacgctatacataacgacagaggcgacagttccacattgaccaagcaagaactgaagttcatcggcatatacaactctaacgatgtcgctgttagctttcctaatgtagtgtctgggtcaggaagctctactccagtgagtagcagtcatctgcctcagcagtcatcaggccatcttcagcaggtgggtgccctgtccccatcggccgttagttctgccgcgcccgcggtggctactacccaggccaacacactgtcaggctcctctctcagtcaggccccatcacacatgtatgggaatcggtcgaattcgagtatggcggccctgatcgctcagtccgagaacaatcagacagatcaggacctcggagataattctcgcaacctggtcggacgcggaagctcaccacgtgggtcgctgtcaccgaggagtccggtctctagcctgcagatcagatatgaccagcccggttag

SEQ ID NO: 26844 - DNA, 924 bp, Artificial Sequence
  Description of Artificial Sequence: Synthetic coding sequence
atgcagagcctgaccctggacctgctgggccccagcgagctgctgttggccctcaatatgggcaacacttctttcaatgaggtcatggaggcacaactgccatcccacggggggcctaaaccatctgctgaaagcgacatggggaccaggagggactacattatggccaagtacgtggagcaccggttcgcacggcggtgcactcccgaaccgcagaggctttggaccgccatctgcaacagagatctgctgtctgttctggaagccttcgcaaacggacaggattttggacagccacttcctggcccagatgcccaggctcctgaggagttggtcttgcatctcgctgtgaaagtcgcaaaccaggctagtctgccactcgttgactttatcatccagaatggcggacatcttgacgcgaaggcagcggacgggaacaccgctttacattatgctgcattatataaccagcccgattgcctcaaacttctgctcaagggcagagctcttgtgggaactgtgaacgaagccggtgagacagccctggatatcgctagaaaaaaacaccacaaggaatgcgaagagcttttggagcaggcccaggccggcacttttgcctttcctttgcacgtggactatagttgggtgatatctaccgagccgggttccgatagcgaagaagatgaagaagaaaagagatgcctactcaaactgccggcacaagctcattgggcctctggacggttggacatctccaacaaaacttacgagactgtggcttctctcggcgctgcaacacctcaaggagaatcagaagactgcccgccccctctacccgtgaagaacagctcacgcactctagtgcaggggtgcgcgcggcatgcctccggcggtcggagggaggaaagggctagacgcgagtag

SEQ ID NO: 26845 - DNA, 1497 bp, Artificial Sequence
  Description of Artificial Sequence: Synthetic coding sequence
atgagcagctgcgtgagcagccagcccagcagcaaccgggccgccccccaggatgaactgggcggccgagggtctagctcttccgaatctcaaaagccatgtgaggctctacgcggcttgtctagcctgtcaattcatctcggtatggaaagctttatcgtggtgactgaatgcgagcccgggtgtgcagtggatctgggcctggcgcgcgatagaccccttgaagccgatggacaggaggtacccctggatacctccggctcacaggccaggcctcaccttagtggtcgcaaactgtctcttcaagaaagaagccagggcgggcttgctgctggcggatcgctggacatgaacggcagatgcatctgcccaagcctgccctacagcccagtatctagtccacagagtagtccacggctcccgagaaggccaactgtcgagtcccaccacgttagcatcaccggtatgcaggactgcgtacagctgaatcagtacacactgaaggatgagataggaaaggggagttacggcgttgtcaaacttgcctacaacgagaacgataacacctattacgcaatgaaagtactctcaaaaaagaagctgatacgtcaagccggttttccacgtcgccctccgcctcggggaacccggccagcccccgggggatgtattcagcctagagggcctattgagcaggtctatcaagaaatcgccatcctgaagaaattggaccaccccaatgtggtgaaactcgtagaggtgcttgatgatcctaatgaagaccacctgtatatggtgtttgagctggtgaaccaaggacctgtcatggaagttccaactctcaagcccctgtccgaggaccaggctcgcttttactttcaggacttaataaaaggcattgagtatctgcactatcagaaaatcatacatcgcgatattaagcccagcaacctgctggtgggcgaagatggacacatcaaaattgcagatttcggagtatctaacgaatttaaagggtccgatgcgctcttatccaataccgtcggaacccccgctttcatggcccctgagagcctcagcgaaacccgaaagatttttagcggtaaagctctggatgtctgggcaatgggagtaaccctctattgctttgtgttcggacagtgtcctttcatggatgaaaggatcatgtgtctccattctaagattaagtcacaagccctggagttccctgatcagccagatatcgcagaggatttaaaagacttaattacacgaatgctcgataagaaccccgaatccaggatagtggtgccggagatcaagatcctcgttaagacgatgattaggaagcggagttttggtaacccattcgaaggctcaagacgcgaggagcgctctctgtcagcccccggcaacttgttgactaagcagggctccgaagacaacctccagggaactgatccaccaccagttggggaggaagaagttcttttatag

SEQ ID NO: 26846 - DNA, 600 bp, Artificial Sequence
  Description of Artificial Sequence: Synthetic coding sequence
atgacccccctggccccctgggaccccaagtacgaggccaaggccggacccaggcccgtctggggagcaaactgcagcagtggggcttctttctcaggcagaaccctatgccaccctagtttttggcccctctatgaggccgcttccggccgcggcctgagaccagtggcccccgccacagggcattggaatgggcagcaagctcctcccgatgccggctttcctgtggtgtgctgtgaagatgtctttctgagtgatcccctgctcccccgggggcagcgtgtgccactgtacctatcaaaagctcctcagcaaatgatgggttcacttaagcttctgccccctccgcccattatgagcgctcgcgtacttccgagaccatccccgtctaggggtccatccacagcctggcttagcggacctgagctgatcgcacttacgggcctgctgcagatgtcccagggtgagcccagaccctcgtcgtcagctgtgggaccacccgatcacacatctgaccccccaagcccctgtggttctccaagcagttcccagggcgcagatcttagcctgccacaaacccctgacacacactgcccctag

SEQ ID NO: 26847 - DNA, 1248 bp, Artificial Sequence
  Description of Artificial Sequence: Synthetic coding sequence
atgtggcggaaggtgtacaccccccggagcagcttcgagctgagcgcacagcctccatcttgggaacaacgtaagctgctggagaagtgtgcaatgactgcgcttagctcgaaattaattagtcagcagaaggcctttttcgcaaagatggtagtcgatgcagttatgatgctggatgacctgttacaattgaagatgatcggaataaagaaagtgcagggaggtgccctggaagactcccagctagtcgccggtgtggctttcaagaaaactttcagttacgccggtttcgagatgcaacctaagaagtaccacaatcctaagatcgctttgctcaacgttgagctggagctcaaggccgagaaagacaatgctgagatccgggtccacactgtcgaggactaccaagccatcgtcgacgctgagtggaacatcctctatgataaactcgaaaaaatccaccatagcggcgctaaggtagtgctgtcgaagctccctattggagacgtggcaacccagtacttcgccgacagggacatgttctgtgccggccgggtgcccgaggaggacctgaaacggactatgatggcttgtggggggagcattcagacatccgtgaacgccctttcggctgacgtattgggcaggtgtcaagtgtttgaagaaacacagattgggggagaacggtacaacttctttacagggtgccctaaggcaaaaacgtgtactttcatcttgagaggtggagcggaacagtttatggaggaaactgagcgcagtctccatgacgcaataatgattgtgcggagagctattaagaatgacagtgtagtcgccggcgggggtgcaatcgagatggaactatctaagtatttgagagattactcaaggacgatccctggaaagcagcaactgcttattggagcgtatgcaaaggccttggagattattccccgccaactgtgcgataatgcgggtttcgacgccaccaatattttgaataaacttagagctcgccatgcccagggcggcacatggtatggagtggacatcaataacgaggatatcgcggacaacttcgaagcgttcgtatgggagccagccatggtccgcataaacgcactgaccgctgcctcggaagccgcctgcttgattgtgtctgtggacgagaccattaaaaatccaaggtctaccgtggacgccccaaccgcggcggggcggggacgcggacgcggtcgacctcattag

SEQ ID NO: 26848 - DNA, 3117 bp, Artificial Sequence
  Description of Artificial Sequence: Synthetic coding sequence
atggtgagcagcgcccagatgggcttcaacctgcaggccctgctggaacagctgtctcaggatgagctgtcaaagtttaaatacctgataacaactttctccctagcacacgagcttcagaagatcccacacaaggaggtcgataaggccgatggaaaacagctggtcgaaattctgactacgcattgtgacagttactgggtggaaatggccagcttacaggtctttgagaaaatgcatcgaatggatctgtcagagcgggccaaggacgaagtccgcgaagctgccttaaaaagctttaacaaacggaagcctctgagcctggccttcaccgagaccaaaggcaatgttatatgtctggggaaagaggtcttcaaaggtaagaagcccgacaaggacaaccggtgcaggtatatcttgaaaaccaagtttcgtgaaatgtggaaatcttggccaggggattcaaaagaagtacaggtcatggccgaacggtataagatgctgattccgttttctaatcccagggttctccctggcccatttagttacacggtcgtcctgtatggacctgcaggcctcgggaaaactacccttgcccaaaagctcatgctcgactgggccgaggacaacctgatccacaagtttaaatacgcgttctacctcagctgccgggaactgtccagactagggccctgctctttcgccgaactcgtatttagggactggcccgagctccaggacgatatcccacacatattggctcaggctcggaagattctgtttgttatcgatggttttgacgaactcggggctgcccctggggcactcatcgaagacatctgcggagattgggagaagaagaaacctgttcctgtgctgctaggctcattactaaacagggtaatgctgcctaaagctgccctgcttgtcaccacgaggccacgcgccctccgggacctgagaattcttgcagaggagcctatctatatccgcgtagaggggttcctggaggaggacagaagagcatattttctgcggcactttggggatgaagatcaagccatgagagcatttgagctgatgagatccaatgcagcgctattccagctcggaagcgcacccgctgtgtgttggattgtgtgcacgaccctgaaactgcaaatggaaaagggcgaagacccagtgccgacgtgtctgacacgcaccgggttgtttctcaggttcctctgttccaggttccctcagggtgctcagcttagaggggcactgaggacactgtctctcctggccgcccagggactttgggcgcagactagtgtgcttcatcgggaggatctggagaggctgggagttcaagagtccgatctgcgcctctttctggatggagacatcttacgccaggatcgcgtgtcaaaaggatgttactctttcatccacttgtctttccagcaattcctgacagcactgttctacaccctggagaaggaggaagaagaagatcgtgacgggcacacatgggacataggagacgtgcaaaagctgctctcgggtgtggaacggctaaggaaccctgacctcatccaggctggttattattctttcggattggccaacgaaaaaagggctaaggaattggaagcaacctttggatgccggatgtctccagatattaaacaggaattattgcgatgtgacatcagttgtaagggtggtcactcaaccgtgacagatctgcaggagctccttgggtgcttgtatgaatcccaggaggaagaactggtgaaggaagtcatggcgcagtttaaagaaatctcgctgcatctgaacgcagtggatgttgttccgtcctcgttctgtgttaagcattgccgcaatctccagaagatgagtttacaagtgattaaggagaatttaccagagaatgtaacggcctcagagtccgacgcagaggtcgagcgctcccaggacgatcagcatatgctgccattttggactgacctgtgttcaatctttggctccaacaaggacctgatgggactggcaatcaacgactcattcttaagcgcctctctggtgcgcattctgtgcgagcaaattgcaagtgacacttgccatttgcagcgagtggtgttcaaaaatattagccctgccgacgctcacagaaacctctgtctggccttacggggtcacaaaactgttacgtacctcaccctacaaggcaatgatcaagatgacatgttccctgccctttgtgaggtgctccggcatcctgagtgcaatctgagatacctggggttagtgagttgcagtgccactacacagcagtgggccgatctctcactggccctagaggttaaccagtccctgacctgtgtaaatctgagtgacaacgagttactggacgagggcgccaagttgctctatacaacattgcgccaccccaaatgctttctgcagaggctgagcttagaaaactgtcacctgacagaggcaaactgcaaggacttggcggccgttctggtagtgagtcgggagctcacccatctttgcttagcaaaaaatcctattggaaatacgggagtgaaattcttatgtgagggcttgagataccccgaatgcaagctccagacgctcgtgctgtggaactgtgacatcactagtgacggttgctgcgatctgacaaaactcctgcaggaaaaatccagcctgctgtgccttgatctagggctcaaccatatcggagtgaaaggcatgaaattcctgtgtgaagccctgagaaagccactatgtaatcttcgttgcctgtggctctggggctgctctattccacctttctcctgcgaggatctctgcagcgcactgagctgcaatcagagcttggtgacactggatctgggccagaacccacttggaagcagtggagtcaaaatgctgtttgagactttaacttgtagctcaggaacattacggaccctgcgcctcaaaatcgacgacttcaacgatgagctcaacaagctcttagaggagatcgaggaaaaaaatcctcagctcatcatcgacactgaaaaacatcatccttgggcggaaaggccgtcatctcacgactttatgatctag

SEQ ID NO: 26849 - DNA, 1443 bp, Artificial Sequence
  Description of Artificial Sequence: Synthetic coding sequence
atgcggctgcggcggctggccctgttccccggcgtggccctgctgttggccgcagccagactcgctgccgcatcggaattctttgcaccctggtgtgggcactgcaagcgtttggctccggaatacgaggcagcggctactcgactcaaaggaatcgtccccctagcaaaagtcgactgtaccgctaatacaaatacatgcaataaatatggcgtgtctggatatcctaccctgaaaatctttcgcgatggcgaggaggctggagcctatgatgggccccggaccgccgacggcattgtgtcccaccttaaaaagcaagcggggcctgccagtgtgccgcttcgaaccgaagaggagttcaagaagttcatttcagacaaagacgcttctatcgtcgggtttttcgatgatagttttagtgaagctcacagtgagttcctgaaggccgccagtaacttacgggacaattaccgattcgctcacacaaacgttgaaagtcttgtgaatgagtatgatgacaacggtgaggggattattttatttcgtccttcacacctgactaataagttcgaagacaagaccgtagcctacactgaacagaagatgacttccgggaagatcaagaagttcatccaagagaatatttttggtatctgccctcacatgacagaggataataaggatttgatccaaggaaaggacttactgatagcctattatgacgtggactacgaaaagaatgctaaagggagcaactattggagaaatagagtcatgatggttgccaagaagttcctcgatgccgggcataagctgaatttcgccgtagcttcacgtaagacattcagccacgaactgtccgactttggcctggagagcactgctggcgaaattcccgtagtcgcaatcaggaccgccaagggtgagaaattcgtaatgcaggaggaattttctcgagatggcaaagccctggagaggttcctgcaggactatttcgacggcaacctgaagcgctacctcaaatcggaacctatacctgagagcaacgatggccctgtgaaagttgtcgtcgcggagaacttcgatgaaatcgtgaacaacgaaaacaaggacgttctgattgaattctatgccccgtggtgtggccactgcaagaacctagaacccaagtataaagaactgggggagaaactcagcaaagatcctaatatcgttattgctaaaatggacgccaccgctaatgacgtcccgtcaccctatgaggtgcggggttttcctaccatttactttagccctgcgaacaagaagcttaacccgaagaagtacgaaggcggcagagagctcagtgacttcatcagctatcttcagagggaagctacgaacccacccgttatccaggaagagaagcctaagaaaaagaaaaaagcacaggaagacctctag

SEQ ID NO: 26850 - DNA, 228 bp, Artificial Sequence
  Description of Artificial Sequence: Synthetic coding sequence
atgggcgtgaagctggagatcttccggatgatcatctacctgacctttcctgtcgcgatgttctgggtctcaaatcaggctgagtggtttgaagatgatgtgatccagcggaaacgcgaactgtggcccccagagaagctccaagaactcgaggaatttaaagagaggctgcgaaagcggaaacgccgagaggaaaagctgctacgagatgcccagcagaattcctag

SEQ ID NO: 26851 - DNA, 807 bp, Artificial Sequence
  Description of Artificial Sequence: Synthetic coding sequence
atgggcagcgccaagagcgtgcccgtgacccccgcccggccccccccacacaacaagcacctcgctagggtggcagatccacgttctccatccgcaggcattttgagaacacctatacaggtggagtcgagtccccaaccaggacttccagccggcgagcagctggagggactcaagcacgctcaggattcagacccacgttcacctaccttgggtatcgctaggactcctatgaagacaagctccggggaccccccttctcccctggttaagcagctgtctgaggtttttgaaactgaggattcaaagtctaatctcccccctgaacctgtgctccctcccgaagcacctctcagctccgaattagacctacccctcggcacccagctatcagtggaagagcagatgcccccctggaatcaaacagaatttccatctaaacaggtcttctctaaggaggaggcccgtcagccaacagaaacccctgtggcatcgcagagctccgacaagccttctcgcgatcccgagaccccacgtagcagcggcagcatgcggaatagatggaagccgaactccagcaaggtgctgggtagatcacctttgacgatactgcaggacgataatagtccgggcacacttacgctgcgccaggggaaacgaccttctcccctgagcgagaatgtgagcgaactcaaagagggagcaattttggggactgggcgtctcctcaaaacagggggccgggcctgggaacagggtcaggaccacgacaaggaaaatcagcattttcccctcgtggaatcatag

SEQ ID NO: 26852 - DNA, 351 bp, Artificial Sequence
  Description of Artificial Sequence: Synthetic coding sequence
atgctgctggagtgcggcatgcaggaggagggcctgttccgggtggcgccctctgcctccaagctgaagaaactgaaggcggcgctggattgctgcgtggtggatgtgcaagaatacagcgcagacccacacgctattgctggtgccttgaagtcttacctacgggaactgccagaacctctgatgacttttgaactttatgatgagtggattcaggcaagcaatgtccaggagcaggataaaaagctgcaggctctttggaacgcctgcgagaagctgcccaaggctaatcacaacaacatccgctacctcatcaaattttatcccagttgccagaatattaagatgtag

SEQ ID NO: 26853 - DNA, 906 bp, Artificial Sequence
  Description of Artificial Sequence: Synthetic coding sequence
atggtgcggaccaagacctggaccctgaagaagcacttcgtgggctaccctacaaactctgatttcgagctgaaaacggccgagttgccgcccctgaaaaatggagaggtgctcctggaagcactttttctgacagtcgatccttatatgcgggtggcggcaaagaggctgaaggaaggcgacacaatgatgggccagcaggtagccaaggtggtggaatctaagaatgttgcgttgcctaagggaacaatcgttctcgccagccctggctggacgacgcactccatctccgatgggaaagacctagagaagctactgacagagtggcctgacaccattcctctgtctttggccctgggaaccgtgggaatgcccggactgactgcctattttggactcttagaaatttgtggagtgaaggggggagaaacggtcatggtcaacgccgcagcaggtgcggtgggctcagtggtcggtcagattgccaagttgaaaggctgcaaggtggtgggtgccgtcgggtcagacgagaaggtggcctacctccagaaattaggctttgatgtcgtgtttaattacaaaacagtggaatccttagaagagaccctcaagaaagcctccccagacggatacgattgctattttgataatgtgggcggcgagttttccaacaccgttatcggacaaatgaaaaagtttggaaggatagccatctgtggggcaataagcacgtacaaccgaacaggtccgcttccccctggtccaccgcccgagattgtgatctaccaggagctgaggatggaggcattcgtggtctatcgatggcagggagacgctaggcaaaaggcgctgaaagacctgctcaagtgggtactggaaattaagcgcgagaatgaggaagattag

SEQ ID NO: 26854 - DNA, 1068 bp, Artificial Sequence
  Description of Artificial Sequence: Synthetic coding sequence
atgctgggcagcggcttcaaggccgagcggctgcgggtgaacctgcggcttgtcatcaacagactgaaattgctagaaaaaaaaaagactgagctggctcagaaggcgcgcaaggaaattgccgactaccttgccgcagggaaagacgagagagcacgcatccgcgtggaacatattataagagaggactaccttgtggaggccatggagatcctcgaactttactgtgatctacttctcgccaggttcggcctgattcagtctatgaaggaactcgacagcggcttggctgagtccgtctctacactggccgagctgaagatagttgccgatcagttgtgcgcgaagtattctaaagagtatggcaagctgtgtcgcacaaaccagattgggactgtcaacgacaggttaatgcacaagctatccgtggaggcgccaccaaaaatcttggtggaacgctatctgatagagatagcaaagaattacaatgttccttacgagcccgatagcgtggtgatggctgaggcaccccccggggtcgagacagacctgatcgacgtgggtttcaccgacgacgtgaaaaagggcggccccggtagaggcgggtcgggaggcttcacagcacctgtgggcgggccggacggaacagtccccatgccaatgccaatgcccatgcctatgccgtcagctaatacccctttttcataccccctgcccaaagggccgagtgacttcaacggactgcccatgggcacttaccaagcatttccaaatattcacccgccacagatcccagccacaccccccagctatgaatccgtggacgacatcaatgctgataagaatataagcagcgcccagatcgttggccctgggccaaagcctgaggccagcgccaagttaccatccaggcccgcagacaattacgataattttgtactgccagaactccccagcgtgcccgatactcttccaacagcgtctgccggcgctagtactagtgccagcgaagatatcgactttgacgacctgtccaggagatttgaggaattgaagaagaaaacatag

SEQ ID NO: 26855 - DNA, 2175 bp, Artificial Sequence
  Description of Artificial Sequence: Synthetic coding sequence
atgcagatgaccatccaggccctgcaggacgagctgcggatccagagggatctgaatcagcttttccaacaggacagttcctcacggacaggagaaccctgcgtggccgaactcacagaggaaaactttcagagactacatgccgagcatgagaggcaggcgaaagagctcttcctgctcaggaagactctggaggaaatggagctccggatagagacacagaagcagacgctaaacgcccgtgacgagtctattaaaaagctcttggaaatgctgcaatctaagggcctgtcagcaaaagccacagaggaagatcacgagcgcacaaggcgcctcgcagaggccgagatgcacgtgcatcacctggagtctttactggaacagaaggagaaggagaattctatgctgagagaggagatgcacaggagatttgaaaacgcccccgacagcgccaagaccaaggccctgcagactgttattgaaatgaaggatagtaagatttcttccatggagcgcgggctgagggatctggaagaagagatccaaatgctaaaaagcaacggcgctctgagcacagaggaaagggaagaagaaatgaaacagatggaagtgtatcggtcccacagtaagtttatgaagaataaaatcgggcaggtaaagcaggagttgtcaagaaaggataccgaactgttggccctacagaccaagctagagaccctgacaaaccagttcagtgactcaaaacagcacatcgaggtcctgaaagaatctctgacagctaaggagcagcgcgccgctatactgcagaccgaagtggatgccttgcgacttagactagaagagaaggagacgatgctcaacaagaagactaaacagatacaagacatggctgaggagaagggtacgcaagccggagaaatccacgatttgaaggacatgctcgacgtaaaagaaaggaaggtgaacgtgttgcagaagaaaatagaaaacttacaggaacagcttcgtgacaaggaaaaacagatgtcctcactcaaggagagggtgaagtcccttcaggctgacaccaccaacacggacactgctctcactactctggaggaagcactggcagagaaagagcgcacaatagagaggttgaaagagcagagagatcgagatgagagggaaaagcaggaagaaattgacaactacaagaaggatctgaaggatctgaaggagaaagtgtctctcctgcagggtgacttgtcagagaaagaagcctctcttttagacctgaaggagcacgcttcctccttagctagctcaggtctgaagaaagacagcagattgaagaccctggaaattgcattggaacagaagaaagaggagtgtctcaagatggaaagtcagttgaagaaagcgcatgaagccgccctggaggctagagcctcacccgagatgagcgatcggattcaacatcttgagcgggagataacacgctacaaagatgagtccagcaaagctcaagcagaggttgatcggttgctggagatactgaaagaggttgaaaatgagaagaatgacaaggacaaaaagattgccgagctggagtctttgacttccagacaggtgaaggaccaaaacaagaaggtggccaatctgaagcacaaagaacaggtggaaaagaaaaagagcgcgcaaatgttggaagaagcacggagacgcgaagataacctgaacgacagctcacagcagctccaggtcgaagaactgctcatggccatggagaaggtgaagcaggagcttgagagcatgaaggccaaattgtccagtacgcagcagagccttgctgagaaagaaacacacctcacaaatcttcgagctgagaggcggaaacacttggaagaagtactggaaatgaaacaggaggctctgctggcagctatctccgagaaagacgcaaacatcgctcttctggagctgtcgtcttcaaagaagaagacccaggaggaggtagcagctctgaagcgggaaaaagacaggctggtgcagcagctgaagcagcagacgcagaatcggatgaagctgatggctgataattatgaagacgatcactttaagtctagccattccaaccagactaatcataaacccagtcccgatcaggacgaagaagagggaatctgggcttag

SEQ ID NO: 26856 - DNA, 408 bp, Artificial Sequence
  Description of Artificial Sequence: Synthetic coding sequence
atggccatcggcttcaacgtggagaccgtgacctacaagaacctgaagtttcaggtgtgggatctgggcggccaaacgtcaatcaggccatattggcggtgctattatagtaacactgatgctgtcatttacgtcgtagatagttgtgacagggaccgcatcggaatcagtaagtcggagctcgtagctatgcttgaggaggaggaactgagaaaggctatcctagtcgtgttcgcgaacaaacaggacatggaacaggccatgacgtcgagcgaaatggcaaattcactggggttgcctgcgctgaaagatcggaagtggcagatctttaaaacgtccgccaccaagggaactggccttgatgaggccatggaatggcttgtcgaaaccctgaagtctaggcagtag

SEQ ID NO: 26857 - DNA, 684 bp, Artificial Sequence
  Description of Artificial Sequence: Synthetic coding sequence
cggcggcagatcctgaaggagctggccctgtgcctgcggcggcaggagatgtatggacctagagctgcttcccgcaataaagaaacaagcgctggacctgttgccgttatgggcaaagactactataagatcctggggatcccttcaggggccaacgaggatgaaattaaaaaagcttataggaagatggctctcaaataccatcccgacaagaataaggagccaaatgctgaagagaaattcaaagaaatcgccgaggcatatgatgtactatccgatccgaagaaaaggggcctgtatgaccagtacggggaggaggggctcaaaacaggcggtggaacatcgggtggcagctcaggtagtttccactatacttttcatggtgatccacacgcaacctttgcttcttttttcgggggctcgaacccattcgacattttctttgcttctagtagatccacacgaccatttagtggattcgaccccgacgacatggacgtggatgaagacgaggaccccttcggtgcattcgggagatttggctttaatgggctgtccagaggtcctcgcagggctccagaacctttgtatccaaggagaaaagtccaggacccacccgttgtgcacgaactcagagtcagtctggaggagatttaccacggctcaactaaacggatgaaatag

SEQ ID NO: 26858 - DNA, 252 bp, Artificial Sequence
  Description of Artificial Sequence: Synthetic coding sequence
atgagcatgctgaagcccagcggcctgaaggcccccaccaagatccttaagcctggatctacggcgcttaagactccgacggcagtcgtggcccctgttgaaaagacgatctcttctgagaaagcaagcagcacaccatcatccgagacccaggaggaattcgtggacgactttagagtgggcgagagggtgtgggtgaacggtaataaaccaggttttatccaatttctgggggagacccagttcgcatag

SEQ ID NO: 26859 - DNA, 642 bp, Artificial Sequence
  Description of Artificial Sequence: Synthetic coding sequence
atggacatgctgggcggccccggcatcgagagccagtgccggaaggtcgacataatcgccgatgcggcctacagtatttttcagaagccaaaatctttcactggtaactttgttattgatgagaatatcctgaaagaggaagggatcgaaaattttgatgtgtacgctattaagcccggtcatcccttgcaacccgacttcttcctagacgagtaccctgaggccgttagcaaaaaagtagaaagcacaggcgccgtgcccgagtttaaggaggaaaagctgcagctgcagcctaagccgcggagtggcgctgtagaagagactttccgaatcgtgaaggatagtctcagcgatgacgtcgtgaaggccactcaggccatatacctttttgagcttagtggcgaggatgggggcacttggttcctggacctcaagagcaaaggtggcaacgtagggtatggagaaccgtccgaccaggccgatgtggtcatgtccatgacgacagatgactttgtgaaaatgttttctggcaaactgaagccgaccatggcttttatgtctgggaagttgaaaataaagggcaatatggctttggcaattaagttagaaaagctgatgaatcagatgaacgcccgactgtag

SEQ ID NO: 26860 - DNA, 1230 bp, Artificial Sequence
  Description of Artificial Sequence: Synthetic coding sequence
atgaaccggacctggccccggcggatctggggcagcagccaggacgaacccgagttcgctagctccgttcgcaggcctcacctaacctcagatgccgttgccttactgcgcgataatgtcacaccccgagagaacgagctgtggaccagcttaggtgacagctggaccaggcctggtctagaactttctcctgaagagggcccaccgtatcgcccagagttcttctccggttgggagccccccgtgacagacccacagagtcgtgcctgggaggacccggttgaaaagcaactgcaacacgagaggagaagacgacaggtgacccaggcaacacagcaaggtaggggatgggaggtccgcggcagaggtcggagcgcatggcctcggctaactagattgagttacttcctacagcagtcagccccccaggttgctgtcaatggtcaccgcgacctggagcctgagagcgagccgcagctggagtccgagacggcgggtaagtgggttctgtgtaattacgattttcaggctcggaactcatccgagctgagtgtgaaacagcgtgacgtgcttgaagtactagacgattcaagaaagtggtggaaggtcagagatcccgctggtcaagaggggtatgtcccttataatatcctgacgccataccccggcccgagacttcaccactcccagagtcccgctcggtctttgaactccacccccccccctccccccgcaccggctccggcccccccccccgctttagctagacctcgctgggatagaccaaggtgggattcttgcgattccctgaacggcctggatccctccgaaaaagagaaattctcccagatgctaatcgtcaatgaagaattacaggctagacttgcccagggaaggagcggaccctcaagagctgtcccaggccctagagcgccagaaccgcagttatcacctggcagcgacgcctcggaggttcgggcatggttgcaagccaaaggattttctagtggcactgttgatgcactgggcgtgctaacaggggcccagttgttctccttgcagaaagaagaactgcgcgcagtgtcacccgaagaaggcgctagagtttactcgcaagtgaccgtgcagcggtcgctgctggaggataaggaaaaggtgtcagagcttgaagcagtgatggaaaaacagaaaaaaaaggtagaaggggaggttgaaatggaggtcatctag

SEQ ID NO: 26861 - DNA, 1425 bp, Artificial Sequence
  Description of Artificial Sequence: Synthetic coding sequence
atggccagcctgagccgggccctgcgggtggccgccgcccaccccagacaaagccccacgagaggtatggggccatgcaatctaagctcagcagctggacctaccgccgaaaaaagcgtcccttatcagagaaccctcaaagaggggcagggaacatccgtcgtggcccagggacctagcaggccgctgccaagtacagccaacgtcgtggtgatcggcggagggagtctcggttgtcagaccctctatcatcttgcaaaattggggatgagtggagctgtactgctcgagcgggaaagactcacctctgggaccacctggcacacagccgggctgttgtggcagcttcgcccttccgacgtcgaggtggaactcctggcccacactcgccgggtcgtgagtagagagttggaagaagaaacgggtctgcatacaggttggatccagaacgggggactgtttattgccagcaacaggcagaggctggatgagtataagagactgatgtccctgggcaaggcctacggggtggagtcccacgtcctctcacccgccgaaaccaagaccctttaccctttgatgaatgtcgatgacctgtacggcactctgtatgtgcctcacgatggtacgatggatccggccggcacatgcaccaccctcgcacgggccgcctccgccagaggggcacaggtgatagaaaattgcccagtgacagggattcgggtctggacagatgacttcggggtgcggagggtggccggggtagaaacccagcatggtagtatccagacaccttgtgtggtgaactgtgctggcgtgtgggcatccgcggtgggcagaatggcaggcgtgaaagtgcctttagtcgctatgcaccacgcctacgtggtcaccgagcgcatagagggcatccagaacatgcccaacgttcgggaccatgacgcttcagtttacctgcgtctgcagggtgatgccctctcagttggtggctacgaagccaacccgatcttttgggaggaggtctccgacaaattcgcatttggcctgtttgacctggattgggaagtgttcacccagcacatcgagggcgccattaacagggtgcctgtgctcgaaaagacaggtattaaaagcaccgtgtgtggcccagaatctttcacaccggatcataagccactcatgggggaggcacccgagctgcgggggttctttttaggatgtggcttcaactctgcggggatgatgcttggcggcggttgcggtcaagagctggctcattggattatccatgggagacctgaaaaagatatgcatgggtatgatatacggaggtttcaccactcattaaccgatcacccgcggtggataagggaacggtctcatgaatcttaccaggagctgctgcggagactaccgccaaggtag

SEQ ID NO: 26862 - DNA, 1893 bp, Artificial Sequence
  Description of Artificial Sequence: Synthetic coding sequence
atgagcatcgagctgcagagcgtgagcaaccccgtgcaccggaaggacctcgtaataagattgaccgatgacactgaccctttcttcctgtacaatctagtgatctcggaggaagacttccagagtcttaagtttcagcagggacttctcgtggactttttggcttttccccagaagttcattgacttgctgcagcagtgtacccaggagcatgcgaaagagattccacggttcctgctgcagctggtttcccctgccgctattttagataactcacctgcgtttctgaacgtggtagaaactaacccctttaaacatctgactcatctgagcttgaagctgctccctggaaatgacgtggaaatcaagaagttcctggccggctgtcttaaatgttccaaagaggagaagctgagtcttatgcagtcgctggacgacgctaccaaacagcttgactttaccagaaagacactggctgaaaaaaagcaggaactcgataagctcaggaatgagtgggcgagccataccgcggctctgacgaataagcattctcaggagttgaccaatgaaaaggagaaggccctccaagcccaggtgcagtaccaacaacagcacgaacagcaaaaaaaggaccttgagatcttgcatcagcaaaacattcaccagctgcagaataggctgtccgagctcgaggccgcaaataaagacctgaccgaacggaaatataaaggggactcaaccattagagaactgaaggcaaagctgagcggggtggaggaagagctgcaacggaccaaacaggaagttctttccctgaggcgggaaaattctactcttgacgtagagtgccacgaaaaggagaaacatgttaatcagttgcaaaccaaggtagcagtcctcgagcaggagatcaaagacaaggaccagctcgtcctcagaactaaagaagcctttgacacaatacaggagcagaaagtcgtcctggaagagaacggcgagaagaatcaggttcagctgggcaagctcgaggcaaccatcaagagtcttagtgctgaactgctgaaagcaaatgaaatcatcaagaagctgcagggagatctgaaaactcttatgggcaaactcaagctgaagaacactgttacaatccagcaagaaaagctgctcgccgagaaggaggagaagctccagaaggagcaaaaagagctgcaggacgtagggcagtcactcagaatcaaagagcaggaggtctgcaaactgcaggaacagttggaagccactgtcaaaaagctcgaggagtctaagcagcttctaaagaataatgagaagctgattacttggctaaataaggaactcaatgagaaccagctggttaggaaacaggacgtgttaggaccttcaaccaccccgcccgctcactctagcagcaataccattaggtctggaatctctcctaatctgaatgtggtggatgggcgacttacctatcccacatgtggcatcgggtaccccgtctctagtgctttcgctttccagaatacgtttccccatagtatttctgcaaaaaacaccagccaccccggctcagggactaaagttcagtttaacttgcagtttactaagcctaacgcttctcttggtgatgtccagtcaggcgctacgatatccatgccatgttccaccgataaagagaatggggagaacgtaggacttgaaagtaaatatttgaagaagagagaggattcaatccctctgcgcggcttatcccagaatctcttttcaaatagcgatcatcagcgggacggtacactcggggcgttgcacacttcatccaagcccactgcactgccaagcgcgagcagcgcgtacttccctggacaactgccaaactcctag

SEQ ID NO: 26863 - DNA, 1170 bp, Artificial Sequence
  Description of Artificial Sequence: Synthetic coding sequence
atggaccgggagaccctgatcgacgtggcccggaccagcctgcggaccaaagtgcacgccgagctggcagatgttctgacggaagctgtggtggatagcatcttagctataaagaagcaagatgaacctattgacctgttcatgatcgagatcatggagatgaaacacaaaagtgaaaccgacacctccctgattcgtggccttgtgcttgaccatggcgccaggcatcccgacatgaagaaaagagttgaggacgcatatatcctgacctgcaatgtgagtttggagtatgagaagactgaggtcaactctggattcttttataagtccgccgaagagcgtgagaagttggttaaggctgagcgaaagtttattgaggaccgcgttaagaaaatcatagaacttaaacgcaaagtctgcggcgattcagacaagggattcgtggtcataaaccagaaaggaatcgacccattcagccttgacgcattatctaaggaagggatagtcgctctgaggagggccaagcggcgcaacatggagcgcctgactttagcctgcggcggcgtggccctgaattcatttgatgacctgtcacctgactgcctgggtcatgcaggtctggtttacgaatacaccttgggcgaagagaagttcacattcatagagaagtgcaacaatccccgctccgtgacgctcctgattaagggcccgaacaagcacactttaactcagattaaagatgccgttagggacggtttaagggcggtgaagaatgcgatcgatgacgggtgtgttgtacctggagcgggcgcagtggaagtggcgatggctgaagccttgataaagcataagccgtctgttaaaggcagagctcagctgggtgttcaggcctttgccgatgcgctgctcatcatcccaaaggtgctggctcaaaacagcggctttgatctccaagagactctcgtgaagatccaggctgagcactctgaatcaggtcagttagtgggggtggacctgaacaccggcgaaccgatggtcgctgccgaggtaggagtatgggataattattgtgtcaagaaacaacttctgcactcctgcactgttattgccactaatatcctgctggtcgatgagatcatgagggctggaatgtcttcactgaaaggctag

SEQ ID NO: 26864 - DNA, 441 bp, Artificial Sequence
  Description of Artificial Sequence: Synthetic coding sequence
atgaccgtgaacgaggccaaggagaagctgaaggaggcccccgagggaacttttcttatacgcgactcgagccactctgactatctccttaccatctctgtgaagacatccgccggtccgactaatctgcggatcgagtatcaggacggaaagtttaggttagatagtattatttgtgtcaaatctaaactgaagcagttcgactccgtggtgcacttgatcgattattacgtgcagatgtgtaaggataagaggaccggtccagaagctccgagaaacgggactgtccacttgtatctgactaaacctttgtacacctctgctccaagcctccagcacctctgccgcctgactatcaacaaatgcaccggagccatctggggtctcccacttcctacacgtcttaaagactacctggaagaatataaatttcaggtgtag

SEQ ID NO: 26865 - DNA, 1905 bp, Artificial Sequence
  Description of Artificial Sequence: Synthetic coding sequence
atgctggagtacgccctgaagcaggagcgggccaagtaccacaagttgaaattcggcacagacctgaaccagggagaaaagaaagcagacgtttcagaacaggtgagcaacggacctgtggagagtgtgacattggaaaactctccattagtctggaaagagggccgccagctgctccggcagtacctggaagaggtgggttacactgacactatactagatatgagatccaaacgagtgcgcagccttttaggcagaagcttagaacttaatggagccgtggagccctctgagggcgctccacgtgccccaccaggcccggctggtctaagcggtggggaaagcctgctggtcaaacagattgaggaacagataaagcgaaatgcagccggcaaagatggcaaggaacgtttggggggcagtgtgttaggacaaatcccatttctccagaattgcgaggatgaggactccgacgaggatgacgaactcgattctgtgcagcataaaaagcagcgagtaaagttgccatcaaaagccctggttccggaaatggaggatgaggacgaagaagacgattctgaggatgccatcaatgaatttgattttttgggatcaggcgaggacggggagggtgctcctgacccacggaggtgtaccgtggatggcagcccgcacgaactagaatctcgccgggtaaaactgcagggcatcctggccgacctgagggatgttgacggcctgcctccgaaagtgacaggcccgcctcctgggacaccccaaccaagacctcatgaagatgtgttcatcatggacacgattggcggcggtgaggtgtcactgggcgacttggctgatttgaccgtcactaatgataacgacctcagttgcgacctgtccgattcgaaagacgcgttcaagaagacatggaacccaaagttcacactgagatcacattatgatggtattcgatctctcgcttttcatcacagtcagtcagcactgttgacagcctcagaagacggcaccctaaagttgtggaatctccagaaagctgtgacagcgaaaaagaatgccgccttggatgtcgaaccgatccacgctttcagagcccatcgagggcccgtgctggccgtcgcaatgggaagcaatagcgagtactgctactcaggcggagctgatgcatgcattcactcttggaagatcccagatctgagcatggacccctacgacggctacgaccccagcgtgctctcccacgtcttagaaggccatggggatgccgtctggggcttggccttctccccaactagccagcgactggcatcttgttctgccgatggtacagtgagaatctgggacccctcgtcttcttcccccgcttgtctctgcaccttccccacggctagtgagcacggcgtgcccacctccgtggcttttacaagtacggaacccgctcatattgtagcttcttttcgctccggcgacacagtgctgtatgacatggaagtcggaagtgccctgttgactctcgagagtagagggagtagcggccccactcaaattaatcaagttgtcagtcacccgaatcagcctctgaccataaccgcccacgatgatagggggatcagattcctggataatcggaccggcaaacccgtgcactctatggtggctcatctggatgctgtgacttgcctggctgtagacccaaacggggcttttctaatgagcggttctcatgattgctcactccggctgtggagtctagataataaaacatgcgtgcaagagataactgcccatcgcaagaagcacgaggaggcaatccacgcagtcgcatgccacccctcaaaggctttaatcgcctcagccggcgcggatgctcttgccaaggtttttgtttag

SEQ ID NO: 26866 - DNA, 1368 bp, Artificial Sequence
  Description of Artificial Sequence: Synthetic coding sequence
atgagcagcctgggcgccagcttcgtgcagatcaagttcgacgacttacagttcttcgaaaactgtggcgggggctcttttgggtccgtttaccgcgcgaagtggatcagtcaggacaaagaggtggcggtgaagaaattgctgaaaattgagaaggaagctgagattctcagcgtactcagccatagaaacatcattcaattttatggagttatcctggagccccctaattatgggatagtgaccgaatacgcctctttgggcagtctctatgactatatcaactctaaccgatctgaggagatggacatggatcacatcatgacgtgggcgactgacgtagccaaaggcatgcattacctgcatatggaagcccctgttaaggtgatccaccgagacctgaagtcccgtaacgtggtcattgcggctgacggtgttctgaagatatgtgactttggagcctcgcggtttcacaatcacactacccatatgtctcttgtcggaacctttccttggatggctccagaggtcatacagtcgttacctgtcagtgagacatgcgatacctactcttacggcgtggtcctatgggagatgctcacccgagaggtcccatttaagggactcgagggcttgcaggtggcctggctggtggtggaaaaaaatgagaggttaacgatcccgtcgtcatgcccacgctcctttgccgagctgctccaccagtgctgggaagctgacgctaagaaaagacctagtttcaagcagattattagtatactggaaagcatgtcaaacgatacctcccttcctgacaagtgtaatagttttctgcacaacaaggccgaatggcgttgtgagatcgaggccacacttgagcgcctcaaaaaattggaaagggatcttagtttcaaagagcaggagctgaaagaaagagaaaggcgcctgaagatgtgggaacagaagctgaccgaacagtccaacacccctctccttcttccacttgcggccagaatgagtgaagaatcatacttcgagagcaagaccgaagaaagcaattcagcggaaatgtcttgccagattacagccacaagtaatggagaaggccacggaatgaaccccagtcttcaggccatgatgttaatggggtttggggacatcttttccatgaataaggcaggtgcagtaatgcattctgggatgcagattaacatgcaggcaaaacagaatagcagcaagactacctccaagcgtagaggcaaaaaagtcaatatggcactggggttttcagatttcgacctgtcagagggagatgacgatgacgacgatgacggcgaggaggaggacaacgacatggacaatagtgaatag

SEQ ID NO: 26867 - DNA, 474 bp, Artificial Sequence
  Description of Artificial Sequence: Synthetic coding sequence
atgaagagcatgagccagctggccgtgctgagccggcggtggaagccctcagagatgaaactggacccgtttcaagaagtagtgctcgagtcatcctctgtcgatgagctacgcgagaagctgagcgagatcagcggcattcccctggacgacatcgagttcgccaaaggcagaggtacattcccgtgtgatattagcgtgctcgatatccaccaggacctggattggaacccgaaggtgtccacccttaacgtttggccgctgtatatctgcgatgacggagccgttattttttatcgcgacaaaacggaagagctcatggaacttacggacgaacagaggaacgaactcatgaagaaagagagctctaggctccaaaagacaggccaccgagtcacctatagtcctcgaaaggagaaggcactgaagatttatctggatggcgcccctaacaaggatctgacccaggactag

SEQ ID NO: 26868 - DNA, 1083 bp, Artificial Sequence
  Description of Artificial Sequence: Synthetic coding sequence
atgaaggccaccgccatgaccagcgcctggctggcccagggcaccggcgagggtgtcaacgatgtcagaaaaggtgcctgcgctagccacgtgtccaccatggcctcatttctgaagggcgctcacgtgaccattaacgccagagccgaagaggacgtagaacctgagtgtattatggagaaagtcgcaaaggcctccggcgcaaattacagctttcacaaagagtccgggcgcttccaggacgtggggccacaggctcccgttggcagtgtgtatcaaaaaactaacgcggtctcagagataaaaagggtgggcaaggacagcttctgggccaaggccgagaaggaagaggagaaccggcgcttagaagagaagagacgggctgaagaggcccagcgccagctggagcaggagcggcgcgaaagggagctaagggaggctgcccggcgcgagcagagataccaggagcagggcggcgaggcttcccctcagcgcacctgggaacagcagcaggaggtggtctcacgaaatcgtaacgagcaagagtccgctgtgcacccaagagaaattttcaagcagaaggaacgcgcaatgagcactacctctattagttcacctcagcctgggaagttacggagccctttcctccagaagcagctaacccagcccgagacccacttcgggcgcgaacctgctgctgcgatttcccggccgagagctgacctacctgcagaagagcctgccccaagcacccctccttgtctagtccaagctgaagaggaggcggtgtatgaggagcctcccgaacaggagacattctatgagcagccccctcttgtgcagcaacagggcgcaggctccgagcatattgaccaccacattcagggccaggggctatcgggccagggcctgtgcgcacgtgctctgtatgactaccaagccgccgatgacactgagatttctttcgatcctgagaatttgattacaggtatcgaggtgattgatgaggggtggtggaggggctacggtcccgacggacactttggcatgtttcctgccaattacgtggaactgatcgaatag

SEQ ID NO: 26869 - DNA, 291 bp, Artificial Sequence
  Description of Artificial Sequence: Synthetic coding sequence
atgtgccacaccagctgcagcagcggctgccagcccgcctgctgcgccccgtctccttgtcagccagcctgctgcgtccccgttagttgccagtcttccgtatgtgtcccagtcagctgccgcccaatagtttgcgccgcaccaagttgccagagcagcctttgtgtgccggtgagctgccggcctgtcgtgtacgctgccccaagttgccagagctccgggtgttgccaaccgagttgtacgtctgtgctctgcaggccgatatcctactctatctctagctgctgctag

SEQ ID NO: 26870 - DNA, 27 bp, Artificial Sequence
  Description of Artificial Sequence: Synthetic coding sequence
atgcccctgagcagccccaacgcctag

SEQ ID NO: 26871 - DNA, 384 bp, Artificial Sequence
  Description of Artificial Sequence: Synthetic coding sequence
atgagcagcagcatgtggtacatcatgcagagcatccagagcaagtacagcttgtcagaaaggctgattcgcactatcgccgctataagaagttttcctcatgataacgtggaagacctgattagaggcggggctgacgtgaattgcactcatggaactctcaagcctttacactgcgcctgcatggtgtccgacgcagactgtgttgagctgctcctggagaagggcgcagaggtaaatgccctggacggctataaccgtacagcacttcattatgcagcagagaaggatgaagcctgtgtagaggttctcttggaatatggggcgaatccgaacgcactggatgggaaccgggataccccgctccattgggcagcattttag

SEQ ID NO: 26872 - DNA, 318 bp, Artificial Sequence
  Description of Artificial Sequence: Synthetic coding sequence
cagtggaccgccagcaccgccaccatcaccaaggagaagcaggaccaaccaaagaaagacatctcaaattatcaggtggagcaggcccaggtgcttctcaagagggagaaggagattccgcctaccgtcttccccaatcgctctccttggtgccaaaacccttacgtgagcgcccacccatattgtcctcttatcgaaccccacaacacgtcaaccgccggaggccgtctggacaggcagccgcggaccaggtcaacgcgaccgaatcgggcctccggttccaaaaaaaagaagaccagcgaaagccagaagcaatag

SEQ ID NO: 26873 - DNA, 1116 bp, Artificial Sequence
  Description of Artificial Sequence: Synthetic coding sequence
atggaggaggagggcctggccgacgaggaggtgcggctggtgcagaaaaaagatacagggcacatttacgccatgaaaatcctgagaaaatccgacatgctggagaaagagcaggttgcccacatccgcgctgaacgagatattctggtggaagcagatggagcatgggtggtgaaaatgttctactcatttcaggacaagaggaatctctacctgataatggagtttctgccagggggcgacatgatgaccctcctcatgaagaaggacactctgaccgaagaggagactcagttttatattagtgagaccgtgctcgccattgatgcaatacatcaactaggcttcatacaccgtgacatcaagcccgacaatcttctcctcgatgcaaaggggcacgttaagttgtcagacttcgggctctgtaccggtttgaagaaggcacatcgcactgagttctatagaaacctgacacataatccgccctccgatttcagttttcaaaatatgaattcaaaacgaaaagcggagacatggaaaaagaataggcgacaacttgcatactccaccgtcggaaccccagattacatagctccagaggttttcatgcagactggatataacaagctgtgtgattggtggtccctgggagtgattatgtacgagatgctcatcgggtaccctcccttctgttctgaaaccccccaggaaacctatagaaaggttatgaactggaaggagaccctcgtgttccctcccgaggtaccaatatcagaaaaagccaaggacctgattcttagattttgcatcgactccgaaaatcgaattggaaattccggagttgaagaaattaagggacatcccttcttcgagggagttgattgggagcacatccgcgagcgacccgccgccatcccaattgagatcaagtcaatcgatgacacatcaaactttgacgactttcctgagagcgatatactgcagcccgtccctaacacaacagaacccgactacaagagcaaggactgggtgttcctcaactacacttataaacgcttcgagggactgacgcagagggggtccatccccacatacatgaaggcagggaagttgtag

SEQ ID NO: 26874 - DNA, 564 bp, Artificial Sequence
  Description of Artificial Sequence: Synthetic coding sequence
atgaacaacaccctgcggaaggacggcaagaaggactgctgcttcgagatcagcgctccggacaagcgcatctatcaattcactgcagctagccctaaagatgcagaagagtgggtgcagcaactgaagtttgttttgcaggacatggagtctgatattattcccgaggactacgatgaacggggagaactctacgacgacgttgaccatcccctccctattagcaacccattgacaagcagccaacccatcgatgacgaaatatacgaggaactgcctgaggaggaggaggattcagccccagtgaaggttgaagaacagagaaaaatgagccaggatagtgtgcaccataccagtggtgacaagtccactgactacgccaatttctaccagggcctttgggattgcaccggggctttctccgatgaactttcctttaaacgcggagacgttatctacatattgagcaaagagtacaacagatacggatggtgggttggcgaaatgaagggagccatcggactcgtgcccaaggcctatatcatggagatgtacgacatctag

SEQ ID NO: 26875 - DNA, 219 bp, Artificial Sequence
  Description of Artificial Sequence: Synthetic coding sequence
atggccctgagcctgggctggaaggcccaccggaaccactgcggcctcctgctgcaagcactgcggagctctggcctactgttgtttccatgtggccagtgtccctggcgcggtgcgggatccttcctcgaccccgaaattaaagcattcctggaggagaacacggaagtgacctccagcggatccttgacccctgagatccagttacggctcctctag

SEQ ID NO: 26876 - DNA, 2919 bp, Artificial Sequence
  Description of Artificial Sequence: Synthetic coding sequence
atggccgccgccgccgccgagcagcagcagttctacctgctgctgggcaacctgttgagccctgacaatgtggtccgcaagcaagcagaggagacttacgaaaacatcccggggcagtcaaaaattacctttctactgcaggccattcgtaacaccaccgctgccgaggaggcccgacaaatggctgcagtgctgctgagacgcctgctttcctccgctttcgacgaggtctaccccgccctcccaagcgatgtgcagacggctataaagaacttgctaccagggttcctacaggccgtcaacgattcttgctaccagaacgacgattcggttctgaaaagtctcgtggagattgccgatactgtgcctaaatacctcagaccacacttggaagcgacactccagctgtccctcaagctgtgcggcgacacttccctgaataacatgcagagacaactcgcactggaggtgatcgtcacattgtccgagacagctgcagctatgttgcggaaacacaccaacattgtggcccagactatcccccaaatgttggccatgatggtggatctggaagaagacgaagactgggcaaatgctgacgaacttgaggatgacgactttgacagcaatgcagtggctggagagtctgccttggatagaatggcgtgcggactgggcgggaaacttgtgctgccaatgataaaggaacacattatgcagatgctccagaaccctgattggaaatacaggcatgccggtttgatggccctgagcgcgataggtgagggctgtcaccagcagatggagggtatcttgaacgagatagtcaactttgtgttactttttttgcaggacccacaccccagggtgcgatatgcagcttgtaacgccgtcggtcagatggcaactgacttcgcaccgggattccagaagaagtttcacgagaaagtcatcgccgcactcttgcaaaccatggaggaccagggtaatcagcgggtgcaggcacatgccgctgcagcactgattaacttcaccgaggattgcccaaaaagccttctaattccctacctggacaatctggtaaaacatctccacagtatcatggtgctcaagctgcaggagctcatccagaagggtaccaaactggtactggagcaagtggtcacctctatcgcatccgtggccgacactgctgaggaaaagttcgtgccttactatgacctctttatgcccagcctgaaacacatcgtggagaacgcggtgcaaaaggaactgcgattactgcggggcaaaacgatagagtgtatttctcttattggtttggcagtgggcaaggaaaagtttatgcaggatgctagcgatgtgatgcagctgctcctgaagacacaaactgacttcaatgatatggaagatgatgacccacagatctcatacatgatctcagcctgggcccgtatgtgtaaaatcctggggaaggagttccaacagtatctccctgttgtgatggggccgttgatgaagacagcttccataaaaccagaagtcgctctccttgatacccaagacatggaaaatatgagtgacgacgatggatgggaattcgtgaatctgggagaccagcagtcattcggtatcaagacagccgggctagaagaaaagagcactgcgtgccagatgcttgtctgctatgctaaagagctgaaggagggcttcgtagaatataccgagcaagtggttaaactgatggtccctctcttgaaattttattttcacgatggagttagagtggcggctgcggaaagtatgccactcttattagagtgtgcccgggttcgcggacctgaatatctgacccaaatgtggcactttatgtgtgacgccctgatcaaggctatcggaacggagcctgattccgacgttctctccgaaatcatgcactccttcgccaaatgtattgaggtgatgggcgatgggtgtctgaataacgagcattttgaagagctgggtgggatcttaaaagcaaagctggaggagcacttcaagaatcaggagctgaggcaggtgaaaaggcaggatgaggactatgacgagcaggtagaagaatcgctccaggatgaggacgacaatgatgtgtacatcctgacaaaagtctctgacatcctccacagcatcttttccagctacaaagagaaagtcctcccctggttcgagcagttactacccttgatcgtgaatctcatctgcccgcatcgtccttggcccgacaggcagtggggactttgtatcttcgacgatgtcatcgagcactgttcgcctgcctcttttaagtacgcggagtactttcttagacccatgctgcaatatgtctgcgataattcccccgaggtgcgacaggctgctgcatacggattgggcgtgatggcacagtacggcggcgacaactatcgtcctttctgcaccgaggccttacctctacttgtgcgcgtgatccagtcggctgacagtaagacaaaagagaatgttaacgcaactgagaactgtatctctgctgttggcaaaatcatgaaattcaagcccgactgcgtgaatgtcgaagaagtgctgccacattggctctcatggctgccgctccatgaagacaaggaggaagccgtccagaccttcaactatctgtgcgacctgatcgagtcgaaccaccccatcgtgctcggtcccaataacacaaatctgcccaaaatcttcagtattatcgctgagggagagatgcacgaagccatcaaacacgaggacccctgcgcgaagagattggcaaacgtcgtgaggcaggtccagacgtctggaggcctttggaccgagtgtattgcccagctgagtcctgagcagcaggctgctatacaggagctgctgaattcagcctag

SEQ ID NO: 26877 - DNA, 1428 bp, Artificial Sequence
  Description of Artificial Sequence: Synthetic coding sequence
atgcaggtgaccttcatctacgtgtgcctgaagggcctgatgctgcaggacctcgtgtccgcgaaattgattagtgactacacagttacagaaatacctgatacgattaacgatctacagggatccaccaaagtgctgcaggccgttcagtggctcgtctcgcactgtccgcactctctcgacctgtgctgccagacgctgatccaatacgtggaggatggtatcgggcacgagtttagcggtcggttcttccatgaccgccgcgagagacggctcggcgggcttgcatctcaggaacccggtgcaattatcgagctttttaactccgtgttgcagttcctagcaagcgtagtctctagtgaacagttgtgcgacctcagttggccagttaccgaattcgccgaggccggcggtagccgtttactcccgcaccttcattggaacgcgccggagcacctcgcctggctcaagcaggctgtgctaggatttcagttgccacagatggatttacctccactcggcgcgccttggctccccgtctgctcaatggtggttcagtacgcctcacaaattccctcaagtagacagacgcagcctgtgctccaaagccaggttgagaacttgctccatcgcacgtactgccgatggaaatccaaaagcccctccccagtgcacggagcgggaccctccgtaatggagatcccttgggatgatctgattgccctgtgcatcaatcataagctccgggactggacacccccgaggctgcccgtcacatccgaggctttgagcgaggatggccagatttgcgtatattttttcaagaacgatttaaagaagtatgatgtgcccttgtcctgggaacaagcacggctgcagacacaaaaggagttgcagctgagggaaggaaggctggctatcaagcccttccaccctagtgctaacaactttcctattccactgttgcatatgcatcggaactggaagaggtccacggagtgcgcgcaggaagggagaatcccatctacggaggatctcatgcggggagcttcagctgaagaactgctagcccaatgcctgtcgagctcactgctgctggaaaaagaggagaataaacgttttgaagaccagttgcaacagtggctgtccgaggattcaggagcctttactgatctgacgtctctgcctttgtacctgcctcagaccctggtcagccttagccatactatagaacctgttatgaagacttctgtcacgacctccccccaatctgatatgatgagggagcaactgcagcttagcgaagccacgggcacttgcctaggggagcgattaaaacacctcgagaggttgataagaagttctcgggaggaggaagttgcctcagagcttcatctctccgctttacttgatatggtcgacatatag

SEQ ID NO: 26878 - DNA, 333 bp, Artificial Sequence
  Description of Artificial Sequence: Synthetic coding sequence
atgagcaccgccctgacccacaccaccgtggccatgcggtgccccatggggggtgggggagggccaacttacgggcctccgcaaccatgggggcatcctgacgtccatataatgcaacatcacgtcttaccgatccaagcgcgcctgggctcaattgctgaaattgacttaggagtccctcccccggtgatgaagacgtttaaagaatttctcctatcactagatgattcagttgatgaaacagaggctgtcaaaagatataatgactacaagctcgatttccgtcggcagcagatgcaggatttttttctggcccataaggacgaggaatag

SEQ ID NO: 26879 - DNA, 828 bp, Artificial Sequence
  Description of Artificial Sequence: Synthetic coding sequence
atgagcgccgaggtgaaggtgaccggccagaaccaggagcagttccttctactagcaaagtcagcgaaaggcgctgctctggcaaccctcatccaccaggttttggaggcacctggcgtctacgtgtttggcgaactgttagacatgccgaatgtgagggagttggccgaatccgatttcgccagcacattcaggctcttaacagtctttgcctacggcacttacgctgactacctggcagaggccaggaatctgcctcccttgaccgaagcccagaaaaacaaattgcggcatttgtcagtggtgacacttgcagcgaaagtgaagtgtattccttacgccgtccttcttgaagcacttgctttgcgcaatgtacgccagctggaggatctcgttatcgaggctgtgtatgcggatgtactgagaggtagcctggaccagaggaatcagcgcctcgaagttgactattctataggccgcgacattcagagacaggacctctccgcaattgcccgtacactgcaggaatggtgtgttgggtgcgaggtagttttgtctggaatcgaagagcaggtctccagggcaaaccagcacaaagaacagcaacttggcttgaagcagcaaattgaatcggaagttgcaaatctgaaaaaaactatcaaagtgacgaccgcggcagccgctgccgccaccagccaagatcccgagcaacatctcacagaactcagagagcctgcccccggaacaaatcagagacagccttctaagaaagccagcaaaggaaagggtctacgaggatctgctaagatatggagtaagtccaattag

SEQ ID NO: 26880 - DNA, 876 bp, Artificial Sequence
  Description of Artificial Sequence: Synthetic coding sequence
atgatcggcgacggcgaggactacttcctgagcctgttcggcgacagtaagaagctcaccgcccattcaaactacacacagaagacccttaaatacttttcaatgatcttagaggaggttgggcagtttacctcctcttctttaggtgacgtggagatcgccgaggtgaatgtgaagggactctttgtgaaattaataaacagctccctggacaaagaaatggctattggagatcatattctgcaacaaaatgtcaacggacagacaatcagcctttaccggttcttaccgaatattgttatgcaagccaactccactgtgaccgtgtgggctgctgcgagcgaggccaagcaccagcctcctagcgacttcctttggaaagagcaggataagtttcgggccagccccgattgcattacaatattgtgcaaacccaacggacaggctatcgcctggtatacacctatacattggaagcaggcttgggagaaattggatgcagatgtggagtttaatcgctgctctgttgttagcccgacatttaggaaaagagttttccagtggacagccagtaccgctactatcacaaaggaaaagcaggaccagcctaagaaagatattagtaattaccaggtggagcaagcacaggtcctgctgaaacgcgagaaagagattcctcctaccgtttttccaaaccggtccccatggtgccagaacccctacgtgtccgcccatccctactgcccactcatagagccccacaacacctccacagcggggggacgattagaccggcagccacgcactcggagcacaagacctaatcgagcctctggaagcaaaaagaaaaaaacttctgagtcgcagaagcagtag

SEQ ID NO: 26881 - DNA, 1185 bp, Artificial Sequence
  Description of Artificial Sequence: Synthetic coding sequence
atggtgcccagccaggccccctacctggtgcccgccttccccctgcctgccgctactagcccggggcgggaatacgcggcgcccggcactgcgcctgaggggctgcatgggctcccattgtccgaggggctccaaccctatccagccttcccgtttccatatttggacacattcatgaccgttttccttccggaccctcccgtctgtcctcttctgagcccttcctttttaccatgtccgtttctgggggccaccgctagttccgctattagccctagcatgtcatcggcaatgagccctacactggatccccctccatctgtaacctctcaacgcagggaagaagaaaagtgggaggcgcaatccgagggccatcccttcatcactagtaggagctccagccccttgcagcttaatctcctacaggaggagatgccccggccatcggagagcccggatcagatgaggaggaatacttgccctcaaaccgaatactgtgtcaccggaaacaatggctccgaatcatcccctgcaactacaggcgccctctccaccggcagccctcccagagaaaaccccagtcatcctaccgcaagcgctctaagcacaggctctccccctatgaagaatccctcccatcctacagcaagcaccctcagtatgggcctcccaccctcccggacgcccagtcatcccacagccacagtactgtccacgggtagccctccttccgagagccccagccgcactggtagcgccgctagcggttcatcggattctagcatttatttaacctcgtcagtgtactcaagcaagatttcccaaaatggccagcagtctcaggacgtccagaagaaggagacattccccaacgtggcagaggagccaatctggcgtatgataaggcagacccccgaaagaatcttgatgacatatcaagtccctgagcgtgttaaggaagttgtgctgaaagaggatcttgaaaaactggagtcaatgaggcagcagcagccccaattctcccatggccagaaggaggagctcgccaaggtctataactggatccagagtcagacagtgacccaggaaatcgatattcaggcatgtgtgacctgtgagaacgaagattctgccgatggagcggccacctcatgtggacaggtgctggtggaggactcatgctag

SEQ ID NO: 26882 - DNA, 2424 bp, Artificial Sequence
  Description of Artificial Sequence: Synthetic coding sequence
cagggcgccagcttcgccctggccgccgccgccgccctgctgttcgggagcgacatggaagatggtccgtctaacaacgcttcctgcttcaggagattgaccgagtgcttcctgtcaccctcactaactgatgaaaaggtcaaggcatacctgtcactgcacccacaggtcttggacgagttcgtgtccgagtccgtttcggctgaaacagtggagaagtggctcaagcggaagaacaacaaaagcgaagatgagagtgctcccaaggaggtttctcgctatcaagacaccaacatgcagggggttgtgtatgaattgaattcctatatcgagcagcgcttggacaccggaggagacaaccagctgcttctctacgagctgtcctctataatcaaaatagcgactaaggctgacggctttgctctgtatttcctgggcgaatgtaacaactccctgtgcattttcaccccccccggcattaaagaaggcaaaccaagactgatccctgcagggccgataactcagggcacaaccgtaagcgcctatgtcgcaaagagtcggaagacgcttttagtcgaagatattctcggagacgaaaggttcccaaggggtacaggactggagtcaggcactaggatccagtccgtgctgtgcctgcccattgtcaccgccattggtgaccttatagggattctcgaactttaccgacactggggaaaggaagcattttgcctctctcaccaggaagtggccaccgctaatcttgcgtgggcctccgtggctatccaccaggtgcaggtgtgtcgcggtttggccaagcaaaccgagctaaacgactttcttctggatgtatccaagacatactttgacaatattgtggctatcgactcactgcttgaacacataatgatatatgcaaagaatctggtaaatgctgaccgctgtgccctgttccaggtggaccacaaaaataaggagctgtattccgatctgttcgatattggtgaggaaaaggagggcaaacccgtttttaagaagacaaaggagatcaggtttagtattgaaaagggtattgccggccaggtggcccgcaccggagaggtgctgaatattcctgacgcatacgcggatccaaggtttaatagagaagtcgacctgtacaccgggtatacaactcgtaatatcctttgtatgcccatcgtgtcaagagggtcggtcattggcgtggtgcagatggtcaacaagatttctggttctgcgttttcaaagaccgacgaaaacaactttaaaatgtttgccgtgttctgtgccctagcgctccactgtgcaaacatgtatcacaggatacgacacagtgaatgtatttatagagttactatggaaaaactatcttaccactcaatttgtacgtccgaagaatggcagggccttatgcagtttactctgccagttagactgtgcaaagagatcgagctgttccatttcgacatcggaccgttcgagaatatgtggccaggtatttttgtgtacatggtgcaccggtcttgtggtacaagctgctttgagctggagaaactgtgccgtttcatcatgtccgttaagaagaactatcgacgggtgccctatcacaactggaaacacgcagtgaccgtggctcactgcatgtatgccatactccagaataatcacactctgttcactgacctcgaacggaaaggtctcttgattgcatgtctgtgccacgacctagaccaccgcggatttagcaactcttacctccagaagttcgatcaccctctggctgcgctgtatagtacttcaactatggagcaacaccatttctctcagacggtgtccattttacagctggagggacacaacatcttctccacgttatcctcatcagaatatgaacaggtcctcgagattattcgaaaagcaatcatcgctacagatctcgcactgtatttcggcaatcggaagcagctggaggagatgtaccagaccggctcactaaatctgaataaccagtcccatcgagacagggttatcggtttgatgatgacagcctgcgatctctgctcagtgacgaaactttggcccgtgaccaaactaaccgccaatgatatttatgctgaattctgggctgagggggacgagatgaaaaaactaggcatacaacccatacccatgatggaccgagacaagaaagacgaagttcctcagggacaactcggcttctataacgcggtcgcgatcccatgctacaccacactgactcagatcctacctcccaccgagccactcctcaaagcgtgtcgggacaacctgagccagtgggagaaagtgatccggggagaggagacagccacttggatcagctcaccctctgtcgcacaaaaggcagccgctagtgaggactag

SEQ ID NO: 26883 - DNA, 1677 bp, Artificial Sequence
  Description of Artificial Sequence: Synthetic coding sequence
atggccagctgccccgacagcgacaacagctgggtgctggccggcggtgagctgggcatcagcttgaatatgtgccttctgggtgccctggtcctgctgggcctcggggtgctgcttttttctggaggactgtctgagtcggaaacagggcctatggaagaggtggaaaggcaggttctccctgaccctgaagtactggaagctgtaggggaccgtcaggacggactgcgggaacaacttcaggcccccgttccccccgattctgtgcccagcttgcagaacatgggcttgctgctggataaactagctaaggagaaccaggatatccggctgctgcaagctcagctacaagcgcagaaggaggaacttcagtccctaatgcaccaacctaagggtttggaagaggagaatgcccagttacgcggcgcactccagcaaggcgaggctttccagagagcccttgaatccgagttgcaacagctgcgtgcacgcctgcagggacttgaggccgactgcgtgcgcggccctgacggtgtgtgtttgtccggagggcgtggacctcaaggagacaaggccatcagggagcagggaccccgagaacaagagccagagctgagttttttgaaacagaaggagcagctggaggcggaggcccaggctctgcgtcaggagttagagcggcagcggagattactcggctctgtgcagcaggatcttgagcggtcattacaggacgcctcaagaggcgatccagcgcacgccggcctcgctgagcttggtcataggctggctcagaagctccagggcttggaaaattggggccaagatccaggggtgagcgccaacgcatctaaggcatggcaccagaagagtcactttcaaaactctagagaatggtcagggaaagaaaaatggtgggacggccagcgcgaccggaaggccgaacattggaaacataagaaggaagaatcaggcagggaacggaagaagaactggggtggacaggaagatagagaacccgcaggcagatggaaggaggggaggccaagagtggaagagagcggctccaaaaaggaaggcaagaggcagggtcccaaggaaccaccccggaagagcggaagcttccactcgtcaggcgaaaagcagaagcaaccaaggtggcgcgagggcactaaggattcccatgatccactgccttcctgggcagaactgctccggcccaaatatcgagcaccccagggctgtagtggtgtagatgaatgtgccaggcaggaaggacttacctttttcggaacggaactcgcgccagtgaggcaacaggagctggctagtttgctgcgtacatacttggcacggctcccgtgggccggccagttaactaaggaattgcccttaagcccagctttcttcggtgaagatgggatcttccgacacgatcgtcttaggtttcgagatttcgtggacgccctggaggattcattggaggaggtggccgtgcaacaaactggggacgatgacgaagtggacgatttcgaagatttcattttctcacatttcttcggtgataaggccctgaagaagcggtcaggcaaaaaagacaaacatagtcagagcccccgggctgctggaccccgtgagggtcattcacactctcaccaccaccatcatagagggtag

SEQ ID NO: 26884 - DNA, 1881 bp, Artificial Sequence
  Description of Artificial Sequence: Synthetic coding sequence
atgggcaacgccgccggcagcgccgagcagcccgccggccccgccgcacccccccctaagcagcaccggttcgaaaagctcatggagtactttcgcaacgaggattccaatattgacttcatggtggcctgcatgcagttcattaacatcgtggtgcactctgtggagaacatgaacttccgggtattcctgcagtatgagtttactcatctgggattggatttatacctcgaaagactcaggttaaccgagtccgacaagctccaggttcagattcaggcatatcttgacaatatctttgacgtaggggccctgttagaagacaccgaaactaagaacgccgttctggagcatatggaggagcttcaagagcaggtagcgctacttacagagcggctaagagacgcagagaacgagtcaatggccaaaattgccgaattggagaagcaattgagtcaggcacgtaaagagctggaaaccctccgggaacgcttctcagagtcaacggccatggggccatctaggcgacctccagagccggaaaaggctccaccggccgcaccaacacgtccatctgcgctggagttaaaagtggaagaacttgaagaaaaggggctgatacgcatcctgcggggccccggggacgctgtttcaatcgagattttgccagtggcggtggcaaccccttcgggtggggatgctcccacccccggcgtacccacagggtctccttccccagatcttgccccggctgctgaaccggcgcctggcgctgcaccacctccaccccctcctcctcccggtgggcccccggatgctcttgggaggagagactctgaactcggaccgggtgtgaaagccaagaagccaattcaaacaaagttccgaatgcctttgctgaactgggttgcactgaagccgtcacagatcaccggaacggtttttaccgagctaaacgacgaaaaagtcttgcaggaacttgatatgtccgacttcgaagagcaattcaagacgaagagccaaggaccgtccctcgacctgagcgcactgaaatcaaaggccgcgcagaaggctccgtctaaagccacactaatagaggcaaatagagccaaaaaccttgcaattaccctgcgaaaaggcaatttgggggccgagcggatctgccaggcaatcgaggcttacgacctacaggctcttggccttgactttttggaacttctgatgcgcttcctcccaacggaatatgagcggagtctgattacacgatttgaacgggagcaaagacctatggaggaactgtcagaggaggaccgctttatgctgtgcttcagccggatcccccgacttcccgagaggatgacaacgttgacctttctaggcaattttccggatactgctcagcttctgatgcctcaactgaatgccataatagccgcaagcatgagcattaagtccagtgataagcttagacaaatactcgagattgttttagccttcggcaactacatgaatagcagcaagaggggcgcagcttacggcttccgcctccagagcctggatgcccttcttgaaatgaaatccacagaccgaaaacaaacattactgcactatctggtaaaagtgatagcggagaagtaccctcagcttaccggatttcactctgacctacacttcctcgataaggcagggtctgtgtcactggactccgtcctcgccgacgtgaggagcctgcagagaggcctggagcttacccagagagagtttgtccgtcaggacgactgtatggtgctaaaagaattcctaagggccaatagtccaactatggataagttgttggccgactctaaaaccgctcaagcagtcccaaccggcggactgtag

SEQ ID NO: 26885 - DNA, 1500 bp, Artificial Sequence
  Description of Artificial Sequence: Synthetic coding sequence
atggacaagctgatcgtggacggccggggcaaggccaccatcagcaacgatggggccaccatacttaagcttcttgatgtggtccaccctgccgccaaaaccctggtcgatattgcgaagagtcaggacgctgaggtgggggacgggacaactagtgtgacactgctggctgccgaattcttgaaacaggtcaagccctatgtcgaggaagggctgcaccctcagataattattcgggcttttcgcaccgctactcagctcgctgtcaacaagataaaggaaatcgctgtgacagtgaagaaggcggacaaagtcgagcagaggaaattactcgagaagtgcgcaatgacagctttgtcaagcaagctgatcagtcagcagaaagctttttttgcgaaaatggtggttgatgccgttatgatgctggatgatctgctacagcttaaaatgattggtatcaaaaaagtgcaggggggcgccctggaggactcccagcttgtggctggggtcgcgttcaaaaaaactttcagctacgcagggttcgagatgcaaccgaaaaagtaccataacccaaagatcgcgcttctgaacgtggaattagaactcaaagccgaaaaagacaacgccgagatccgggtccatacggtcgaggattatcaagccatagtcgatgccgaatggaacatcctttacgataagctagaaaagattcatcatagcggggctaaagtggtcctgtccaaacttcctattggtgacgtagctacgcagtatttcgccgacagggacatgttttgtgcggggagagtgcccgaggaggatctcaagaggaccatgatggcttgcgggggaagcatacagaccagcgtgaacgcccttagcgccgacgttttgggcagatgtcaggtgttcgaggaaacccagattgggggggaacggtataattttttcacaggatgccccaaagccaaaacttgcacattcatcctgagaggaggggccgagcagttcatggaagagaccgaacggtcacttcatgacgcaattatgatcgtaaggagagcaatcaaaaatgacagtgttgtcgccggcggaggggccatcgagatggagctcagtaaatatcttagggattattccaggacaatccccggaaaacaacagctgttaatcggggcgtatgctaaagccctggagatcatcccacggcagctgtgtgacaacgccggctttgacgccaccaacatcctgaacaaattgcgggctcgccatgctcagggagggacctggtacggcgtggacataaacaatgaggacatcgctgacaacttcgaggcattcgtatgggagcccgcgatggtcagaattaatgcgcttaccgccgcgagtgaagccgcatgcctcattgtcagtgtggacgagactattaagaacccaagaagtacggtggatgcacctaccgctgccggtcgagggaggggccggggaagaccacactag

SEQ ID NO: 26886 - DNA, 78 bp, Artificial Sequence
  Description of Artificial Sequence: Synthetic coding sequence
atggcccacgagatgatcggcacccagatcgtgaccgagcggctggtggccctgctcgagtccgggaccgagaagtag

SEQ ID NO: 26887 - DNA, 633 bp, Artificial Sequence
  Description of Artificial Sequence: Synthetic coding sequence
atggagaagaccgagctgatccagaaggccgtggcctacaagaacgtggttggtggtagacggtctgcctggcgcgtaatatcctcgatagagcagaagactgatactagcgacaaaaagttacaacttatcaaggattatagagaaaaagttgagagcgagctgaggagtatttgcactactgtcctcgagttgctagacaaatatttaatcgctaatgccactaacccagagtcgaaagtgttctatcttaaaatgaagggagattactttcgttacctggctgaggtggcctgcggtgacgataggaagcagactatcgataattcccaaggggcttaccaggaagccttcgacatatcaaagaaggaaatgcagccaacacatccgatccgactgggcctcgccctgaacttttctgtgttctattacgaaatcttgaataatccagagctggcatgcactctggctaaaacggcctttgatgaggccattgcagaactggacactctaaatgaggatagctataaagactctaccctgatcatgcaactgctacgagataacctgacgctctggaccagtgattccgcgggcgaagagtgtgacgcggcagaaggagcggagaactag

SEQ ID NO: 26888 - DNA, 501 bp, Artificial Sequence
  Description of Artificial Sequence: Synthetic coding sequence
atggacctgatgcccttcatcaacaaggccggctgcgagtgcctgaacgagtctgacgagcatggatttgacaattgtcttaggaaagatactacattcctggaaagcgactgcgacgagcagttgctgattacagttgccttcaatcagcctgttaaattgtattccatgaaattccaaggcccggataacgggcaggggcctaaatacgtcaaaatctttattaatcttccgaggagtatggactttgaggaagccgagaggtcagagccaacccaggccctggagctgacagaggatgacattaaagaagacgggatcgtgcccctccgatatgtgaaattccagaacgtgaattcagtgacaattttcgtgcaatccaaccagggcgaggaggaaaccaccagaatttcttacttcacttttatcgggaccccagtccaggctaccaacatgaacgacttcaagcgtgttgtgggtaagaaaggggagtcacattag

SEQ ID NO: 26889 - DNA, 639 bp, Artificial Sequence
  Description of Artificial Sequence: Synthetic coding sequence
atggccgcccccgaggagcgggacctgacccaggagcagaccgagaaattactgcagtttcaggatttgacaggtattgagtctatggatcagtgtagacatactttagagcagcacaattggaacattgaggctgcagtccaggacagactcaacgagcaggagggggtaccatccgtgttcaatccccccccctcacggccgctccaagtgaatacggctgaccacagaatatactcatatgtggtcagtaggcctcagcctagagggctgctcggatggggctactacctaatcatgctgccgttcagatttacatactatactatattggacatcttccgcttcgcgcttcgcttcatcagacccgatcccagatcgagagtgacagacccggtgggtgatatcgtatctttcatgcacagcttcgaggaaaaatacgggagggcgcaccccgtgttttatcagggaacgtactctcaggcactgaacgatgccaagagggagctgcggtttctgctggtgtatctccacggggatgatcatcaggacagtgacgagttttgtcggaataccctctgtgcccctgaggtgattagtttaattaatacttccagtcacagcttcttgttactgtag

SEQ ID NO: 26890 - DNA, 1371 bp, Artificial Sequence
  Description of Artificial Sequence: Synthetic coding sequence
atggccgacagcctggagagcacccccctgcccagccccgaggaccgcttagccaagctccatcctagcaaggaactcctggagtattaccaaaaaaaaatggccgagtgcgaggccgaaaacgaagatctgctcaagaaactcgaattgtacaaggaagcatgtgagggccagcataagctggagtgtgacctgcagcagagggaggaggaaatcgccgagctgcagaaagccttatcagatatgcaggtctgcctcttccaggagcgcgagcatgtcctgcgactttactccgagaatgataggttgcgaatccgtgagttagaggacaagaaaaaaatccagaatctgctcgccctcgtcgggacggacgctggagaagtaacctatttttgcaaggaacccccccacaaagtgactatccttcagaagacgatccaagctgtgggagagtgtgaacagagcgagagctcagcgtttaaagcggatcccaagataagcaagcggcgcccaagccgggaaaggaaagaatcgtctgagcactaccagcgtgatattcagacactgatccttcaggtggaggccctacaggctcagttgggagaacagactaagctgtcaagagaacagattgaaggcctgattgaggataggaggattcatctggaggagatacaggtacaacatcaaaggaaccagaacaagatcaaagaacttacgaagaatctccatcatacccaggaattgctctacgaatctaccaaagactttctccagctgcgcagcgagaaccagaacaaggagaaatcttggatgctagagaaggacaatctgatgagcaaaatcaagcaatacagagtccagtgcaaaaagaaggaagacaagatcgggaaggtgctccccgtgatgcacgagagccaccacgcccagtctgagtatattaagtccctgaaagataaactggtgcaagaaaagaaattatctaacatgtaccaggaacaatgtatcagcctggaggaggagctggccaggattcgggaagaggagggaatgaggcgagaaattttcaaagatcgaaccaataagatgggaaaacgattgcagatcatgacaaaacggtacgaggcactcgaaagacgaagaatcctagaagtagaggggtttaagaccgacatcaaggttttaagacagaaattgaaggaccttgagcagatgttgtacaaagctacagtgaatgctcgggccaatcaggaccttgccctcttgtgcgaagtgcgagatagcaaccgacgcgcccataagatccagggggaacttaagaacctgaagagcaaggtcttcggactggaaaatgagctcaggctgtgctag

SEQ ID NO: 26891 - DNA, 183 bp, Artificial Sequence
  Description of Artificial Sequence: Synthetic coding sequence
atggacgagcaggccctgctgggcctgaaccccaacgccgacagcgatttcaggcagcgggccttggcctatttcgaacagttgaagatttcccctgacgcttggcaggtttgtgccgaggcactcgcgcaacgcacctattctgacgaccatgtgaagttcttctgcttccaggtgctgtag

SEQ ID NO: 26892 - DNA, 339 bp, Artificial Sequence
  Description of Artificial Sequence: Synthetic coding sequence
atgagcagcagcatgtggtacatcatgcagagcatccagagcaagtacagtctgtccgagcgcctcatacgcacaatagcggcaattcgctcatttccacatgataacgtagaggatttaatcagggggggcgcggacgttaattgtactcacggaaccctcaagccattacattgcgcctgcatggtgtccgatgccgactgcgtagaacttctcctggagaagggcgcagaggtgaacgccttggatggatataatcggaccgcgcttcactatgccgcggaaaaggacgaagcgtgtgtcgaagtattgctggagtacggggcgaaccccaactag

SEQ ID NO: 26893 - DNA, 1173 bp, Artificial Sequence
  Description of Artificial Sequence: Synthetic coding sequence
atgagcgccgccaaccccgagacccccaacagcaccatcagccgggaggccagcacgcaaagttctagtgccgccgcatctcaggggtgggtcttgcccgaagggaagatcgtcccaaatactgttttcgtgggaggaatagacgctcgcatggatgagacagagattggctcttgcttcggccgatacggatctgttaaggaggtcaagatcattactaaccgtaccggggtgtccaaaggatatggattcgtgtctttcgtgaatgacgtggatgtccagaaaattgtcggcagccagatacactttcatgggaaaaaacttaaactaggccccgccatccgaaagcagaagctgtgtgcccggcacgtgcagcctagacctttggtggtaaatccaccccctcctccacagttccagaacgtttggcgaaaccccaacacagaaacctatcttcaaccacaaatcacccctaatccggtcacccagcacgtgcaggcttactcagcttacccccatagccccgggcaggtgatcaccggctgccaactgctggtatacaactaccaggagtatccgacatatcctgattctgctttccaagtgacaactggttatcagctccccgtatacaattatcagccattccctgcctacccccggagccccttccaggtgaccgccggttatcagcttccggtgtacaattaccaggcgtttcccgcataccccaacagtccattccaagtcgccactgggtatcagtttcccgtgtacaattaccagccgtttcccgcctacccttcttcaccatttcaagttacggccggttaccaactccccgtctataactatcaagcattccccgcatatccaaactccccatttcaggttgccacggggtaccagtttcctgtatacaattaccaggcttttcctgcctatccaaatagtccagttcaagtaactacaggctatcaattgcccgtttataactatcaggccttcccagcatatccaaacagcgccgtacaggtgacaaccgggtatcagtttcatgtctacaactatcagatgcctcctcaatgccctgtcggggagcagagacggaatctgtggactgaagcctataagtggtggtatctagtgtgcttaatacaacgccgtgactag

SEQ ID NO: 26894 - DNA, 1335 bp, Artificial Sequence
  Description of Artificial Sequence: Synthetic coding sequence
atgcgggagatcgtgcacctgcaggccggccagtgcggcaaccagatcggtgccaagttttgggaggttattagcgacgagcacggaattgacccgacaggtacctaccacggagactcagatcttcaactggagcggatcaatgtttattataatgaggcaaccggtggaaattacgtaccgagagcagtactagtagatctggagccagggactatggacagtgtccggtctgggccttttggacagatcttccgccctgataactttgtattcggtcagtccggcgctggcaacaattgggccaaaggacactacaccgaaggagctgagttggtcgatgcggtcctcgacgtggtgcgcaaggaggccgagagttgtgactgcctgcagggatttcagttgacacacagcctcggcggtggaacagggagcgggatgggaaccctgcttataagtaagatcagggaagaattccctgatagaataatgaacactttctccgttgttccctctcccaaggtgtccgataccgtggtcgaaccatacaacgctactttgtctgtccaccagctggtggagaacacagatgaaacctattgtatagacaacgaagcactctacgacatctgtttccgtacattgaagcttaccaccccaacttatggcgacctgaatcatctggtcagcgcaacgatgagtggggtcactacatgcctgaggttccccgggcaactgaatgctgatctgagaaaactcgctgtgaacatggtgccattcccacgtttacactttttcatgccaggattcgcgcctctaaccagccgcggcagtcagcagtacagagcactgacagtgcccgaactaacccagcagatgtttgatgcgaagaacatgatggctgcttgcgaccctcgtcacggacgttatctgactgtcgctgccgtgtttagaggccggatgagtatgaaagaagttgatgaacagatgctttctgttcagtccaagaacagctcgtattttgtggagtggatcccaaacaacgttaaaactgcggtatgcgacattcctcctcggggcctcaagatggcagccaccttcatcggcaatagcaccgctatccaggaactgttcaagcgtatcagcgagcagttcaccgcgatgtttaggaggaaggcttttctgcattggtataccggcgagggtatggacgagatggagtttacagaggcggaatcaaatatgaatgacctggtaagcgagtaccagcaataccaggatgctactgctgaggaaggagagtttgaggaagaagccgaggaagaggtggcctag

SEQ ID NO: 26895 - DNA, 495 bp, Artificial Sequence
  Description of Artificial Sequence: Synthetic coding sequence
atggtgaacagcgtggtgttcttcgacatcaccgtggacggcaagcctctcggacggatctcaattaagctcttcgcagacaagatcctgaagactgcagagaactttcgtgcactttcgaccggagaaaagggattccgctacaaaggatcttgttttcatcggattatcccaggctttatgtgtcaggggggggatttcactaggcacaatggtacaggcgacaagtccatttatggggaaaagttcgacgacgagaacctgatcaggaagcacacagggtctgggatcctgtcaatggccaacgctggccccaacacaaatgggtctcagttttttatttgcgctgcaaaaaccgagtggctcgacggcaagcacgtcgcttttgggaaagtaaaggaacgggtgaacattgtcgaggcaatggaacatttcggatacagaaattccaaaacgtcaaagaagatcaccattgcagattgcggccagttctag

SEQ ID NO: 26896 - DNA, 3252 bp, Artificial Sequence
  Description of Artificial Sequence: Synthetic coding sequence
atgagccagacccaggactacgagtgccggagccacaacgtggacctgccagagtccagaatccctggctccaacactaggctggaatgggtcgagatcatcgaacctcggacccgcgagcgcatgtatgccaatctcgtgactggggaatgtgtatgggatccgcctgccggagtgcgaatcaaacggacgtccgagaaccagtggtgggagttatttgacccaaacacatcacggttttattactacaatgcgagcactcaacggacagtttggcaccgccctcaggggtgtgatattattcccctcgccaaactgcagactctcaagcaaaacactgagagtcccagggcctcagccgagtcttcaccaggacgcggatcttccgtgtcgcgcgagggttctacatcatcatcgttggaaccagagcccgacactgaaaaggcccaggaattacctgcccgagccggcagaccagcggcgttcggtaccgtcaaggaggattctgggtccagtagccctccgggagtcttcctagaaaaggattatgaaatctatagggattattctgccgatgggcaactgcttcactaccgaactagcagcctgcgttggaatagcggtgccaaggagcgcatgctgatcaaggtagccgaccgcgagccctctttcctggcggcccaaggcaatggctacgctcccgatgggcctcctggcgtacggtcaagacggccatcagggagccagcactctccttcactgcagacatttgcccccgaggcggatggcaccatcttcttccctgaacgacggccaagccccttcctgaagcgcgctgagttgcctggatcttcctcccctctactcgcccagccaaggaagccaagtggagactctcagccgtcctcgcctaggtacggttatgagccccccctgtacgaggagcccccagtcgaataccaggcacctatttatgatgagccacctatggacgtgcagttcgaagctggcggaggatatcaggccggttctccccagcgctcacctggtaggaaaccgaggcctttccttcaacccaataagcagggacctccgagtccttgccagcaactggtgctgacgaaacaaaagtgccccgagcggtttctgtctcttgagtattcaccagctggtaaggaatacgtgagacaactagtttacgtagaacaagcaggttcctccccaaaacttcgcgccgggccaagacataaatacgcacctaaccctgggggcgggtcctactccctgcagcccagtccgtgcctcctgagagaccagcgtcttggcgtgaagtccggcgactacagtacaatggaaggcccggagctcagacatagccagccccccacgccgttacctcaggcccaagaagacgccatgtcatggtccagtcagcaggataccctgagcagcaccgggtactcaccgggcacaaggaaaagaaaatcacgaaagccctccctgtgtcaggcgacctcagccacccctacagagggccctggagatctgctggtcgagcagccactcgcagaagaacaaccaccttgcggcaccagcctcgcaccagttaaaagagctgagggcgaagccgagggcgcccgaggcgcagcagaaccctttctggcgcaggcgagactcgcctgggaggcccagcaggctcatttccacatgaagcagcggagctcgtgggacagccaacaggatggttcagggtatgagagcgatggcgctctccctttaccaatgcccggtcctgtagtgagagccttctccgaggacgaagcgctcgcacagcaagaaaatagacattggaggagggggactttcgaaaaactggggttcccccagatacttctggaaaagagtgtaagtgtgcagactaatctcgccagtccagagccttacctccaccccagccagtccgaggacctggcagcgtgcgcgcaatttgaaagctctcgccaatcaagaagcggggttcccagttctagctgtgtcttcccaactttcactttaaggaaaccatccagtgagacagatattgagaactgggcatccaaacacttcaataagcacacccaaggcttgttccggcggaaggtgagcatagctaacatgttggcctggagctctgagagcattaagaagcccatgatcgtgacatcagatcggcacgtcaagaaagaagcttgtgaactgtttaagctgattcagatgtacatgggagacagacgagctaaagccgatcccctacatgtggctcttgaagtcgctaccaaaggatggagcgtacaggggttgagggacgagctgtatatccagttatgtcgacaaactacagaaaacttccggctggagagtctcgcaaggggatgggaactcatggctatatgccttgccttttttccgcctactcctaaattccattcttatttagaaggctatatatacaggcatatggatccggttaacgacacaaagggagtcgcaattagcacctacgccaaatattgctaccataagctccagaaagccgcgctgactggggccaaaaagggactcaaaaagcccaatgtggaggagattaggcatgcgaaaaatgccgtcttctcaccttccatgtttggaagtgccctgcaggaagtcatgggtatgcagcgggagcgttaccccgagagacagttgccatgggtacagacacggttatccgaagaggtgctagctctgaatggtgaccaaacagaggggatttttcgcgtgccaggggatatcgacgaggtgaacgcactgaaacttcaggtcgatcaatggaaagtgccaaccggtctggaggacccacatgtgccagcttcactgctgaagctttggtatagagagctggaggagcccctcatcccacacgagttttatgaacagtgtatcgcccattatgattcccccgaagccgccgttgcagtggttcacgcgctgcccagaattaaccgaatggttctctgctaccttatccgctttttacaagtcttcgtccagccagctaatgtggccgtcacaaaaatggatgtgtccaatctggccatggtcatggcaccgaactgcctgagatgtcagtccgacgatccaagggtgatatttgaaaacactaggaaagagatgtcattccttagagtgttgattcagcacttagacacttccttcatggagggggtgctttag

SEQ ID NO: 26897 - DNA, 1503 bp, Artificial Sequence
  Description of Artificial Sequence: Synthetic coding sequence
atggccgccgtgaagaccctgaaccccaagggcaccatgaagatgctggtcagtggggctggcgacattaaactcaccaaggacggaaacgtgttgctgcacgaaatgcagatccaacatcccaccgctagcttgattgcgaaggtggctaccgctcaggacgacataacaggagacggtactacctccaatgttctgattatcggggagctgctcaaacaggcagatctgtatatcagtgaaggcctacacccacggattattacagaggggtttgaggctgcaaaggaaaaagcgttgcagtttctggaggaggtcaaagtgagccgcgagatggaccgggagaccttgatcgatgtcgctaggacttcactgcggacgaaagtgcacgcagagttagccgacgtgcttactgaggccgtcgtcgattctatcttagcaatcaagaaacaggatgagccaattgatttatttatgattgagatcatggaaatgaaacacaagtctgaaacagatacatcactgatccggggcctggtcctggaccacggagccagacaccccgatatgaaaaagagagtggaagatgcttatattctgacctgcaatgtctccctggagtatgagaagactgaagtgaattcagggtttttctataaaagcgcggaggagagagaaaagctggtcaaggccgagcgcaagttcatcgaagacagggtgaagaaaatcatcgaactgaagagaaaggtttgcggcgattcggataaaggctttgtggtgattaaccaaaaaggaatcgatccattctccctggacgctctgagcaaggagggtatcgtggctctacgacgcgccaagagaaggaatatggagaggctcacgctagcctgtggtggcgtcgcgttaaattcatttgacgacctgagccctgactgtttgggccatgccggcctcgtctacgaatatacactcggagaggagaagtttactttcatcgagaaatgtaataacccacgctcagtcacccttctcatcaaagggccaaataagcatactctgacacagataaaggacgcggtgagggacgggctgcgcgccgtgaagaacgctatcgacgatggttgcgtcgtaccgggtgccggtgccgttgaagtcgcaatggcagaggcgctgatcaagcacaaaccctccgtgaaggggcgggctcagcttggggtccaggcttttgctgacgcactgcttatcattccaaaagtactggcccaaaactctggattcgacttgcaagagacattagtgaagattcaagccgaacattcagaaagtggccagctggtcggcgtcgatctgaacactggggagccaatggttgccgccgaagtaggggtttgggataattactgcgttaagaagcaactgcttcactcctgcaccgtcatcgccactaacattctcctcgtcgatgaaattatgcgggctggcatgagttcgctcaaggggtag

SEQ ID NO: 26898 - DNA, 1542 bp, Artificial Sequence
  Description of Artificial Sequence: Synthetic coding sequence
atgtgggacgtgtgcatggagcggggccaccgggacctggagcagttcgagagagtacacaggtacataagtgaccaactatttacaaatttcaaagagcgaacagagagactggttattagcccactcaatcagctattgtccatgttcacaggcccccataagctcgtccagaaaaggtttgacaagctgttggacttctacaactgcacggaacgcgccgagaaactgaaagacaaaaagacactagaggagctccagtccgcccgtaataattacgaggcgctcaacgcccaactgcttgacgaattgcccaaatttcaccagtatgctcagggactttttactaactgtgtccacgggtacgcagaggcgcattgcgactttgtgcaccaggctctcgaacaactgaaacccctgttgtctctcctgaaggtagcaggcagagaagggaacctgatagctatctttcacgaagagcactctagggtgcttcagcaactacaggtcttcacattcttcccggagtctctgcccgccacaaagaaaccttttgagcgaaagaccatcgaccggcaatccgcccggaagcccttgctaggcttaccgtcttacatgctgcagagcgaggaactgcgcgccagtttacttgccagatacccccctgaaaagctcttccaggcagaacgcaacttcaatgccgctcaggatctggacgtttccctactggagggagacctggtcggagtgatcaagaagaaggaccccatggggtctcaaaaccggtggctaatcgataatggagtcaccaagggttttgtgtacagctcctttctgaaaccctacaatccaagacggtctcattctgacgcctctgtcggttcacacagcagtactgagtccgaacatggctcctccagccctcgatttcctcggcaaaattccggctctactctcacttttaacccaagcagcatggcggtgtcattcacctcaggctcgtgccagaaacaaccgcaggacgctagtccacccccaaaagaatgtgaccagggaaccttatctgccagcctgaacccctctaattccgagtcgagcccctcccgctgccccagcgacccggactccactagccagcctcgatccggcgatagcgcagatgtggcacgagacgtcaagcagcctaccgccactcctagatcatatcggaacttcagacatccagaaatcgtaggatatagcgttcctgggagaaatgggcaatcacaggacttagtaaagggttgcgccaggaccgcccaggctcccgaggatagatccacggaaccagacggcagtgaggctgaaggaaatcaggtgtacttcgcggtgtataccttcaaagccagaaatccgaacgagctgagtgtctccgctaaccagaagctcaagatcctggaattcaaagatgtgaccggcaacactgagtggtggctggccgaggtgaacggcaaaaaagggtatgtcccttccaattatatccggaagacagaatacacatag

SEQ ID NO: 26899 - DNA, 153 bp, Artificial Sequence
  Description of Artificial Sequence: Synthetic coding sequence
atgatgcagaacgtgcacctggcccccgagaccgacgaggacgacctatactctggatataacgactataatcctatttatgatattgaagaattagaaaacgatgccgccttccagcaggcggtcaggaccagtcatggacgtcgtccatag

SEQ ID NO: 26900 - DNA, 4317 bp, Artificial Sequence
  Description of Artificial Sequence: Synthetic coding sequence
atgagcatgctgaagcccagcggcctgaaggcccccaccaagatcctgaaacctgggtccactgcattgaaaactcccaccgccgttgtggcacctgtcgagaagactatctctagtgagaaggcttccagcactccctcctcagagacacaagaggagttcgttgacgattttagagtgggtgaacgggtctgggtcaacggcaataagcctggcttcatccagtttcttggtgaaacacagtttgcgcccgggcaatgggccggcattgttttggacgaacctattggaaaaaacgacggaagtgtcgctggggtgaggtacttccaatgtgagccgttaaaagggatttttaccagaccctctaagcttaccagaaaagtgcaggctgaggacgaagctaatgggcttcagaccactccagcttctcgagccacttcacccctgtgtacctcaacagccagcatggtctcgtcttcaccttcaaccccatcaaacatacctcagaagcccagtcaacctgcagcaaaggaaccctctgccacaccccctatttcaaaccttaccaagaccgccagcgaatctattagtaatttgtctgaggccgggagcatcaagaagggagagagggaattgaagatcggggaccgggttctggttggcgggaccaaagctggcgtggttagatttctaggggaaaccgattttgccaagggagagtggtgtggcgtggagctggatgaacctttgggcaaaaatgacggcgccgtcgctggaactagatacttccaatgtcagcctaagtatgggttgttcgcccctgtacataaagtcaccaagatcggtttcccttctactacaccagctaaagccaaggcgaatgcagtccggcgtgtgatggccaccacttctgctagtctgaaacgatctccgtccgcgagcagcttgagtagcatgtcttccgtagctagcagcgtaagtagccggccaagccgcacggggctgctgacggagacctctagcagatatgctcggaaaatctctggaacaactgcactgcaagaagctctaaaggaaaagcagcagcacatcgagcaactacttgcagagagggacctcgagagagctgaggttgctaaagctacatcccatgttggagaaatcgagcaggagctcgccctggcgagagacggacacgatcaacacgtgctagagctggaagcaaagatggatcaactcaggacaatggttgaggcagcagatcgagagaaagtggagttgctcaatcaactggaggaggaaaaacgtaaagttgaggacctgcagttcagggtggaggaggagagtattacaaaaggagacttagaacagaaatcccagatcagcgaggatcccgaaaatacacagaccaaactggagcacgcccgcatcaaggaactcgagcagtccttgctcttcgaaaaaacaaaggccgacaaactccaacgtgagctggaggacactcgggtggcgaccgtgtccgagaagagtcggattatggagctggagaaggatctcgccctacgagtgcaagaagtggctgagctccgacggcgactggaatctaataaaccagccggtgacgttgatatgagcttgagcctgctgcaggagatcagctccctgcaggaaaagcttgaagtgacccgaaccgatcatcagcgtgagatcacctctcttaaggaacattttggagcccgcgaagagactcatcagaaggagattaaggctctctatactgcaaccgagaagctatcaaaagagaatgaatctctgaagtccaagctagaacacgctaataaagagaactccgacgtgatcgccctgtggaaatccaaactggagaccgccatcgcttctcaccagcaggccatggaggaattgaaggttagcttctccaagggcctcggaactgagacggccgagttcgctgagctgaaaacccagattgagaaaatgcgcctagactatcagcacgaaatcgagaaccttcaaaaccagcaggactcggaacgcgccgcccacgccaaggagatggaagccctgagggctaaactgatgaaagtcatcaaggagaaagagaatagtctggaagctattcggagcaagctggacaaagcagaggatcagcacctcgtggagatggaggataccctcaacaagctgcaagaagccgaaattaaggtaaaagagctggaagtgttgcaggctaagtgtaacgaacagaccaaagtgattgacaacttcacatcgcagctgaaagccactgaagaaaagctgctggacctcgatgccctccggaaagcatcttcagagggcaaatctgaaatgaagaaactgagacagcagctggaggccgcagagaaacaaatcaagcatcttgaaatcgaaaaaaacgccgagtcctcaaaggcaagctctatcaccagggagttgcagggacgggaactcaagttgaccaacttgcaagaaaatctaagtgaggtatcccaagtgaaagaaaccctggagaaggaactgcaaatcctgaaagagaagttcgcggaggcaagtgaagaggcggtgtctgtgcaacggtcaatgcaggagaccgtgaacaaactgcatcagaaggaggagcagttcaacatgcttagcagtgacctggagaagctccgtgagaacctggcggatatggaagcgaagtttcgtgaaaaggacgaaagggaagagcagctcatcaaggcgaaggagaagctagaaaacgacatcgccgagatcatgaaaatgagcggcgataatagctcccagctgacaaagatgaatgatgaactgaggcttaaagaacgcgatgtggaagaattgcagctcaaactcactaaggcaaacgaaaatgcatcatttcttcaaaagagcatcgaggacatgaccgtaaaagctgaacagagtcaacaggaggcagcaaaaaaacatgaagaggaaaaaaaggaattggagcgcaaactctcagacttagaaaagaagatggaaacttctcataaccagtgccaggagcttaaagcacgatacgaacgagccacctctgaaacaaaaacaaaacatgaggagatcttgcagaacctgcaaaagaccctgctggataccgaggacaagctgaagggtgcaagagaggagaatagcggcttattgcaagaactggaagaactgcgtaagcaggcggataaagccaaggcggcccagaccgcggaggatgccatgcaaatcatggagcagatgactaaggagaagactgagactttggcgtctcttgaagatactaaacagacaaacgccaagctacagaatgagctggatacactcaaggaaaacaacctcaaaaacgtggaggaactgaacaagtcaaaggaactgctgaccgtagaaaaccagaagatggaggagtttaggaaggaaatagagaccttaaagcaggcagcagcccagaaatcacagcagctgtctgcgctgcaggaggaaaatgttaagctagccgaagagcttggccgatcccgcgacgaggtgacaagccaccagaagctcgaggaggaacgttcggtactgaacaatcagttgctggagatgaaaaagcgggaatccaaattcatcaaagatgcagatgaggaaaaggcatccctacagaagtcaatttctataacctcagctttactgaccgagaaagatgctgagctggagaagctgaggaacgaagttaccgtcctgcgtggcgaaaacgccagcgcgaagagtctccactccgtggttcagaccttagagtctgataaagtgaagctagagctaaaggtgaagaacctggagttacagctgaaggaaaacaagcgccagttatctagttctagtgggaacaccgatactcaggcagacgaggacgagcgcgctcaagaatctcagatagatttcttgaattcagtgattgtcgacctgcagaggaagaaccaggatcttaaaatgaaagtagaaatgatgtctgaggctgctttgaacggcaacggagacgatctgaataactacgattccgatgatcaggagaaacagagcaagaaaaaaccgagactattctgtgatatatgcgactgctttgatcttcacgacactgaagactgccccacccaggctcaaatgtcagaggatccacctcatagcacacaccatgggagccgcggggaggagaggccctattgcgagatctgcgagatgttcggacactgggcaactaattgtaacgatgacgaaacattctag

SEQ ID NO: 26901 - DNA, 636 bp, Artificial Sequence
  Description of Artificial Sequence: Synthetic coding sequence
atggccttcgccgacagccacctgtggaagctgctggaccggcacgcaaatactattagactgttcgtgttgctgcctgaacagagccccgtgtcttattctaaacgcacggcctatcagaaagcgggaggggactctggcaacgtcgatgatgactgtgagcgggtgaagggtcccgttgggagcttaaagtcagtcgaagctattctggaagaatctacagagaaactcaaatcactcagcctgcagcaacaacaggatggcgataacggcgattcgagcaaatcaacagagaccagcgatttcgaaaatattgaatcccccctcaacgagagagatagctcagcctcagttgataacagggaactggagcagcacattcagacatccgatcctgagaatttccagagcgaggagagaagtgattcggatgtgaacaacgacaggtccacttccagtgtagattctgacattctgtcctcaagtcactcttctgatacattgtgcaatgccgacaacgctcagatccctctggcgaatggacttgactcacatagcattaccagcagtcgaaggactaaggctaatcgggagaaacggaatatgggttatagtagaagacggctgtggaattag

SEQ ID NO: 26902 - DNA, 2136 bp, Artificial Sequence
  Description of Artificial Sequence: Synthetic coding sequence
atgctggccagcctgaaggtgaagaagcaggagctggccaacagcagcgacgccacgcttcctgatcggccactgtctccccccctcactgcccccccgactatgaagtcatcggagttttttgaaatgctcgaaaaaatgcagggcatcaagctggaggagcagaaaccggggccgcaaaagaataaggacgattacatcccttaccctagcatcgacgaggttgtcgagaagggtggaccctatccccaggtgattctgcctcagtttggcggctactggatcgaagaccctgaaaatgtgggcactcccaccagtctcggctcatcaatatgcgaggaggaggaagaggacaatctgtctcctaacacttttggttacaagcttgaatgcaagggcgaagccagagcatatcgacggcactttctgggcaaagaccacttaaacttctactgcacaggctccagcctggggaacctcattctgtctgtgaagtgcgaagaggccgaagggattgaatatctccgagtcattttgagatccaaacttaagacagtgcatgaaaggatccccttagctggactgtctaagcttccatccgtcccccagatagccaaagctttctgcgacgatgctgtgggattacgatttaatcccgtcctgtatcctaaagcttcacagatgatcgtgtcctacgacgaacacgaggtgaataatacgttcaagtttggcgttatatatcagaaagcaagacagaccctcgaggaagagctctttgggaacaatgaggagagccctgctttcaaagagtttctggacctactaggagacactattactttacaagattttaagggcttccgtggaggcctggatgtcacacacgggcagaccggtgttgagagtgtttacaccacattcagggacagagaaatcatgttccatgtcagcaccaaactgcccttcacagatggggatgctcaacaactccagcgaaaaagacatatcggaaatgacatcgtggctatcatcttccaggaagaaaacaccccatttgttcccgacatgatcgcatctaacttcctccacgcctatatcgtggtacaagtggagacgcccggcacggaaaccccgtcatataaagtctccgttacagcacgcgaagacgtgccgacctttggcccccccctcccatcccctccagtgtttcagaaaggccccgaattcagggagttcctgctgaccaaactgacaaatgccgagaacgcgtgctgcaagagcgacaaattcgccaaactggaggatcgaacgcgtgccgccttacttgataatctgcatgacgaacttcacgcccatacgcaggccatgctcggacttggacccgaggaggacaagttcgaaaatgggggccacggcggtttcctggagtccttcaaaagagcgatacgagtgaggagccactctatggagacgatggttggcggccagaagaagtcccactccggaggaatcccaggaagcttatcaggcggtatttcccacaacagcatggaggtcactaaaaccaccttcagccccccagtcgtagcggcaaccgtgaagaaccaaagtaggagtcctatcaagcggcgcagcggccttttcccccgccttcacactggatctgaaggccagggcgattctcgggcgcgttgcgactctacaagcagtactcctaagaccccggacggcggccattcaagccaggagattaagtccgagactagcagtaatccatcaagccctgagatttgtccaaataaagagaagcccttcatgaagctcaaggaaaacgggcgggcaatttctcgctcctcttcctctacctcctccgtgagtagcaccgctggggagggagaagcaatggaggaaggcgactcagggggctcccagccctccaccacctccccttttaagcaggaagtgttcgtctattccccctcccccagctccgaaagtccctcgctgggcgcggccgcaacacccattattatgagccgatctcctaccgacgctaaatcccgtaatagccctaggagcaacctgaagtttcgtttcgacaagctttcccatgcttccagcggcgccggccactag

SEQ ID NO: 26903 - DNA, 1089 bp, Artificial Sequence
  Description of Artificial Sequence: Synthetic coding sequence
atggacggcctggacgacgtggagaacagcatgctgtactacaaccaggctgtcattttgtaccacctgagacaatacaccgaagccatttccgtaggggagaaactgtaccagtttatcgaacccttcgaagaaaaattcgcccaggccgtgtgcttcctgctcgtggacctgtacattctcacctaccaggcagagaaagctcttcacctgttagccgtcctggaaaaaatgatctctcaggggaacaataacaagaatgggaaaaatgagactggaaataataacaataaggacgggtccaatcacaaagcggaatcgggcgccctcatcgaggccgccaagagtaagattcaccagtacaaagtgagggcctacatccagatgaagtctttgaaagcctgtaaacgggagattaagtcagtgatgaatactgctggcaatagcgcaccctccctcttccttaagagcaattttgagtatctacgcggcaactaccgtaaagccgtgaaactgcttaactcgagtaatatcgccgagcatcctggcttcatgaagaccggcgaatgccttcgttgtatgttctggaataatttaggctgcattcactttgcaatgagcaaacataacctgggaatcttttactttaagaaggcactgcaggaaaatgataacgtttgtgcgcagctgtccgcaggctcaaccgatcctggcaagaagttttcggggcgccccatgtgcacacttttaactaataaacggtatgagctgctgtataattgcgggattcagctcctacacataggccgtcctctggcagcatttgagtgcctgattgaagcggtacaagtgtaccatgccaatcccagactctggctccggctcgccgagtgctgtattgctgctaataaggggacatctgagcaggagaccaagggcctgccctctaagaagggcatcgtacagtccatcgtgggccagggctatcaccgcaagattgtgctcgccagccagtccatccagaatacagtgtataacgatggacagtcctcagccatccccgtggccaaggccggcaagtgggggtag

SEQ ID NO: 26904 - DNA, 1821 bp, Artificial Sequence
  Description of Artificial Sequence: Synthetic coding sequence
atgtgcggcgccggcttcggccacttcgagtggctggccggcggcggagctggacaggacgtggggagatcatgcatcctcgtgagcatagcaggcaagaacgttatgctggactgtggaatgcacatggggttcaacgacgatcggagattccccgatttctcttatatcacacagaacgggaggctgaccgacttcctggactgtgtgattataagccatttccatctggatcactgtggcgctctcccctatttcagtgaaatggtggggtacgatggccccatttatatgactcatcccactcaggctatatgtcctatcctgctggaggactataggaagattgctgtcgacaagaaaggcgaggcaaatttcttcacctctcagatgatcaaagactgtatgaagaaagtggtcgcggtacacttacatcagacagtccaggtagacgatgagctcgagatcaaggcctattacgctggtcatgtgctcggcgctgcaatgtttcagattaaggtggggagtgagtctgtagtttacactggtgactataacatgacccccgatcggcacctgggcgcggcttggatcgataagtgcaggcctaatcttcttataaccgagagcacctatgcaaccacaattagggactctaagcggtgtcgcgaacgggactttctgaaaaaggtccacgaaacggtcgagcgcggtggtaaagttttaattccagtctttgctctgggacgggcccaggaactgtgtatactacttgagacattttgggaacgcatgaatctgaaggtccctatctacttctcaaccggcctcactgaaaaagccaatcattattataagctcttcattccctggacaaatcagaagattcgaaagacattcgtgcagaggaatatgttcgaattcaagcacatcaaggcttttgatagagcctttgccgataatcctgggcccatggtggtctttgccacgcctgggatgctgcacgccggacagtctctgcagatatttagaaaatgggcggggaacgagaagaacatggtcattatgcctggatactgcgtgcaaggcactgttggccataagatactgtccgggcagcgcaagctggagatggagggtcggcaggttctcgaggtgaagatgcaggtggagtacatgtcattcagtgcccacgcagatgcgaagggcatcatgcagctcgtgggccaggccgagccagagtctgttctactcgtccacggagaggccaagaaaatggaatttctgaagcagaaaattgagcaagagctgcgagttaattgctatatgcctgcgaatggagagaccgtcaccctacctacctcaccttctattcccgtcgggataagcctcggcctgctgaagcgggagatggctcagggcctgctgccggaagccaagaaaccaagattgttgcacggaaccctaatcatgaaggattccaacttcagactggtgtcatcagagcaggcactaaaagaactcggcctcgccgaacatcaactgaggttcacttgcagagtgcacctgcacgacaccaggaaggaacaagagacggcactgcgggtgtattctcatttgaaatctgttctgaaggaccactgtgtgcagcacctcccggacggctcagtgactgtcgaatctgtcctgctccaggcagccgcccctagtgaagatccagggaccaaggttcttctggtttcctggacttatcaggacgaagagctgggctcctttttaacctccttgctgaaaaaaggactgcctcaggccccatcttag

SEQ ID NO: 26905 - DNA, 399 bp, Artificial Sequence
  Description of Artificial Sequence: Synthetic coding sequence
atgaagaaggtgcggctgaaggagctggagagccggctgcagcaggtggatggcttcgaaaagcccaagctcctgcttgagcaataccccaccaggccccacatcgccgcttgtatgttatacacaatccacaacacatacgacgatattgaaaacaaagttgtggccgatctgggttgtggctgcggggtgctgagcatcgggaccgccatgctgggggccggcctgtgtgtgggcttcgatatcgatgaggatgctttggaaatcttcaacaggaatgccgaagagtttgaactccaaattctcacctggtttaacgtgatgtgcgcttactatcttactgaatgcccatcccatagtatccaaaattatgagtccagcctgtgggaccagaaatag

SEQ ID NO: 26906 - DNA, 1371 bp, Artificial Sequence
  Description of Artificial Sequence: Synthetic coding sequence
atgatggtgggcgacggcaccaccagcgtgaccctgctggccgccgaatttcttaagcaggtgaagccgtatgtggaggagggattgcaccctcagatcatcatccgtgcattcaggaccgcgacccagctcgcagtgaataaaattaaagaaatcgctgtgacagtgaaaaaagccgacaaagtcgagcagcggaaactcctggagaaatgcgcaatgaccgccttatcttctaagctgatctctcagcagaaagcatttttcgcaaaaatggtggtggacgccgtaatgatgctggatgacctcttgcagttgaagatgatcggcattaagaaagtacaaggcggcgcactggaagacagtcagctggtggctggagtggcgtttaagaagacgttctcctatgcgggctttgagatgcaacccaaaaagtaccataaccctaagatcgcattactcaacgtagagctggaactgaaagctgaaaaagacaacgccgagattcgtgtccatactgtggaggactaccaagccatcgtggacgccgagtggaatattctgtacgataagctcgaaaagatccaccattccggtgcaaaagttgtacttagcaaattaccaatcggagatgtcgccacacagtactttgccgacagggacatgttctgtgccggtagagtacccgaagaggacctgaagagaacaatgatggcctgtggcggctctatccagaccagcgtcaacgcactctcggccgatgttctggggcggtgtcaggtgttcgaggaaactcaaatcggcggagagcgttataacttcttcacagggtgtccaaaggccaagacttgtactttcattttgcgcgggggggcagagcagtttatggaggaaaccgagcgctctcttcacgacgcaattatgatcgtgcgaagagctattaagaatgattccgtagtggcaggcggaggcgccattgagatggagctgtcaaagtacctccgggactacagcaggacgatccctggaaaacagcagctgcttatcggagcctatgcaaaagccctggagatcattccaaggcaactctgcgacaatgcagggtttgatgccaccaatatccttaacaagctgcgggcccgacacgctcagggcggaacctggtacggagtggacattaacaacgaggacatagcggacaattttgaagcgtttgtgtgggaacctgccatggttcggatcaacgccctgactgccgcttccgaggccgcatgccttattgtctctgttgatgagactattaaaaaccccaggagcactgtagatgcccccacagccgctggacgtggccggggcagaggccgtccccactag

SEQ ID NO: 26907 - DNA, 2520 bp, Artificial Sequence
  Description of Artificial Sequence: Synthetic coding sequence
atggacggcaaggccgacgtgaagagcctgatggccaagtacaacacaggggggaaccctactgaggacgtgagtgtgaactcccggcccttccgggtaactggaccgaactcctcgagtggtatacaagcccgcaagaatctcttcaacaaccagggcaacgcctcaccgcccgcaggcccaagcaatgtgcccaagttcgggtcacctaaaccccctgtggccgtgaagcctagctcagaggaaaaaccggacaaagagccaaagcctccattcctgaagccgactggtgcaggccagagattcggcacccccgcgtctctgacgacaagggaccccgaggccaaggttggatttctgaaacccgtgggccccaagcccataaaccttccaaaggaggacagcaagccaaccttcccatggccacccggcaataagccctcactgcactctgtgaaccaggaccacgacctgaaacctttagggcccaaaagcggacctactccacccactagtgagaatgaacaaaagcaggccttcccgaagctcaccggggtcaagggtaagtttatgtcagcctcccaggacctcgagcccaagccacttttcccaaaacctgccttcggccagaaacctcccttgtctactgaaaactcgcacgaggatgagagcccgatgaagaacgtcagttcgtcaaaaggttcccctgcccccttgggcgtgaggagcaagtctggaccgctgaagcctgcacgtgaggacagcgagaacaaggaccacgccggcgagatatctagcctgccgtttcctggagtggtgcttaagccggctgcatctcgtggcggtcccggcctatcaaaaaacggcgaagaaaaaaaggaggatcggaaaatagatgcagcaaaaaatacctttcagagtaagattaaccaggaagaactggcgagtggaacgccgcccgcacggttcccgaaggcccctagcaaactcacagtgggaggcccttggggacagtcgcaggagaaggagaagggagataaaaattccgcaacacccaaacagaagccactgcctcccctgtttacactgggaccaccacccccaaaacctaatcgcccacccaatgtggacctcacgaaatttcataagaccagttccggcaactcaacctccaagggccaaactagctatagtacgacctccctgcctccccctccccctagtcaccctgcctcacaaccccctctcccggcgagtcacccatcacagcccccagtgccttcccttccgccaagaaacattaaaccaccgtttgatttaaaatctccagtgaacgaagacaatcaggacggtgtcactcatagtgacggcgcgggcaacttggatgaagagcaggactcagaaggggaaacctacgaggacattgaagcatctaaggaaagagaaaagaagcgggagaaagaagagaagaaacgtttggagctagagaagaaggaacagaaggaaaaggagaagaaggagcaagaaatcaaaaagaagtttaagttgaccggcccgatacaggttatacatcttgccaaagcatgctgcgatgtcaaggggggaaaaaatgagctcagcttcaaacagggcgagcagattgagatcatcagaatcaccgataaccccgaaggaaagtggctaggaaggactgctagagggagctatggatatattaagacaaccgcggtcgaaatcgattatgattccctgaagctgaaaaaggattctctgggcgccccctccaggcccatcgaggacgaccaggaagtgtacgatgacgtcgctgagcaagatgatatttcctctcactcccagagcggaagtggcggaatttttcctcctccacctgacgacgatatatacgatggcatagaggaggaggacgcagatgatggttcaacactgcaggtccaggagaagtccaacacctggagctggggcatcttaaaaatgctcaaggggaaagatgaccggaagaaatccatcagagaaaagcccaaggtgtccgactccgacaataacgagggctcctcttttcctgcccctcctaagcagctggacatgggtgacgaggtgtacgacgacgtggacacgagtgatttcccagtcagcagtgccgagatgtctcaagggacgaatgtcgggaaggcaaagaccgaggaaaaggatctcaaaaaattaaagaagcaggaaaaagaggagaaggactttcggaaaaagttcaaatacgacggcgagatccgggtgctttacagcacaaaggtaaccacttccataacatccaagaagtggggcacccgagacctacaggttaagccgggggaatcactggaagtcattcaaacgacagatgataccaaagtgctttgcaggaacgaggagggaaagtacggctacgtgctgaggagctacctggcagacaatgatggggaaatttatgacgacattgccgacggttgtatatacgacaacgattag

SEQ ID NO: 26908 - DNA, 1017 bp, Artificial Sequence
  Description of Artificial Sequence: Synthetic coding sequence
atgggccaccggtacatcgaggtgttcaagagccaccggaccgagatggattgggtcctcaaacatagcggcccaaatagtgccgatagcgctaacgatgggttcgtccgcctacgtgggctgccatttgggtgcaccaaagaagaaattgtgcagttcttctctggcctggagattgtccctaacggaattacactacctgtcgacccagaagggaaaatcacaggagaagccttcgtgcagtttgcctctcaggaactggctgagaaagccctcggaaagcataaagagaggataggccataggtatatcgaggtgttcaagtcttcccaggaggaggtaagaagctactctgaccctcccttgaaatttatgagtgtgcagcgcccaggcccctacgatcggcccggaactgccaggagatacattggaatcgtgaagcaggcggggctggaacggatgcgaccaggcgcatactctactggttatggcggctatgaggaatattccggtctatccgatggctacggtttcaccaccgatttgttcggaagggatctgagttactgtctgtctggcatgtacgatcataggtatggcgacagcgagttcacagttcaaagcactactggccattgcgtccatatgcgcgggttaccctataaggcaacagaaaatgacatctataatttcttctctccgctgaatcctgtgcgcgtccatatcgagattggcccagatggtagagttaccggagaggcggatgtggagttcgctactcacgaggaagctgtggccgcaatgtctaaagatcgagcaaacatgcagcaccggtatattgaactcttcctgaacagcactaccggtgcatctaatggagcctactccagtcaggtgatgcagggcatgggtgtctctgcagcgcaggccacttattccgggctggagtcgcagagtgtgtcggggtgttacggcgccggctattctggacagaactccatggggggctatgattag

SEQ ID NO: 26909 - DNA, 1536 bp, Artificial Sequence
  Description of Artificial Sequence: Synthetic coding sequence
atggccagcgtggtggagtacaagggcctgcgggccggctaccactgtggctactgcgatagtaaagaaggcaaggcatcttgcgggatgtgggctcacagcatgactgtgcaggattatcaggacctcatcgataggggttggcggaggagcggaaaatacgtgtacaagcctgtgatgaaccaaacctgttgtcctcaatacactatccggtgtaggccactgcagttccagccttcaaagagccataaaaaggtactcaagaaaatgcttaaatttctggccaagggcgaagttccaaaaggcagctgtgaagacgagccgatggatagtaccatggacgacgctgtggctggggacttcgccctgattaataagctggacatccagtgcgatctgaagactttatccgacgacatcaaggagagtttggaaagtgaggggaaaaacagcaagaaagaggagccgcaggagttgctccaatcacaggattttgtgggcgagaagctggggtctggtgagccttcccacagcgtgaaggttcacactgttccaaagccaggcaagggagccgatctgagcaaacctccttgtcgaaaagcaaaggaaatcaggaaggagaggaagaggctgaagcttatgcagcagaatcctgcaggtgagctcgaaggatttcaggcccagggccaccctccatcactcttcccaccaaaagccaaaagcaatcagccaaagagtctggaagatctcattttcgagtctctacctgagaacgcatctcacaaacttgaggtgcgcctcgtgcccgtttccttcgaggatcctgaatttaaatcaagcttctcccagtccttttctttgtacgttaagtatcaggtcgccattcaccaggacccacccgacgagtgcggaaaaaccgagttcacccggttcttgtgctcctcgcctctggaggccgagacaccccctaacggtcctgactgtgggtacggctcctttcatcagcagtactggctggatggcaagataatcgcggtaggggtgattgacattcttcccaattgtgtatcatctgtgtacttgtactacgatcccgactactctttcttgtccctgggcgtgtattccgctctgagagaaatagccttcacacgccagctgcatgaaaaaaccagccagctgagttactattacatgggattctatatccactcctgcccaaagatgaaatacaagggacagtatcggcctagtgatctgctgtgtcccgagacgtacgtgtgggtccctatcgagcagtgtttaccatcgttagaaaacagcaagtactgccggttcaatcaggaccccgaagctgtggatgaggatcgctctaccgaacctgacaggctgcaggtctttcacaagcgcgctatcatgccctacggcgtgtataagaaacaacagaaggacccttccgaagaggccgccgttctgcagtatgcgtcattggtgggacagaaatgcagtgagagaatgctgctcttccgcaactag

SEQ ID NO: 26910 - DNA, 3963 bp, Artificial Sequence
  Description of Artificial Sequence: Synthetic coding sequence
atgcaggacgacagcatcgaggccagcaccagcatcagccagctgctcagggaatcttatcttgccgagactcgacacaggggaaataatgaacggtccagagctgaacccagctcgaacccctgccatttcggttcgccaagtggagccgctgagggtggaggaggacaggatgacctgcccgacttgtccgcattccttagtcaggaggagctggacgagagtgttaacctcgccaggctggctatcaattatgaccccctcgagaaagctgatgaaactcaagccagaaaaaggctgtcacccgaccagatgaagcactctcccaacctgtctttcgagccaaacttctgccaagataatccgagatcccccacatcctccaaggaatctccgcaggaggccaaaagaccccagtactgcagcgagacccaatctaagaaggtatttcttaacaaagctgctgatttcatcgaagagttgagctctctattcaagtcccacagttccaaacgcatccgtccccgggcgtgtaaaaaccacaagagcaaactggagtcacagaataaggttatgcaggaaaactcctctagcttcagcgatctatcagagcgaagggaacgatcttcagtgcccatccccatcccggctgacactagagataatgaagttaaccacgccctggagcagcaggaggccaagcgcagagaggcggaacaggctgcaagcgaggccgcgggcggcgacaccacgcctggatcctctccttccagcctctactatgaagaaccgctgggccagcctccaagattcacccagaagctgagaagtagagaggttccagaaggaacccgagtgcaactagattgcatcgtcgtggggattccccctccacaagtcaggtggtactgtgagggtaaagagctggagaactctccggacatccacatagtgcaggcagggaacctgcacagcctgacgatcgccgaggccttcgaggaagacaccgggaggtattcatgctttgcatcgaacatctatggcaccgactccacatctgccgagatctatatcgagggcgtaagcagctccgacagcgagggggacccaaataaggaagaaatgaatagaattcaaaagcccaatgaagtgagctccccccccaccacctctgcagttatcccccccgctgttccccaggcacagcacttggtagctcagcctcgggtcgcaaccattcagcaatgccagtcccccacaaactatcttcagggactggatggcaagccgattattgcagcaccggtgtttaccaagatgttgcagaacctctctgctagcgagggacaactggttgtgtttgaatgccgggtcaagggagccccttcccccaaagtggaatggtatagggaaggcaccctgatcgaggactccccagatttccgcatcctgcaaaaacggccagtttgtatggagcatatagaagagatttgcacgctggtcatcgccgaagtattcgcagaggacagtggatgtttcacctgcacagcaagtaacaagtacggaacagtctcgtccatagcccagctgcatgtacgcggaaacgaggacttgagcaacaatggttctctgcactccgcaaatagcactactaacctggcagcaattgaacctcagccatccccaccacactcggagcccccatcagtcgagcaacctcctaagcctaagctagagggtgttttagtcaaccacaatgaacctcgatcatcctcccggatcggtcttagggtacattttaatcttcctgaggacgacaaaggcagtgaggcctcatccgaggcaggagtcgtcactactagacaaacaaggcccgattccttccaagagcgctttaatggccaggccactaagactcccgaaccaagttctcctgttaaggagcctcctcctgtactggctaagcctaaactcgattcaactcagctgcagcagctccataatcaggtactcttggaacagcatcagctgcaaaaccccccccctagctcacccaaggagtttcccttctctatgacagtgctaaatagcaacgctcctccggctgtcacaacgagcagcaaacaggtaaaggccccatccagtcaaactttctctctggcaagacctaagtatttctttcccagtaccaacacaaccgctgccactgtggccccatcatcttcacccgtgttcaccttatctagtacccctcagacaatccagcgaaccgtttcgaaagaatccctgttagtgtctcatccctctgtgcaaacaaaatcacctgggggacttagtatccagaacgaacctcttccaccaggccccactgagcccactccccctccttttacctttagcattccttctggaaatcagtttcagccccgttgcgtgtctcctattccagtgagtcctacatcaagaatccagaatcctgtcgcttttctgtcttccgtgttaccttccttgccagccattccccccactaacgcaatgggcctacctcgttcagccccttccatgcccagccagggcctcgctaaaaagaatactaaaagtccccagccagtgaatgatgataatataagagaaactaaaaacgcagtaatacgggatctggggaaaaaaatcacattttccgatgttagaccaaatcaacaggagtacaagatctcttccttcgaacagagactcatgaacgagattgaattccgacttgagaggactccagtggacgagtccgatgatgaaatccagcacgacgaaatccccaccgggaagtgtatcgcccctatttttgacaagaggcttaagcactttagagtgacagagggatcccccgtgacctttacttgtaagattgtggggatccctgtaccaaaagtgtactggttcaaagacggcaagcagatttctaagagaaatgagcattgcaagatgcgtagagagggggacggaacttgcagtctgcatatcgagtccacaacttcagacgacgatggaaactatacaattatggccgctaatcctcaaggccgcatatcttgctccggccaccttatggtacaaagcttgccgatccgaagccgcctcacttcagccggccaatcacaccggggccggtcaagagtgcaggaacgcgacaaggagcctttgcaggagaggttcttccgaccccattttctccaagcacctggggatatggtggcacacgagggccggctgtgtaggctcgactgcaaggtgtccggcttgccgcccccggagttgacctggcttctcaacggacagcccgtgcttcccgatgcttcccataagatgctcgtacgagagaccggggtgcactccctactgatcgaccccctcacacaaagagatgctggtacctataaatgtattgcaacgaataagaccggccaaaacagtttcagcctggaactgagcgtggttgccaaagaagtcaagaaggctccggtgatcctggagaagttgcagaactgcggcgttcctgaaggccacccagtcagacttgaatgtagggtgattggaatgccccccccagtattctactggaaaaaagataacgagaccatcccttgtaccagagagcgcatttccatgcaccaagataccacaggctacgcctgccttcttatccagccagcaaagaagagcgatgccgggtggtatactctatccgccaagaacgaggctgggatcgtgagctgtacagcacgccttgacatttacgctcagtggcaccaccagatccccccacctatgagcgtccgcccgagtggcagcagatacggctctcttacttcaaaaggtctagacatattttcagctttcagttctatggaaagcaccatggtctactcttgttcctccagaagcgtagttgagtctgatgaattatag

SEQ ID NO: 26911 - DNA, 2292 bp, Artificial Sequence
  Description of Artificial Sequence: Synthetic coding sequence
atgcaggacctgggcgacaagctgcggatgatcgtgatgggccaccgacgggtccatatctctcgtcaattggaagttgaacccgaggagccggaggccgagaataagcataaaccacgtagaaaaagcaaaaggggcaaaaaggaggcggaggatgaactgtccgccaggcacccagctgaactggctatggaacctacccctgaactgcctgcagaagtcctgatggtggaggttgaaaatgtagttcatgaggattttcaggtgactgaggaagtaaaggctctgactgcagagatcgtgaagaccattagagatatcattgccttaaaccctctgtatcgcgagtcagtactgcagatgatgcaggctggccaaagagttgtggacaatcctatctacctttctgacatgggggcagctctgactggggccgaaagtcacgagttgcaagacgtcctcgaggaaaccaacattcctaaaaggctctataaagccctgtccttactaaaaaaagagttcgagctctctaagctgcagcagcggctcggccgtgaggtggaggaaaagataaaacagactcatcgtaagtatttacttcaggagcagctgaaaataatcaagaaggagcttggcttagagaaagacgacaaggacgctatagaagagaaatttcgggagagactcaaagagttagttgttcccaagcacgtcatggatgtggtggacgaggaattgtcaaagcttggcctgctcgataatcactcatctgagtttaacgtgactcgaaattaccttgattggctgacttccatcccatggggtaaatattctaatgagaacctcgatctcgcaagggcccaggccgtgcttgaggaagaccattacgggatggaggacgtgaagaagcgaatcttagagttcatcgccgtctctcaactgcgtggcagtacccagggcaaaatcttgtgtttttacgggcctccaggggtcggaaagacatctattgcccgatcaatagctagagcactcaacagggagtattttaggttttctgtcgggggtatgaccgatgtagctgaaattaagggacaccgacgcacctatgttggggccatgcctggcaagatcatccagtgtttaaagaagacaaaaaccgaaaaccctctgatactgattgacgaagtggataagatcggtcggggttatcagggtgacccttctagcgcactgctggagttactggatcccgaacagaatgccaactttctggaccactacttagatgtcccggtggacttgtcaaaggtgctctttatctgtacggccaacgtcactgacaccattcccgaacccctcagggatcgcatggagatgataaatgtctctggctacgtcgcccaggaaaaattggctattgctgagcgctacctggtgccccaggccagagctctttgcggcctggacgagtctaaagcaaaattgtcaagcgatgtcctgactttactgattaagcagtattgtagggagagcggcgttaggaatctacagaagcaggtcgaaaaggtcctccgcaagagcgcatataaaatagtgagtggtgaggcggagtcagtcgaggtgacccctgaaaacctgcaggattttgtgggtaagcctgtcttcaccgttgaacggatgtatgacgttacgccaccaggggtggtgatgggtttagcttggactgctatggggggatctaccctgttcgtcgaaactagcctgaggagaccgcaggataaggacgccaagggtgataaagacggctctctcgaggttacaggacagctcggagaggtgatgaaagaaagcgcgcggatagcatatacgttcgctagagcctttttgatgcagcacgcccccgccaacgactacctggtcacgagtcacattcaccttcatgtgcccgagggtgccactccaaaggacgggccttcagctggttgcacaatcgttacggcgcttctgagtctggccatgggaaggcccgtgcgccagaacctcgcaatgactggcgaggtgagtttgaccggtaagatcctgcccgtggggggcatcaaggaaaagaccatcgccgctaagcgcgccggagtgacctgtatcgtgctacccgcagagaacaaaaaagatttttatgacctcgctgctttcatcacggagggactggaggtgcatttcgtggagcactatcgcgagatcttcgacatagcattcccggacgaacaggccgaggcacttgctgtcgagcggtag

SEQ ID NO: 26912 - DNA, 558 bp, Artificial Sequence
  Description of Artificial Sequence: Synthetic coding sequence
atgaacaacaaccagatcgtggccaaggacctgcaggacgagaagatcttgtaccctgaattcaacaaacttaaggagcgaaacagagagctgaaaacacttctgagcattggagggtggaatttcggcacttccaggtttacaaccatgttgagtacctttgcaaaccgtgagaagttcattgccagtgtgatatccttactgcgtacccacgactttgacggactcgacctttttttcttatacccaggacttcgtggctcccccatgcacgatcgctggacattccttttcctgatcgaggagctgctgttcgccttccggaaggaagccctcctgactatgcgtccccgcctgctgctgtccgctgctgtgagcggcgtgccgcatatcgttcagacttcctacgatgttaggtttttgggacgtttcgtgcccttgagtggagagcggcggtctacagggcttatcacttccatgtcccgtatgcccacccgtggtaagtctgggttggccatgacgatgccttccgcctccgtcaccaggcacggtttatag

SEQ ID NO: 26913 - DNA, 1269 bp, Artificial Sequence
  Description of Artificial Sequence: Synthetic coding sequence
atgagcggcggcaccccctacatcggcagcaagatcagcctgatcagcaaagccgagatacgatacgaaggtatcctgtacacaatagataccgagaattccacagttgcactcgccaaggttaggtcttttgggacagaggatcggcctacggaccgcccaattccaccaagggatgaagtcttcgagtacattatctttcgcggcagcgacatcaaggatctcacagtctgcgagcctccaaagccgcaatgtagcctgccacaagatcctgcaattgtgcagtcctctctgggctcctctacgtcgagctttcagtcaatgggtagttatggtccatttggaaggatgccaacatactcccagttctccccctcctccctggtcggtcagcagtttggggccgtcggcgttgggaggtcaagcccgcagctggacccactcaggaaaagccctactatggaacaggcggtgcagacagcatccgctcaccttccagcacctgccgctgttgggcgccgctcccccgtttcaacgcgccccttgccctctgccagccagaaggccggggagaatcaagagcatagaagggccgaggttcacaaggtgtccaggccagagaacgagcagctccggaacgacaataagcgccaagtcgcacctggggccccttccgcacctagaagaggcagaggaggacaccggggaggccgcggccgatttggtatccggagagacggtccgatgaagttcgaaaaggacttcgattttgagtctgccaacgcccagttcaataaagaggaaattgatagagagttccataacaaactcaagctcaaagaggataaattggagaagcaagagaagcccgttaatggtgaggacaaaggtgactctggcgtggatacgcagaacagcgaaggcaacgccgacgaagaagacccactgggacccaattgctattacgataagacgaaaagctttttcgataacataagttgcgacgataatcgggagaggcgcccgacgtgggctgaggagcgccgactgaacgctgagacctttggaattccactgcgtcctaaccgggggagaggaggctatcgcggcagaggcggactgggatttaggggcggaagagggcgaggaggcggcaggggcggaactttcacggctcctcggggcttcagaggggggttccggggaggcagaggtggccgtgagtttgctgattttgagtaccggaagaccacggcctttgggccctag

SEQ ID NO: 26914 - DNA, 1266 bp, Artificial Sequence
  Description of Artificial Sequence: Synthetic coding sequence
atggccagcagcagcgtgccccccgccaccgtgagcgccgccaccgccgggccagggcccggtttcgggttcgcatctaagacgaagaaaaagcatttcgttcaacagaaggtgaaagtgtttagagcagctgatcctctggttggtgtgtttttatggggggttgcgcactcaataaacgaactcagccaggtccctccgcccgtgatgctgctgcccgacgacttcaaagcttcttccaagattaaagtgaacaaccacctattccatcgcgaaaatcttcccagccacttcaaattcaaagaatattgcccccaagtatttcgcaatctgagggatcgcttcggaatcgacgaccaggattatctggtttccctcactagaaaccccccttccgaaagcgagggatctgatggacggtttctaatttcttacgacaggacactcgtgataaaagaggtatctagcgaggacatcgccgacatgcacagcaatctctccaactatcatcaatatatagtgaaatgtcacggcaacaccctgctcccacagttcctcggcatgtacagggtatccgttgacaatgaagactcctatatgcttgtcatgcgcaacatgttttctcatagattgcccgtccatcgcaaatatgatctgaagggcagtttagtgtctcgcgaggctagcgataaggagaaagttaaagaactccctaccctaaaggatatggattttctaaacaaaaatcagaaggtttatataggcgaggaagagaaaaaaatttttttggaaaagttaaagcgcgatgtggaattcctcgtgcagctaaaaataatggactacagtctgttattgggcatccacgacattatcaggggctctgaacctgaggaggaagccccagtccgcgaggatgaatcagaggtcgatggcgattgttctcttactgggccaccagccctggtgggttcctatgggacatccccagaaggtatcggcggttatatccactctcataggccactcggccccggagagtttgaatctttcatcgacgtctacgccatcagaagtgcagagggcgctccacaaaaagaggtttactttatgggcctaatcgacatcctgacccaatacgacgccaaaaagaaagccgcccacgctgccaagaccgtgaaacacggcgctggtgccgagatcagcaccgttcaccccgaacaatacgcaaaaagatttctggacttcattacaaacatattcgcatag

SEQ ID NO: 26915 - DNA, 756 bp, Artificial Sequence
  Description of Artificial Sequence: Synthetic coding sequence
atggacagcgagctgatgcacagcatcgtgggcagctaccacaagccacctgagagagtctttgtgcctagctttacacaaaatgagccatcccagaactgtcatcccgccaacctagaagtgaccagccctaagatattgcacagccccaattcccaggccctgattctcgcactgaagaccctgcaggagaaaatccacaggctggagctggagcggactcaggcagaggacaacctgaacatcttatccagagaggctgcccagtataagaaggctttggaaaatgaaaccaacgaaagaaatctcgctcatcaggagctgatcaagcagaaaaaagacatcagcattcaactgtcatctgcccaatctaggtgcactctgcttgagaaacaactggaatatactaaacgcatggtcctgaacgtagagcgggagaagaatatgatcttggaacaacaggcccagctacaacgcgagaaagaacaagaccagatgaaactctatgccaagctggagaaactggatgtccttgagaaagagtgtttccgattaaccacgacccagaagactgctgaggataaaattaaacacctcgaggaaaaattaaaggaggaggagcaccagcggaaattgtttcaagataaggcatcagaactgcagactggtctggaaatctccaaaataattatgtcatccgtttccaatctgaagcactctaaagagaaaaagaaatcgagtaaagtgtgtatctag

SEQ ID NO: 26916 - DNA, 1980 bp, Artificial Sequence
  Description of Artificial Sequence: Synthetic coding sequence
atggacagccagggccgggtgtgggcccaggagatgctgctgcgggtctcccccgatcatgtgacactgctggatccggcttcgaaggaagagctggaatcctatccgttgggcgccattgtgaggtgtgacgcagttatgcctcctgggcgatcgagatccctgctcctcttggtgtgccaggagcctgagagagcacagcctgatgttcatttctttcaggggctgcgcctgggcgccgaactgatccgggaggacattcagggagcgttacataattaccggagtgggaggggcgagcgccgggccgcagcattgagggctacgcaggaagaactgcagcgggacagatcacccgctgcagaaacacctcctctacagagacggccatcagtgcgcgcagtgatctccactgttgaacgcggcgccggtcgcggtagacctcaggcgaagccgatacctgaggccgaggaggctcagagacccgaacctgtggggactagtagtaacgctgactcagcttctcctgacttagggccacgagggcctgatcttgctgtgctgcaggccgagcgggaagtagatattctcaaccatgtgttcgacgatgtggagagcttcgttagccggctgcagaaatctgccgaagcagcgcgcgtgctcgagcacagagagaggggacggagaagtaggcggcgcgccgctggggagggactgctgaccttgcgggctaagccacccagcgaagccgagtacacggatgtgctgcaaaaaataaagtacgcttttagtttgctggcacgactgagaggcaatattgctgacccaagctctccagagttgttgcatttcctctttggaccactgcaaatgattgttaacactagcggcggccctgagtttgcttcaagcgttcgtaggccacatctgaccagcgatgctgtggctctgctaagggacaatgttacgcccagagagaacgagttatggacctccttgggagatagctggaccaggccaggacttgagctgtctcccgaagagggaccaccctatagacccgaatttttttctggttgggaaccacctgtaaccgaccctcagtcaagagcctgggaggatcctgttgagaagcaactgcaacacgagaggcgccgacggcaacagagcgccccccaggtcgcggtcaacggtcatcgcgatttagagcctgagtcagagccacagctagagtccgaaacagccgggaagtgggttctctgtaattacgatttccaggccagaaattcatccgagttgtccgtgaagcaaagagacgtactcgaggtccttgatgatagtaggaagtggtggaaagtgcgcgatccagcaggccaggagggttacgttccatacaacatcctgaccccgtatccaggcccaaggctgcaccattctcaatccccagccagatctcttaatagcactccaccccccccaccggcccctgcacccgcgccaccacctgctctggctagacctcgctgggacagaccccgctgggacagctgtgactctttaaatggccttgacccttccgaaaaagaaaaattttctcagatgttgatagttaacgaagaactgcaagctcgtctggcacaaggtagaagtggacctagcagggccgtgcctgggccaagggcaccagagccccagctgtcacctggaagtgacgctagtgaggtcagggcctggctgcaagcaaagggcttttcaagtggcacagtggacgccctgggggtgctgactggtgcccagctgtttagccttcaaaaggaagaactacgagccgtttctccggaagagggggccagggtgtattcccaggtgaccgttcagcggagccttttagaggacaaagagaaggtgagcgaactggaggcagtgatggaaaagcaaaagaagaaagtggagggagaggtggagatggaggtcatctag

SEQ ID NO: 26917 - DNA, 3702 bp, Artificial Sequence
  Description of Artificial Sequence: Synthetic coding sequence
atgaacaccaagaagcggggcagccccgcccggacccacagcatgatgtcacttagcgtgcgtccacagagacgcctgttaagtgctcgagtcaacagaagccagtctttcgccggagttctgggcagccacgaacgggggccacgtagttttcctgtgttcagtcccccagggccccctcggaaacctccagccctgtccagggtgtcccggatgttctccgtggcccacccagccgcgaaggtcccacaacctgagagactggacctcgtatatacagctctgaaacgggggctgactgcctatttggaggtgcaccaacaggagcaggagaaactgcagggccaaatccgggagagtaaacgcaacagcagactgggcttcctctatgatctggacaaacaggtcaagtcgattgaaaggttcctgcggcgccttgagttccacgcttctaagattgacgagctctatgaggcctattgtgtgcagcgaaggctccgggatggagcctacaacatggtacgagcttacaccacgggcagccctgggagcagggaggctcgcgattcccttgcagaagcaacccgtggccatcgggaatacacggaatccatgtgccttctcgaaagcgagctggaggctcagctcggggagttccacttgcggatgaaaggcctcgctggtttcgcccggctgtgtgtgggagaccagtatgagatctgcatgaagtacgggaggcaacggtggaagttgcgggggaggatcgaaggaagcggaaaacaggtgtgggactcggaagagactatattcttacctctcttaaccgagttcctgtcaatcaaagtcaccgaactgaagggcctagccaaccatgtagttgttggaagcgtgtcttgtgaaacgaaggacctcttcgcagccttgcctcaggtagttgccgtcgacatcaacgacctcgggaccatcaagctgtcacttgaggtaacctggagcccattcgacaaggatgaccagcctagcgccgcctcctccgtgaacaaggcgagcacagtaaccaaacgattctcaacttacagccaaagccctccagacaccccctccctgcgcgaacaagcattttacaacatgctgagaaggcaggaagagctggagaacgggaccgcctggagcctctcgtccgagtccagtgacgacagcagctcacctcaattgtcgggaacagcacgacacagtccggctccccggcccctggttcagcagccagaaccactgccaatacaggtggccttccggagacccgaaactccaagttcaggcccactcgatgaggagggcgccgtggcaccagttctggctaatggtcacgctccatacagtaggaccttgagccacatttctgaagcctctgtcgacgccgccctggctgaagcctcggtggaagccgtaggccccgagtctcttgcttgggggccttcccctcccacacatcccgcgcccacacacggagagcatccaagcccagtgccacctgcattagaccccggacacagcgcaacttccagcactctaggcaccaccggcagtgtcccaacatccactgatccagcgccttcagctcacttggatagcgttcacaaaagtactgacagcggccccagtgagctaccaggtcccacccacacaaccactggcagtacatactccgccatcaccacaacccactctgcaccatccccattaacacacactactaccgggtccacccataaaccaatcatcagtactctcacaacaacagggcccactctgaatattattggacctgttcaaaccaccacatctcccacgcatacgatgcctagtcccacccatacgaccgcatctcccacacatacttctacctctccaacccacacgcctacatcgcctactcataagacgtcaatgtccccccctacaacgaccagcccaacgccgagcggcatggggctggtgcagactgcaacatcacctacacatccgacaaccagtcccacccaccctactacttcccctattctcataaacgtctcccccagcactagcttggagctagctacactgagctctccatccaagcattctgaccctactctgcctggaaccgactctctgccttgtagcccccctgtgtcgaattcttacacacaggcagacccaatggccccacggacgcctcaccccagcccagcacactccagccgaaagcctctaacatctccagcaccagacccaagcgagtcaactgtccaatcgctgagtccgactccatctccacccacacccgcgcctcagcattcagacctttgcctggccatggccgtgcagactcctgtaccgacagctgctggcggcagcggtgaccgctctctggaagaggctttgggcgccctgatggcagcactcgacgactaccgtgggcaattcccagaactgcagggtctggagcaggaggtgactagactggagtccttgctcatgcaacgccagggtttaacaaggagcagagctagttccctgtccatcactgtggagcatgctctggaatctttttctttcctgaacgaagatgaggatgaggacaacgacgtgccgggcgataggcccccgagcagccccgaagcaggcgcggaagattcaattgatagtccaagtgcacggcccctatctacgggatgtcctgcactcgacgccgctctcgttcgtcatttataccattgctcccgcctgctgctgaagctgggaactttcggtccccttcgctgccaggaagcttgggctcttgaacggctcctgcgggaagcgcgtgtgctcgaggctgtctgtgaattctccaggcgctgggagatcccggcttcatcagcccaggaagtagttcagttttctgcatctcgcccgggcttcctcaccttttgggaccaatgcaccgagcgactgtcctgtttcctgtgccctgtggaaagggtgctcctgacattctgtaaccagtacggggcccgcctatccctgcgacaaccggggcttgccgaggccgtttgcgtgaaattcttagaggatgctctgggccagaagctaccgagacggccacaaccaggcccaggtgaacaactcacagtgtttcaattctggtcctttgtagaaacgctcgactcccctacaatggaagcttacgtaactgaaacagcggaggaggtcctgctggtccggaacctgaactccgatgaccaggccgttgttctcaaagccctgagactggcccccgagggccggctgagacgtgacggcctgcgcgcgctgtcttctctgttggtccatgggaataacaaagttatggctgctgtgtcgacccagctgcgatctctgagcctgggacccacattccgcgaaagggccttgctgtgcttcttagaccaattggaggacgaagatgtgcaaacaagggtagcaggttgcctggccttggggtgtatcaaagcccccgaaggcatcgagccactcgtttacctgtgccagacagacacagaggccgtgagggaggccgcccgccaatctttacagcagtgtggagaagagggacagtcagcacaccggagactcgaggagtctcttgacgctctgcctcgaatcttcggacctggcagtatggcatccaccgcattctag

SEQ ID NO: 26918 - DNA, 1428 bp, Artificial Sequence
  Description of Artificial Sequence: Synthetic coding sequence
atggaccagatggtgcagcaccccgccgccaagatgatcgtgatggccagccacatgcaggaacaggaagttggagacggcacgaatttcgtgctggtgttcgcaggcgcactgctggaattagcagaggaactgctgagaattggcctgtctgtgagtgaggtaatcgagggttacgaaatcgcctgtcgaaaagcacatgagattttgccgaacctggtgtgctgttctgccaagaacctcagggatattgacgaggtttcgagtctgctgcggacgtcaatcatgagtaagcagtatggaaacgaagtgtttctggcgaagctcatagcccaggcatgcgtaagtatttttcccgactccgggcatttcaatgttgacaatattagggtgtgcaaaatcctgggatctggaatcagctcctctagcgttttgcacgggatggtcttcaagaaagaaacggagggtgatgtaacatcagtcaaagatgccaaaattgcagtctattcctgcccttttgatggcatgattacagaaactaaagggacggtcctgatcaaaactgccgaggagctgatgaacttcagtaagggcgaggaaaaccttatggatgcacaagtgaaggcaatagcggatacgggtgccaatgtggtagtcacgggggggaaggtggccgacatggccttgcattatgccaataaatacaatatcatgcttgtgcggctgaacagcaaatgggacttgaggcgactgtgcaaaactgttggggccacagcccttccccggctgactcctccagtactggaggagatgggacattgtgattccgtctacctgagcgaagtgggtgatacccaggttgtcgtttttaaacatgagaaagaagatggcgccatctccactattgtgcttcggggatccaccgacaatttgatggacgacatcgagagagcagtagatgatggcgttaatacatttaaggtattaacccgggacaaaagactggtccctggcggaggagcaacggagatagagctggcaaaacagattacgtcttacggggagacatgccctggccttgagcagtacgcaatcaaaaagtttgctgaggcattcgaggccataccaagggccctggctgagaacagcggtgtgaaggcaaatgaagtcatttctaagctctacgccgtacaccaggaaggtaacaagaatgttggtctggacattgaagctgaagttcctgctgtgaaagacatgctcgaggcagggatcctagatacatacctggggaaatattgggccatcaagctggctacaaatgccgcggttacagtacttagagtggaccagattattatggccaagcccgccggtggtcctaagcccccatctggcaagaaggactgggacgatgaccagaatgattag

SEQ ID NO: 26919 - DNA, 1626 bp, Artificial Sequence
  Description of Artificial Sequence: Synthetic coding sequence
atgcgggccctgctgcacaagcccgagatgatcaagcagatcctgccggaacacagcgtcctccagaatataaactttgtggaagccttccaggatgagctgctggtgaccgaggtatacgatctgccccagagacctaacgatgtgcagctgttctatggaagcatgtgtaaaatcatattgagcgtgataggcgaatttagggattgcatatcctcccgggaatttcttcaaccaagtagcaaagcaagcttagaaagtacctccgaccttggtgcaagtgggaaacacggcggtaatgtaagcctggacgtgctgccagttaaagggccccagggcagtccactgttgtcccgcgccgcccggccacctctggatcagctcgcttcagaggaaccttggacggtgctccccgagcatttgatcttggtggccccctccccttgcgatatggccaagaccggtcgattccagattgtaaacaatagtgtcaggctattgaggttcgagctctgttggccagcacattgtctgacagtcacaccgcaacatggatgcgttgcaccagagtctaaactccagattctggtcagccctaactcttctttaagcaccaaacagagcatgtttccctggtcaggcctgatctatattcactgcgatgacggacagaagaagatcgtcaaagttcagattcgcgaggacctgacacaagtggaactgctcacgagactaaccagcaagccgtttgggatcctgtctccagtttccgaaccaagtgtgtctcacctcgtcaaacctatgacaaagcctcccagcaccaaagtggaaatcagaaataagtctattacattccctacaaccgagcccggagagacaagcgagtcatgcctagagctggaaaaccacggtacgaccgacgtgaagtggcacctttctagtttggcacccccgtatgtcaagggggttgacgagtctggggacgtctttcgcgcgacctatgctgccttccggtgtagccctatatccggtctgctggagtctcatggtatccagaaggtgtccattacattccttccaaggggtaggggcgattacgcccagttttgggacgtcgagtgtcaccctctgaaggagccccatatgaaacacactctgcgcttccagctgtcgggtcagtccattgaggcagaaaatgaaccagaaaatgcctgcctgtccacagatagcttgataaaaatcgaccatctggtgaagccccgccggcaggccgtctcggaagcctcagctaggatccctgagcagctcgatgtgactgcacgaggtgtatacgcgccagaggatgtgtataggttccggcctactagtgtaggcgagtcaagaactctgaaagttaatctccgtaacaacagcttcatcacacatagtctcaaatttctctctccccgcgaacccttctacgttaagcactcaaaatacagcctgagggcacagcactatatcaatatgcccgtgcagtttaagccaaagtctgccggaaagttcgaagccttgcttgtgattcagaccgatgaagggaagtccatagccattaggctaataggcgaagcactcggaaagaattag

SEQ ID NO: 26920 - DNA, 1737 bp, Artificial Sequence
  Description of Artificial Sequence: Synthetic coding sequence
atgagcagcaagggcagcagcaccgacggccggaccgacctggccaacggttctctctccagtagccccgaagaaatgagcggtgctgaggaaggacgggaaacgagcagcgggatagaggttgaagcatcagacttgtcacttagtctcaccggggatgacggtgggcctaaccggacttctatggaggatacgggacattactcaattaatgacgagaatagggtgcatgaccgcagtgaggaggaggaggaggaggaggaggaggaggaggaggaacagcctcgtagacgggtgcagcgtaagagagctaatcgggatcaggatagctctgatgacgagcgggccctggaagactgggtttccagtgagactagcgccctgcccaggccccgttggcaggcgctccctgcacttagagagcgagaactgggatcctccgctaggttcgtgtatgaggcatgcggtgccagggtgttcgtgcagagatttcggctacaacacggcctggaaggccacactggctgcgtgaacactctccactttaatcagagggggacatggctggctagcggtagcgacgatctaaaggtggtggtttgggattgggtgaggaggcaacctgtgctggatttcgagtcaggacataaatctaatgtgtttcaggcaaagtttctgcctaatagcggcgattccaccctggcaatgtgtgctagagatggacaggttcgcgtggcagagctgtccgccactcaatgttgcaagaataccaaaagggtggcacagcacaaaggggcctcccataagctggcgctcgagccagattcaccctgtacctttctgagtgcgggcgaagatgccgttgtgtttaccatcgatctgaggcaggatcgaccggccagcaagttggtggtgactaaagagaaagagaagaaagtcggcttatacaccatctacgtcaatcctgctaacactcaccaattcgccgtgggcggccgggaccagttcgttcgaatttatgatcagcgcaaaatcgatgaaaatgagaataacggggtgctcaagaaattctgtccccatcatcttgtcaatagtgagagtaaggccaacatcacctgcctagtttactcacatgatggtaccgaactgctggcatcgtacaatgatgaggatatctatctatttaacagcagccattcagatggggcccaatacgtgaaacgatataagggccacaggaataacgccacagttaaaggagtgaacttttatggccccaagtcagagtttgtagtgagcggttccgattgtggacacatctttctgtgggaaaagagttcttgtcagattatccagttcatggaaggggacaaaggcggtgtggtgaactgtctcgagccacacccccacctccctgtactagccacatcgggacttgatcatgacgtgaaaatctgggctcctacggctgaagcatccacagagctgaccggtctaaaagatgtaataaagaagaacaagagggagcgtgatgaggattctctgcaccagactgacttattcgactcccacatgctttggtttcttatgcaccacctgcgacagcgtaggcaccacaggaggtggagggaacccggggtgggagcaacagatgccgacagcgacgagtcaccgagctcgtccgacacttcagacgaagaggagggccctgacagagtccagtgtatgccctcctag

SEQ ID NO: 26921 - DNA, 426 bp, Artificial Sequence
  Description of Artificial Sequence: Synthetic coding sequence
atgggcggcaagccccggcacagcctgtacttcatcggctaccaggacgacttcctgctatatctagatcctcactattgtcagcccactgtggacgtgtcccaggctgactttcctctcgaatcctttcactgtacatctccacgcaagatggccttcgccaagatggatccgtcgtgcactgttggattttacgccggggatagaaaggaattcgagaccctctgttccgagctcactcgtgtgctgagttcttcctcagctactgagagatacccaatgtttacactcgccgaagggcatgctcaggatcactcattggacgacctctgctcccagctggctcagcctacactgaggctcccacgtacaggacgcctcctgagggccaagagaccaagctctgaagactttgtgtttttatag

SEQ ID NO: 26922 - DNA, 570 bp, Artificial Sequence
  Description of Artificial Sequence: Synthetic coding sequence
atggtgctgctgcacgtgaagcggggcgacgagagccagttcctgcttcaggctcccggaagcacagagctggaagaactcactgtgcaggtggcacgcgtttacaatggtcggcttaaagtccagaggttgtgtagtgcaccaaacgagaagatgaagcaggtgctcaagaagaccatcgaagaagctaaggccattatttcgaaaaaacaagtggaggccggggtgtgcgttactatggagatggtcaaggatgccctggatcagctgcgaggcgccgtcatgatcgtgtaccccatggggctgccgccctatgatccaatcaggatggagtttgagaataaggaagatctgtccggcacacaggcggggctgaacgttattaaagaggctgaagcccagctctggtgggccgcaaaggagctcaggcgcaccaagaaactatccgactatgtcggtaaaaacgaaaaaacaaaaatcatagcaaagatccagcaggtgtcaaccttttgcttcaatgtgtccgtggtgtttgtgatctcgcttcagacagacaaaaacgtccagtag

SEQ ID NO: 26923 - DNA, 2031 bp, Artificial Sequence
  Description of Artificial Sequence: Synthetic coding sequence
atggccgccatccagcacggccacgaggccgtggtgcggctgctgatggagtggggggccgaccccaaccacgccgcaagaactgtgggctggtctcctcttatgctcgcagccctgacaggtcgcctcggggtcgctcaacagcttgtggagaagggagccaatcccgaccacctgtcagtgctggaaaaaacggcatttgaagttgcattggattgcaagcatcgtgatcttgtggattacttggatccattgaccacagtcaggcctaagaccgatgaggagaaacgacgccctgatatttttcatgcgctgaaaatgggcaacttccagctagttaaagagatcgcagacgaggatccgagccatgtcaatctcgtgaacggtgatggagccacccctctgatgctggctgctgtcaccgggcagctcgcgctggtccaactactagtcgagcgacacgcagatgtggacaagcaagatagcgtgcatggctggacagccctgatgcaagcaacctaccacgggaataaggagattgtgaagtatctcctcaatcagggggctgacgtcactttgagggctaagaacggctatactgcttttgaccttgtgatgctcttgaacgatccggataccgagctcgtgcgcctactggcatctgtctgcatgcaggtcaataaagataaaggtcgaccatcacatcagcctcctttaccccatagcaaggttcgtcaaccttggtctattccagtcctgcctgacgataaggggggtctcaagtcttggtggaacagaatgagcaatcgcttcaggaagctgaagcttatgcagacattgcctaggggcctgagcagcaaccaaccgcttccattttcagacgagcctgaaccagcactcgatagcacgatgagagccgctccacaggataagacgtctcgttctgcactgcccgatgcggccccagtcacaaaggacaacggcccgggcagtaccaggggagagaaggaagacactctgctgacaacaatgctgcgcaatggggcacctctgacgaggctgccctccgataaactgaaagcagtgatacctcccttcttacccccatcttcctttgaactatggtcttctgataggtcacggacccggcataatggcaaagccgatcctatgaagacagctctgcctcagagggctagtcgcggccatccagtgggcggcgggggcaccgatacgactcccgtccgacccgtgaaatttccctccctgcccagaagtcctgcctctagcgccaactctggcaacttcaaccatagtccgcattcatcaggaggatcctcaggcgtgggtgtatcgcgccacggcggcgaacttttaaaccggtccggtggctccatagacaacgtgctcagccaaattgccgctcagcggaagaaagctgcaggactgttggaacagaagccatcacataggtcctcccccgtcggcccagccccaggatctagtccctctgaactccccgcgagccctgctggtggctctgcccctgtgggcaagaagctggagactagcaagcggccgccatccggcacatccactacctcaaagtcaacctctccaaccttgaccccttcacccagccccaagggtcacacggcggagagctcagtatcttcatcctcgagccacaggcagtctaaatcatcaggcggatctagttctggtaccattacggacgaggacgaattgacaggtatcctgaagaaactctccttagagaagtaccaaccaattttcgaagaacaggaagtggacatggaggcctttctaacccttaccgacggggatctcaaggaactggggatcaaaactgatggctctcgccaacagattctggccgccatctctgaactgaatgcgggcaaagggagagagcgacagattttgcaggagactatccacaactttcactcttcttttgaatcttctgcatccaacactcgcgcccccggtaacagcccatgtgcatag

SEQ ID NO: 26924 - DNA, 2319 bp, Artificial Sequence
  Description of Artificial Sequence: Synthetic coding sequence
atgcggcaccagaagcggaacgtgtaccactgcaacaagtgccggctgcagtttctatttgccaaggacaagatagagcataagctgcaacaccataagacatttcggaagcctaaacaacttgagggcctcaaacccggcacgaaagtgacaatcagggcgagcagagggcaaccccgtaccgtccccgtgtcctcaaacgacacgccgccgagcgccctgcaagaggcagccccactgacaagctcaatggatccgctgccggtgtttctatacccccccgtgcagaggtcaatacagaaaagggctgtgcgcaagatgagcgtaatgggaagacagacttgcctggaatgttcatttgagattcccgatttccctaatcattttcctacttatgtacactgctccctctgtcgatacagtacttgttgcagtagggcatacgccaaccatatgataaacaatcatgttcccagaaagtctcccaagtaccttgccctattcaagaattccgtttctggaatcaaacttgcctgtacttcctgcaccttcgtgaccagcgtgggcgacgccatggctaaacacctagtgtttaacccaagccatcggtcctcaagtatcttaccgcggggcctaacttggattgctcattccagacatggccaaactagagatcgcgtccacgacaggaatgtaaagaacatgtacccacccccaagctttcctactaacaaagccgccaccgtgaaaagcgcaggagcaaccccggctgagcccgaggaactcctgaccccactggccccagctctaccatcaccagcctctaccgccacaccccccccaacaccaacacatccccaggccctggccctccccccactcgctaccgagggcgcggaatgtttaaatgtggacgatcaggatgaggggtccccagtgacacaggagcccgagcttgctagcggaggtggcggcagcggaggagtgggcaaaaaggaacaactgtccgtgaaaaagcttcgcgtcgtgctttttgcactgtgctgtaataccgagcaggcagcggaacacttccggaatccccagcggcgcattcgacgttggttgcgccgctttcaggcgagtcagggagagaatctcgaagggaaatacctgtcattcgaagccgaggaaaaactagcagaatgggttctaacccagcgcgagcagcaactgccagtcaacgaggaaacgctcttccagaaggctacaaagataggacgtagtcttgaagggggattcaaaatctcttacgagtgggccgtgaggtttatgcttagacatcacctgacaccacatgcacggcgcgccgtcgcacatacgcttccaaaggatgttgcagagaatgccggcttgtttattgatttcgtgcagagacaaattcacaatcaagatctgcctctgtcaatgatagttgccattgatgaaatctccctgtttttagatactgaggtgctgtcttcagacgaccgaaaggagaatgccctccagaccgtcgggacaggggaaccttggtgtgatgtggtcctggccatcctggcagacgggaccgtcctgcccaccctggtgttctaccgcggccaaatggaccagcctgccaatatgcctgattcaatccttttggaagcaaaggaaagcggatattcagacgacgagataatggaactgtggagcacacgcgtttggcagaaacacacagcatgccagagatcaaaaggcatgctggtcatggactgccacaggactcatttatctgaagaggtgttagcaatgctgtctgcaagctctacattgccagctgttgttccggcaggttgctcttccaagattcagcctctagacgtatgcataaagagaacagtcaaaaatttcctgcataaaaagtggaaggagcaggcgagggagatggccgacacggcctgcgactctgatgtgcttctgcagcttgtcctggtgtggttaggagaagtgcttggagtcataggcgattgtccagaacttgtacagaggagcttcctggtcgcctctgtgttgcctggtccggatggaaatataaattctccgacgcgaaacgctgatatgcaagaagagctgatagcctccctggaggaacaactcaagctatccggcgagcattcagaatccagtacaccaagaccaaggagtagtcctgaggagacgatcgagcccgaatccctacaccagttgttcgaaggagagagtgagactgagtccttttacggatttgaagaagcggatctcgacctgatggaaatatag

SEQ ID NO: 26925 - DNA, 285 bp, Artificial Sequence
  Description of Artificial Sequence: Synthetic coding sequence
atggccatgaccgccggcaccaccaccaccttccccatgagcaaccacacccgagagagggtgactgtcgcgaagttgactctcgaaaatttctattccaaccttatactgcagcacgaggaacgcgagacccggcagaaaaaactcgaggtagcgatggaggaggaaggactggccgacgaggagaaaaagctcagacggtcacagcatgcacgtaaagaaactgagtttctgcgcctcaaacgaaccaggctcggacttgatgactttgagagtcttaaatag

SEQ ID NO: 26926 - DNA, 1047 bp, Artificial Sequence
  Description of Artificial Sequence: Synthetic coding sequence
atgggcaaggactactacaagatcctgggcatccccagcggcgccaatgaagatgaaatcaaaaaagcctatcgcaagatggccctgaagtaccatccggataagaataaagagccaaacgccgaggaaaaatttaaggagatcgcggaagcatatgacgttctgtcggatccaaaaaagagaggcctctatgaccagtacggcgaggaagggttgaaaacaggaggcgggacctccggcggctcctcaggctcattccactacaccttccatggcgaccctcacgccacattcgccagcttttttgggggctccaatccctttgacatcttcttcgctagttctcgaagcaccaggccgttcagtgggtttgatcccgacgatatggacgttgatgaagatgaggatcccttcggtgccttcgggaggttcggttttaacggcctctcccgggggcctagacgggctcccgaaccactttacccccgccgtaaggtacaggatccacctgtcgtgcacgagctccgcgtaagcctggaggagatctatcatggatctacgaaacgcatgaagatcactcgcagacgcttgaaccctgacggacgtacagtacgtaccgaggataagattttgcacatcgtcatcaaacggggatggaaggaggggaccaaaatcaccttcccgaaggaaggggatgcgacccctgacaacatacctgcggatatcgtatttgtgcttaaagataagccccacgcccatttcaggcgcgatggcacaaatgtgctttattctgccctcatctccttaaaggaagccttgtgcgggtgcacagtgaacatccctaccattgacggccgtgtgattcctctcccctgcaatgatgtgatcaagccagggaccgtgaaaaggctcaggggggagggcctaccattccccaaagtgccaacgcaaaggggcgacctaatcgtggagttcaaggtgaggttcccagatcggctcacgccccagaccagacagatactcaagcagcatctaccttgctcatag

SEQ ID NO: 26927 - DNA, 888 bp, Artificial Sequence
  Description of Artificial Sequence: Synthetic coding sequence
atgcccgtgcacaccctgagccccggcgcccccagcgcccccgccctgccctgtcggttgcgcacccgcgttccggggtacctgttacgcgggccagcagatggcggtgcccgaaagcctagcgctgttgaaaggctggaggccgacaaagcaaaatacgtaaaaagcttacatgtagctaacactcgccaggaacctgtgcagccactgctgtccaagcagcccttattcagccctgagacccgcagaaccgtcctcactccctctaggcgggcgctcccaggaccctgtagaagaccccagctggacctggacattctgtcctcactcatagacttatgtgattcccctgtgtctccagctgaggcttctaggacccctggaagggcagagggagcaggacggccgccccccgccacaccaccccgcccacccccttccacaagtgctgtgagacgagttgacgtgagaccgctgccggcatccccggcgagaccctgtccgagccctggtccagccgcagccagctctcctgcaagacctccggggctacagagatcaaaatctgatctgagtgagaggttctccagagccgctgcagatctagaacggtttttcaatttttgcggacttgacccagaggaagcaagaggtctgggagtcgcccatcttgcccgagcttcctccgacattgtatctctggccggcccttctgccggcccaggatcttccgaaggaggatgctcccgacgtagttcggtcaccgtggaggagagggctcgtgaacgggtaccgtatggggttagcgtcgtggagaggaatgctagggtcatcaagtggttgtacggactccgccaagccagggaatcgcccgctgcagaaggctag

SEQ ID NO: 26928 - DNA, 258 bp, Artificial Sequence
  Description of Artificial Sequence: Synthetic coding sequence
atgccctacaacgaggccgagaacaagcggagctaccacctgtgcgatttgtgtgaccgtatcataataggcgatcgcgaatgggctgcgcatataaaaagcaaatctcatctcaatcaactgaagaaacgtaggaggcttgactctgacgccgtaaacactatagagagccagagcgtgtcccctgaccataacaaagagccaaaagagaaaggcagtccagggcagaacgaccaggaattaaagtgctcggtttag

SEQ ID NO: 26929 - DNA, 396 bp, Artificial Sequence
  Description of Artificial Sequence: Synthetic coding sequence
atggccatgaccgccggcaccaccaccaccttccccatgagcaaccacaccagagaaagagtcacagtcgccaaactgactcttgagaacttttacagcaacctgattttacagcatgaagaaagagaaactaggcagaaaaagttagaggtggcaatggaagaagagggtctggcagacgaagagaagaaacttcggaggtcacagcatgccaggaaagagactgagttcctgaggctgaaacgcaccaggcttggtctggatgattttgagagtctgaaagtgataggtagaggagccttcggtgaagtgcggctcgtgcagaaaaaagacacaggccacatctacgcgatgaagatcttgcggaagtctgacatgttggaaaaggaacaatag

SEQ ID NO: 26930 - DNA, 21 bp, Artificial Sequence
  Description of Artificial Sequence: Synthetic coding sequence
atggcccacgagatgatctag

SEQ ID NO: 26931 - DNA, 2199 bp, Artificial Sequence
  Description of Artificial Sequence: Synthetic coding sequence
atgggcttccgggacgaggccgccggctacttccacaaggccgtgaaactcaaccccgatttttctgatgcaaaagagaacttctatagagtggctaattggttggtcgaaaggtggcacttcatcatgctaaatgacaccaaacgaaacaccatatacaatgccgctattcagaaggccgtgtgtctgggctccaaatctgtgctggatatcggcgccggaactggaatcctttccatgtttgctaaaaaggcaggcgcccactctgtgtacgcctgtgaactgagcaagacaatgtatgaactcgcatgtgatgttgtcgccgccaacaaaatggaggccggcatcaaactcctccacacaaaatctctagatattgaaattcccaagcatatccctgagcgggttagtcttgtcgtaaccgagacagtggatgccggcctttttggcgaggggatcgtggaatcactgatccacgcctgggagcacttgctactgcagcctaaaactaaaggagaatcagccaactgcgagaagtacggtaaggtgattccagccagtgccgtgattttcggcatggccgtggagtgtgccgagatccggaggcaccatcgcgtgggcatcaaagatatcgccgggattcatttgcccacgaacgtgaagttccagtctcccgcctactcctcggtcgacaccgaagaaaccatcgagccgtacacgacggagaaaatgagtcgggtaccaggaggatatctggccttgacggaatgcttcgaaattatgactgtcgactttaataacctgcaggagctcaaaagtctggcaacaaagaagccagacaagatcggtatacccgtgatcaaagaaggtattttggatgccatcatggtgtggttcgtgctgcagctagacgatgagcactccctgtctacaagtccgtccgaagaaacatgttgggagcaggccgtttatccagtccaggacttggccgattattggattaagccaggggaccacgtaatgatggaggtcagctgtcaggactgctacctgaggattcagagcatcagtgtcctgggccttgagtgcgaaatggatgtggctaagagcttcacacaaaacaaagatctgcttagtctgggaaacgaagccgagctgtgctcggccctggccaacctgcaaactagtaagcccgatgcggtggagcagacttgtattcttgaatctaccgagatcgcccttttgaataatatcccctaccacgaagggtttaaaatggccatgtctaaggtattgagctccctgacccccgaaaaactgtaccagactatggacacccattgtcaaaatgagatgagcagtggaactggacagtctaatactgtacagaatatactggagccgttctacgtcctcgatgtaagtgaaggtttcagcgttctgcctgtcatagccggcaccctcgggcaagtaaagccatactcctccgtagagaaagatcagcataggatcgccttagatctcatttccgaagccaaccattttccaaaggagactctggagttctggctgcggcatgtagaggatgagtcagcgatgctgcagagaccgaaatcagataagctttggagtatcattatccttgatgtgatcgagcccagtggacttattcagcaggagatcatggaaaaggccgccattagcaggtgcctcctccagtccggaggcaagatctttccccagtacgtactcatgttcggtctcctcgtggagtcacaaactttattagaggagaacgctgtgcaggggaccgaacggaccctgggactgaatattgcaccgttcattaaccagttccaggtgccaattagggtcttcctggacctgtcttcactgccctgcatacctctgtctaagccagtagaactcttgcggcttgacctaatgacaccatatctgaatacgtctaatagggaggtgaaggtctatgtctgcaagtccggtcgactaacggccatcccattttggtatcatatgtatctcgatgaggagatcagacttgataccagcagcgaggcttcacattggaagcaggcagccgtggtgctcgacaaccctatccaagtggagatgggcgaggaactggtgttgagcatccaacatcataaatctaacgttagtattacagtgaagcaatag

SEQ ID NO: 26932 - DNA, 1554 bp, Artificial Sequence
  Description of Artificial Sequence: Synthetic coding sequence
atgtgcagcctggccagcggcgccaccggcggccggggcgccgtggagaatgaagaggaccttccagaactaagtgatagcggcgatgaggctgcctgggaagacgaagatgacgctgatctgcctcacgggaagcagcagaccccctgcttattctgtaaccggctgttcacgtcagctgaagagacattcagtcattgcaagagcgagcaccagtttaacatagactccatggtacataagcacggactggaattctatggctacattaagctcattaattttatccgcctcaagaaccccactgtcgagtatatgaatagtatttataaccctgtgccttgggaaaaagaagagtatctcaagcctgtcttggaggatgatctcctcttgcaattcgatgtggaggacctctatgagcccgtgtccgtcccattctcctaccccaacggcctctccgaaaacacctccgtcgttgagaagctcaagcacatggaggcgagggcactcagtgctgaagccgctttggcaagagcaagagaggatctgcaaaagatgaaacagttcgcccaagacttcgttatgcacaccgacgttcgcacctgctccagttcaactagcgttatagccgatttacaggaagatgaagacggagtgtatttttcctcatatggacactatggaattcacgaagaaatgctgaaggacaagatcaggactgagtcctacagggatttcatttatcagaacccacacatcttcaaagataaagtggtactggatgtgggctgcggcaccggcatactttccatgttcgccgcaaaggccggcgccaaaaaagttctgggggtagaccaaagcgagatactgtaccaggcaatggacatcatcaggttaaataaactggaagatactattactctgatcaaaggcaaaattgaggaagtgcatctgcccgtggaaaaggtggacgttataatcagcgagtggatgggatacttccttctgttcgagtcaatgctcgacagcgtgttgtacgccaagaacaagtatctggccaagggcggatcggtatatcccgacatctgtaccattagtctcgtggctgtgagcgatgtgaacaaacacgccgatcggatcgccttttgggacgatgtttatggttttaagatgtcctgtatgaagaaggccgtaatcccagaagctgtcgtagaggtgttagaccccaagacactaatttccgagccttgcggtattaaacatatcgactgtcatactacttccattagcgatctggagtttagctcagattttactctgaagattactaggacttctatgtgcacagctatcgccgggtactttgacatttacttcgagaagaactgccataaccgcgtcgtgttttccaccggaccccagtccactaagacacattggaaacagacagtcttccttttggagaagcctttctcagtgaaggccggggaggctctgaagggtaaagtgaccgttcataagaacaaacgggaagtccttattgtgggcatttag

SEQ ID NO: 26933 - DNA, 1560 bp, Artificial Sequence
  Description of Artificial Sequence: Synthetic coding sequence
atggagcaggagaagttcgacctgcagaagcagcacaccgagaacatccaggaactcctggaggacacaaatgttaggctcaacaaaatggaatccgagtacatggcacaaacacagagcacgaatcatatgatcaaggaactcgaagccagagttcaacagctgacaggtgaagccgaaaatagtaacctgcagaggcagaagctgatacaagaaaaagctgaactggagcggtgttatcagattacatgttccgaactccaggaagttaaggcgcggagaaataccctgcataaagagaaggatcacctggttaatgactacgaacaaaacatgaaacttttgcagactaaatatgatgccgacattaatctccttaagcaagagcacgccctctcagcttctaaagctagctccatgatcgaagaactggagcagaacgtgtgccaacttaaacaacaactgcaggagagcgagctacagcggaagcagcagctgcgggaccaggagaataagtttcagatggagaagtcccacctgaagcacatttatgagaagaaggcccacgacctgcagtctgaactggataagggaaaagaagacactcagaagaagattcacaagttcgaagaagccctgaaagagaaagaggagcagctgacaagggtgacagaggttcagagactccaagcccagcaagcagacgccgcgctagaagaatttaagcgacaggtagagctcaacagcgagaaggtatacgccgaaatgaaagagcagatggagaaggtggaggccgatctcactcgaagtaaatcactacgagagaagcaaagcaaagagtttctgtggcagctggaagacatccgccaacgatatgagcagcaaatcgttgaactgaaactcgagcatgagcaggagaagacgcacctcttacaacagcataatgccgagaaggacagcttggtgagagatcacgaacgggagattgaaaatctggagaagcagttgcgggcggctaatatggaacatgagaatcagatccaggagtttaaaaaacgtgacgcccaggtgatagccgatatggaagcccaggtacacaaactccgggaagagcttattaacgtgaacagccagcggaaacagcaattagttgaactgggattgctgagagaggaagagaagcagagggcaacgcgtgaacacgagatcgtggttaacaaattgaaggccgagtcagagaagatgaaaatagagctgaagaagacacacgcagccgaaacagagatgaccttagaaaaagtcctgcaggacgaattagagaaccgatccaaccaggtgcggtgcgctgaaaaaaagctccagcataaggaactggagagccaggaacagataacctacatacggcaggagtacgaaacaaaactgaaggggttaatgcctgcatcgctcagacaggaactggaggacaccatttcctcattgaagagtcaagtgaatttcctgcagaagcgggctagtatcctccaggaagaactgacaacttatcagggccggcgctag

SEQ ID NO: 26934 - DNA, 1743 bp, Artificial Sequence
  Description of Artificial Sequence: Synthetic coding sequence
atgaacaacatccacgtggagaacgagagcctggacaacttcctgaaggaaactaacaaggagaacctgttggatatcctcacagagccagagcgcaaacctgacccaaagctctacaccaggtccaaacctaagaccgacagttataaccagaccaagaatagtctcgtccctaaacaagctctaggtaaatcaagcgtcaactccgccgtgttgaaggatcgcgtaaacaagcagtttgtcggagagacccagtctcgaacatttccagtgaaatcacagcagctgtccagaggagccgacctggctcgcccgggcgtgaaaccttcacgcactgtcccttcacattttatccgaacgctctccaaagtacagtcaagcaagaagcccgttgtgaagaacataaaggatatcaaggtcaacagaagtcagtacgagcggccaaacgagaccaaaattcgctcctacccagttacagagcagcgcgtgaaacacaccaagccacgcacttacccaagcttgctgcagggagaatataataataggcacccaaatattaaacaggaccagaagagcagccaggtgtgtattcctcagacgtcttgtgttttacagaagtctaaagcaatctcacagagaccaaatctgacagtgggccggtttaacagcgccatcccatctacaccaagtatcaggccaaacggcacctctggtaacaagcacaacaacaatggttttcagcagaaggcacagacactggacagcaagttgaagaaagcggtgccgcagaaccacttcctgaataagaccgcccccaagacccaagccgacgttactaccgtcaatgggacacagaccaaccctaatataaaaaaaaaggccacagccgaggataggcgaaagcagttggaagagtggcagaagtcaaaaggaaagacttataaacggcctcctatggagttaaagaccaaacgaaaggtaatcaaagagatgaacataagtttttggaagtcaattgagaaggaggaagaagagaagaaggcccaacttgaactctcaagcaagatcaataatacgttaacagagtgccttaacttgattgagggcggggtccccagcaacgagatccttaatatcttatcttctattccagaggcagagaagttcgcaaagttttggatctgcaaggctaaactgcttgcgagtaagggcactttcgatgtcattgggctttacgaggaagccatcaagaacggagccacacctattcaggaactcagaaaggtcgtcctcaacatcttgcaggactctaataggacgactgagggcatcacgagcgactccctggtcgccgagacctctatcacttcggtggaagagttagcaaaaaagatggagagtgtcaaatcgtgcttgagccccaaggagagagaacaggtgaccgcaacaccacgaattgcaaaggccgagcagcacaactatcccggcattaaacttcagatcgggcccattccccgaatcaacgggatgcctgaggtgcaggacatgaaatttataacacccgtacgacgcagcagtagaatagagagggccgtctcccgctatccagaaatgctccaggagcacgacttggtggtggcttccctggatgagctactggaagtggaagagacaaagtgtttcattttccgcagaaatgaggctttgcctgtaacattgggattccagacaccagagagctag

SEQ ID NO: 26935 - DNA, 705 bp, Artificial Sequence
  Description of Artificial Sequence: Synthetic coding sequence
atgtacatggacctggtggacggcatcttcctgaaccagatcatgctccagatcgacccgagaccaaccaatcagcggatcaataagcacgtgaacaacgatgtcaatcttcgtattcagaacctaacaattctagtccgcaatattaaaacctactatcaggaagtcctgcagcagttgattgtgatgaacctgcctaacgtgctgatgatcggtcgcgacccattgtctggcaagtctatggaagagattaagaaagtcttactgctcgtgctgggatgtgccgtccagtgcgagaggaaagaggagttcattgagcgaatcaagcagctggacatagagacccaagcaggtatcgtggctcacatacaagaggtcactcataatcaagaaaacgtattcgacttgcagtggctggagctgccagatgtcgcacctgaggagttggaggccctgagtagaagtatggttctgcatctgaggagacttatcgaccagcgcgatgaatgtactgaacttatcgttgacctcacccaggaaagagattatctgcaggcacaacacccaccttccccaatcaaaagtagcagtgctgacagtactccttcaccaactagttctctgagctctgaggataagcagcatctggccgtcgagctggccgacactaaggccaggctaagacgagtgcggcaagagttatag

SEQ ID NO: 26936 - DNA, 1161 bp, Artificial Sequence
  Description of Artificial Sequence: Synthetic coding sequence
atgaccgacatccggaagatccggctgggcgagcggctggtggaggtttttagtgccgagaaagtgtacatggtgaggctcagaaatcccctcgggaggcaggagtggtcaggaccttggtccgaaatcagcgaggagtggcagcagctaacagcatctgacaggaagaatctgggccttgtgatgagcgatgatggcgaattttggatgtctctggaagacttttgtagaaactttcacaaactcaacgtgtgcaggaacgtcaacaaccccatttttggtcgtaaagagctggagtcagtgctggggtgctggacagtcgacgacgatcctttaatgaacagatccgggggatgttataataatagagatacctttctgcagaatccacagtacattttcacagtaccagaagatggacataaggtcataatgtcgctgcaacagaaggatctcagaacatataggcgaatgggccgtcctgataactacatcatcggtttcgagctttttaaagtggaaatgaatcgcaaattcaggctccatcacctctatattcaggaaagggcaggcacttcaacctatatagataccagaacggtgttcctcagcaagtacctgaagaagggtaactacgtgttagttccgaccatgttccagcacggtagaacatcagagtttctgctccggatcttctctgaggtgcccgttcagctaagagaactgacactggatatgcctaaaatgtcctgttggaatctggcacgggggtatcccaaagtggtgactcagatcactgtgcactctgcagaagatctcgagaaaaagtatgccaacgagaccgttaatccatacctggtgattaagtgtggcaaggaagaagtgagaagtcccgtgcagaagaatacagtgcacgcaatctttgatacccaggcaattttctacaggagaactacggacattcctataatcgtgcaggtgtggaactctaggaagttttgcgatcagtttttgggtcaggtgacgttagacgccgacccatccgattgtagagacctgaagtccctctacttacgaaagaagggcggtcctacagctaaggtgaagcagggccacattagctttaaagttatctcaagcgatgatctgacggagctatag

SEQ ID NO: 26937 - DNA, 966 bp, Artificial Sequence
  Description of Artificial Sequence: Synthetic coding sequence
atgaccgagctgagcctgcagaaggagcagctgcagctgaagatcattgaaatcgaggacgaagccgaaaagtggcagaaggaaaaagatcggattaagagcttcacaacaaacgagaaagcgatactcgaacagaatttccgtgatctggtgcgcgacttagagaagcagaaagaggaagtgagagccgcgctggagcaacgggagcaggatgcagtggaccaagtaaaggtaatcatggacgccctggatgaaagagctaaggttttgcacgaggataaacagacaagagaacagctacactcgatttccgactctgtgctttttttacaagaatttggagccttgatgtcaaattactctttgcctccaccattgcctacttatcacgtgctgctggagggagagggcctcggtcagagtctaggcaattttaaagacgacctgttgaatgtgtgcatgcgtcatgtggaaaagatgtgtaaggccgatctgtcaagaaatttcattgagaggaatcatatggaaaacggcggggatcaccggtacgttaacaattacactaacagctttggtggggaatggtctgcgccggatacaatgaagcgatacagcatgtatctgacccctaaggggggagtcagaacatcttatcagccgtcctccccgggccggttcaccaaggagaccacccaaaagaacttcaataacctgtatgggaccaaaggcaattatacgtcaagggtttgggaatattccagctccattcaaaatagtgacaacgacttgccagttgtccagggaagcagttccttcagcctcaagggttatccctccctgatgaggtcccagtcgccaaaggcccaaccccaaacgtggaagagtggcaaacagactatgctgagccactaccgccccttttatgtcaataaggggaacggcataggtagcaatgaggccccttag

SEQ ID NO: 26938 - DNA, 687 bp, Artificial Sequence
  Description of Artificial Sequence: Synthetic coding sequence
atgtaccggcagcggttcctgtacagcctgtaccggcacacccactgggtgcggtgcgctaagttttcaccagatggccgactcattgtctcatgctccgaggacaaaactatcaaaatatgggatactaccaataaacagtgtgtcaacaatttcagtgattccgtcggttttgcaaactttgtggattttaacccttctggaacttgcatcgcaagcgctggatcagaccagaccgtgaaggtgtgggatgtgagggtgaacaaattgctgcaacactatcaggttcatagcggaggtgtgaactgcatttcctttcatccatcaggcaattacctaatcacagcctcctcggacgggacgttgaagatattggacctactcgagggccggctgatatatacactccaggggcacacgggccccgtattcacagtctccttttctaagggcggggagctcttcgcctctggtggagccgacacgcaagtccttctgtggcgcactaattttgacgaactccattgtaaagggctaactaaaaggaatctgaagcgcttgcatttcgattctccacctcacttacttgatatttatcctcggaccccacatccccacgaggaaaaggtcgaaacagtggaagatttctttctccatctgctccggctcattcagagcctgaggtag

SEQ ID NO: 26939 - DNA, 1686 bp, Artificial Sequence
  Description of Artificial Sequence: Synthetic coding sequence
atgcgggccgtgcggcggcacctgttcccccagcacagcgcccccgggcgaggcgtggtatgggaatggctcagtgacgatggctcatggaccgcctatgaggctagtgtttgcgactacctggaacagcaggtcgctcgcggcaatcagttagtagatctcgcccctctgggctacaactacaccgtgaactacacgacgcacactcaaactaataagacatcgtcattttgtcgatcagtacggaggcaggcagggcccccatatcctgttactaccatcatcgctccccccggtcacacgggtgtggcctgttcctgccaccaatgcttgagtggtagtcggaccgggcctgtgtccggcaggtatcgccattctatgacgaatctaccagcctatccagtgccacagcaccctcctcaccggacggccagcgtgtttgggactcaccaggccttcgccccatataataagccaagcctgtccggggcaagatctgcccccaggctcaatacaaccaacgcgtggggagccgctcctccatcactgggtagccaacccctgtatcggtcatccctgagccatctgggcccacagcatctcccccctggtagttccaccagcggggcagtctccgcgtctcttccatccgggccttcatccagtcctggttctgtgcctgctacagtccccatgcaaatgccaaaaccgagtcgggtgcagcaggctctcgcagggatgacttcggttctgatgtcagcaatcggattacccgtgtgcctgtccagagccccacagccaacttcgccacctgcctctagattggccagcaaatcccacggatctgtgaagagactgcgaaagatgtctgtgaagggggccaccccgaagccggaacctgagcctgagcaggtcataaaaaattatacagaggagcttaaggtgccacccgacgaggattgtatcatttgtatggagaaattgagtactgcctctggatatagtgacgtaaccgactcgaaggcaatcgggtctttagcggtcggtcatttgactaagtgctcccacgcttttcacctgctgtgtctgttggctatgtattgcaacggtaataaagacggatccctgcagtgtccttcttgtaaaaccatatacggcgaaaagaccggcactcaaccacaggggaaaatggaagtcttaagattccagatgtctttacccgggcacgaggattgcggaacaatcctgatcgtctattcgataccacacggcattcagggccccgaacaccccaatccaggcaaacctttcactgcccgagggttcccacgtcagtgctatctgcccgacaacgcacaggggcggaaggtactggagttgttgaaagtagcttggaaaagacgtctaatcttcacagtaggaactagctccacaaccggggagacggatacggttgtgtggaacgaaatccaccataagactgagatggacagaaacattactggccacgggtatcccgaccccaattacctgcagaatgtgcttgctgagcttgccgcccagggtgtgaccgaggactgcttagaacagcagcacgccagactctggtggcccccgaggtgtccaatggctggttgggtggctcgacaggaagtgccttctcctagaggctgggaagtatgttag

SEQ ID NO: 26940 - DNA, 2565 bp, Artificial Sequence
  Description of Artificial Sequence: Synthetic coding sequence
atgaaggtggaggcctgcacctgggccggctacagcggcctgtacgaggctattgaaagctgggactttaaaaaaattgagaagctagaggaatatcggttgctgctgaaacgacttcagccggaatttaaaacgcggattatcccaactgacattatcagcgatcttagcgagtgccttatcaaccaggagtgtgaagagatacttcagatctgctcgactaaggggatgatggccggggccgagaagctggtcgagtgtctgcttaggagcgacaaagagaactggcccaaaaccttaaagctcgcattggaaaaagagagaaacaagtttagtgagctgtggatagttgagaagggcatcaaggatgtggagacagaggaccttgaggacaaaatggaaacgagcgatatccagatcttctaccaggaggatccggaatgtcagaatctgagcgagaactcatgtccgccatctgaggtgtcagacaccaatctctattctccatttaaaccgaggaactaccagttggaactagctctgccagcgatgaagggcaagaatactattatttgcgctcctaccggatgcggtaaaacctttgtctctcttctgatatgtgaacaccatctaaagaaattcccacagggtcaaaaaggcaaagtggtattctttgccaaccagattccagtgtatgagcagcagaagagtgtctttagtaaatacttcgaacgccacggttatagagtcaccggtatatctggggcgacggctgagaacgtaccagtggaacagatagtggagaataatgatatcataatcctgaccccccagatactggttaacaacttaaagaagggaacaatcccatccttatccatttttaccctcatgatatttgacgagtgtcacaatacaagcaaacaacacccttataacatgatcatgttcaactacctagatcaaaagctaggcgggagcagcgggccacttccccaggtgatcggactgacagcctctgtaggtgttggggatgctaaaaatacagatgaggccctggactacatctgtaagttatgcgcatcccttgacgcgagtgtgatcgccacagtgaagcacaatcttgaggagttagagcaagtggtgtataagcctcagaagttctttcggaaagtggagagccggatctccgataaattcaagtatatcattgctcagctcatgcgagacaccgagagcctggcaaaaaggatctgcaaggatttagagaacttgtctcaaattcagaacagggagtttggcacccagaagtatgagcagtggattgtgacagtccagaaagcctgcatggtatttcagatgcctgacaaggacgaagaatctcgaatttgcaaagcactcttcctctatacatcccacctgagaaaatataacgatgctctgattatcagcgaacacgcccgcatgaaagatgcattggactaccttaaagacttcttctccaacgtgcgcgctgctgggttcgatgagatagagcaggacctgacccaacggtttgaagagaagcttcaggagctcgagagcgtttctcgggacccctcaaatgagaatccaaaactcgaagatctctgcttcatcctgcaggaagagtatcacctgaatcctgagacgattaccattctgtttgtgaaaactcgggccttagtagacgccctcaaaaattggatcgaggggaacccgaagttaagcttcctcaagcccggcatcctgacgggacgtggaaagacaaaccaaaacaccggaatgacgctcccagcccaaaagtgtatcctggacgcgtttaaggcaagcggtgaccataatattctgattgcgacctcggtcgccgacgagggtatcgacatagctcagtgcaatctcgttatattgtacgagtacgtcggcaatgtgattaaaatgattcaaacccggggacgagggcgggcacggggctcgaaatgttttcttttgacttccaacgctggagtgattgagaaggagcagataaacatgtataaggagaaaatgatgaatgattctatcctcagactccagacttgggatgaggcggtgttcagggagaagattctgcacatccaaacccacgagaagttcatcagagacagccaagagaaaccgaagcctgtgcccgataaggaaaataagaagctgctttgtaggaaatgcaaggcattagcgtgttacaccgcagatgttcgggttattgaagagtgtcattacacagtgcttggcgatgccttcaaagaatgtttcgtttctcgtccacaccccaagcctaaacaattctcgtcctttgagaagcgcgctaaaatcttctgtgcccgacagaattgttctcacgattggggaatacacgtcaaatataaaacatttgaaattcccgtgatcaaaatcgagtcttttgtggtcgaagacattgctacaggggtccaaacattgtacagtaagtggaaagatttccactttgaaaaaatccctttcgacccagctgaaatgtcaaagtag

SEQ ID NO: 26941 - DNA, 813 bp, Artificial Sequence
  Description of Artificial Sequence: Synthetic coding sequence
atgcagatcgagcacatcatcgagaacatcgtggccgtgaccaagggcctaagcgaaaagctgcctgagaagtgggaatcggtcaagctgctgtttgttaagaccgagaaatccgccgctttgccaattttctcgagcttcgtgtctaactgggacgaggccacgaaaagatctcttttgaacaaaaagaaaaaggaagctagaaggaaaagacgcgagagaaattttgaaaaacagaaggagagaaagaagaaacggcaacaggctcgaaaaactgccagtgttctgtccaaggatgacgtggctccagaatctggagataccacagtgaagaagcccgagtccaaaaaggagcagacgcctgaacatggaaagaagaagcgaggacgcggcaaggcccaggtcaaggccaccaatgagtctgaggacgaaatccctcaattagttcctattggtaagaagacccctgcgaacgaaaaggtggaaatccagaagcatgctacagggaagaaatctcccgctaagtcgccaaacccctccactccacgggggaaaaagcgcaaggctttacccgcatccgaaacacccaaggcagctgaaagtgagactcctggtaaatctccagagaagaaaccaaagattaaggaggaggcggtcaaagagaaaagccctagcctaggaaaaaaagacgccagacagacgccaaaaaagccggaggccaaattcttcacgactccctcgaagtctgtgcgaaaagctagtcacacccccaagaagtggccgaaaaagcccaaggttccccagagcacttag

SEQ ID NO: 26942 - DNA, 1059 bp, Artificial Sequence
  Description of Artificial Sequence: Synthetic coding sequence
atgagcagccggaagctgagcggccccaagggccggcggctgagcatccacgttgtgacatggaacgtggcatcagctgcccctcccctcgacctcagcgacctactgcagctgaataatagaaacttgaatctcgatatctacgtaatcggtctgcaggagctgaattctggcataatcagtctgctttcggacgccgccttcaacgacagttggagctccttcctgatggacgtgctttcacctctatccttcatcaaggtctcacacgtgcggatgcagggcattctgctacttgtatttgccaaataccagcacctcccctacattcagatattgtcaacaaagagcacccccacaggcctgtttggctactggctctcaatcgcgaaaaaacatgatccactactgcgggaatttcaggaggggcggctcctgtttccccctacttataagtttgataggaattccaatgattacgacacatctgaaaagaaacgcaaacctgcatggactgatcggatcctatggagactgaaaaggcagccatgcgcaggtcccgatacacctataccccctgcttcccacttctccctaagccttagaggatattccagccatatgacttacgggataagcgaccataagcccgtgtctggtaccttcgacttagagctgaagcctctggtaagcgctcccctgatcgtcctgatgcctgaggacttgtggactgtggagaatgacatgatggtcagctactccagcacctcagactttccttcgtccccatgggactggatcggtttgtacaaagtcgggctccgcgatgtgaatgactatgtgagctatgcatgggtcggagactccaaggtgtcttgtagtgataaccttaaccaggtctacattgacatatcaaatatccctacaaccgaagacgagttcttgttgtgctactactcaaactccctaaggtcagtcgtgggaatttcccggccattccaaatcccgcctggatccctgagggaagaccctctgggggaagctcagccgcagatctag

SEQ ID NO: 26943 - DNA, 375 bp, Artificial Sequence
  Description of Artificial Sequence: Synthetic coding sequence
atgaccggcagctgctgcggcagcaccttcagcagcctgagctacggcggcggctgctgccagccatgctgttgcagagatccatgttgttgtcgacctgttacctgtcagaccaccgtatgcagacctgtcacatgtgtccctaggtgtacaaggcccatctgtgaaccatgtcgacgccctgtttgttgcgatccctgttctctccaggagggatgttgcagacctatcacctgttgccccagcagctgtactgccgtcgtctgccgcccctgttgctgggcaactacttgttgccagccaccagtctccgttcagagtccatgtggacagcctacaccctgctccactacatgtcggacgtccagttgttag

SEQ ID NO: 26944 - DNA, 927 bp, Artificial Sequence
  Description of Artificial Sequence: Synthetic coding sequence
atgaagcgggcccaccccgagtacagcagcagcgacagcgagctggacgagacaatcgaggtagagaaagagtctgccgacgagaacggcaacctgagctctgcgctaggatcaatgagtccgacaacatcctcccagattctggctaggaaaagacggcggggcataatcgaaaagagaagaagagaccggatcaacaattctctgagtgagcttagaagactggtaccctccgctttcgagaaacaggttatggagcaggggtcagcaaagcttgaaaaggcagaaatccttcagatgacagttgaccacctcaagatgctccataccgccgggggaaagggctacttcgatgcccacgcacttgctatggattatcgtagcctgggttttcgagaatgtctagccgaggtggcgcggtacttatctatcatcgaggggcttgatgcaagcgatccactgcgtgtgcgtcttgtaagccacctgaataactacgccagccagagagaagctgcttctggagcgcatgcaggacttggccatattccttggggcacggtatttggacatcatccacatatcgctcacccactactgctcccgcagaatggccacgggaacgccgggactaccgcatctcccactgaaccacaccatcagggacggcttggctcagcacatcctgaagctcccgcactgcgcgctcctccgtctggcagtctgggccccgtgctacctgtggtgacctccgcatcgaagctgtcccctcccttactttcgtctgtcgcgtccctctccgcattcccattcagttttgggagctttcacttgctttcgcccaacgccctgtcaccttcagcacccacccaagcagctaatctcgggaagccttacagaccttggggaacagagattggtgctttttag

SEQ ID NO: 26945 - DNA, 2943 bp, Artificial Sequence
  Description of Artificial Sequence: Synthetic coding sequence
atgaccgagggccggcactgccaggtgcacctgctggacgaccggagactggaactgctagtccagcctaaacttctggcaagggagctgctcgatctcgttgcctcccatttcaatctcaaagagaaggaatattttggcatcactttcattgacgataccggccaacagaattggctgcaacttgaccatcgcgtcttggaccacgacctgcccaagaagccaggacctaccatcctccacttcgctgttaggttctacatcgagagcattagctttctgaaggataaaactaccgtggagctcttcttcttaaacgcgaaagcttgtgttcacaagggccagatcgaggtggagagcgagaccatctttaaactcgccgcattcattttgcagtcccccaaggtgagcctgactcatgatgagaatgcccggaaggacctcaaaacattaccggctttccctacaaaaactttgcaggagcatccaagtcttgcatattgcgaggatcgtgtgattgaacactacctgaagattaaaggattaacacgaggccaggcagtcgtacaatatatgaaaatcgttgaggctctccctacgtacggggtccattactacgcagttaaagataaacagggactgccttggtggctggggatcagctataagggcataggacagtacgacattcaggacaaggtgaagcccaggaagctgttccagtggaaacaactggaaaacttgtactttcgggagaagaaatttgccgtggaggtgcatgatcctcggcgaatctccgtaagtcggaggacctttgggcagagcggcctgttcgtgcagacgtggtacgctaattccagcctgattaagtctatttgggtaatggccatctcccagcatcagttctacttagataggaaacagagcaaagcaaaaattccttcggcccgcagcttggacgagattgccatggatttgacagagactggaactcaaagggcctctaaactagttaccctcgagacaaaatctcagttcatcatggcctccaacggaagcttaatctccagtgggtctcaggatagcgaggtgagcgaagaacagaagcgcgaaaagatcctggaactgaagaagaaggaaaagctacttcaggagaaactcttgaaaaaggtagaagaattgaaaaagatttgcttacgggaggcagagcttactggcaaaatgcccaaggagtaccccctgaacataggcgaaaagcccccgcaggtaaggaggagggttggcaccgccttcaaactggacgataacctgctccccagcgaggaagacccggccctgcaagagctggagagtaacttcctaattcagcagaagctggtggaggctgccaagaagctggccaatgagcccgatctgtgtaaaactgttaaaaagaagcgaaaacaggactacaccgacgccatgaaaaaattgcaagaaatagaaaatgctattaacgagtataggatacggtgtgggaagaaaccctcacaaaaagccacagtgctccctgaagacatcattccaagcgagagttcaagcttgagtgacactacaacttatgatgatccaagcgacgctttcacattcccgggacagagaagtagctccgtaccccatagcccccgaattcttcctcctaagagtcttggcatagaaaggatccacttcaggaaaagtagcatcaacgaacagttcgttgacaccaggcagagtagggaaatgctgtcaacacattcaagcccctataagaccctggagaggaggcctcaaggcggtcgcagcatgccaacgacacccgttctcacgcgaaatgcatatagctcgagccatcttgaacctgagtccagttctcagcattgccgccagagatctggctccttggagtcacaatctcatctcctgtcagagatggacagtgacaagccatttttcagcttgagtaagtcccagcggagcagttcaactgagattcttgacgacggctcttcctacaccagtcagtcctctaccgagtattattgcgtcacccccgtgacgggaccatattataccactcagacactagatacacgcacacgaggtcgccgccgcagtaagaagcaaaatgtgagcacctccaacagtggctccatgccaaatctagcccagaaggatagcctccgtaacggggtctattccaagtctcaggagcccccttcctcaagctactatatcgccggatatacaccgtacgccgagtgtgacttctactatagcggcgggtatgtctacgaaaatgacactgagggccaatattcggtcaatccctcataccggagttccgctcattacggctacgagcggcagagagactactcccggtcgttccacgaggatgaagttgaccgtgtcccccacaacccctatgccaccctgaggttaccacgtaaagccgcagctaaaagcgagcacatcaccaagaatatccacaaggccctggtcgcggaacatttgcgagggtggtaccagcgggcatcgggccagaaggatcagggccatagccctcaaacctcttttgacagcgatcgcgggagtcagaggtgtctaggttttgcaggcttgcaggtaccctgcagccctagctctcgcgcgagcagctactccagtgttagctcgaccaatgccagtgggaactggcgcacacagttgaccatcggtctttcggactatgaaacaccggctcattcttcctatacctcctgttacgggaatgtgtataatcctctccctagcccttccagacagtacactgagatctcccagttggatggcacagatggcaaccaactagaagataacctcgaatcctctgagcaacggctgttttggcacgaggacagtaagcctggaacgctggtatag

SEQ ID NO: 26946 - DNA, 2979 bp, Artificial Sequence
  Description of Artificial Sequence: Synthetic coding sequence
atgtacggcagcgcccggagcgtgggcaaggtggagcccagcagccagtcacctggacgcagccctaggttgccccggtctcctaggctaggccacagacgcacgaattccactggaggatcgtccgggagttctgtgggcggcgggtccgggaagacactttccatggagaacatccagtcactgaacgcggcttatgccacatctgggcccatgtatctcagcgatcacgagaacgtcgggtccgaaaccccaaagtcaactatgactctgggccggagcggggggagactcccgtacggtgtcaggatgaccgctatgggttcctctcccaatattgctagcagcggagtggcctccgacactatcgccttcggagaacaccatctaccacctgtgagtatggcgtccacagtgccccatagtctacgccaggccagggataatacaattatggacctgcagacccagcttaaggaagttctgcgggagaatgacctcctgagaaaagatgtggaggtgaaagaaagcaaattgtcctcttccatgaactcaataaagacattttggtccccggaactaaagaaagagagagccttgagaaaagatgaggcgagcaagattactatttggaaggagcaataccgtgtcgtgcaggaagagaaccagcacatgcagatgacgattcaggcgcttcaggacgagctgagaatccagagagacttgaaccagctctttcaacaggacagttccagtcgaactggcgagccctgcgtggccgagttaactgaggagaacttccagcgattgcacgcggagcatgagcgacaggccaaggagctctttctcttgcgtaagacccttgaagagatggagttgaggattgagactcagaagcagaccttgaatgcacgcgatgagtccattaagaagctactggagatgctacagtcgaagggcctctctgctaaagccactgaggaggatcacgaacggaccaggcgtttagccgaggctgagatgcacgttcaccacctcgaatctcttttggagcagaaggagaaggaaaacagtatgcttcgggaggagatgcataggaggttcgagaatgctccagatagcgccaaaaccaaggccctgcagaccgtgatagaaatgaaagacagcaagatttcctctatggaacggggtctccgggatttggaagaagaaatccagatgctcaagagcaatggggcactgtctactgaagagagagaggaggagatgaaacagatggaggtgtatagatcacattctaaatttatgaaaaacaagattgggcaagttaagcaggaactctcacgcaaggatacggagctgctggccttgcagacgaaacttgaaacattaactaaccagttctccgactcaaaacagcacatagaggttttgaaagagagtctgaccgctaaggaacagcgggctgctatacttcagactgaagtcgacgcattgagacttcggcttgaagaaaaagagaccatgctcaacaagaaaactaagcagattcaggatatggcggaggagaaaggcacgcaagccggcgagattcacgaccttaaggacatgttggacgtcaaggagaggaaagtgaacgtcctgcagaagaaaatagaaaatctgcaagagcagcttcgcgataaagaaaaacaaatgagtagcttgaaggagcgcgtgaagagcctgcaagctgacactacaaacactgatactgcactaacaaccttggaagaagctttggctgaaaaggaaaggaccattgagcggttaaaagaacaaagagatcgcgacgagagggagaaacaggaggagatcgacaattataagaaggacttgaaagacttgaaagaaaaagtatccctgcttcaaggagacctgtcggaaaaggaagcctcccttttggaccttaaagaacacgcatcaagtctggcgtccagcggcttgaaaaaagattcccgcctgaaaaccctcgagatcgccctcgagcagaaaaaggaggaatgtctgaagatggagagccagttaaagaaggcccacgaagccgcacttgaagccagagcctcccctgagatgtctgatagaattcaacaccttgaaagggaaattactcggtataaggatgaaagcagcaaggcccaggccgaggtcgataggctcctggaaattttgaaagaagtggagaacgagaagaacgacaaggataaaaagatcgccgagctggaatctctgaccagtaggcaggtgaaagatcaaaataagaaggtcgctaacctcaaacataaggagcaagtagaaaaaaagaagtccgcccagatgctggaggaagcacggaggcgggaggacaacttaaatgactcctcccaacagttacaggatagcctgcggaaaaaggacgaccgcattgaggaacttgaagaagccttgagggaaagtgtccagatcacagccgaaagggaaatggtactggcccaagaggagtccgccagaacaaatgcagagaagcaggttgaggaactcctaatggctatggagaaagtgaaacaagagctcgagtccatgaaagcaaagctatcctccacacagcagagcctcgcggagaaggagacccatctaacaaatctgcgggcggagaggaggaaacacttagaagaagtcctggaaatgaagcaggaagctctcctcgccgcaatttctgagaaggacgctaatatcgcacttttggaactcagctcgagtaaaaaaaagacacaggaagaagtggctgccctgaaaagagagaaggacaggttagtgcagcaattgaagcaacagacacaaaaccgaatgaaactgatggccgataactacgaagacgaccatttcaagagttctcacagtaatcaaactaatcataagcccagtcccgatcaagacgaagaggagggcatttgggcatag

SEQ ID NO: 26947 - DNA, 3138 bp, Artificial Sequence
  Description of Artificial Sequence: Synthetic coding sequence
atgctgaccgtgcaggtgaagaccagcagcgccatcgagctgcccgatagcctggcctttctgtggattatccctatgtggtactgcgaaggcaaggaactagagaacagcccagacattcacattgtgcaggccgggaaccttcacagtctgactatcgccgaggctttcgaggaagataccggacgctacagctgctttgccagcaacatttatggtaccgactctaccagcgcggaaatctacattgaaggggtttctagcagtgattccgagggggacccgaataaggaggagatgaaccgaatccagaaacccaacgaggtgagcagccctcctacaacatcagctgtgattcctccggctgtgcctcaggcccagcatctagtggcacagccaagggtggcaacaatccagcagtgccagtccccaacgaactacctgcaagggctggacgggaagcctataatcgcagcaccggtatttactaagatgctgcagaatttgtctgcttcggagggccagttagtggtgtttgagtgtcgagttaaaggagctccgagcccgaaggtggagtggtacagggagggaaccctaatagaagatagtccagatttccgaattctgcagaaaaggccagtttgcatggagcacatcgaagagatctgtacactggttatcgccgaagtcttcgcagaagacagtgggtgcttcacatgtacagctagcaataaatatggtactgtttcttctattgctcagctgcacgtcaggggcaacgaagacctttccaataatggctctttacattcagccaactcaaccaccaacttggccgctatcgagccacagccctccccaccccattccgagccgccatcagtggagcagcccccgaagcccaaacttgagggggtccttgtgaaccataacgagcctagatcaagctcacggataggccttcgggtgcatttcaacctgcccgaggatgataaaggtagcgaagcttcctcagaggccggcgtggtcacaacgaggcagacacggccagattctttccaagaacggttcaacggacaggcaaccaaaactcccgagcctagttcccccgtgaaggagccccctccagtgctagctaagcccaagctcgactccacccagctgcagcagctgcataaccaggtgctcctggaacaacatcagctgcaaaatcctcctccttcatctcctaaagaattccctttttcaatgaccgttctcaactcgaacgctcctccagccgtgacaaccagctccaaacaggtcaaggctccctccagccagaccttctctctggccaggccaaagtatttttttccatccactaatacaactgcagcaaccgtagctcctagctcctcgcccgtgttcacactgagttccaccccacaaacaatacagcgaaccgtttcaaaagagagcctactggtgagccatccatccgtccagacgaaatccccaggaggcctttccatacagaacgagcccctcccaccagggcccaccgagcccaccccaccccctttcaccttctcaattccttctggaaaccagttccagccgagatgcgtcagcccaattcctgttagtcctacgtcccgcatccagaacccggtagcttttttgtcctcagtgctcccaagcctgcctgccatccctcctaccaatgccatgggattgcctcgctctgcaccatcgatgccttctcaagggctggcgaagaagaatacaaaaagtccccagcccgtgaatgacgacaatatccgcgaaacaaaaaatgcggttattcgtgacctggggaaaaaaattactttctctgatgtgcggcctaaccagcaggaatacaaaatctcttcatttgaacagcgcttgatgaacgagattgaattcagactggagcggaccccagtcgatgagagtgatgatgagatccaacatgatgagatccccaccggaaagtgcatcgcgcctatctttgataaaaggttgaaacactttagagtcactgagggttcccccgtgacatttacctgtaaaattgtgggaatccccgtcccaaaggtgtactggttcaaagatggcaagcagatcagtaaacgtaacgaacactgcaaaatgcgcagagaaggggatggaacctgcagtctccatatcgagtccacaacatccgacgacgacggtaattacaccattatggccgccaacccgcagggtaggatcagctgctctgggcacctgatggtccagtctctgccgattaggtcccgtctaacgagcgctggacagtcacacagaggtaggtcaagagtgcaggaacgtgacaaagagccattgcaggagcgcttttttagacctcacttcctccaggcccccggggatatggtagcccacgagggcagactctgccggctcgactgcaaggtatccggtttacctcctcctgagcttacatggctactgaatgggcaacctgtactccccgatgcctcccacaaaatgctcgttagggaaacaggggtgcattctcttcttattgatcctctgactcaaagagatgccggtacttataagtgcatcgcaaccaacaaaaccgggcagaattctttttccctggaactaagcgtggtcgctaaggaagtcaagaaagcacctgtgatcttagagaaactccaaaattgtggagtgcccgagggtcatcccgtccgactagagtgtagggtgattggtatgccacctcccgttttctattggaaaaaagataacgagacgatcccgtgcactagagagcggatctctatgcaccaggatacaaccggttatgcctgcctgctcattcagcctgccaaaaaaagtgacgcaggttggtacaccctgtccgctaaaaatgaagcagggattgtctcatgcactgccagactggatatttacgcacagtggcaccatcagattccccccccaatgagcgtgagaccatccgggagtcgatatggatcactgaccagtaaggggcttgatatattttctgctttctcctctatggagtctaccatggtgtattcatgttccagcaggtccgtggttgagtctgatgagctatag

SEQ ID NO: 26948 - DNA, 72 bp, Artificial Sequence
  Description of Artificial Sequence: Synthetic coding sequence
gtgcggctggcctggggcttcgtgagcgccctgggcagcttccacacagccgatcctgaaggggcagcttag

SEQ ID NO: 26949 - DNA, 1608 bp, Artificial Sequence
  Description of Artificial Sequence: Synthetic coding sequence
atggaggcccccaccgtggagaccccccccgaccccagccccccctccgctcccgctcccgctctggtaccactcagagcaccagacgtcgcgaggctccgggaggagcaggaaaaggtggttaccaattgccaagaaaggattcagcattggaagaaagtagataacgactataatgccctgcgggagaggctgtccacgctgcccgacaagcttagctataacatcatggtaccatttggacccttcgctttcatgcctggcaagcttgtgcatacaaacgaagtgacagtcctgctgggcgacaattggtttgcaaaatgttccgcaaaacaggcagtgggtctggtggaacacagaaaggagcatgtgcgcaagacaattgacgacttaaagaaagtgatgaagaacttcgagagccgggtcgagttcactgaggatctgcagaaaatgagcgacgctgctggcgacatcgtagatatccgtgaagagattaagtgcgacttcgagtttaaggccaaacataggatcgcgcacaaacctcattcgaaacccaagacctctgacatcttcgaagcagacatagccaacgacgtgaagtctaaggatctcctggcggacaaggagctgtgggcgagactggaggagctggaaagacaggaagagcttcttggagagctcgattccaagcccgacaccgtaatcgccaacggcgaggataccacatcatctgaggaggaaaaagaggatcgaaatactaatgttaacgcaatgcaccaggttacagattctcacacgccctgccacaaggacgtagcctccagcgagcctttttccgggcaggtgaacagccagctgaattgttccgtgaatggatcctcctcatatcactctgacgatgatgacgacgacgatgacgacgatgatgacgataacatcgacgacgacgatggcgacaacgaccacgaagctctgggagttggagacaactccattccaactatatacttctcacatactgtggagcctaagagagtgcgcataaacacaggaaaaaacaccactttaaagtttagcgaaaagaaggaagaggccaagcggaagcgcaagaactccaccggtagcggacatagtgcccaggaacttccaaccatccgcacacctgccgacatttatcgagcgttcgtggacgttgtgaacggggaatatgttccgagaaagagcatcctgaaatcccgctccagagagaactctgtgtgcagcgacacgtctgagtcttcagctgccgaattcgacgatagacgaggggtactgcggtccatcagttgcgaggaggcaacttgttccgatacatctgagtccatcctcgaagaagagccacaggagaaccagaaaaagctgctgccactctccgtcacccccgaagcattttcaggcactgtgattgagaaggaatttgtgtccccaagcttaactccccccccagcgatcgcccatccggcccttccaaccatccctgagcggaaagaagttctcctagaagcatccgaagaaaccggcaaaagggtatccaagttcaaggcagcaagactccagcagaaagattag

SEQ ID NO: 26950 - DNA, 1731 bp, Artificial Sequence
  Description of Artificial Sequence: Synthetic coding sequence
atggagggcctgcggcggcggcggggccgggaggccggccccccccaacccatggtgcccctggctgtcgaaaatcaagctggcggggagggagctggcggtgaactcggtatcagcctgaacatgtgcttgctgggtgccctcgtgctcttggggctgggagtcctgctgttcagcggcggactttccgagtccgagacgggccctatggaagaggtggagagacaagtcttgcccgacccggaggttctggaggccgtgggcgatcggcaagacggtctcagagaacagctgcaggctcctgtcccacctgatagcgtgccttctttgcaaaacatggggctgctcctagacaagttagcaaaagagaatcaagatattagattactgcaggcacagcttcaagcgcagaaggaggagttgcagtcattgatgcatcagcctaaggggttggaagaagagaatgcacagctgcgcggggcacttcagcagggggaggcattccaacgcgccctcgaaagcgaacttcagcaactccgagcccgactgcagggcttagaggccgattgcgtgagggggccagacggcgtttgcttgtctggagggagaggacctcagggggacaaggccattagggagcaaggccccagggaacaagaacccgagttatctttcttaaagcagaaggaacaactcgaggcggaagctcaggccctacgacaggaattggaacgacagaggagactcctgggtagtgtacagcaggatctcgagcggtcacttcaggacgcgagccggggagaccccgcacatgctggattagcggagctaggccaccggctggcccagaagctgcagggcctcgaaaactggggacaagatcccggggtgagcgcgaatgcatcaaaggcatggcatcagaagtctcacttccaaaattctcgagaatggagcggaaaggaaaagtggtgggacggccagagagacagaaaggcagagcattggaaacacaaaaaagaggaaagcgggcgcgaacgcaaaaaaaattggggcggacaggaagaccgggagcctgcgggccgctggaaggagggacgcccgcgggtcgaagaatccggaagcaaaaaggagggcaaacgccagggcccgaaggaacctccacgcaagagtggtagtttccacagttcgggcgaaaagcagaaacagcccagatggcgtgagggtaccaaggactctcatgatcctttacccagctgggctgaacttctgcgccccaagtatcgcgcaccccaggggtgttcgggagtcgatgagtgtgcgcggcaggagggactcacattctttggcaccgaactggctcctgtccgacagcaggaactagcaagcctgttacggacatacctggcacgactcccctgggctggccagctcaccaaggaactgccactttctcctgcgttctttggcgaggatggaatcttcagacatgatcgccttcggttcagggatttcgtggatgcactcgaagactcactggaagaggttgcagtgcagcaaaccggggatgatgatgaggtcgatgacttcgaagacttcattttttcccactttttcggggacaaagccttaaagaagcgttctgggaaaaaagacaaacattcccagagccctcgcgctgctggcccacgggaagggcacagccattctcatcatcatcatcaccggggatag

SEQ ID NO: 26951 - DNA, 2244 bp, Artificial Sequence
  Description of Artificial Sequence: Synthetic coding sequence
atggccaagtacaacaccggcggcaaccccaccgaggacgtgagcgtcaacagccgaccttttagggtgaccgggccaaactcctccagcggaatccaggctcggaaaaacttgttcaataaccaggggaacgcctccccacctgccggcccaagcaatgttccaaagttcggctcccccaaaccccctgtggccgtgaaaccctcgtctgaggagaagcctgacaaggaacccaagcctccattcttgaagcctacaggcgcaggccagaggtttgggaccccagcaagcctgactactagagatcccgaggcaaaagtcggcttcctgaagccagtgggacctaagcccatcaacctcccaaaggaggatagcaaacctacttttccatggcctcctggcaataagccttctttacactcagtgaaccaggatcatgatttgaaacctttggggcctaagtcaggccccaccccccctacgtcagaaaatgagcagaaacaagccttcccaaaacttacaggggtgaagggtaagtttatgtcagcgtctcaggacctggaaccaaagcctctgttccccaagccagcctttggtcagaagccaccgcttagcactgaaaactcccatgaggatgagagtccaatgaaaaacgtgtctagctcgaaaggatctcctgctcctctcggcgttcgctccaagagtgggcccctaaagccagctagggaagattcggagaacaaagatcacgcaggagagatttctagtttaccctttcccggcgtagtcctcaagccagccgcaagccggggtggaccaggcttgagcaagaatggcgaggaaaaaaaagaggaccgcaagatcgatgcagctaagaacacattccaatctaaaattaaccaggaagagctggcaagtggaacaccccccgcacgatttccaaaggccccatcaaagctcactgtaggcgggccatgggggcaatcccaggagaaagagaagggagacaaaaactccgcaacaccaaagcagaagcctctgcctcccctatttaccttaggtccaccaccgccaaaacccaatcgtcccccaaacgtcgacctgaccaaattccataaaaccagctcaggcaatagcacaagcaaaggccaaacctcctactccacaaccagcctgcccccacccccaccaagtcatcctgcatcccagcctcccctgccagcttcccatccaagccagccacccgtgccaagcctcccaccccgcaacatcaagcctcctttcgacctgaaatcccctgtgaacgaagataaccaggacggcgtgactcactcagacgtggtgattcctttagaccacgagcaggactctgaaggtgagacctacgaggacattgaggcttccaaggagcgagagaagaaaagggagaaggaagaaaagaagagactggagctggaaaaaaaagaacagaaagaaaaggaaaagaaggaacaggaaatcaagaagaagttcaaactgactggtcctatccaggtgattcatttggctaaagcttgctgcgatgtgaagggcggtaagaacgagttgtccttcaaacaaggcgaacagatagaaatcatcagaatcacggataatccagaagggaaatggctcggccggacagctcggggatcatatggctatatcaaaacaaccgctgtggagattgattacgacagtctgaagctcaagaaggatagtctgggagcccccagcagacccatagaagatgatcaagaagtttatgacgacgtggctgagcaggacgatataagttctcactcacaaagtggtagtggaggcatctttccccccccccccgacgatgacatttacgatggcatcgaggaggaagacgcagatgacggctctacacttcaggtgcaggaaaagtccaacacctggagttggggcattctcaagatgctcaagggcaaggatgatagaaagaagtccattcgtgagaagcctaaggtctctgattctgacaacaatgaggggtcttccttccccgccccaccaaaacagttggatatgggggacgaagtatacgatgacgtcgacacatcagattttccagtgtcatctgccgagatgagtcagggaacaaatgtaggtaaggccaagaccgaggagaaggatttgaagaagttaaaaaagcaggaaaaggaggagaaggattttcggaagaagtttaaaaagtag

SEQ ID NO: 26952 - DNA, 1566 bp, Artificial Sequence
  Description of Artificial Sequence: Synthetic coding sequence
atgaccagcgccttcaagctggacttcctgcccgacatgatggtggagggccggctcttggtgcccgatcgaattaacggaacagccaacaaaatgaacggagccttggatcacagcgaccagccagacccagacgctataaaaatgtttgtgggccagataccaaggagttggtctgaaaaggagctcaaagagctgttcgagccgtatggcgccgtctaccagatcaacgttctgcgcgaccgcagccagaatccgccgcaaagcaaaggatgttgctttgttaccttctatactcgaaaagcagccttggaggcccagaatgccctccataacatcaagacgctccccggcatgcatcatccaattcagatgaaaccggcggatagcgaaaagagcaatgccgtggaggaccgaaaactctttataggcatggtgagcaagaaatgcaacgagaacgatatccgcgtgatgttcagcccattcggccagatcgaagagtgtcggatccttcgagggccagacggcctgagccgcggatgtgcttttgtgacattttcaacccgcgctatggctcaaaatgccatcaaggctatgcaccagagccagaccatggagggctgcagtagcccgatcgtggtgaagtttgctgacacccagaaggataaagagcagcgcagactgcagcagcagctggcacagcaaatgcagcagctgaacaccgccacctggggtaatctgactggcctgggaggactgactcctcaataccttgcactcctgcaacaagctacaagctcatcgaacctgggcgccttttccgggattcagcagatggctggaatgaacgccctgcaattacaaaacctggccactcttgcagctgccgccgctgccgcacaaacaagtgcaacttccacaaacgctaatccccttagtaccacctctagcgccctgggagcattgacctctcctgttgcggcctcaaccccaaattccaccgcaggagctgctatgaatagcttgacttcattgggcaccctccagggtctagccggggctactgtcggactgaataacattaatgcccttgccgtcgcacagatgctgagtgggatggcggcattgaatggtgggttgggcgccacaggacttactaatggcaccgcagggactatggacgcattaacccaggcctatagcggaattcaacagtatgctgctgcagccctgccaaccctgtattcccagagcctgttacagcaacagtctgcagctggctcacagaaggagggtccagagggcgcgaatctctttatctaccatttacctcaagagttcggcgatcaagacatcctgcagatgtttatgccttttggaaacgtaatctctgctaaggtgttcattgataagcaaaccaacctgagcaagtgcttcggatttgtgtcatatgacaatcccgtgtctgctcaagccgctattcaggctatgaatggttttcagatcggcatgaagcgactcaaggttcagctcaagcgatctaagaacgactctaaaccatattag

SEQ ID NO: 26953 - DNA, 1710 bp, Artificial Sequence
  Description of Artificial Sequence: Synthetic coding sequence
atgctgcgggacatgaccggcctgccccacaaccggaagtgcttcgattgtgaccagaggggccccacttatgtgaacatgactgttggaagtttcgtttgcacatcctgtagcggatctctgcggggactcaatcctcctcacagagttaaatctatttcgatgacaacgttcacccagcaagaaattgaatttcttcagaaacatgggaatgaggtgtgcaagcagatttggcttggccttttcgacgatagatcctctgcaatccctgactttagggatccgcagaaggtcaaagaatttctgcaggagaagtatgaaaaaaaacggtggtacgtcccccccgaacaggccaaggtcgtggcctctgtgcatgcctcaatctcaggctcgtccgccagtagtacatctagtacccctgaggtgaagcccctcaagtccctgctgggcgatagcgcacctactctccacctcaacaaaggaacccctagccagagccccgtagtaggaagatcgcagggacagcagcaggagaagaagcagtttgacctcctatccgatcttggtagcgacatctttgctgctccagccccccagtcaaccgccacggcaaatttcgcaaactttgcacactttaatagccatgcagcccagaatagcgctaatgccgattttgcaaatttcgacgctttcggccaatcatctggaagtagtaactttggagggtttcctactgcatcccactcacccttccagccacaaaccacagctttccggatgctctcttcttcctgcagttttggagagttcacaagtgcgttccccctgcaggccacgcattctggctctgccgccagcgtaaacgctaattttgcccattttgacaatttcccaaagagtagttctgccgatttcggaacttttaatacctcgcagtcacatcagaccgcatctgctgtaagcaaagtgtccacgaacaaagcagggcttcagacggccgataagtatgctgccttagccaacttggacaatattttctctgctgggcagggcggcgaccaggggtcaggcttcggcactaccgggaaggctccagtggggtctgtggtgagcgtgcccagccagtcttcagccagtagtgacaagtacgccgcgcttgcggaacttgatagtgttttttcatcagccgcaacctccagcaacgcatatacgtccacaagcaacgcatcatccaacgtgttcggcacagtgccagtggtggcttcagcgcagacgcagcccgcgtccagcagcgtgccagctcccttcggagctacaccttctacaaacccctttgtggctgccgcaggcccgagcgttgctagtagcactaaccctttccagacaaatgcacgaggcgcaacggccgccacatttggtactgcgtctatgagtatgcctacggggttcggtacacctgcaccctacagtctgcccacgagcttttccggatcttttcagcaacccgcattccctgcccaggccgctttccctcagcaaacagccttttcccagcaacctaacggcttcgccgcatttggccaaaccaagcctgtggtgaccccttttggccaggtggccgcagccggggtgagctctaatccctttatgaccggtgcccccacagggcaatttccaacagggtcatcgtctacgaatccttttctgtag

SEQ ID NO: 26954 - DNA, 2007 bp, Artificial Sequence
  Description of Artificial Sequence: Synthetic coding sequence
atgagcaagctggccgccgcccaccggggcgccatccgggccctgcaaatgttcgtcacccagtttacggaccgcggcgaacatccgttgcctgctagatgcaaggaattgggctcccttattcgtcagctgtccctgtgtagtgtaaagctcgacgccgaccctagcgtgccagacgtagtcattgatatcctgcagcaaatagaggccctggaaagcctgctcgagaaaaagctttcaccgaaaaaggtcaaaaaatgtttctccgaaatccggtcgagattccctatagggagccagaaagccttggagaggtggccatcgacctctcccaagggggaaaggcggcccctgaccgcaaaagacacctttccacaagaaacctcacgaccttcagtagccaagcaactcctcgctgataagtaccagccagacacagagctcccggaaacccagcgcctgcaatctgagttggacgtcttagacgcagacatagtgctggaggaggggccatttattctggatcagagcgcctccttcaaggatgaggtcctcgccgtagctaagactaaggccgggaaaaagaagcccgtgaccgagaacgttcctttccgtaaaaaagatacactggcacccgcaagacaacaaggccttagaaaggccgaaagaggacgccagtctcagcctcactctaagagtcgcgttcagcaaactacagtttcctccaggctgaagatgaacagacagccagtcaaggacagaaaggctccatggattccgcccaatcctacctcaccacccgcatctcctaagtgcgccgcctggctgaaagttaagacaagcccacgggatgctaccaaggaaccactgcagcaggaggatcctcaggaggagagccacttgaccggggcagttgagcatgaggctgcccggctggcctggttagatgccgaaacatcaaaaagactcaaagagctggaagagctgaaggccaaagaaattgatagtatgcagaagcaacggttggattggcttgacgcagaaacaagccgcaggacaaaagaactgaacgagcttaaagcggaggagatgtacagactgcagcagctgagcgtttctgctactcacttggctgataaggtagaggaagcagtgttggataggctgaagcccctactggtcaaggcgcagagagtgaactccacaactgaggctaacatccacctgaaggacggtagctctgtgaacaccgccaaggcccaacctgcacaggaggtcgcagctgttgattttgagtccaataatatcaggcagctagacgactttctggaagattgcgctagcgaactgtgggccgttactcacgccaaaattctcgggtcggaaacgctcgccacagttgaagacagcaaggacagtcctgatctcgaaatcatgatgcgcaggatggaggagatggaaaaatatcaagaatccgtcagacagcgatacaataagatagcatacgctgatccccgcctctggatgcaagaggagaataatgaccagaagatttctgccatttccgagaaacctcttagtccccaccccatccgcattaccaaaacagttgacaggaaagaccctgccgtgaacattatgctcgagagaccatgcaatgggaactcattagatgaatctgttggaacagaagaaggaagtgaaaaaagagaggcccccctattgtccctggcagaagacagccagcagaaggagggaagagcccctctgttcgttccgccagggatgcaacattcaatcggcgattactgcagccggttcgagcaatacctccggataatctcccatgaggcagtggggtcttttaacccgtggctaatcgcagagtctttctctgaagaattagtggacgaggctctgggggctgttgccgccgagctgcaggatatgtgtgaggattacgcggaggcagtattcacttccgaattcctggaagctgctacatag

SEQ ID NO: 26955 - DNA, 3612 bp, Artificial Sequence
  Description of Artificial Sequence: Synthetic coding sequence
atgcccgcccggatcggctactacgagatcgaccggaccatcggcaagggcaattttgctgtcgttaaaagagcaactcatctggttactaaagcaaaggtagcaataaaaatcattgataaaactcagcttgatgaggaaaatctgaaaaagatctttcgggaggtgcagattatgaagatgctttgccaccctcacataatcaggctttaccaggtgatggaaaccgaaaggatgatttatctggttaccgagtacgcttctggcggagaaatcttcgatcacctggttgcccatggaaggatggctgagaaagaggcgcggcgcaaatttaaacagatagtaactgcggtgtatttttgccactgcaggaacatcgtccaccgcgatcttaaagccgaaaatctgctcctcgatgctaacctcaacattaaaatagcggacttcggtttttcaaatttgttcactcctggccagctgttgaaaacgtggtgtggatcccccccatatgcggctccggaactgttcgaggggaaggaatacgatggtccgaaagtggacatttggagcctgggagtggtgctgtacgtgctggtttgcggcgcactgcccttcgacgggagcaccctgcagaacctcagggcccgagttctttccgggaagttcagaattcccttttttatgagcacggagtgtgagcatctgattcgtcatatgctggtgcttgaccccaacaagagattgtccatggagcagatctgtaagcacaagtggatgaaattaggagatgccgacccaaatttcgatagactgatcgccgagtgccaacagctgaaagaagagaggcaggttgacccactgaacgaggatgtgcttttggcaatggaagatatgggcctggataaggagcaaaccttgcaagccgaacaggccggaactgccatgaatatcagcgtgccccaggtccagctaataaatcctgaaaatcaaatcgtagagcccgatggaaccctgaacttggattccgatgagggcgaggaacccagcccagaggctctggtgcgctacctgagcatgcgacggcatactgtcggagtggccgatccgcggacggaagtcatggaagacttgcagaaactcttaccaggttttccgggtgtgaacccacaggctccgtttttgcaggtcgccccaaatgtaaatttcatgcataacctcctccccatgcaaaatctccagcccacgggccagctggaatacaaggaacagagcctgctacagccacctactctccagcttttaaatggaatgggccccctggggagacgagcatcagacggcggagcaaatatccagttacatgcgcagcaactgctgaagcgtcccagaggtccctcccccctggtaacaatgaccccagccgtgcccgccgtgacacccgttgacgaggagtcttccgacggagaaccagaccaggaggccgttcagcgttacctcgccaatagatctaagcgtcacactctggctatgaccaacccaacagctgagatccccccagacttgcaaaggcaactaggacagcagcccttcaggagccgcgtgtggcctccgcatcttgtgcctgatcagcataggtcaacatacaaggattcgaatacgctccacctgcccacggaaagatttagtcctgtacggagattcagcgacggtgcagcctccattcaagccttcaaagcgcacctcgagaagatgggcaacaacagcagtataaaacagctgcagcaggagtgcgagcagctccagaaaatgtacggcggtcagatcgacgaacgcaccctcgagaaaacccaacagcagcacatgctctatcaacaggagcaacatcatcaaatcctgcaacaacaaattcaggattcaatctgtcccccgcagcccagtcctcccttgcaagctgcctgtgaaaatcagcccgcccttttaacacaccagctacagaggctcagaattcagccgtcttcaccgcccccaaatcaccccaacaaccatctgtttcgccagcctagcaacagtcctcccccaatgagctctgccatgatacagccgcacggggccgcaagtagttctcagttccaaggtctccctagcagatcggcgatctttcaacagcagcctgaaaactgttccagcccaccaaatgttgccctgacctgcttgggaatgcagcaaccagcccagtcacagcaggtgacaatacaagtgcaagagccagtggacatgttgagcaacatgccgggaactgctgccggatcaagtggccgcggaattagcatctcacccagtgctggccaaatgcaaatgcaacaccgtaccaatctgatggcgactctgagctacggtcaccgcccccttagcaagcaattaagcgctgactctgcggaagcccattctgcccaccagcagccaccgcattacacaaccagtgcattgcagcaggctttgctatcgcctaccccaccagattatactagacatcaacaggtaccccatatcctccaggggctgctctccccaaggcattccttaactgggcatagtgatatccgccttccaccaactgaatttgcccaactcatcaaacggcagcagcagcaacgacagcagcagcagcagcaacaacagcagcaggaatatcaggaactattcaggcacatgaaccagggggatgccggatcgcttgcgccttctctgggcggtcagtccatgaccgaaaggcaggccctgagttatcagaacgccgactcataccaccaccacacatccccacagcatctcctgcaaattcgtgcacaggagtgtgtgagccaagcatctagccccacaccccctcacggatacgctcaccagcccgccttaatgcactccgaatcaatggaggaggactgcagctgcgagggagctaaagatggctttcaggatagcaaatcatcttccacgctgacaaagggctgtcatgattccccattgctgctgagcacagggggccccggagaccccgaaagcctccttgggaccgtttcacatgcccaggagttaggaatacacccatacggtcaccagcccactgccgctttttcgaagaacaaggtgccctcacgggagccagtgattggtaactgcatggacaggtcctctccaggtcaggccgtagagctcccagatcataacggactgggttatcctgcaaggcccagtgtgcacgagcaccatcggcctcgcgctctgcagcgacatcacacgatccagaatagtgatgacgcatacgttcagttagacaatctgccaggaatgagtctggttgctgggaaggctctctccagcgcacgtatgtctgacgctgttctgagtcagtctagccttatgggctctcaacagtttcaggacggcgagaacgaggaatgtggggcgagccttggcggccatgaacacccagacctgtcggatggcagccagcacctgaattcttcttgttatcccagcacatgtattactgacatcctcctcagctacaaacacccggaagtgtcttttagcatggaacaggccggagtctag

SEQ ID NO: 26956 - DNA, 2046 bp, Artificial Sequence
  Description of Artificial Sequence: Synthetic coding sequence
atgatcgagaagatgcagggcagccggatggacgagcagcggtgctccttccctcccccgctcaaaaccgaggaagactacattccatatccctctgtccacgaagtgttggggcgcgagggcccatttcccttaattcttttgccacagtttggcggctactggattgaaggaacgaatcacgagataacctctattcccgagaccgaaccacttcagagcccgaccacgaaggtgaagctggaatgcaacccaacagcacggatctatagaaaacactttctcggcaaagaacactttaactactactctctcgatgctgctctggggcacttagttttctctctgaagtacgacgtcatcggtgatcaagaacatctgcggctcttgttacgtacaaaatgccgcacttaccatgacgtaatacccatcagctgcctgacggaatttcccaatgtagtacagatggctaagctcgtgtgcgaggacgtcaacgtggatagattttaccctgtattgtatcctaaagctagcagactcatcgttacatttgacgagcatgtgatcagcaataattttaagttcggagtgatatatcaaaagctgggccagacctctgaagaggaattattttctaccaacgaggagtcccctgctttcgttgagttcctggagtttctcgggcaaaaagtgaaattacaagactttaaagggtttaggggcggcctcgatgtgactcacggccagacagggacagagagcgtgtattgcaactttaggaacaaggaaatcatgtttcatgtgtccactaaattgccatacacagagggggacgctcagcaattgcagcgcaagcgacacatcggcaacgatattgtggcagtggtatttcaggacgagaacacccctttcgtacccgacatgatcgcaagcaactttcttcatgcctatgtcgtggttcaggctgagggcggaggccccgacggcccgctgtacaaggtgtcagttacagcaagggatgacgtgccattcttcggacctccattgccagaccccgcagtctttaggaaaggccctgagttccaggagttcctgctgacaaaactcatcaatgccgaatacgcatgttataaggccgagaagtttgcgaaacttgaggaacgcacacgtgccgcacttctcgagacattgtacgaggagcttcacatacatagccagagtatgatgggactgggcggcgacgaggacaaaatggagaatgggagcggcgggggaggattctttgagagcttcaaaagagtgattaggagccggtcccagtctatggacgctatgggattaagtaataagaaacctaacacagtgagtaccagtcattccggctcattcgccccgaataatccagatctggctaaagccgctggtatctctcttctcattccaggaaagtctgctagtcgtttcggcagacgaggcagcgctatcggaattggtactgtcgaagagtccttaattgtccctgggaaatccccaacccgcaaaaaatcaggcccgttcggcagccgaagatccagcgcaattggcatcgagaatatccaagaggtgcaggagaaacgcgagtccccccccgccggacagaagactccagatagtggtcacgtctcacaggagcccaagtccgagaatagttcaacacaatccagcccagagatgcctaccaccaaaaatagagcagagaccgccgcccagcgggctgaggctctgaaagatttcagccgatcatcctcctctgcctctagctttgcaagtgtggtggaagaaactgagggcgtcgatggcgaggatacggggttggagtctgtatcttcttctggcacccctcataaaagggactcttttatatattcaacctggttagaggattccgtgtcaactactagcggtggttcatcacctgacgccggtaaacttggcgacccagcctgtccggagatcaaaattcagctggaggcatctgaacagcacatgccccaactcggatgctag

SEQ ID NO: 26957 - DNA, 675 bp, Artificial Sequence
  Description of Artificial Sequence: Synthetic coding sequence
atgagcgtgggctacgccaacggcatccgggtgatgagcatgacccacaccggggaaccaggctttatgctctatattccaatcgaatacgcccttcacgtgtacaacgaagttatgtcagtgggtcagaaatatggtattaggaacgcggggtattacgcactgcgcagtttacgtatcgaaaaattttttgctttctggggccaagacattaacaatctgaccacaccactggagtgcggacgggaatctagggtaaaactcgaaaagggtatggatttcattggccgcgacgcgctgctgcaacagaagcagaacggcgtctataaacgcttgaccatgtttatccttgatgatcatgactccgatctggacctgtggccttggtggggcgaacctatctaccgcaatggtcagtatgtagggaagaccacaagcagtgcctactcatactcactggaaagacatgtgtgcctgggcttcgtgcacaacttctctgaagataccggcgaggaacaggttgtcacagctgacttcattaatcgcggcgagtatgagattgacattgccggttaccgattccaggccaaggccaagttgtaccccgtagcttccctcttcacccaaaagcggagaaaggatgacatggaactgagtgatctgcatggcaagtag

SEQ ID NO: 26958 - DNA, 1590 bp, Artificial Sequence
  Description of Artificial Sequence: Synthetic coding sequence
atgcacttcagcggcctggaggaggccgtgtaccggaacatccaggcttgcaaagagctcgctcagaccacccgcacagcatacgggccgaacggaatgaacaaaatggtcatcaatcatctggagaaactgttcgtgacaaacgatgccgcaaccattctccgggaactggaggttcagcatccagccgctaagatgattgtgatggctagtcatatgcaagagcaggaggtgggggacggaaccaactttgttctcgtgttcgccggcgctttgttggagctggctgaagaactcctgcgcataggcctgagcgtgtcagaagtgatagagggctatgaaatagcctgccgaaaggcacatgaaattctgcccaaccttgtatgttgctcagctaaaaacctcagggatatcgacgaggtatcatctctcttgcgcacctccatcatgagcaagcaatacggcaacgaggttttcttggccaaactgattgcacaagcatgcgtgtccatattccccgactcaggccacttcaatgtggataatattagggtgtgcaagatcttgggctctggaatttcaagctcttcagtgctccatggcatggtgttcaagaaagagaccgagggggatgtaacgtccgtgaaagatgccaaaatcgcagtgtatagttgtccattcgacggtatgatcactgaaaccaaaggaactgtgttaataaagactgctgaggaattgatgaatttctctaagggggaggagaacctgatggatgcccaggtgaaggccattgctgacaccggcgcaaatgtggtcgtcaccggcggaaaggtggctgacatggcactccactacgccaataaatataacattatgctagtcaggttgaacagcaagtgggatctacggcgcctatgtaaaacagtcggggctacagcactccccagactgacacctccagtgcttgaagaaatgggtcattgcgacagtgtgtatctgtccgaggtgggcgacactcaggtagttgtcttcaagcatgaaaaggaagacggcgcaatttcaactatcgtgctgaggggcagcaccgacaacttgatggatgacatagaacgcgctgtagatgatggcgtcaacactttcaaagtgctgacaagggacaagagattggttcccggcggaggagccactgagattgagcttgccaagcagattaccagctatggggaaacttgcccggggctggaacagtacgccatcaaaaagtttgcagaggccttcgaagcaatccctagggctctggccgagaattccggcgtgaaggcaaacgaggtgatctcaaagctgtacgctgtgcaccaggagggaaacaaaaatgtagggctggacattgaggctgaggtgccagctgtgaaagacatgttggaggctggtattcttgacacctacctggggaagtactgggcaatcaaactggcgactaacgcagctgtgacagtgctaagagtggaccaaattataatggctaagccggcgggaggacctaaacccccttccggaaagaaggattgggacgacgaccagaacgactag

SEQ ID NO: 26959 - DNA, 2193 bp, Artificial Sequence
  Description of Artificial Sequence: Synthetic coding sequence
atgttcggccggaagcggagcgtgagcttcggcggcttcggctggatcgacaagacgatgctggcctcactcaaagtgaagaagcaggagctcgccaactcttcagacgcaacacttccggaccgccctcttagcccacccttgaccgccccacccactatgaaatcttcggagtttttcgaaatgctggaaaaaatgcaggggatcaagctggaagagcagaaacccgggccgcaaaaaaacaaggatgactacattccatacccttctatagacgaggtggtggaaaaaggcggtccgtaccctcaagtcatccttcctcagttcggcgggtattggatagaggaccctgaaaatgttggaacacccacttcgctaggatcctcgatttgcgaagaggaagaagaggataacctaagtcctaacacttttggctacaagctggagtgcaagggtgaggccagagcgtatagacgccacttcctggggaaagaccacctcaatttctattgcactgggtcttccctcggcaatctcatccttagcgtaaagtgcgaagaagccgaaggaattgagtacctcagagtaattctcaggtccaaactgaaaaccgtgcacgagaggattccactagcgggtttgagcaagcttcccagcgtgccccaaattgcaaaagcattctgcgatgacgcagtgggacttcggtttaacccagtattgtatccaaaagccagtcaaatgattgtaagttacgacgaacatgaagtgaacaataccttcaagttcggcgtgatctatcaaaaggctcggcagacactggaagaggagcttttcggcaataatgaagaaagccccgcattcaaggagttcctcgacctgttaggtgacaccatcacactgcaggatttcaagggctttcggggaggtctggacgtgacacatgggcaaacgggcgtcgagtccgtgtataccaccttcagagatcgcgagataatgttccacgtttcaaccaagcttccatttaccgatggcgacgcgcaacagttgcagagaaaacgccatatcggaaatgacatcgtggccatcattttccaggaagagaacaccccttttgtacccgatatgattgcttccaactttttgcatgcctacatagtggttcaagtagagacccccgggaccgaaacaccgtcctataaggtgtccgtgacggcccgtgaagacgtccccacattcggcccacctctaccatctcctcctgtgttccaaaaaggccccgagttcagggagttcctgctgactaaactgaccaatgcagagaatgcatgttgtaagagcgataaattcgccaaacttgaagacaggaccagggccgcgctcctggataaccttcacgacgagttgcacgcacatacacaggctatgctgggtctcggccccgaggaagataagttcgaaaatgggggacatggaggtttcctcgagtccttcaaaagggctattcgcgtgcggagccactctatggagaccatggttggcggtcaaaagaaatcacacagcggggggattccagggtcactgtcggggggcatttcacacaactctatggaggtaaccaaaacaacattttccccgccggtagtggcagctacagtcaagaaccagtctagatctcctataaaacgacgttccggcctgttcccaaggttacacacagggtcggagggccagggggactccagagccaggtgtgacagcacttcctcaacacccaagacaccggatggcggacatagcagccaggagattaagagtgagacttccagtaacccttcctcccccgagatatgtccaaacaaggaaaagccctttatgaagctgaaagaaaatggtagagctatctctcgctcatcctcatcgacttcctcagtttcctccacggcaggtgagggcgaagccatggaggagggcgactctggtggaagtcaaccgtccaccacgtctccgttcaaacaggaggtctttgtgtattcgcctagccccagcagtgagtcacccagcctgggggctgccgctacccccattattatgtcccggtctccgacagacgccaaatccagaaatagcccacgcagtaacctgaagttccgcttcgacaaactgtcccatgcttcctctggcgctgggcactag

SEQ ID NO: 26960 - DNA, 2271 bp, Artificial Sequence
  Description of Artificial Sequence: Synthetic coding sequence
atggtggcccccgtgctggagaccagccacgtgttctgctgccccaacagggtacggggagtactaaattggtcctcaggcccacgcggcctgctagcgttcggcactagctgcagtgtcgttttgtacgatcccctgaaacgcgtggtggtaactaacctcaacggccacacggctcgggttaattgtattcagtggatttgcaagcaggatggctccccctcgacagaactggtttcgggcggaagcgacaatcaagtaatccattgggagatcgaagacaatcaactattgaaagcagtccatctgcagggacacgaaggaccagtgtacgccgtgcatgccgtttatcagcgtcgcacatctgacccggcattgtgtaccttgatcgtatccgccgcagccgatagcgccgtgcgcctctggagcaaaaagggccccgaagtccccatccttgcctgtggaaacgacgattgccgcatccacatatttgcccagcagaacgaccagttccagaaagtcctgtctctatgtgggcatgaggattggatacgcggagtagagtgggccgcctttggccgtgaccttttcttagctagttgcagccaggattgtctgattcgaatttggaaactttatatcaaaagcacgtccctggagactcaggatgacgacaatatccgactgaaggagaacacctttaccatagagaacgaatccgtcaagatcgcctttgcggtgacactcgagacagtgcttgccgggcacgaaaattgggtcaacgctgtgcattggcagcctgttttttataaggacggtgtgctgcagcagcccgttcgcctgctgagcgcatccatggacaaaaccatgattctatgggcccctgacgaagagtccggggtatggctggagcaaagggagtggacccctgagatcgtgatatccggccacttcgacggagttcaggatttagtgtgggacccagagggagaattcattatcacagttggaaccgaccagacaacaaggctttttgccccgtggaaacgaaaagaccaatcacaagttacctggcatgaaattgcgcgacctcagattcacggatatgacttgaagtgcctggctatgatcaaccgatttcagttcgttagtggcgctgacgagaaagttcttcgcgtcttcagtgctccgcgcaatttcgtggagaacttctgcgccatcacaggccagtccctcaaccacgtcctgtgcaatcaggattcagatctgcccgaaggcgcaaccgtgccggcgctgggactttctaacaaggctgtgttccagggtgatattgcatcccagccgtcagatgaggaagagctgctgacatcaacaggatttgagtaccagcaggttgcatttcaaccatccatactgaccgagcccccaacagaagatcaccttctgcagaatactctctggcccgaggttcagaagctgtacggtcacggttacgagattttttgcgtgacctgtaacagctccaagaccttgctggcctccgcctgtaaagctgccaagaaggagcacgcagctattatcctgtggaacaccaccagctggaagcaggtccagaaccttgtttttcacagccttactgtcacacaaatggccttctcccctaacgaaaagttcctgctcgctgtctccagagataggacatggtccttgtggaaaaaacaggatacaatctcgccggagtttgaaccggttttcagtctgtttgcttttaccaataaaattactagtgttcactctcgaattatttggtcttgtgactggtcacctgattcaaaatatttttttaccgggtccagggataaaaaggtggtggtttggggggagtgcgactctactgacgattgtattgagcacaatattggtccatgcagcagtgtgctggacgtaggcggtgcagtgacagctgtgtccgtgtgcccagtccttcatccctcccagcgatacgtagtcgcagtcggactcgaatgcggtaagatttgcctgtatacgtggaagaagaccgaccaggtccccgagattaacgactggactcactgtgtggaaacctctcagtcacaatctcacacccttgcaattaggaaactgtgctggaaaaactgtagcggtaaaactgagcaaaaggaagccgagggcgcagaatggctgcacttcgccagttgcggcgaggatcataccgttaagattcaccgagtgaataaatgcgccctatag

SEQ ID NO: 26961 - DNA, 1272 bp, Artificial Sequence
  Description of Artificial Sequence: Synthetic coding sequence
atgaaccggcagcccgtgaaggaccggaaggccccctggatccccccaaatccgacttctccacctgctagcccaaaatgtgccgcttggctgaaggtgaagacctcacctagagatgccacaaaggaacctctgcaacaggaggaccctcaggaagagagtcacctcaccggagccgtggagcatgaggcggccaggctagcctggttggatgcagagactagcaaacgtctgaaggagctagaagagctgaaggcgaaggagatagacagcatgcagaagcagcgactagactggctggatgccgagactagtagaaggaccaaagagcttaacgaattgaaggctgaagagatgtaccggctccaacaactgtctgtttcagccacgcacctagccgacaaggtagaggaagcggtcctagacagactcaagccgctgctagtgaaagcccagcgcgtcaacagcaccaccgaggccaacatccacctgaaagacggctcatctgtgaacaccgctaaggcccagccagctcaggaagtcgccgctgtggacttcgagagcaacaacatccgacaactggatgatttcctggaggattgcgctagtgagctctgggccgttacccacgccaagatcctcggctcagagactcttgccaccgtggaggactctaaagactccccggatttagaaataatgatgcgaagaatggaggagatggaaaagtaccaggaaagcgtccggcaacgctacaacaagatcgcttatgccgatccacggctctggatgcaggaagagaataacgaccaaaaaatctctgccatttcggagaagcctctgtcccctcaccccattaggatcaccaagacagtcgacagaaaggatcccgcagtaaacattatgctggagcggccctgtaacggcaacagcctggacgaaagcgtgggcacagaggagggcagcgaaaagcgcgaggctcccctgctcagtctcgcagaagatagccagcagaaggagggaagagctcccctgttcgtcccacctggcatgcagcactctataggcgactattgcagtcgatttgagcagtacttgagaataatctcacatgaggcagtcggctcgttcaatccttggctcatagctgagagtttctcagaagaactggtcgacgaggcactgggcgctgtagcagcagagcttcaagatatgtgcgaggactacgcagaagcggttttcacgtccgagttcctggaggccgcgacttag

SEQ ID NO: 26962 - DNA, 777 bp, Artificial Sequence
  Description of Artificial Sequence: Synthetic coding sequence
atggcccggctgcaggaggagcacggcgaccagctgctgagcatccgatgtcagcatcaggagcaagtggaggaccttaccgcttctcatgacgcagcgttgttggaaatggagaacaaccataccgttgcaattacaattctgcaggacgatcatgaccacaaggtccaggagctgatgtctactcatgagctggaaaagaaggaactcgaagagaattttgaaaagttgagattgtctctacaggaccaggttgataccctgacattccagtcccagagcctaagggatcgggccaggagattcgaagaagccctgaggaagaataccgaggagcagctggaaatcgcactggctccctatcagcacctcgaggaagacatgaaatccctgaaacaggtcctcgaaatgaaaaatcagcagatccatgagcaggagaagaagatcctggaattggaaaaacttgcagaaaagaatattattctggaagagaagatccaggtgctccagcagcagaacgaagatttgaaagcccgaatcgatcagaataccgtggtcactcggcagctgtccgaggagaacgccaatctgcaagaatatgttgagaaggagacacaagaaaaaaagagactttcgaggactaacgaagagctgttgtggaaactgcaaaccggcgaccccacttcacctattaaactgtccccaaccagtccggtctaccgcggatcttcctccggcccaagtagtccagcccgcgtctccaccacgcccaggtag

SEQ ID NO: 26963 - DNA, 1053 bp, Artificial Sequence
  Description of Artificial Sequence: Synthetic coding sequence
atgtgccccaccaccacctggccccggggccggcggtggagccggaacctgagagatactcaggcagtgcgccattataaaatctggcgccgcgccggcggccgtctgcacctgaacgaagctgtgtctttcctgtcactccctgagcttgtaaattatcatagagcacagtctctcagccatggcctaagactagcggccccgtgcagaaaacatgaacccgaacctctgccgcattgggacgattgggagagaccgagagaggagttcacactctgtcgaaagttaggctctgggtatttcggtgaagtattcgaggggctgtggaaggacagggttcaagtagcaatcaaagtaatttcacgcgacaaccttctgcaccaacagatgctccaatctgagatccaggccatgaagaagcttcggcataagcatattcttgccctgtacgctgtagtaagtgtgggggatcccgtgtatattattactgaacttatggcaaagggctctctgctggaattactgagagactccgacgagaaagtgctccccgtgagcgaacttcttgatattgcatggcaggtggccgagggaatgtgttatctggagtcgcaaaattatattcacagggatctcgccgcccgcaacatactagtgggcgagaatacactgtgtaaagtgggagacttcggcctggctcggcttatcaaagaagatgtatatctctctcatgatcataacatcccttacaaatggacagctcctgaagcattatctcgcggtcactacagcacaaaaagcgacgtctggtccttcggcatcctgttgcacgaaatgttctcgcggggtcaggtgccataccctggcatgagcaaccacgaggcctttttgagagtggacgccgggtaccgaatgccgtgtcccctcgaatgcccgccaagcgtgcacaagctgatgctgacatgttggtgtcgcgaccctgaacaaagaccttgtttcaaggccctccgagaaagattaagctcttttacatcttacgagaaccccacctag

SEQ ID NO: 26964 - DNA, 3480 bp, Artificial Sequence
  Description of Artificial Sequence: Synthetic coding sequence
atggtgagcagcagccccagcacccccagcaacatcccccagaagccctcacaacccgctgcaaaggagccgtccgccacccctcccatctcaaacctcactaaaacagcaagcgaatccatatccaatctttcagaagccggatctatcaagaagggagaaagagaactgaagattggggaccgtgtcctggtgggagggacaaaggccggtgttgtgagattcctgggcgagacggattttgcaaagggtgaatggtgcggcgtggagcttgacgaaccactcggcaagaatgacggagctgtcgctggaacacgctatttccagtgccaacctaagtacgggctgtttgcacctgtccacaaggtcactaagatcggattcccgagcacaacccctgcaaaggctaaagcaaacgctgtccgtagggtgatggccaccactagtgccagcttaaagaggtctccttccgcgagctctctgagtagcatgtcaagtgtagcctcttcggtctcttctcgcccatctcgcaccggactgttgacagagaccagcagccgatacgcccgaaaaatcagcggaaccacggccttgcaagaagctctcaaggaaaaacagcagcatatcgaacagctgctcgcagaaagggatttggaacgcgcggaagtggctaaggcaaccagccacgtcggagagatagaacaggagctggcccttgcccgcgacggacacgatcagcacgtgctggaactcgaagctaaaatggaccaattacggactatggtggaagcagccgacagggaaaaagtggaactcctgaatcaactggaagaagaaaagcgcaaggtcgaggatctccagttccgggttgaggaggagtcaatcaccaaaggcgacttggagactcagacaaagctcgaacacgctaggattaaagaattggagcagtccctcctgtttgaaaaaaccaaggctgacaagttgcagcgggagttagaagacacaagagtagccaccgtgagtgagaagtcccgaatcatggagctggagaaggacttggctctcagagtccaggaggttgctgaactgaggagaaggctagaatccaataagcctgcaggtgatgtcgacatgagcctgagtctgctgcaagaaatttcttccttgcaggagaaactggaggtgacaaggacagatcatcagcgagagattaccagcttaaaagaacattttggagcacgggaggagacccatcagaaagagatcaaggcgctgtatacagctacggagaaactgtctaaggagaatgagtccctgaagtcaaagttagagcatgccaataaagagaactccgacgtgatcgctctatggaagtccaaattggaaacggccatcgcatctcaccagcaggccatggaggagttgaaagtgagtttctcaaaaggcctgggaacagagacagcggagtttgccgaactcaaaacccagattgaaaaaatgagactagactaccagcacgagatcgagaacctccaaaatcagcaagactcagaacgggctgctcatgctaaggaaatggaagccctgcgagcgaaactgatgaaagtgattaaagagaaggagaactccctggaggctatcagatccaagctggataaggccgaggaccagcaccttgtggagatggaggataccctgaataagctccaggaggctgaaatcaaaaaggaaaagtttgctgaagcgtccgaggaagctgtttcagtgcagcgatccatgcaggagacagtcaataagctgcatcagaaggaagaacagttcaatatgcttagctctgacctcgaaaagctgagagagaatttggcagatatggaggccaagttcagggagaaggacgagagagaagaacagctgattaaagcgaaggagaagttagaaaacgatatcgcggagataatgaaaatgtcaggggataacagttctcagctcactaagatgaatgacgaattaaggctcaaagagagagacgtcgaggagctgcagctaaagctgacgaaggctaacgagaacgcgagctttttgcagaagtccattgaagacatgactgtcaaagcagaacagtcccagcaagaagctgccaagaaacacgaagaagaaaaaaaagagttagaaaggaaactatcggatctcgagaaaaagatggaaacgtctcacaatcagtgccaagagcttaaggctcgctacgagagagccacgagcgagaccaaaactaaacacgaggaaatattacagaatcttcagaaaaccctgttggataccgaggacaaacttaagggcgcccgcgaagaaaactccggtctgctgcaggagctggaggagctcaggaagcaagctgataaagccaaagctgcccagacagcagaggacgccatgcagattatggaacagatgactaaagagaagaccgaaaccttggcctctttggaggacacgaagcagacgaacgcaaaactgcaaaacgaactggacactctgaaggagaacaatctgaaaaatgtcgaagaactaaacaagagtaaggagttattgacagttgaaaaccaaaaaatggaagagttccgaaaggagatagagacactgaagcaggccgctgcacagaagagtcagcaattaagcgctcttcaggaagagaacgtcaaattggccgaagaacttggtcgatctcgggacgaggtcacgtctcatcagaagttagaggaggagcggagcgtgcttaataaccagctccttgagatgaagaagagagaaagcaaatttattaaagacgcagacgaggagaaggcatcactgcagaaatccatcagtatcacatcggctctgctgactgagaaagatgcagagctggagaaactgagaaacgaggtgacagtgttgcggggagaaaacgcatctgctaagtctctccactctgtcgttcaaacccttgaatctgacaaagttaagctcgagctgaaagttaaaaacctggagctccaacttaaagagaataaacggcaattaagctcatccagcggcaacactgatacacaggctgacgaggacgagagggctcaagagagtcagaaccaaatcgactttctaaactctgttatcgtggatctacaacgcaaaaaccaggacctcaaaatgaaagtggagatgatgagtgaagctgctctaaacgggaatggcgacgatctgaacaactatgatagtgatgatcaggaaaaacagtccaagaagaagccccgcctgttttgtgacatttgcgactgcttcgatttgcacgacaccgaggactgtcccacacaggctcaaatgagtgaggatccgccccactccacacaccacggatctaggggggaagagaggccctactgcgaaatatgcgagatgttcggtcattgggcaaccaactgtaatgacgacgagactttttag

SEQ ID NO: 26965 - DNA, 756 bp, Artificial Sequence
  Description of Artificial Sequence: Synthetic coding sequence
atgaccaccgagcagcggcggagcctgcaggccttccaggactacataagaaagaccctcgacccaacttatattctgtcctatatggcaccatggttcagagaagaagaagtgcagtatatacaggctgaaaagaataataaaggacccatggaagcagccaccctgttcctgaagttcctcctagaactccaagaagagggatggttcagaggctttctggatgccttggaccacgcgggatattccggtctttatgaggccattgaatcatgggatttcaagaagatcgagaaacttgaagagtatagactgctgctcaaaagactgcagcccgaattcaagactagaatcatcccaaccgacataatcagcgacctttccgagtgcctgattaaccaggaatgtgaggagatcctgcagatatgtagcacaaagggtatgatggccggtgcggagaaactcgtggagtgcttattacgatcagacaaggagaattggcccaaaacactgaagctggcactggagaaggaacgcaataagttctccgagttatggatcgtggagaaaggcataaaagatgtcgaaacggaagatttggaagacaaaatggagacttctgacatccaaattttttatcaggaagaccctgaatgtcagaacctgtcagagaactcatgcccaccttctgaggtgtccgatactaatttatatagcccatttaagcccatcaagaaaaaaaaaaagaaaaagtag

SEQ ID NO: 26966 - DNA, 3189 bp, Artificial Sequence
  Description of Artificial Sequence: Synthetic coding sequence
atggtgagcagcgcccagatgggcttcaacctgcaggccctgctggagcagctctcacaagatgaattaagtaagttcaagtacctcattacaaccttttccctggcccatgaactgcagaagattccacataaagaggttgataaagccgatgggaaacagctggtcgaaatcctgaccacacactgtgatagctactgggtcgagatggccagcctgcaagttttcgaaaaaatgcatcgcatggacctgagcgagagggcaaaggacgaagtgagagaagctgccctgaaatcattcaacaaacggaagccactgtccctgggcattacaagaaaagagaggccccccctggacgtggacgaaatgttagagcggttcaaaaccgaagctcaagcattcactgaaacaaagggtaatgtgatctgcctggggaaagaggtattcaaagggaaaaagcctgataaggacaaccgatgtagatatatcctgaagaccaagtttagagagatgtggaaatcttggcctggggacagtaaagaagtccaagtgatggctgagcgctacaagatgttgatccctttctctaaccctcgcgtcttgcccggtccatttagctacacagtggtactgtacggccctgcagggcttggcaagaccacattggctcagaaactcatgctggactgggcggaggacaatttaatccataagtttaagtacgcattctacctcagttgcagggaattgagtagacttgggccctgctctttcgcagaattagtatttcgtgattggccagaattacaagacgatattcctcacatcctggcccaggctcggaaaatcctgttcgtaatcgacggcttcgatgagctgggcgcggcgcccggtgccctgatcgaggacatttgtggcgattgggagaaaaagaagcccgtcccggttttgctcgggagtttactgaacagggtaatgctgccaaaagccgctttattggtgacaacccgaccacgggccctacgcgatctgcgcatattggctgaggaacctatttatattcgagtggaaggattccttgaagaagatcgcagagcttatttcctgaggcatttcggggacgaagatcaggctatgagggcctttgagctgatgcggagcaacgccgccctgtttcagctgggaagtgctccagctgtgtgctggattgtgtgcaccactttaaagctgcagatggagaagggggaagacccagttcctacatgtctgacaagaacggggctattcctcaggttcctctgttcaagattcccacagggcgctcaacttagaggtgccctgcgtactttgtcgttactggcagctcaggggctgtgggcccaaacatctgtcctccacagggaagatctggaaagattgggagtacaggaaagtgacttgagactgtttttggatggggatatcctgcggcaggatagggtctccaaaggctgctatagttttatacacctgtcctttcagcaattcctcaccgctcttttctatacactagagaaagaggaggaggaagacagggatgggcacacctgggacatcggggacgtccagaaactcttgagcggagttgaacggctacgaaaccccgacctgattcaagctgggtattactcctttggcttggctaatgagaagcgagctaaggagctggaggccacgtttggatgccgcatgtcacctgatattaagcaagagctcctacggtgcgacatctcctgcaaggggggccactccaccgtcaccgacctgcaagaacttcttggctgtctttatgaatcccaggaggaggagctcgtcaaggaagtcatggcacagttcaaagagatatcattacacctgaacgctgttgacgtggtaccctctagtttttgcgttaaacattgcagaaacttgcagaaaatgtctttgcaggtaataaaggaaaatcttcctgaaaatgtgacagcatcagagtcagacgccgaagtcgaacggtcccaggatgatcagcacatgctcccattttggacagatctctgttctatcttcgggtctaacaaagacttaatgggtctggcaatcaacgactccttcctgagcgcttctctggttagaatcctatgcgaacagattgcaagcgacacatgtcatctgcagagagtagtctttaagaacattagccccgccgatgcccatcgaaacttatgcctcgcccttcgaggacacaaaactgtcacctacctgacgctccagggcaacgatcaggatgacatgttcccagctttatgcgaagtgctaagacatcctgagtgtaacctcagatacctcggtctggtgagctgcagcgccactacacagcaatgggccgatctctctctggctttggaggtaaaccagtcacttacatgcgtcaacctaagcgacaacgagttactggatgaaggcgcgaaacttctctacaccacgctcaggcaccctaagtgtttcctgcaaaggctcagcttggagaattgccatctgactgaagcgaactgtaaggacctggctgccgtactggtcgtgtctagggaactgacacatctctgtttagcaaaaaacccaatcgggaacacaggggtcaaatttctctgtgaaggcctgcgatacccagagtgcaagcttcaaactctcgtcctctggaattgcgatatcacatcagacgggtgttgcgacctcaccaaactgttacaggagaagtcaagcctcttatgtctggatctgggtctaaaccacatcggggtgaagggtatgaagttcctttgcgaagcccttcgaaaacccctatgcaaccttagatgtctgtggttgtggggatgtagcatccctccttttagctgtgaagacctttgtagcgccctgtcttgtaaccagtccctcgtgacccttgacctgggccagaatccccttgggagtagcggtgtgaagatgctgttcgaaaccctgacctgcagctctggtaccctgagaaccctccggctaaagatagacgactttaacgacgaactgaacaaactgctggaagaaattgaggagaaaaatccccagctgatcatcgatacagaaaagcaccacccatgggctgagcgcccctcgagccatgattttatgatctag

SEQ ID NO: 26967 - DNA, 363 bp, Artificial Sequence
  Description of Artificial Sequence: Synthetic coding sequence
atgtggagcatcgagaacatcgccttcggcagcggcggcggcctgcttcagaaacttacccgcgatctcctgaattgcagttttaaatgttcatacgtcgtgacgaacgggctgggaatcaacgtttttaaagaccccgttgcagacccaaataagaggtcgaagaaggggaggctgagcctccacagaacacccgcgggcaatttcgtcaccctagaggagggtaagggggaccttgaggaatacggacaggatctcctgcacaccgtttttaaaaatggcaaggtgaccaaatcatactccttcgatgagatacgcaagaacgcccaactgaacattgaattggaggccgcccaccattag

SEQ ID NO: 26968 - DNA, 936 bp, Artificial Sequence
  Description of Artificial Sequence: Synthetic coding sequence
atgtaccacctggacaaccaccccgagaagcagttcagcaccgacgttcttaagcaggccattgagctttcaccagataatcagtatgttaaagtgctgttaggcttgaagctacaaaaaatgaacaaggaggccgagggtgagcagttcgtggaagaggctctcgaaaaaagcccatgccaaacagacgtgctcagaagtgccgcaaagttctacaggcggaagggcgaccttgacaaggccattgagctctttcagagagtgttagagagcaccccaaataacggctatttgtaccaccagatcgggtgttgttataaagccaaggtacgccagatgcagaatacaggagagagtgaggccagcggcaataaagaaatgattgaggcactcaagcagtacgctatggattactcaaacaaagcgctggagaagggtcttaacccacttaatgcatacagtgatttagctgagttcctggagaccgagtgttaccagacacccttcaataaagaagtgccagacgctgagaaacagcagagtcaccagaggtactgcaatttgcaaaagtacaacgggaaatcagaagatactgccgttcaacatggccttgaaggcttatctatatccaagaagtctaccgacaaagaggagattaaggaccagccacagaacgtttccgaaaatcttcttccacaaaacgcgcctaactactggtatctgcagggtttgattcacaagcaaaacggagaccttctccaggcagccaagtgctatgagaaggagttaggccgcctgctccgagatgccccaagcgggattggcagcatcttcctgagtgcctctgaattagaagatggaagcgaggagatgggacagggtgccgtcagttcctctccccgagaacttctgtctaattcggaacagctgaactag

SEQ ID NO: 26969 - DNA, 3267 bp, Artificial Sequence
  Description of Artificial Sequence: Synthetic coding sequence
atgtacggcagcgcccggagcgtgggcaaggtggagcccagcagccaatccccaggcaggtccccccgacttccgaggtccccgcgacttggccacagaagaacaaactcgactgggggatcttcaggatcctccgtgggggggggatctggtaagactctgagcatggagaacattcagtccctcaatgcagcttatgccacatctggcccaatgtaccttagcgatcacgagaacgttggctctgagaccccaaagtcaaccatgactttaggtagatcaggtgggcgtctgccctacggggtccgcatgacagccatgggctctagtccaaatatagcgtcctcaggtgtcgcctcagacacaattgcatttggagagcaccacctaccacccgtctccatggcctccacagtgccacactcattacgacaggcacgcgataacaccatcatggacctgcagacacagctgaaagaagtgctgcgcgagaacgacctgctgcggaaagacgtcgaagtgaaagagagtaaattgagctcctctatgaattcaatcaagactttctggtctcccgaactcaagaaagaaagggctctgcgtaaagatgaggcttctaagattaccatatggaaggagcagtaccgggtggttcaagaggagaatcagcacatgcaaatgaccatccaggcccttcaagatgaactgagaatacaacgcgaccttaatcagctgtttcagcaggacagcagttccagaaccggtgagccctgcgttgctgagctgacagaggagaacttccagcgcttacacgccgaacatgagagacaggccaaagagctttttcttctgcgaaagaccttggaagaaatggagctgaggattgaaactcagaagcagactctcaatgcccgagatgaatccattaagaagttgctggagatgttgcagagcaaaggtctttcagcaaaggccaccgaagaagatcatgagcggacccgacgactggctgaggccgagatgcacgtgcaccacttagagtccttgctggagcaaaaagaaaaggagaacagcatgctgcgcgaggagatgcacagacggtttgagaacgccccagactcggccaaaaccaaagcactgcaaaccgtcatcgaaatgaaggacagcaagatttcctccatggaaagggggttgagggatctggaagaagagatccagatgttgaaatcaaacggggccttgagcacagaagagcgtgaagaagagatgaaacaaatggaggtgtatcgttctcattcaaaattcatgaaaaacaaaattggccaggtcaaacaggagctgtctaggaaggacacagaactgctcgccctgcagaccaaactcgaaaccttgacaaatcaattttccgattctaagcagcacattgaggtgttgaaagaatcgctaacagctaaggagcagcgggccgcaatcttacagactgaagtggatgctttgcgcctgcgcctggaggagaaagagacaatgctgaataagaagacaaaacagattcaggacatggcagaggagaagggcacacaggctggcgaaattcacgatctcaaagatatgttggatgttaaagaacggaaggttaacgtcctccagaagaagatagaaaacctccaagaacagttgcgcgacaaagagaagcagatgagcagtctaaaagaaagggtaaaaagcttgcaggcagatactaccaacactgatacagcactcactaccctggaggaagcattggcagaaaaagaaagaactattgaacgtctcaaggagcagagggacagagacgaaagggagaaacaagaagaaatcgacaattataaaaaggacctgaaagacttaaaagagaaggtgtccctattacagggcgacctctcagaaaaggaggcaagtctgcttgacttgaaggaacatgcatcatccctggccagctcagggctgaagaaggattctcgcttaaaaacgttagagattgctctggaacaaaagaaggaggaatgtctgaagatggaaagccagcttaagaaggcccacgaagccgccctcgaagcccgtgcctcccctgaaatgtctgatcgaatccagcacctcgagagagagattacgcgttataaggatgagagcagcaaggcacaagctgaggttgatcgcctgttagaaattttgaaagaggtggagaatgaaaagaacgacaaagataagaaaatcgcagagctggaacgtcaggtgaaagatcagaacaagaaagtggccaaccttaaacataaggagcaggtagagaagaagaagagtgctcaaatgctagaagaagcgcgacggagggaagacaatctgaatgacagctcgcagcagctgcaggactctctccgaaagaaagatgataggattgaggaactggaagaggctttgagagagtctgtccagattaccgcagagagagaaatggttctagcgcaggaggagtccgcacgtactaacgccgaaaagcaggtggaggaacttctgatggccatggagaaggtaaagcaggagctagagtccatgaaggcaaagctctcgtccactcagcaaagcctcgcagagaaggagacgcacctgaccaatttaagagcagaacgccgaaagcatctcgaggaagttctggaaatgaaacaggaggcactgctggccgctatttctgaaaaagacgctaacattgcactgttagagctctcctctagcaagaagaaaacacaggaggaggtcgcagcactgaagagggaaaaagatagactggtccaacagctaaagcagcagactcagaatagaatgaagctgatggccgataactacgaggatgaccactttaaatccagccactcaaatcaaactaaccataaaccatctcctgaccaaattattcagcccctgctggagcttgaccagaatcgatctaagctgaaattatatatcggccacctgactactttatgccacgacagagatccattaattctcagaggcctgacccccccagcttcttataaccttgatgatgaccaggcagcgtgggagaatgagcttcagaagatgacacgtggtcagctccaggacgaattggagaagggtgaacgggacaatgccgagttgcaggagttcgctaatgctattctacagcagatagcagaccactgcccagatatcttagagcaggtcgtgaacgcgcttgaagagtccagttag

SEQ ID NO: 26970 - DNA, 1485 bp, Artificial Sequence
  Description of Artificial Sequence: Synthetic coding sequence
atgaagctggtgaacctgtacaagggcgccgtgctgtacctgctgcgtggacgtaaaaccttcctgatccccgtcctgttcaataattatataactgcagccctgaaactgctggagaagttgtacaaagttaaccttaaagtgaagcacgtcgaatacgacaccttctacatcccggaaatcagcaatctggttgatatccaggaagattatctcatgtggttcctgcaccaggctggaatgaaggcaaggcccagcataatccaggatactgttactctatgcagctatccgtttattttcgatgctcaggcaaaaaccaaaatgctccagacggacgccgagctccagatgcaggtggccgtaaacggggccaatctgcagaacgtcttcatgctcctcaccctcgaacctctcttagcacgaagcccttttcttgtactgcatgtgcgtcggaataacctcgtgggcgatgcgctccgggagctgagtattcactctgacatcgatttgaaaaagcctctgaaagtgatcttcgatggtgaagaggctgtggatgcgggaggggtcactaaagagttttttctcttgttactgaaggagctcctcaatcccatttacggcatgttcacttactaccaggactctaacctcctgtggttctccgacacttgtttcgtggagcacaattggttccatttaattggtatcacttgtggattggccatctacaactcgactgtggttgatctccacttccctttagctttgtacaaaaaattgttgaatgtcaaaccaggacttgaagatttgaaagagcttagccctaccgagggacggagcctacaagaactgttggactacccaggcgaggacgtagaagagaccttctgtctgaactttactatttgcagggagagttatggggtgattgaacagaaaaagctcattcctggcggagataatgtgacagtgtgcaaggataaccgccaggagttcgttgacgcatatgtgaactacgtgtttcagatctccgtgcatgagtggtacacggccttttccagcgggttcctgaaagtttgtgggggaaaagtgctggagttgttccaaccaagcgagcttcgagccatgatggttggcaacagcaactataattgggaggaactagaggaaaccgctatttacaagggagactacagcgctacacaccccaccgtcaagctgttctgggaaacctttcacgaatttccattagaaaagaagaagaagttcctcctgttcctgacgggttccgatcggatacctatttacggaatggccagcctccagatcgtgatacagagcactgctagcggggaggaatatctccctgttgcccatacatgctacaatctactcgacctccccaagtactcctcaaaagaaattcttagtgcgcgcctgactcaggcactggacaactacgaaggcttttccctggcctag

SEQ ID NO: 26971 - DNA, 2370 bp, Artificial Sequence
  Description of Artificial Sequence: Synthetic coding sequence
atgtgccccagcagccagagcccccggccccccctgctgcggcccccttgcagctaccgggaagtaccttcatccgtccagtccccagcacagcagcaagtgccggcgcgccctggagcgccctcggtacaggtgccttccccatttctgcttcagaatcagtatgaacccgtccagcctcattggttttattgcaaggaagtggagtataagcaactgtggatgccctttagcgtgttcgactccctgaatcttgaggaaatctataattctgtgcagcccgaccccgagtcagtcgtgctcggcacggatggaggcaggtacgacgtgtacctctatgaccggattcgcaaggccgcttactgggaggaggagccagccgaggtgaggcgctgtacttggttttacaagggggataccgacagtaggttcatcccctacacagaagaattttctgaaaaacttgaagccgagtataagaaggctgtgacaacaaaccaatggcacaggcgcctcgaatttccctcaggagagaccattgtgatgcacaacccgaaggttatagtgcagtttcagccgtctagtgtgcccgacgagtggggtaccacccaggacggacagactcgccctagagtcgttaagagagggattgatgacaatctggatgagatcccagacggggaaatgcctcaagtggaccatctcgtgttcgtcgtacacggcattggcccagtttgcgatcttcggttcaggtccatcattgaatgcgtagatgacttccgggtggtttccttaaagctgctgcggacccatttcaagaaatcgcttgacgacgggaaggttagccgggtggagtttctccctgtacactggcattcctctctgggcggcgatgccactggtgtggacagaaacataaaaaaaatcacccttcccagcattggccggttcaggcattttacaaatgagacgctgctggacatactgttttacaattcccctacctattgccagacaattgtggagaaggtcggcatggagattaaccacctccatgctctgtttatgtccaggaatcccgactttaagggaggggtgtccgtggcggggcattctctcggctcccttatcctttttgatatcctgagcaatcagaaggatctcaaccttagcaagtgccccggccctcttgccgttgctaatggagttgtgaagcaactacactttcaggagaaacaaatgcccgaggagcccaagcttacgttagatgagtcttacgacctggtcgtcgagaataaggaggtcctgacactacaggagacacttgaggctttgtccttgtccgagtatttctccacattcgagaaagagaagattgacatggagagcctcctgatgtgtaccgttgatgatttgaaggaaatgggcatccccttgggtcccagaaagaagattgctaatttcgtggaacataaagcagctaaactaaagaaggctgcctccgagaagaaagccgtggctgcgacctcaacgaagggtcaagaacagagtgcgcagaaaacaaaagacatggcctccctgccaagtgagtccaatgaaccgaagcgcaaactcccagtgggtgcctgtgtgagctctgtttgcgtcaactacgaaagtttcgaagtgggggcggggcaagtgagcgtagcctacaactcactggattttgagccagagatcttcttcgcgctggggtcaccaatcgccatgtttttgacgattcggggcgttgaccggattgatgaaaactattctctgccaacgtgtaagggctttttcaatatatatcatccactggatccggtggcttacaggctcgagccgatgattgtccccgatctcgatctaaaggccgtgctgattccgcatcataagggtaggaagcgactgcacctggagctgaaggaaagcttgagccgaatggggtcagacctgaaacagggctttatttcaagtcttaaatccgcatggcagactctgaatgagtttgccagggcccatacgtcctccacacaattacaggaagaactggagaaagtcgcgaaccagatcaaagaagaagaggaaaagcaggtggtagaggccgaaaaagtggtggagtcgcccgacttctctaaggacgaggattacctaggaaaggtaggaatgcttaatggtggccgcagaatcgattacgtattgcaggaaaagccgatcgagtcatttaatgaatacttgttcgccttgcagtcccacctgtgctactgggaatctgaggacacagcattactgctattaaaagagatttaccgaaccatgaacatatcacccgaacagccacagcactag

SEQ ID NO: 26972 - DNA, 828 bp, Artificial Sequence
  Description of Artificial Sequence: Synthetic coding sequence
atgagcgccgaggtgaaggtgaccggccagaaccaggagcagttcttattgctcgctaagtctgccaagggggctgctctcgcaaccctcatacaccaggtgttagaagcaccaggggtttacgtcttcggcgaattgcttgatatgcccaatgtcagagaactggcggagagtgatttcgcatctactttccgtctactgaccgtttttgcttatggtacatatgccgactacctggctgaggctcgcaatctgccgccactgaccgaggctcagaagaacaaactaaggcatctatcggtcgtaaccttagccgccaaggtcaaatgcataccttatgccgtcttgttagaggccctggcgctgcggaacgtccggcagcttgaagatttggtgattgaggccgtctacgcagatgtgctaaggggttcacttgatcagagaaaccaaagactcgaagtcgattattcgatcggcagagacatccagagacaggacctgagcgctatagctaggaccctgcaagaatggtgtgtgggctgcgaagtggtcctgtccggtattgaagagcaggttagtagggctaaccagcacaaagaacagcagttgggcctgaaacagcagatcgagagcgaagttgcgaatttgaagaagacaatcaaggtgaccaccgctgccgcagcagccgctactagccaggaccctgagcagcatttgaccgagctcagagaacctgctccgggaactaatcagcggcagccttcaaaaaaggcaagtaaaggtaaaggcctgagaggatctgctaaaatctggtcaaagagtaactag

SEQ ID NO: 26973 - DNA, 240 bp, Artificial Sequence
  Description of Artificial Sequence: Synthetic coding sequence
atgaacggcaccctggaccaccccgaccagcccgacctggacgccatcaaaatgttcgtcggacaagtgcctcgtacctggtctgaaaaagaccttcgcgagctgtttgagcagtatggggccgtctacgaaataaacgttttgcgtgaccgctcccagaacccaccccaatcaaaggggtgctgtttcgtaacattctacactaggaaggcagccctcgaagctcagaacgccctttag

SEQ ID NO: 26974 - DNA, 738 bp, Artificial Sequence
  Description of Artificial Sequence: Synthetic coding sequence
atggtgctgctgcacgtgaagcggggcgacgagagccagttcctgctccaagcccctgggtccacggagctcgaagaactaaccgtacaggtagctagggtgtataatgggcgcctgaaagtacagcgtctttgctcagaaatggaagagctggccgaacacgggatctttctgccgcctaatatgcagggtcttacagatgaccagattgaagagctgaaactcaaagacgaatggggcgagaagtgtgtccccagcgggggagctgtgtttaaaaaggatgacattggacgtagaaatggccaggcacctaatgagaagatgaagcaggtgttgaagaagaccattgaagaggcgaaggcaataatctctaaaaaacaagtggaggcgggtgtttgcgtgactatggagatggtgaaggatgctcttgaccaacttagaggtgccgtaatgattgtctacccaatgggactgccaccatatgatcctatccgcatggaattcgaaaataaggaggatctgtcgggaacacaagcgggactgaacgtgataaaagaggctgaagcgcagttgtggtgggcagcaaaggagttgcggcgcacaaagaaactcagcgactacgtgggtaaaaatgaaaagactaagatcatcgcaaaaattcaacaagtatccacattctgcttcaacgtgagcgtggtgttcgtgatttccctgcaaaccgataagaatgtccagtag

SEQ ID NO: 26975 - DNA, 396 bp, Artificial Sequence
  Description of Artificial Sequence: Synthetic coding sequence
atggccatgaccgccggcaccaccaccaccttccccatgagcaaccacacgcgggagcgggtgactgttgcgaaactgacattggagaatttctattctaatctgatcctgcaacacgaagaacgagagacaagacaaaaaaaactggaggttgctatggaagaggagggcctggcagacgaggagaagaagctgagaagatcccaacacgctcgcaaagagaccgagttccttaggctcaagcgaactaggcttggtctcgacgatttcgaatcgctgaaagttatcgggaggggcgcgttcggtgaggttcgactggtgcagaaaaaagatacaggacacatttacgcgatgaaaattttacgcaaatctgacatgctggagaaagagcagtag

SEQ ID NO: 26976 - DNA, 2517 bp, Artificial Sequence
  Description of Artificial Sequence: Synthetic coding sequence
atgaccggcgccgagatcgagcccagcgcccaggccaagcccgagaaaaaggcaggcgaggaagtcatcgccggtcctgaacgggagaacgatgtcccccttgtcgtccgtcccaaggtgaggacgcaagccaccacaggagctcgccctaagacagaaaccaagtcagtgcctgctgcccgtcctaaaactgaagcccaggcaatgagtggcgctaggcccaaaaccgaggtacaggtcatgggaggggcgagaccgaagacagaggcgcagggaattacgggagcacggccaaagacagacgcacgggctgtgggaggggcacgcagcaaaactgatgccaaggccatcccaggggcaaggcctaaggatgaggcccaggcttgggcccaatccgagttcggcaccgaggcagtgagccaagccgagggggtttctcagaccaacgctgtggcatggcccctggccactgctgaatcagggtcagtgaccaaatccaaagggcttagcatggatagggaactcgttaacgtggacgcggagacattccccggtacgcaaggtcagaaagggattcagccctggttcgggccaggagaagaaaccaacatggggtcctggtgctattcacggccgagagcacgcgaagaggccagcaacgagagcggattctggtccgctgatgaaacaagcaccgcaagctctttttggaccggggaagaaaccagtgtcagatcctggccaagagaggagtccaatacaaggtccaggcatcgtgctaagcaccagacaaaccctcgcagccggcccagaagcaagcaggaggcctatgtggatagttggtccggttccgaagatgaggcctcaaacccattttcattctgggtcggcgaaaatacaaacaatctctttcgccctcgcgtccgagaggaagccaatatacgatccaaactgcgcaccaatagagaagactgcttcgagtctgagtctgaggatgaattctataaacagtcctgggttctgcccggcgaggaagcaaactcacgttttaggcacagagacaaagaggatccaaataccgctctgaagctcagggcacagaaagacgtcgattccgaccgcgtcaagcaagagcccaggttcgaggaagaagtgatcattggcagttggttctgggcagagaaggaggcaagcttggaaggcggggcgagcgctatctgtgagtcagagccaggaacagaggagggtgccatcggcggttcagcctactgggctgaagagaaatcttctctcggagccgtagcccgggaagaggccaagccagaatccgaggaagaggccatctttggatcctggttctgggaccgcgatgaggcctgtttcgacctgaacccttgtcctgtctataaggtctctgatcgctttagagacgcagcagaagagctcaacgcaagcagccggcctcagacttgggacgaagttacagtggagtttaagcccggtctgttccatggggtggggtttcgttcgactagcccattcgggattcctgaagaagcctccgaaatgctcgaggccaaacctaaaaacctggaactgagccctgagggcgaagagcaggagtctcttctgcagccagatcaacctagccctgaatttacattccagtacgatccttcctaccggtccgtaagggaaatcagggagcacctacgagccagagaatctgctgaatccgagagctggtcctgcagttgcattcagtgcgagctgaaaatcgggtccgaggagttcgaagaatttctgctactcatggataaaatcagggatccctttatccacgagatatccaaaatcgccatgggcatgaggagcgcatcccaatttactagagacttcatcagggactcaggcgtagtgagtcttatcgaaaccctgctgaattacccatcttcccgcgtcagaaccagttttctggaaaatatgattcacatggccccaccctaccctaatctaaatatgatagaaacctttatttgccaggtatgtgaagaaacactggctcatagtgtggactcccttgagcagttgactggtattagaatgctgcggcacctgaccatgaccatagattatcacacgctgatcgcgaactacatgtccggatttctgtccctgctgaccactgccaatgcccgtacaaagttccatgtgcttaaaatgttgcttaatctctcggagaacccagctgtggctaagaagctgttttctgccaaggctttgtccattttcgtgggcctgttcaacattgaggagaccaatgacaacatccagattgttattaagatgtttcagaacatctctaatatcattaaaagtggcaagatgtctctgatcgatgatgactttagtttggagccacttatatctgccttccgggagtttgaggagctggcaaagcagttacaagctcaaatcgataaccagaacgatcccgaagtagggcagcagagctag

SEQ ID NO: 26977 - DNA, 1215 bp, Artificial Sequence
  Description of Artificial Sequence: Synthetic coding sequence
atggacttcaacatgaagaagctggccagcgacgccggcatcttcttcaccagggccgtccaattcactgaggagaagttcggacaggctgagaaaaccgagctcgatgctcactttgagaatttactcgcacgggccgatagcactaagaactggacggaaaagatattgcgacagactgaggtgctcctacaaccaaacccgagtgcacgcgttgaggagtttctttacgagaaattggacaggaaggtaccaagtagagtgactaacggcgaactgcttgcgcagtacatggcagatgcagccagtgagttggggcccaccacaccttatggaaagacactgatcaaagtagccgaagcggagaagcaactgggagccgccgagcgggactttatccacaccgcgtcaattagcttcctgacgcccctcaggaattttctggaaggagactggaagaccatctcaaaggagcggaggctgctccaaaataggcgattggatctggacgcatgcaaagcacgtctaaagaaggcaaaggccgccgaagccaaagccacggcggaggggcccaccgtaccagacttccaggagactcgcccccgaaattacatcttgtccgccagcgcaagcgctctctggaacgatgaggtggacaaggctgagcaggagcttcgcgttgcccagacagagttcgatcgacaggcagaggtgacacgattgctgcttgaagggattagctccacccatgttaaccacctgaggtgccttcacgaatttgtcaaaagtcagacaacgtactatgctcagtgttaccgacacatgcttgatctgcagaaacaattagggagctcacagggcgctatttttcccggcactttcgtcggcaccacggaaccagcctctcctccactgtcctccacgagcccaactacggccgcagcaactatgcctgtcgtcccctctgtggcctccctggccccgcccggagaggcttcactttgtctcgaagaagtagcccccccggctagtggcactaggaaagctcgggtgctgtacgactatgaagccgcagactcttccgagctcgccctcctggcagacgaactgattactgtctactctcttccaggcatggatcctgattggcttatcggagaaagaggtaataagaaggggaaagtacccgtgacatacctggaactgctgtcgtag

SEQ ID NO: 26978 - DNA, 495 bp, Artificial Sequence
  Description of Artificial Sequence: Synthetic coding sequence
atgacctgctgccagaccagcttctgcggctaccccagcttcagcatatccggcacctgcgggagctcctgttgccagccaagctgttgcgaaacctcctgttgtcaacctaggtcttgtcagacaagtttctgtggcttcccttctttttctacctctggcacctgttcatcctcctgttgccagcctagctgttgcgagaccagctgctgccagccttcttgctgccaaatcagttcctgcggcacaggctgcggcatcgggggagggattagctatggccaagagggctcaagtggcgcagtgagcacacggatccgctggtgccgcccggattccagagtcgagggaacatacttgcccccatgttgcgtggtttcctgcacaccgcccagctgttgtcagctgcaccatgcccaggcgtcttgttgccgcccctcttattgcggacaaagctgttgccggccggtgtgctgttgtgagcccacttgttag

SEQ ID NO: 26979 - DNA, 846 bp, Artificial Sequence
  Description of Artificial Sequence: Synthetic coding sequence
atgctgaccaagctgcagatcaagcagatgatggaggccgccacccgtcagatcgaagagcgtaaaaaacagcttagttttattagtcccccaactccccagcctaaaactcctagcagctcacagcccgagagactgccaataggtaatacaattcagccatcacaggccgcaacctttatgaatgacgccatcgagaaggccagaaaggccgctgaactgcaggctcgcatccaggcccagctggccctaaaacccggcctgatcggtaacgctaacatggtgggcctcgcgaatctccatgccatggggatcgccccccccaaagtggagttaaaagatcagacaaagccaacgcctctgatacttgacgagcagggcagaacggtggatgccacaggtaaggagatcgaactgacccatcggatgccgaccctgaaggccaatatccgggctgtaaaacgggagcagttcaaacagcagctcaaggaaaaacccagcgaggacatggagagcaatactttctttgacccgcgggtgagcatcgccccgtctcagaggcagcgtagaaccttcaagttccatgataagggcaagtttgaaaagattgcccagcggttgaggactaaagcacaactggaaaagttgcaagcggaaatctctcaggcagctagaaaaaccggcattcacaccagtaccaggctcgccctaatcgccccaaagaaagagctcaaggagggtgatattcctgagatagaatggtgggattcctacatcatcccaaacggcttcgatctggggaaatcacaggagaggcgcttattttggaatcacaagtcctgttag

SEQ ID NO: 26980 - DNA, 693 bp, Artificial Sequence
  Description of Artificial Sequence: Synthetic coding sequence
atgcggggccacgagagcagcgtgttcagcatcagcgtgcacgcctccgggaagtacgctatcactacctcttctgatactgcccagctttgggacctggacacatttcagagaaaaagaaaactcaatatcagacagtctgtggggatccagaaggtattctttctgcccctgtcaaacaccatcttatcttgttttaaagacaactcgatattcgcttgggagtgcgatacactgttctgcaaataccaattacccgcacccccggagtcttcgtcgattctttataaagtgttcgcggtcactagagatggacgcatcctggcagcgggaggtaaaagcaaccacttacatctttggtgtctcgaggctagacaactgttccgtatcatccagatgcctactaaggtgcgagctatccgccacctggaattcttaccggactccttcgacgctggcagcaaccaagtgctgggcgtgttatcccaggatggaattatgaggtttatcaatatgcagacctgtaagttgcttttcgagattggtagtctggacgaaggcatttcgagctcggctatttctcctcacggacgttatatcgcgtctatcatggaaaatggcagtctaaacatatactctgtccaggcattgacgcaggagattaataaggaagaggtgagggcccaaaattag

SEQ ID NO: 26981 - DNA, 1212 bp, Artificial Sequence
  Description of Artificial Sequence: Synthetic coding sequence
atggacagcaccatggacgacgccgtggccggcgacttcgccctgatcaataaactggatattcagtgcgatttaaagactttatcggacgacattaaggaatcacttgaatctgaggggaaaaatagtaaaaaggaagagccgcaggaactccttcagtcacaggattttgtcggcgagaagttaggttcaggggagccatctcacagtgtcaaggttcatacggtcccgaagcctggaaagggggctgatctgtcaaaaccaccctgtaggaaagccaaggaaataaggaaggaacggaagcggctgaagctcatgcagcagaaccctgccggcgagcttgagggctttcaggctcaaggccatccacccagcctttttcctccaaaagcaaagtctaatcagccaaaatcgttggaggacctcatttttgagtcacttcccgaaaacgcttcacataaactagaagtgcgggtcgttaggtcgagtccaccctcctcccaattcaaggccacactgttggaatcctaccaggtctacaaacgataccaaatggtgatacataaaaacccgccggacacgccaacagagtctcagtttacacgctttctctgttccagccccctagaggctgagacacccccgaacggccccgattgcgggtatgggagctttcatcagcagtattggttggatggcaaaatcatcgctgtgggcgtgattgatatcctgcccaactgcgtgagcagtgtgtacctctactacgacccagactattcattcctaagcctcggggtttacagcgccctgagggaaattgcttttaccaggcagctccatgaaaagacctcccagctcagttactactacatgggtttttacattcacagttgccctaagatgaaatacaagggccagtatcgtccatccgacctgctttgcccagaaacctacgtgtgggtgccaatagaacagtgcttgccatctttggaaaactcgaagtactgccggtttaaccaggacccagaggcagtggacgaggacagaagtaccgaacctgaccggctccaggtgttccacaagagggcaatcatgccctacggagtctacaagaagcagcagaaagatccctctgaagaagccgcagtgctgcagtatgcctcgttggttggacagaaatgcagcgagcgcatgctgttgtttcggaactag

SEQ ID NO: 26982 - DNA, 909 bp, Artificial Sequence
  Description of Artificial Sequence: Synthetic coding sequence
atgcccctgtacgagggcctgggcagcggcggcgagaagaccgccgtcgtcatagacttgggggaggcatttacaaagtgcggcttcgcgggtgaaaccgggccacggtgtatcatcccctctgtaattaagcgcgccggaatgcctaagccggtccgagtggttcagtataacatcaacacagaggaattgtattcctacctcaaggagtttatccatattctttactttagacacttgctggtgaatcccagggaccgccgagtggtgatcatcgagagtgtgctttgtccatctcactttagagaaaccctgacacgagtgctcttcaagtactttgaagttccatccgtccttctcgccccctcccatctgatggccctgctaacgctgggaatcaatagtgcaatggtgcttgactgtggctatagagagtctcttgtcctccctatctacgaggggatccctgttctgaattgctggggggccctcccgttgggaggtaaagccctgcacaaagagctcgaaacacagttgctagaacagtgtaccgtggataccagcgtggccaaggagcaatcccttccgagtgttatgggttctgtgcctgaaggcgttctagaggatatcaaggccagaacctgctttgtcagcgatctaaaaaggggactaaagatccaagctgccaagtttaacatcgatggtaataacgaacgtccatcccctcccccaaacgtggactatccccttgacggagagaaaatactgcatatactgggatctatccgtgattctgtagtggagatcttatttgagcaagataacgaagaacagagcgtggccactctcattctggactccctcatacagtgctgttcttgttgtccaggctggagcgctatggcatag

SEQ ID NO: 26983 - DNA, 378 bp, Artificial Sequence
  Description of Artificial Sequence: Synthetic coding sequence
atgagcagctgcgtgagcagccagcccagcagcaaccgggccgcccctcaggacgagctagggggtcgtgggagtagttcctcggagtcccagaaaccatgtgaggcactgcggggtctttcatcacttagcattcacttaggcatggaatccttcatcgttgtcaccgaatgtgagccaggctgcgccgtcgatttgggcctggcccgggataggccgctagaagcggatggccaggaagtgccgctcgatacatctggttcacaggctaggccccacctgtccggccgaaagctgtcactgcaagaacgaagccagggaggcctagcggcagggggatccctcgatatgaatggtagatgcatatgcccaagttag

SEQ ID NO: 26984 - DNA, 1161 bp, Artificial Sequence
  Description of Artificial Sequence: Synthetic coding sequence
atggccgacagcctggagagcacccccctgcccagccccgaggaccggctggcaaagctgcacccttcgaaggagctgttagaatactatcagaagaagatggccgagtgtgaggcagagaatgaagacctgctgaagaagctggagctgtataaggaggcctgcgaaggacagcacaagctggaatgcgaccttcaacagagggaggaagaaatcgccgaactgcaaaaagctctcagtgatatgcaggtctgcctctttcaagaacgggagcacgtgctgcggctgtactccgaaaacgaccggctgcgcattcgcgagctggaagacaagaaaaaaatccagaacttattggcgctcgtcggcaccgacgcgggtgaagtcacatatttctgcaaggaacctcctcacaaggttaccatcttacagaaaactatacaagctgttggggagtgcgagcagagcgagagtagcgcctttaaggccgacccgaagatctctaaacgacggccatccagggagaggaaggagagtagtgagcattaccagcgggatatacaaaccctaatactgcaagtcgaggcccttcaagctcagctaggagagcaaacaaagctgtctcgggagcagattgaagggctgatcgaggacagacggatccacctggaggaaattcaggttcagcatcagcggaaccagaataagattaaagaactgaccaagaatctccatcacactcaagagctcctgtacgagtcaacaaaggacttcctccaactgaggagcgaaaaccagaacaaggagaagagttggatgctagaaaaagacaatctgatgtccaaaattaagcagtacagagtgcagtgtaaaaaaaaagaggataaaattggcaaggtgctgcctgtaatgcatgagtcccaccacgcccaatctgaatacataaagagtctgaaggacaagctcgtccaggaaaaaaagctgagcaacatgtatcaggaacagtgtatatctctggaggaagagcttgcaaggatcagagaagaggagggcatgcgacgtgaaatattcaaagatagaactaacaaaatgggaaagcgacttcaaatcatgactaagaggtatgaggccttagagcgtcgaaggattttggaggtcgagtag

SEQ ID NO: 26985 - DNA, 999 bp, Artificial Sequence
  Description of Artificial Sequence: Synthetic coding sequence
atggagtacctgggcggcggcagcgccctggacctgctgaagcccggtccattagaagagacttacattgcgacgattctgcgcgagattctcaagggcctggactatttgcacagcgaaaggaaaatccaccgggacattaaggcagcaaatgtgctcctgagcgagcagggagacgtgaagctggccgattttggagtcgctggacagttgaccgacactcagattaagcggaataccttcgttggaacacctttttggatggcacctgaggtgatcaaacaatccgcttatgactttaaagccgatatctggtctcttggtatcaccgccatagagctggccaaaggcgagccacccaattccgatttgcatccgatgcgtgtacttttcctgatccccaaaaatagcccaccaacgctggaggggcagcactccaagccctttaaagagttcgtcgaggcctgtctgaacaaggatccccgattccggccgactgctaaagagctgctgaaacacaagtttattacgcggtatacaaaaaaaacctcattccttaccgaactgattgacaggtacaaacgttggaagagcgagggacacggagaggagtcaagcagcgaggattccgacatcgacggagaagctgaggacggtgagcaaggcccgatatggacctttcccccaacgatccgcccaagtcctcatagcaagctacacaagggtacggctctgcactctagtcagaaaccggcagagccagttaagaggcagccaagatcccaatgtctgagcacactcgtcaggccagttttcggggaactgaaggagaaacataaacagagcggcggaagcgtcggtgccctggaagagctggagaatgccttctccctagctgaggagtcttgtcccggcatttctgataagctaatggtgcacctggttgaacgcgttcagcggttctcacacaacagaaaccatcttacctctactcgttag

SEQ ID NO: 26986 - DNA, 1524 bp, Artificial Sequence
  Description of Artificial Sequence: Synthetic coding sequence
atggaggaggtggagcggcaggtgctgcccgaccccgaggtgctggaggctgtcggcgataggcaggacggccttcgggagcaactgcaggccccagttcctccagattccgtccccagcctgcagaacatgggcctactgctggacaagctggcaaaagaaaatcaggacattagacttttacaggctcaacttcaggctcagaaggaagagctccagtcacttatgcaccagccgaaggggctggaggaagaaaacgcacaattacgcggagcattgcagcaaggcgaggcattccagagagcactagaaagcgaattacaacagctaagggcaaggctgcaggggctcgaggccgactgcgtgcgcgggccggacggggtctgtctgtccgggggacgggggccacagggcgataaagccatcagggagcaaggacccagagagcaggaaccggaactgtcattcttgaaacaaaaagagcaactcgaagccgaggctcaggctctgcgccaggagttagaaagacaacgccgcctgctcgggagcgtccaacaagatctggaacgctcacttcaggacgcttcccgtggagaccctgctcatgcgggcttggcagagttgggtcatcggttagcacagaagcttcagggcctggagaattggggccaggacccaggtgttagtgctaacgcaagcaaggcatggcaccagaagtcacattttcagaattcccgcgaatggagcgggaaagagaaatggtgggacggtcagagggacaggaaagcagaacactggaaacacaagaaggaagaatctggccgggaacgcaaaaaaaactgggggggccaggaggatcgcgagcctgcaggacgatggaaagagggccgcccccgcgtagaggagtccggcagcaaaaaggagggtaagcgccagggacccaaggagcctccaaggaagtctggtagcttccatagcagtggagagaagcaaaagcagcctcggtggcgtgaagggaccaaggattcacatgacccccttccttcttgggctgagttgctgcggcccaaatatcgcgctccgcaggggtgtagcggtgttgatgaatgtgcgagacaagagggcctaacattttttggaacggaactcgcccccgttcggcagcaggaattggcttcgctactacggacttatctggcacggctcccctgggctggtcagttaactaaggagttacctctgtcaccagccttcttcggcgaggatggcatctttaggcacgaccgtcttagattccgagacttcgtggatgctttggaggactccctggaggaggttgccgtgcagcagaccggggatgacgacgaagtggacgacttcgaggatttcatcttttcccatttcttcggtgacaaagcactgaagaagcgctcgggcaagaaggataaacattcacaaagtccgcgcgcagccggacctcgagaagggcactcacactcacaccaccatcatcatcgagggtag

SEQ ID NO: 26987 - DNA, 2472 bp, Artificial Sequence
  Description of Artificial Sequence: Synthetic coding sequence
atgaccctgctgagcagccagagcagcagcctggtggcccccagcggctccgtatccgcagagaaccctgagcagaggatgcttgagaaaagagcaaaagtcattgaggagctgctgcagaccgagagggattacatccgcgatctcgaaatgtgcatcgagcgtattatggtccccatgcaacaggctcaagttcccaacatcgatttcgaaggcctgttcggcaacatgcagatggtaatcaaggtgagcaagcagctactggccgctctggaaatttcagatgcagtggggcctgtgtttctcggacatagggatgaacttgaaggaacttataagatctactgccagaatcatgacgaggccattgccttgctggagatctacgagaaagacgagaaaatccagaagcatctccaggatagtttggccgacttaaagtcactctacaacgaatggggctgtacaaattacattaatctaggcagcttccttattaagcccgtgcagagagtgatgcgatatcccttattgctgatggagctgctgaatagcacaccagaatcccaccccgataaggtgccacttaccaatgcggtcctcgctgtcaaagagattaacgtgaacataaacgagtataagaggcggaaagatttggtgctcaagtaccggaaaggagacgaggactcactaatggagaaaatctcgaaactgaacatccattcaattattaaaaagagcaatcgagttagttcccaccttaagcacctgaccggttttgccccccagatcaaagacgaagtgttcgaggagacagagaagaatttccggatgcaggaaagactgattaagtcttttatcagggatctgagcctgtatctacagcacatcagagagagtgcctgcgtaaaggtcgtggccgcagtatcaatgtgggacgtatgtatggagcggggccaccgggatctggagcagtttgagagagtgcacagatatatcagcgaccagcttttcaccaacttcaaggaacggaccgaacgactcgttatctcacctttgaaccagttgctatcaatgtttactggacctcataagctcgtacagaaacgcttcgacaagctgttggatttctataattgcaccgagagagctgagaagctcaaagacaagaagacactcgaagaactgcaaagcgctcggaacaactacgaagccctgaacgcacaactactggatgaattaccaaagtttcaccaatatgcccaggggcttttcactaattgtgtccatggttacgctgaggcccactgcgacttcgttcaccaggcgctcgagcaactgaaaccactcctgagcttactcaaggtcgccggtagagagggcaatctcattgccatttttcacgaggaacactccagagtccttcagcagttacaggtgtttacattcttccctgagagcctgccagccaccaaaaagccttttgaacggaaaacaattgacagacaatccgccagaaaaccccttctgggactcccaagctatatgctgcagtcagaggagctccgggcatctctactcgctaggtaccctcctgagaagcttttccaggcagaacggaactttaatgccgcacaggacctggacgtgagtctcctggaaggggatctggtgggcgtgatcaaaaaaaaggacccgatgggcagccaaaacaggtggttgattgataatggcgtgacgaagggctttgtctacagcagtttcttaaaaccatacaatcccaggcgatctcacagcgatgcctcggtaggatcacactcgtcaaccgagtcggaacatggatcctcctcgccgcgatttccacgtcagaatagtggttctaccctaacatttaatccctcatcaatggcagtctctttcacaagtgggagttgtcagaagcagccccaggacgcaagccctcctccaaaggaatgcgatcaggggacgctgtcagcaagcctgaacccaagcaatagcgagagttctcctagccgttgcccctcagatcccgactcaacctcacagccgaggtcaggcgattcagctgacgtagcaagggacgtcaagcagcctaccgccaccccccgcagttacagaaatttccgtcatcccgagattgtggggtattctgtacccgggcgcaatgggcagtcacaggatttagtgaaagggtgtgccaggacggcccaagcacccgaggataggtcgactgagcctgatgggagcgaggcagagggtaaccaggtgtacttcgccgtttacacattcaaggctagaaatccaaatgagctgtctgtaagcgctaaccagaagctgaaaatcctagagtttaaagatgtgactgggaatacggaatggtggctggctgaagtcaatggaaaaaagggatacgtgccatctaattatattcgaaaaacagaatatacttag

SEQ ID NO: 26988 - DNA, 492 bp, Artificial Sequence
  Description of Artificial Sequence: Synthetic coding sequence
tgagacaagttccgggccagccccgactgcatcaccatcctgtgcaagcccaacgggcaagcaatcgcttggtatacaccaatccactggaaacaggcctgggagaaactggacgcagacgtggaatttaacagatgctctgttgtctctcctaccttcagaaaaagggtctttcaatggacagccagcacggccactataacgaaggaaaaacaggatcagcccaaaaaggatattagcaattaccaagtggagcaggcgcaagtgttgctaaagagagaaaaagagatccctccgaccgtgttccctaatcgctcaccctggtgtcagaatccgtacgtgagcgctcacccatactgtcccttaatcgagcctcacaacaccagcaccgccggcggccgcctggatcggcagccccgcacgcgcagcaccaggccaaatagggccagtggatctaagaaaaagaagacatctgagtcacaaaagcaatag

SEQ ID NO: 26989 - DNA, 771 bp, Artificial Sequence
  Description of Artificial Sequence: Synthetic coding sequence
atggccacccagcggaagcacctggtgaaggacttcaacccctacatcacctgttacatatgtaagggttatcttataaaaccaactactgtgaccgagtgtctccacaccttttgtaagacctgtattgtccaacactttgaggacagcaacgactgtcctaggtgtgggaatcaagtccatgagacaaaccctctcgaaatgctccgcttggataacaccttagaggaaatcatttttaaactcgtgcccggattgcgggaacaggaactcgaacgagaaagcgagttctggaaaaagaataagccccaagaaaacggtcaggacgacacatctaaggccgacaaacctaaggtggacgaagaaggtgatgagaatgaggacgataaggattaccaccgatccgatccccagatcgctatatgcttggattgcctccggaacaacggacagagcggcgataacgtggtcaaagggctgatgaaaaaatttattcggtgttcaacacgcgtgactgtcggcacaattaagaaattcctgtccttaaaactaaagcttccaagcagctatgagttggatgtgttgtgcaacggggagattatggggaaagaccacacaatggagttcatctacatgacccgctggcgcctgcggggggagaattttagatgtctgaattgctccgcctcccaggtctgcagccaggacggccccttgtaccaatcctatccaatggttctccagtatcgaccgcgaattgattttggatag

SEQ ID NO: 26990 - DNA, 2793 bp, Artificial Sequence
  Description of Artificial Sequence: Synthetic coding sequence
atgagcgagttccggatccaccacgacgtgaacgagctgctgagcctcctgagagtgcacgggggcgacggggcggaggtgtatatcgatctactgcagaaaaatcggactccttatgtgacgaccactgtctcagctcatagtgctaaagtgaaaatcgcagaattcagtagaactccagaagacttcctgaagaagtatgacgaactcaaatccaaaaatactagaaatctggaccctttagtatatttgctgtccaaattgaccgaagataaggaaaccctccaatacctgcagcaaaatgccaaggagcgggccgaattagccgctgccgcagttgggagctccacaacctcaatcaatgtgcctgccgccgcttctaagatctctatgcaggagcttgaagagctgcggaagcagctcggttccgttgccaccggtagcacgctccagcagagtctagagttgaaaaggaagatgctccgggataaacaaaacaaaaagaattccgggcagcatctaccgatctttcccgcctgggtgtatgagagaccagcccttatcggcgacttcctgattggagctggtatctctacggataccgccctacccatagttttgctgcgttggaacttggccctatcacccaggctaaaatgcagcggggtaatcagtgcacactgtaaccttcacttgcccgggactctgccccttgccagccaggaatctgccgtggttgaggacctgttgtacgtactggtgggtgtggatggccgatatgtgagcgctcaacctctggccggacgacagtccaggacatttctggtcgaccccaaccttgatttgtctattcgggagttagttcatcggatccttcccgtggcggcgtcatacagcgctgttactagatttatcgaggagaaatcgtcatttgaatatggccaagtgaaccatgcattggctgcagccatgaggacccttgttaaggaacacctgattctggtgagccagctggaacaactacataggcagggcctgctgtccctacagaagttgtggttctacatccagcccgcaatgcggactatggatatcttggcctccctggccacatctgttgataagggtgaatgcctcggcggatcaacgctaagcctgcttcacgatagatctttctcctatacaggtgattcacaggcacaagaactgtgcttgtacctcaccaaagctgcatccgcgccttacttcgaggtgttagagaagtggatttatcgcggtattatccacgacccttatagcgagtttatggtggaagaacacgaactgcgtaaagagagaatccaggaagactacaacgacaaatattgggaccagaggtacacaattgtgcagcaacagattccttctttcctgcagaaaatggcagataaaatcttgagcacaggcaagtatcttaatgtggtccgcgaatgtgggcacgatgtgacctgtccagtcgcaaaagagatcatctacacactaaaagagcgggcttatgtggagcagatcgaaaaagccttcaattatgcctctaaagtgctcctagatttcctaatggaagagaaagagctcgtggcacatcttcgttctatcaagaggtactttttgatggatcagggcgactttttcgtgcatttcatggacctcgccgaggaagagctgcgaaaaccggtagaagatatcactcctccacgcctggaggcacttctggaacttgcgctgcggatgagcactgccaacactgatccattcaaggatgaccttaagatagatttaatgcctcatgacttgattacacagctgctgagggtgctggccatcgagaccaaacaagagaaggctatggcacacgccgatcctacggaactcgccctctctggcctggaagctttttcatttgactatatagtgaagtggccgctatcactcatcattaacaggaaggctctcacccgctaccagatgttattccggcacatgttttattgcaagcatgttgaaaggcaactgtgctcagtctggatttccaacaagacagctaagcagcattcactccatagcgctcagtggtttgccggagccttcacgctgaggcagcggatgcttaattttgtacaaaatatccagtattatatgatgttcgaagtgatggagcctacttggcatatcctcgagaagaatcttaagtcagcttccaacatcgacgatgtcctgggacatcacaccggatttcttgacacgtgtttaaaggattgcatgcttacaaatcccgaattacttaaggttttttccaaattgatgagtgtgtgcgtgatgtttaccaactgcatgcaaaagttcacgcagagtatgaaactagatggtgagctaggtggtcagacattagagcactccaccgtgctgggacttcccgcgggcgctgaggaacgggctagaaaggaactagcccgcaagcaccttgccgagcacgcggacaccgtccaattagtgagcggattcgaggcaactattaacaagttcgacaaaaatttctccgcccacctgttagacttattagctagactgagcatttattctacgtcagactgcgagcacgggatggcctcagtgataagccgcctagacttcaatggtttttacaccgagcgcttagagcggctgtccgccgagagatctcaaaaggccaccccccaggtgcccgtccttcggggaccaccagctcccgctccacgagttgctgttaccgcacagtag

SEQ ID NO: 26991 - DNA, 129 bp, Artificial Sequence
  Description of Artificial Sequence: Synthetic coding sequence
atgtgcctgctgcccatccgggtgaaggaggccgaggaggtgtgccggcagaagaagggaaagtctctttacaaaattaaacctcgccacgacagcggaatcaaagcgaagatttccatgaaaacgtag

SEQ ID NO: 26992 - DNA, 456 bp, Artificial Sequence
  Description of Artificial Sequence: Synthetic coding sequence
atggactgccgggagatggacctgtacgaggactaccagagcccctttgacttcgacgccggcgtgaacaagtcctacctatatctatcaccctccggtaattctagtccccctgggtcccccactctgcagaaatttggattgcttagaacagatccggttccagaagagggggaggatgtggctgccaccatctcagcgacagaaaccctgtctgaagaagagcaagaagagctacgtcgagagctggccaaggtcgaagaagaaatacagacactatcacaggtgttagctgcaaaagagaaacatctggcagaaatcaaacgcaagcttggaatcaactccctccaagaactgaagcagaatatagccaagggatggcaggacgtgaccgccacaagcgcacgtagcaagctgttagctgccgaaacagagttactatgtttgctctattag

SEQ ID NO: 26993 - DNA, 627 bp, Artificial Sequence
  Description of Artificial Sequence: Synthetic coding sequence
atgagcgccggcggcgacttcggcaaccccctgcggaagttcaagctggtgttcttaggcgagcagagcgtcggcaagacctctctgattaccaggttcatgtatgactcatttgacaacacttaccaggctactattggtatagactttctgagtaagaccatgtacctagaggacagaactgtccgcctgcagctatgggatacagcaggccaagagagatttagaagcctgatcccatcatacatccgtgattcaaccgtcgcggtcgtcgtgtatgatataaccaatctgaactccttccagcagactagtaagtggatcgacgacgtgaggaccgagcggggctcagacgtcattataatgcttgtcggaaataagactgacctggcggacaaacgccagatcacaatcgaagagggcgagcagcgggcgaaggaactctctgtgatgtttattgaaactagtgccaaaactggatacaatgtcaaacagctctttcgcagggtggcctctgctctacctgggatggaaaacgtgcaggagaaaagcaaagagggcatgattgatattaaacttgataagcctcaggagcctcctgcttccgagggtgggtgttcgtgctag

SEQ ID NO: 26994 - DNA, 1575 bp, Artificial Sequence
  Description of Artificial Sequence: Synthetic coding sequence
atgaagcggagcagcgtgagcagcggcggcgccggccggctgagcatgcaggagctgagaagccaggacgtcaacaagcagggtctgtataccccacagaccaaagaaaaacctacgttcggtaagttgtctatcaacaaaccgaccagcgaaaggaaagtgtccctgtttggtaagcgtacgtccggacatggctctaggaatagccagcttggtattttctcgtccagtgaaaagataaaagatcccaggcccctaaatgacaaagcctttatccagcagtgcattcggcagctctgtgaattcctcaccgaaaatggttatgcccataacgtgtctatgaaatcgctgcaagctccaagtgtcaaggattttttaaagatcttcacattcctgtacggttttttgtgtccttcttacgagctacctgataccaaattcgaggaggaagtgccgcgtatcttcaaggacctcggctatcccttcgccttgagcaagtcatctatgtatacggtgggagcaccacatacctggccacacattgtggccgcgctcgtgtggctgatagactgcatcaagatacatacagccatgaaagagtcaagtccgctgtttgatgacggccagccgtggggagaggaaacagaggacggcattatgcataacaaactctttcttgattacaccattaaatgttatgagtccttcatgtcaggtgcggacagttttgatgagatgaacgctgaacttcagtccaagttgaaggatctgtttaatgtcgacgccttcaaactcgaatctcttgaggccaaaaaccgcgcactgaatgagcagatcgcacgtcttgagcaggagcgagagaaagaaccgaatagattagagagtttgcgcaagctaaaagccagcctgcagggggatgtgcagaagtaccaggcatatatgagcaaccttgaatctcacagcgctattcttgatcaaaagctaaatggcctcaatgaagagatcgctcgcgttgaacttgagtgtgagaccatcaaacaggaaaacactcgccttcagaatatcatcgataatcagaagtattcagtcgcagacattgaaaggataaatcacgagcgcaacgagctgcagcagacgatcaataaactgacgaaagacttagaggccgaacagcagaaactctggaacgaggaattgaagtatgcgcgggggaaagaggcaatcgagacacaactagccgaataccataagctcgcaagaaaactcaagctaatccccaagggagcggagaacagtaagggatatgatttcgagatcaaattcaaccccgaggccggggccaactgtcttgtgaaataccgcgcacaggtgtacgttccacttaaggagttattgaatgaaaccgaggaggaaattaacaaggcactgaataaaaaaatgggtcttgaagatacacttgagcagctcaacgccatgattaccgagtcaaagcgaagcgtaaggacgttgaaagaagaggtgcagaagttagatgatctttatcagcagaagattaagaaggagcgtaagaaatag

SEQ ID NO: 26995 - DNA, 1248 bp, Artificial Sequence
  Description of Artificial Sequence: Synthetic coding sequence
atgatgctgggccccgagggcggcgagggcttcgtggtgaagctgagagggctgccctggagttgttccgtggaagatgttcagaacttcctgtctgattgtacaatccacgacggcgctgccggggtccactttatctacacacgcgaaggcaggcagtcaggcgaggcatttgtggaactgggttctgaggacgatgtaaaaatggctctcaagaaggaccgagagtccatggggcaccgctatatcgaggtgttcaagtctcatcgaactgaaatggactgggtgctcaaacacagtggccctaattccgctgatagtgcaaacgacggattcgttcggctcagaggtcttcctttcggatgcactaaggaggagatagtacagtttttttcgggccttgagatcgtgcctaacggaataacactgccggtggaccctgagggcaaaattactggagaggcttttgttcagtttgcatctcaggagctggccgaaaaggccctaggaaaacataaggaaagaattggacaccggtatattgaagttttcaagtctagtcaggaggaagtgaggagttatagcgaccctcctctgaagttcatgtccgtacaacgtccagggccatacgacaggcccggcaccgctagaaggtacatcgggattgtgaagcaggcagggcttgaaagaatgagaccaggggcatatagtacaggatacgggggctatgaggagtactctggcctgtccgatggctacgggttcaccacagacctattcggccgcgacctgtcgtactgtctgagcggaatgtacgaccatcgctacggagactccgagtttaccgttcagagtacaactggccactgcgtccacatgagaggactgccatataaagcaaccgagaatgacatttacaacttcttctcacccctgaaccctgtccgggtgcatatcgagattggacctgatggccgggtgaccggggaagccgacgtggaattcgctacccatgaagaggctgtcgcagccatgtccaaagatcgtgcaaatatgcagcatagatatatagagttattcctaaatagtacaaccggggcgagcaatggtgcctattccagccaggttatgcaaggtatgggtgtttctgccgcgcaggctacctacagcggcctggagagtcaatccgtaagcggatgttatggcgcaggctattcaggtcagaattcaatgggaggttacgactag

SEQ ID NO: 26996 - DNA, 1512 bp, Artificial Sequence
  Description of Artificial Sequence: Synthetic coding sequence
atggccagcaaccacaagagcagcgccgcccggcccgtgagccggggcggtgtgggactgacaggtcggccacccagcggtatccgacccctgtccggcaatattagggtcgccactgcgatgccccctggcactgcaagaccaggaagccgcggctgcccaatcggtaccggtggggttctctcttcacagattaaagttgctcataggcctgtgacacagcaggggctgaccgggatgaagaccgggacaaaagggccgcagagacaaattttagacaaatcatactaccttggcctgcttcgctcaaaaatctccgaactgactaccgaggttaacaaactacagaaggggattgagatgtacaaccaggagaacagtgtctatctatcgtacgaaaagcgcgctgaaactctcgccgtagaaatcaaggagctccagggtcagcttgctgattacaacatgttggtggataagttgaataccaacactgaaatggaagaggtgatgaacgattacaatatgttaaaggcccagaatgaccgtgaaacacaatcactcgacgtcatctttacagagcggcaagccaaagagaagcagatcaggtctgtagaggaggagatcgaacaggagaaacaagctaccgacgacatcatcaaaaacatgtcttttgagaatcaggtgaaatacttggaaatgaagacgacgaacgagaagctgcttcaagagctagacaccctgcaacagcagttggatagccagaacatgaagaaagagtcactagaggcagaaattgcccactctcaggtcaaacaggaggcggttctgctccacgagaagttgtatgaactggagtcacacagggaccaaatgatcgcagaggataaatccattggtagtccgatggaggagcgcgagaagctgctgaaacagattaaagatgataaccaggagatagccagtatggagaggcagctgacagacaccaaagaaaagatcaatcagttcattgaagagatccggcagttagacatggatctagaagagcaccaaggagagatgaatcagaagtacaaggagttgaagaagcgcgaggaacacatggacaccttcatcgagacctttgaagagacaaagaaccaagagttaaagaggaaggcgcaaatcgaggctaatatagtggccctgctggagcactgttctaggaatataaaccgcatcgaacaaatctcctcgatcacgaaccaggaactcaagatgatgcaggacgatcttaactttaagagcaccgaggttcagaagagccagagcacagcccagaacctcacaagtgatattcagcggctccagctggatctgcagaaaatggagctcttggagtctaaaatgaccgaagaacagcactcacttaagtctaaaattaaacagatgaccacagacctcgagatctataatgatctacccgcacttaagtctagcggggagaaaaagaagaagaaaaagaagaaatag

SEQ ID NO: 26997 - DNA, 1461 bp, Artificial Sequence
  Description of Artificial Sequence: Synthetic coding sequence
atgacctgcggcagctactgcggcggccgggccttcagctgcatcagtgcatgcgggccccggcctgggcggtgctgcatcaccgctgccccttatcgcggaatcagctgctaccgcggcctcacagggggcttcgggagccatagtgtttgtggcgggtttagagctggatcatgcggccgttccttcggatatcgcagcggaggcgtatgtgggccatcacccccgtgcataacgacggtgagcgtgaacgaaagtctccttaccccgcttaacctcgaaattgacccaaacgcccagtgcgttaaacaagaggaaaaggagcaaattaagagtctcaatagtcggtttgctgccttcatcgacaaggtgcgattcctggaacagcagaataaactcttagagaccaagctgcagttttatcagaatagagagtgctgccagagcaacctagagcctctgttcgagggctacattgaaacactcaggagagaagctgagtgcgtggaagccgattcaggacgcctcgccagtgagttgaaccacgtccaggaagtgttagaggggtataaaaagaagtatgaagaggaggtgagtcttcgagcgacagccgaaaatgagtttgttgccctgaagaaggatgttgattgcgcctatcttcgtaaaagcgaccttgaggcaaatgtcgaagccttgatacaagagattgactttctccgtcgactctatgaggaggagattagagttctgcagtcacatatctccgatacctcagtggtcgtgaagctagacaactcgcgggacctcaacatggactgtattatcgctgagattaaagcgcagtatgatgatatcgtcacaaggagtagggccgaggctgagtcatggtatcgctccaaatgcgaagaaatgaaggccacagttatccgtcatggcgagactctgcggaggacaaaagaggaaatcaatgagctcaatcgtatgatccagcgcttgaccgctgaggtggaaaatgcaaaatgccagaacagtaagcttgaggctgcagtggcccagagtgagcagcagggggaggccgccctctcggatgcacggtgtaagctcgccgagctagaaggggcactccaaaaggcaaagcaagatatggcgtgcttgataagagagtaccaggaggtgatgaattctaaattggggctggacatcgagattgcaacttataggaggctcctggagggcgaggagcagaggctgtgtgagggtgtcggatctgtgaatgtatgtgtgagttcaagtagaggtggggtcgtttgtggagatttgtgcgcctcgacgaccgctcctgttgtttctacacgagtgagctccgtgccttcgaacagcaacgtggtagtggggacgaccaacgcctgcgccccctccgctcgagtaggtgtttgtgggggaagctgtaagcgttgttag

SEQ ID NO: 26998 - DNA, 1011 bp, Artificial Sequence
  Description of Artificial Sequence: Synthetic coding sequence
atgtgcaccatgcacaaggacgagaaggccaagcgggaggtgagctcatggaccgtggaaggcgatattaacacagatccctgggcagggtaccgctatactggcaagctccgccctcactacccccttatgcccactcgcccggtcccgtcatacatacagcggcctgactacgccgatcatccactcgggatgtctgaatctgagcaggcccttaaggggaccagccagattaagctcctgtccagcgaggatatcgaggggatgaggctggtgtgcaggctggctcgggaggttctggatgtagccgccgggatgattaaaccaggcgttaccactgaggaaatcgatcacgcggtccatctggcttgcatcgccagaaattgttacccttctcctctaaactattataacttccccaaatcgtgttgcacatcagtaaatgaggttatctgccacggaatccccgatcggcgccctctccaggaaggggacatcgtgaacgtggacataacattatacagaaatggctatcatggggacctaaatgagacattctttgtgggagaggtggacgacggcgctcgaaagcttgttcagaccacgtatgaatgtttaatgcaggcaattgacgccgtgaaacctggtgtgcggtacagggaactgggaaatatcatccagaaacatgctcaggctaatggcttttccgttgtgcgctcttactgcggacacgggattcataaactgttccataccgcgcctaatgtcccccactacgccaagaacaaagctgttggtgtaatgaaaagtgggcatgtgtttaccatcgagcctatgatatgcgaaggaggctggcaggatgagacctggcctgacggatggacagccgtaaccagggacgggaagaggtctgctcaattcgagcatacccttctggtgacagacactggctgcgagatcttaacccggcggctggattcagcgcgcccgcatttcatgtcacaattctag

SEQ ID NO: 26999 - DNA, 3102 bp, Artificial Sequence
  Description of Artificial Sequence: Synthetic coding sequence
atggccggcatgatcgaccggttcagccccgccaacaccggcatccgcagctgggatgtggacccgggcgtctgtaacctggatgagcaactcaaagtgttcgtgagtagacattcagctacgttcagcagcattgtgaagggtcagaggagcttacaccatagaggggacaatttagaaaccctggtgttactcaacccttccgataaaagcttatacgatgagcttcgaaacttactcttagatccagccagccacaaactgctggttcttgcaggaccttgtctggaggaaactggggagctgctgcttcagacaggaggtttcagcccacatcactttttgcaagtgctgaaagaccgagaaattcgcgatattttggctactacacctcccccggttcagcctcccattctaaccatcacttgcccaacttttggcgattgggcacagctggcccctgccgtgcctggcctgcagggcgccctgagattgcagcttcgacttaacccaccagctcagttgcccaactcagagggtctttgtgaattcctggagtacgtggcagagtccctggagcctccctccccgtttgagctcctggagcctccaacatccggtggctttctcaggctaggtcgcccgtgttgctacatattccctggcggcttgggtgacgctgcattttttgctgtgaatggctttaccgtcctggtgaatggcggctcaaatcctaaatcctccttttggaaactggtgaggcatctggacagggtggatgccgtgcttgtgacgcacccaggtgcagattcactgccaggtctaaatagcttgcttcggcgaaagcttgccgagagaagtgaagttgccgctggtggtggctcatgggatgacaggttaagacggctcatcagcccaaaccttggagtcgttttttttaacgcctgtgaagctgcctctcggctcgctcggggcgaagacgaagcggaacttgctctcagccttctagcgcagctggggattactccactgccattgagcagaggaccagtgcctgctaagccaacagtgctgtttgagaagatgggtgtaggacggcttgacatgtatgtcttgcaccctccctctgcaggagcggagcggacactcgccagcgtctgcgcccttctcgtgtggcatccagctggtccaggcgaaaaggttgttcgagttctgtttccaggatgtaccccccccgcctgtcttttggatggtctggtccgcctgcagcacctcaggttcttgcgagaaccggttgttaccccgcaggacctggaaggccctggtcgggccgagtctaaagaatccgtgggaagtcgggacagttctaagagagagggactgctggccacacaccctcggcccggacaggagcgccccggcgtagcccggaaagagccagcacgggccgaggccccgcgaaaaactgagaaagaggcgaaaacccctagggagttaaagaaggacccgaagccaagcgtctcccgaacgcaacctcgcgaagtgaggagggccgcctcttcagttccgaatctgaaaaagaccaatgcacaagccgcccctaaaccacgtaaagctcccagtacgagtcacagcggcttcccccccgtggcgaatggtcctcggtctcctccttcactgcgatgcggtgaggcctctccaccctctgccgcgtgcggctccccagctagtcagttggtggcgacgccgtcactggaacttgggccaatacccgcgggtgaagaaaaagccctcgagctgccactggcagcttcctctatcccacgccctcgaaccccttcccccgagtctcataggtcgccagcagaggggagtgagcggctgtcactcagtccgctgcgagggggcgaagcaggaccagacgcctccccaaccgtgacgacccccaccgtgaccactccatccctgcctgcagaggttggaagtccacattctaccgaggttgacgagagccttagcgtgtcatttgagcaggttctgcccccctctgcgcctacatccgaggcaggcctgtccttacctttaagaggtcctagggccagaagaagcgccagtcctcacgacgtggatttgtgcctggtgtctccgtgcgagtttgaacaccggaaggcagtgcctatggccccagcaccagcttctcccggatcttctaacgactcttctgccagatcacaggagcgtgccggggggctgggtgccgaagaaacacctcctacatccgtcagcgagagtttgcccactttgtcagactccgatcctgtgcccttggcgccaggggcagctgactcggacgaggatactgaggggtttggcgtgccacgacacgacccgttgcctgatccattgaaggttccccctcccctgcctgacccttcgtctatctgtatggttgaccctgagatgctgcctcccaagaccgcccggcagaccgaaaatgtttcccgcacgaggaagcccctggcccgccctaattcgcgagctgccgcccctaaggcaactccggtagccgctgcaaaaacgaaggggctagccggcggggacagggcctccagacccctttccgcacggtcagaaccgtcagagaaaggtgggagggcccccttgagtcgcaaaagttcaacacctaagacagccacccgaggaccttcaggaagtgcatcgtcgcggcccggcgtgtcagctaccccacccaaaagcccggtgtacctggatttggcatatttaccctctggcagctctgctcacttagttgacgaagagttcttccaacgggtgcgagctctttgttacgtaatatcaggccaggaccaacgcaaagaagaaggaatgcgcgccgtgctggatgctcttctcgcatcaaagcagcactgggatcgggacctgcaggtgacgctgatccctacttttgatagtgttgccatgcacacttggtacgcagagacccatgcccggcaccaggcacttggcattaccgtcctggggtctaactctatggtcagtatgcaggacgatgcatttcccgcatgtaaagtagaattttag

SEQ ID NO: 27000 - DNA, 2223 bp, Artificial Sequence
  Description of Artificial Sequence: Synthetic coding sequence
atgcgggacctggagggctaccgggagacccggtaccagctgctgcaactgcgccccgcccaaagggccagctggatcggttacgccatcgcttaccacctgctggaggactatgaaatggccgcaaagattctggaggagttccggaagacgcagcaaacttcccccgataaggtggattatgagtactctgagttgttgttgtatcagaatcaggtgctccgtgaagccggtctgtacagagaagcgctagaacacctgtgcacttatgagaagcagatttgcgataagctggcggtcgaagaaaccaagggggagttactcttgcagctttgtcggcttgaagatgctgccgatgtgtacaggggactgcaggagaggaatccagagaattgggcctattacaaggggctggaaaaagcattaaaacccgccaatatgcttgagagattaaaaatttacgaggaggcatggactaagtacccaagaggattagtgcctcggcgcctcccgctgaacttcttgtcaggggagaagttcaaagagtgtttggacaaatttctacgcatgaatttttccaaaggatgcccccctgtgtttaacacccttcggagcctctacaaggataaagaaaaggttgctattattgaggagttggtagtgggctatgaaacatcactcaagtcctgtcggctgttcaaccctaatgacgatggaaaagaagaacccccaacaactctgctgtgggttcagtattatctggcccagcattatgataagataggtcaacccagcatagccctggagtatataaacacggcaattgaatccactccgaccctgatcgagctatttctcgtgaaagccaagatctacaaacatgccgggaacatcaaggaggcggcaagatggatggacgaggcccaggcactggataccgcagacagatttatcaacagcaaatgcgcaaaatacatgttgaaggccaatctgattaaagaggccgaagagatgtgcagtaagtttacaagagagggcacctctgcagtggaaaaccttaacgaaatgcagtgcatgtggttccagaccgagtgtgctcaggcatataaggctatgaacaaattcggcgaggcactgaagaaatgtcacgagatcgaacggcattttatcgagataaccgatgaccaatttgactttcacacttactgtatgcgaaagatcacgctgaggtcctatgtggatctccttaaactggaggacgtcctcaggcagcacccgttctacttcaaagcggccaggatcgcgatagagatatatctcaagctgcatgacaacccactcactgatgaaaacaaagaacacgaagcggacactgctaatatgtcggataaagagctgaaaaaacttaggaacaaacagcggcgtgctcaaaagaaagctcaaattgaggaggagaagaaaaacgcagaaaaggaaaagcaacaaaggaaccaaaagaaaaaaaaagacgatgacgacgaggagatcgggggccctaaagaagagctgattcccgagaagctggcaaaggttgagaccccactggaggaggccatcaaattcctcaccccgttgaagaacctggtgaaaaataagatcgaaactcacctgtttgcctttgaaatttactttcggaaagaaaaattcctacttatgttacaatcagtaaagagggccttcgccatagactcttcacacccttggctgcacgaatgtatgatacgcttgtttaacacagccgtatgcgagtccaaggatttaagcgacactgtacggacggtcctcaagcaagaaatgaatcggttatttggagcgacaaacccgaaaaacttcaacgaaacattccttaaacggaattccgactccctgccgcaccgactgtccgctgcaaaaatggtgtattaccttgacccttcttcccaaaagcgggccatcgaattagctactacgcttgatgagtctttaaccaacaggaacctgcagacatgtatggaggtactggaagctctgtacgacggatctttaggcgactgcaaagaggcagcggaaatttacagggcaaactgccataaactctttccttacgccctggccttcatgccgcctggttatgaagaagatatgaaaattaccgttaacggggacagtagtgccgaagcggaagaattggctaacgaaatttag

SEQ ID NO: 27001 - DNA, 183 bp, Artificial Sequence
  Description of Artificial Sequence: Synthetic coding sequence
atgagctgcaccatcgagaaggccctggccgacgccaaggccctggtggagcgcttgcgggatcatgacgacgccgcggagtctttgatagagcagactaccgcacttaacaagagggtcgaagcgatgaaacagtaccaagaggaaatccaggagcttaacgaggttgcccggcacaggtag

SEQ ID NO: 27002 - DNA, 1419 bp, Artificial Sequence
  Description of Artificial Sequence: Synthetic coding sequence
atgggcaaggagcaggagctgctggaggccgcccggaccggccacttgcccgcagttgaaaaactgctatctggaaaacgccttagctccggtttcggcgggggtggcggaggtggaagtggcggtggcggaggaggctctggaggtggcggaggcggtctcgggagttcatcacacccattgagcagcttgctgagcatgtggagaggccccaacgtaaactgcgtggattccacaggatatactccactccatcatgccgctctgaacggtcataaggacgttgtcgaagttctccttcgcaatgatgcactcactaatgtggccgactcgaaggggtgttatcccctgcatctcgcagcatggaagggggacgcccagatcgtaagactcttaatccatcagggcccttctcacaccagagttaatgagcagaataatgacaatgaaaccgctctgcactgcgctgcccagtatggacacacagaggttgtcaaggtcctgctcgaggagctcaccgacccaactatgcgcaacaataaattcgagacacctttagatctggcagccctctatggacgtctggaggtcgttaagatgcttctgaacgcgcacccaaacctgctctcctgcaatacaaagaagcacaccccccttcacctggccgctaggaacgggcataaagctgtggtgcaagtgttgctggatgctgggatggactcaaattaccagaccgagatgggtagtgctctgcacgaagctgcactgtttgggaagaccgatgtggttcagatcttgctggcagctggcaccgacgtgaacatcaaggacaaccacggcttaactgctcttgacaccgtaagagagttgccatctcagaaaagtcagcagatcgcggcccttattgaggaccatatgacggggaagagatccaccaaagaagtggataagactccaccccctcaaccgccactgatctcaagcatggactctatcagccagaagtctcagggcgatgtggaaaaggcggtgaccgagctgattatcgacttcgacgccaacgccgaagaagagggaccttatgaggcactgtacaacgctatttcctgccattctttagactcgatggccagtgggagatccagcgaccaggactcaaccaataaggaggcagaagcagccggagtgaaaccagccggagtgaggcctcgggagcgcccccccccaccagctaaacctcccccggatgaggaggaggaggaccatattgataaaaagtacttccccctaacagccagtgaagtgctctccatgcggcccaggattcacggctctgcagcccgggaagaggacgagcacccatacgaactgctcctaacagcagaaaccaaaaagaaaaagaagaagaagaaaaaatag

SEQ ID NO: 27003 - DNA, 1392 bp, Artificial Sequence
  Description of Artificial Sequence: Synthetic coding sequence
atgagcggcggcaccccctacatcggcagcaagatcagcctgatctcaaaggccgaaatccggtatgagggtatcctctataccatcgacacagagaatagcacagtggcgctcgccaaagtcaggtcgttcgggactgaggacagaccgaccgacagacctataccgcctcgggatgaagttttcgaatacataatctttcgtgggtctgacataaaggaccttactgtttgcgagccccccaaaccccagtgcagccttccccaggaccctgctatcgtgcagagctccctcgggtcttctacatcctccttccaaagcatgggctcctatggcccttttgggagaatgcccacgtactcgcagttctcccctagctccttggtgggccagcagttcggagccgtcggggtggccgggtcctccctgacaagctttggcacagagaccagcaattccggcacccttccccagagcagcgccgtgggcagcgcttttacacaagacaccagaagcctgaagacacaactgagtcagggccgatcaagcccccagctggacccacttagaaagagtcctactatggagcaagccgtgcagaccgccagtgcacatttgccagctccggcggctgtaggacgaagaagtcccgtatcaacaagacctcttccctctgcgagtcaaaaagctggtgagaatcaggagcatcggagggccgaagtccataaagtttccaggcccgagaacgaacaacttaggaacgacaacaagagacaggtggccccgggcgcccccagcgccccccgccgcggcagaggaggccatagagggggccgggggaggttcggtattcgtcgcgatggccctatgaagttcgagaaggactttgacttcgagagcgctaatgcacagttcaataaggaggagattgaccgagaatttcacaacaagctcaaactcaaagaggataaactcgagaagcaggagaagccggtgaacggagaagacaaaggtgattccggcgttgatacccagaacagcgaaggtaacgccgatgaggaggacccgctcggaccaaattgctattatgataagactaagtctttctttgataatatttcatgcgatgataaccgagagaggcgccccacctgggctgaggaacggcggctcaatgccgaaacctttggaattccgctccgccctaacaggggaaggggagggtaccgaggacgcggagggctcgggttccggggcggacggggccgcggcggcggccgcggagggaccttcacggcaccccgtgggtttaggggcggctttagaggcggccgtggaggtcgcgaattcgccgactttgagtaccgcaaggataacaaagtggccgcctag

SEQ ID NO: 27004 - DNA, 1287 bp, Artificial Sequence
  Description of Artificial Sequence: Synthetic coding sequence
atgggcggcggcgtgggcgccagcagcagcggcggcggccccggcggcagcggtggtgggggtagcggagggccgggagctggaacctcttttccaccaccgggcgtgaaactgggccgggatagcgggaaggtcaccacagtagttgccacactgggccagggccccgagcggtcacaagaggtggcgtacacggacattaaggtcatcggcaacggatcattcggtgtggtttatcaggctaggctggcagagactagggagcttgtggccatcaagaaggtgctgcaagataagagattcaaaaatagggagttacagataatgagaaagctggatcactgcaacatcgttcggcttcggtacttcttctattccagtggcgagaagaaagatgagttgtacctcaacctggtgctggagtacgtgccagaaaccgtatatagggtggcaaggcattttacgaaggctaagctcacaatccccatactgtacgttaaagtgtacatgtaccagctctttaggtccctcgcttacatccactcccagggcgtttgccatcgagacatcaaaccccagaatttactagtagatcctgataccgcagtactcaagctctgcgattttggtagtgccaaacagctggttagaggagaacctaatgtttcctacatttgcagccgctactaccgagcccccgagctgattttcggagccacagactatacctcttccatcgacgtgtggagcgcgggatgtgttttggctgagttgcttttgggccagcccatttttcccggggactctggggtggaccagctcgtggagatcattaaggttctgggtacgcccaccagggaacagattcgagaaatgaatcctaattacactgaattcaaatttccccaaatcaaggcacacccgtggactaaagtgttcaagtcacggacaccaccggaggctatcgccttgtgctcctctttgctggagtacacacccagcagcaggttatctcctctggaagcttgtgcccactccttttttgatgaattacgttgtttaggaacacagctccctaataaccgaccactgccacctttgtttaatttttctgccggcgagctctcaattcagccaagtctgaatgcgatcctgatacctccccatttacgtagcccggcagggaccacaactcttaccccgtcctctcaagcgctgaccgaaactccaacctcatctgattggcagagtactgacgccacaccaacactaaccaactcctcctag

SEQ ID NO: 27005 - DNA, 657 bp, Artificial Sequence
  Description of Artificial Sequence: Synthetic coding sequence
atggacgccgagcaccccgagctgcggagctacgcccagagccaggggtggtggacaggagagggagagttcaatttctctgaggtgttttcccccgttgaggatcacttagactgcggagcaggaaaagacagcttggagaagcaagaagagtcaattactgtgcagacaatgatgaacaccctgagggacaaagcttccggagtttgcatagatagcgagtttttcctcactactgcaagtggcgtgagcgtgctgccccagaataggtccagtccatgcatacactattttaccggcacacctgaccctagcaggtccatttttaagccttttatcttcgtcgacgatgtgaagctcgtacctaagactcaatccccgtgtttcggtgacgatgaccctgccaagaaagaaccacgctttcaggaaaagcctgatcgtcggcacgagctgtacaaggcccacgagtgggctagagcaattatagagtcggaccaggagcaaggtcggaaactcagaagcacgatgttagaactcgagaagcaaggtcttgaggccatggaagagatactcacaagtagcgagccacttgaccctgctgaggtaggggatttattttacgactgcgtggacaccgagattaagttctttaagtag

SEQ ID NO: 27006 - DNA, 573 bp, Artificial Sequence
  Description of Artificial Sequence: Synthetic coding sequence
atggccctgctggccgagcacctgctgaagcccctgcccgccgacaagcagatcgagaccggtcccttcctggaagcggtgtctcatctcccgccattctttgactgcctgggaagcccggtgttcactccaattaaagctgacatctctgggaatatcactaaaattaaggctgtgtacgataccaatcccgcaaaatttagaaccctccagaacatcctcgaggtcgagaaagaaattgggctcagatttattcaggtgttcctgcagtctatctgtgatggcgaaagggacgagaatcatccaaacctgatccgggttaatgccacaaaggcttatgagatggccctgaagaaataccacggatggatcgtacagaaaatattccaggcggccttgtacgcggcaccatacaaaagcgacttcctcaaggctctgagcaaaggacagaacgtcacggaggaggagtgtttagaaaagatacggctgttcctggtgaactatacagctacaatagatgtgatttacgaaatgtacacacaaatgaacgctgagttaaactataaagtgtag

SEQ ID NO: 27007 - DNA, 762 bp, Artificial Sequence
  Description of Artificial Sequence: Synthetic coding sequence
atgagcatctgcagcagcctggcccggaagttccccaagctgaccataattggcgaagaggacctccccagtgaggaggtcgatcaggaactgatcgaagatagtcagtgggaggaaattttgaagcagccgtgcccctctcagtacagcgcgatcaaggaggaggatctagtagtgtgggttgacccattggatggcacaaaagagtatactgaaggtttactggataacgtcaccgtcctcattggaatcgcctatgagggtaaggccatcgcaggtgtgattaatcagccatactacaattatgaggcaggcccagatgccgtgctcggaagaactatatggggggtactgggtttgggtgcattcgggttccagctcaaagaggtgcctgctggtaaacatatcattacaaccacgcgctctcattctaataagctggtgaccgactgcgtcgctgcaatgaacccggacgcagtgcttagggtgggaggtgcaggaaataagatcattcaactgattgagggaaaggctagcgcctacgtttttgcctctcctggctgtaagaagtgggacacttgtgcgccggaggttatcctccatgcagtcggaggcaaactgaccgatatacatggcaacgtactacagtatcacaaagacgtgaagcacatgaactctgcaggtgtcctggccaccttacgcaactatgactattatgcgtcaagagtgcccgagagcatcaagaacgcccttgtgccctag

SEQ ID NO: 27008 - DNA, 1590 bp, Artificial Sequence
  Description of Artificial Sequence: Synthetic coding sequence
atgggcgcctacctgagccagcccaacaccgtgaagtgcagcggcgatggagtcggcgtgtccatggaagacgcccacaattgtattcctgagctggactctgagaccgcaatgttctcagtgtatgacggtcacggtggagaagaggtggctttgtactgcgctaagtacttgcccgatatcatcaaggatcaaaaggcatacaaagaaggtaaacttcagaaagccttggaggacgcgttcctggccatcgacgcaaagttaactaccgaagaggtgattaaggagctcgcacagatcgcaggccggccaactgaggacgaagacgagaaagagaaagttgcggatgaggatgatgtggataatgaggaggccgcactgttgcatgaggaggctacaatgaccatcgaagagctgctcacacgctatggccaaaactgtcataaaggcccccctcactctaaatctggcggtggcacaggagaagagccggggagtcaggggctaaacggggaagccgggccggaggactcaacgcgggaaactccctcccaagagaatggccccactgctaaggcgtatactggctttagctcaaattccgagcgcggcacagaagctggacaagtcggtgagcctgggatacctacaggtgaggcgggcccttcatgcagctcagcctccgacaaactgccccgagtggccaaatcaaaattctttgaggatagcgaggacgagagcgacgaggcagaagaggaagaagaggactctgaggagtgcagcgaggaggaggatggctattcgtctgaggaggccgagaatgaagaggatgaagacgatactgaggaggcggaagaggatgacgaggaggaggaagaggaaatgatggtgccaggcatggagggtaaggaggagcctggctcagatagcggcactacagctgtggtcgcgttgattagggggaaacagctgattgtcgctaacgcaggggattcgaggtgtgttgtgagtgaggcaggaaaagccctagatatgagctacgaccataaaccagaagatgaggtcgaactcgcgaggatcaaaaatgcaggcgggaaagttacaatggacgggcgagtgaatggagggctgaacttgtcccgtgcgatcggagaccatttctacaagaggaataagaacctgcctcccgaagaacaaatgatcagtgccctgcctgatatcaaagtgctgactttaaccgacgaccacgagttcatggtcattgcctgcgatggcatctggaatgtcatgagcagccaggaggtcgtggattttatacagtcaaaaatatcccaacgggacgagaatggagaactgcgtctgttgagcagcatcgttgaagaacttctcgaccaatgtctggccccagacactagtggcgatggaacaggatgcgacaacatgacttgcatcattatttgtttcaaaccacggaacaccgctgaattgcagccggaatcgggaaaaagaaagctggaagaagtgctgtccacggagggtgccgaagaaaatgggaattcagacaaaaaaaagaaggccaagagggattag

SEQ ID NO: 27009 - DNA, 1293 bp, Artificial Sequence
  Description of Artificial Sequence: Synthetic coding sequence
atgaccttcgagctgtacgacgagtggatccaggccagcaacgtgcaagagcaagacaagaaactgcaggccctgtggaatgcctgcgaaaaacttcccaaggccaatcacaataatatccggtatctgattaagttcctgtccaaactttcagaatatcaggatgtgaacaaaatgaccccctcaaatatggcaattgtgttaggtcctaaccttctatggccacaggcagaaggtaacatcacagaaatgatgaccactgttagcttacagatcgttggcataatagagccaattattcagcatgcggactggtttttccccggagagatcgagttcaacataacgggtaattacggatcacccgtgcacgtcaaccataatgcgaattattcttctatgccgtctcccgatatggaccccgcagatcgcagacagccggagcaggccaggcgccctcttagcgtagccacagataacatgatgctggagttttataagaaggatggcatgggagtgcgagtgatggacactaattgggtcgcccgcagaggttcaagcgctggtaggaaagtctcctgtgccccgcccagtatgcagccgcccgctcccccggccgagctggcggccccacttccctcacccctccctgagcagcccttggactcaccggctgctcctgccctgtctcctagcggactgggtttgcagccaggccctgagcgtacaagcaccaccaagagtaaggagctgtcgccggggtccgctcagaaaggatcccctgggagctcccaggggactgcctgtgccggtacccagccgggggcacagcccggagcacagcctggcgcttcccccagcccaagccagcctcccgcggatcagagtccacatactttacgtaaggtgtcaaagaagctggctcccattccccccaaggtgcctttcggacaacctggggccatggccgatcagagtgctggacagccttctccagtgtcattgagcccaactcccccatctacaccgtctccttacggcctttcctaccctcaaggctacagcctcgctagcgggcagcttagtcccgcagcagccccacccctagcctctcccagcgtgtttacatctacgctgtctaagtctcgtccaacacctaaacccagacagagacccaccctcccacctccccagcccccaacagtcaacctaagcgcaagctctccgcagagcacggaggctccaatgttagatggaatgtcccctggtgagtccatgtcaacagcagtgtag

SEQ ID NO: 27010 - DNA, 846 bp, Artificial Sequence
  Description of Artificial Sequence: Synthetic coding sequence
atgcccggcccccggcggctgcggagccccggcggcagcggctgcagtagccggggctccgggcctcggctttctacaaggcgttggcggccatgctgctattgcggaggctcaggggtttggttgctccgcacccctccctctccttcagcatggcccgcccgcagatgccctcgccatcggttcgaattctgtgaaccagccttcgtggttggcaattgcctgcagatcgcatctgacagccatcagtatgatagaatttactgtggggccggcgtgcagaaggaccacgaaaattatatgaagatcctcttgaaggtcggaggcatcctcgtgatgccaattgaggatcaattaacacaaatcatgcggaccggccagaatacgtgggaaagcaaaaatatcctggctgtttctttcgcccctcttgtacaaccgagcaaaaacgacaacggcaagcctgactcagttggactcccgccctgtgccgtccggaaccttcaggacctggcgcgcatctacatccggcgcaccctcaggaatttcattaacgacgagatgcaagctaaaggaatcccacaacgagcacccccaaagcggaagcggaaaagggtcaagcagcgcatcaacacctacgtgttcgtgggcaatcagcttattccccagcctttggactcagaggaagacgaaaagatggaggaggataacaaggaagaggaggagaaagaccacaatgaagccatgaagcccgaagaaccacctcagaatctattgcgcgagaagattatgaagctgcctctcccggagagtttgaaagcctacctaacatatttcagagacaaatag

SEQ ID NO: 27011 - DNA, 1251 bp, Artificial Sequence
  Description of Artificial Sequence: Synthetic coding sequence
atgagccccgccatgctgagcgtgctggtgaagatgatgctggcccaagctcaagaatctgtcttcgagaaaatcagtctacccggaatcaggaacgagttctttatgttggtgaaggtggcacaggaggctgccaaggtcggcgaagtctatcaacaactccatgccgctatgtcccaggcccctgtgaaagagaacattccttacagctgggcctccttggcatgtgtgaaagctcaccattatgccgccctggctcactattttactgcgattctactgattgaccatcaggtaaaaccgggcacggacctggatcaccaggagaaatgcctttcgcagttgtatgatcacatgcctgaagggctgaccccacttgctaccctgaaaaacgatcaacagcgacgacagcttgggaagtctcacctaaggagagctatggcacaccatgaggaaagcgtgcgtgaggcaagcctgtgcaagaaactcagatccattgaagtcttgcagaaggtcttgtgtgcagctcaggagaggtctcgcctgacttacgcccagcatcaggaggaggacgacttgctgaatctcatcgacgcgccatccgttgtcgccaagactgagcaggaggtcgacataatcttacctcagttcagtaagctcacggtgactgatttctttcagaagttgggcccgttgtctgtgttctccgctaataagagatggacacccccacggagtattcgcttcactgctgaagagggtgaccttggatttacgctgcgcgggaacgcacctgtccaagtgcatttccttgacccctactgttctgctagcgtcgcaggagccagggaaggggattatattgtctccattcaactcgtggattgcaaatggttaacactgagtgaagttatgaagcttttgaagagcttcggggaagatgaaattgagatgaaagttgtatccctccttgactccacgagctccatgcataataagagcgccacgtacagcgtcgggatgcagaagacttattctatgatctgcctggcaatagatgatgatgataaaaccgacaagaccaagaaaataagtaagaaattatcattcttatcgtggggtaccaataagaataggcagaaatctgcgtctaccctgtgcttgccaagtgttggtgccgctcgccctcaggtcaagaaaaagctgccatcaccattctcacttttgaactccgattcttcttggtactag

SEQ ID NO: 27012 - DNA, 6201 bp, Artificial Sequence
  Description of Artificial Sequence: Synthetic coding sequence
atgtgcagcacccccggcatgcccgcccccggcgccagcctggccctacgagtctcttttgtagatgtacacccagacgtgatcccagttcagctgtggggactcgttggcgaaaggaggggggaatatctgcgactcagccgagagattcaggaagctgccgcaactcgcggccagtgggccctcgggtcagccagcgcaagccccggagaactctgcctcgtgcaagtcggactgctttggcatcggtgccgcgtagtatcccggcaagcccaggagagcagggttttcttactggacgagggtagaaccattactgccggagctggttccctcgcacctggtcggcgcgaatttttcaacctcccctccgaggtgttgggctgcgtgctcgccgggttggtacccgctggctgcggcgccggatcaggcgagccaccccaacactggccggcagatgccgttgactttctctcaaatctgcagggaaaggaagttcatgggtgcgtgcttgatgtgctcctgctgcaccggctggtgcttcttgaggtgccagacgtgtttcagcagatgagggagctgggattggctcgcagagtgcccgacagcctgttccggtcactgctggagcgctacctcacagccgccaccgcatctgtgggatctggagtcccggtgctctctcgcgttccactgaaacaaaagcagcctggccttgactatttttacccacagctgcagctgggagtgaccgaagctgtggtaataacacaggtgtgccacccgcaccgaatccactgccagctcaggtctgtgtcccaggagatccatcgactgtctgaaagcatggcacaggtgtaccgcggtagcacgggcaccggcgatgagaattcaacctcagccacttgggaggaacgcgaggagtccccggacaaaccaggcagtccatgcgccagctgtggactggatggtcattggtatagagctctgctgctggagacttttcgtccgcagaggtgtgcgcaagttctccatgtggactacggcagaaaggagctggtgagctgcagtagtctgcggtatctcttgccagaatactttcggatgcccgtggtgacctatccctgcgccctgtacggtctttgggatggcggacgaggctggagtcggagccaagttggggacttaaaaaccctaattctgggcaaggctgtaaatgccaaaatcgaattttattgcagctttgagcatgtgtactacgtctccctgtatggagaagacggaataaatctcaaccgagtgttcggtgttcagagttgttgcttggccgaccgggtcctccaatcgcaagctaccgaagaggaggagccagaaacatcccagtcccagtctcctgcagaggaggtggacgaagagatttccctccctgcactccggtctattagactaaaaatgaacgccttctatgatgcccaagtggagtttgttaagaatccctccgagttttggataaggctgcgcaagcacaacgtgactttctctaagctgatgcgacggatgtgcggattttacagctctgcatccaagctagatggcgtggttctgaaacccgaacctgatgatctgtgttgtgtaaagtggaaggagaatgggtactaccgtgccatcgtaacaaaacttgatgataagtcagtcgacgtgtttttggtggaccggggaaacagtgagaacgtggactggtatgacgtgagaatgctgctcccccagtttcgccagctgcctattctggcggttaagtgcaccctagccgatatttggccactggggaaaacttggtcccaagaagcagttagcttcttcaagaagacggtgcttcacaaggagttagtcattcatattctggataaacaggaccatcagtacgtaatagaaatccttgacgagagtaggacaggggaagagaacatctctaaagttatcgcccaggctgggtatgccaaataccaggagtttgaaaccaaggagaacattctggtgaatgcccattcaccaggccacgtgtcaaaccactttaccaccgaatctaataaaattccatttgcgaagaccggcgagggggagcagaaggccaaacgggagaataaaacgacatcagtgtctaaggcactatcagataccacggtggtgacaaatggcagcacagaactggtcgtccaggagaaggtgaaacgggcctcagtatacttccctcttatgcaaaattgcctggagattaaacctggatcttcatcaaaaggagaactcgaagtagggtccacggtggaggtgcgggtctcctatgtcgagaaccccggctacttctggtgccaactgaccagaaatatacagggtctgaagactctgatgtctgacatccagtattattgtaaaaacactgctgcccctcatcagcgtaacaccttagcatgcctcgccaaacggaccgtcaacagacagtggtcgcgcgccctgatatcaggcatacagtctgtggaacatgtcaacgtcaccttcgtggactacggggatagagagatggtaagcgtaaaaaacatctactcgattagtgaggagttcctgaaagtcaaggcccaagctttcagatgttcactgtataatctcatccagcccgtagggcaaaatccttttgtatgggacgtgaaggctatccaagccttcaatgagttcatcgacaatgcttggcagaaaaatctcgaactgaagtgcacaattttcgccctggcctccattaatgaagagctgtttaatattgtggacttgttgactccgtttcagtcagcctgtcacttcctcgtggaaaagcgccttgcaaggcccgtaaagctgcagaagcccctggagagctcagtccagcttcactcctatttctattcaacccacgatatgaaaatcggttcagaagaattggtttacataacccatatcgacgacccttggacattctattgccagctggcccgaaacgcgaacattctggaacagttatcttgtagtattacgcagctgtctaaggtgctgttgaacttgaagacctccccactcaaccctgggacactgtgcctggccaagtatacggacggaaactggtaccgtggtatcgttattgagaaggaacctaagaaggtattcttcgtcgattttggtaatatctatgttgtgacttccgacgaccttcttccgatcccctcagatgcatacgatgtgttgttgctacctatgcaggccgtacgttgctcccttagtgatatccccgaccacattccggaggaggtcgtcgtttggttccaagagacaatcctcgacaaaagcctgaaagccctcgttgtggccaaagaccccgacggaacacttattatcgaactgtacggagataacatacaaatttctgcatctatcaacaagaagctggggctgctatcatacaaagacagaattcggaagaaggaatccgaggtgctttgttccaccacagagactctggaggagaagaatgagaacatgaagctaccttgtacggaatatctctcaaaaagtgtcggttacaaactgcccaacaaggagatcctggaggagtcgtacaaacctcagatcaactcttcctacaaggagctgaagctgctccagtctctcaccaaaactaacctggttacccagtatcaggactctgtgggcaacaaaaacagccaggtatttcccctgactacagagaagaaggaagagatctcagccgagacacccttgaaaactgctcgggtcgaggccaccctctccgagcgaaagataggagattcctgcgataaagacctgcctctgaagttttgcgaattcccccagaagacgatcatgcctgggttcaagactaccgtgtacgtgtcccacatcaacgacttaagtgacttctacgtccagctgatcgaggatgaggccgagattagccacctgtccgaacggttgaacagcgttaagacacgtccggaatactacgtgggaccgccacttcagaggggggacatgatctgcgcggtgtttccggaggataatctctggtatcgagcggtgattaaggagcagcagcccaatgacctattaagtgtccagttcatcgattacggaaacgtgagcgtggtacacaccaataaaatcggccgtcttgacctggtgaacgcaatcttacccggcctgtgtattcactgctcgctgcagggttttgaggtacccgataacaagaatagtaaaaaaatgatgcactattttagtcagcggacgagcgaggccgcaattagatgcgagttcgtcaaatttcaggacagatgggaggtgatcttggctgacgagcacggaataatagcggacgacatgattagccgctacgcgctgagtgaaaagtctcaggttgaactgtcaactcaagtgatcaagagcgctagctccaagtccgttaataagtccgatatagacacctcagtgttcctcaactggtacaacccagagaaaaaaatgatcagggcctatgcgacagtaatcgatgggccggagtatttctggtgccagttcgctgatacggagaagctccaatgtctggaagtggaggttcaaaccgccggtgagcaggtcgctgaccgacggaactgcatcccgtgtccgtacatcggcgacccctgcatagtgagataccgggaagatggacattattatagagccctaattaccaacatttgcgaagactaccttgtaagcgttcgccttgtggattttggaaacatcgaagactgtgtggaccctaaggccctatgggcaatcccgagtgagctcctctctgtccccatgcaggcgttcccctgttgtctctctggcttcaacatctctgagggcttatgctcccaagaaggaaatgattacttctacgagatcatcactgaggatgtacttgaaattacaatcctggaaattaggcgcgacgtgtgcgacattccactggccatcgtggacctcaaatctaaaggcaaatcaattaacgagaaaatggaaaaatactctaaaacaggaattaagtcagctttgccttatgaaaatatcgattctgaaatcaagcagaccttgggaagttataatctggatgtggggctgaagaaactatcgaacaaagccgttcagaataagatttacatggagcagcagacagacgagctcgccgaaataaccgaaaaggacgtcaacatcatcgggaccaaaccctcaaatttccgcgacccaaagactgacaatatatgcgagggcttcgagaacccttgtaaggacaagatcgataccgaagagctggaaggggagctagaatgtcacctcgtggacaaggctgaatttgatgacaaatacctgatcaccgggttcaataccctccttccacacgccaatgagacaaaagagatactggaattgaacagtctagaggtccctctgagcccggatgacgagagtaaagaattcctcgaactggaaagcattgagctgcagaacagccttgttgtcgatgaggagaaaggcgaattatctcctgttcccccgaatgtgcccctgagtcaggagtgcgttaccaagggcgcgatggaattgttcactcttcagttgccactgtcttgcgaagccgagaaacaacctgagctcgagctaccaactgcccaactgccgctggatgataagatggatcccttatcactcggcgtaagccagaaggcacaggagtctatgtgtacagaggacatgcgcaagagttcttgtgtagagtcatttgatgaccagagacgcatgtccctgcacttacacggagccgactgtgatcccaagactcaaaacgagatgaacatttgcgaggaggaattcgtagagtacaagaatcgcgatgccatttccgcactcatgccactcttctcagaggaagagtcctcggatgggagcaaacacaacaatggactgccagatcacatttcagcacagctccagaatacctatactctaaaggccttcaccgtagggtcaaagtgcgtagtttggtcctcactccgaaacacttggtccaaatgcgagatcctggaaactgcggaagagggaactaggaagcgtgggctcgaagtgatggaaatttag

SEQ ID NO: 27013 - DNA, 264 bp, Artificial Sequence
  Description of Artificial Sequence: Synthetic coding sequence
atgagcagctgcgtgagcagccagcccagcagcaaccgggccgcccctcaggacgaactgggcggacgcggatcaagttcgtctgaatctcaaaagccatgtgaagctctccggggattgtctagcctatccatccacttgggtatggagagtttcatcgtcgtgaccgagtgcgaacccgggtgtgcagtagacttgggcctcgctcgcgatcgtccactcgaagctgacgggcaggaggtacctttggacaccagtgggtag

SEQ ID NO: 27014 - DNA, 2469 bp, Artificial Sequence
  Description of Artificial Sequence: Synthetic coding sequence
atggccgccgagggcgaccccgagtggggccccaccccccccagcacatcggccacaactgcagcaaggcgggcagtaaataaagttgtctacgatgatcacgagagcgaggaagaggaggaggaggaggacatggtcagcgaggaagaggaagaagaagatggtgacgcggaggagacccaggattcggaggacgacgaagaggatgagatggaagaggatgatgatgactccgactatccagaagagatggaggacgatgacgatgacgcctcctattgtacagagtcttcatttcgcagccatagcacgtatagttccacaccgggaaggcggaagcccagagtgcacaggccccgaagtccaatcctggaagagaaggacattccacccttggagtttccaaagtccagtgaggaccttatggttccgaatgagcacataatgaacgtgatcgccatttacgaggtcctgagaaatttcggaacggtgctgagactctcgccatttaggttcgaggacttctgcgcggcactcgttagtcaggagcaatgcaccttaatggccgagatgcacgtcgtcctgttaaaagccgtgctccgtgaagaagatacatccaacaccacttttgggcccgccgatctgaaggacagcgtgaacagcactttgtattttatcgacgggatgacatggcccgaagtgttgcgggtctattgtgagagtgacaaggagtatcatcacgttttgccttaccaagaggccgaagactacccctacggtccggttgagaacaagataaaggttctccagttcctcgtcgaccagttcctcacaaccaatattgccagggaggaactcatgtccgagggagtaattcagtacgatgatcactgcagggtgtgccataaattgggcgacctactttgttgcgagacctgctccgcggtgtaccacctggaatgcgtgaagccacccctggaagaggtacctgaagacgaatggcaatgtgaggtatgcgtcgcccacaaagttccaggggtaaccgactgcgtggccgaaatacagaaaaataagccatacatccgtcatgagcctatcggctatgaccgaagcagacgtaaatactggtttctaaacaggcggctgataattgaagaggacaccgagaacgagaacgaaaaaaagatctggtactactcaacaaaggtgcagttggctgagctcatagattgtctcgacaaagactattgggaagcagagttgtgcaagattttggaggagatgagagaggagatccacagacacatggatatcacagaagaccttaccaataaggcacgagggagcaataagtcatttctggccgccgccaacgaggagatcttggagtccatacgcgcaaaaaagggcgatatcgataatgtaaagagccctgaggagactgaaaaggataaaaacgaaactgagaacgatagcaaggatgctgaaaagaacagagaggagtttgaggatcagagtctggaaaaggactccgatgataagacccccgatgatgatcctgaacagggcaagtctgaagaaccgacagaggtgggcgataagggtaattcagtttcggctaatcttggagacaacactacgaacgcaacctcagaggaaacctcaccctcagagggacggagccccgtaggatgtctcagtgagacaccagacagctctaacatggctgaaaaaaaagtggcttctgagctgccccaggatgtgcctgaggagcctaacaaaacgtgcgaatcgagtaatacctcagcaacaaccacttccatccagcctaatttggaaaattccaattcttccagcgagttaaatagcagtcagtccgagagcgccaaagctgccgacgacccagaaaatggggaaagggagtcccacaccccagtgtctattcaagaagagattgtcggcgactttaagagcgagaagtcaaacggcgaattgtctgaatcccctggcgccggtaagggcgcctcaggatccacgagaatcataacacgccttaggaatccggactccaagctctcgcagctgaagtctcagcaggttgctgccgccgcccatgaagcaaacaaactttttaaggaaggaaaagaagttctggtcgtgaacagccagggtgagataagtcggctgtctacgaagaaggaagttattatgaaaggcaacatcaataattactttaaattgggccaggaagggaaatacagggtttaccacaaccagtattcgactaacagctttgccttaaataagcaccaacaccgtgaggaccacgacaaaaggaggcatttagctcacaagttctgcttaacaccggctggggagttcaagtggaatgggtcggtacacggcagcaaggtgctcaccatctctacccttcgtcttactattacacagtacggggagaatttatag

SEQ ID NO: 27015 - DNA, 552 bp, Artificial Sequence
  Description of Artificial Sequence: Synthetic coding sequence
atgctgcagcagacctggaccagccggtgcctgatgaagttctacgccgtggtggcgacatcccctgccagttgggagtcccataaaatcgcggagcgcattgaacagcgcatcctgaactctaaccctgtgatggaggcttttggaaacgcgtgcaccctgcgcaataacaatagtagcaggttcgggaaattcatccagctgcagctgaatagagcccagcagatgactggggcagctgtccagacatatttgttagagaaaacccgggtcgcctgtcaagcctcgtcagagcgcaattttcatatcttttaccaaatctgtaaaggagcttcggaagatgagaggcttcagtggcatctccccgagggcgcagctttcagctggttgccgaatcccgagcgctctctcgaggaggactgctttgaggttacccgggaagccatgttgcatctggggatcgatacccccacgcagaacaatatattcaaagtcaggcggaaggctacgcccctaaaattcggaagagatgacggtcagccattcgcgtag

SEQ ID NO: 27016 - DNA, 744 bp, Artificial Sequence
  Description of Artificial Sequence: Synthetic coding sequence
atgctgaagttcctggtgtggttcctgcagtggtgcgtgtgcgtgcttgtgcaacctgccaaagaactgttacattgtctcaagatgcaaatgcgtatctcaaaatacactaagtgtctgcaggctcagatcgcaattacagtaccgaaaacatggaagaagcccaaagaccgcactcgtacaacagaagagatgttggaggccgaactcgagctgaaagctgaggaggagctcagtatagataaggtgttagaatcagaacaggataagatgtctcaaggcttccacccagaaagagatccatccgatctcaagaaagtcaaagcagtcgaggagaacggagaggaagccgaacctgtccggaacggagcagagagtgtgagtgaaggggaaggcattgatgccaattctggatccacagacagctcaggggatggtgtgacctttccattcaaacctgagagctggaaacccacagatacggaaggcaagaagcaatatgatagggagtttctgctcgatttccagttcatgccagcctgcattcaaaagcccgaggggctcccgccgattagcgatgtcgtgctggacaagatcaatcagccaaagctccctatgcgcacacttgacccaaggatcctgccgagaggacccgattttacccccgcattcgccgattttggccgacagacccccggaggtcgaggagtgcctgtttctgcaagcagccttcagttgacatag

SEQ ID NO: 27017 - DNA, 981 bp, Artificial Sequence
  Description of Artificial Sequence: Synthetic coding sequence
atgctgggcggcgtgggcgaggagaacgagaagctgtggagcttcaccaagaaggcgtcgcatatccaactggacagcctgcctgaagtccccctgctcgtggatgtgccatgtctaagcgcgcagttggacgatagcattctcaacattgtgaaggaccatatcttcaagcatggcacggtcgcttcccgccctcctgtgcaaattgaagaattaatagagaaaccaggcgggataatagtaagatggtgcaaggtggacgatgacttcactgcccaggactatcgcttgcagttccgcaagtgtacttctaatcatttcgaagatgtatacgttggcagcgagaccgaattcattgtgttgcacattgacccaaatgtcgactaccagtttagggtgtgcgccaggggagacggaaggcaggagtggtctccctggagcgtccctcagattggtcactcaaccctggtcccccatgagtggacagctggattcgaaggatattcactgagctctcgcaggaacatagcactacgcaacgacagcgaaagtagcggggttctgtattctcgtgctcccacttacttctgcggacagacactaacgttcagagtcgaaaccgtgggacagcccgatcggagggatagtattggagtgtgcgcagagaagcaggacggctacgacagtctgcagagagatcaggcagtgtgcatttctaccaacggagcagtcttcgtgaatggcaaggagatgacaaatcagctgccagccgtgacttccggcagcacggtgacatttgacatcgaggccgtcacactaggaacgacctcgaacaacgaagggggccactttaagttgagagtgacgatcagctccaataacagggaagtggtgtttgactggcttctagaccagagctgtggctccctgtatttcggttgttcgtttttctatccagggtggaaggtgttggtgttctag

SEQ ID NO: 27018 - DNA, 2436 bp, Artificial Sequence
  Description of Artificial Sequence: Synthetic coding sequence
atggtgagcgaggaggaggaggaggaggacggcgacgccgaggagactcaagactctgaggacgacgaggaggacgagatggaggaagacgatgatgatagcgactatcctgaagagatggaggacgacgatgatgacgcttcctattgtacagagagcagtttcagatctcactcaacctactcatccacccccggccggcgcaagccaagggtacatcggcctcgctctccgatactggaggagaaggacatccccccgttggaattccctaaatcatcagaggacctgatggtaccgaacgagcatatcatgaatgtgatcgccatctacgaggttttaagaaacttcggtaccgtgctgcggctgtccccattcagatttgaggatttctgtgcggccctcgtgtcgcaagaacagtgcaccctcatggctgagatgcatgtggtgctactcaaggccgttctgcgagaggaagacacctcaaatactacctttggtcccgcggacttaaaggactctgttaattcaactctgtactttatcgacggcatgacctggccagaggtgctgagggtgtactgcgaatccgataaggagtatcaccacgtcctaccataccaggaggcggaggattatccttacggtcctgtggagaacaaaatcaaggtgctccagttcctcgttgaccagtttttgaccacaaatatcgcccgggaggaactgatgagcgagggcgtcatacaatacgacgatcactgtcgcgtttgtcataaactcggggacctcctttgttgcgaaacctgttccgctgtgtaccatctggagtgcgtgaaacctcccctggaggaggtgccagaggacgagtggcaatgtgaagtgtgcgtggcccacaaggtccctggggtgaccgactgtgtcgcggaaatccagaaaaataagccatacatcagacatgaacctattggatacgacagatccagacgcaaatactggttcttgaataggcgcctgatcatcgaagaggatacagaaaatgagaacgaaaagaagatatggtactactctaccaaggtacaactcgcagagctgatcgactgccttgacaaagactactgggaggcagaactgtgtaagattctggaagaaatgcgcgaggagatacaccgccacatggatataacagaggatttgactaataaggcgcggggctccaataagagcttcctagcggctgctaacgaggagatcctggaaagcattcgtgctaaaaagggggatattgacaacgtcaaaagtccagaagaaacggaaaaggataaaaatgagacagagaacgatagtaaggatgcggaaaagaatcgggaagagttcgaggaccaatccctcgaaaaggactctgacgacaagacccctgacgatgacccagaacaaggcaaaagcgaagagccaactgaagttggggacaaaggcaatagtgtgtcagctaacctgggagacaataccacaaacgccactagcgaagagactagcccaagtgagggccggagtcccgtgggctgcctgtctgagacaccggactcaagcaatatggccgaaaaaaaggtggcttccgaactcccccaagacgtacctgtaggcgacttcaaatcagagaagagtaatggcgaactcagcgagagtccgggggccggcaaaggggcctccggatctactaggattattaccagactgcgcaatcccgacagcaaactgagtcaactgaagtcccaacaggtggccgctgcggcccatgaggccaataagctgtttaaggaagggaaagaagtgcttgtggtaaactcacaaggagagatcagtcggcttagtacaaagaaggaggttattatgaaaggcaacattaacaattacttcaaactggggcaggagggtaaatatagggtttatcataatcagtactccaccaacagcttcgccctgaacaaacaccaacacagagaagaccatgataaacgccggcatctagcccataagttctgtctgaccccggctggggaattcaaatggaacggatcggtgcacggcagcaaggtgttaaccatttccacactgaggttaaccattactcaattagaaaacaacatcccgtcaagttttttgcacccaaattgggcaagccaccgggcaaactggattaaagccgtgcagatgtgctccaaaccacgggagtttgcactggccttggccattttggagtgtgctgtgaagcccgtcgtcatgctccctatctggcgcgagtccctgggccacaccaggctgcatcggatgaccagcatcgagcgtgaggaaaaagaaaaggtgaagaagagagaagagacaggtaggcgcagaaatgatgctgccagtgatatggggaagatccacatcagctcatag

SEQ ID NO: 27019 - DNA, 1752 bp, Artificial Sequence
  Description of Artificial Sequence: Synthetic coding sequence
atggcccccgagctgacccccgaggaggagcaggccaccaagcagttcctagaggagataaacaagtggacagtgcagtataacgtctcacctttgtcgtggaatgtcgccgtgaagttcctcatggcacgtaagtttgacgtactgagggctattgaactctttcacagttacagagaaacccgacggaaggagggcattgtgaagctgaaaccccacgaagagcccctccgcagtgagatattgtcaggcaagtttacaatcctgaatgtccgtgacccaacaggggccagcatagccctctttacagccagactgcatcatcctcataagtctgtgcaacatgttgttctccaagccctattttatctactagacagagccgttgacagcttcgagactcaaaggaacgggctggtattcatttacgacatgtgtggatccaactacgcaaactttgagctcgacctcggtaagaaggtactcaacctgctgaaaggggctttccccgcccgcctgaaaaaggtactgatcgttggcgcaccaatttggtttcgagtgccttactccattatatcattgctgttgaaggacaaagttagagaacggatccagattctgaagacttcagaggtcacacagcatctgccacgggagtgccttcccgagaacctcggaggatacgtcaagatcgaccttgccacctggaatttccagttcctaccccaggtgaacgggcatccagatccctttgatgaaatcatattgtttagcctgcctccagcactcgactgggactcagtgcacgtgccggggccccacgcgatgactattcaggagcttgtggattatgtgaatgcccgccagaagcagggaatatatgaagagtatgaagacatcagacgggagaaccctgtaggcaccttccactgttcaatgtccccaggcaacctggaaaaaaatagatatggggacgtgccttgtctggatcagacgagggtcaagttaaccaagaggagcgggcacacacagaccgattacattaatgcatcttttatggacggctacaaacagaaaaatgcttacatcggcacacagggccctcttgagaatacgtatagggatttttggctgatggtatgggaacaaaaggtgcttgtgatagtgatgaccaccagattcgaggaaggcgggcgccggaaatgcggacagtattggcctctcgagaaggactcacgaattcggttcggatttctgactgttacaaatctcggtgtggaaaatatgaaccattacaagaaaacaaccctcgagatccacaatacagaagagcggcagaagcgccaggtgacgcattttcagtttctaagttggcctgattacggggtccctagcagcgcagcctctcttatcgactttctccgtgtggttcggaatcagcagagcctcgcagtgtcaaacatgggtgcgcggtccaagggccaatgccctgagccaccaatcgtagtgcattgcagcgcaggaattggtcggaccggaacgttctgctctctagacatctgcctggcccaactggaagagctaggcacactgaatgtatttcagaccgtttcaaggatgcgcacgcagagggcttttagtattcagaccccagaacagtattatttctgttataaagccatattggagtttgccgagaaagaggggatggtgtcatctggacagaacctcctggctgttgaatctcagtag

SEQ ID NO: 27020 - DNA, 396 bp, Artificial Sequence
  Description of Artificial Sequence: Synthetic coding sequence
atggccatgaccgccggcaccaccaccaccttccccatgagcaaccatactcgtgagagagtgacggtggctaagctgacattggaaaacttctattcaaatcttatactgcaacacgaagagagggaaaccagacaaaagaaactggaagtggcaatggaagaggagggcctcgctgacgaagagaaaaagcttcgccggtcgcaacacgctagaaaggaaaccgaatttctgaggttaaagcgtactcgactgggtttggacgatttcgagagcctcaaagtgattggtagaggtgcgtttggtgaagtccgcctggtacaaaaaaaggatacaggccacatttacgcaatgaagattctgagaaaatccgacatgctggaaaaggagcagtag

SEQ ID NO: 27021 - DNA, 435 bp, Artificial Sequence
  Description of Artificial Sequence: Synthetic coding sequence
atggccagcgtggccgccgcccgggccgtgcccgtgggcagcggcctacgaggtttgcagcgaacactcccgttagttgtaatccttggagccacgggcacgggaaaatcgacattggcgctgcagctaggccagcggcttggcggggagattgttagcgcggacagtatgcaggtgtacgagggccttgacataatcactaataaggtaagcgctcaggagcagcgtatttgtaggcatcacatgatctcttttgtggaccccttggtgaccaactatacagttgtggactttcggaacagggccacagccttaatagaggacatttttgcccgggacaaaattcccatcgtggtcggggggacaaattactatatcgaaagcttactgtggaaggtactggtgaatacaaaagtaagtctcgtgcacagctag

SEQ ID NO: 27022 - DNA, 1386 bp, Artificial Sequence
  Description of Artificial Sequence: Synthetic coding sequence
atggccgccagcagcctggagcagaagctgagccggctggaggccaagctgaaacaggaaaaccgcgaggctagacggagaatcgatctgaatctggatattagccctcagcgcccacgccctacactccaactcccactggccaacgacggagggtcgcgctctcctagctccgaaagttccccccagcatccaactcctccggcgagacccagacacatgttgggcctcccttccacactgtttacaccaaggtcaatggaatccattgaaatcgaccagaagctgcaggaaattatgaagcagacaggctacctcactatcggcggacaggtcccaccgtcactttggaggggcgaaggaggagggcccgcgagactggacccttcctgggagagacagtggggggctggcggtgggggccggcccgggacactgcagccttccctttcttcccaaagatatcaggccgaaattaatgatctggaaaatctgggcgagatggggtcgggcacatgcggccaagtgtggaagatgcggttccgcaagaccggccatgtcattgcagtgaaacagatgagaagaagcggaaataaagaagagaataagcgtatcctaatggacctcgacgtggtcctcaagagccacgattgcccctatatagttcagtgctttgggactttcatcacaaataccgatgtgtttatagctatggagctcatgggcacatgtgccgagaaactgaagaagaggatgcagggccctattccggagcggatcctgggaaaaatgaccgttgccattgtgaaggcgctttactacctcaaagagaagcacggcgttatacacagggacgttaagccttctaatatcctcttggatgagagggggcagattaaattatgtgacttcggcatctcaggaagacttgtggattctaaagcgaagactcggtccgctggctgtgccgcgtatatggccccagagcgaatcgacccacctgacccaaccaagccagactatgatatcagagccgacgtgtggtcactcgggatttcgttagttgaactggctacgggacaattcccctataaaaattgcaagaccgactttgaagtgttgacaaaggtcctgcaggaagagcctcctctgttacccgggcacatgggattctcgggcgactttcagagctttgtgaaagactgcctcacaaaggatcatcgtaagcgaccgaagtataacaagctgctggaacattcatttattaaaagatatgaaactcttgaagtcgatgttgctagttggttcaaagacgtgatggccaaaactgagtctcctcggacgtccggcgttctgtcacagccccacttgccattctttagatag

SEQ ID NO: 27023 - DNA, 1611 bp, Artificial Sequence
  Description of Artificial Sequence: Synthetic coding sequence
atggagaccagcgacatccagatcttctaccaggaggaccccgagtgccagaacctgtccgagaattcatgcccaccttccgaggtcagcgacaccaatttgtactcccctttcaaaccgcgaaactatcagctggaacttgccctgccagctatgaaagggaaaaatactatcatatgtgctcctacggggtgtggtaagacctttgtatcactcctcatctgtgagcaccatctcaaaaaatttccgcaagggcaaaaggggaaggtcgttttttttgccaaccagattccagtgtacgagcaacaaaagtccgtgttcagcaagtacttcgaacgccatgggtaccgcgtcacagggattagtggggcaaccgcagaaaatgttcccgtggagcagatcgtggagaataatgacatcataattttgacaccccaaatcttggtaaataatctgaagaaaggcaccatcccctccctgtccatattcacccttatgatattcgacgaatgtcacaatacctccaagcagcacccttataacatgattatgttcaactatttggatcaaaagcttggaggtagttccggacctctgccacaggtgatcggactcaccgccagcgttggagttggggatgccaaaaataccgatgaagctctggactatatttgcaagttgtgtgcttccctggacgcatcagtgattgccaccgtgaagcataatctggaggagttggagcaggtggtgtacaagccccaaaagtttttccggaaggtggaaagtcgaatcagcgataaatttaagtatataatcgcccagctgatgagagatactgaatctctggccaaacggatttgcaaagatctggagaacctctcccagattcagaaccgcgaattcgggacacagaaatacgaacagtggattgtgacggtgcagaaggcgtgtatggtattccaaatgccagacaaggatgaagagtctcggatatgtaaggcgctgttcctttatacatcccatcttcgcaagtataacgatgccttgatcataagcgagcacgcacgcatgaaggacgccctcgattatcttaaggatttcttttcaaacgtgcgagctgcaggattcgacgagattgagcaagacctcactcagcgtttcgaagagaagctccaggagttggaatccgtgtctagagatcccagcaacgagaatcctaagctggaggacttatgctttatactccaggaggaataccatttaaaccccgaaacaattaccatcctttttgttaaaactagggcactcgtggatgcactgaagaactggattgagggaaacccaaaactgtcgtttctgaaaccaggtatcctgactggcagggggaagactaatcagaacactgggatgactctgccagcccagaagtgcattctcgacgctttcaaagctagcggtgaccacaatatattaatagcaacctctgtggcagacgaagggatagacattgcccagtgcaatctcgtgattctgtatgaatacgtgggcaatgtaattaagatgatacaaacgagagaggaggaacaggaggtcgcttctgcatctttctag

SEQ ID NO: 27024 - DNA, 2883 bp, Artificial Sequence
  Description of Artificial Sequence: Synthetic coding sequence
atgagccggctgatcgtgaagaacctgcccaacggcatgaaggaggagaggttccggcagctgtttgcagcctttggtacactgaccgactgtagtttaaaatttactaaagacggtaaattccggaagtttggattcatcggctttaaaagcgaagaggaggcccagaaagctcaaaagcattttaacaagagtttcattgacaccagtagaatcactgttgaattttgcaagagctttggcgacccggccaagccacgtgcatggtctaagcatgcccaaaaaccatcccaacctaaacaacctcccaaggattctacaacacctgaaatcaagaaggatgaaaagaagaagaaggttgccgggcaactggagaaactcaaggaggacacagaattccaagaatttctctctgtgcatcaaagacgtgcccaagctgccacttgggcgaacgatgggctcgatgccgaacccagcaagggcaagagtaagcccgcatcagactacctcaactttgactccgactcgggccaagaatctgaggaggagggagccggagaagacctcgaggaggaggcgtcactggagccaaaagcggccgtgcaaaaagaactgtctgatatggattaccttaagagcaaaatggtaaaggccggttccagttcatcctccgaggaggaggagtcggaggacgaagcagtgcattgcgatgaagggagcgaggcagaagaggaggattcaagcgcgactcccgtgcttcaggagcgagattcgaaaggggcagggcaggaacaggggatgcccgccggaaaaaagcggccccccgaagccagagctgaaaccgaaaagcctgctaaccagaaagaaccaacaacttgccacaccgtaaaactgagaggtgccccatttaatgtaacggagaaaaacgtgatggaattcctcgcccccctgaagccggtggccattcggatcgtgcgcaacgctcacggaaataaaacaggttatatatttgttgatttttcaaatgaagaggaagttaagcaggccttaaaatgtaaccgagaatatatggggggcagatacatcgaagtgttccgcgagaaaaacgttcctaccaccaagggcgctccgaagaacacaaccaaatcctggcaagggcggatcctcggagaaaacgaggaggaagaggacctggccgagtctgggaggctttttgtcaggaacctgccatacacgtcaacagaagaggacctggaaaagcttttcagcaagtacgggcccttatcagagctgcactatccaatcgactctctgaccaaaaagccaaagggatttgcctttattactttcatgttcccagagcacgctgttaaagcgtattctgaggttgatggacaggtcttccagggccgcatgcttcacgtactgccgtccacaattaaaaaggaagccagtgaggatgcaagtgctttggggagcagcagctacaaaaagaaaaaggaagcccaagacaaggcgaactctgccagttcacataattggaatacattattcatgggaccgaacgctgtggccgacgcaatagcacagaagtataatgctacaaaaagtcaggtattcgaccacgaaaccaaagggtccgtagccgtgcgggttgctcttggcgaaacccagctcgttcaggaggtcagacgtttcctcatagataatggggtctccctggattccttttcccaggccgccgctgaaagatccaagacagttatcctggtcaagaacctcccagccggtaccctcgccgcacaactgcaggaaacttttggtcacttcggctcactgggtagggtcctcctccccgagggcggtataaccgccattgtcgaattcctcgagccgttagaagctcgcaaggccttcagacacttggcctatagcaagtttcatcatgtgcccctttatctcgaatgggccccagtcggtgtttttagcagtaccgcaccccagaaaaagaaactgcaggacactccttctgagcctatggagaaagacccagcagaacccgagaccgtcccagatggagaaacccccgaggacgagaatcccaccgaagaaggggctgacaattcttccgcaaaaatggaggaagaggaggaagaggaagaggaggaagaagaatcgctgcctgggtgcactctctttattaaaaacttgaattttgacacgaccgaggaaaaacttaaagaggttttttcaaaggtgggcactgtgaagtcttgtagcatctccaaaaagaaaaacaaggcaggggtcttactgagtatgggctttggatttgtggaatatcgcaaaccagaacaggcccaaaaggctcttaaacagctgcaaggtcatgtggtggatggacacaaactggaagttcgaataagcgaaagagctaccaagcctgctgttactttggcccggaagaagcaggtgcccaggaaacagactactagcaaaatattagttcggaacattccttttcaggcacatagccgggagattagagagctcttctccacctttggcgagctgaagacagtgcgtctcccaaaaaagatgaccggcacaggaactcaccgcgggtttgggtttgttgatttccttacaaagcaggacgccaagcgcgcattcaacgccttatgccatagtactcatttatatgggcggaggttggtgttggagtgggctgacagcgaggtaaccctgcaggctcttagacggaaaactgccgcccattttcacgagcctccaaagaaaaagagaagcgtcgtgctggacgaaattctcgagcagctggagggtagcgattcagatagtgaggaacaaactctccagctttag

SEQ ID NO: 27025 - DNA, 666 bp, Artificial Sequence
  Description of Artificial Sequence: Synthetic coding sequence
atgctggccgccggcctgctggaggagctgcgggacttccaccggaggtataatcagaaaaacgtaagcgaaaattcgcaagactatcagcacgggatattccagagcatcggattcaaggagttccatgaatacctgattacggaggggaaatgtaccctggaaactagtaaccaactgctgaaaaagggaatcgaggcgctgaagcaggtcactaaacgctatgcccggaagcagaatcgatgggtgaagaacaggttcctgtcaagacccggccccatcgtgcctcccgtgtacggcctggaagtgtccgatgtatcaaagtgggaggagagcgtgttggagccagccctggaaatcgtccaaagcttcattcaggggcataagcccaccgcaacccccattaagatgccctacaacgaggccgaaaacaaaaggtcctaccacctgtgcgacctgtgcgataggattattattggagatcgtgaatgggcagcgcatatcaagagcaagtcacatcttaaccaactgaagaaacgacgtcgacttgatagcgatgccgtcaataccattgagagccagagtgttagccccgatcacaacaaggagcctaaggaaaagggttccccaggacaaaacgatcaagagctgaaatgctcagtatag

SEQ ID NO: 27026 - DNA, 2649 bp, Artificial Sequence
  Description of Artificial Sequence: Synthetic coding sequence
atgccccgggtgaagcccaagctggagaagcagctgcagaaggacaaggaaaaagtggaggaattcaagagcattcctgccaagagcaacaatatcataaatgaaaccacaacccgtaataacgcactcgagaaggagaaggaaaaagaggaaaagaagcttaaggaggtgatggattccctcaaacaggagacccagggcctgcagaaggagaaagagagtcgggaaaaagaacttatgggcttctctaagtctgtcaatgaagcgcggtccaagatggacgttgcgcaatctgagttggacatttatctcagtcggcacaatacggctgtaagccaattgactaaagccaaggaagcactcatcgccgcatcagagacattaaaagaaaggaaagctgcaatcagggatatagaaggtaagcttccacagactgaacaggagctgaaagaaaaggaaaaggaactgcagaagctgacacaggaggagactaacttcaagtccctcgtgcatgacttgtttcagaaagtggaggaagccaaaagctcactggccatgaaccggtcacgtggcaaggtgctggacgcaatcatccaggagaaaaagagcggccgcatccccggaatctacggacgactcggcgacctgggtgcgatcgatgagaagtatgatgtggcgattagttcttgctgtcacgcgctggactatattgtggtcgatagcatcgatatagctcaggagtgtgtaaacttcttaaaacggcagaatattggcgtcgcgacattcatcgggctagataagatggcagtgtgggctaaaaaaatgaccgaaatccagaccccagagaataccccacggctgttcgacttggtgaaggtcaaggatgaaaaaattaggcaagccttctatttcgctttgcgggatacccttgtggccgacaacctcgatcaggcgactagggtggcataccagaaggatagaagatggcgggtcgtgactctgcaggggcagatcatcgaacagtctggtaccatgacgggcggcggttccaaggtaatgaaggggaggatgggatcgagtctagtgatcgaaatctctgaagaagaggtgaataaaatggaaagtcagctccagaacgactctaaaaaggctatgcagatccaagaacagaaagttcaacttgaagaaagggtagtgaaactgcgccatagtgagcgcgagatgcggaataccctggagaagttcacggctagcattcaacgattgattgaacaggaagagtaccttaacgtgcaagttaaagaactggaggcgaacgtgctcgccacggcccccgataagaaaaagcagaaactgctggaggaaaacgttagcgcattcaaaaccgagtatgacgctgtcgcagagaaggctggaaaagtggaagctgaggtcaaacgcttgcacaatactatcgtggagatcaacaatcataaacttaaagcccaacaagataaactcgataagatcaacaaacagctcgatgaatgtgcaagcgccattactaaggcccaggtcgcaatcaaaacggcggatcggaatctccaaaaagcccaggactccgtgttgaggactgagaaggagattaaggataccgaaaaggaggtcgacgacctcacagccgagctgaaatcgctggaggacaaggccgccgaagtcgtgaaaaacactaacgctgcggaagagagccttcctgagatccagaaggagcaccggaacctgctgcaagagcttaaggtgatccaggagaacgagcacgcactccagaaagacgctctctccataaagctgaaattggagcagatcgacgggcacatcgcggaacataactctaagatcaagtattggcataaggagatcagcaagatatcactgcatcccatcgaagataatcccattgaggagatctccgtcctgtcacccgaggatctagaagctatcaaaaatccggactcaataacaaaccagatcgcgcttctagaggcacgatgccatgaaatgaaacctaaccttggagccatcgcggagtataagaaaaaagaggagttgtacctacaacgggtggctgagcttgacaaaatcacatacgagcgcgattccttccgccaggcctatgaggacctgaggaagcagagattaaatgagtttatggcaggcttttacataattacgaataaactgaaggagaattatcagatgctcacacttggcggcgacgccgaattggagctggttgactccctggaccctttttcggagggtataatgtttagtgtgcgtccccctaagaaatcctggaagaagatcttcaacttgagcggcggggaaaaaacactctcctccttagcactggtgtttgctctgcaccattataagccgaccccgctgtacttcatggatgagattgacgcagccctcgattttaagaacgtgtctattgtggccttttacatctatgaacagaccaaaaacgcccagttcatcataatatctctccggaacaacatgttcgagataagcgatcgcctgatcgggatctacaagacctataatatcaccaaaagcgttgctgtcaatcctaaagagatcgcctctaaaggcctgtgctag

SEQ ID NO: 27027 - DNA, 1038 bp, Artificial Sequence
  Description of Artificial Sequence: Synthetic coding sequence
atgttcctgacccggcccaaggtgtgcgtggacctgaaccggcgggtgactctatacggagtgtttacgattcacttttcaccaaatgtgccatcccgatgcctgctcctggagttgcttgacgtcagcgtgagtgagctgttactgtactcttcccaccagggctgcagtatgtggatgattcaacactgcgccagagacgtgctggaggcattagccttcctccaccatgagggatacgttcacgccgacctgaaaccccgcaacatcctctggagtgccgaaaatgagtgctttaagcttattgactttggactgtcgttcaaagaaggcaatcaggacgtgaagtacatccagactgatggatatagagcccctgaagcggagctccagaactgcctggcccaggccggcctgcagtcagatacagaatgcacatccgccgtggatttgtggtcacttgggatcattctgcttgaaatgttctcagggatgaaactgaaacacaccgttcgctcccaggagtggaaggccaatagcagcgcaatcatagaccacatttttgcttcaaaggcagtcgtcaatgccgccattcctgcataccacttgcgcgacctgatcaaatcaatgctccacgatgacccctcccgacgcatccccgctgagatggctctctgctcccctttctttagcattccatttgctcctcatattgaagacctggtgatgctcccgacccctgtactaagactacttaacgttctggacgacgactacctcgaaaatgaggaggaatacgaagatgtcgtggaggatgttaaagaagagtgccagaaatacgggcccgttgtcagcctgctggtccccaaggagaatcccggacgagggcaggtgtttgtggagtatgctaatgcgggcgacagcaaggccgcacagaagctgcttacgggcagaatgttcgacgggaagtttgttgtggcaactttctaccctctgtccgcctataaacgtggttacctttaccagacgttactttag

SEQ ID NO: 27028 - DNA, 954 bp, Artificial Sequence
  Description of Artificial Sequence: Synthetic coding sequence
atgtggctggcccgggagggcatcgtggcccccctgcccggcgagtggaagccctgccaagatataacgggagatatctactactttaactttgcaaatgggcagtcaatgtgggaccacccatgtgacgagcactaccgctcgctggttatccaggagcgggcaaaattgtccacatctggcgccatcaagaaaaagaaaaagaaaaaagagaaaaaggataaaaaggatcgcgatccaccaaaaagttctctggagacccagccagaagaaggcctcttaccacctagttcattcctttgtagtctgtcacctcctagtgcgcccgggctcgcggatctcgatctggaccaggagatgcaggccatcagtgagggtagctataacaagggcaaatccccaggaatgctcggcgacacaccatggagattcatgggggctctgccgcgtaagctacagccactaagtaagggtcaaccgtcacagatacaccaggtgtttgcggatatggaaaaaattctgggacgcgcgcctgcccagtgtcggcgagaactgggtgatcagcagggtctcgagaaattgcagaaagcaactgagaaaatctatcttggattttcagatccggagaccgaggaacttgagatgcgctctcgtcagcaaaaactgggcaccccagccccgcaaaatacagggttactgcagaatatgcaggacgttgttgaatcgcgtaatcaggcctcggtccactccaagttgtctgaagcaatcaaaggtttacctctgaagggcgaacagcacagccattctctcgccaaactcagcccgaccgggccagggggggacaagggacaaagccctattccaatgtggatctgctgcaggctaagggccagtaattgcaggaatacgtctgccgcatggcgcctcaaactgaagcgcagttctacgtgctag

SEQ ID NO: 27029 - DNA, 162 bp, Artificial Sequence
  Description of Artificial Sequence: Synthetic coding sequence
atgggcaacagcgacagccagtacaccctgcagggcagcaagaaccactcgaataccattactggggccaagcagatcccttgttccctcaagattagagggatacatgccaaggaagagaagagtctgcatggatgggggcatggtagtaacggagcctag

SEQ ID NO: 27030 - DNA, 1203 bp, Artificial Sequence
  Description of Artificial Sequence: Synthetic coding sequence
gcctggctgcagagcgccggcgagctgcccagcgacggcggctgcagtagattgcgttggcaggctcacctggagtttacacacaatcatgacgtgggggatctgacctgggataagattgccgtatccctcccccgttccgaaaaattgcgctccttggtcctggcaggcatcccacacggcatgcggccgcaactctggatgcggctgtctggcgcccttcagaagaaaagaaattcagagctgagctacagagaaattgtcaagaactcctcaaatgacgaaacgatcgcagctaagcagattgagaaagacctcctgcggaccatgccttctaacgcgtgcttcgcatccatggggagcatcggagtcccccggttgcggcgggtcttgcgggccctggcttggctctatccagagattgggtattgtcagggaacggggatggtcgctgcatgcctgctcctcttcctcgaagaagaggatgctttctggatgatgtccgccattattgaagatcttctccccgcctcatacttttccacaactttactgggggtgcagactgaccagcgtgtcctgcggcacttaatcgtccagtatctgccacgtctggacaagttgttgcaagagcatgatatcgagctaagccttataacactgcactggttcctgactgctttcgcttcagtggtggacattaagctactgctgaggatctgggacctgtttttctacgagggctccagggtcctatttcagctgactttagggatgctgcacctgaaagaagaagagcttattcagtccgaaaacagtgcatccatatttaacaccctgtccgacataccgtcccagatggaagatgcagaactgctgctcggcgtggccatgaggcttgcaggcagccttaccgacgtggctgtcgagactcagcgaagaaagcatctcgcctacctgattgcagaccaaggtcagcttctcggtgcaggtaccttaactaacctaagccaggtggcccaggatggcggcccccatctggaccctcagcatactggcagacgaggtcatcttgaggtccagtcagcaggggccgccgaaaacaaacctgccctcccggctctccccccgagcttggctcagagcgaccattcctgcggggtgattcaggcctcgtctggcttcgtgcatttacgcttttag

SEQ ID NO: 27031 - DNA, 294 bp, Artificial Sequence
  Description of Artificial Sequence: Synthetic coding sequence
atgctgcggggcaccaaggagatggacaacatgagcccccggctgcgagcctttcttagtgagccgattggggagaaggatgtgtgctgggtcgacggaatctcccacgaattagcaataaacctagtgactaaggggatcaacaaagcgtacatcctgctcggacaatttctgctcatgcacaagaatgaagccgagttccagcgctggctcatctgctgttttggagccacagagtgcgaagcgcaacaaaccagtcactgtctgaaggagtggtgtgcctgtttcctgtag

SEQ ID NO: 27032 - DNA, 1011 bp, Artificial Sequence
  Description of Artificial Sequence: Synthetic coding sequence
atggagtacctgggcggcggcagcgccctggacctgctgaagcccggccccttggaagagacctatatagcgacgatcttgcgggaaatcttaaagggcctggactatctgcacagtgagcgtaagatccatcgggacatcaaagccgcaaacgtactgctgagcgagcagggtgacgtgaagctggcagactttggagtagctgggcagttaactgacactcagattaaaagaaatacattcgtcggtactcctttttggatggctcctgaggtgatcaaacaaagcgcttacgactttaaggcggacatttggagtcttggaataactgccattgaactagctaagggggagcctccaaatagcgacctgcatcctatgagagtcttattcctgatccccaagaatagccccccgacattggagggacaacatagcaagccgtttaaggagtttgtcgaggcctgtttgaataaagatccacgttttcggcctaccgccaaagaactactcaaacataagttcatcacacggtatactaaaaagacttccttccttacggagctgatcgaccgctacaagcggtggaaatctgaaggacatggcgaggagagttcttcagaggatagtgatatcgacggagaagccgaggacggagagcagggccctatttggacttttcccccaacaatccggcccagcccacacagcaaactccacaagggaacggcactccattcttcgcagaagccagccgagcccgttaagcggcagcctcgtagtcaatgcctgtccacattggtccggcctgtatttggcgaggtcttttcacaactgaaggaaaaacacaagcagtccggcgggagcgtgggggcgctggaagagctagaaaacgcgttctcattggccgaggagtcctgtcctggaattagcgataagctcatggtccacctggttgaacgagtgcaacggttctcccacaacaggaaccacttgacaagcacccggtag

SEQ ID NO: 27033 - DNA, 1455 bp, Artificial Sequence
  Description of Artificial Sequence: Synthetic coding sequence
atggtgcacgagaccagctacagcgcccagttcaagggcgaggcctctaagcctacaaccgcagacaataaagtcatcgatcgaagaaggattcgctcactgtattccgagccctttaaagagccgcctaaagtcgaaaaaccaagcgtccaatcctccaagcctaagaagacttccgcaagtcacaagcccacgcggaaagccaaggataagcaggcagtgagtggccaggcagctaaaaaaaagtctgcggagggccccagcacaaccaagcctgatgataaagagcagagtaaggagatgaataacaagctcgccgaggcgaaggagagcctcgcccaaccagtctcagactcaagcaagacccaggggcccgtggccacagagcccgataaagatcagggctctgtcgtgcccggactgctgaagggacagggccctatggtacaggagccactgaaaaagcagggttcagtggtgccaggcccccctaaagatctagggccgatgattcccctccctgtcaaggaccaggaccacaccgtgcctgagcccctcaagaatgagtcccctgtcatctccgcccccgttaaggatcagggccctagtgtccccgtccctccaaagaatcagtcacccatggtcccagctaaggttaaggaccaaggaagcgtggtccctgagagcctcaaagatcaaggccccagaatcccggagccagtgaaaaaccaggcacctatggtgccagctcccgttaaggacgagggacccatggtgtcagcaagcgttaaggaccagggacctatggtgtctgccccagttaaggatcagggacctatcgtgcccgcccctgtgaagggcgagggccctattgtgcctgcaccggtaaaggatgagggaccaatggtttctgctcccattaaagaccaggatcctatggtaccagagcaccccaaggacgagtccgcaatggctaccgcccctatcaagaaccagggatccatggtgtccgagccagtaaaaaatcagggccttgtagtctccggcccagtaaaagatcaagacgtggttgttcccgagcacgccaaagtacatgactccgccgtggtggctccagtaaaaaatcagggccccgttgttcctgaatccgtcaaaaatcaagaccctattctaccggtcctggtgaaggatcagggtcctaccgtcctgcagccacccaagaaccagggacggatagttcctgaaccactgaagaaccaagtccccattgtccccgtaccacttaaggaccaggaccctctggtgccagtgccagccaaggaccagggtcccgccgtgcccgagcctctgaagacacaaggtcctcgggatccccaactgccaacagtctcccccctgccccgggtcatgattccaaccgcccctcacacagaatatatagagagttctccctag

SEQ ID NO: 27034 - DNA, 2103 bp, Artificial Sequence
  Description of Artificial Sequence: Synthetic coding sequence
atggccctgggcgaggagaaggccgaggccgaggccagcgaggacacaaaagcccagtcttacggacgcgggtcatgccgggagcagccacctcggctcgaggctgaaggcggccttatctctcctgtttggggtgctgagggcattcccgcacccacctgttggataggtacagaccccggcggaccttcaagggcacaccagcctcaggccagtgatgcaaaccgcgaaccagtcgccgaaagatctgaaccagccctctcaggtctgccaccagcaaccatgggctcaggggatcttctgctgagcggagaatcccaagtggaaaaaacaaaattgtcttcgagcgaagagtttccccagactttatcactgcctagaaccaccacaatctgctccggacatgatgctgacacagaagacgaccccagtctcgcagacttgcctcaggcgctggacttaagccaacagccccacagctcgggtctctcttgtctgtcccaatggaagagcgtcttgtcacccggtagcgctgctcagcctagctcttgtagtatctcagcgtccagcaccgggagcagcctgcaaggccaccaagagcgagctgagccaagaggcggatccctcgccaaagtctcttcgtcactggagcctgttgtgccccaggaaccgagctctgtagtggggctaggcccgcgcccacagtggtctccgcagcccgtgttttccggaggagacgcctccgggctcggaaggcggcgcctatccttccaggccgagtattgggcctgtgtgcttcccgactccctccccccatcacccgatagacactctccattgtggaatccgaataaggagtacgaagacctccttgattatacatacccattgcggcccgggcctcagctccccaaacacctggactctcgcgtgccggcagatcctgtacttcaagattcaggggtggatctggactccttcagtgtctccccagccagtacccttaagtcccccactaacgtcagtccgaactgccctcccgcagaagccacagcgctccctttctccggaccccgggagcctagcctcaagcaatggcccagcagagtcccccagaagcagggtggcatgggtctagcgagttggtcgcagctggcctccacgcccagagcccctggcagccgcgacgcccgctgggagagaagagaaccagctctccggggtgccaaagacaggctgacaatcgggaagcatctggacatggggtccccacaactaagaacacgcgaccggggctggccatcacctcggcccgaacgcgagaaacgcacttcgcagtccgcccggcgaccaacctgcactgagagccgctggaaaagtgaagaagaagttgaatctgacgacgaatatctggctctgccagccaggttgacccaggtgtcttccctggtgagctacctcggtagcatatccactcttgtaacactcccaactggcgatataaaaggccagtctccattggaagtgagcgattcagatggcccggcctcatttcctagctcaagcagccagtctcaactgcctccaggggcggctctgcagggctcgggggaccctgagggccagaatccatgttttctcaggtcatttgttcgcgcccacgattccgcaggagaaggtagtctgggaagtagccaagcgctgggcgtgtccagtgggctcctgaagacacgcccatcactgccagcaagattggaccggtggccatttagcgaccccgacgtggagggacagctgcctaggaagggaggtgagcaagggaaggagtctctggttcagtgtgtgaagacattctgctgtcagctggaagagctcatttgttggctgtacaatgtggctgacgtgacggatcacgggaccgccgccagatccaatcttacctccttgaaatcttcattgcaactgtatcgcgtgatctgcggtccaggtagcggtctctttccacataagtcagtcgctaaattactggattataaggtgaaaagtcaaattacgaacgtctggtatgtgatcgcacagctgactatcattccggaaatttag

SEQ ID NO: 27035 - DNA, 1626 bp, Artificial Sequence
  Description of Artificial Sequence: Synthetic coding sequence
atgaagagctacgtgagcgagaccatggccagccccggcaaggacaactaccgtatgaagagttacaagaacaacgcacttaaccccgaggagatgcggcgccgccgcgaagaggaagggattcagttacgaaaacagaagagagaacagcagctctttaagcgaagaaatgtggagctgatcaacgaggaggccgctatgtttgactccctgcttatggattcctatgtaagctccacaacaggagagagcgttattacccgagagatggtggaaatgctcttttccgacgactctgatctgcaattagcaaccacacagaaattccggaaactactttctaaagagccctctccaccaatcgatgaggtaatcaatacaccgcgggtagtcgatcggttcgtcgagtttttgaaacggaacgaaaattgcacactgcagttcgaagccgcttgggccctcaccaacattgccagtggaacatctcagcagactaagatagtgatcgaggctggcgcagttccgatattcattgagctccttaattctgactttgaggatgtgcaggaacaggctgtgtgggctctggggaatattgccggagactcgtctgtttgtcgagattacgtgctcaactgttctattctcaaccccctgctcacactgttgactaagagtactcggctcactatgacccggaatgctgtgtgggcactgtcaaatctgtgtcggggaaagaacccaccccccgaattcgctaaagtgagtccctgcctgcctgttctgagccgactgctgttctcatcggacagtgatttgcttgccgacgcctgttgggcactgtcctatctcagcgatggaccaaacgagaagatacaggctgtgatagattctggagtgtgccggcgtctggtagagctgctgatgcataacgactacaaggtggccagtcccgctttgagagccgttggaaacatagtgacaggcgacgatattcagacacaagtaatcttgaactgttccgccctgccatgtttactgcatctgctgagttctcctaaggaaagtattagaaaagaagcatgctggactatcagcaatattactgccggcaatcgggcgcaaatacaggccgtgatcgacgcgaatatctttccagtgctgatagagattctgcagaaggcagagttccgaactcgaaaagaggcagcatgggctatcacaaatgctacgagcggcggcactcccgagcagattcgatatctggtttccctgggctgcatcaaacctctatgtgatctgctgacggtgatggacagtaagatagtccaggttgccctcaacggcctcgaaaacattctaaggctaggggagcaggagggcaaacgatccggtagtggggtgaatccctactgtggtctcatcgaggaggcttatggtctcgacaagatagaattcttgcagtcccacgagaaccaggaaatttaccagaaggcctttgacctcatcgagcactactttggagtggaagatgacgactcctccctagcaccacaggttgatgaaactcagcagcagtttatttttcagcagcccgaggccccaatggaggggttccagttatag

SEQ ID NO: 27036 - DNA, 1716 bp, Artificial Sequence
  Description of Artificial Sequence: Synthetic coding sequence
atgctggactgcggcatgcacatgggcttcaacgacgaccggcggtttcccgacttttcgtacatcacccaaaacggtaggttgacggatttcctggattgcgtgattattagccacttccaccttgatcattgtggcgcactgccatacttttctgaaatggtaggttatgacggcccaatatacatgacccacccaactcaggcaatctgcccaatacttctggaggattatcgcaagatagccgttgacaaaaagggagaagccaactttttcacctcccaaatgatcaaagactgcatgaaaaaggttgtggcagtgcacctccaccaaacagttcaggtggacgatgagttagagatcaaagcatattacgctggtcatgtgctcggcgcggcaatgttccagataaaggtcggttccgaatccgtggtgtacacaggtgactataacatgacccccgaccggcatctgggtgctgcttggattgataagtgtaggcccaaccttcttattacggagagtacttatgccactacaatccgggacagtaaacgttgtagagaacgagatttcctcaagaaggtgcatgagaccgtggaacgggggggaaaggtcttgatcccagtttttgctctgggaagggcacaagagctgtgcattctgttggagactttctgggagcgaatgaacctcaaagtgccaatctatttctcaacaggattgactgagaaggctaaccattactataaactgtttatcccatggactaaccagaaaatcagaaaaaccttcgttcagcggaatatgtttgagttcaagcatataaaggctttcgacagggcctttgccgataatcctggacccatggtcgtttttgcgacccccgggatgctccacgctgggcagagcctgcagatttttagaaagtgggcaggaaacgaaaagaatatggtgatcatgccaggttactgtgtgcaggggacagtgggtcacaagattctgagcgggcagcgtaaacttgagatggaaggtcgccaggtcctcgaggtaaaaatgcaggtggaatatatgtcttttagtgcacacgccgatgctaaggggattatgcaactcgtgggccaggccgaaccagagtccgtgctgcttgtccacggcgaggccaaaaagatggaattcttgaaacagaagattgagcaagagctccgggtgaactgctacatgcctgccaatggcgagactgtgacactcccgacgtctccctccatccctgtcggcatctcgttagggctcctgaagcgggaaatggcacaaggactcttaccagaggccaaaaaacctaggctgcttcatggcactctcatcatgaaggactctaacttccggctcgtcagctccgaacaggcactgaaggaactgggactggccgaacatcagctgcggtttacttgccgggtccacctgcacgatacccgcaaagaacaggagacggcactacgcgtgtattcccacctcaaaagtgtgctaaaggaccactgtgtccagcacctgccagacggctccgtgaccgtcgaatctgtccttctccaagctgccgcgccctctgaagatcctggtaccaaagtactgctcgtgtcatggacatatcaggatgaggaactaggaagcttcctgaccagcctgttaaaaaaagggctgccgcaggcgccatcctag

SEQ ID NO: 27037 - DNA, 2232 bp, Artificial Sequence
  Description of Artificial Sequence: Synthetic coding sequence
atggaggccgccgccgtgaccgtgacccggagcgccacccggcggcgacgcagacagctgcaaggacttgccgcccctgaggcaggaacccaggaagagcaggaggaccaagagcccagaccccggcggcgtcgtccagggaggtctataaaggacgaagaagaggaaaccgtgtttagggaagtcgtgtccttttcacctgacccactgcccgtgcggtattacgacaaagacacaactaaaccaatctcgttctatctctccagcctcgaagagctcctggcctggaagcctcgactcgaagacggttttaacgttgcactcgaacctttagcgtgtcgccagccaccgctgtctagccagcgcccccggactctgctctgtcatgatatgatgggcggctaccttgatgatagatttatacagggcagcgttgtgcagaccccatacgcattttatcactggcagtgtatcgacgtttttgtctacttcagtcaccacacagtgactattccccccgttggctggaccaatacggcgcataggcacggagtctgtgtactgggtacattcatcacagagtggaatgagggggggcgcttgtgtgaggctttcctggctggcgacgagaggtcgtatcaggccgtggcggaccgcctggtacaaattacacaatttttcagattcgacgggtggttgattaacatcgagaacagtctgagcctggcggccgtcggcaatatgccaccatttctgcgctaccttaccacccagcttcatcggcaggtacccggtggactggtgctttggtacgattccgttgtgcagagcggacagctgaaatggcaggatgagctcaatcagcacaaccgcgtcttctttgacagttgcgatggcttctttactaactataattggagagaggaacatctcgagagaatgctcgggcaggctggagagcggagggctgatgtttacgtaggggttgacgtctttgcccgtgggaatgttgtgggtgggaggttcgatactgacaagagccttgagttaatcagaaaacatgggtttagtgttgcactatttgctcctgggtgggtgtatgaatgcctggagaagaaggatttttttcaaaaccaagacaaattctgggggagactggaaagatatttacctacccactctatttgctccctgcccttcgtgacttccttttgtctcggtatgggggcccgtcgtgtatgctatggccaagaggaggccgtgggaccctggtatcacctgtcagcccaggagattcaaccgctattcggcgagcatcgcctgggaggcgatggccgcggatgggtacgtacacattgttgtctggaagacgcttggcatggagggtcaagccttctggtcaggggggtcatcccccccgaggttggcaatgtcgccgtcagactgttttccttacaggcccctgtgccccctaagatatatctatcaatggtatacaaactggagggcccaacagatgttactgtggccttggaactcaccacaggagacgcaggatcatgccacatcggcggcatctcagtgctgaacgcagaaacaagcagtaggcattccctccgccccttgcgggtgcctcccacaaaactcgcacgctgggtgggtcggtgtgggcggcagctgtcaggcgggtgggtgcaacactgttacgaagtgagtctgcggggctgtctgctgctcgatttgctcgtttgtttctccagaccacccggatctcgggaggaggaatcttttacttgtcgactcggtgagattcaggtggtagatgcagccagtctgttggcccccctgccccaagtgcaggccgtgacgataagccacattaggtggcagccatccgcctctgagcgtgaaggcccccccgcgttgctgcagctatcctgcacacttcattggtcttttctgttaagccaagtacgctgttttaggattcactgctgggggggcatgagcgatgactctcccggacgggaacttccccgcccagagatgcctatgtttctgggcctggcttttgccacccagtacaggattgtggatcttctggtcgaagctgctggccccggtcaggacaggaggatggaatttctcgtggaaccagtccccaaggagggattccgcgtgccccaggccgagtgggggagagccgtgttgctctactcagctccagcctag

SEQ ID NO: 27038 - DNA, 396 bp, Artificial Sequence
  Description of Artificial Sequence: Synthetic coding sequence
atggagctgcgggtgcacatggtgagccacaccggcgagatgccctacaaggtacggctgggcttgagccctggcccagggctgggaggacccaggatcttacctgcagaaccgtttacttggggagctgtgcgacacctccctcacagctcttgtcagggggcctgcctgccctgtctgccttgcttaagttctgccccgctgtccagacaggggctgagcgctgcttccccgccaaggtctttgctcgggccatgcttctttccttggcggactggcctcgcttccagtgggcagctgagccccgaagccttgttatgtaccatcttgcataccagaagtggggtactgccggagtcctcacaccgtggacttcccttggtgcccgccctctag

SEQ ID NO: 27039 - DNA, 909 bp, Artificial Sequence
  Description of Artificial Sequence: Synthetic coding sequence
atggagcacggcatcgtgaaggactggaacgacatggagcggatctggcagtacgtgtattctaaagaccaactgcagaccttctctgaggaacatccggttctgcttacggaggcccccctgaacccgcggaagaacagggagcgagcggcggaagtattttttgaaaccttcaacgtccccgccttgtttattagcatgcaggctgttctgtccctgtacgctaccggaaggactacaggcgtggtcctcgactctggcgatggcgttacccatgctgtacccatttatgagggattcgccatgcctcattccatcatgaggatcgacatcgctgggagggatgtgtctcgcttcctgcgcctgtatctcagaaaagagggctatgacttccactcctccagtgagtttgaaattgtgaaggcgatcaaagagcgcgcttgctatttatcaattaaccctcagaaagacgaaactctggaaacagagaaagctcagtattatctccctgacgggagtacaatcgagatcggccctagtcgtttcagagctcctgagctgttgttcagacctgatcttataggggaagagagtgagggaattcatgaggtgctggtcttcgcaatacagaaaagcgacatggacctgcgtaggaccttattttccaacatcgtgctttctggtggctcaacattattcaaaggcttcggcgacaggctgctttcagaggtgaagaaactggcaccgaaagacgttaagatcagaatcagcgccccccaggaacgcctttatagcacatggattgggggttctatcctagcctccctcgatacctttaagaagatgtgggtgtccaaaaaagaatatgaagaggacggggccaggtccattcataggaagaccttctag

SEQ ID NO: 27040 - DNA, 780 bp, Artificial Sequence
  Description of Artificial Sequence: Synthetic coding sequence
atgctgcggtgcggccagatgatgctggcccaggccctgatctgccgccatttaggccgcgattggtcatgggagaaacagaaggaacaacccaaagaatatcaaaggatcttgcagtgctttctggatagaaaggactgctgttattccatccaccaaatggcccagatgggcgtaggagaagggaaatctattggcgaatggttcggacccaatacggtggcccaggtactgaaaaaacttgcactgtttgacgagtggaattctctggccgtgtatgtttctatggataatacagtggttattgaggatattaaaaaaatgtgcagagtgctgccactaagcgcagatacagccggcgaccgtccgcccgactcactgacggcatccaaccagagtgacgaattgatattcctggatccacacaccactcagacatttgttgacacagaggagaacggaacggtgaacgaccagactttccactgcttacagtcccctcaaagaatgaacatattgaacttggacccttcggtcgcgctgggatttttctgcaaagaggagaaggattttgacaattggtgctcccttgtgcagaaagagatcctgaaggaaaatctccgaatgtttgaattggtgcagaagcatcccagccactggcctccatttgtccctccagccaaaccagaagtcacaacaaccggggctgaatttatagacagcaccgagcagctggaagagtttgatttggaagaagacttcgagatactgtctgtgtag

SEQ ID NO: 27041 - DNA, 957 bp, Artificial Sequence
  Description of Artificial Sequence: Synthetic coding sequence
atgcgggcccagagcgacgagctggagaagatcgagaagcacggccggtcatctaaggacaaagaaaacgctaaaagcctggataaacctgagcaattcctgtatgaactctccctgatcccaaacttcagtgagcgggtgttctgtatcttgtttcaaagcacatttagcgagagcatttgctcgatccgccgtaaattggagctcctgcagaagctctgtgaaacattaaaaaatggacccggcgtgatgcaggttctgggcctcgtactggcctttggcaattatatgaacggcggcaacaaaaccagagggcaagccgacgggttcggcctcgacatcctgcctaaactgaaagatgtgaaatcatccgacaactctcggtcgttactgtcatacatcgtatcttattacctccggaatttcgatgaggacgcaggcaaagaacagtgcctgttcccgctgccagagccacaagacctgtttcaagcaagccagatgaagttcgaagactttcagaaagatttgcgcaagctgaaaaaggatctaaaggcgtgcgaagtggaggccggaaaggtgtaccaggtgagctccaaggagcatatgcagccattcaaggaaaacatggagcaatttataatccaagcaaagatcgatcaggaagcagaagaaaatagtttgactgagactcataaatgttttttggagactaccgcgtatttctttatgaaaccaaagctaggtgaaaaggaggtctcaccgaacgcttttttttcaatatggcatgaattttcgagcgatttcaaagatttctggaaaaaagaaaacaagctccttttgcaggaaagggtgaaggaagctgaggaggtgtgccggcagaaaaagggaaagagcctgtacaagataaaaccccgtcatgatagcggcatcaaagctaagatttctatgaagacctag

SEQ ID NO: 27042 - DNA, 345 bp, Artificial Sequence
  Description of Artificial Sequence: Synthetic coding sequence
atgagcagcagcatgtggtacatcatgcagagcatccagagcaagtatagtctgtcagagcgcctgatccgcaccatcgccgccattcgatcatttccacatgacaacgtcgaagacctcatccggggcggggccgatgttaactgcacccatggaacattaaagccgcttcattgcgcatgcatggtgtcggatgccgactgtgtagagctgctgctggaaaagggtgccgaggttaatgctcttgatggttacaaccgcacagcactgcattacgccgctgagaaggacgaggcctgcgtcgaagtcctgctcgagtacggtgctaaccctaacgctctttag

SEQ ID NO: 27043 - DNA, 1365 bp, Artificial Sequence
  Description of Artificial Sequence: Synthetic coding sequence
atgagcaccttccggcaggaggacgtggaggaccactacgagatgggagaagagttgggatctggacagtttgcaattgtacggaaatgtcgacagaagggcacaggaaaggagtacgcggcaaaattcatcaagaaacgtaggctgtccagctcacgacgaggagtgtcccgggaagagattgagcgagaggtgaatatcttgcgggagatcaggcatcctaacattattacactccacgacatatttgaaaataagactgacgtcgtactgattctggagttggtgtccggtggggagttattcgatttcctggccgaaaaggaatctctgactgaggacgaagcaacccaatttctgaagcagattctcgatggcgtccattatctccacagtaagcgtatcgcccacttcgacctgaagcctgagaacatcatgctgcttgacaagaatgtgcctaaccctcggattaaactcatcgatttcgggatcgcccacaagattgaagctggcaacgagttcaagaacatcttcgggacaccggagttcgttgcacccgaaatagtaaattatgagcctttggggctagaggccgatatgtggagcataggcgtgatcacttatatccttttgagtggcgcttccccatttctgggggaaacgaagcaagaaaccctgaccaatatttccgctgtgaattatgactttgacgaagaatacttttctaatacctctgaactggccaaagacttcattaggcgactcctagtaaaggaccctaaaaggaggatgacgatagcccaaagcctcgagcactcctggatcaaagccatccggcgtcgcaatgtcagaggggaggatagcggtcgaaaaccagagcgccgccgcctgaaaactaccaggcttaaggagtacaccataaagtctcactccagtctcccacccaacaattcctatgctgatttcgagcggttctcaaaagtactggaggaggccgcagcagctgaggagggcttgcgggaattgcagcggtcaagacgcctctgccatgaagatgtagaagccttagccgcaatctacgaagagaaagaagcctggtatagggaggaatccgactctctgggtcaggacctgaggaggctgagacaggagttactgaagactgaagcccttaagcggcaggcccaagaggaagcgaagggcgccctcctagggacctctgggctgaaaagaagatttagtcgtcttgaaaaccgctacgaagccctcgccaagcaggtggcttcagaaatgcgttttgttcaggatcttgtgagagcgttagaacaggagaaactgcagggggtcgaatgtggactacgctag

SEQ ID NO: 27044 - DNA, 1047 bp, Artificial Sequence
  Description of Artificial Sequence: Synthetic coding sequence
atgggcaaggactactacaagatcctgggcatccccagcggcgccaacgaggacgagattaagaaggcctaccgcaaaatggcactgaaataccaccccgataaaaataaggagccaaatgctgaagaaaaatttaaagaaatagcagaagcctatgatgtgttgagtgacccgaagaagaggggtctgtatgaccagtacggcgaggagggtctaaagactggtggaggaactagcggaggaagctctggctcgttccactacacatttcacggcgatcctcacgcaacgtttgcatcatttttcggaggcagtaacccctttgacatcttttttgccagcagccggagtacccggcctttttcagggttcgaccctgatgatatggatgtggatgaggacgaggatcctttcggcgcgttcgggcgatttggctttaacggtctaagccgcgggcccagaagagctcctgagccgctgtaccctagacgtaaggtgcaggacccccctgttgtacacgaactgagagtgtcattggaagaaatatatcatggctctacaaagcgcatgaaaattactaggaggaggctgaatccagacggccgtaccgtgcgaactgaggataagattctgcacattgtaattaagcggggttggaaggaaggtaccaagatcactttcccgaaggagggcgatgccacaccggacaacatccctgccgacatcgtgtttgtgcttaaagataaaccacatgcacattttcggagagatggcactaatgtgctgtacagtgctttgatctccctaaaagaggcattgtgcgggtgtacagtgaacattcccacgatcgatggaagagtgattccgttgccctgcaacgatgtgataaagcccgggactgtaaaacgcctgcggggagaaggtctgcctttccccaaggtgcccacccagcggggcgatctcatcgtggagtttaaagtccgctttccggatagactgactcctcagactcgacagattttgaagcagcacctgccatgcagttag

SEQ ID NO: 27045 - DNA, 2163 bp, Artificial Sequence
  Description of Artificial Sequence: Synthetic coding sequence
atgtacggcagcgcccggagcgtgggcaaggtggagcccagcagccaaagtcctggacgctctccaaggctgcccagaagccctagactgggtcacagacgaacgaattctacaggtggaagctccggctccagcgtgggcggaggtagcggtaaaactttaagtatggagaacattcagtctctcaacgctgcctatgccacgtcaggacccatgtacctttcagatcatgaaaacgtgggcagcgagacccccaagtctaccatgacccttggccggagcggaggcaggctcccctacggtgtccggatgaccgctatgggttccagccccaatatcgcgtcttcaggcgtggcctctgatacaatagcattcggcgaacatcacctgccaccagtctccatggcttctacagtgcctcattcactgagacaggcccgggacaacactataatggatttgcaaacacagctgaaggaagtgctgcgggagaatgacctacttcgaaaggacgtggaggtgaaggagtccaagctcagttccagcatgaactctataaagacattctggtcccctgaactcaaaaaagagcgggccctgagaaaggacgaggcaagtaagatcaccatctggaaggagcaatacagagtggtccaggaggaaaatcaggtcgatgcactccggttgaggctagaggagaaggaaacgatgctgaacaagaaaactaagcagattcaagacatggcagaggaaaaaggtacacaagctggtgagatccacgatctcaaagatatgcttgatgtgaaagaacgcaaagttaatgttttgcagaagaaaatagaaaacttgcaggaacagctaagggacaaggaaaagcagatgagctctctaaaggagagagtcaaatcacttcaggccgacaccactaataccgacacagcactgaccacactggaggaagccctggctgagaaggagagaaccattgagaggctgaaggagcagagggaccgcgacgaacgcgaaaagcaagaagaaatcgacaattataagaaggatctgaaggacctgaaagaaaaagtttccctgctccagggcgatttgtcagagaaggaggcttctctcctcgacctaaaggagcacgcctcgtctctcgccagctccggccttaagaaagattctcgtctcaagactctcgagattgctctcgagcagaagaaggaagaatgtctgaaaatggagagccagctgaagaaggctcacgaagccgccctagaagcacgggcctctccggagatgagtgatcgcattcagcatctagagcgagaaattacccgctacaaagatgaaagctccaaggcccaagcggaggttgatagactccttgagatcctaaaggaggttgagaatgaaaagaacgacaaggacaaaaagattgcagaactagagtccttgacgtcccggcaggtgaaagaccagaataagaaagtcgccaacctcaaacacaaagaacaggtggaaaaaaaaaaaagtgctcagatgctggaagaggccagaaggagagaggataacctcaacgattccagccaacagttacaggattccctcaggaagaaggatgatcgcattgaagaattggaggaggcgcttcgcgagagtgttcaaataacagccgaaagagagatggtcctcgcccaggaggagtccgcccgcacaaatgccgagaaacaggtcgaggagctgttgatggcaatggagaaagtgaagcaagagcttgagtctatgaaggccaagctgtcctctacacaacagtccctggccgaaaaagagacacacctgaccaacctgcgggccgaacgcaggaagcacttagaggaagtgcttgagatgaaacaggaggcattgctggctgccatctcggagaaggacgctaacatcgccctcctcgaactgtcaagttctaagaaaaagactcaggaagaggtagcagccctgaagagagaaaaagaccgactggtacaacaactgaagcaacaaactcagaatagaatgaagctaatggcagacaactacgaggatgaccactttaaaagctcacattcaaatcagactaatcataagccctcacccgatcaggacgaggaggagggcatctgggcttag

SEQ ID NO: 27046 - DNA, 768 bp, Artificial Sequence
  Description of Artificial Sequence: Synthetic coding sequence
atggccgccagcaccatgagcgtgtgcagcagcgcctgcagcgacagttggcaggttgacgcatgtcccgaatcttgttgtgagccccattgctgtgcactgtcatgctgcgcgccagccccatgcctcactttggtctgtacgcccgtgtcacgcgtgagctccccttgttgtcaggccgcctgcgaaccctccccatgtcagtctggatgcacttcttcgtgcacgccttcctgctgtcagcagtcttcctgccagcccgcctgctgtacttcttcaccatgtcaacaagcttgctgcgtgcctgtttgctgtaagccagtctgctgccttccgacttgtagtaaggattcctcatcctgctgtcagcagtcttcctgccagccaacgtgttgcgcttcttcatctagccagcagtcatgctgtgttcccgtgtgctgtaaaccagtgtgttatgttcccacttgttccgaggactcatcctcctgttgccaacagagtagctgccaccctgcctgttgcacgagtagcccttgccaacaagcatgctgcgtccccgtgagatgcaagccagtgtgttgcaagcctatctgttgcgtgcctgtatgtagtggagcctccacttcatgctgccagcagagctcttgtcagcctgcatgctgcactacttcatgttgccgaccctcctcaagcgtgtccctgctttgccgtcccgtttgcagacccgcatgctgcagcttgtgttctgggcaggaaagttcatgctag

SEQ ID NO: 27047 - DNA, 2562 bp, Artificial Sequence
  Description of Artificial Sequence: Synthetic coding sequence
atgagcgagaaggtggactggctgcagagccagaacggcgtgtgcaaagtggatgtgtattctccgggcgacaatcaggcccaggattggaagatggataccagtacggatcctgtgcgggtcttatcgtggttacgcagagatctggagaagtctactgccgaattccaagatgtgcggttcaagccaggagaaagctttggaggagaaactagcaactcgggagatcctcataagggattctcagttgactattataacacgaccactaagggcacaccagagaggctgcactttgagatgacacataaagagatcccttgtcagggccccagagcacagctcggaaacgggagctccgtcgacgaggtatcattttatgccaaccgactaaccaacctggtaatcgcaatggccagaaaggaaattaacgaaaaaattgacggctctgagaataagtgtgtgtaccagtcactgtacatgggcaacgagcctacaccgacgaagtcattatcgaaaattgcctcagagttagtaaacgagaccgtgagtgcgtgtagccggaatgcggcccccgacaaggcccccgggagtggggatcgggtttccgggtcttcacagagcccgcccaacttgaaatataagtctacactgaagattaaggagtccactaaagagaggcaaggcccggatgacaagcctccctccaagaagagcttcttttataaggaggtctttgagtcaagaaatggagactatgcaagagagggaggacggttcttcccacgcgagcgaaagcgctttaggggacaggaaagacccgatgactttactgcctcggtgtcggagggtatcatgacttatgccaactctgttgtgagcgatatgatggtgtctatcatgaagaccctcaagatccaggttaaagatacgacaatagcaacgatcctgctgaagaaagtgctgctgaaacacgccaaggaagtggtgtcagacctcatagatagcttcctgcggaacttgcacagcgtcactggtacattaatgactgatacacaatttgtctctgcagttaaaaggactgttttctcacatggttcccaaaaagccaccgacattatggatgccatgctccgaaaactgtataacgttatgtttgccaagaaggtcccagagcacgtgagaaaggcccaggataaagccgaaagctactccctgataagcatgaagggtatgggcgacccgaagaatcggaatgtgaattttgccatgaaatctgaaacaaagctgagagaaaagatgtatagcgagcctaagtctgaagaggaaacctgtgcaaagactcttggagagcatattatcaaggaaggacttacattgtggcacaagactcaacagaaggaatgcaagtccttggggttccagcatgcggcattcgaggctccaaatacccaaaggaaacctgcaagcgatatctcctttgagtaccccgaagatattggcaacttgtctctgccgccgtacccaccggaaaaacccgaaaacttcatgtacgactccgatagctgggcggaggatctcattgtcagtgccctcttgctgattcagtatcatctggctcaggggggacgaagagacgcacggagctttgttgaggccgccggaaccaccaattttcctgctaatgagccacccgtcgctcccgacgagagttgcttgaagagtgcccccatagtaggcgaccaggaacaggccgagaagaaagatctgcgctccgtgtttttcaatttcatccgcaatctcctgtctgaaactattttcaagcgggaccagtctcctgaacctaaggtacctgagcaacctgttaaagaggacaggaagctgtgcgagcgccccctggcttcttcgccaccacgcctatacgaagatgacgaaaccccaggggccctgagcggtctgacaaagatggcggtctctcagatagacggccacatgagtggccagatggtggagcatcttatgaattccgtgatgaaactctgcgtgattatagccaagtcctgtgatgcatcactcgctgaattaggcgatgataagtctggagatgccagtcggctcacatctgcttttcccgacagcctctacgagtgtcttcccgccaaaggcactgggtctgctgaagccgtcctgcagaacgcctatcaggccatccataatgagatgcgcggcacttccggtcagccaccagaaggctgcgcagccccaacagttattgtttcaaatcataacttgaccgatactgttcagaacaaacagctccaagctgttctgcaatgggtggccgcctcagagctcaatgtgcccattctgtattttgccggcgatgatgagggcatccaagagaaactgctgcaattatcagcggcagccgtggacaaggggtgttctgtaggtgaggtgctacagagcgtgctccgctatgagaaagagcgtcaattaaacgaggcagtggggaacgtcactcccttgcagctacttgactggctgatggtcaatctttag

SEQ ID NO: 27048 - DNA, 1263 bp, Artificial Sequence
  Description of Artificial Sequence: Synthetic coding sequence
atggtgcacggccggaaggccaacgcccaggtgatggagagcgaggaattcatgttattgcccgctaaccagctaattgatatcataagctctgacgagctcaatgtgcgctccgaggaacaggtgttcaacgccgttatggcgtgggtcaaatacagcattcaggagcgtaggccccaattgccccaggtgctgcaacacgtccgcctccccctcctgtctcccaaatttttagtcggcacggtgggatccgatcccctgattaagtcagacgaagaatgtcgcgacttggtggacgaggccaagaactacctcttactgcctcaggaaaggcccctgatgcaggggcctcggactcgacccagaaagccgatccggtgcggggaagtcctcttcgcagtgggcggctggtgcagcggggatgctatcagcagcgttgaacgatatgatccacagactaatgaatggcgtatggtcgcttcaatgagcaaacgcaggtgtggagtcggggtgtccgtcctggacgatctgctgtatgcagttggcggccacgatggatcctcctatctgaattccgtcgaacgctacgatcccaaaactaaccagtggtcctctgatgtggctcccacttcaacatgcagaacatccgtaggggtcgcagtcctcggggggttcctgtacgcagtgggggggcaggacggcgtgtcttgccttaatattgtggaacgttacgacccaaaagagaacaagtggaccagagttgccagtatgagcacacggcgcctcggggttgctgtcgccgtgttaggggggttcctgtatgctgtgggggggagtgacggaacaagccccctgaacacggtggaacgctataacccgcaggagaaccggtggcacaccatagcgccgatggggacaaggcggaagcatctaggctgtgccgtatatcaggatatgatatacgccgtgggaggtcgagacgacactacagagcttagtagcgctgaacgatataatccccgcacgaaccagtggtcccccgtggtggccatgacaagccggcgcagcggtgtcgggctcgcagtggtaaatggccaactgatggctgtggggggttttgatggaacaacgtatcttaagacaatagaagttttcgacccagacgccaacacgtggcgcctatacggcggaatgaactatagacggctcggggggggcgtcggggtgattaagatgactcactgcgaaagccacatttggtag

SEQ ID NO: 27049 - DNA, 519 bp, Artificial Sequence
  Description of Artificial Sequence: Synthetic coding sequence
atgagctgcaccatcgagaaggccctggccgacgccaaggccctggtggaacgacttcgagaccatgacgatgcagctgaatccctcatcgagcagacaacggcactgaataagagagtggaggctatgaaacaataccaagaggagatccaggagttgaatgaggtcgcccgacaccggcccaggagcactctggtcatgggaatccagcaagagaatagacagatccgcgaactgcaacaggagaacaaggaactccgcaccagtctcgaggagcatcaatcagcactagagctcataatgagcaaatatcgggagcagatgtttcggctgttaatggcatctaagaaagatgatcctggaatcattatgaaactgaaagagcagcactccaaaatcgatatggttcaccgtaataagagtgaggggttctttctagacgcgtctcgtcatattcttgaagcacctcagcatggcttagaacggcggcacctcgaggctaatcaaaatgtacattag

SEQ ID NO: 27050 - DNA, 813 bp, Artificial Sequence
  Description of Artificial Sequence: Synthetic coding sequence
atgctgttcatcttccccctgagcctgccctggcggcccagctgctggaaggaaagctgttcaacggggcaacgccaggccggccgatcaagggaggattcagtgaccccacctcctagcagtccttggccaacgccccccgccggcgccatgtccacgaagcaggaggcccgcagagatgaaggcgaagcacggaccagggggcaggaggctcagttgagagacagagcccatctctccctgcacaaggacagtgccgacttgctcccactcgactctttgaaaaggctaggtacttctaaggatctccagccccggtcagtgatccagaggagacttgtagagggtaatcccaattggctgcagggggagcctccgcggatgcaggacctcattcatgggcaagaatcccgccggaagacaagtcgaacagagatcccagctctgttagttaattgcaagtgccaagatcagttgttacgggtggccgtcgataccggaactcagtacaataggatatctgcgggatgtctgtcccgacttgggctcgagaagcgggtgctgaaggcaagcgccggggacctggccccagggcctccaactcaggtggaacagctggagctacagctgggtcaggagacagttgtgtgtagcgctcaggttgttgacgctgaaagtcctgagttttgtttaggactgcagaccctcctctccctgaagtgttgcattgatctagagcacggagtcttaaggctcaaggctccgttttctgaacttcccttcctccctctataccaggagccaggccagtag

SEQ ID NO: 27051 - DNA, 243 bp, Artificial Sequence
  Description of Artificial Sequence: Synthetic coding sequence
accagctgctgccggcccagcagcagcgtgagcctgctgtgccaccccgtttgctcttgcagccctgcttgccagccaacatgttgtatccactccccctgccaagccagctgttacgtgcccgtgtcgtgccagccaatcatttatgtgacacctagctgtcagagttctggctgctgccagcccccctgtaccaccgccctgtgccgccctatatcctgttctacaccttcctgctgctag

SEQ ID NO: 27052 - DNA, 2013 bp, Artificial Sequence
  Description of Artificial Sequence: Synthetic coding sequence
atggccctgggcgaggagaaggccgaggccgaggccagcgaggacaccaaggcccaatcttacggacgcggtagttgtagagagcgggagctcgacattcctggcccgatgtccggggaacaaccgcctaggttggaggccgaaggcggcttgatttctcccgtttggggagccgagggaatacccgcccccacctgctggattgggactgaccctgggggcccaagccgggctcatcaacctcaggcgagtgatgcaaaccgcgagccagttgctgaacgtagcgagcccgctttaagtggactaccccctgccaccatggggtctggggacctcctgctgagcggggagagtcaggtcgagaagactaaattatcgagcagtgaggagtttccacagaccctaagcctcccacgaactaccacaatctgttcgggacacgacgcggatacagaagacgaccctagccttgctgatcttccccaggccctcgatctcagccagcagccccactcctcggggctatcgtgcctctctcagtggaaatctgtcttatcacctggtagcgcagcccagccatccagctgttctatctctgcgagcagtaccggttcttctctccaagggcatcaggagagagccgaaccccgtggaggttcactcgcaaaagtgagctcctctttggagcccgtggtgccccaagagccatcctctgtagtagggctgggccctcgtccccagtggagtccgcaacctgtgttctccggaggggacgcaagcgggctgggacgtcggcgccttagttttcaggccgagtactgggcctgtgtgctgccagactcgctccctccttcaccagaccggcacagtcctctgtggaatcccaacaaggagtatgaggacctcctggactacacctacccattgagacctggacctcaactaccaaaacatctggattcgagagtacccgccgatcccgtgctgcaggactccggggttgaccttgacagcttctctgtctctccagcatccaccctcaaatccccaactaacgtgtcacccaactgcccccctgctgaagccacggcattgcccttcagcgggcccagagagccaagtctaaaacagtggccgtcacgggtaccccaaaagcagggaggaatgggactagcctcctggagtcaattggcctctacccccagggcacccgggagcagagacgcccgctgggagcggagagaaccagcacttcgtggagccaaagaccggctcaccattggtaagcatctagacatgggttcaccccaactccggaccagagacagaggctggccttctccccggcctgagagagagaaacgaaccagccagagcgcgagacgacctacatgcacggaaagcagatggaagagcgaagaagaggtggagtccgacgatgaatatctggctctgcctgctcgactcacacaggtgagctccctggtgagctatctggggtccatttcaacactggtaaccctccccacaggcgacatcaagggccagtctccactggaggtctccgatagcgacggccccgctagtttcccgtctagttcctctcagagccagctccctccgggcgccgccctgcagggctccggagacccggagggccagaacccctgtttcctccgttcctttgttagagctcacgacagcgccggtgaggggagcctgggctcgtcccaggccctcggcgtcagctccgggctgctcaaaacccgcccatctctgccagcgcggctggaccggtggcctttctctgatccagacgtggagggtcaactgccgagaaagggaggggagcagggcaaggagtcgcttgtgcagtgcgtgaagactttttgttgtcaattggaggagctcatctgttggctttataatgtggccgacgttactgaccacgggactgccgctcgctccaacctgacttctctcaagagtagtctgcagctctaccgattttag

SEQ ID NO: 27053 - DNA, 702 bp, Artificial Sequence
  Description of Artificial Sequence: Synthetic coding sequence
atgaagcagctgatcgaggacaccgagaagaacaaggtgtacgtggctatggtgacagactatggggcctttattaaaatccctgggtgcagaaaacagggcctggtgcataggacccacatgagctcctgtcgggtagataaacccagtgaaatcgtggatgtcggagataaagtttgggtgaagctgatcgggcgggagatgaaaaacgacagaatcaaggtctctttgagcatgaaggtcgtgaaccaggggactggaaaggacctggatccgaataacgttataatcgagcaggaagagaggcgccgccggtcttttcaagattacacaggccaaaaaattacactggaggcagtcctgaatactacatgcaagaaatgcgggtgcaaagggcatttcgctaaggactgcttcatgcagccaggtggtactaaatatagcctgatccccgacgaggaagaggaaaaggaggaagcgaaaagcgccgaatttgaaaagcctgatcctacaagaaatccatcacggaagcgcaaaaaggagaagaaaaaaaagaaacatcgcgatcggaagagtagcgactctgactcctccgacagcgagagcgatacaggcaagagggctagacatactagcaaggattcgaaagccgccaagaagaaaaaaaaaaaaaaaaagcacaagaagaaacataaggaatag

SEQ ID NO: 27054 - DNA, 492 bp, Artificial Sequence
  Description of Artificial Sequence: Synthetic coding sequence
atgggctggcggctgctgacccaggacgagggccccgccctggtgcccggggggcggctgggcgatctgtgggactaccatcagcataggtacttacagggcgtccccgagggggtcagagaccttccacccggcgtggccctgcccttggagtccaatttggccttcatgaatggcgtgtcctttacgaaaggctgttacatcgggcaagagttgactgcgagaactcatcacatgggggtcatacggaagcgcctattccccgttcgatttcttgaccccctgcccacgagcggcattacacccggtgcaaccgtcctgaccgcaagtggccagaccgtgggaaaattccgcgctggccagggaaatgtcggactcgctctgctgtggtctgagaaaatcaaaggtccactgcacattagagccagcgaaggggcccaggttgcactggcggcctccgttcctgactggtggcccaccgtgtccaagtag

SEQ ID NO: 27055 - DNA, 804 bp, Artificial Sequence
  Description of Artificial Sequence: Synthetic coding sequence
atggccatggagatgcggctgcccgtggcccggaagcccctgagcgagcggctgggacgcgacacaaagaagcacctggttgtgcccggggacaccataacaactgatacaggttttatgcggggacacggtacctacatgggggaggaaaaacttatcgcttcagttgcgggctctgtggaaagggttaacaagcttatttgtgtgaaggctctcaaaacgaggtatattggcgaggtgggcgacatcgtggtcgggaggatcacagaggttcagcaaaagagatggaaagttgagaccaattccaggctggactctgtgttacttctcagttccatgaatctgcctggaggggaactacgcagaaggtccgcagaagacgaacttgctatgcgggggttcttgcaagagggcgaccttattagcggcgtgctcgtccaggtttcaccttctctcgtcaagcggcagaagactcacttccatgacctgccttgcggcgcttccgtcattctcggaaacaatggctttatctggatatatcctacacctgaacataaggaggaggaggcgggcgggtttattgcaaatctcgagccagtatcccttgctgaccgtgaggtgataagccgcctgaggaattgcataattagcctcgtgacccagcggatgatgctttatgacaccagcatcctttactgctacgaagcaagcttaccacaccagatcaaagatattctgaagccggaaattatggaagagattgtgatggaaactcgtcaacgcctgctggagcaggaggggtag

SEQ ID NO: 27056 - DNA, 3111 bp, Artificial Sequence
  Description of Artificial Sequence: Synthetic coding sequence
atgcccgtgttcaaggaggtgaaggtgcacctgctggaggacgccgggattgagaaagacgctgtcacccaggagacacgaatcagccctagcgggatcgattccgccactacagtggcagcagccactgccgcagccattgccactgctgcaccattgattaaggtgcaaagtgacctcgaggctaaggtaaattcggttacagagctgctctccaagcttcaggaaactgacaagcacctgcagagggttactgagcagcagaccagcatccagagaaaacaggagaagctccactgtcatgatcacgaaaaacaaatgaatgtgtttatggaacaacacatcagacatctcgagaaactgcagcagcagcagatagatattcagacgcactttatttcagcagctctgaaaactagttcgttccagccggtatccatgcccagtagcagagcagtggaaaagtattccgtgaagccggagcaccccaacttgggcagttgcaatccatctctctacaatacgtttgcaagtaaacaggcccccctcaaggaggtcgaagacacctcatttgacaaacagaaatctcccctggagacacctgcacctcggcggttcgcacccgtgccagtctcacgcgatgatgagctgtcaaaaagagagaatctgcttgaagaaaaggagaacatggaggtctcatgccatcgcggaaacgtgcgattactagagcagatcctaaataataatgactcattaacacgaaaatccgaatcttctaatactaccagcttgacacgaagcaaaatcggctggacacctgaaaagacaaataggtttccgtcatgcgaagaactagagactaccaaagtaacaatgcagaagagcgatgatgttctgcatgatctggggcagaaggagaaagaaaccaactcaatggtgcagcccaaagaatcactatcgatgcttaaactacctgatctgccgcagaacagtgtaaagctgcagacaacaaacaccacacgcagcgtcttgaaggatgcagagaagattctgcgcggcgtgcagaacaataaaaaggtgttggaggaaaaccttgaagcgattatcagggctaaagacggggccgccatgtacagtttaatcaacgctctgagtaccaatagggagatgtccgagaaaatacgaatacggaagaccgtagacgaatggattaaaactatcagcgcagagattcaggacgagctgtccaggacagactacgagcaaaagagatttgatcagaagaaccagaggaccaaaaagggtcagaatatgaccaaagacatcagaacaaacacgcaggacaagaccgtaaataaaagcgtgatcccacgcaaacactcgcagaaacagatcgaggagcatttccgaaatctgccaatgaggggcatgcctgcaagcagcctgcagaaggagcggaaagagggcctgctgaaagctacaaccgtcattcaagacgaagactacatgttacaagtctatggtaaaccagtctatcagggccatcggtccacacttaaaaaaggcccatacctcagattcaactctccttcccctaagagtagaccccagcgcccgaaagtaattgagagagtcaaaggtacaaaggtgaagagcatcaggacacagacagatttctatgccactaaacccaagaaaatggattctaaaatgaaacacagcgtaccagtcctgccccatggcgatcagcagtacctgttttcaccctccagagagatgcccacctttagcgggacacttgagggtcacttgatcccgatggccatcctgctcggccagacacagtctaatagcgacactatgccccccgcaggcgtgatcgtgtcaaagcctcatcccgttactgttaccacaagcattccaccttcgagtcgcaaagttgaaaccggcgtaaaaaaaccaaatatcgcaatcgtggaaatgaagtccgagaagaaagacccaccgcaactgacagtgcaagtactgccgtctgtggatattgattcaattagcaactcatccgccgacgtgctgagtccactctcatcccccaaagaagcaagcttgcctccagtccagacctggattaagacgcctgaaataatgaaagtggatgaggaagaggttaaatttcctggaacgaactttgatgaaatcattgatgtaatccaggaagaggagaaatgcgacgagatcccagatagtgagcctattctcgagttcaaccgttccgttaaggctgatagcaccaagtacaatggtcctccgttcccaccggtcgcttctaccttccagcccactgctgacatactagataaggtgattgaacgcaaggaaaccctggaaaatagcctaatccagtgggttgaacaagagatcatgagccgaattatcagtggcctgtttcccgttcagcagcagatagctccctcaattagtgtgtctgtgagtgaaacctcagaacctctgacttctgatattgtggaaggcacttcatcgggtgctcttcagctgtttgtggacgcaggggtgcctgtaaactcaaacgtcataaaacatttcgtgaacgaagccctggcggagacaatcgcggtgatgctcggagatcgcgaggctaagaaacaaggcccagtggctacaggggtctctggggatgcctcgacgaacgaaacctatctgccagccagagtatgcactccccttcccacacctcaacccacccctccttgcagcccatccagtcccgccaaagaatgtgttttggtcaagacccccgatagtagtccatgtgattcagaccatgacatggcttttcctgtaaaggagatctgtgcagaaaaaggggacgatatgcctgctattatgcttgttaacacccctacagtgacacccactaccactcctcccccagccgcagccgtgttcacccccaccctttctgatatttcaatcgataagttgaaggtcagctccccggagctgccgaaaccatggggcgacggtgacctgccattagaggaagagaatcctaattctccacaggaagagttacaccctagggcgatgtag

SEQ ID NO: 27057 - DNA, 3351 bp, Artificial Sequence
  Description of Artificial Sequence: Synthetic coding sequence
atgtacggcagcgcccggagcgtgggcaaggtggagcccagcagccagtcccctggaaggtccccacgacttcctcgaagtccccgactgggccatcgccgaaccaattcaacgggcgggtcatcaggatcctcagtcgggggaggaagtggcaagacactgagcatggagaatattcaatccttgaacgccgcatatgcaacaagtggcccaatgtatctcagcgatcacgaaaacgtgggatcggaaacccctaagagcactatgaccttgggccgctccggcgggagattaccatacggggttcgcatgaccgccatgggcagcagcccgaatatagccagcagtggggtggcttcagatacaattgcattcggcgaacatcatctgccacccgtgtcaatggcatctacggtgcctcacagcctcagacaggcccgagataacacaatcatggatctgcagacacagctgaaagaagtgctacgcgagaatgatctgcttaggaaggacgtggaagtcaaagagagcaagctctcaagtagtatgaactctatcaagactttctggagtcccgaattaaagaaggaacgcgccctgcggaaagacgaagcctccaagatcaccatctggaaggagcaatatcgtgttgtacaggaagaaaatcagcacatgcagatgactatccaggcactccaggatgagttgcgtatccaaagagatctcaatcagttatttcagcaggactcctcctcccgcaccggagaaccttgtgtagcagagctaacagaggagaatttccagagactgcatgcagagcacgaacgccaggctaaggaactgttcctactgaggaagacattggaagaaatggaactgcgaattgagacacagaaacagactcttaacgcccgcgacgaaagtataaaaaaactgttggagatgctgcagtctaagggcctctcagctaaggctaccgaggaggaccatgagagaacccgccggttagccgaagcggaaatgcacgtgcaccatctggaatcccttttggagcagaaggagaaggaaaattcaatgctgagggaggagatgcaccgcaggttcgaaaatgcccctgacagtgccaaaacaaaggccctgcagaccgttatcgagatgaaggatagcaagatcagcagcatggaacggggtcttcgagacctggaggaggaaattcagatgctgaaatccaatggggctttgtcaacggaagagcgggaagaggaaatgaagcagatggaggtgtatcgttcccacagcaagttcatgaagaataaagtcgaacagctgaaggaagagctatcgtccaaggaggcccagtgggaagaactgaagaaaaaggccgccggcctgcaggccgagatcggccaggtgaagcaggagctcagccgcaaagatacggaactgttggctctccaaaccaaactcgagactctcactaaccagttctccgactcgaagcagcacatcgaggtacttaaggagtcactcacggcaaaggaacaaagggccgccattctccagaccgaagtggatgccctccggctgcgtctggaagaaaaagagaccatgttgaacaaaaaaaccaagcagattcaggacatggccgaagagaaaggtactcaagctggcgaaatccacgatctcaaagatatgctggacgttaaggaaaggaaagtgaatgtgctccagaaaaagattgagaacctgcaggaacagctgagggacaaggaaaaacagatgtcctcactgaaggagcgggtgaaaagcttacaggctgacacaaccaataccgacacagccctgacaacgctcgaggaggcgctggctgagaaagaacggaccatcgaacgtctgaaggaacaaagggatcgagatgagagagaaaaacaggaggagatcgacaactacaagaaagacctgaaagatcttaaagagaaagtctcccttttgcagggagacttgtccgaaaaagaagcttccctgctggatttaaaggagcacgcgtcctcccttgcaagctctggtttgaagaaagacagccgactcaagacactggagatcgctctcgagcaaaaaaaggaggagtgtttgaagatggaaagtcagctcaaaaaagcccatgaggccgctctggaagcaagggcttctccggaaatgtctgatagaattcagcatctggagagagagattactcggtacaaagacgaatcctcaaaggcccaagccgaagtcgaccgactactggaaatcctcaaggaagtcgagaatgagaagaacgataaagataaaaaaattgccgagctggagaggcaagtgaaggatcaaaataagaaagtggccaatctaaaacacaaggaacaagtggaaaaaaagaaatccgcacagatgctcgaggaagcccggcgcagagaagacaacctgaacgactcctcccagcaattgcaggatagccttaggaagaaagatgataggatagaagaactcgaagaggcattgagagaatctgtgcagatcaccgctgaacgggaaatggtgcttgcacaggaggagagcgccaggaccaatgccgaaaagcaggtagaggagctgctgatggccatggaaaaggttaaacaggagctggagtcaatgaaggctaaactgtccagtacccagcagtctctcgcagaaaaggagacacacttaaccaacctgagagccgagcgccggaagcatcttgaagaagtattggaaatgaaacaggaggccctcctggccgccatctcagaaaaagacgcaaatatcgctctgctcgagctcagttctagcaagaaaaaaactcaggaggaggttgccgctctgaagagagagaaagatcgtctcgtgcagcagctgaagcagcaaacccaaaaccgcatgaagttgatggccgataactacgaagacgaccacttcaagtcttcgcacagtaaccaaacgaaccacaaacctagcccggaccaaataatccaaccactactagagttagatcagaataggagcaagctcaagctgtacatcggacatttaacaacattgtgtcacgacagggaccctctaatcctgcgtgggctcacacccccagcatcatacaacttggacgacgatcaggccgcttgggaaaatgaactgcagaaaatgacgcggggccagctgcaggacgaactcgaaaaaggcgagagagacaacgccgagttacaggaatttgccaatgccattctgcagcagatcgcagatcactgcccggacatattagagcaggttgtgaatgccctggaggaaagttcttag

SEQ ID NO: 27058 - DNA, 816 bp, Artificial Sequence
  Description of Artificial Sequence: Synthetic coding sequence
atgcggcagctgcaccccgaggccatcgccgccatccagagcaaggccctgttctctaaagccgaggaacagctactctccaaggtgggctcaaccagtcagccaacgctggaaacatttcaggatttattgcaccgccatcccgatgctttctatctggcgcgcacagcaaaagcgcttcaggcccattggcaactgatgaagcagtactacttgttggaggatcagacagttcagcccctgcctaaaggcgatcaggtactgaactttagtgatgccgaagaccttattgatgactcgaagttgaaggatatgcgtgacgaggtcctggaacatgaattgatggtagccgaccgccggcagaaacgggaaataaggcagttggaacaagagctgcacaagtggcaggtgctggtagactcaatcaccgggatgtcctctcctgattttgacaaccagacacttgctgtcctgagagggaggatggtgcgctatctgatgcggagccgggaaatcaccctaggaagggctaccaaggacaaccagatcgatgtagacctctctcttgaaggtcctgcctggaagatctcccgaaagcagggcgtgataaagctcaaaaacaatggggacttttttattgcaaatgaagggcgtcggcccatctacatcgacggtagacctgtgctgtgtgggtcgaagtggcggctgtcaaacaatagcgtagtcgagattgcctcattgcgctttgttttcttgatcaatcaagacttgatcgctctgatccgggccgaagcagctaaaatcaccccacaatag

SEQ ID NO: 27059 - DNA, 2751 bp, Artificial Sequence
  Description of Artificial Sequence: Synthetic coding sequence
atggagatgcccctgccccccgacgaccaggagctgcggaacgtgatcgataagctggcacagtttgtcgctcgaaatggaccggagtttgagaaaatgaccatggaaaagcagaaggacaacccgaagttttcatttttgttcgggggggagttttactcttattacaagtgtaaactagcactggaacagcagcaactgatctgcaagcagcagacgccggagctggagccagcagccaccatgccaccactcccgcagccaccactcgcccccgccgcccccatccctcccgcacagggtgcaccctctatggatgaattaatccaacagagccaatggaacctccaacagcaagaacagcacctgctggcacttaggcaggaacaggttacggcagccgtagcccatgccgtggaacagcagatgcaaaagcttttagaagaaacacagctagacatgaacgagtttgataacttgttacagcctatcatcgacacgtgcactaaggatgcgatctctgccggcaagaattggatgtttagcaatgccaagagccctccccattgcgagcttatggcaggacaccttcggaaccgcattaccgcagacggggcccattttgaacttcgtctgcacctgatctacctgattaatgacgtcctgcatcattgccaaagaaagcaagcaagagagctgctcgccgcccttcagaaggttgtggtgcctatatattgcacctctttcttggccgtggaagaggacaagcaacagaaaatcgcccgattgctacagctgtgggaaaagaacgggtatttcgacgatagcatcatccagcagctgcagtcacccgccctggggctgggacaataccaggcgaccctgatcaatgaatacagctccgtcgtgcagcccgtccagctggccttccagcagcagattcaaaccctgaaaacgcaacatgaggaatttgtgacctctctggctcagcagcagcagcaacaacaacagcagcagcaacagctacaaatgccccaaatggaggccgaagtcaaggcaacacctccacctcctgctccccctcctgcgccagcaccagcgccggccattcctcccacgacccagccagatgacagcaaaccgcctatacagatgcctggttctagcgagtatgaggcccctggaggcgtgcaggaccctgccgccgcgggacccagaggtcctggcccccacgatcagatcccgcccaacaagcccccctggtttgatcagccacaccccgtggctccctggggccaacagcagcctccagagcagcctccatacccacaccatcagggaggtcccccgcactgccccccatggaacaactctcacgaaggtatgtggggggagcaacgcggcgatccaggctggaatggccaacgagacgccccctggaataaccagccagacgcggcatggaactcccagtttgaaggcccatggaattcccaacatgagcagccaccctgggggggaggccaaagagaaccacccttccggatgcagaggccaccacactttaggggccctttccctccacatcagcagcacccacagttcaatcagcctccccatccacataattttaatcggttccctccacggtttatgcaggatgattttcctccgagacacccctttgaaaggcccccatacccacatagatttgattatcctcaaggtgactttccagccgaaatgggtccaccccaccaccaccctggccatcggatgccacaccctggaatcaacgaacacccaccttgggccgggccccagcatccggacttcggacctccgccacatgggtttaacggacagcctcctcacatgagacgtcaaggtccgccacatatcaaccatgacgatccctctctcgtgccaaacgtgccttattttgatttgcccgccggactgatggcgcctctcgttaagcttgaagaccacgaatacaagcccttggacccgaaggacatacggctgcccccccccatgccaccctctgagcgtctcctggcagcagttgaagccttttactcaccaccttcccacgatcgacctcggaactcagagggctgggagcagaacgggctctacgagttctttcgcgccaagatgagagctcggaggaggaaggggcaggagaagaggaattctggcccgtcacgatctcgctcaagaagcaaatctcgaggacgaagttcatctaggtccaattcgcgttcaagcaagtctagtggcagctacagtcgtagtaggagtcgcagctgctcacgatcttactcacgcagccggagccgcagtcgcagcaggtcgcggtccagtcgatcacgctcaaggtctcagtcccgtagccgctctaaatcctactctcccggacggcgccgcaggtcaaggagtaggtccccaacgcctccctcctcagcagggctgggatccaattctgccccaccaatacccgactccagactgggagaggaaaacaagggacaccagatgctcgtgaaaatgggctggtctggaagtgggggcctcggtgccaaggagcaggggatccaggacccgattaagggaggggatgtgcgcgataagtgggaccagtataaaggagttggagtagccctggacgatccctacgaaaactatcggcgcaacaaaagctattccttcatcgcccgcatgaaagcccgagacgagtgtaagtag

SEQ ID NO: 27060 - DNA, 963 bp, Artificial Sequence
  Description of Artificial Sequence: Synthetic coding sequence
atgagcaagagcgagagccccaaggagcccgagcagctgcggaagcttttcatcggggggctgtcttttgaaacaacggatgagtccctgcgctctcatttcgaacaatggggtaccctgaccgattgcgtagttatgcgcgaccctaataccaagcgctcaagaggcttcggattcgttacttacgcaactgtcgaggaggtcgacgccgcaatgaacgcccgaccacataaagtggacggccgagtggtcgaaccaaagcgggcagttagtcgagaggactcacaacgccccggcgcccatctgacagtgaagaagatctttgtggggggtattaaagaagataccgaagaacaccatcttagggattatttcgaacagtacggcaaaatagaagtgatagagattatgactgatagagggagtgggaagaagagaggcttcgcctttgttacttttgacgaccatgattccgtggacaaaattgtgattcaaaaataccacactgtcaacgggcacaattgcgaggttagaaaggccttgagcaagcaagaaatggccagcgcatcatctagccagcgcggccggtcagggtccgggaactttggcgggggacgaggaggggggttcggcggcaacgacaacttcgggaggggagggaactttagtgggcggggtggatttggaggctccaggggggggggaggctacggagggtcgggcgatgggtataacgggttcggaaatgacggctctaatttcggcgggggaggcagctataacgactttggaaattacaacaatcaaagttccaactttgggcctatgaagggtggaaatttcggtggacgctcatcaggaccatacgggggcgggggccagtactttgcaaagcccaggaatcaaggcggctatggtggctccagctcctcaagcagctatgggtccggcagacggttttag

SEQ ID NO: 27061 - DNA, 735 bp, Artificial Sequence
  Description of Artificial Sequence: Synthetic coding sequence
atggagctgaccatcttcatcctgcggctggccatctacatcctgaccttccccttatacctgctgaacttcttaggactctggtcctggatttgtaagaagtggtttccttatttcctcgtgcggttcacggttatttataatgaacagatggcaagtaagaaacgggaactcttcagtaacctccaggaatttgccgggccttccggaaaattgtccttgttggaagtgggttgcggaaccggcgcaaactttaaattctacccccccggctgcagggtgacctgtatcgatcctaatcccaacttcgaaaagttccttatcaagagtattgccgagaaccgccacctgcagttcgaacgtttcgtagtggccgcaggcgaaaacatgcaccaggtcgccgacggttctgtggacgtagtggtttgtacattggtactctgtagtgtgaaaaaccaggaacgtatcctgagggaggtttgccgcgtgcttaggcctggcggcgccttttatttcatggagcacgtcgctgctgaatgcagtacctggaattacttctggcaacaggtcctggatcctgcttggcacctgttatttgacggatgcaatcttacacgtgagagctggaaggccttagagagggcttcattctctaaactcaagctgcagcacattcaggccccactgagctgggagctggtcaggccccatatttatggatacgcggtaaagtag

SEQ ID NO: 27062 - DNA, 4125 bp, Artificial Sequence
  Description of Artificial Sequence: Synthetic coding sequence
atgaccagcgccgccgagatcaagaagccccccgtggcccccaagcctaagttcgtcgtggccaacaataaaccagctcctccacccattgcacctaagcccgatatcgttattagctccgtccctcagagcacaaagaagatgaagccagccattgcccccaagccaaaggtcctgaagacttcaccagttcgtgaaatcgggcagtctccatccagaaaaatcatgcttaatcttgaaggacataagcaagaactggccgagtctactgacaattttaactgcaaatatgagggaaatcagagcaatgactatatcagcccgatgtgcagctgttcatctgaatgcatccataaacttggccatcgggagaatttatgcgtgaaacagctggtacttgagccattagaaatgaacgaaaacctggagaactcgaaaatagacgaaacgcttaccattaagactaggtctaaatgtgacctgtatggagagaaggccaaaaaccaggggggggtcgttcttaaagctagtgtgctggaggaagagctgaaagacgccctgattcatcagatgccaccatttataagtgctcaaaagcacagacccaccgacagccccgagatgaatggggggtgcaattccaatgggcagttcaggatagagttcgcagatttgagtcccagcccctctagcttcgagaaggttcctgaccatcatagctgtcacttacagctgcctagcgacgagtgcgagcatttcgagacctgtcaggacgatagcgaaaaatctaacaattgttttcagagctctgagctggaagcacttgagaatggtaaacgctcaacccttatcagttccgatggcgtcagcaaaaagtcggaggtgaaagatctgggacctttggaaatccatctcgtgccctacacccctaaattccccacaccgaagcccaggaagaccaggactgcccgactgctccggcagaaatgcgttgacactcctagtgagagcacggaagagcccggaaatagcgacagctccagctcgtgtctgaccgagaacagcttaaagattaacaaaatttctgttctgcaccagaatgtgttatgtaagcaagagcaggtggacaagatgaaacttggtaataaaagcgagttaaacatggagagcaatagcgacgcccaggaccttgtgaactcacaaaaagcaatgtgtaacgaaaccacttcattcgagaagatggcgccatccttcgataaggactcaaacttgtcatcagactccaccaccgtggacggctcatccatgtctctagccgtggatgaagggactggcttcatacgctgcactgtctcaatgagcctcccaaagcaactgaaactaacttgcaacgagcatctccagagcggcaggaatttgggtgtatctgcccctcagatgcagaaagagtcagtaataaaagaggagaacagcctgagaattgtcccaaaaaaaccccagcggcactccctacctgcaacaggggtgttgaagaaagccgcttccgaggagctcctggagaaaagctcttacccatctagtgaagagaagtcgtccgagaagtctctcgagcgcaaccacctgcagcacctctgcgcccagaacaggggggtctcctcttccttcgacatgccaaagagggcatcagaaaaacctgtgtggaagctaccccaccccatcctaccattctccggcaacccagagttcctgaagagtgtgaccgtaagttccaatagtgagccttcgacagccctgactaaacctcgcgccaagagcctgagtgcaatggatgttgaaaagtgtaccaagccctgcaaggatagcactaaaaagaacagttttaagaagctgttatctatgaaactgtcaatctgttttatgaaatctgacttccagaaattttggtccaaatcgtcccagctgggagacacgacgacaggtcacttgtcatctggcgagcagaagggcatcgaatcagattggcaggggctgctggttggcgaggaaaagcgaagcaagcctatcaaggcctacagtactgaaaactacagcctggaaagccagaaaaaaaggaagaaatctcggggtcagacttctgcggctaacggcctgagggccgagtccctggacgaccagatgctcagcagagaatccagttctcaggccccttacaagagtgttacctcactgtgtgcccccgagtatgaaaacattcggcactatgaggagatcccagagtatgagaacttaccttttattatggcaatcaggaagacccaggagctggaatggcaaaattcgtcctctatggaagatgctgacgcaaacgtgtacgaggtggaggagccctatgaggcacccgatggtcaactacagttaggaccaagacaccagcactcgagttcaggagctagccaggaggagcagaatgatttgggcttgggagacttgccatccgatgaggaagaaatcattaacagctctgacgaggatgatgttagttctgagagcagcaaaggtgaacctgatcccctggaagataagcaggacgaggacaatggcatgaaatctaaggtgcaccacattgctaaggagataatgagtagcgagaaagttttcgtcgacgtacttaaactcctccacattgactttcgcgacgccgtggcgcatgccagcagacagctgggaaagcctgtgattgaggaccggatactcaaccagatactgtactacctgcctcaattgtatgaactaaaccgggatctgctgaaagagctagaggaaaggatgctgcattggaccgagcagcagaggatagcagacattttcgtgaagaaggggccctatctcaagatgtattcaacatacattaaggagtttgataagaatatcgctctgcttgatgaacagtgtaagaagaaccccggttttgcagctgtggtgcgcgaattcgaaatgagcccacggtgcgcaaacctggctcttaaacactatttgctaaagcccgtgcaacggatcccccagtatcgattgctgcttactgactacctgaaaaacctgatcgaggacgcaggggactatagagacactcaggacgcactagccgtcgtgatcgaagtggcgaaccacgctaatgatacaatgaaacaaggggacaacttccagaaactgatgcaaatccaatacagcctgaatggacaccacgaaatcgtccaacccggcagggtcttcctaaaagaggggatattgatgaagctaagccgtaaggtcatgcagcctcgcatgttttttctcttcaacgacgccctgctgtacactacccccgtgcaatccggcatgtacaagttgaacaacatgctatcattggctggcatgaaggtcaggaaacccactcaggaggcataccagaacgaactaaagatagaatctgtggagaggagtttcattttatcagcatctagcgcaaccgagcgtgatgagtggcttgaggccatctcgagagctatcgaggagtacgctaagaagagaatcactttttgtccaagtcgcagcctggacgaggctgacagcgaaaacaaagaagaggtgtcacctctgggaagcaaggctcctatctggatcccggacactcgggctactatgtgtatgatctgtacctctgagtttacactaacctggagaaggcatcactgccgcgcctgcggaaaaatcgtatgccaggcttgttcatctaacaaatatgggctcgactacctgaagaatcagccagcacgagtttgtgagcattgctttcaggagctgcaaaagcttgatcatcagcactcccccagaattgggtcacccggcaaccacaagagccctagctccgccctgagtagcgtcctgcattctatcccttctggaaggaagcaaaaaaagattcccgcagctctgaaagaggtgtcagcaaacacagaggactcttctatgagcggttatctgtatcggagtaaaggcaataaaaagccttggaaacacttctggtttgttattaagaacaaagtgttgtacacctacgcagccagtgaggtaagatcagagatatag

SEQ ID NO: 27063 - DNA, 1446 bp, Artificial Sequence
  Description of Artificial Sequence: Synthetic coding sequence
atggccagcgccgccagcgtgaccagcctggccgacgaggtgaactgcccaatctgccagggcactctgcgcgaacctgtgaccatcgattgcgggcataatttctgccgtgcttgtcttacacgctactgcgaaataccagggcccgacctggaagagtcgcccacttgtcccttatgcaaggagccattcagacccggtagctttcggcccaattggcaactagccaacgttgtggagaacattgagcgattgcagctcgtaagcaccctgggactcggggaagaggacgtgtgtcaggagcacggtgaaaagatctactttttctgtgaggacgacgagatgcagctctgtgtggtgtgtagggaggcaggggagcacgccacacacaccatgagatttctagaggacgctgccgccccgtatcgcgaacagatccacaagtgtttaaaatgccttcggaaggaaagagaagaaatccaggaaatacagtccagagagaacaagagaatgcaggtcctgttgacccaggtgagtacaaaacgtcagcaggtcatcagtgaatttgcacacctgaggaaattcctggaggagcagcagagtattctgctagcgcagctggaatctcaggatggggatatcctgcgccaacgagatgaatttgacttgttagtggcaggcgaaatctgccgcttttccgccttgattgaggagcttgaagagaaaaacgaaagacctgctcgcgaattgctgacagacatacgtagcacactcattcgatgcgaaactagaaagtgtcgaaaacccgtggccgtgagtcccgaactggggcaaagaatccgcgactttccccagcaggccttgcctctgcagcgcgagatgaagatgtttctcgagaacctgcccaatcatctcgtgattcccaccgctcacatatctctagacccacagacaagtcacccgaaactgctcctctccgaggaccatcaacgcgcccaattttcctataagtggcaaaactcaccggataatccacagagatttgacagagctacctgcgtcctggcacacactgggataactggcgggaggcacacctgggttgtgagcatcgatctggctcacggcgggtcatgtaccgtaggcgtggtttcagaggatgttcaaaggaagggggaactgcggcttaggccggaggaaggagtttgggccgtgcgattggcatggggcttcgtgtccgcactgggcagcttccctacgaggcttaccctgaaggagcagccaaggcaagtccgcgtgagcctcgattacgaggtgggctgggtgacgttcacaaacgccgtgactcgggagccaatctacacttttaccgcttcgtttacccgtaaagtgattcctttctttggcttgtggggtcgagggtcttcgttttccctgtctagctag

SEQ ID NO: 27064 - DNA, 468 bp, Artificial Sequence
  Description of Artificial Sequence: Synthetic coding sequence
atggacaccatgatgctgaacgtgcggaacctgttcgagcagctggttcgtagagttgaaattctgagcgaagggaatgaagtgcaattcatccagttggccaaggatttcgaagattttagaaaaaaatggcagcggacagaccacgaactggggaagtataaggacttgctgatgaaagcagagaccgagagaagcgcactggacgtaaagttgaagcatgccagaaaccaggttgacgtcgagatcaagcggcgccaacgagcagaagccgattgtgagaagttagagcgacaaattcagctaatcagggagatgctaatgtgcgatacgtcaggaagcattcagctctccgaggagcaaaagtctgccctggcttttctgaatcgcggccaacctagttcgagcaacgctgggaataagcgcctgtccaccattgacgaatctgggtctatccttagcgattag

SEQ ID NO: 27065 - DNA, 420 bp, Artificial Sequence
  Description of Artificial Sequence: Synthetic coding sequence
atggacaccatgatgctgaacgtgcggaacctgttcgagcagctggttagacgagttgagatcctgagtgagggcaatgaagttcagtttatccaactcgcaaaggattttgaggacttccgcaaaaagtggcagcgcaccgaccacgaattgggtaaatataaagacctgctgatgaaagctgaaacggaaaggagcgccctggacgttaagctgaaacatgcacgcaaccaggtggatgtcgaaattaaaagaagacagagggcagaagccgactgtgagaagcttgaaaggcagattcagctcatcagggaaatgttgatgtgtgatacttctgggtcaattcagctatcagaggagcagaagagtgccttggctttcctgaatagaggccaaccaagctcgtccaacgccgggtag

SEQ ID NO: 27066 - DNA, 3282 bp, Artificial Sequence
  Description of Artificial Sequence: Synthetic coding sequence
atgggcggcaaggcctggccccggcgggccgtgggcaccgccggcggcccctgcgcagagcagattagcgctccgtttcagacactgctcatgcctcatctgcccctggcctcattccgaccaccgttctggggtctgcgccacagtcgcggcctgcccagatttcacagcgtgagtacccagtcagagccccatgggtcccccattagccgaagaaaccgagaggccaagcagaagcggttgagagagaagcaagcaacgctcgaggccgaaatcgctggagaatcaaagagcccggcagagtcaatcaaggcctggcggcccaaagaactggtgctttacgagattccaaccaaacccggggagaaaaaggacgtctcaggccccctacctcccgcatattcacctagatatgttgaagccgcgtggtacccttggtgggtgagagaaggttttttcaagcccgagtatcaggccaggctcccccaggctacaggtgaaactttttcgatgtgcatccccccaccaaatgtgacgggatctctccacataggacacgctctgactgtggctattcaggacgcccttgtccggtggcaccggatgaggggggaccaagtcctgtgggtgccggggtcagaccatgccggcatcgccacccaggccgtggtcgaaaagcagctctggaaggagaggggagttagacggcacgagctgagcagagaagccttcctgagagaggtctggcagtggaaggaggctaagggaggagagatttgtgaacagctcagagccctgggggcatctctggattgggacagggaatgcttcaccatggacgtgggtagctcagtcgccgtaactgaagcctttgtccggctatataaagcaggacttctgtaccgcaaccaccaactcgtaaattggtcctgtgctttacgctcagctatctccgatatcgaagtggagaaccgtccgctccctgggcatacccagcttcgcttgcctggatgcccgacacccgtgagctttggactattgttctcagttgccttcccagttgatggcgagccagacgccgaagtcgtagtgggtaccacacgccctgagaccttacctggagacgtcgcagtcgccgtccacccagacgactcccgctatactcacctccacggacgacagctcaggcatccactcatgggccagcccttgcccctcataacagattacgcggtacagccacatgtgggaaccggggcggtgaaggtgactccggcccactctccagcagatgctgaaatgggggctcgtcatggcctctcaccactgaacgtgatcgcagaagatggaaccatgacaagcctgtgcggagactggctgcagggcctacatagattcgtggcccgggagaagataatgtccgtgttatcggagtggggcttgttccgaggcctccagaaccaccctatggtgctgcctatttgttcaaggtccggcgacgtgatcgagtacttgctcaagaaccagtggtttgtaagatgtcaggagatgggtgccagagctgcaaaagccgtcgagtctggagccctcgagttaagcccgtcattccatcaaaagaactggcagcattggttcagtcatattggggattggtgtgtcagccggcagctgtggtggggccatcagattcccgcgtatctagtggtggaagatcacgcacagggggaggaagactgctgggtagttggaagaagcgaagccgaggcccgggaagtggcagctgagctgaccggaaggccgggggcagagttgactctagaaagggatccggacgtcctcgacacctggtttagttcagctctctttccattctctgcactcgggtggccccaggagactccagacctggcgcgcttttaccctctaagccttctcgagacgggctccgatctgctgctgttctgggtcggacgcatggtaatgctgggcacacaacttaccggccagctgccatttagcaaggtcctgttgcaccctatggtgagagatagacagggacggaaaatgtcaaaatcattgggcaacgtgctggaccctcgcgatatcatcagcggggtggaaatgcaagtactgcaggaaaagttgcggagcggcaatcttgacccagccgaactggctatcgtggccgccgcacagaagaaggatttcccccatgggattccggaatgtgggaccgatgccctgagattcactctatgttcacatggggtgcaggccggcgacttacatctttcagtatcagaggttcagagctgccgacatttctgtaacaagatttggaacgctctcaggttcattctgaatgcacttggagaaaaattcgtccctcagccagccgaagaattaagtccttcatctcccatggacgcctggatcctgagtaggctggctctggccgcacaggaatgtgagcgggggttcctgaccagagagctatctttggtgactcacgccctccaccatttctggctgcacaacctttgcgacgtgtacctcgaggccgtcaaaccagtgctttggcactcgccacgccctcttggtccaccccaggtccttttctcctgtgccgacctcgggctgcgattgctcgcaccgctgatgccattcttggccgaagagctatggcagcgcctgccaccgcgtcccggctgcccccctgctccttccatcagcgtggccccctatccctccgcgtgcagcctggagcactggcggcagcccgaactggaaagaaggttctctcgcgttcaggaagtagttcaagtacttagggccctccgagcaacttatcagttgacaaaagcccggccacgcgtcctccttcaaagctctgaacctggtgatcagggcctgttcgaagccttcttggaaccattgggcacactgggttattgtggtgccgtggggctgctgccccccggggccgctgctccctcggggtgggctcaggccccattgtccgataccgcccaggtctatatggagctgcaaggtcttgtggatccacaaatacagctgccacttcttgccgctcgaagatacaaactccagaagcagctggactctctgaccgcccggacccccagtgaaggtgaggctggaacgcagcgccagcagaaactgtctagtctgcagttggagctgtccaaactggataaggccgcttctcacctccggcagcttatggacgagccgccagctcctggatctcccgagctgtag

SEQ ID NO: 27067 - DNA, 231 bp, Artificial Sequence
  Description of Artificial Sequence: Synthetic coding sequence
atgaacagcgtgggcgaggcctgcaccgacatgaagcgggagtacgatcagtgtttcaatcgctggttcgcagagaaattcttaaagggggattcttccggagacccctgcacagacctcttcaaacgctaccaacagtgtgtccagaaggctatcaaggagaaggagattcccatcgaggggctggaattcatgggacatggcaaggagaagccagagaacagtagctag

SEQ ID NO: 27068 - DNA, 735 bp, Artificial Sequence
  Description of Artificial Sequence: Synthetic coding sequence
atggagctgaccatcttcatcctgcggctggccatctacatcctgacgttccctctgtacttgttaaacttcctgggtctctggtcatggatttgcaagaagtggttcccatattttcttgtccgttttactgtcatttataacgagcaaatggctagtaagaagcgggaactgttcagcaatcttcaggaatttgccggacctagcgggaaactgtccctactcgaggtcggttgtgggactggcgcgaattttaaattctacccacccggctgtagggtgacttgcatcgacccgaaccctaatttcgaaaagtttctaatcaagtctattgctgagaatagacaccttcagtttgagagatttgtggtggctgccggcgagaacatgcaccaggtggccgacgggtccgtggatgtggttgtgtgcacgctcgtgttgtgcagcgtgaaaaaccaagaaagaatccttcgggaagtctgccgcgttttaagaccgggtggcgcattttatttcatggagcatgtggccgcagagtgtagcacctggaattatttctggcagcaggtactagatcctgcctggcacctcctgttcgacggatgtaatctgacccgcgagtcctggaaagcgttagagcgggcttctttctccaagctgaaattgcagcatatacaggcccctctttcctgggagctcgtgcgtccgcatatctacgggtacgcagtgaagtag

SEQ ID NO: 27069 - DNA, 774 bp, Artificial Sequence
  Description of Artificial Sequence: Synthetic coding sequence
atgccccacctgcccctggccagcttccggccccccttctggggcctgcggcactcacggggcttaccaaggtttcatagcgtgagtacacagtctgaaccacacggctctcctataagcagacgcaaccgcgaggccaagcaaaagcgtctgagagagaagcaggccacactggaggccgagatcgctggcgagagcaaatcccccgctgaatctataaaggcctggcggccaaaggaactcgtcctgtatgagatcccaacaaagccgggggagaaaaaggacgtgtccggtcctctgcctcccgcttactcccctagatacgtggaggcagcctggtatccttggtgggtacgcgaaggattcttcaagcccgagtaccaggcccggttgccccaggcaaccggagagacattctcgatgtgcattcctccgccaaatgtcactggtagcctccacattgggcacgccctgacagtcgccatccaggatgcattggtgcgctggcatagaatgcgtggcgatcaagtgctttgggtgcctggctctgatcacgccggaatcgcaacccaggccgtagtggaaaaacagctctggaaggaacggggagtccgccgccacgagctgtctcgggaggcattcctgagggaagtttggcaatggaaggaggccaagggcggcgagatttgtgagcagctcagggctttaggagccagtctggattgggaccgagttttctatcacgggtgctggctgctctccggttgcgactag

SEQ ID NO: 27070 - DNA, 804 bp, Artificial Sequence
  Description of Artificial Sequence: Synthetic coding sequence
atgagcaagagcgagagccccaaggagcccgagcagctgcggaagttatttatcggtgggttatcgtttgaaactacagacgaatctttgcgctcccacttcgagcagtgggggacactcacagattgcgtagtcatgagggaccccaacaccaaacgcagcaggggatttggctttgtcacgtatgccactgtcgaagaggtggacgccgctatgaacgcacgcccccataaagtggacgggcgggtggtggagcccaaacgagctgtgtccagagaagattcccagaggccgggggcccatttaactgtgaagaagatctttgtgggtggtatcaaggaagatacggaagaacaccacctgagggattattttgagcagtacggtaaaatagaggtcatcgagattatgaccgatcgaggttctggcaagaaaaggggcttcgccttcgtgacctttgacgatcacgattccgttgacaaaatcgttatccagaagtaccatacagtgaatggccacaactgtgaggtaaggaaagccctctctaagcaagaaatggcatccgcttcaagttcccaacgtggccggagtgggagcggtaacttcggtggtgggtcttataatgactttgggaactacaacaaccagagctctaactttggaccaatgaaaggcgggaatttcggggggcggtccagcgggccgtacggtggtggtggccagtacttcgccaaaccccgcaaccagggcggatacggggggtcatctagctccagctcgtatgggtctggacgcaggttctag

SEQ ID NO: 27071 - DNA, 531 bp, Artificial Sequence
  Description of Artificial Sequence: Synthetic coding sequence
atgaacgagagcaagcccggcgacagccagaacctggcctgcgtgttttgccgaaagcacgatgactgccccaacaagtacggtgagaagaaaactaaggagaagtggaacctcactgtgcattactattgcctgcttatgagtagcggcatctggcagagaggcaaggaggaggagggggtctatggattcctaatagaggacattcggaaggaggtgaatagggcctctaaactgaaatgttgtgtatgtaagaagaatggcgcttcaatcgggtgcgtagcgcctaggtgcaaaaggagttatcacttcccgtgcggcctgcagagggaatgtatcttccagttcactggaaactttgcctccttttgttgggatcacagacccgtgcagattatcacctccaataactacagagaatctcttccatgtacgatctgcctggaatttatagagccgatcccttcctacaacatactgaggtccccctgttgcaaaaatgcctggttccatcgtgactgcctgcaatag

SEQ ID NO: 27072 - DNA, 3171 bp, Artificial Sequence
  Description of Artificial Sequence: Synthetic coding sequence
atgctgagcgtggtggagaacggcctggacccccaggccgccatccccgtcataaaaaagaagttagtgggcagcgttaaggctctccagaagcagtacgttagcctggataccgttgtgacgagcgaggatggcgatgctaataccatgtgttctgccctggaggctgtgtttatccacggcctgcacgccaagcacattagggctgaggcgggaggcaagcgtaaaaagtcagcgcaccagaaaccactaccgcagccggtgttttggccactgctgaaggctgttacgcataagcatattatctccgagctggaacatctgaccttcgtgaacacagacgtgggacggtgccgcgcgtggctgagactggccctgaatgacggcctcatggagtgttacctcaagctcctgttacaagagcaggcgaggctccacgaatactaccagccgaccgctctgctccgtgatgccgaggaaggggaattcctgctgtcatttctgcaaggtcttacctcactctcatttgagctgtcgtacaagtcggcaatactgaacgagtggactctgactccccttgcactctccggcttgtgccctctcagcgaactggacccgttaagcacctccggtgccgaattgcaaagaaaggagagcttggattccatctcccattccagcggctctgaagacatcgaggtccatcactcagggcataaaatacggcgcaaccaaaaactgacagccagttccctgtccttggacactgcatctagttctcagttgtcctgctctctgaactccgatagctgcctgttgcaggaaaatggaagtaagtcccccgaccactgtgaggagccgatgagctgcgatagtgatttaggtacagccaacgccgaggattcagacagatccctgcaggaggtactcttggagttctccaaagcacaggtaaattcagtgccaacaaacggtctgtctcaggaaacagagattcccacaccacaagcctccctgtcattacacggtctgaatactagtacctacttgcattgtgaggcccccgccgagcccctccccgcccaagctgcgtccggaacccaggacggggtgcatgtgcaggaacctagaccccaggctcccagcccactggatctgcagcaaccagtggaaagcacatcgggccaacagcctagctcaaccgtgtctgagaccgcaagagaagtcgggcagggaaatggtctgcagaaagctcaggcccatgacggcgccggtctgaaactggtcgtgagcagtcccaccagcccgaagaataaaagctggataagtgaggacgacttctaccgaccttcccgtgagcagcctttagaaagtgcctccgaccatcccatagcgagttatcggggcacgcccggctccagacctgggctgcacaggcacttttcgcaggaaccccgtaagaactgctctctaggggccctggaccaggcctgcgtgccttccccggggcgtaggcaagcacaagccgcacctagtcagggacacaaatcattccgggttgttcataggcgccagatgggcctgtctaatccgttcagaggtctgatgaaattgggaacggtggaaagacgcggagctatgggtatctggaaggagctattttgcgaactctcccccctggaatttagactctacctctctaatgaggagcatacgtgtgtggaaaattgtagcctgctgagatgtgaaagtgttggccctgcccactctgatggccgtttcgaacttgtgttctcgggcaagaaactagcactcagagctagctcacaggacgaggcagaggactggcttgacagagtcagggaagccctgcaaaaggtacgcccacagcaagaggacgagtgggtgaacgtccagtatcctgatcagcccgaggagccacccgaagctccacagggttgcctttcaccatcggatctgttatctgagccagccgcccttcagggcacacagttcgattggtccagcgcccaggtgcctgaacccgatgccattaaggagagcttactctacctgtatatggataggacttggatgccgtacatctttagcttgagcctcgaagccctcaagtgctttagaatccgtaataacgagaagatgctgagcgacagccacggggtcgaaaccattagagatatactcccagatacctccctgggcggaccgagtttttttaagatcataactgccaaagcagtccttaagctccaagccgggaacgccgaggaagctgcgctgtggcgtgacttggttcggaaggttttggcaagttatctcgagaccgctgaggaagcagtcaccctcggtggatcactggatgagaattgccaggaggtccttaaatttgccactagagaaaatggattcctgctacagtacctggtggctattcccatggaaaaggggctcgattcccaagggtgcttttgtgcaggctgcagtcggcagataggcttcagcttcgtgcggcccaagctctgcgcattctccggtctctattattgcgacatctgtcaccaagacgatgccagcgtgatccctgctcgtatcattcacaattgggacctgacaaagaggccaatttgcagacaggcattaaaatttctcacccagattcgcgctcagccgctcattaatctgcaaatggtcaacgccagcctatacgaacacgtggagaggatgcatttgatcgggcggaggagagagcaactcaagctcttgggggactatctgggcctgtgcagatctggtgctctgaaagagctttctaagaggttgaatcaccgtaactatctattggaaagcccgcataggttttctgtggccgatctgcagcagatcgcagatggggtgtacgaggggtttctaaaggccctgatcgagttcgcctctcagcacgtttatcattgtgatctttgcacccaacgcgggtttatctgccagatctgtcagcaccacgatattatctttcccttcgaatttgatactaccgtccggtgcgcagaatgtaaaacagtattccaccaatcttgtcaggctgtcgttaagaagggctgcccccgatgtgctcgtcgaaggaaataccaggagcaaaatattttcgcatag

SEQ ID NO: 27073 - DNA, 390 bp, Artificial Sequence
  Description of Artificial Sequence: Synthetic coding sequence
atggccgagctgatccagaagaagctgcagggcgaggtggagaagtatcagcaactccagaaggacctgtctaagtcaatgagtggccgtcagaaacttgaagctcagctgactgagaacaacatcgttaaagaagaactggctcttctggatggctccaacgtggtctttaagttgttggggccagtccttgtcaagcaggagttgggcgaagcacgggctacagtcggcaagaggctcgactacatcacagccgagataaaacggtatgaatcacagctgagagatcttgaacggcaatctgagcagcagcgtgaaacacttgctcagttacagcaagagtttcagagagcccaggcagccaaagccggggcacctgggaaggcgtag

SEQ ID NO: 27074 - DNA, 348 bp, Artificial Sequence
  Description of Artificial Sequence: Synthetic coding sequence
atgaccaagaagcggcggaacaacggccgggccaagaagggccgggggcacgtgcagccaattaggtgcacaaactgtgcaaggtgcgtgcctaaagataaagccatcaagaagttcgtgatccgcaacattgtggaggccgccgccgttagggatatatccgaggttagcgtgttcgatgcgtacgtcctgccgaagctttacgtgaagctccactactgtgtgtcctgtgcaattcactccaaagtcgtgaggaacagaagtcgcgaagccaggaaagaccgcactcctccacctcgcttccgaccggcaggagctgccccgggacctccaccaaaacctatgtag

SEQ ID NO: 27075 - DNA, 1899 bp, Artificial Sequence
  Description of Artificial Sequence: Synthetic coding sequence
atggacaccatgatgctgaacgtgcggaacctgttcgagcagctggttagaagagtggagattctttcagaagggaatgaggtccagtttatccagttggccaaagattttgaggactttcgtaaaaaatggcaacgtacagatcacgagctgggcaagtataaggacttgctaatgaaggccgagacagagaggtcagcactcgacgtaaagctcaaacacgctaggaatcaagtcgatgtcgagatcaaaagaagacagcgtgccgaggccgattgcgaaaagctggagcgtcaaatccagctcatccgggagatgttgatgtgcgacacaagcggatccatacaactgagtgaagaacagaagtcggcgctggcattccttaacagagggcagccaagttcctccaatgctggtaataaaaggctctccacaatcgacgagagtggtagcatcctgtcagatatcagctttgacaaaaccgatgaaagcctggattgggactcttctctagtgaagaccttcaaactaaagaaaagagaaaaaaggagatctaccagcaggcagtttgtggacggacctcccggacctgttaagaaaaccaggagcattggaagcgcagtggaccaggggaatgaatctatcgtagctaagacaacggtaacagttccgaatgatggtggccccattgaggctgtgtccaccatagagactgtgccttactggacaagatcccgcagaaagaccgggactttacagccttggaacagcgattccactcttaattctaggcagctggagcctaggactgaaacagatagtgtgggcactccccagtccaatggaggcatgcgcttacatgacttcgtgagtaagaccgttatcaagccagagtcgtgcgtgccatgcggaaagcggatcaagtttggcaaacttagcctgaagtgtcgcgactgcagggtggtgtctcaccctgaatgccgcgacaggtgccccctgccctgtatccctacactaattggtactcctgttaaaattggcgagggcatgctggccgatttcgtgagccagacctccccgatgatcccttccatcgtggttcattgcgtgaacgagattgagcagaggggcctcaccgagaccggcctttacagaatctcgggatgtgaccgtaccgttaaggagcttaaagaaaaatttttgcgcgtcaagaccgtgcccctgctgtcgaaagtcgacgacatacatgcaatttgttccctgctgaaggacttcctgcgaaacctgaaagaacctctgcttacctttcgactgaatcgggcttttatggaggctgccgaaatcactgacgaggacaattcgattgccgcaatgtaccaggcggtcggcgaactccctcaggccaatcgggatactctcgccttcctgatgatccacttacaacgtgttgcccagtccccccacacgaagatggacgtcgccaatcttgctaaggtgtttggtccaactattgtggcccatgcagtgcccaacccagaccctgtgactatgctgcaggacatcaagaggcaaccaaaggttgtcgagcgccttctctctttgcctctggaatattggtcacagttcatgatggtcgagcaggagaacatagaccccttacatgtgattgaaaattcaaatgccttctccacaccacagacgccagatatcaaggtgagcttgctgggtcctgtgacaacgcccgagcaccaactgctgaaaacaccctccagctctagcctctctcagcgagtccggagcaccctgactaaaaataccccacggttcggtagcaagagtaaaagcgccacaaatctggggcgccaaggtaattttttcgccagccccatgctgaaatag

SEQ ID NO: 27076 - DNA, 390 bp, Artificial Sequence
  Description of Artificial Sequence: Synthetic coding sequence
atggccgagctgatccagaagaagctgcagggcgaggtggagaagtaccagcagctccagaaagatctttccaagtccatgagcggcaggcaaaagctcgaggcccagctgaccgagaataatatcgtgaaggaggagcttgcactgctggacggttctaatgtggtctttaagcttctgggtcctgtgctggtcaaacaggaattaggggaggccagagcaacagtggggaagcgcctagattacattactgccgagattaagagatatgaatcccagctccgggatcttgaacggcagtccgagcagcagagagagaccctggcgcagttacagcaggaattccaacgggcacaggccgctaaagcaggtgctccaggcaaggcatag

SEQ ID NO: 27077 - DNA, 5220 bp, Artificial Sequence
  Description of Artificial Sequence: Synthetic coding sequence
atgatggagggcaacggcaccgagaacagctgcagccggacccgggggtggctccagcaggataacgacgccaagccttggttatggaagttctcaaattgttttagccggcctgaacagactcttccccattcaccacagaccaaagaatacatggagaataaaaaggtagctgtggagctgaaagatgtgccttcccccctgcacgcggggtctaaactattccccgcggtgcctttacctgacatccggtcactgcagcagcccaaaatacagctgtcatcggtacccaaggtgtcttgctgtgctcattgcccaaacgaaccatcgacatcgcccatgcgatttggcggagggggaggcggatccggcggtacctcgtctctgatccaccccggggcattactcgacagccagtcaacaagaactatcacctgtcaggtgggctccggttttgccttccagtctgctagtagtctacaaaacgccagtgcacggaataatttggcgggcattgctagtgactttccttctatgtgtctggaatctaatctaagctcttgcaaacacttgccctgttgcggcaagctccacttccaaagttgccacgggaatgtccataaacttcatcaattcccgtcactgcaaggatgcacctccgcaggttacttcccatgcagtgacttcaccagcggcgcccctgggcacttagaggaacacatttcccagtctgagctaaccccacatctgtgcacaaatagtttacatctcaatgtggttcccccagtgtgtctcaaaggctccttatattgcgaggactgcctcaataagcctgctcgaaatagcatcatcgacgccgcaaaggtgtggcccaacatccctccccctaacacacagcctgcaccactggcagttcccctctgcaacgggtgtggtactaaaggtacaggcaaagaaacgacactcctgttggccacttctctagggaaagccgcttctaaatttgaagtggccgtggctggacaggtgctggagaacctgcctccaatcggcgtcttctgggacatagaaaactgctctgtcccatccgggcgttctgctacggctgtcgttcaaagaatccgggaaaaattcttcaagggccaccgcgaggcagagtttatctgcgtatgtgatatttccaaagagaacaaggaggtaatccaggagttaaataattgtcaggttacagtcgcccacataaatgccaccgctaagaatgcagcggatgacaagctgaggcaatcccttaggcgctttgcaaatacacacactgcaccagcaaccgtggtccttgtttccaccgatgtcaattttgccctggaactctccgacctccgccatcggcatggatttcatattatcctggttcataagaaccaagctagcgaggccctcctccatcacgctaacgagcttatccgatttgaggagttcattagcgacctgcccccacggctgccgctgaagatgccacaatgtcataccctgctgtatgtttacaatctgccagcgaataaagacggcaaatccgtgagtaaccgtctcaggcgtttaagtgacaactgcggaggaaaggtcctgagcatcacaggctgctctgcaatcctgcgcttcatcaatcaggactccgctgaaagggcgcagaaaaggatggaaaatgaggacgtttttggtaaccggatcatcgtctcttttacgcccaagaacagggagctatgcgaaaccaagagtagcaacgcaatcgcggataaggtgaagtcacccaagaaacttaagaatcccaagctgtgcctgattaaagacgcctctgaacagtcttcaagcgctaaagctacgccaggcaagggatcccaggccaattccggttccgcaacgaaaaacacaaatgtgaaaagtttacaggaattgtgtagaatggagtcgaagaccggacatagaaacagcgaacaccaacaggggcacctgagactcgttgtgcccactcatggcaattctagtgctgctgtgtccactccaaagaattctggagtagctgaaccagtgtacaagacaagtcaaaaaaaagagaatctgtccgcacgaagtgtgacatcatccccggtagagaagaaggataaggaggaaactgtcttccaggtctcataccctagtgcttttagcaagctcgtcgccagcagacaagtgagtcccctgcttgcatcccagtcttggtctagcagatccatgtccccgaacctactgaaccgcgcctcccccctcgccttcaacatcgctaatagctcttctgaggcagactgccccgaccctttcgcgaacggcgccgacgtgcaggtaagcaacatcgattataggctctcgcggaaagaactgcagcagctcctccaggaagcctttgcccgccacggaaaggtgaagagtgtcgagctatctccgcacaccgactatcaactgaaggccgtcgtgcagatggaaaatcttcaggacgccatcggagctgtaaatagtctgcacaggtataaaattgggtccaaaaaaatcctcgtttccctggcgaccggagcggcgagcaaaagcctgagcttactgtccgccgagacgatgagcgtgctgcaggacgcgccggcctgttgcctcccgctttttaaatttactgatatctacgagaagaaattcggccacaagctcaacgtgagcgacctgtataagctaaccgacacggtagcaattcgtgagcagggcaatggccgactggtatgcttgttaccatcttcccaagctaggcaaagccctctgggttcatcccaatcccatgacgggtctagcactaactgttcacctataatcttcgaagaactcgaataccacgagccagtgtgccgccaacattgctctaacaaagacttcagtgagcacgagttcgatcctgattcttataagattcctttcgtgatactgtccctcaaaactttcgcaccacaggtgcacagcctgcttcagacccacgaaggcactgttcctttgctaagttttcccgattgctatatcgccgagttcggggatctggaggtcgtccaggagaaccagggcggagtgcctctcgaacatttcattacgtgtgtgccaggcgtgaatatcgccactgcccagaacggtatcaaggtcgttaagtggatccacaacaagcccccgccacctaataccgatccttggttgttaaggagcaagtctccagttggtaatccacagctaatccaattctcccgggaggtcattgacctgctgaaatcccagccatcctgcgtcatcccaatttctcacttcattccgtcataccaccatcactttgcaaaacagtgccgggtgtcggactatgggtacagcaaactgatcgagcttctagaggctgttccccatgtcctccagattctaggcatgggctccaagagacttctgactctaacacatcgggctcaagtaaaacgattcacccaggaccttctgaagttgttaaagagtcaggcctccaagcaggtgatagtgagagagttcagccaggcctaccattggtgcttctccaaggattgggacgtgactgaatatggagtatgtgagctgattgacatcgtctctgagatcccagacacaaccatctgcttgtcacagcaggataatgaaatggttatctgcattcccaagcgagagcggacacaggacgaaatcgaaagaacgaaacaattttccaaggatgtggttgatctgctgagacaccagccgcactttcgcatgccgttcaacaagtttatcccgtcttaccatcaccactttgggcgccagtgtaaactagcctattacggcttcaccaagctcttggagctgttcgaagcaattcccgacaccctgcaagttcttgagtgtggcgaagaaaagatcttgacgctgactgaggtggaacgtttcaaagctctagcagcccagtttgttaagctgttacgcagtcaaaaggacaactgcctaatgatgactgacctcctgaccgaatatgctaagaccttcggatataccttccgtctgcaagattacgacgtttcgtcgatctccgctctcacacaaaagctgtgtcatgtcgtcaaggtggccgacatcgagagcgggcggcaaatccagttgattaaccgtaaatctctccgctccctgaccgcccagctgttggtgcttctgatgagctgggagggtactactcacctgtctgtggaggagttaaaaaggcattatgagtcaacccacaatacgcctctgaatccttgtgagtacggatttatgacattgaccgaactgctcaaatccctcccatatctggtggaagtgtttaccaacgataagatggaggaatgcgtcaaacttacgtccttgtatctgttcgctaaaaacgtgagatccctccttcatacttatcattaccagcagattttcctgcatgaattctccatggcctacaccaaatacgtgggagagacactccagcctaagacctacggccatagctcagtggaggagctgttgggcgctattcctcaagtggtgtggatcaaagggcacggccataaaaggatcgttgtacttaagaatgatatgaagtcacgactttcttctctcagcttgagcccagcaaaccatgaaaatcagcccagtgaaggcgagaggatactggaggtgcccgagtcccacacagcatccgagttgaaattgggggcggacggaagcgggccctcccataccgaacaggagctgctgcgccttaccgatgattcacccgtcgatctactttgcgcacctgtcccttcctgtttgccgtcaccacaactgaggcctgacccagttatacttcagtcagcagaccttatccagttcgaagagcggcctcaggagccaagtgaaatcatgattctgaaccaagaagagaaaatggagattcctattcctggaaagagtaagacattgacctcagacagctcttcctcctgcatctccgccgccgtccccgtacccccatgcccatcttcggagaccagtgagtctttgctgtcgaaagatcctgtggagagcccggctaaaaagcaaccaaaaaaccgtgtgaaattggccgccaactttagcctagctcctatcacgaaactttag

SEQ ID NO: 27078 - DNA, 390 bp, Artificial Sequence
  Description of Artificial Sequence: Synthetic coding sequence
atggccgagctgatccagaagaagctgcagggcgaggtggagaagtatcagcagctgcagaaagacctttctaagtccatgtctggaagacagaagttggaggctcaactcaccgaaaataacatcgtgaaggaggagctagccctcctggatggatccaacgttgtgtttaaacttctgggtcccgtgctggtgaagcaagagctgggtgaagccagagccacggttgggaagaggctggattacatcactgcagagatcaagagatacgaatcacagctccgggatctagaaagacagagcgaacagcagagagaaacactagcacagttgcaacaagaattccaaagggcccaggcagctaaagcgggggctccaggtaaggcgtag

SEQ ID NO: 27079 - DNA, 432 bp, Artificial Sequence
  Description of Artificial Sequence: Synthetic coding sequence
atgaccctgcggtgcctggagcccagcggcaacggcggcgagggcactcgttctcagtggggcacagcagggagcgccgaggagccatccccccaggcagccagactcgctaaagcgcttagagagctcgggcagaccggctggtattggggctcaatgactgtgaatgaggctaaggagaagttgaaggaggccccggagggtaccttcctgatccgggattcgtcccatagtgactaccttctcacaatctccgttaagaccagcgcagggcccactaatttgagaattgaataccaggatggcaaatttcgtctggactctatcatctgtgtgaaatccaagttaaaacagtttgatagcgtggtacacctcattgactactatgtgcagatgtgcaaagacaaaagaaccgggcccgaagccccctag

SEQ ID NO: 27080 - DNA, 156 bp, Artificial Sequence
  Description of Artificial Sequence: Synthetic coding sequence
atgagcagcagcatgtggtacatcatgcagagcatccagagcaagtactcacttagcgagagactgattaggacgattgccgccataaggtctttccctcatgacaacgtggaggatctcattcgcggaggggccgacgtgaactgtacacactag

SEQ ID NO: 27081 - DNA, 1902 bp, Artificial Sequence
  Description of Artificial Sequence: Synthetic coding sequence
atggaggagagccccctgagccgggcccccagccggggcggcgtgaactttctcaatgtcgcacgcacctatatccctaatactaaggttgaatgtcactacacactcccacctggaactatgcccagtgcctccgactggattgggattttcaaagtggaggcagcgtgtgtacgggattatcacacatttgtttggagctcggtgccggaatccacgaccgatgggtctccaatccatactagcgttcaattccaggcttcctacctgccgaaaccaggagctcagttgtatcagtttagatatgttaaccgacagggccaggtgtgtgggcagtccccacccttccagttccgggagcctcggcctatggacgagttagtaaccctcgaggaggcagatgggggctcagatatcctgctggtggtgccaaaagccacggttctccagaatcagctggacgagtctcaacaagagagaaatgacctcatgcaattgaaactgcagcttgagggtcaggtaacagaactgagaagtagggtgcaggagctggaacgggccctcgccactgccagacaggagcacaccgagttgatggagcagtacaaaggaatcagccgaagtcatggcgaaataacagaagaacgggatatcctttccagacaacagggagaccacgtcgccagaatcttggaattagaggacgacatccagacaatcagcgagaaggttttgactaaggaggtcgagctggataggcttagagacaccgtgaaagcactcacacgtgaacaggagaagctgctcggccagttaaaagaagtccaggccgataaggagcagtctgaagccgaactccaagtagctcaacaggaaaatcatcatctgaacctggacctgaaggaggccaaatcttggcaggaagagcagtccgcccaagcccagcgcctcaaagacaaagttgcccagatgaaagatacactggggcaagctcagcagcgggtggctgagctggaaccgttgaaagaacagctccgtggggcccaggaactagcagcaagctctcagcagaaagccacactgctcggtgaagagctggcctctgctgccgctgccagggataggaccattgcggaactgcacaggagccgtttggaagtggctgaagtcaatggtcgtcttgcagagctgggtctgcacttgaaagaggagaagtgtcagtggtccaaggagcgcgccggactgctgcaaagcgtggaagcagaaaaggataaaattctgaagttgtccgcagagatactgcgcttggaaaaggccgttcaggaggagcgcacccaaaatcaggtctttaaaaccgagctggctagagaaaaggattcatccctggtccaattgtccgagagcaagcgtgaactcactgagctgcgctctgcgcttagggttctgcaaaaggaaaaagagcagttacaggaagagaagcaggagttgctggaatacatgcggaaactggaggccagattggaaaaggtagctgacgaaaaatggaatgaggacgcaactacagaggatgaggaggccgcagttggcttgtcttgcccggcggccctaactgatagcgaagacgagtcaccagaagatatgagattgcccccgtatggactgtgcgaaagaggagatccaggctctagcccagcagggccccgcgaggcaagcccgctcgtcgtgattagccaacctgcaccaatatccccgcacttgtcaggccccgctgaggactccagctccgacagcgaagccgaagacgaaaagtccgtgttgatggccgcagtccaatctggaggtgaagaggctaatttgctcttgcccgaactcggatctgccttttacgacatggccagatag

SEQ ID NO: 27082 - DNA, 810 bp, Artificial Sequence
  Description of Artificial Sequence: Synthetic coding sequence
atgaagacccccgtggagctggccgtgagcggcatgcagaccctggggctccagcatcggtgtcggggcgggtacagggtgaaggcccgtacttcctacgtggacgagaccctgtttgggtcacctgccgggacgcggccaactccgccggacttcgacccaccatgggtggaaaaagcaaaccggaccagaggtgttggcaaagaggcaagcaaagccctgggagcaaaaggtagctgcgagaccacaccctcccgcggcagcacacccaccttaacccctaggaagaaaaacaagtacagaccgatcagtcacacgccatcctactgtgacgagagtctgtttggcagccgaagcgagggagcaagtttcggtgccccaagaatggccaagggggatgccgcaaaactgcgtgcgttactgtggacaccaccccccaccccgcgtggcagtcactcccctagaccgagagaagcccccctcagagccatacacccagctggcccttcaaagaccgagcctgggccagctgcagactcacaaaaactgagtatgggaggcctgcactcaagccgccctctgaagagaggcttgagccatagcctcacccatctgaatgtaccctcaaccggccatccggcgactagcgctccccatacaaacgggccacaagacctgagaccttcgaccagcggggtgacctttcgctctcctctggtgacaagccgagccaggtctgtctccatcagcgtgccctccacacccagaagaggcggcgctacgcagaaacctaaaccaccatggaaatag

SEQ ID NO: 27083 - DNA, 618 bp, Artificial Sequence
  Description of Artificial Sequence: Synthetic coding sequence
atggacaaggacagccagggcctgctggacagcagcctgatggccagcggtactgcatcaaggtctgaagatgaagagtccctggccggacagaagagagcctcctcccaggcgttaggaaccattcctaaaagacgaagtagtagcagattcataaaacgaaagaagttcgacgacgaacttgtcgagtcttccttagccaaatcctctacacgggcaaagggcgccagcggcgtcgaaccaggccgatgcagcgggtccgaacctagttcatcggagaagaagaaagttagtaaggccccaagtacgccagtcccaccaagcccagctccagccccagggctgacaaaaagggttaagaagagcaagcaaccattacaggttacaaaggacctgggccgatggaagccagccgacgacctgctcctgatcaacgcggtacttcagaccaacgaccttacttctgtgcatctgggcgtgaagttttcttgcaggttcaccctaagagaagtgcaagaaagatggtatgcactgctctatgatcccgtaatctccaagttggcatgccaggccatgaggcaacttcatcctgaggcaatcgctgcgattcagagttag

SEQ ID NO: 27084 - DNA, 540 bp, Artificial Sequence
  Description of Artificial Sequence: Synthetic coding sequence
atggactggaccccccggctgcccagccggcacatcatcagcgagctggagcacctcacattcgtcaatactgatgtgggacgctgtagagcctggctgagactggccctcaacgatggcctcatggagtgctacctcaagctcctgctgcaagaacaggctcggctgcagctgcaacgaaaagaatccctagattctatctcacattccagtggctctgaggatatcgaggttcaccatagcggtcacaagattcgcagaaaccagaaattgaccgcatccagcttatccctggacaccgccagtagttcccagttgagttgcagcctcaactccgattcctgtctccttcaagagaacggaagcaagtcccctgatcactgtgaagaacctatgagttgtgacagcgaccttggcaccgccaacgcggaagactccgataggagcctacaggaaaaaacacgagccggatcgcaaaggatgacaagcactggtctgccggggagcaatccatggagagtcctccaaacaactcagtag

SEQ ID NO: 27085 - DNA, 735 bp, Artificial Sequence
  Description of Artificial Sequence: Synthetic coding sequence
atggagctgaccatcttcatcctgcggctggccatctacatcctgaccttcccgttgtatctcctgaatttcctggggttatggtcctggatatgtaagaagtggttcccatattttcttgtgaggttcaccgtgatctacaatgagcagatggcttccaaaaagagagagctgttcagtaacctgcaagaatttgccggcccatctggtaaactttccctgttggaggtcggctgtggcaccggagccaacttcaagttctaccctcccggatgcagagtcacgtgcatcgacccaaaccccaattttgagaaattcttgattaagtctatcgcggagaaccgacatcttcaatttgagaggttcgtcgtcgctgctggagagaatatgcaccaggtggccgacgggagtgtagatgtggtcgtgtgcaccctggtgctctgctccgtgaagaaccaggagaggatcctgcgggaggtctgccgagtactgcgacccggcggcgccttctactttatggaacatgtcgccgccgaatgcagcacctggaactacttctggcagcaggttctggaccctgcatggcacctcctgtttgacggatgtaatttgactagggaatcctggaaggcccttgaaagagccagtttttctaagctgaagctgcaacatattcaagctcccctatcatgggagttagttcgaccccatatctacgggtacgctgtgaagtag

SEQ ID NO: 27086 - DNA, 558 bp, Artificial Sequence
  Description of Artificial Sequence: Synthetic coding sequence
atggacaaggacagccagggcctgctggacagcagcctgatggccagcgggaccgctagtcgatccgaggacgaagagagtctagccggacagaagcgcgctagtagccaagcactcgggaccattcccaagcgtaggtcaagttcacgatttattaagcgcaaaaagtttgacgacgaactggtggagagttccctggccaagtcatccacacgcgcaaagggagcctcaggggtcgaacctggacggtgttccggctctgaaccctcttccagtgagaaaaagaaagtctcaaaagccccatcaactccggtccccccgagcccggccccagcacctggtctgacaaagcgggtaaagaagtcaaaacagccacttcaggtgaccaaggacctgggtcgctggaagcctgctgatgacctgctcctgataaatgctgtgctgcaaactaacgatttgacatccgtgcatctgggggtcaagttctcttgcagattcacactccgggaagttcaggagcgatggtacgccttactctacgaccctgtgatctcctag

SEQ ID NO: 27087 - DNA, 3003 bp, Artificial Sequence
  Description of Artificial Sequence: Synthetic coding sequence
atggtggagtgcttcgagagcggcggcacccggctgagcctgagctcattcaacgtgtcctgcgatagtctccgggaacagttaagggagtggcggtgctttcagtggtggaggatggactggacaccgaggcttcctagccgacatatcatttctgaactggaacacctgacattcgtcaataccgatgtgggaagatgccgcgcctggctgcggctggcacttaatgatggtttaatggaatgttacctgaagctcctcttgcaagagcaggcacggctacacgaatactatcagcccactgctctgctgcgcgatgccgaagaaggcgagttcctattgtccttcctgcagggactgacatcactttcattcgaattaagctataagagtgcaattttgaacgaatggactctaacacccctcgccctgtcaggattatgtccccttagcgaacttgatcctctcagcacctcgggagctgagctgcaacgcaaggagagcctggactcgatttcgcatagctcgggtagcgaagatattgaagttcatcattccggtcacaagattcgccggaatcagaagctgacagcctctagcttgtcactcgatactgcctcttcttcacagctgtcttgcagtttaaattccgattcgtgtttgctccaggaaaatggcagcaagtcccctgaccactgcgaggagcctatgtcttgtgactctgacctggggacggcaaacgccgaggactccgacagatcactgcaagaggttctgctggagtttagcaaagcccaggtgaactccgttccaactaacggactgtcgcaggagaccgaaataccaacccctcaggccagcctgtccctgcatggcctgaacacttcaacatatctgcactgtgaggcccccgccgagcccctcccggcccaggctgcttccggaacccaagacggggtccatgttcaggaaccccggccccaggccccttcccccctagatctgcaacagcccgtggaatctacaagcggccaacaaccatccagcaccgtcagcgaaaccgccagagaagttggccaaggaaacggacttcagaaagcgcaggcccacgacggggctggactcaagttggtggtttctagtcccacatccccgaagaataagtcctggataagtgaggacgacttctaccgtccctcacgagaacagcccctggagtcagcttcggatcaccccattgcttcttacagaggaacccccgggtccagaccagggcttcacaggcatttctctcaggaaccccgaaagaactgtagtctgggagcacttgaccaggcatgtgtccctagccccggtcgtcgacaggcccaggcagccccttctcagggccacaagagtttcagagttgtccatcgaagacaaatgggtctgagcaatccatttcgcggtctcatgaagcttgggaccgtggaacgcagaggcgccatgggcatttggaaagagctcttctgcgagctgtcgcctctggagtttcgactttatctttccaatgaggagcacacctgtgtggagaactgcagccttctgaggtgcgaatccgtaggcccagcccacagtgatggccggttcgagctggtattttctgggaaaaaattagccctgagagcgtcttctcaagatgaggccgaagactggttggaccgggtgagagaagctctgcaaaaagtgcgcccccaacaagaggatgagtgggtgaatgtgcagtaccccgatcagcccgaagagccccctgaggccccacagggctgtctctctccttccgatctgctaagcgagcctgcggcactgcagggcacacagtttgattggtcgagcgcccaggtcccggagcccgatgccataaaggagagcctactgtatctatacatggaccgcacatggatgccctatattttttccctgtctctagaggccctgaagtgctttagaattcgcaacaatgaaaaaatgcttagcgatagccatggagtagagacgatccgcgacatattgcctgatacctccctgggtggacccagcttcttcaaaattattactgctaaagctgtactgaaactccaggcaggtaatgctgaggaggccgccttgtggcgagacttggtacgaaaggtgcttgcttcatacctggagaccgcggaggaggccgtgaccctgggaggctccctcgacgagaattgccaggaagtgctcaagttcgctacccgggagaatgggttcttactccaatatctggtggctattcctatggaaaagggactcgacagtcaggggtgcttttgtgcagggtgcagtaggcagatcgggtttagcttcgtccgaccaaagctgtgtgccttttcgggcttatattattgcgacatctgccaccaagatgacgcaagtgtgatccccgctagaatcattcacaattgggacctgaccaagaggcccatctgcagacaagccctcaaattcttgactcagatacgcgctcagcctctgatcaacctacagatggtgaatgcctcgctatacgaacatgtggagagaatgcatttaattggaagaagaagagagcagttaaagcttctcggtgactatttaggcctgtgtagaagcggagctctgaaagagttgagtaaacgcttgaatcaccgtaattatctgctggagtctccccaccggttttctgtagcggacctgcaacaaattgccgacggggtttacgagggcttctctccgaaagttcccagcgaagctgcaggcctgagaccatggggcgcacgttcacctgaagcagcaagcgccttccgatgtatcgattcttctcacctgccctctttgcgaaaagtggtgcctacattgtttctgaaatgttactttatgcagtatacagtgccaagcgaacaagggtctggtccagaagagagcttgcagtgtatcgaaggaattgcagccgtgtag

SEQ ID NO: 27088 - DNA, 525 bp, Artificial Sequence
  Description of Artificial Sequence: Synthetic coding sequence
atggacaccatgatgctgaacgtgcggaacctgttcgagcagctggttcgcagagtggagatcctttcggaagggaacgaagtgcagttcatccaattagctaaagattttgaagacttccgtaagaagtggcagcggaccgaccatgagctaggcaaatataaagacctcctcatgaaggcggagacagaaaggagcgcactcgacgtgaagctaaagcatgcccgcaaccaggtggatgttgagattaagcggcgacaaagagcagaggcagactgtgaaaaactggagcggcaaatccagttaatacgagaaatgctaatgtgcgacacaagcggctcgatccaactgtcggaggaacaaaagagcgccctggctttcctgaataggggtcaaccaagcagctcaaatgctgggaataaaagactgtcaaccatagacgagtccggaagcatcctatcggacatcagttttgacaagactgatgaatctttagactgggactccagcctcgtgaaaacttag

SEQ ID NO: 27089 - DNA, 2904 bp, Artificial Sequence
  Description of Artificial Sequence: Synthetic coding sequence
atggactggaccccccggctgcccagccggcacatcatcagcgagctagagcacctaaccttcgtgaacactgacgttggcagatgtcgtgcttggctgagactggccttaaatgacggcttgatggagtgctacctgaagttgctgctgcaggagcaggcgcgcttacatgagtattaccagcccacagccttactaagagacgctgaggaaggcgagtttttgctcagcttcctccaggggctgacttcgctgagcttcgagctcagctacaaaagtgccatcctcaatgaatggacactaacacctctagctttatccgggctctgtccactgtctgagctggacccgttaagcacatctggagccgaactccagagaaaagaaagcctcgattctatctcacactcaagtggcagcgaggatattgaagtccaccactctggacataagatccgcagaaaccaaaagctgactgcttcctctctgtcattggatacagctagctccagccaattaagctgtagcctgaattctgattcctgtctcctgcaagagaacggctcaaagagcccagatcattgcgaggaacccatgtcctgtgactcagatttagggacagctaacgctgaagattcagatcgctcgttacaggaagttctgctggagttttccaaggctcaggttaactcagttcctaccaacgggctgtctcaagagacagaaattccgactccacaggcaagccttagcctgcacggtctaaatacgagtacttatctgcattgtgaagcacccgcagagcctctccccgcccaagccgcatctggcactcaggacggggtgcacgtccaggaacctcggccacaggcaccttcacctcttgatcttcagcagcccgtcgagtccacaagcggtcaacagcccagttctaccgtcagcgaaaccgcgcgcgaagtcggtcagggaaatggcctgcaaaaggctcaggcccacgacggagcagggctgaagctggtggtgagcagtccaacttccccaaagaataagtcatggatcagtgaggatgacttctacagaccctcccgcgaacagcctttggagtccgccagcgatcacccgattgctagctatagaggcacaccagggtctagacctggacttcaccgacacttcagccaggaacccagaaagaactgtagtcttggagccttggaccaggcctgcgtcccgagcccgggccgcaggcaggcgcaggccgcgccttcacaagggcataagagctttagagtggtgcaccggcgccaaatgggtctatctaatccgtttcgagggctgatgaagcttggtactgtggagcgacggggcgcaatgggaatctggaaagagctcttctgcgaactaagtccactggagtttcgactgtacctatcaaatgaagagcatacttgcgtggagaactgcagcctgctacggtgtgagagtgtaggcccagcccacagtgacggccggttcgaactggtgttcagtgggaagaaacttgccctgcgcgccagctcacaggacgaagctgaagactggctggatagggtgcgcgaggctttgcagaaggtgcgcccgcagcaagaggatgaatgggtaaatgttcaatatccggatcaaccagaggaacctcctgaagctccacaaggctgtttgtccccaagcgacttgttaagtgagcctgctgcccttcagggtacccagtttgattggtcatctgcccaggtacccgagccagacgcaataaaagagtcactgctgtatctatatatggacagaacatggatgccttatatttttagcctctcactcgaggccttgaagtgcttcagaatccggaacaacgagaagatgctgtcagacagccatggtgtggagaccatcagggatattttgcctgatacctctctcggtggtccgagttttttcaagattatcacagcaaaagcagttttaaagttgcaagccggtaacgccgaggaggccgcactgtggagggacctggtgaggaaagtgctggcctcgtatcttgagactgctgaggaagcagtcaccctggggggctccctagacgaaaattgccaggaagttctcaaatttgctactcgggagaacggtttcctgctgcaatatctcgtggcgattcccatggaaaaaggccttgactcccaggggtgcttttgcgccggctgttcgcggcagattggatttagtttcgtaagacccaaactatgcgctttctcagggctctactactgcgacatatgccaccaggacgatgcatccgtgatccctgcacgcatcattcacaattgggaccttactaagcggcccatttgtcgccaggctctgaaattcctcacacagatccgcgctcagccattgatcaacctgcagatggttaacgctagcttgtacgagcatgttgagaggatgcacttgattggcaggcgtagagaacagctgaagctgctaggagattatctgggactgtgtcgatccggtgccctgaaagaactgtctaaacgattgaatcacagaaactacctattggaaagtccacaccgcttcagcgtggccgatctccagcagatagctgacggcgtttatgaaggctttcttaaggcattaattgagttcgccagccagcacgtgtaccactgcgacctttgcacgcaacgggggttcatctgccagatctgtcaacaccacgacatcatttttccattcgaattcgacacaacagtccggtgtgcggagtgcaaaacagtgttccaccagagttgtcaggctgttgtgaaaaaaggttgccctcgctgcgcccgtaggcgaaaatatcaggagcaaaatatctttgcctag

SEQ ID NO: 27090 - DNA, 1446 bp, Artificial Sequence
  Description of Artificial Sequence: Synthetic coding sequence
atggccagcgccgccagcgtgaccagcctggccgacgaggtgaactgccctatctgtcaggggactctgagagagccagtgaccatcgactgtggccacaatttctgccgggcgtgcctgacaaggtattgtgagattcctggcccagatctggaagaaagtcctacttgtccactatgtaaagagccgttccggcccggatctttccgacccaactggcagttggctaatgtagtcgaaaatattgagcggctgcaactcgtctccacattggggctgggagaggaggacgtgtgccaagagcacggagagaaaatctactttttctgtgaggatgacgaaatgcaactatgtgtcgtgtgccgcgaagcaggggagcacgctacccacacaatgagattcctcgaagacgccgctgctccataccgagagcagattcacaaatgcctcaaatgtctcaggaaggaaagggaggagatacaggagatccagtcccgagaaaataaacggatgcaggtcctccttacgcaggtgagcaccaagcggcagcaggtgatatccgagttcgctcacctcagaaagtttcttgaggagcagcagtctatcctgctggctcagttggagagtcaggatggcgacattttgcggcagagagacgagttcgatctcctggtggccggcgaaatctgtcggtttagtgcacttatcgaagagctggaggagaagaatgaacgaccagcccgggagctcctcaccgatatcaggagcactctcatccgatgcgagaccagaaaatgcagaaaacctgtggcagtatcaccagagcttggacagcgcatccgtgattttcctcagcaagccctaccattgcagagggagatgaaaatgtttctggagaatctgcccaatcacctggtgatacctaccgcccacatctcattagatcctcaaacaagtcacccaaagctgctcctgtctgaggaccaccagcgtgcacagttctcatacaagtggcagaattccccggacaacccccagagattcgatcgagcgacatgtgtgctagcccacacgggcattacaggtggccgccacacatgggtggtgtcaattgacctggcgcacggcggatcttgtaccgtgggcgttgtgagtgaggacgtgcagcggaagggtgagcttcgccttcgcccagaggagggcgtgtgggccgtgagactggcatggggattcgtttcggccctcggcagtttcccaactcgcctgacactgaaggagcaacctagacaagtccgggtgagtctggattacgaggtcgggtgggtgacattcaccaacgccgtgacccgcgaaccaatatatacattcacagcctcattcaccagaaaagtcatccccttcttcggcctctggggacggggttccagcttctctctttcttcttag

SEQ ID NO: 27091 - DNA, 462 bp, Artificial Sequence
  Description of Artificial Sequence: Synthetic coding sequence
atggcccccggcagccggggcgagcggagcagcttccggagccggagagggcccggcgtgccatccccgcaacctgatgttactatgctctcccgtctgctgaaagaacaccaggcgaaacaaaacgagcgtaaagaacttcaggagaagcgcaggcgcgaagcgatcaccgcagccacctgcctcaccgaggcgttagtcgaccatctgaacgttggggtggcccaggcctatatgaaccagaggaaactcgatcacgaagtgaagaccctgcaggtgcaggctgctcagttcgcgaaacagactgggcagtggataggtatggtggagaatttcaatcaggcgctgaaggagatcggcgacgtagaaaattgggcgcgatctatcgaactagacatgcgaacaattgctaccgccctcgaatatgtatataaagggcagttgcagtctgcaccaagctag

SEQ ID NO: 27092 - DNA, 1311 bp, Artificial Sequence
  Description of Artificial Sequence: Synthetic coding sequence
atgctgtggaacttcaagccccacgcccgggcctaccggtacgtggggcataaagatgtggttacttctgtccagttttcgcctcatgggaatctgctggccagcgcttcgcgcgaccggactgtcagactgtggatccccgataagcgaggcaaattctccgagtttaaagcgcataccgccccagtgcgttctgtcgatttttcggccgacggccaatttctggccactgcgagcgaagacaagtccattaaggtctggtctatgtaccgacagaggtttctttattccttgtacaggcacacccattgggtaagatgtgcgaagtttagccctgacggtagactgatagtctcatgttctgaggacaagactattaaaatctgggatactaccaacaagcagtgtgtcaataacttctccgatagtgtcggtttcgcaaacttcgttgactttaatccctccggaacttgtatagcctctgcagggtccgaccagaccgtgaaggtgtgggatgtacgagtgaacaagctacttcagcattatcaagtccacagcggaggcgtaaactgtatcagttttcacccctctgggaactacctgattacagcctcttcagatgggacactgaagatactggatctgttagagggtcggctcatttacacattacagggccacaccggacccgtgtttaccgtgagtttcagcaagggtggcgagttattcgcctcagggggagcggacacacaggtgctactgtggcggacgaatttcgacgaactgcattgtaagggcctgactaagcggaatcttaaacgcctacacttcgactctcccccacacttgctggacatctacccccgcacgccccaccctcatgaagaaaaggtggagaccgtggaaattaacccaaaactagaggtcatcgatttgcagatcagcacccctcccgtgatggatatactgagtttcgatagcactacgaccaccgagacgagcggtcgtacgcttccagacaaaggggaggaggcttgcggatactttctgaatccgtcactcatgagcccggaatgcttgccaactacaaccaaaaagaaaacagaggatatgtccgacctgccctgtgagtcccaaaggagcatcccacttgcagtcacagacgcgctggagcatattatggagcagctgaacgtgctgacgcagacagtatctatcttggaacagagactcacattgaccgaagataaactgaaggattgtctcgaaaatcagcagaaactcttcagcgcagttcaacagaagtcctag

SEQ ID NO: 27093 - DNA, 597 bp, Artificial Sequence
  Description of Artificial Sequence: Synthetic coding sequence
atgaccctgcggtgcctggagcccagcggcaacggcggcgagggcaccaggtctcaatggggaacagcaggctctgccgaggaaccctccccccaggccgcccgcttggccaaagcattaagagaactgggccaaacaggatggtattggggaagtatgaccgtgaacgaggccaaggaaaagcttaaagaggcacccgagggtaccttcttgatacgggattcctcccactcagattacttactgacaatatcagtcaaaactagcgcaggacctaccaacctcaggattgagtatcaggacggcaaattcaggttggatagcatcatatgtgtgaagtccaagcttaagcaattcgacagcgtggtacacttgattgactattacgttcagatgtgtaaagacaagcggacggggcccgaggccccccggaacggcacagtgcacttatatctcacaaagcctctttacacctctgctccatctcttcagcacctttgtagacttacaatcaataagtgtacgggggccatctggggtctgcctctgcccaccaggttaaaggactatctcgaggagtacaaattccaagtctag

SEQ ID NO: 27094 - DNA, 597 bp, Artificial Sequence
  Description of Artificial Sequence: Synthetic coding sequence
atgaccctgcggtgcctggagcccagcggcaacggcggcgagggcacacgatcacagtggggcactgctgggtctgcagaagagccaagcccccaggccgccagactcgctaaggctttgcgggagctggggcagacggggtggtactggggatctatgaccgtcaacgaagcgaaggaaaaactgaaagaagcgcccgagggaacgttcctaattcgcgactctagccatagtgattatttgctgacaatttctgtgaagacttccgcaggcccgaccaacctccgcattgagtaccaggacggtaagtttcggctggactccatcatttgtgtgaaatctaaattgaagcaattcgatagtgtggtccacttgattgattactatgtacagatgtgcaaagataagcggactggccccgaggccccacggaacgggacagtgcacttgtacctcactaagcctctgtacacctctgctccatccctccaacacttgtgccgattgacgattaataagtgtactggagctatatggggactgcctctgcctactcgcctaaaggattacctcgaggaatataaattccaggtgtag

SEQ ID NO: 27095 - DNA, 495 bp, Artificial Sequence
  Description of Artificial Sequence: Synthetic coding sequence
atgatggagggcaacggcaccgagaacagctgcagccggacccgggggtggctgcagcaagataacgatgctaaaccctggctttggaaattttcaaactgcttcagtcgacccgagcaaacactgcctcactcaccacagactaaggagtacatggaaaataagaaggtcgccgtagaattaaaggacgttccctcgccattgcatgccggctccaagctgttccccgcagttcctttgcctgacatacggtccctgcagcaaccgaagattcaattatcaagcgtgcctaaagtttcatgttgtgcccactgtcccaatgagccctctacaagccctatgcggtttggggggggcggcggcggctctggaggaacatcatccttgatccatccaggagcactgctggactcccaaagcacacgcactataacctgtcaagtggggtctggctttgcctttcagagcgcttcatctctgcagaatgcgtcctag

SEQ ID NO: 27096 - DNA, 855 bp, Artificial Sequence
  Description of Artificial Sequence: Synthetic coding sequence
atgctgagcgtggtggagaacggcctggacccccaggccgccatccccgtgatcaagaaaaagctcgtgggaagtgtaaaagcgttacagaaacagtacgtgtcacttgacactgttgtgacatcagaggatggagatgctaatacaatgtgttcagctctggaagctgtcttcatacacggcctgcacgcaaagcacatccgggcagaagcaggggggaagaggaaaaaaagcgctcatcaaaagccactgcctcagccggtgttttggcctttgctgaaagcagtgactcacaagcacatcattagcgaactagaacatcttacctttgtaaacacagatgtcggcagatgtagagcctggttgaggttggcgctgaacgacggcctaatggagtgctacctcaagcttttactccaggagcaagcccgcctgcagctacagcgtaaagaatccctggacagcatctcacacagcagcggttcagaggacattgaggtgcatcactctggacataaaatccggaggaaccagaaattgaccgccagcagtctaagcctagatactgcctcaagcagtcaactcagttgcagtttaaacagcgactcttgccttcttcaggagaacggctcaaaatctcccgaccactgtgaagaacccatgtcttgcgactctgatctgggcacggcaaatgcagaggactcagatcgtagtcttcaggacataaagattttttcctgggctcagtggctaactccagtcatacctgccctctgggaagcagaagcaggaggaagtcaaagacaacaaatagagacttttctggcaaataccgtaaaacctcacctgtactag

SEQ ID NO: 27097 - DNA, 3282 bp, Artificial Sequence
  Description of Artificial Sequence: Synthetic coding sequence
atgggcggcaaggcctggccccggcgggccgtgggcaccgccggcggcccgtgtgcggaacagatctcagccccctttcaaactctgcttatgccgcaccttcccctcgcctcgttcagacccccattctgggggttgaggcattctaggggactaccacggttccattccgtaagtacccagtctgaaccccatggatctcctatttctagaaggaacagagaagccaagcagaagaggctgagagagaagcaggcaactttggaagccgaaatcgccggagagagcaagagccccgccgaatccattaaggcatggaggcctaaggagctcgtgttatacgaaatcccaacaaagcccggtgagaaaaaagacgtatccggcccacttcctcccgcttacagtcctcgatatgtggaagccgcttggtatccatggtgggttcgcgagggcttcttcaaacctgaatatcaggcaagattacctcaggccaccggcgaaaccttctccatgtgtatccccccaccgaacgtcacaggaagtttgcacatcggccacgcattaacagtggcaattcaggatgccctggtacggtggcacagaatgcgcggcgatcaagtgctctgggtaccaggttccgatcacgcagggattgcgacccaggccgtcgtggagaagcagctgtggaaagaacggggcgttcgcagacatgagttgtcacgggaggctttcctaagagaagtttggcagtggaaagaggcaaaggggggtgagatctgtgagcagctgagggccttaggtgcctcattagactgggatcgggagtgcttcaccatggatgtgggttcctcggtggcggtcaccgaggcctttgttcgcctgtacaaggcagggctgctgtaccgcaaccaccagctagtgaattggtcttgcgctctgcggtctgctatctcggacatcgaggttgagaatcgaccccttccggggcacactcagctcaggcttcccggctgtcctactccggtctcgttcggcctgctcttctcagtggctttcccagtcgacggcgagcccgatgcagaggttgtcgtagggacaacacggcctgaaactctcccaggcgatgtggccgtggcggtccaccctgacgattcccggtatacccacctgcatggaaggcagcttcgccacccactaatggggcagcctctgccactcatcaccgattacgccgtccagccccatgtgggaactggagctgtcaaggttacccctgctcactccccagcagatgcagagatgggcgcccgtcatggcctttctcctttgaacgtaatcgccgaggacggcaccatgacgagcttgtgcggggactggctgcagggtcttcataggtttgtcgcaagggagaagatcatgtctgtcctgtctgaacgcgggctttttcggggccttcagaaccaccccatggtgctccccatttgctcccgctccggcgacgtcatagagtacctactgaaaaaccaatggtttgtaagatgccaggagatgggcgcccgtgccgcgaaagcggtagagagcggtgcgttggagctgtccccttcatttcaccagaagaactggcagcattggttttctcatatcggggactggtgtgtatctcgacagctgtggtggggccaccagatcccagcatacctggtggtggaagaccacgcacagggcgaagaggattgctgggtcgtgggtcgaagcgaggctgaggcgcgagaagtagcagccgaactgacaggtcgacccggtgccgaactcaccctcgaacgagaccctgacgttctggatacctggttttcctcagctctgtttcccttttcagcattaggatggcctcaggagactccagatctcgcacggttctacccactcagccttctggaaaccgggagcgatctcttgctcttctgggtgggcagaatggtcatgctgggaactcagctgactgggcagttacccttttcaaaagtgctgcttcacccaatggttagggacagacagggcaggaagatgtcaaagtcccttggaaacgtccttgacccccgcgatataatctctggtgtggagatgcagctactgcaggaaaaactccggagcggtaatttggaccctgccgagctcgccatcgtggctgcagcccagaagaaggactttcctcatgggatccccgaatgcggtacggatgccctgcgctttacactgtgctcccacggagttcaggccggcgacttacacctatccgtgtccgaggtgcagagctgtcggcacttttgcaacaaaatttggaatgctctcagattcatcctcaatgcactgggggaaaaatttgtacctcagcctgcagaagaactttccccctcatccccaatggatgcctggattctctcgcgtctggctctggcagcccaggagtgtgaacggggatttttgaccagggagttgagtctggtgacacacgctctgcaccatttttggctccacaatctgtgcgatgtttacctggaggcggtaaaaccagtgctttggcacagtccgagacccctcggaccaccacaggtgctgttctcctgcgcagatcttggactgcgattactggcgcctctcatgccctttctcgccgaggaactctggcaaagactgccacctaggccaggctgccccccggccccctctatctccgtggccccctacccatctgcttgctctcttgagcactggcgtcaacctgaattggagcgcaggttttctcgagtgcaggaggtggttcaggttctgcgggcactgcgcgcaacataccagttgacgaaagcccggccacgtgtcctactgcagagttccgagcccggtgatcaggggttgtttgaggcctttctcgagcccctcggcaccctagggtactgcggcgccgttgggcttctgccacccggtaccgctgctccatccgggtgggcccaggctcccttgtcagataccgcccaagtgtatatggagctgcaaggtctcgttgatccacagatccaacttcccttacttgctgctcgccggtataagctccagaaacaactggatagtctgacagctagaacacccagtgaaggagaggctggcacgcagcgccagcaaaaactctccagcctccagctcgagttatcaaaattggataaggccgcatcccacctgagacaactgatggacgagccacccgctcctgggagtcccgaattgtag

SEQ ID NO: 27098 - DNA, 3621 bp, Artificial Sequence
  Description of Artificial Sequence: Synthetic coding sequence
atgaccagcgccgccgagatcaagaagccccccgtggcccccaagccaaaatttgtcgttgctaataacaaaccagccccccccccgatagcaccaaaacctgatattgttattagtagtgttcctcaatccactaaaaagatgaagcccgccatcgcccctaagcccaaggtactgaaaaccagcccagtgagagaaataggacaatctccaagcagaaagataatgcttaatctcgaaggtcataagcaggaacttgccgagagcaccgataattttaactgtaaatatgagggcaaccaaagtaatgactacatatctccaatgtgcagctgcagtagcgaatgtatccacaagctgggacatagagagaacctctgcgtgaagcagcttgtgcttgagcctctggagatgaatgaaaacctggagaattctaaaatagatgaaacgcttaccataaaaacgagatcaaaatgtgatctctacggagaaaaagcaaaaaaccagggaggagtagtactgaaggcgtcagtcttggaagaggagttaaaggacgctctgatccaccagatgccgccatttatttcagcccagaagcacaggccgaccgattcacccgaaatgaacggggggtgcaactccaacggtcagttccgaattgaattcgctgacctctcaccttctccgtcatcgttcgagaaagtacctgaccatcatagctgccacctacaactcccatccgacgagtgtgaacattttgagacgtgccaggatgacagcgagaagtcgaacaactgctttcagtccagtgaactggaggccttggaaaacggaaagcgcagtacactgataagctccgatggagtttccaaaaagagcgaggttaaggaccttgggcctttagagatacacctggtgccatacacacccaagttccccacgcctaaaccacgtaaaacacggaccgcgcgactgctacgacagaagtgtgtggacaccccaagcgagagcaccgaagaacctggcaattccgattccagcagctcctgcctgacggagaattcactgaagatcaataagatctccgtgctgcaccagaacgtactatgtaagcaagagcaggttgacaagatgaagcttggtaacaaaagcgagctgaacatggagagcaactctgacgctcaggatctcgtgaatagccagaaagcaatgtgtaacgagacgacaagcttcgaaaagatggccccgtcttttgacaaggattccaacctttcaagcgacagcaccacggtggacggatcatccatgtctctcgcagttgacgaggggactggatttattcggtgcactgtttcaatgtctctccccaaacagctgaagctcacttgtaacgagcatctgcagtcaggccggaacttgggggtaagcgccccgcagatgcagaaagaatccgttatcaaagaagagaactccctccgcattgtaccaaagaagcctcaaagacattcccttcctgcgactggggtgctgaaaaaagccgcttctgaggagttgctcgaaaagagttcctacccaagcagcgaagagaaatcatcggagaaaagcttggagagaaaccacctccagcacttgtgcgcacagaaccgaggggttagcagcagctttgatatgcctaagagggcttcagagaagcccgtctggaagctgccccatcccattctcccgttctccgggaaccccgaatttctgaaatccgtgacagtgagctccaactccgagccatctacggccctgactaaaccccgcgcaaagagcctgagtgcaatggacgtcgagaaatgcacaaagccatgcaaggactctaccaaaaagaactcttttaaaaagctcttgtccatgaaactgagcatttgtttcatgaaaagcgattttcaaaagttttggtctaaatctagtcagcttggcgacactacaacaggtcatttatcctctggcgagcagaagggcatagagtccgactggcagggtttgctggtcggtgaggagaaaaggtctaaaccaataaaggcttactcgactgaaaactactctctagaaagccaaaaaaagaggaagaagtctcggggtcagacgtccgcagccaacggtctgagggctgaaagtctggacgatcagatgttatccagagaatcatcctcccaggctccctacaagagcgtcacatctctgtgtgctccagaatatgagaatattcggcactatgaggagattcctgagtatgaaaaccttcccttcataatggcgattagaaagacccaggaactggagtggcagaactcttcctccatggaggacgcggacgccaacgtatacgaagtagaggaaccatacgaagcccccgatggtcagctgcagctagggccaagacaccagcacagcagtagcggtgcatcacaggaagagcagaatgatctaggtctgggcgatctcccgtcggatgaagaagaaattatcaacagcagcgatgaggatgacgtcagctctgagtcctctaaaggtgaaccggatcctcttgaggataaacaagatgaggacaacgggatgaagtccaaagtgcatcatatcgccaaagaaataatgagttccgagaaggtctttgtggacgttctcaagctgcttcatatcgatttccgggacgcggtggcccacgcctccaggcagttagggaaacctgtgattgaggaccgaatcctgaaccaaattctctactacctcccccagctatacgagttgaacagggacctcctcaaggaactggaagagaggatgctgcattggaccgaacaacaacgtatagcagatatttttgttaaaaagggtccctatctgaaaatgtatagtacatacattaaggagtttgataagaatattgctctgctggatgagcagtgcaaaaaaaaccccggcttcgcggctgtggttcgcgagtttgagatgtctccacggtgtgctaacctggctttaaagcattacctgctgaagccagtacagcgtatacctcagtataggctcttgctcactgactatcttaagaacctgattgaggatgccggggactaccgagatacccaagatgccctggccgtggtcatcgaggtggcgaatcatgcgaatgataccatgaagcagggcgacaatttccagaaacttatgcagatccaatattcactgaatggtcaccatgagattgttcagccggggagagtgtttctgaaagaaggaattcttatgaagctgtcccgcaaagtcatgcagccgcgtatgtttttcttgttcaatgatgctttgctgtacaccacacctgtccagtccggcatgtataagttgaacaatatgctcagcctggccggcatgaaggtccgaaagcctactcaggaggcttaccagaacgaactcaagatagagtcagtcgaacgcagttttatcttgtctgcaagttcggctaccgaaagagatgaatggctggaggcaataagtcgagccatcgaggagtatgccaaaaagcgtatcacgttctgcccctcacgctctctcgatgaagccgactctgaaaataagtag

SEQ ID NO: 27099 - DNA, 435 bp, Artificial Sequence
  Description of Artificial Sequence: Synthetic coding sequence
atggacaaggacagccagggcctgctggacagcagcctgatggccagcgggaccgcatccagaagtgaagacgaggaaagccttgcaggccaaaagcgggcttcttcccaggctcttggtaccatacccaagagaagaagctctagtcggactctttatcgctttatcaaaaggaaaaagtttgacgatgagttggtggagtcttcactcgccaaatccagcacacgggcaaagggagcgagtggcgtggagcccggccggtgtagcggaagcgaaccaagctcttccgaaaagaaaaaggtgagtaaagccccatcaacccctgtgccccccagccctgcacccgctcccggtctgacaaaaagggtgaaaaagagcaagcagccgctgcaggtgaccaaggacctggggcgatggaagcctgcagatgactag

SEQ ID NO: 27100 - DNA, 810 bp, Artificial Sequence
  Description of Artificial Sequence: Synthetic coding sequence
atgaagacccccgtggagctggccgtgagcggcatgcagaccctggggctgcaacacaggtgtcgaggagggtatagagtcaaggccagaacaagttacgtggacgagacactgtttggctccccagctggtactcggcctacccctcccgacttcgacccaccctgggtggaaaaagctaataggacaaggggcgttggaaaggaggcatctaaagccctcggggctaagggttcatgcgagacgaccccaagtcggggcagcacgcctacattgacacctagaaaaaagaataagtataggcctatctcacatacgccatcctattgtgacgaaagtctattcggctcgaggagtgagggcgcatcgttcggagccccacggatggccaaaggggatgcagcgaaactgcgggcactcctctggacccctccacctacgccacggggttcccacagtccccgcccacgagaggcacctctgcgcgctatccaccctgcgggtccgagcaagacagagcctggccccgccgcggattcccagaagctgagcatggggggactgcactcttctagacccttgaagagaggccttagccactctctgacccacttaaatgtgccttccactggtcatccagccacctcggcaccccacacaaacggcccccaggatctgcggccctccacctctggtgtgacatttcggtctcccctcgtgactagtcgggcacgaagcgtctccatttctgtgccgagtactcccagacgaggcggcgccacgcaaaagccaaaacctccctggaagtag

SEQ ID NO: 27101 - DNA, 501 bp, Artificial Sequence
  Description of Artificial Sequence: Synthetic coding sequence
atggccaacgaccccctggagggcttccacgaggtgaacctggccagcccaacatcccctgatctgctgggcgtttatgagtctggtacacaggaacagaccacctcacccagtgtcatctacagaccgcacccaagcgccctgagttccgtccctattcaggccaatgctttggacgtatccgaactgcccacacagcccgtgtactctagtccccggcgactcaactgcgcagagatttctagcatctccttccacgtcacagaccccgctccctgttctaccagtggggtgaccgcgggattaactaaactgactactcgcaaggataactacaatgcagagcgggagtttttgcagggcgccaccataaccgaggcatgcgacggatccgacgatatctttggactgtccacagatagtctctcacgactgcgtagcccatctgttttggaagtgcgggagaaaggctacgagcggcttaaagaggagcttgcctag

SEQ ID NO: 27102 - DNA, 390 bp, Artificial Sequence
  Description of Artificial Sequence: Synthetic coding sequence
atggacaccatgatgctgaacgtgcggaacctgttcgagcagctggtgcggcgcgtagagatcctttccgaaggtaatgaagtgcagtttatccagctggcaaaagatttcgaggacttcaggaaaaagtggcagagaaccgaccacgagctgggcaaatacaaggatcttctcatgaaggctgagactgagagatccgctctagatgtgaaattgaaacatgccaggaatcaggttgatgttgagatcaagcggcgtcagcgggctgaggcagattgcgagaaactggaaaggcagattcaactgatccgcgagatgctgatgtgtgacacgagcggatcaatacagctaagcgaagagcagaagagtgccttggcatttctcaattag

SEQ ID NO: 27103 - DNA, 486 bp, Artificial Sequence
  Description of Artificial Sequence: Synthetic coding sequence
atgaccctgcggtgcctggagcccagcggcaacggcggcgagggcaccaggtcacagtgggggactgctgggtcagctgaggagccgtctccacaagctgcccgtctggctaaagcactgcgggagctggggcagacaggatggtactggggatccatgaccgtcaacgaagccaaggaaaagctgaaggaggcccccgagggcacgttcctgattcgcgactcaagccattcagactacttgctgaccatctccgtgaagacgtccgctggcccaactaatctgcgcatagagtaccaggatgggaaattccgcctcgatagcatcatatgcgtgaagagtaagctgaagcagtttgatagcgtcgtccacttgatcgattattacgtccagatgtgcaaagacaagcgtactgggcccgaggctccgaggaacggtaccgttcacttgtacctaacaaagcccctatacactagcgcaccatag

SEQ ID NO: 27104 - DNA, 1389 bp, Artificial Sequence
  Description of Artificial Sequence: Synthetic coding sequence
atggacaaggacagccagggcctgctggacagcagcctgatggcctctgggacagcctcaagaagtgaagacgaggagagcctggctgggcagaagagagcatcaagtcaggcgcttggtacaatccccaaaagacgatcaagctcacgtttcattaaacgaaaaaagtttgacgatgagcttgtagagtctagccttgccaaatcatccaccagggcgaagggcgctagcggtgttgaaccagggaggtgtagcggcagtgaaccgtcaagtagcgaaaaaaaaaaagtaagtaaggcaccctctaccccagttcctccatcccctgcaccagcaccaggcttgacaaagagagtcaagaaatcaaaacaaccgctgcaggtgaccaaggatttagggaggtggaagcctgccgacgacctgctgctgattaacgctgtgctccaaactaacgacctgacatctgtgcaccttggtgtgaaattctcatgtagattcacccttagggaagtgcaggaacggtggtatgccctgctgtacgatcctgtgatctcgaaactcgcatgtcaggccatgagacagcttcaccccgaggcaatcgccgcaatccagagtaaggctctgttctctaaggcagaagagcagttgctgagtaaagtaggatctaccagccagccaactctggaaacctttcaggacctgttgcaccggcacccagatgcattctatctggcccgtaccgctaaggctttgcaggcacattggcagctgatgaaacagtactatcttctggaagaccagaccgttcagcccttaccaaaaggcgatcaggtgctgaacttcagcgacgcagaggacctgattgatgactctaagttgaaggacatgcgtgacgaggtcttggagcacgagttaatggtggccgataggcgacaaaaacgcgagatcagacagttagagcaagaattgcacaaatggcaggtgttagtggactccatcacaggcatgtccagcccagatttcgataatcagacactggccgtgttgcgaggcagaatggtgagatatctgatgcgctcgagggaaattactttgggacgcgctactaaagataaccagatcgacgtcgacttaagcctcgaagggccagcctggaaaatcagccgaaaacagggagtgataaaattgaagaataacggcgatttcttcatagccaacgaaggccggcgcccgatttacatagacggcaggcctgtattgtgcgggagtaagtggaggctgtccaataactctgtggtcgaaatcgcatccttgcgctttgtcttcttgattaaccaagacttaattgctctgatcagggcagaagctgctaagatcaccccacagtag

SEQ ID NO: 27105 - DNA, 576 bp, Artificial Sequence
  Description of Artificial Sequence: Synthetic coding sequence
atgggcaagaagaccaagcggaccgccgacagcagcagcagcgaggatgaggaggaatatgttgtcgagaaggtgctcgaccgcagagtggtgaaagggcaagtcgaatatcttctcaagtggaaagggttctcagaggaacataacacatgggaacccgaaaagaacctggattgccctgaattaattagcgagtttatgaagaagtataagaagatgaaagagggggagaataataaaccacgcgagaaatccgagtcaaacaaacgcaagtcaaacttttccaactctgcagacgacattaagagtaagaagaaaagagaacagtccaacgatatcgcccgcggcttcgaaagaggcctggaacccgagaaaattataggagccaccgatagctgcggcgatctgatgttcctcatgaagtggaaagacaccgacgaagcagatctcgtcctggccaaggaagcgaacgtgaagtgcccccagattgtcatcgcgttttatgaagaacgcctaacgtggcatgcgtatcctgaggatgcagagaacaaagaaaaagagactgcaaaatcctag

SEQ ID NO: 27106 - DNA, 1212 bp, Artificial Sequence
  Description of Artificial Sequence: Synthetic coding sequence
atggccagcagcagcgtgccccccgccaccgtgagcgccgccaccgcaggtcccggacctggtttcggcttcgccagtaagacaaaaaaaaaacatttcgtgcagcagaaggtgaaagtgtttcgggcagcagatcctctcgtcggagtattcctgtggggcgtcgcccacagcattaacgagctgagccaggtgcccccacccgtcatgctgctccccgatgattttaaagcgtcaagcaaaatcaaggagtattgccctcaggtgttcaggaatctgagggacagatttggtattgacgaccaagattacctggtttcactgactcggaacccaccctctgaatctgaaggatccgatggtaggtttctgatcagctacgatcggaccctagtgattaaggaggttagttctgaagacatcgctgatatgcattctaatctgtcaaattaccatcagtacatagttaagtgtcacggaaacactttactgccccaattcctgggcatgtacagggtgagcgtggataacgaagacagttacatgctggtgatgaggaacatgttcagtcacagattgcccgtccatcgcaagtacgatctcaagggcagtttggtcagcagggaggcgtcagataaagaaaaggtgaaagaattgcccacgttaaaagacatggatttccttaacaagaaccaaaaggtctatatcggcgaggaggagaagaaaatttttctggaaaagttgaagcgcgatgtggaatttctcgtgcagcttaagataatggactactctttacttctcgggattcacgacatcatcagaggatccgagccagaggaggaggcccccgtcagggaggacgagagcgaagtcgatggtgactgctctctgacaggccccccagcacttgtcggcagctacggtacgtctcccgagggcattggcgggtacatccatagccatcgcccattaggcccaggcgagtttgaatcttttatagacgtctacgccatcaggagcgccgaaggagcacctcagaaggaggtgtacttcatgggactgatagacatcctcactcagtacgatgccaaaaagaaagcagctcacgcagcgaagacagttaagcacggcgctggcgcggaaatctcaacagtccaccccgagcagtatgctaaacgcttcctggatttcattaccaatattttcgcgtag

SEQ ID NO: 27107 - DNA, 576 bp, Artificial Sequence
  Description of Artificial Sequence: Synthetic coding sequence
aagatcgaggtgatcgagatcatgaccgaccggggcagcggcaagaagcggggcttcgcctttgtgacttttgatgaccatgactccgttgataagatagtcatccagaaataccacacagtgaacgggcataattgcgaagtgcgcaaggcgctttcaaagcaggagatggcttccgcaagctccagccagcgggggcggagcggaagtgggaattttggtggggggcgaggtggcggattcggcggaaacgacaacttcggtcggggcggtaacttttccggacgaggggggtttggagggtcgagaggcggcggaggttatggcggcagcggtgatggttataatggcttcggaaatgatggttcaaacttcgggggtggaggctcatacaacgacttcggtaattataacaatcagagttctaattttggcccaatgaagggaggcaacttcgggggcagaagttctgggccctatggtggaggaggacaatattttgccaaacctcgtaatcagggtggttacgggggtagttcatcctcgtcaagctacgggagcggtagaaggttctag

SEQ ID NO: 27108 - DNA, 543 bp, Artificial Sequence
  Description of Artificial Sequence: Synthetic coding sequence
atggagctgaccatcttcatcctgcggctggccatctacatcctgacgttcccgctgtacctcctgaatttcctgggactgtggtcatggatatgcaagaagtggttcccctattttctggttaggtttacagttatctacaatgagcagatggcaagtaagaaaagggaactgtttagtaacctgcaggaattcgccggtcctagcggcaagctgtccctcctcgaggtgggatgcgggaccggagccaatttcaagttctaccctcccggctgccgggtgacttgtattgaccctaaccctaacttcgagaagtttctgatcaagtccattgcggagaatcgccacctacaattcgaacgatttgtcgttgctgccggggaaaatatgcaccaggttgctgacggctccgtggacgtggtcgtttgcactctggttctgtgctccgttaagaatcaagaaaggatcctaagagaggtatgtagggtgttgcgacctgggggagccttctactttatggagcacgtggctgccgagtgttag

SEQ ID NO: 27109 - DNA, 1431 bp, Artificial Sequence
  Description of Artificial Sequence: Synthetic coding sequence
atgggcctgaagaagatgaagggcctgagctacgacgaggccttcgccatggcaaacgatcctctggaggggttccatgaagttaacctggcttcaccgacatccccagacctgcttggcgtgtatgaaagtgggacgcaggagcagacgacttctccaagtgtcatatacaggcctcaccccagtgctctgtcctccgtccccattcaagcgaacgcgctcgacgtgagcgagctgcccactcagcctgtgtatagcagccctagaagactgaactgcgctgagatttcgagtatctcgttccatgtcactgatcccgccccatgctctacatccggagtcaccgctggcctcacgaaactcaccacgcgtaaggataactataacgcagagagggaatttctgcaaggcgctactataacagaggcgtgcgacggtagcgacgacatctttggattgtccactgattctctctctcggttgcggtctccctccgtgttggaggtgcgggagaaagggtatgaaaggctaaaggaagagttggccaaggcccagcgcgagctgaaactgaaagacgaggagtgcgagaggttgtccaaggtcagagatcagttggggcaagagctggaggaactcactgcgagcctgtttgaggaggcacataagatggtgcgcgaagcgaacatcaagcaggctacagctgagaagcagctgaaggaggctcaggggaaaatagacgtgctccaggcagaggtggctgctctcaaaacgcttgttttatctagtagtcctacctcaccaacacaggagcccctacccggcggcaagacacccttcaagaagggacatactcgcaacaaatctaccagctcagccatgagtggctcgcaccaggacttgagcgtaattcaacctatagttaaggactgtaaagaagcagacctgagcctgtacaacgaatttcgtttgtggaaagacgagccaaccatggacaggacctgtccttttctggacaagatttatcaggaggacatatttccatgtctcactttctcgaaatctgagttggctagcgccgtgctcgaagcagtcgaaaacaacacattatctatagagcctgttgggctccagccgatccgattcgtgaaagcgagcgccgtcgaatgcgggggacccaaaaagtgcgcactcacagggcagtcaaagtcctgtaagcatagaataaagctgggcgactctagtaactattactatatttcccccttttgtcgctacaggatcacttccgtgtgcaactttttcacatatatccggtacatacaacaggggctggtgaaacaacaggatgtggatcagatgttctgggaggtgatgcagcttagaaaggaaatgtccttggcaaagttgggttacttcaaggaggaattatag

SEQ ID NO: 27110 - DNA, 336 bp, Artificial Sequence
  Description of Artificial Sequence: Synthetic coding sequence
atggacaccatgatgctgaacgtgcggaacctgttcgagcagctggtgcggcgcgttgagatcttgagtgaaggcaacgaagtgcagtttatccagctagcaaaggacttcgaagacttccgtaaaaagtggcaaaggaccgaccatgagctgggtaaatataaagacctgctgatgaaagccgagactgagcgctcagccctggacgtcaaattgaaacacgctagaaaccaagtggacgtcgagattaagaggcggcagcgagccgaggcagattgtgagaagcttgagagacaaatccagcttatccgcgaaatgctgatgtgcgatacctag

SEQ ID NO: 27111 - DNA, 324 bp, Artificial Sequence
  Description of Artificial Sequence: Synthetic coding sequence
atgatcaagaacctggaggtgcagctgcggcgggccaccgacgagatgaaggcatatatttctagcgatcagcaggaaaaacggaaggctattagggaacaatatacaaaaaatacagctgaacaggagaatctcggcaagaaactccgcgaaaagcagaaggtcattcgcgagtcccatggcccaaacatgaagcaggctaaaatgtggagggatctcgagcaactcatggagtgtaaaaagcagtgctttctcaaacagcagagccagacctcgatcggccaggtcatccaagagggcggcgaggataggctgatcctctag

SEQ ID NO: 27112 - DNA, 2772 bp, Artificial Sequence
  Description of Artificial Sequence: Synthetic coding sequence
atgtgcatccccccccccaacgtgaccggcagcctgcacatcggccatgccctaactgttgcaatacaagacgcgctcgtacgttggcacaggatgcggggggaccaggtgttgtgggtccccgggagtgaccacgccggcattgccacccaggctgtggttgaaaagcagctctggaaggaacggggcgtgcggagacacgagctgagccgcgaggccttcctgcgggaggtgtggcagtggaaggaagctaaggggggagaaatctgcgaacagctgcgcgctctgggggcctctctggattgggaccgggagtgctttacgatggatgtcggttcctccgtagccgtcaccgaagccttcgttcgcttatataaggcgggcctgctttatcggaatcatcaactcgtgaactggtcctgcgccctccgcagcgccattagtgacattgaggtggagaacagacctttgccaggccacacccagctccggctccccggctgccccacaccagtgagttttgggttgctcttctcagtcgcctttccagttgacggggaaccagacgccgaagtcgtggtaggtactactcggccggaaactctccccggggatgtggcggttgccgtgcacccagatgactccagatacactcatctccacggaagacaactgcggcatccgctaatggggcagcccttgcctctgatcaccgattacgctgtacagcctcatgttggtaccggggccgtcaaggtcacgccggctcactcccccgcagacgcagaaatgggcgcaagacacggcttgagtcccctaaacgtaatcgctgaggatggcacaatgaccagcttatgcggcgattggctgcagggcctgcatcggttcgtggctagggaaaaaattatgtctgttctgagtgaaaggggcctgtttcgaggattacaaaatcacccaatggtgcttcccatctgtagcagaagcggcgatgttatcgagtacctgctaaagaatcagtggttcgttcgatgccaagaaatgggagccagggcagccaaagctgttgagtctggcgcattggagcttagcccaagctttcaccagaaaaactggcagcactggttctctcacatcggcgactggtgcgttagcagacaactgtggtggggccaccagatccctgcttacctagttgtggaggaccatgcgcagggagaggaagattgttgggtggtgggtagatcagaggcggaggcgcgtgaagtggctgccgagctgactggcaggcctggtgctgagctcaccttggagcgcgatcccgatgtccttgatacttggttctcatccgctctgtttcccttctccgctctcggatggcctcaagaaactcctgacttggcccggttctatccactgtccctgctggaaaccggttctgacctcttattgttttgggtcggtagaatggttatgcttggtacccagctcacaggccaactgccattctcaaaagtgttgctgcatccgatggtgagggaccggcaaggccgcaagatgtccaaatctctggggaatgtactggaccctcgggacatcattagcggggtagagatgcagttgctgcaggagaaactgcgttccggcaacctcgatcccgcagagttggcgattgtcgctgctgcccaaaagaaggacttcccacacggaatccccgaatgtggcacagatgctttgcgttttactctgtgttcccatggcgtgcaggcaggggatctgcacctgtctgtatctgaggttcagtcatgccgccatttttgcaataagatttggaacgctcttcgatttatcttaaacgcactcggggagaagttcgttcctcagccagcagaagaactgtccccttccagcccaatggacgcttggattcttagtcgcttagcactggcggctcaggagtgtgaacggggattcctgacacgtgagctgtcccttgtcactcacgccctacaccacttttggctccataatctgtgtgacgtttatctcgaggccgtgaagccagtcttgtggcattccccaagacctctgggaccaccccaggtgctcttcagttgtgccgacctcggcctgaggctgctcgctcctcttatgccatttctggcagaggagctgtggcaacgactgccaccccggcctggttgcccccccgctccttccataagcgtggcgccctaccctagtgcgtgctctctcgagcattggcggcagccagaactagagcgcagattcagtagggtccaagaggtggttcaagttctccgtgctttgcgcgcgacgtaccaactaaccaaggccaggccacgggtgctcctgcagtcaagcgagcctggagaccaaggcttgtttgaggcattccttgagccattagggacactgggttactgtggtgccgtagggttgctaccacctggcacagcggctccaagcggctgggcccaggcccctttatccgacactgctcaggtgtacatggagttacagggattggtggatccacagatccaactgcccttactggctgcgaggaggtacaagctgcagaaacagctggattctctgacagccagaactcccagcgagggagaggctgggacacagcgacaacagaaattgtcctccctgcaattggaattaagcaagctggacaaggcggcctcacacctgagacagctcatggatgagcctcccgcccccggctcacctgagctctag

SEQ ID NO: 27113 - DNA, 2076 bp, Artificial Sequence
  Description of Artificial Sequence: Synthetic coding sequence
atggaggagagccccctgagccgggcccccagccggggcggcgtgaacttccttaatgtcgcccgaacatacatccctaatacaaaagttgagtgccactacaccttacctcccggcactatgcccagcgccagtgactggataggcatctttaaggtggaggcagcgtgtgtgagggactaccacacttttgtgtggtccagcgtgcctgagtccacgactgacggatctcccatacatacttctgtgcagttccaggcttcttatctgccaaagccgggtgcacaattataccaatttaggtacgtcaatcggcagggtcaggtttgtgggcaaagccctcccttccagttccgcgaacctaggcctatggatgagttagtgacacttgaagaggcagatggcggaagtgatattctgttagtagtccccaaagctactgtgctgcaaaaccagttggatgagtcccagcaagagcggaacgatctcatgcagctcaaactgcaactggaagggcaggttaccgagctgaggagccgggttcaggaattggaacgggcactggcaactgcccgccaggagcacacagaactgatggagcaatataaggggatttcacgtagtcacggtgagatcacagaagaacgcgatattctttccagacagcaaggagaccatgtggcccgcatccttgagcttgaagacgatattcaaaccatctccgagaaggtgttgacaaaagaggtggagctagaccgattgcgagataccgtgaaggcactaacgagggagcaagagaaattactgggacagttaaaagaagtgcaggccgataaagaacaaagcgaagctgagctccaggtggcccagcaagagaatcatcatctcaacctggacctgaaagaggccaagagctggcaggaagagcagtccgctcaggcccagaggctgaaggataaagtggcgcagatgaaagataccctggggcaggcacagcagcgggtggccgaactcgaacctttgaaagagcagctacgaggtgcccaagagctcgccgcctcctctcagcaaaaagctaccctgctcggcgaggagctagcaagtgcagcagccgcccgggaccggacgattgcggaactgcaccgctcacgcctggaagttgccgaggtgaacggaaggctggcagaactgggcttacacctgaaagaagagaaatgccaatggagcaaagaacgagccggtttattgcagtctgtagaagccgagaaagacaagattctcaaactgtctgcagaaatccttcggctggagaaggccgtgcaggaggaacgcactcagaaccaagtttttaagacagagctggcaagagagaaggattcatccttagtgcagctgtccgagagcaaacgtgagttgaccgagctgcggagcgcactgcgagtgttgcaaaaagagaaagaacagctgcaggaagaaaaacaagagctgttggaatatatgcggaaactggaggcaaggttggagaaagtcgctgatgaaaaatggaacgaggacgcaaccacagaggatgaggaggccgcagttggacttagttgccccgcagcactgaccgactccgaggacgaatctcccgaggacatgagactcccaccctacgggctgtgcgagcgtggtgatcccggttcctctcctgcaggacctcgagaggccagccccttggtcgtgatctcccagcccgcccccatctctccccacctttctgggcctgccgaagactcctcaagcgattctgaggccgaagacgaaaaaagtgtcctgatggcagccgtccagagtggaggtgaggaggctaatttactcctccctgagctaggatccgccttctacgacatggcttctgggttcaccgtcggcacactttcagagacctccactggaggccctgccactcctacctggaaggaatgccctatctgtaaggagcgctttcctgcagagagtgacaaggatgcactggaagatcacatggacggacactttttcttctccacccaggaccccttcaccttcgagtag

SEQ ID NO: 27114 - DNA, 366 bp, Artificial Sequence
  Description of Artificial Sequence: Synthetic coding sequence
atgaacgagagcaagcccggcgacagccagaacctggcctgcgtgttctgccgcaaacacgacgattgccctaacaagtacggagagaagaagaccaaagagaagtggaacttaaccgttcactactattgtctgctcatgtccagcggtatttggcagcgtggaaaggaggaagagggagtgtacggcttcctaatagaggacattagaaaagaggtcaatagagcttctaaacttaaatgttgcgtgtgtaaaaaaaacggggcctctatcggctgcgtggctccccgatgtaaacggtcatatcacttcccctgtggcctgcagagggaatgcatttttcagtttaccggtaattttgcctag

SEQ ID NO: 27115 - DNA, 657 bp, Artificial Sequence
  Description of Artificial Sequence: Synthetic coding sequence
atgaactgccggagcgaggtgctggaggtgagcgtggagggccggcaggtagaggaagccatgctggccgtgctgcacactgttctgttacatcgcagcactgggaagttccactacaaaaaggaaggcacctattctatcggaacagtggggacacaggacgtagattgtgatttcattgattttacttacgtccgcgtgagcagcgaagagctcgaccgcgccttgagaaaagtggtaggagagtttaaggacgctttgaggaactcagggggcgatggcctgggccagatgtctctcgaattttatcaaaaaaaaaagagccggtggccgttttccgacgagtgtataccatgggaagtatggaccgttaaagtgcacgtagtggctctcgccaccgagcaggagcgacaaatctgtcgagaaaaggtaggggagaagttgtgcgagaaaattattaacattgttgaagttatgaacagacacgagtacctgccgaaaatgcccacgcagtctgaggtggataacgtgttcgatactgggcttcgcgatgtacagccatatctgtacaagatatctttccaaatcaccgacgcgctaggaacctcagtcaccaccaccatgagaaggctgattaaggatacgttggccctgtag

SEQ ID NO: 27116 - DNA, 1899 bp, Artificial Sequence
  Description of Artificial Sequence: Synthetic coding sequence
atggacaccatgatgctgaacgtgcggaacctgttcgagcagctggtccggagagtggaaatactttccgaagggaatgaagtgcagttcatccagttagctaaggatttcgaagactttcggaaaaaatggcagagaacagatcacgagctcggaaagtataaggaccttttaatgaaagccgagactgagaggagcgccttggacgtgaagctgaaacatgctcggaaccaggtcgacgtggagatcaaacggcgacagagggcagaggccgactgtgagaagttggagcggcagatccagctgatccgggaaatgctaatgtgcgacactagcgggagcattcaattaagcgaagaacagaagagcgcacttgccttcttaaatcgagggcagccctcttcaagcaatgcaggcaacaaaagattatcgactatcgatgagtctggtagcatccttagcgatattagtttcgacaaaaccgacgaaagcctggactgggacagttccctagttaaaacttttaagcttaaaaaacgtgaaaaacggcggtcgacttcaaggcaatttgtggacggaccccccggcccagtgaagaagaccaggagcattggttcagcagtggatcagggaaacgagtcgatcgtcgccaagacaaccgttacggtaccaaatgatggaggaccaattgaagctgtctctacaattgaaaccgttccctactggacacggtcccgacgaaaaaccggcaccttgcagccttggaatagcgatagtaccctgaattctaggcaactcgaacccagaacagagactgactctgttggcacgccacagagtaatgggggtatgcgcctgcacgacttcgtctcaaaaacggttattaagccagagagctgcgtaccctgcggcaagcgaattaagtttggaaaactgtccctgaaatgcagggactgccgtgtggtgtctcacccggagtgcagggatagatgcccactaccttgcattcctacgctgatcggcactccagtaaagataggtgaagggatgctggctgattttgtctcacagacaagtcccatgatcccctctatagtagtgcactgcgtgaacgagattgaacagagaggactgactgagacaggtctttacagaatatccggctgtgaccgcactgtcaaggaattaaaggaaaagttccttcgcgtcaagacagtgcccctgctgagtaaagtggacgatattcacgccatctgttccttgctgaaagactttttacgtaatctaaaggaaccgctgttaacattccggctgaacagagcttttatggaggccgccgagatcaccgacgaagacaactccattgccgccatgtaccaagctgtcggcgagctgcctcaggctaacagagatacccttgcttttcttatgattcacctccaaagggtggcacagagcccccacaccaagatggacgttgctaatctggccaaagtgttcggcccaactattgtggcccatgcagtcccaaaccccgaccctgtgactatgctgcaggatattaaaaggcagcccaaagttgtggagcggttgttgtctctgcccctagaatactggtcccagtttatgatggtagagcaggagaatatagatcctctgcacgtcatcgaaaactcaaacgccttctctacaccacagacaccagacattaaggtgtctctgcttgggcctgtaacaacgcctgagcaccagttgctaaagactccaagcagctcatcactgtcacagagggtccggagcacattgaccaagaacacccccaggttcggttctaagagtaaatcagccacaaacctcggaagacagggaaacttctttgctagtcctatgcttaagtag

SEQ ID NO: 27117 - DNA, 1134 bp, Artificial Sequence
  Description of Artificial Sequence: Synthetic coding sequence
atggccaccatccccgactggaagctgcagctgctggcccggcggcgccaggaagaggctagcgtacgcggcagggaaaaggctgagagggaacgactgtctcagatgccagcatggaagagagggctgcttgagcgcagacgtgcaaagttgggcctgagtcccggcgagcctagtcctgtcctgggaactgttgaagccgggcctccagacccggatgagagtgcagtattactggaagccatagggcctgttcaccagaacaggttcatccgacaggaaaggcaacagcagcaacagcaacaacagcgctccgaggaactgctagcagagcgcaaacctggacccctggaagcacgggaaagaaggccaagtcccggggagatgcgcgatcagagtcccaaggggagagagagccgagaggaacgcctgagtcctagagaaacaagagaacgcagactgggcatcggcggcgctcaggagctttcacttcgcccactggaggcccgagattggagacagagtccaggcgaagtgggggatagatccagtaggctttccgaagcctggaagtggcggctaagccccggcgagaccccggaaaggagccttcggcttgcggagagtagggagcagagcccgagacgcaaagaggttgagtcccgtctcagccccggggaatccgcctatcagaaactagggctcactgaggctcataagtggcgccccgattccagggaaagccaggagcagagcttagttcaactggaagctaccgaatggcgccttcggtcaggggaggagcgacaggattacagtgaagagtgtggtcggaaggaggaatggccagtccctggagtggcccccaaggaaacagcagaattgtccgagacacttaccagagaggcacaggggaacagtagcgcgggggttgaagctgccgaacagagaccggtcgaggatggcgagagagggatgaagcctacagaaggctggaaatggaccctgatcatgagcttagccggcaagggcaaccagcatctggtgacctgctttccacaccccgtctcaggtgggcgagctaactgtcccatttccaccttaatacagtccccctggtgtgggtggggttag

SEQ ID NO: 27118 - DNA, 1134 bp, Artificial Sequence
  Description of Artificial Sequence: Synthetic coding sequence
atggccaccatccccgactggaagctgcagctgctggcccggcggaggcaggaggaagcatcggtacggggccgagaaaaggctgagagggaaaggctgtctcagatgcccgcctggaaacggggccttctagaaaggcggcgggccaaattaggtctttcacccggggaaccttcacctgtgctgggcaccgtcgaagcagggccccctgaccctgatgaatctgccgtcctactcgaagccatcggccctgtgcatcagaaccgctttattaggcaggagcgccagcaacagcagcaacaacagcaaaggtctgaagagctactagcagagcggaaacctgggccgctggaagcgcgagagagaagaccttcaccaggcgaaatgagagatcaatctcccaaggggagggagagccgcgaagaacgcctgagcccccgggaaacccgagagcgcaggctgggcatcgggggtgcccaagaactctccctcagaccactggaggcacgagactggagacagtcccctggcgaggtcggagatcggagttccagattaagtgaggcctggaagtggaggctctctcccggggagacaccggagcgatctctgcggttagccgaatctagagagcagagtccacgccgcaaggaagttgaaagcagactctcgcctggcgagtctgcctaccaaaagcttggactgaccgaagctcacaagtggagacccgattcacgcgaaagtcaagagcagagcttagtccagctcgaagctaccgagtggcggctcagaagtggcgaggaacgccaagattatagtgaggagtgcggaaggaaagaggagtggccagtacctggagtggcgcccaaggagacggcagagctctctgaaaccctcacacgtgaggctcagggcaattccagcgccggagtagaagccgcagagcagcgaccagtggaagacggcgaacggggcatgaagcctaccgaaggctggaagtggaccctcatcatgtctctcgcaggcaaggggaatcagcacctggttacttgtttcccccacccagttagcggcggtcgcgccaactgtcccatcagcaccctgatacagtcgccttggtgcggctggggctag

SEQ ID NO: 27119 - DNA, 774 bp, Artificial Sequence
  Description of Artificial Sequence: Synthetic coding sequence
atgccccacctgcccctggccagcttccggccccccttctggggcctaagacacagccgaggactgcctagattccactctgtatcaacacagagtgagcctcacggctcccctattagccggcgcaacagggaagcgaagcagaaaagattgagggagaagcaggcaacccttgaagctgagatagcgggggaatcaaagtctcctgcggagtccatcaaggcctggcgcccaaaggagcttgtgttgtacgagatcccaaccaaacccggtgagaaaaaggatgtgagtggacccctcccaccggcttattccccccgatacgtggaggcagcctggtacccgtggtgggtacgtgaaggattcttcaaaccagaataccaggcaagactgccccaggccaccggagaaaccttttcaatgtgtattccgcctccaaacgtgacagggagcctccacataggccacgctctgactgttgctattcaagatgctcttgtcagatggcatagaatgaggggtgaccaggtgctttgggtgccgggaagcgatcatgcagggatcgccacccaggctgtggtcgaaaagcagctgtggaaggagagaggagttcgccgtcacgagctgtctagggaagccttcctgcgtgaagtttggcagtggaaggaggctaaaggaggtgagatctgcgagcaactaagagccctcggggcctccctggactgggatcgggtgttttatcacgggtgctggctgctgtctggttgcgactag

SEQ ID NO: 27120 - DNA, 1446 bp, Artificial Sequence
  Description of Artificial Sequence: Synthetic coding sequence
atggccagcgccgccagcgtgaccagcctggccgacgaggtgaactgccccatctgtcagggaacgctgcgtgagcctgtgactatagactgcggtcacaatttttgcagagcttgtcttactcgatattgcgagattccggggccggatctcgaagaatcacccacgtgtcctctgtgtaaagagcccttccgacccggcagcttccgccctaattggcaactagcaaacgtcgtagaaaacattgagcggcttcagcttgtctccacactgggactgggcgaggaggatgtgtgccaggaacatggggagaagatatacttcttttgtgaggatgatgaaatgcagctgtgcgtagtctgtagggaggccggagagcacgccactcatactatgcgcttcttagaggacgctgctgctccatatcgcgaacaaatccacaagtgtttgaaatgcctgagaaaggaacgagaggagattcaggaaattcagtcacgagagaataaacgaatgcaagtactcctgactcaggtgagtactaaaagacagcaggtcataagtgagtttgctcacctgagaaaattccttgaagagcaacagagcattcttctggcacagttggaaagtcaggatggcgatattctgcgtcagcgcgatgaatttgacctgctggtggcaggggaaatctgtcggttttctgctttgattgaagagctcgaggagaagaacgagaggccggcacgcgagctgctcactgatatcaggtccaccctgattcgttgcgaaacccggaaatgccgcaagcctgtggcggtctccccagagttgggacaaagaattcgggacttccctcagcaggcgctgcccctgcagcgcgagatgaaaatgtttctggagaatctccctaaccatctggtaatccccaccgcgcacatttccctggatccgcagacctctcacccgaagctactgctttctgaagatcaccagagagctcagttctcttataaatggcagaacagccccgataacccccaacgttttgatagggccacctgcgttttagctcacactggaatcaccggtggtcgtcacacttgggtggtcagtatcgacctcgctcatgggggatcctgtacagtgggcgtggtgagtgaagacgtccagaggaagggcgaactccggctgcggcccgaggaaggcgtctgggctgtcagactggcgtggggattcgtatctgccctgggttcgtttccaactaggttgacactgaaggagcagcccagacaagttcgcgtcagcctggattacgaagtaggatgggtaacttttaccaatgctgttacacgtgaaccgatctacacttttacagcgagcttcacacgcaaggtaattccattttttggcttatggggccgggggagttccttcagcctctccagttag

SEQ ID NO: 27121 - DNA, 597 bp, Artificial Sequence
  Description of Artificial Sequence: Synthetic coding sequence
atgaccctgcggtgcctggagcccagcggcaacggcggcgagggcacccggtctcaatgggggactgcaggcagcgcagaggagccttctccacaggcagcacgactcgcaaaggccctacgtgagctcggacagacaggctggtactgggggagcatgacagtcaatgaggctaaagagaaactcaaagaagccccagaaggaacattccttatacgtgattccagccacagtgattatctgctgaccattagtgtgaagacaagcgccggaccaaccaacctacggatagagtaccaagacggaaaattcagacttgactcgataatctgcgttaagagcaagcttaagcaatttgattccgtggttcatcttatcgattattatgtacagatgtgtaaagataagagaactggccctgaggctcctcggaatggtacggtccatctgtacctgactaaaccgctgtataccagcgcaccttctctacagcacctgtgccgcctgacaatcaacaaatgtactggcgctatttggggcctgccactgcccacacggctgaaggactatctcgaagagtataaattccaggtgtag

SEQ ID NO: 27122 - DNA, 345 bp, Artificial Sequence
  Description of Artificial Sequence: Synthetic coding sequence
atgaccacccggcaggccaccaaggaccccctgctgcggggcgtgtcacctacgccatccaaaatccccgtgcggtctcaaaaaagaactccctttcctactgtcacctcatgcgccgtggatcaggagaaccaagatcccaggcggtgggttcagaagccacctctgaatatccaacggcccctggtggactctgcgggccccagaccgaaggctaggcaccaagcggagacctctcagcgcctggttgggattagtcagccacggaaccccttggaagagttacggcccagccctaggggccagaacgtgggacctgggccacctgctcaaaccgaggcctag

SEQ ID NO: 27123 - DNA, 1446 bp, Artificial Sequence
  Description of Artificial Sequence: Synthetic coding sequence
atggccagcgccgccagcgtgaccagcctggccgacgaggtgaactgccccatttgtcaagggacactgcgggagccagtgaccatcgactgcggccataacttttgccgtgcctgtctgactcgatattgtgagattcccggcccggatctggaggagtccccaacatgccccctctgtaaagagccttttcgtcccggctctttcagacctaattggcaactggctaacgtggttgagaacatcgagcgattacagctagtctctacattaggcctcggagaggaggacgtatgtcaagagcatggcgagaaaatatacttcttctgtgaagatgatgaaatgcagctgtgtgtcgtgtgtagggaagccggagagcacgctacccacaccatgcggttcctggaagacgccgccgctccatatagagagcagattcataagtgtctgaaatgcctcaggaaagagagggaagaaatacaagagatacaatctcgtgaaaacaaacgaatgcaggtcctgctgactcaggtgtccacaaagaggcagcaggtgatttcagaattcgcacatctccgcaagttcttagaagaacagcaatcaatcctcctagcacagctggagtcccaagacggcgacattctccgccaacgtgacgaattcgacctgcttgtcgctggcgaaatttgtcggtttagcgccctgatagaggaactcgaggaaaagaatgagcgacccgctagagagctgctcaccgatatcaggtctacactgatcaggtgtgagacccgcaaatgtcgtaaacccgtggccgtctcgcccgaactcggtcaaaggattagagacttcccccagcaggcgctgccactgcagcgggaaatgaagatgttcctggagaacctgccaaatcacctagtcatcccgacagcacatatttctcttgacccacagacttcccaccctaaactgttactttcggaagatcaccagcgcgcacaattcagctacaaatggcagaacagccccgacaatccccaacggttcgaccgcgccacctgcgtgctggctcataccggcatcacaggcggaaggcatacctgggtggtgtccattgacttggcacacggagggtcatgcacggtcggcgtggtcagtgaagacgttcagcggaagggcgagttgcggctccgcccagaggagggcgtctgggccgtaaggcttgcttggggcttcgtttctgctttaggatcctttcccacaaggctcacactcaaggagcaacccaggcaggtcagagtgagtttggactacgaggtaggctgggtcactttcactaacgcagtgactagagaacccatctacacctttactgccagctttactagaaaggtgatcccgttcttcgggttgtggggacgtggctcaagtttcagcctttcttcctag

SEQ ID NO: 27124 - DNA, 396 bp, Artificial Sequence
  Description of Artificial Sequence: Synthetic coding sequence
atgagcaagcggtacctgcagaaggccaccaagggcaagctgctgatcattatatttatcgttactctgtggggtaaagtggtatcctcagcaaaccaccacaaggcccatcacgtgaagacaggaacctgcgaggtggtggccctgcataggtgctgtaataaaaacaaaattgaagagagatcacagaccgtgaagtgctcatgttttcccggacaagtcgctgggacaacccgcgcagctccgtcctgtgtcgacgctagtatcgtcgaacagaaatggtggtgtcatatgcagccttgtctggaaggagaggagtgtaaggtgctcccggaccgtaagggttggagctgcagttccggcaacaaagtcaagaccacccgtgtaactcactag

SEQ ID NO: 27125 - DNA, 765 bp, Artificial Sequence
  Description of Artificial Sequence: Synthetic coding sequence
atggtgcgggaggccaacatcaagcaggccaccgccgagaagcagttaaaggaggctcagggtaagattgatgtcctgcaggcggaggtggccgctttaaagacgcttgtgctgagctcatcaccaacctctcctacccaggaacctttaccagggggtaaaaccccttttaaaaagggtcatacacggaataaatcgacaagctcagccatgtcaggtagtcatcaggacctatcagtgattcaacccatcgtaaaggactgtaaggaagccgacctctctctgtacaatgagtttaggttgtggaaggacgagcccaccatggatagaacctgcccatttctcgataaaatctaccaagaggacattttcccctgtctgacctttagtaaatccgaattagccagtgccgtcttagaggctgtcgagaataacacattaagtatcgaacctgtaggcctccaacctatacggttcgtgaaagcctcggcggtggaatgcgggggcccgaagaagtgcgctttaactggacagagcaagtcatgcaaacacagaattaagctgggagatagcagtaattattactacatatctcccttttgcaggtataggattacgtctgtgtgtaatttcttcacatatatccgctacatccaacaggggctggtcaaacagcaggatgtcgatcagatgttctgggaggtgatgcagttacgaaaggagatgtcattagcgaaactgggctactttaaagaggagctgtag

SEQ ID NO: 27126 - DNA, 2772 bp, Artificial Sequence
  Description of Artificial Sequence: Synthetic coding sequence
atgtgcatccccccccccaacgtgaccggcagcctgcacatcggccacgccttgactgtcgccattcaggacgccttggtgagatggcaccgcatgcgtggcgatcaggtgctgtgggtgcccgggtcagatcacgccggaatagccacacaagctgtggttgaaaaacagctgtggaaagagaggggggtgaggaggcatgaattgagccgagaggctttcttacgtgaggtgtggcaatggaaagaggccaagggcggcgaaatctgtgagcagttgagagctctgggggctagcctggactgggatagagaatgttttaccatggatgtgggcagcagcgttgctgtgaccgaagcgtttgtgagattgtacaaggccggtcttctttatcggaaccaccaacttgtgaattggtcgtgtgccctgagatctgctatctctgatatagaagtggagaatcgacctctacctggacacacacagctcaggctgcccggctgccctacacctgtttcttttggattacttttttctgtagcattcccggtggatggcgagcccgacgcagaagtggtcgtgggcacgacccgaccagaaacactacctggagatgtcgcagttgctgtgcatccggacgactcaaggtacacgcacttacacgggaggcaacttaggcacccactgatgggacaacctctgcccctgatcactgactatgctgtgcagccccacgtggggacaggggccgtgaaggtaactcccgcgcatagtcccgctgatgccgaaatgggggccagacacgggctaagtcctctgaatgtgattgccgaggatggaacaatgaccagtctgtgtggcgattggctgcaggggctccacagatttgtggcccgcgagaagattatgtcagtgctctccgaatggggactctttagaggcctgcagaaccatcctatggtgctgcccatctgttcacggtcgggcgacgtgattgagtatctactgaagaatcagtggtttgtgaggtgccaggagatgggagctcgtgccgcgaaagctgtggaaagtggagctttggaattgtctccaagcttccaccaaaaaaactggcagcactggttcagccacattggcgactggtgcgtgtcccgtcagctctggtggggacatcagataccagcctacttagtcgtggaggaccatgctcaaggcgaagaggattgctgggttgtgggccgctccgaagccgaggcacgcgaggtagcagccgagctgaccggccgaccaggcgctgagttaaccctggaacgagaccctgacgtgttggacacttggttcagctcggccctgtttcccttcagtgcactcggctggccgcaggagacacccgacctggctagattctacccactgagcctgctggagaccgggtccgacctgctcctcttctgggtgggacgaatggtcatgctgggcacacaactgaccgggcagctcccattctctaaggtgttactgcacccaatggtgcgcgacagacaagggaggaagatgagcaagtccctaggaaatgtgctcgacccacgtgatattatctcaggggttgagatgcaagtgctgcaagaaaagctccgaagtgggaatctggatccggctgaattggctatcgttgccgccgcccagaagaaagactttccccatggcattccagagtgtggaacggacgccttgcgctttaccctgtgctctcatggagtgcaagccggagacctccatttatcggtaagtgaagtacagtcctgccggcacttttgcaataaaatctggaatgcactgcgctttatactgaacgcgctcggagaaaaattcgttccacagcctgctgaagaactcagcccttcctcccctatggatgcttggatactatctaggctcgcattggctgcgcaggagtgcgaaagggggtttttgacccgggaactgtcactggtgacacacgccttacatcatttttggctgcataacctgtgcgatgtctaccttgaggcagttaagcccgtgctgtggcactcaccgcgtcctttagggccaccacaggttctgttctcctgtgctgatcttggattacgactgctggctcctctgatgccttttttagcagaagaactgtggcagagactgcctccaaggcccggttgccctcccgcaccttcaatatcagttgccccctatcccagtgcctgcagcctggagcactggaggcaaccggagctggagagaagattttctagggtgcaggaagtggtccaggtactgcgggcactgagggccacgtaccagcttacaaaagcccggcccagggtgctcttacaatcctcggagcccggcgaccagggcctctttgaagcgttcctggagcccctgggcactcttggctattgtggcgccgtgggcctcctcccaccgggtgcggctgcaccaagtggctgggcacaagccccattgagtgacacagcccaggtatatatggagctgcaagggctcgtcgacccacaaatacagctgcccctgttggcggctagacggtacaaactccagaaacagctggattctttgaccgcaaggacacccagtgaaggcgaggcggggacacagcgccagcagaaactatcgagcctgcagttagagctttccaagttagacaaagctgcctcccacctgaggcagcttatggacgagcctcccgcacctggttctcccgagctctag

SEQ ID NO: 27127 - DNA, 5229 bp, Artificial Sequence
  Description of Artificial Sequence: Synthetic coding sequence
atgatggagggcaacggcaccgagaacagctgcagccggacccggggttggctccagcaggacaacgacgcgaagccatggctctggaagttcagtaattgtttcagccgaccggagcagaccctgccgcattctccacagactaaggagtacatggaaaataagaaggtggccgtcgaattgaaggatgtgcctagccctcttcacgccggaagcaaactgttcccagctgtgccacttcctgacataagaagcctgcagcagcccaaaattcagctgagctctgttcccaaagtatcatgttgcgcccattgccccaatgagccttctactagccctatgaggttcggcgggggaggcggtgggtccggcggaacatcaagtttgatccatccaggagcactgttggacagccagtctaccagaaccataacttgtcaggtgggatcaggttttgctttccagagtgcctccagccttcagaacgcctccgccagaaacaatctcgccggcattgcctccgatttccctagcatgtgcttagaatcaaatcttagctcctgcaaacacctgccgtgctgtgggaagctgcactttcagtcctgccacggtaacgtacataagctgcaccagttcccaagtctgcaagggtgcactagcgcaggatatttcccctgttccgactttacaagtggcgcgcctggccatctggaagagcacatcagtcagagcgagctgaccccccacctgtgtactaatagcctgcatcttaatgtggtaccccctgtatgcctgaaagggagcctctattgtgaggactgcctgaacaaaccggcaaggaactccatcatagatgcagccaaagtttggcccaatatccccccgccgaatacccagcccgccccattagccgtgcctctgtgtaatggttgtggtacaaaaggcacgggcaaggagactaccctgctgctggctactagtctaggcaaggccgcctctaaatttggcagtcccgaggttgccgtagccggtcaggtgttagagaacttgccacctatcggggttttctgggatattgagaattgtagcgtgccctccggccgcagcgcaaccgccgtggtacagcgaatcagggagaagttctttaaggggcaccgcgaggcggagttcatctgtgtttgcgacatttctaaagagaacaaagaagtgatccaagagctgaataactgtcaggtaaccgtggcccatatcaacgctaccgcaaaaaacgcggccgatgacaaactgaggcagagccttcgtcggttcgcaaatacccacaccgcacccgcaacagtggtactggtgtctacggacgttaatttcgccctggagctgagtgatctacgacaccgccacggatttcatattatactcgtgcataagaaccaggccagcgaagctctcctgcaccacgcaaatgagctgatccgctttgaagagttcattagtgacttgccgccgcgattacccttgaagatgccgtgccacactctcttgtatgtgtataatttgcctgccaacaaagatggcaagtcagtttcgaacaggctgcgccgattatccgataactgcggcgggaaggttctaagtatcaccggctgttctgctattctccgcttcattaatcaggactctgcggagagagcccaaaaaagaatggagaacgaggacgtgttcggaaatcgcatcatcgtcagcttcacgccaaagaacagagaactgtgcgagactaagagttccaatgccatcgccgataaggtgaaaagccccaagaagctaaaaaacccaaaattatgccttatcaaggatgcatcagagcagagctcgagcgcaaaggcaacccctggaaaaggatcccaagcaaactccggatcagccacaaagaacactaatgtaaagtcgttacaggagttgtgccgaatggagtccaaaaccggccaccgcaattcagagcaccagcaaggacatctgcgactcgtcgtgcccactcacggcaactcaagtgccgcagtgtccacaccaaagaacagcggtgtggcggaaccagtctataaaacatctcaaaagaaagaaaacttaagtgccagatctgtaacttcaagtccagttgagaaaaaagacaaagaagagacagtcttccaggtgagttatccctctgctttttctaaactcgtggcctccaggcaggtgtcccccctgctggcctctcagtcctggagcagttcgcgctcaatgagtccaaaccttctaaacagagcttcccccctcgccttcaacatagccaactcttctagcgaggctgattgtccagacccgtttgctaatggtgctgatgtccaggtttctaacattgattaccgactctcccgcaaggaacttcagcagctactgcaggaagccttcgctagacacgggaaagttaaatcagtggaactgtccccccacaccgactatcagctcaaggctgtggtgcagatggaaaatctgcaagacgctatcggcgcagttaattcactgcataggtataaaatcggctccaaaaagatcctcgtgtccctggctactggcgcggcatcaaagtctctgagtctgctatccgccgaaaccatgtctgtcctgcaggatgcacctgcttgttgtcttcccctctttaaatttaccgatatctacgagaagaagttcggccacaaactcaacgttagtgatctgtacaagttgaccgacaccgtggctattcgggaacagggcaatggcaggttagtttgcctgctgccctcctctcaggcccgccaatctccccttggcagcagccagtcacacgacggaagctcaaccaactgctctcccatcatcttcgaagagctggaatatcacgagccagtgtgtcggcagcactgcagtaacaaggacttttccgagcacgaattcgatccggactcttacaagatccctttcgtgatattgtcactgaagacattcgcccctcaggtgcattcacttcttcagactcatgaggggaccgtgcctctgttatcttttccggactgttacatcgctgaatttggggacttggaggtcgtgcaggagaaccaaggcggggtcccgttggagcacttcataacatgcgtacctggcgtgaacatagccaccgcccagaacggcatcaaggtagtgaagtggattcacaacaagcctccccctccgaataccgacccgtggctgctcaggtcgaaatcgcctgtgggcaacccgcagctgatccaattcagcagagaggtgatagacctgctcaagagccagcctagctgcgttattcctatttcccacttcataccatcataccaccaccacttcgcaaagcagtgccgggtgagcgactacgggtacagcaaactgattgagctactcgaggccgtgccccacgtactgcagatcttgggcatggggagcaaaagactgctaacgctgacccatagagctcaagtgaagcgcttcacccaggacctgcttaaactgctgaagagccaagcctctaaacaggtgatcgtacgggagttttcccaggcataccactggtgcttttccaaggactgggatgtcacggagtacggcgtttgcgaattgatcgacatcgtctccgagattcctgacactaccatatgcttatcgcagcaggataacgagatggtgatatgtattccgaagagggagcggacccaagacgaaatcgaacgcactaaacaattttcaaaggacgtggtggaccttctcaggcaccagccgcactttagaatgccatttaacaagttcatcccatcttatcatcatcactttggaagacagtgtaaattggcatattatggattcaccaagttgctggagttattcgaggccattccggacaccctgcaggtcttggagtgcggggaggagaagatcttaacattgaccgaggtggagaggtttaaagccctcgccgcacagtttgttaaactcctgaggagtcagaaggacaactgtttgatgatgacggatctgcttacggaatacgcaaagacattcggatacaccttccgtctgcaggactacgatgtgtctagcatcagcgccctcactcagaaactctgtcacgtcgtcaaagtggccgacattgagtctgggcggcagatccagcttatcaatcgaaagtccttgagaagtctcacagcgcaactccttgtgctgttgatgagttgggaagggactacccatctgagtgtcgaagagctgaaaaggcactacgaaagcacacataatactcccttgaacccctgcgaatatggtttcatgactctaacagagctactgaaatctcttccttacttggtagaagtgttcacaaacgacaagatggaagagtgcgttaagctaacctcactgtacctcttcgccaagaacgtgcgaagcctcttgcacacataccattaccaacagatcttcctgcacgagttttcaatggcctacaccaaatacgttggggagacgctgcagcctaagacctacggtcactcgagcgtggaggaactcctgggggccattccgcaggtcgtgtggatcaagggccatgggcataaaagaattgtcgtgctgaaaaacgacatgaagtccaggttgagcagcctgagcctaagcccagcaaatcatgaaaatcagccgagcgagggcgagcggattcttgaggttcccgagtctcatactgcatctgagctcaaattaggcgctgacgggagcggcccatcacacacagagcaggaactccttcgcctcaccgacgactcacccgtcgacctgctatgcgcaccagtgccaagttgcctgcctagcccccagttacggcctgatccagtcattcttcaaagcgccgatctcattcagtttgaagaaagaccacaagagccctctgaaattatgattttgaaccaggaagagaaaatggaaatccctatccccggcaaatcaaaaaccttgacttccgattcctcctcttcatgcatcagcgccgctgtcccggtccccccctgtccaagcagtgagacatcagaatccctgctaagtaaggatcccgtggagtcccccgcaaagaaacaacccaaaaatagagtgaaattggctgcaaacttttcgctagccccaatcactaagctgtag

SEQ ID NO: 27128 - DNA, 774 bp, Artificial Sequence
  Description of Artificial Sequence: Synthetic coding sequence
atgccccacctgcccctggccagcttccggccccccttctggggcttaaggcactcaaggggtctcccacggttccacagcgtgtctacgcaatcagaacctcacgggagccccatcagcaggagaaacagggaggccaaacagaagcgcttgagagaaaagcaggccacactggaagccgaaattgctggggaaagcaagtcgcctgcagaatctatcaaagcctggcgtcccaaggagcttgtgctgtatgagatacccactaagcctggagagaagaaagatgtcagtgggcctctgcctcccgcatatagcccgaggtacgtggaggccgcctggtacccttggtgggtaagggagggattcttcaaacctgagtatcaggcccgacttcctcaagctaccggcgaaacattcagtatgtgcatccccccaccaaatgtgaccggcagcctccacataggacacgcactcactgtcgcaatccaggatgcccttgtgagatggcacagaatgcggggcgatcaggtgctgtgggtgcccggctcagaccacgctggaatcgccacacaggccgtggtcgagaaacagctgtggaaggaacggggagtcagacgtcacgagttgagcagggaggcgtttttgcgtgaagtttggcagtggaaggaggctaaaggcggcgaaatttgcgaacaactaagagccctgggcgcgtcacttgactgggatcgcgttttctaccacggttgctggctgctgagcgggtgcgattag

SEQ ID NO: 27129 - DNA, 1134 bp, Artificial Sequence
  Description of Artificial Sequence: Synthetic coding sequence
atggccaccatccccgactggaagctgcagctgctggcccggcggcgtcaggaagaagccagtgtaagaggtagagagaaagcggaacgtgaaagactgtcacaaatgccagcctggaagcgtgggctcttggaacgcagaagagcaaaactaggcctctccccaggagaaccttcacccgtcctggggactgttgaggcaggtccaccagatcctgacgaaagcgcagtcttgctcgaggccatcggcccggtacaccagaatcgctttatcaggcaggaacgccagcagcagcagcagcaacaacagcgttctgaagaattgctggcagagcgtaagcccgggccactagaggcacgtgagagacgcccctccccgggggagatgcgggatcagtctccgaaggggagagagagcagagaggagaggctgagcccacgcgagacacgcgaaaggcggctcggcatcggaggcgcccaagagctgtctcttaggcccctcgaggcccgggattggagacaaagtccaggcgaggtgggtgaccggtcaagcagattgtccgaggcctggaagtggcggctttctcctggcgaaaccccggagcgatctctcagactggcggaaagtcgggaacagagtcctaggcggaaagaggttgaaagcagattgagcccgggcgagtccgcttatcagaagctgggcttaaccgaggcccataagtggcggccggacagtagagagtcacaggagcaaagcctcgtgcagcttgaggccacagagtggagactgcggagtggcgaggagcgacaggattactcggaggagtgcgggaggaaagaagaatggccggtacccggggttgcccccaaagagaccgccgagctctcggagaccttgacccgagaagctcagggcaattcttccgccggcgtcgaggcagccgagcaacgacccgttgaagacggcgagcgaggcatgaagccgaccgagggctggaagtggactttgatcatgtcgctagccggaaaggggaatcaacacctagtgacatgttttccacatccagtgtcaggcggaagagcaaactgtcctatctcgactctcatacagtctccatggtgcggatggggctag

SEQ ID NO: 27130 - DNA, 495 bp, Artificial Sequence
  Description of Artificial Sequence: Synthetic coding sequence
atgcggatcctgatcctgggcctggacggcgccggcaagaccaccatactgtacagattgcaggttggcgaggtagttacaacaattccaaccataggatttaacgtcgagaccgtgacctataaaaaccttaagtttcaggtctgggacttaggcggacagacttctataaggccatactggcgatgttactattcgaacactgacgctgtgatttacgtcgtcgactcctgtgaccgggatcgcatcgggatttcaaagtcagagttagtcgctatgctggaggaagaagagctccggaaggctattttggtcgtgttcgctaacaagcaggacatggaacaggcgatgacgtcctccgagatggctaatagtttagggctcccagccctgaaagaccgaaagtggcaaatctttaaaactagcgccactaagggaacgggccttgatgaggcgatggagtggctagtggagaccctcaaatcacgtcaatag

SEQ ID NO: 27131 - DNA, 393 bp, Artificial Sequence
  Description of Artificial Sequence: Synthetic coding sequence
atggacaccatgatgctgaacgtgcggaacctgttcgagcagctggtgcgacgagtggagatactgtcggagggaaatgaagttcagtttatccagcttgcaaaagatttcgaggacttccgaaagaagtggcaacgcactgatcatgaactgggtaagtataaggatctgttgatgaaggcggaaactgaaagatccgctctagatgtaaagttaaagcacgcacgcaaccaggtggatgtcgagataaaacggcgccagcgggctgaggccgattgcgaaaaactggaacgccaaatccagttgatccgagagatgttgatgtgcgataccagtggctccattcagctgtccgaggaacaaaagagtgcgttagcatttcttaacagatag

SEQ ID NO: 27132 - DNA, 324 bp, Artificial Sequence
  Description of Artificial Sequence: Synthetic coding sequence
atggacaccatgatgctgaacgtgcggaacctgttcgagcagctggttcgtagagtagagatcttgtccgaaggaaatgaagtacagttcattcagctggctaaagactttgaggattttcgaaagaagtggcagaggactgatcatgagctaggcaagtacaaggatctgctcatgaaagccgagacagagcggagtgcactggacgtaaagctgaagcacgctcggaatcaggtggatgtcgaaattaagcgcaggcagagggctgaagcagactgtgagaagctggagcgccaaatccaactcatcagagagatgctgtag

SEQ ID NO: 27133 - DNA, 885 bp, Artificial Sequence
  Description of Artificial Sequence: Synthetic coding sequence
atggacaccatgatgctgaacgtgcggaacctgttcgagcagctggtgagacgcgtcgagatcttgagtgaggggaatgaggttcaattcatccagctagctaaagattttgaagattttcgcaagaagtggcaaagaaccgaccatgagctgggtaagtacaaagacctgcttatgaaagctgaaactgagaggtctgctctggacgttaagctgaagcatgctcgcaaccaggttgatgttgaaattaagcggaggcagagggccgaagccgactgcgagaaactggaaaggcagatccaattgatccgggagatgctgatgtgcgacacttcgggaagtatacagctgtctgaggaacagaagtccgccctcgcatttctgaataggggccagcccagttcaagcaacgccggaaacaaaaggctaagcaccatcgacgagtccggaagcatactctctgacattagctttgacaagacagatgaaagtctagattgggatagtagtctggtgaaaaccttcaagctgaagaaaagagagaaacgccggtctacctcgcgacagtttgtggacggcccacctgggcccgtgaagaaaactagatcgattggatcagctgtggatcaggggaacgaatctatcgtggccaagacaaccgtcacagtgccaaatgatggaggaccaatagaggcagtctccaccatcgagaccgttccttactggacacgcagccgtaggaagaccgggactttacaaccctggaacagcgacagcaccctaaacagtagacagctcgagcctagaactgagacagactctgtaggcacacctcagtcgaacggggggatgcgcctgcacgacttcgtgtctaagaccgtctag

SEQ ID NO: 27134 - DNA, 504 bp, Artificial Sequence
  Description of Artificial Sequence: Synthetic coding sequence
atggaggagacctacaccgacagcctggaccccgagaagctgctgcagtgtccctacgacaaaaatcaccaaatcagggcttgccgctttccttatcaccttattaagtgcagaaagaatcatcctgacgtcgcaagcaaactggccacttgtccgtttaatgccagacaccaggtgccacgcgctgagatctcccaccatatttctagctgcgatgaccgctcttgcatcgagcaggatgtagttaatcaaacaagaagcttaagacaggaaacccttgccgaatctacatggcagtgtcccccctgtgacgaggactgggataaggatctctgggagcagacttcaacccctttcgtctgggggactacacattacagcgacaacaatagccccgctagtaacatcgtcacagagcataaaaacaacctggcttctggaatgcgggtgcccaagagcctgccctatgtcttgccatggaagaacaatgggaatgcccaatag

SEQ ID NO: 27135 - DNA, 882 bp, Artificial Sequence
  Description of Artificial Sequence: Synthetic coding sequence
atgctgcgggagccccggaagcagggcctggccggccgggcccacctgctctccccaggcacaacaggctccatgaaaacccccgtagagcttgcggtgtctggtatgcagaccttggggctgcagcaccggtgcagggggggctatcgcgtcaaagcccgtacatcgtatgtggatgagacattatttgggtctcctgctgggaccaggcccaccccgcccgatttcgacccgccatgggttgagaaagccaatagaacaagaggagtgggtaaggaggcctcaaaggctctgggggctaagggatcctgtgaaactactccctccaggggctctactcccacgcttacgcccagaaaaaagaataaatacaggcccatttcacacaccccaagttattgtgacgagtccttatttggatctaggagcgagggtgcctcgtttggggcccccagaatggctaagggtgacgctgctaagcttagggccttactctggacacccccccccactcctcgcggcagtcatagtccaaggccgcgggaggcgccattgcgggcaattcaccccgcggggccaagcaaaacggaaccagggcctgctgctgactcccagaaactgagcatgggcgggttgcactctagcaggccactaaagcgcgggctttctcactcgctcactcacctgaatgtaccaagtactggccaccccgcaactagtgcacctcacactaacggtccgcaggatctccgaccgtcaacttccggggtcacttttcggtcgcctttagtcacctccagagcccggagcgtgagtataagcgtaccttctactccacggagaggcggcgctactcagaaaccaaaacctccatggaagtag

SEQ ID NO: 27136 - DNA, 3282 bp, Artificial Sequence
  Description of Artificial Sequence: Synthetic coding sequence
atgggcggcaaggcctggccccggcgggccgtgggcaccgccggcggtccttgcgccgagcagatttcagcgcccttccaaaccctcctgatgccccatctgccattagcgtccttccgacctcctttctggggactgaggcactctaggggactgccaagatttcattctgtatcgacacagtctgagcctcacggtagtccaattagcagacggaaccgtgaagccaaacagaaaaggcttcgcgagaaacaggccaccctggaggcagaaatcgctggagagagcaagagcccagccgaatccatcaaagcctggcgaccaaaagaacttgtactctacgagataccaacaaagcccggggaaaaaaaggatgtctctggacccctacccccagcttattcaccacgctacgtcgaagctgcatggtacccttggtgggttcgtgaaggattcttcaagccagagtaccaagcccgtctgccacaggccaccggcgagaccttttcgatgtgcatccctccgcccaacgtgaccggatcattgcatatcggtcacgccctgactgtggctattcaggacgctcttgttcggtggcaccggatgagaggggatcaggtcctgtgggttccaggttcagatcacgcaggaatcgccacccaagccgtggttgagaagcagctgtggaaggaaagaggagtcaggcggcacgagttgagcagagaggcttttttgcgggaggtatggcagtggaaagaagcgaagggcggcgagatttgcgaacagctgcgagctctgggtgcttccttggattgggacagagagtgcttcacaatggatgtgggatccagcgtggcagtgacagaggcttttgtcagactgtacaaggcagggttactgtatcgcaaccatcagctggttaactggtcttgtgcccttagaagtgccattagcgatattgaagtggaaaaccgtcccctgcctggccacactcagctacgactccctggctgtccaacgccagtgtcattcggactcctgtttagcgtcgcctttcccgttgatggcgagcccgacgcagaggtcgtggtgggtacaacccgccccgagaccttaccaggtgacgtcgcagtcgcggtgcaccctgacgactcgcggtacactcacctacatggccgacagctcaggcaccccctcatgggacaaccgcttcccctgatcaccgattacgcggtgcagcctcacgtcggtacaggcgcagtcaaggttacgccagctcattctcctgccgacgcagagatgggggccaggcatggtctatcaccgctaaacgtgattgcagaggacggcacaatgaccagcttatgcggcgactggttacaggggcttcatagattcgttgcacgggagaagataatgtccgtgctctccgagaggggtttgttcagagggctgcagaatcacccaatggtgttacccatatgtagcaggtctggagacgtaatcgaatacctgcttaaaaaccagtggttcgtccgttgccaggagatgggcgcccgagccgcgaaggcggtagagtccggagccttggagctttcccctagcttccaccagaagaactggcagcactggttcagccatatcggggactggtgcgtgtcccgccagctctggtggggccatcagatccccgcctacctggtagtcgaggaccacgcccagggggaggaggattgttgggttgtcggtcgttcagaggccgaagcgagggaagtcgctgcagagctgactggtagacccggcgccgaacttactctggaacgagacccagatgtgttagatacatggtttagtagcgccctgtttccgtttagtgcacttggttggccccaagaaacgccggatctggcccggttctaccctttgagtctgctcgagaccggaagtgatctgctgctgttctgggttgggagaatggttatgctcggcactcagcttaccggccagctgccattttctaaagtgctcttgcatcccatggtgagagaccgccagggcagaaagatgagcaagtccctgggtaatgtgctcgaccctagggatatcatcagtggggtcgaaatgcagcttctccaagagaagttgaggtccggaaatctggaccccgcggaactggcaatagtcgcggccgcgcagaaaaaggatttcccacacgggatccctgagtgtgggacagacgccctgaggtttaccctatgcagtcatggagtgcaggctggtgatctccacctttctgtatcggaggttcagagctgtaggcacttttgcaataagatctggaacgctttacgttttattttaaatgcgctaggcgaaaagtttgttccacagcctgccgaggagctgtctcccagctctccgatggacgcttggatcctcagccgccttgccttggcggcccaagagtgcgaacgtggcttcttgacacgggaattgagccttgtcacacacgccctgcaccatttctggttacacaacctctgcgatgtgtacttggaagccgtcaagccagtcctgtggcactcaccacgaccgcttggacctcctcaggttctcttcagctgcgcagatctcggtcttagactccttgcgcctctgatgccttttctggctgaagagctttggcagagattgcctccacgtccaggatgcccacccgcacccagcatttcagtagccccctacccatcggcctgttctctcgaacactggcgtcagccggaactggagaggcggttctcaagagtccaggaagtggttcaggtgctgcgggctctcagagccacctatcagttgaccaaagctcggcccagagttctgttacagagtagcgagcccggggatcagggcctgttcgaggcctttttggaaccacttgggacacttggatactgcggcgctgtggggttgctacctcctgggaccgccgccccctccggctgggcccaagctccactgtccgatacagcgcaggtctatatggagttacaaggcttggtggatccacagatccagcttcccctgctcgctgcaagacggtacaaactccagaaacagttggacagtctgacagctcggactcccagcgagggggaagcaggaacccagaggcagcaaaagctgtctagcctacaactcgagctctccaaactggataaggctgcgtctcatctgcgccagctcatggatgagcctccagctcctggctcccccgagttatag

SEQ ID NO: 27137 - DNA, 276 bp, Artificial Sequence
  Description of Artificial Sequence: Synthetic coding sequence
atgggcaagaagaccaagcggaccgccgacagcagcagcagcgaggatgaggaagagtacgtggttgaaaaagtactggataggagagtggtcaaggggcaagtggagtatctcctcaagtggaaggggttctccgaagagcacaacacctgggaacccgagaagaacttggattgtccagaactgatttccgaatttatgaagaaatataaaaagatgaaggaaggcgagaacaataagccacgggagaagtctgaaagcaataaacggaagtag

SEQ ID NO: 27138 - DNA, 390 bp, Artificial Sequence
  Description of Artificial Sequence: Synthetic coding sequence
atggccgagctgatccagaagaagctgcagggcgaggtggagaagtatcagcaattacaaaaagatctttcaaaatcaatgtctggccggcagaagctcgaggcacagctcaccgaaaataatattgtcaaggaggagctggcactattagatgggtcaaacgtggttttcaagctgctggggcccgtgttggtgaaacaggagctaggtgaggcaagagctacagtcggcaagcggctggattacatcactgctgaaataaagcgctatgaatctcaactgagagacctggaacgacagagtgagcaacagcgcgagacactggcacagctccagcaagagtttcagcgtgcccaggccgcaaaggccggcgctcccggtaaggcttag

SEQ ID NO: 27139 - DNA, 1134 bp, Artificial Sequence
  Description of Artificial Sequence: Synthetic coding sequence
atggccaccatccccgactggaagctgcagctgctggcccggcggagacaggaggaggcctcggtgcgggggcgagagaaggccgagcgcgagagactttcacagatgcccgcttggaagcgaggacttcttgagagacgacgggcaaagctgggtctgagtcctggtgagccaagtccagtattggggacagtcgaggcggggccgcccgaccccgatgagtccgcagttctgttagaggcaatcggacccgtgcaccaaaatagatttattaggcaggagcgccaacagcagcagcaacaacaacagagaagcgaggaactgcttgctgagcgaaaacccggaccactggaggcacgcgaaagaagaccatctccaggggagatgcgtgaccaaagccctaaggggcgagagagtagggaggaaagactgtctccgcgtgagacccgcgagcgtcgactggggatcgggggagctcaggaactgtcactaaggccactcgaagccagagactggaggcagtcacccggtgaggtcggcgatcgctctagccgtctgtctgaggcatggaaatggaggctgtcgcctggtgagacacctgaacggtcgctgcggttggctgagtcccgcgagcagtctcctaggcgaaaagaagtagagtcacgactgtcacccggcgagtcagcctatcagaagctgggcctgaccgaggcacacaagtggcgacccgatagtcgagaatcccaggaacaatcactcgtgcaactcgaagcgactgagtggaggctgaggagcggtgaggagaggcaggactacagcgaagaatgcggccggaaggaagagtggccagtcccgggagtggcccccaaggagaccgccgagctatctgagacactgactagagaagcccagggcaattcctccgccggagtggaggccgcggaacagcgacccgtggaagacggagagagaggaatgaagcccactgagggttggaaatggactttgataatgagcttggccggaaaggggaaccagcatcttgtgacatgcttcccgcaccctgtgtcaggggggagagcaaattgcccaatcagcacgctcatccaaagcccatggtgcgggtggggctag

SEQ ID NO: 27140 - DNA, 2031 bp, Artificial Sequence
  Description of Artificial Sequence: Synthetic coding sequence
atgagcgaccagatcaagttcatcatggacagcctgaacaaggagccgttccgtaagaattacaacctcataactttcgacagcctggaacccatgcagttgttacaggtccttagtgacgtgcttgctgagatcgacccaaaacaactagttgacattagggaggagatgcccgagcagaccgcgaagcgcatgctgagtttactgggtatactaaagtataaaccaagcggaaacgcaaccgacatgagtacctttagacaagggctggtgattggttctaaaccagtgatctatccagttctgcactggctcctgcaacggaccaatgagcttaagaaaagggcctacctcgctaggttcctaattaagctggaagtgccctcagaatttcttcaagacgagaccgtggccgatactaataaacagtacgaagagttaatggaagccttcaaaacactgcacaaggagtacgagcagcttaaaatttccgggttttccacagcagaaattagaaaggatatcagtgcaatggaagaggagaaagatcagttgattaaaagagtggagcatctgaaaaagagagtggagaccgctcagaaccatcagtggatgctaaaaatcgcgcggcagctgagagtggagaaagagagggaagaatatctggcacagcagaaacaagagcagaagaatcagctgttccatgctgtgcagcgattgcagcgggttcaaaatcagctaaaatccatgaggcaagccgccgctgatgctaagccggagtctctgatgaagagactagaggaggaaatcaaattcaatctctatatggttacagaaaaattcccaaaggagctggagaataagaagaaggagctccactttctgcagaaagttgtctctgagccggccatgggacacagcgacctactggaactcgagtctaagataaatgagatcaacacagagattaaccagctcatcgagaaaaagatgatgagaaacgagccgattgagggcaaacttagcttgtatcgacagcaggcatcaattatatcacgcaagaaggaagcgaaagccgaagagctgcaggaggcaaaagagaaacttgcgagcctcgagcgggaagcctctgttaaacgcaatcagactcgcgagttcgacggtacagaggtactcaagggagacgagttcaagcgttatgtcaacaagttgcggtctaagagcacagtgtttaaaaagaaacatcagattattgctgagctcaaagccgagtttgggctgctgcagcgcactgaagaactgctgaagcagcgccatgaaaatattcaacagcagcttcagactatggaggaaaaaaaaggcatctcagggtacagctacacacaagaagagttagaacgggtgagcgcactcaaaagcgaggtcgatgaaatgaagggacgaacccttgacgacatgtctgaaatggtcaagaaactgtactctctggtctcagaaaaaaagtcagccctggcgtctgtgatcaaggagctcagacagctgaggcagaaataccaggaactgactcaggaatgtgacgagaagaagagccagtacgatagctgcgcagctggtctggaatctaatcggtccaaactcgagcaggaagttcgccggctgcgcgaggaatgcctacaggaagagtcccgttatcactacacgaattgtatgattaagaacttggaggttcagttgagacgggccacggatgagatgaaggcatatatctcgagcgaccagcaagaaaaaagaaaggctattagggagcagtatactaagaataccgcggagcaggagaatctcggaaagaaactgagagaaaaacagaaagttataagggaatctcatggccccaatatgaaacaagcgaagatgtggagagaccttgagcagctgatggaatgcaagaagcagtgttttctcaaacagcagagccaaacttccatcgggcaggtgatccaagaaggcggagaggatagactgatcctgtag

SEQ ID NO: 27141 - DNA, 456 bp, Artificial Sequence
  Description of Artificial Sequence: Synthetic coding sequence
atggacaccatgatgctgaacgtgcggaacctgttcgagcagctggtgcggcgagtagagattctgtccgagggaaacgaggtgcagttcatccagctggccaaggattttgaggatttcagaaagaaatggcaaaggaccgatcatgagttaggcaaatataaggacctgctcatgaaagctgagactgagcgcagcgcattggatgttaaactgaaacacgccagaaaccaggtcgacgttgagatcaaaagaagacagcgcgctgaagccgactgcgagaagcttgagaggcagattcaactgatccgcgaaatgctgatgtgcgacacttcgggctcaatccagctgagcgaagaacagaaaagcgcacttgcctttctcaacaggggtcagccttcaagcagcaatgccggaaacaagaggttgtcaactatcgacgaaagcgggtcctag

SEQ ID NO: 27142 - DNA, 1446 bp, Artificial Sequence
  Description of Artificial Sequence: Synthetic coding sequence
atggccagcgccgccagcgtgaccagcctggccgacgaggtgaactgtcctatttgccagggtacattacgtgaaccagtcactattgactgtggacacaacttctgccgcgcctgtctcacacgatattgtgaaatccctgggccagacttggaggagagccccacatgtcctttatgcaaagaacccttcaggccgggctctttccgcccgaactggcagttggccaacgtggttgagaatatagaaaggctgcagttggtatccaccttagggctaggcgaggaggacgtatgccaagagcatggggaaaaaatatatttcttttgcgaagatgacgaaatgcaattatgcgtggtctgtcgggaagccggagaacatgctactcacacaatgcggtttcttgaggacgccgccgccccttatcgggaacaaattcacaagtgtctgaagtgcctacgcaaggaaagagaggaaattcaggaaatacagtcacgggagaacaaaaggatgcaggtgcttttaacacaggtgagcactaagcggcaacaggtgatcagcgaattcgctcatctcaggaaatttctcgaagagcagcagagcattctgctggcccaactcgaatcacaggacggtgatatacttagacagcgcgacgagtttgatctccttgtagcaggagaaatatgcagattttccgcactgatcgaagaactggaagagaaaaatgagaggccagctcgtgagctcctgaccgacattcgtagtaccctcatccgctgcgagaccagaaagtgtagaaagcccgtcgccgtcagcccagaactggggcagaggatccgagacttcccccagcaggccctgccattgcagagggagatgaaaatgtttctcgagaacctccctaatcatctggtaattccaacggctcatatctccttagatccccagacttcccaccccaaactcctgctctccgaggaccaccagcgggcgcagttctcctacaaatggcagaacagtccagataatcctcagcggttcgatagggctacttgcgtcttggcccataccggaatcacaggcgggcgccacacctgggtcgtctctattgatttagcccacggcggttcctgcacagtgggtgtggtgtcggaagacgtgcagagaaagggagaactgcggctgcgacccgaggagggggtctgggctgtgcgcttggcatggggtttcgtcagtgccctcggaagttttcctactagactgactctgaaagaacagccccgccaggtccgcgtgtctcttgactacgaggttggctgggtaacctttacgaacgcggtcacaagggagcccatatatacctttaccgcatcctttaccaggaaggtcatacccttcttcggcctgtgggggcgaggaagctccttctcactcagctcttag

SEQ ID NO: 27143 - DNA, 765 bp, Artificial Sequence
  Description of Artificial Sequence: Synthetic coding sequence
atggtgcgggaggccaacatcaagcaggccaccgccgagaagcagttgaaagaggctcagggcaaaatagacgtcctgcaagcagaggtagccgccctgaagacgctggtgctctctagctctccaacttcccctactcaggagccgctgcccggaggcaaaacacccttcaaaaagggacacacaagaaataagtccaccagcagtgcgatgtccggatctcaccaggatttatccgtgattcaacccatcgtcaaagattgcaaggaggctgacctgtcactttataatgaattccgcctttggaaggatgagcctacaatggaccgaacatgtccctttctagacaagatctaccaagaggacatcttcccatgcctgacattttctaaatccgaactcgccagcgctgtgctcgaggccgttgagaataacacattgtccatagagccagtcggtttgcagcccattagattcgtgaaggcttccgccgtggaatgtggcggtccaaagaagtgcgccctaaccgggcagtcaaaaagctgcaaacatcgcatcaaattgggtgattcgtccaactattattatatatcccctttttgcaggtaccgcatcacctcagtctgcaacttcttcacgtacatccgctatattcagcaaggcctggtgaagcagcaagatgtggaccagatgttttgggaagtcatgcagctgaggaaagagatgtccttggccaaacttggatactttaaggaagagttgtag

SEQ ID NO: 27144 - DNA, 1446 bp, Artificial Sequence
  Description of Artificial Sequence: Synthetic coding sequence
atggccagcgccgccagcgtgaccagcctggccgacgaggtgaactgtcccatttgtcagggaaccctcagggagccagtgacgatcgactgtggtcacaacttttgtcgcgcctgcctgaccagatactgtgagatccctggacccgacctggaagaaagccccacgtgcccactgtgcaaagaaccttttcgccctgggtctttccggcctaattggcaactggccaatgtggtcgagaacatcgagagattacagctggtctctacccttggactgggggaggaggatgtgtgtcaggaacacggagagaaaatctatttcttctgtgaagacgacgagatgcaattatgcgtcgtctgccgcgaagccggagaacacgccacacacacaatgaggttcctggaggacgccgcggccccatatagggaacagatccataagtgtcttaaatgtctcagaaaggagcgggaggaaatacaggagatccagtcaagggaaaacaagcggatgcaggtcctccttacccaagtttctaccaaaaggcaacaagtgatctcagagtttgcccacttaagaaagttcctggaggagcagcaatccatccttcttgcccagctggagagtcaggatggggacattctgcggcagcgtgatgagtttgacttactggtcgccggcgagatctgtcggttctccgcgctgatcgaggagctcgaagagaagaatgaacgccccgcgagagaactgctaacggacatccggagcaccttaatccgctgcgagactagaaaatgccgaaagcctgtggctgtgagtcccgaacttggccaaagaataagagatttccctcaacaggctctccccctgcagcgcgagatgaaaatgtttctggaaaacctgcccaaccacctggtcatccctactgcccacataagcctggaccctcagacatctcatccaaagctgctgctgagcgaggaccaccagcgagcgcagttcagttacaagtggcaaaacagccccgacaatccacaacgttttgaccgagcgacgtgcgttcttgcgcacaccgggatcacagggggaaggcatacttgggttgtcagcatagatttggcccacggagggagctgcaccgtcggggttgtatctgaagacgtacagagaaagggtgaactgcgcctgaggcccgaggagggcgtttgggctgtcaggttggcctggggcttcgtctccgcccttggctcattcccaacgcgcctgacacttaaggagcagcctcggcaggtcagggtatccttggactatgaggtcggatgggtaacgttcaccaatgccgtgacgcgggagcctatctacacgttcaccgcgtccttcacgagaaaggttattccattcttcgggctgtggggccgcgggagctccttctcactcagttcatag

SEQ ID NO: 27145 - DNA, 1974 bp, Artificial Sequence
  Description of Artificial Sequence: Synthetic coding sequence
atgctgggccccagctgggacggcgacgaggccgagagcaccggcgagatcatcaggctcggagatactgctcacactttctccctccggagcaatggcgctcagtgccctaatgagatgctgagtaagaaggctctggcgagccccagtagcaaaagtcacgaggacatgctttaccccccctctgtcttgagcaagagtcggacgagctttgttgaggatactgaaaccctctctgtcagtgggatccccaacgcccggaaattgggagaacctataagagccgctatccccctccatcctccgtaccaccctagcgaacctagagccccatgtcctataggtaaggaatacctccatagttcccattgttctcccgccgtcaattctacaggcgagcataccgagttttcaggcgatctggatgatggccttttcctcatctctaagcttcccaagggttcgaaatgggaagtgtatcctgcccaggtgcaaggcccaaggaccaggaagcctccaaagggcaagcgcaacgaaaatcgcgctacggctagttcctgtaactcaccttttcctcagaggccaagaaagaggttaaccgaacaggagctgcatgacgtgagcgagaagctatcacagcgcctctccgagctggattggatgctcaagtccgctctgggcgaccgtatcaaggaaaagaccgatcacaaagaggaaaacactggaaacgaggaagtggaagacggtaccgaggagacgctgtctcagcacagcgatggaatagtggagtatgggcctaaaaagagccggcctggcttgtctatgaggagaaaaccgccttaccgatctcactccttgtctccttctccagttaataagcataaacagttccatctggagaggaagcgccagaggaaaccgagggagaccgatgtccggcagtttcaagctcaggcctttacagaagccttcgagcgcgagctgaggagacataaggtgcaggaaaacatcggaccacttcggatacatgagaaggaagaggaaacagagaaaatataccgtggcgaagctgtcaggaagggaacaccagagtgttctcaaccctggaagatctatagcaggaagacaaccacccagtctctaagaggagggttaccgaaaccaaacaaagcagtgcccatgaaagtttcggagcactcactactgccactcatgctggagcagttcccgtttttgtacgtttcagggccaacccttagcaagatgtggaagcagcaaattgcacaagtagagcagcttaaaaaggaggcctgcagggaaaaccgtagcaaaaagaagcttcaggacgaaatcgaggaagccctgcgcaggcatgatcttcttactacgctggtgaaaaaggagtatgaacataacaagcgcttgcaggattttaaggactgcatcagaaggcagcgtctgactcaatcaaagatcaaggaaaatagacagcaaatcgtacgggcccgaaagtactacgacgactacagagtccagctttgtgcgaaaatgatgcgaatgcgcactcgggaggaaatgatctttaaaaagctttttgaagaggggctgaacatccaaaaacagcggctgcgcgacctgcggaactatgccaaagaaaagcgagacgagcagcggaggcgccaccaggacgagttggattctatggagaactattacaaggaccagtttagcttgctggccgaggcaatctcccaggagcaccaggagttgaaggcgagggaaaaatctcaggcgcagactctccataaagtcaagcgtgaactccgatcgaaaatggagaaggagatccagcagctacaggacatgatcacccagaatgacgatgacgtgttcttcagggagttggaggctgaacggtttcggagccgactgcaactggcctcgtttcaatacagcaagtccccatctctctag

SEQ ID NO: 27146 - DNA, 507 bp, Artificial Sequence
  Description of Artificial Sequence: Synthetic coding sequence
atgcagaccttcctgaagggcaagcgggtgggctactggctgagcgaaaaaaagatcaagaagctgaacttccaggctttcgcggaattgtgtaggaagcgtggcatggaagttgtccagctgaatctcagcaggccaatcgaagaacaggggcccttggacgttatcatccacaagctgaccgacgtgatactggaagctgaccaaaacgatagccagagcctcgagttggtccacaggtttcaagaatacattgacgcccaccccgagacaatcgtcctcgatcccttgccggccatccgcactttgcttgaccgctcaaagtcctacgagttgattcggaaaatagaagcgtacatggaagacgatcgaatctgctccccaccttttatggagctgacctctttatgcggcgatgacaccatgcgcctcttggaaaagaacggtttaacattcccatttatatgcaagacaagggtcgcacacggcacaaattcccacgagtag

SEQ ID NO: 27147 - DNA, 2211 bp, Artificial Sequence
  Description of Artificial Sequence: Synthetic coding sequence
atgctgatccccgccctgcagatcagcgacagcgagagcgtgggcctcgaagatggtatagaacaaagcgcatatctcacagaatctaagatgaacgagtccaagccgggtgactcccagaatctcgcatgcgttttctgccggaaacacgacgactgcccaaataaatatggcgagaagaagaccaaagagaagtggaacttaaccgttcattattattgcctcctaatgtcatccggcatctggcagaggggcaaggaagaggaaggtgtgtacggtttcctcatcgaggacatcagaaaggaagtgaaccgtgcttcgaagctgaaatgttgtgtgtgtaagaaaaatggtgcttccatagggtgcgtcgcccctaggtgcaagaggagttatcatttcccttgcggtctccagcgggaatgcatcttccaatttaccggaaacttcgcgtcattctgctgggaccataggcccgtacagataattacaagcaacaactaccgcgaatcactaccttgtaccatctgtttggaatttattgaaccgatcccatcatataatatccttcgcagcccgtgctgcaagaatgcttggtttcaccgcgattgtctccaggtgcaggctattaatgccggcgtgttcttctttcgctgcactatatgtaataacagtgatatcttccagaaggagatgctgcgtatgggcatccatatcccagaaaaggacgcttcctgggagctggaagaaaacgcataccaggagctgctacaacattacgaaaggtgcgatgttcgcaggtgccggtgtaaagagggaagagattacaacgcgcctgactctaaatgggaaattaaacgctgccaatgctgtggatcaagtggaacgcatctggcctgcagctccctgaggagttgggagcaaaattgggagtgcctggaatgtcgaggcatcatctataactctggggaatttcagaaggcgaagaagcatgtgttgcccaacagcaataacgtgggcattacagactgcctcctcgaggaatcatccccaaagctgccccggcagagccctggttcccagtcaaaagacctcctgaggcagggctcgaaatttcgacgcaacgtttctaccttactcatcgaattgggcttccagatcaaaaagaaaactaagcgactgtacattaacaaggctaatatttggaattcagcgttagacgctttccgcaaccggaacttcaaccccagctacgccatcgaagtagcctacgtcattgaaaacgataatttcggctcggaacaccccggctccaagcaggagttcctgtccctgttgatgcagcatctcgagaactcatcactgtttgaaggatctcttagcaaaaatctctctctgaactctcaggccctgaaagagaacttatactacgaggcgggcaagatgctggcgatttcgctggtccatggaggcccttccccaggtttcttcagtaagactttgttcaactgcttggtctacggacccgaaaatacacaaccaatattggatgatgtcagtgattttgacgttgcgcagattataattaggatcaacaccgcgactacagtggccgatctgaaatcaatcataaatgagtgttataactacctggagctgatcggctgcttgcggttgatcacgaccctgtctgacaagtacatgctggtgaaggatattctgggctatcacgtgattcaaagggttcacacgccctttgagtcgttcaaacaggggttgaaaaccctaggagtgctggagaagatccaggcttaccctgaggccttttgttccatcctgtgccacaagcccgagtcactgagtgccaaaatcctgagcgagctctttacagtgcacactctaccggacgttaaagctctcgggttttggaatagttacctgcaagcggtagaggacggcaagtcgaccaccactatggaagatattctgattttcgccaccggctgctctagtattccacctgctggcttcaaacctacgccgtccatagaatgcctccatgtggactttcccgttggaaacaagtgtaacaattgccttgcaattcctatcacaaatacctacaaggaatttcaggagaatatggacttcaccatcagaaacactctgaggctagagaaagaagagtccagccactacattggccattag

SEQ ID NO: 27148 - DNA, 1131 bp, Artificial Sequence
  Description of Artificial Sequence: Synthetic coding sequence
atggccaacagcgccaacaccaacaccgtgcccaagctgtaccggtccgttatcgaagacgtcatcaatgatgtgcgcgatatctttctcgacgacggagtggatgagcaagttttgatggagttaaagacactgtgggagaataagctcatgcagtcccgcgcggtcgacggcttccatagtgaggaacagcagcttctgttgcaggtgcagcagcagcatcagccccagcagcagcagcaccaccaccatcatcaccaccagcaagcacaaccacaacagaccgttcctcaacaggcgcagacccagcaagtactcatccccgccagccagcaggccaccgccccccaggtgattgtgcctgactctaagctcattcagcacatgaatgcctcgaacatgagcgccgctgctacggccgccacactggctctgccagcgggggtgacgccggtgcaacaaattctcacaaattctgggcagctgctccaggtcgtcagagccgccaatggtgcccagtacatctttcagccccaacagtctgtggtgctgcaacagcaggtgattccccaaatgcagcctggaggagtgcaagccccggttatacagcaggtactggctccacttcccggggggataagcccccagacaggggtgattatacaaccacaacaaatcctgttcacagggaacaagacacaagtgatcccaaccacggtggcagctcccactcccgcccaggcccaaatcacggctaccggccagcagcagccgcaggcccagcctgcccagacacaggcccccctggtgctgcaggtcgatggtactggcgatacgtcatcagaggaggatgaggacgaagaagaggactacgatgatgacgaggaggaggataaggaaaaggacggagcagaggacgggcaagtagaggaagagcccctcaactccgaggacgatgtgtccgacgaggaagggcaagaactctttgatacagagaatgtggtggtatgtcagtatgataagattcacaggagtaagaacaagtggaagtttcacctcaaggacggcatcatgaatctaaatggccgcgattacatcttctccaaggctatcggggacgccgagtggtag

SEQ ID NO: 27149 - DNA, 237 bp, Artificial Sequence
  Description of Artificial Sequence: Synthetic coding sequence
atggagaccgactgcaaccccatggagctgagcagcatgagcggctttgaagaaggaagcgaactgaatggctttgaaggaacagacatgaaggacatgcgtttggaagctgaggcggttgttaatgatgtgctgtttgctgttaataacatgttcgtttcaaagagtcttaggtgcgccgacgatgtcgcatatattaacgtggaaaccaaggagagaaataggtactgcttatag

SEQ ID NO: 27150 - DNA, 747 bp, Artificial Sequence
  Description of Artificial Sequence: Synthetic coding sequence
atggccttcagcggccgggcccggccctgcatcatccccgagaacgaggagattcccagggctgcactgaataccgtgcacgaagccaacggtacagaggatgaacgggcggtgtcgaaactgcaaaggaggcactctgatgtgaaggtgtacaaagagttttgcgacttttacgccaagtttaatatggcaaacgcattggcctccgccacctgtgagcgttgcaaagggggctttgcccccgccgaaacaattgtgaactccaatggcgaactgtatcacgagcagtgctttgtctgtgctcaatgtttccaacagttcccagaaggccttttttatgagtttgaggggcggaagtattgcgagcacgatttccagatgctttttgcaccatgttgccaccagtgtggcgaattcattatcggaagggtgatcaaggcgatgaacaactcatggcaccctgagtgcttccggtgcgacctttgccaggaagtgctcgccgacatcggcttcgttaaaaatgccgggaggcatctgtgtcgaccatgtcataaccgggagaaagctcgcggtctagggaagtacatttgtcaaaaatgtcatgctataattgacgagcagcctctcatcttcaagaacgatccttaccacccagatcactttaactgcgcaaattgcggccaggaaggaagcgactgtaggtgcactggagccgaacgcggagccatactgcctgccatgccgtag

SEQ ID NO: 27151 - DNA, 2370 bp, Artificial Sequence
  Description of Artificial Sequence: Synthetic coding sequence
atgagcgcccagaccagccccgccgagaagggcctgaaccccggcttaatgtgtcaggaatcgtacgcctgtagcggcacagatgaggcaatcttcgagtgcgacgaatgctgctctttacaatgtctcagatgtgaagaggagctgcatcggcaggaaagactgcggaatcacgagcgcattcgactgaagcctgggcatgtcccatactgtgatctgtgcaagggattaagcggacacctgccaggggtgaggcagagagctatagtccgctgccagacgtgcaagattaatctttgcctggagtgtcagaagcggacacattcaggagggaacaaaagaaggcatcccgtgaccgtgtataatgtgagcaaccttcaggagagtctggaagccgaagaaatggatgaagaaaccaagcgcaaaaaaatgacagaaaaagtggtgtcttttctgttagtggatgaaaacgaagaaatccaggtgactaatgaggaagatttcatcaggaagctggactgtaaaccagaccagcacctgaaggttgtgtcgatctttggcaatacaggagacggcaaatcgcacactctgaatcacacgttcttctacggcagagaggtgttcaagacttctcccacccaggagtcttgtactgttggcgtgtgggccgcttacgaccccgttcataaagttgcagtcatagacaccgagggactgctgggcgcaactgtcaatctgagtcagcggacacggctgcttctgaaagtccttgccattagcgatctggttatctatcggacacatgctgacagactgcataatgatctgtttaagtttctgggggacgcatcagaggcctacctgaagcatttcactaaggaactgaaagccactacagctcgatgcggcttagatgtgccactttctactcttggacccgcggtcattattttccatgagaccgtgcatacacagctactcgggtccgatcacccatctgaggtgcctgaaaagctcatccaggaccgcttccggaaattaggccggttccctgaggctttctcatcaatccattacaaagggacaagaacttacaatccccccaccgatttctccgggctgaggcgagcgctcgagcagcttctcgagaataatacaactagaagcccgaggcaccctggagtgatattcaaggcgctcaaggccctgtccgaccgctttagtggggaaatcccagacgatcagatggctcactcctctttttttccagacgagtacttcacatgcagttctctgtgtctcagttgtggcgtgggttgcaaaaagagcatgaaccatggaaaggagggtgttcctcacgaggccaagtctagatgccgttattcccatcagtacgacaaccgagtctatacctgcaaagcttgctacgagcggggggaagaggtgtctgtcgtcccaaaaactagcgcctcgacagattcaccgtggatgggtctcgctaaatatgcatggtccggatatgtaattgaatgtcccaactgtggcgtggtctatcgatccaggcagtattggtttggaaatcaagaccccgtggatactgtggtgcgtaccgagattgtccacgtatggccgggaacagacggctttctgaaagataacaacaacgccgcgcaacgcctgcttgatgggatgaacttcatggctcagagcgtgtctgaattgtccctcgggcctacgaaggctgtgacctcgtggttgaccgaccagattgcgcctgcctactggagacccaactctcagatcctgagttgcaacaaatgtgcgacctccttcaaagacaatgatacaaaacatcactgccgtgcatgcggcgagggcttttgcgactcctgcagctccaagacgaggccagtcccagagagaggttggggaccagcacctgttcgcgtttgcgacaactgttacgaagctcgaaacgtacagctggccgtcaccgaagctcaagtggacgacgagggcggcactctaatagcacgcaaagttggcgaggctgtgcagaataccctcggagctgttgtgacggccatagacatccctctggggctcgtcaaagacgcggccaggccagcctactgggtccctgatcacgaaatcctccattgtcacaactgccgcaaagagttctctataaaactcagcaaacaccattgcagagcatgtggccagggtttctgtgacgaatgttctcatgacaggagggcagtgccctcgcgtggatgggaccatcccgttagagtgtgttttaactgtaacaagaagcccgcctggactagcctctccgtcatgacaggcaagggtccactgtgttag

SEQ ID NO: 27152 - DNA, 2271 bp, Artificial Sequence
  Description of Artificial Sequence: Synthetic coding sequence
ctggccggcaacgagaccgagtgggtgaccatcgccaacaacctgctgttcaaatgccacatacacctgcgcatacacgagctacaggactgtgatgccaatgttttcattgccctgtaccagagtatcctgggcgaaaaggtcccagatctaatagtgattccacgcagtcaggaggacgacgcgcataatgtccaggccgtgattgacagcctcgctttggactatcttcaggtgtctctttcccatatcaccgcgctctactctgtgtcacggagaaagtacagtgagaggagaatgctcgggccttcctgggacggtgatgaggccgagtcaactggcgaaatcattcgtctcggagacaccgcccatactttcagcctgaggtccaatggagctcagtgccctaacgagatgctgagcaagaaggccctggcatcgcccagcagcaagtcacatgaggacatgctctaccccccatctgtcttatctaagagccgtacatcctttgtcgaggacaccgagaccttgtcagtttctggaattcccaatgctaggaagttgggggaacccattcgggccgctatccctttacatccgccctaccacccttcagaacctcgcgctccctgtccaatcggcaaggagtacctgcacagtagccactgctcccccgccgtgaatagcaccggggaacataccgagttctctggtgacctagacgacggattgtttctcatctctaaactgccaaaaggatctaagtgggaagtctatccggcacaagtgcagggcccacgaaccagaaagcctcctaaaggtaagaggaacgaaaacagagctaccgccagtagctgtaattctccatttccccagaggcctcgcaaaaggctaacggaacaggaactacatgatgtttctgagaaactgtcacagcgtctctccgaactggactggatgctaaagagcgcccttggcgaccgcatcaaggaaaagaccgatcataaggaggaaaatactgggaatgaggaagttgaggacgggaccgaggagactttgtcccaacactcagacggcatcgtcgagtatggtcccaaaaaatctagaccaggcctgtctatgaggagaaaaccaccttatcgttcacatagcctttccccctcacctgtgaacaaacacaagcagtttcacctcgagcggaaaagacagaggaaaccccgagagactgacgtgaggcagtttcaagcacaggctttcactgaggcatttgaacgcgagctcaggcgccataaagtgcaggaaaatataggcccattacggatccacgagaaggaggaagagacagtggggaaaaacatacagcgccgctcctttgtgaaagagctgcagaatgtggtgagtcctggcagattcacgctggagaaacctcagagaagagtgcgcggaggattgcccaaacccaacaaggcggttcctatgaaggtctctgagcacagcttgctccccctgatgctcgaacaatttccattcttgtatgtatctggtccgacattatctaagatgtggaagcagcagattgcacaggtcgaacagctgaagaaggaggcctgcagggagaacaggagtaagaagaaactccaggatgagatagaggaggcactgcggcgacacgatctactgactactctggttaaaaaggagtacgaacacaataagcgacttcaagacttcaaagactgtattcgcagacaacgactgactcaaagtaagatcaaggaaaacagacaacagatcgtgagggcgcgcaagtactacgacgactacagagttcagttgtgcgctaaaatgatgcgcatgaggacacgagaggaaatgatcttcaagaagcttttcgaggagggactcaatattcagaagcagcggctgagggatctgcgaaattatgcaaaggagaaacgagatgagcaacgacgaagacaccaggatgagctggacagcatggaaaattactacaaggaccagtttagcctgctcgcggaggctatctcccaggagcatcaggaactgaaggcaagagaaaaaagccaggcacagacgttacataaggttaagcgcgagctgcgcagcaagatggaaaaggagatccaacagctgcaggatatgataacccaaaatgacgacgacgtcttcttccgtgaactggaagccgagcgctttaggtctcgtctacagctggcctcgttccagtactctaagagtcccagtttgtag

SEQ ID NO: 27153 - DNA, 420 bp, Artificial Sequence
  Description of Artificial Sequence: Synthetic coding sequence
atggagaccgactgcaaccccatggagctgagcagcatgagcggcttcgaagaaggctccgaactgaacgggttcgagggcactgatatgaaagacatgaggcttgaggcagaggcggtggtcaatgacgtgctcttcgcggtgaacaacatgttcgtgagtaaaagccttaggtgcgcagacgacgttgcttacattaacgtcgaaacaaaagagcgtaaccggtattgcctggagctcaccgaagccgggcttaaagtggtcggctacgcctttgaccaagtggatgaccacctgcagactccgtatcacgaaactgtttatagtttgctggatactttaagccccgcttatagagaggccttcggaaatgctctgcttcagcgactcgaggctctgaagcgggacggccagagctag

SEQ ID NO: 27154 - DNA, 300 bp, Artificial Sequence
  Description of Artificial Sequence: Synthetic coding sequence
atgaccgacacccggcggcgggtgaaggtgtacaccctgaacgaggatcgacaatgggatgatcggggaaccggacacgtttcttcaggctacgtggagcggctcaagggaatgtccctgttggtgcgtgctgaatctgacggttctctcctgctggagtccaagattaacccaaatacagcgtatcagaaacagcaggacacactgattgtgtggtcagaggccgaaaattacgatctggcgctttcatttcaagagaaagccggatgcgacgaaatatgggaaaaaatttgccagtag

SEQ ID NO: 27155 - DNA, 2463 bp, Artificial Sequence
  Description of Artificial Sequence: Synthetic coding sequence
atgaccgacacccggcggcgggtgaaggtgtacaccctgaacgaggaccggcagtgggatgacagaggaacaggtcacgtgtccagcgggtacgtggagcgattaaagggtatgtctctgctggttcgcgctgagtcggatggcagtctgctgctggagagcaaaattaatccgaatactgcctaccagaagcagcaggacaccctgatcgtctggtccgaagctgagaattacgatctggctttgtcttttcaagaaaaagctgggtgtgacgagatttgggagaaaatatgccaggtgcagggcaaggaccccagcgtggatatcacacaggacctggtagatgaatcagaggaggagcggtttgacgacatgagtagtcctggtctcgagctgccgagttgcgaactgtcacgcttagaggaaatcgccgagctcgtagcttcttccctgcctagcccgctgcggcgagagaaactcgccctcgccctcgaaaacgaggggtacattaaaaaattgctggagttattccacgtctgtgaggatcttgagaatatcgaaggcctgcaccacttatacgagatcattaagggtattttcctgctgaaccgaacggcactgtttgaggttatgttctcagaagagtgtatcatggatgtgattggctgcctcgagtatgatccagcgctcagccagcctcggaaacatcgagaattcttgacgaaaactgctaagtttaaggaggttattcccataagcgatcccgaactgaaacagaagatccaccaaacctatcgcgtgcaatacattcaagacatggttctgcctacgccatccgtcttcgaggagaacatgctctcaacactgcactcgtttattttttttaataaagtcgaaattgttggtatgcttcaggaggacgagaagttcttaacagacttattcgcccagctgactgacgaggcaacggacgaggagaagcgacaggagctggtgaacttcttaaaggaattttgtgcattttcccagacacttcagcctcaaaatagggacgccttctttaagacactttcaaacatgggaatcctccccgcactggaagttattcttgggatggacgatacccaggtgagatccgccgctactgatatcttctcctaccttgtggagtataaccccagcatggttcgggagttcgtgatgcaggaagcccagcagaatgacgacgatatcttacttataaacctcataattgaacacatgatctgtgacacagatcccgagctgggcggcgcagtgcaactcatgggactgctgagaactctggtggacccagaaaacatgcttgctactgccaacaagacagagaagaccgagtttttaggctttttctataaacactgcatgcacgtgctgacagcccctttgcttgccaatacaactgaagacaagccatctaaagacgacttccagaccgcacagttgttggcactggtcctcgaactcctgactttttgcgttgagcaccatacataccacatcaaaaactatattatcaataaggatattctgcggagagtgctggtgctgatggcttctaaacatgccttcctggcactgtgcgcccttcgtttcaagcgaaaaatcattggcttgaaagacgagttctataacaggtacattatgaagtccttcctattcgaaccagtggtgaaggcctttttaaacaacgggagcagatacaacctgatgaattcagccattatcgaaatgtttgaatttattagggtggaagacatcaaaagcctgactgctcacgtcattgagaactactggaaagctttggaggacgtcgactatgtccagacctttaaaggcctgaagctgagattcgaacagcaaagagagcgccaggataaccctaaattggactctatgcggtctattttacgaaaccacagatatcgaagggatgccagaacattggaggatgaagaggagatgtggtttaacactgatgaggatgacatggaggacggcgaggccgtggtgtctccatcggacaaaactaaaaacgatgatgatatcatggatccaatctcaaagttcatggagcggaaaaaacttaaggaatctgaggaaaaggaggtgctcctgaaaacaaatctgtctggacgtcaaagcccatctttcaagctctctctctcttccgggaccaagaccaacttgacatcacagtcctccactaccaacctgcctggttctccgggctcacccggctccccaggatctcctggctcacctggaagtgttcctaaaaacacaagccagacagcggcgataacgacgaagggaggtctcgtcgggctggtagattaccctgacgacgatgaggatgatgatgaggatgaggacaaagaggacactctgcccctttcgaagaaagctaaatttgattcctag

SEQ ID NO: 27156 - DNA, 396 bp, Artificial Sequence
  Description of Artificial Sequence: Synthetic coding sequence
atgaacgagagcaagcccggcgacagccagaacctggcctgcgtgttctgccgcaaacatgatgattgccctaacaagtacggagagaaaaagaccaaagaaaaatggaatcttaccgtgcactattactgtcttcttatgagttccggaatttggcaaaggggcaaggaggaggaaggggtctatggtttcttgattgaggacatccggaaggaagtcaatcgagctagtaagttaaaatgttgcgtgtgtaaaaaaaatggagcctccattggatgtgtagcgcctaggtgtaagcgcagttaccactttccttgcggcctccagagggaatgtattttccagtttaccgggaacttcgcttccttctgctgggatcaccggccagtgcaatag

SEQ ID NO: 27157 - DNA, 5934 bp, Artificial Sequence
  Description of Artificial Sequence: Synthetic coding sequence
atggccgcccggagcgcccccagctgccacctgcggctggagtgggtttatggttatcgtgggcaccagtgccgcaacaatctgtactacactgcggcgaaagagattgtgtacttcgtggccggtgtaggagtcgtgtactcccctcgagagcaccgccagaagttttacagaggccattctgatgacattataagtctggctttgcaccccgaacgcgtcctggtcgcaaccgggcaagttgggaaggaaccatatatttgcatttgggattcctacactgtgcagacaatttccgtgctgaaagacgtgcacacacatgggatcgcatgccttgcctttgatctggacggacagcggttggtgtctgtcggtctggactctaagaacgccgtgtgcgtctgggactggaagagaggaaagatgctatccatggcaccaggccacacagataggatctttgacatttcttgggatctttaccagccaaacaaacttgtatcttgcggcgttaagcacataaagttttggtctttatgtggtaacgcccttacgcccaaacggggggttttcggcaagaccggcgatctgcagactatattatgtctggcttgcgccagagatgaacttacgtactccggcgcactaaacggagacatttatgtgtggaagggaatcaatcttatcagaacgatccagggggcccatgccgcgggcatctttagcatgaatgcctgtgaggaggggttcgctaccggcggaagagatggatgcatccgactatgggacttgacatttaagcccataacagtgatcgacctcagagaaaccgaccagggttacaagggcctgtccgtgcgctccgtatgttggaggggtgaccacatcctggttgggactcaggactctgaaatcttcgagatagtggtccaggaacggaacaagccttttctgatcatgcaggggcattgtgaaggagaactgtgggcactggccgtgcaccccactaaacccctggcagttaccggttcagatgatcgctcagtgcgtatttggtctctggtggaccatgccctgatagcccgttgcaacatggaagagcccatccgctgtgcagccgtcaatgccgacggcatccatctggccctgggcatgaaagatggttccttcactgttttgagagtacgagacatgaccgaagtggtccacatcaaggacagaaaggaggctatccacgagctgaagtacagtcccgatgggacgtatctagccgttggctgtaatgattctagcgttgatatctacggcgtggctcaaaggtataagaaagttggcgagtgtttgggtagcctatcttttatcacacatttagactggtcatcggactcccggtacctgcagacaaacgacgggaatgggaaacgcctcttctaccgcatgcccggcggtaaggaagtgacgagcaccgaggaaatcaagggagtgcactgggcgtcctggacctgtgtcagcggacttgaggtgaacggtatctggcccaaatacagcgacattaacgatataaattctgttgacggaaattatatagggcaagtgcttgtgacggctgacgattacggcattattaaactgtttcggtatccgtgtctccgcaagggcgctaagttccgcaagtatatcgggcatagtgcccacgtgacaaatgtccggtggtcacatgattaccagtgggtgatcagtataggaggcgcggatcactcagtgttccagtggaagttcatcccagagaggaagctgaaggatgccgtccatattgcccctcaggagtccctcgccgactcacattcggatgaaagcgactccgatctgtcagacgtgcccgaattagattctgagattgagcaggagactcaactcacataccgccggcaggtgtacaaggaagatctgcctcaactaaaggagcaatgcaaggagaaacagaagtctgccacttctaagcggcgggaaagggcccccgggaactccatccggctgcactttgtgcacgggtataggggatatgactgtcgatccaacttgttctacacccagataggggagatcgtgtatcatgtagccgcagtgggtgtgatctacaatcgacagcagaacactcagcgattttacttaggacacgatgacgacatcctgtgtctcaccattcaccctctgaaagattacgtggccactggtcaggtgggaagagatccaagcatccatatttgggacaccgagactataaaacccctcagtatcctcaaaggccatcatcagtatggcgtgagtgccgtcgactttagcgccgacggaaagaggctagcctccgtaggcatagacgacagccacacagtagtgctgtgggattggaaaaaaggcgagaagctttctattgcacgtggaagcaaagacaaaatctttgtggtcaagatgaacccctacgttcctgacaaactgattaccgccggcataaagcatatgaagttctggcgaaaggccggtggcggactgatcgggaggaaaggctacatcggcacactgggaaagaacgacacaatgatgtgcgcagtatatgggtggacggaagagatggcattctccggcacctcgaccggggacgtgtgcatatggagggatatcttcttggtgaaaactgtgaaagctcacgacggccctgtgttttccatgcacgctctagagaagggtttcgtcacagggggcaaggacggcatagtggctctctgggacgatagtttcgaacgctgcttaaagacatacgccattaagcgggctgcactggccccagggagtaagggattgctactggaagacaatcctagtatccgggcgattagtttaggccatggacacattctggtcgggacaaaaaacggtgagatcctggaggtcgacaagagtggccccataactttgcttgtgcagggacacatggagggcgaagtgtggggcttagccacccatccctacttaccgatttgtgccaccgtctccgatgacaagacattacgaatttgggacttgagcccctcacactgcatgctggccgttcgcaaattaaagaaaggtggtcggtgctgctgcttctcgcctgatggcaaggctcttgccgttggcctcaatgacggatcttttctgatggcgaacgcggacactctcgaagatttagtgtcattccatcaccggaaagacatgatctctgatattagattttcccccggcagtgggaagtatttggccgttgcaagccacgactcttttattgatatatacaacgtgatgtcaagcaagagggtgggcatttgcaagggcgcgaccagctatataacgcacattgattgggatattaggggcaaacttctgcaggtgaacacgggcgccaaggaacagctgttttttgaggcccctaggggcaaaaaacagacgattcctagcgtagaggtggaaaagatcgcgtgggctagctggacctcagtcctgggtctttgttgtgaagggatctggccggtgattggcgaagtgactgatgtgactgcctcatgtttgacatcggataagatggtactcgctacgggcgacgaccttgggttcgtgaaactgtttaggtatcccacaaaggggaagttcggtaagtttaaacgatacgtggctcacagcactcatgtcaccaacgtcaggtggacctatgatgactcaatgctggtcacactaggcggtacagacatgtctctgatggtctggacgaacgagatggagggttaccgggaaaaacgaccttgtgacagtgaggaatccgacatagatagtgaagaagacggtggctacgacagcgacgttacccgggaaaatgagattagctacaccatcagagccctgagtactaatattcgaccaatgcttggcatcaagcctcacctacaacaaaaggagccctcaatcgatgaacgacagggagtggtgaggggaagtaggccaccggtatctagagctccgccccagcccgaaaagctgcagactaataatgttggaaagaaaaagcgacctatcgaggatctggtcctggagctaatcttcgggtatcggggacgagactgtcgcaacaacgtccactacctgaatgatggcgacgacattatctatcatacggcttcagtgggcatcctccacaatgtagcgactggctcacagtctttttaccaggagcataacgatgatatactgtgtctgacagtgaaccagcaccccaaatttattaacattgtggcaactggccaggtgggggactccgccgatatgagtgcaaccgccccatctatacacatttgggacgccatgaataaacaaaccttgtctattctgagatgctaccactcaaagggcgtttgcagcgtttccttctccgctactggcaaactgctgttaagtgtgggcctggatcctgaacatactattactatttggaggtggcaggaaggagccaagatcgcctcaagggctggccataatcaacgcatctttgtagcagagttccgccccgattctgacactcagtttgtgtccgtaggagtcaagcatgtgaagttctggacgctcgcaggccgggcgctcttgtccaaaaagggtttactgagcactcttgaggatgcgcgcatgcaaaccatgctagccatcgcttttggagctaacaacctcacatttacaggtaccattagcggcgatgtgtgtgtttggaaagatcacatcttgtgtcgaattgtcgcaagggcacacaacggtcctgtttttgctatgtacaccacactccgggacggcctcatagtgaccgggggaaaggaaagaccaagtaaggaaggaggtgctgtgaagctgtgggatcaggaacttagacgctgcagggctttcaggctggagacagggcaggctactgattgcgtgaggtccgtatgccgagggaaaggcaagatactcgttggcacgcggaacgccgaaattatcgaggtgggcgagaaaaacgctgcctgtaacatccttgtcaatggccatgtggatggaccaatttggggacttgcaacgcatccctcccgcgacttttttttatccgccgccgaggacggaaccgttcggctgtgggacattgccgataagaagatgctgaacaaggtgaatctcgggcatgcagctcggaccgtatgttactctcccgaaggagacatggtggccatcggcatgaaaaacggcgagtttataatacttctggtgtcaagtctgaagatctggggtaagaagagggataggaggtgtgccattcacgatatacggttctcccccgattcaagatacctagccgtgggctcatcagagaatagcgtcgatttttacgacctgacactgggcccaaccttgaaccgcatttcctattgtaaagatatcccttcctttgtaatacagatggactttagcgctgactcttcctatcttcaggtgagttctggctgttataagaggcacgtttacgaagtcccctccggcaaacatctcatggatcatgcagccatcgataggattacatgggccacttggaccagtattctgggcgacgaagtgttgggtatctggtctcgacacgccgagaaagcagatgtgaactgcgcttgcgtgagccattctgggattagcttagtgacaggagatgatttcggtatggtgaagctgtttgactttccgtgtcccgagaagtttgctaagcataagaggtttctcgggcattccccccacgtaactaacattagatttaccagcggggaccgccacgtcgtgagtgctgggggcgatgactgcagcctgtttgtgtggaaatgtgtgcatacccctcactag

SEQ ID NO: 27158 - DNA, 2502 bp, Artificial Sequence
  Description of Artificial Sequence: Synthetic coding sequence
atgaccgacacccggcggcgggtgaaggtgtacaccctgaacgaggaccgacagtgggacgacaggggcactggccatgtctcaagtggctatgtggagcggctgaagggcatgtcattactggtccgcgccgagtctgacggatctctgctgctggaaagcaaaattaaccccaataccgcctatcagaaacagcaagatactctaattgtgtggtcagaggcagaaaactacgaccttgcgctctctttccaggagaaggccggatgcgatgagatttgggagaagatttgtcaagtccaaggaaaggacccaagcgtcgacattactcaggacctggtggatgagtctgaagaagaacgttttgacgatatgtcctcacctggattagagcttccatcatgcgagctctcaaggcttgaggaaatcgccgagctcgttgcaagttctctgccctctccccttaggagggagaaactcgccctcgcattggaaaacgaggggtacataaaaaagcttctggagctgttccacgtctgcgaggacctagagaacattgaaggactacaccacctatacgagatcataaagggaatcttcctgttgaaccgaacggcccttttcgaggttatgttttctgaggagtgcataatggatgtcataggttgcctcgaatatgacccggcgctgtcacaaccacggaaacacagagaatttctcactaaaaccgctaaattcaaagaagttattcctatctccgatcctgaactgaagcagaaaattcatcaaacataccgtgtgcagtacattcaagacatggttttgccaacacccagcgtgtttgaggagaacatgttgtcgactctgcacagcttcattttcttcaacaaggtagaaatcgttggtatgttacaggaagatgaaaaatttttgaccgacctcttcgcgcagctgacagatgaggctaccgatgaggagaagcggcaagagctggtaaacttcctgaaagaattttgtgctttctcacagactctccaacctcagaaccgggatgccttcttcaagacactgagtaatatggggatactccccgccctcgaggtaattctggggatggacgacacccaggttagaagcgccgccaccgatattttcagctacctggttgagtacaacccttctatggttcgagagttcgtgatgcaggaggcccagcagaatgacgatgtaagtaaaaaacttaccgagcaaaaaattacaagcaaagacattctcctgataaatctgatcatcgagcatatgatctgtgacacagatcctgagctgggaggtgcagtccagttgatgggccttctgaggaccttggttgatcctgagaacatgctggctaccgccaacaagacagaaaaaaccgagttcctgggctttttctacaaacactgcatgcatgtgctcactgcaccactgctggccaataccactgaagacaagccttctaaggatgattttcagaccgcgcagcttctagccctggttctggaacttctgactttctgcgtggagcatcacacataccacatcaagaattacatcatcaacaaggacattctgcgccgcgtgctggtgttaatggcctccaagcacgcgttcctggccttgtgtgctctgagatttaaaagaaaaatcattgggttgaaagacgaattctataaccgctacataatgaaaagctttctgtttgagccagtggtcaaagctttcctgaataacgggtctcgctacaacctcatgaattccgctatcattgaaatgtttgaattcatccgtgtggaagacatcaagtcattgaccgctcatgttatcgagaactattggaaagccctcgaagacgtggactacgtacagaccttcaaggggctcaaattgagatttgaacagcagagagagcgccaggacaatcctaagttggatagcatgaggagtatccttaggaaccaccgttatcgacgggatgccagaaccctcgaagacgaagaagaaatgtggttcaacacggacgaagacgacatggaagacggcgaggccgtggttagtccctcggacaagacaaagaacgacgatgatattatggatcccatcagtaaattcatggaacgcaaaaagttgaaggagagtgaggagaaggaggtcttactcaagacaaacctgagcggtcggcagtcccctagcttcaagctgagcttgtcctctggaaccaagacaaacctaacatcccagtcctcgactacaaacttacctggttctcccggctcccctggaagcccaggaagccctggcagtccggggtcagtgcctaagaatacgagccaaacagcggcaattaccaccaaaggaggtctggtaggcttagtggactatcctgatgatgacgaagacgacgatgaggatgaggacaaggaagatactctgccactgtcaaaaaaggcgaaatttgatagctag

SEQ ID NO: 27159 - DNA, 3987 bp, Artificial Sequence
  Description of Artificial Sequence: Synthetic coding sequence
atgtggcggcggaagcacccccggaccagcggcggcacccggggcgtgctcagcgggaaccggggcgttgagtacggctctggaagaggacaccttgggacttttgagggacggtggcgaaagctgccaaaaatgccagaggctgtgggcactgacccctccacgtctcggaagatggcagagctggaagaagtgactctggacggcaagcccctccaggccctgcgcgtcacagatctgaaagctgctttagagcaacggggacttgccaagtcaggacagaaatcagcactggttaagcgtctgaagggcgcccttatgctagaaaatctccagaagcattccacaccacacgccgcatttcaacctaacagccaaattggcgaggaaatgtcccagaacagttttatcaagcagtacctcgaaaaacagcaagaactgctgcgacagagactggaaagggaggcaagagaagccgccgagctggaggaggcttcagccgagtccgaagacgagatgatccatccggagggcgttgctagcctcctgcctccagacttccagagcagcctcgagcggcctgagcttgaactgtctcgccacagccctcgcaagtctagttctatctctgaggaaaagggggactcagatgacgagaagccgcgaaaaggggagcgacggtcgtcgagggtccgtcaggcaagagccgccaagctgtcagagggaagccagccagctgaggaagaggaggaccaagagacaccttcaagaaatcttcgagtaagggccgataggaatctgaagaccgaggaggaagaggaagaagaagaggaggaagaagaggatgacgaagaggaggagggcgacgatgaagggcagaaatcacgggaggcacctatactgaaagagtttaaagaggagggagaggagatcccaagagtgaaacctgaagagatgatggacgagcgcccaaaaacccgctcccaggagcaggaggtcttggagcgtggtggacgctttacacgatctcaggaagaagcacgaaagtcacacctcgccagacagcaacaggagaaggagatgaagacaaccagccctttggaggaggaggagcgggagatcaaaagctcccagggcctgaaggaaaagtccaagtctccatcaccacctagacttacggaggatcggaagaaggcctctctagtggcactgccagagcagacggcctccgaggaggaaacgcccccacccctgctgacgaaagaagcctcgagtccccctcctcacccccaactgcattcagaggaagaaatcgagcccatggagggacctgctcctgccgtgttaattcaactgagccctcccaacacggatgccgatacccgtgaactgcttgtgtctcagcacacggtacagctggtagggggactgagccccctctcaagcccttctgacactaaggccgagagccctgcagagaaggtgcccgaggagtctgtgttgcctttagtccaaaagagtaccctagcagactactcagctcagaaagatctcgagccggagtcagaccggtcagcccaacctctcccactgaaaatcgaggagctcgctctggcaaaaggcattacagaagagtgtttaaaacaaccatctttggagcaaaaagagggcaggagagcatcgcatactctcctccccagccacaggctgaaacaaagtgctgatagtagctctagccgcagttcctctagctcatccagttcctcgagatctaggtccaggtcccctgacagcagtggaagcagatctcatagccctctgcgcagcaaacagcgagatgtcgcacaggccagaacccatgccaatcccaggggccgccctaagatgggcagccgctctacttccgagtctagaagcagaagtcgatccagatctaggtccgcctccagtaattcacgcaagagcttgagtccgggtgtgtcacgagacagctctaccagctacaccgaaactaaggacccctccagtgggcaggaagtggccacgcctcccgtgccccagctgcaggtgtgcgagcccaaagagcgaacttcgacatcttccagcagcgtccaagcgcggcggcttagtcagcccgaaagtgccgagaagcatgtgacacagcgtttgcaacctgagcgggggagccctaaaaaatgtgaggccgaggaggcagaacctcctgccgcaactcaaccacagaccagtgaaacccagaccagccacctccccgaaagcgaacgcatacaccatacggtggaagagaaggaggaggtgaccatggatacgagtgagaataggcctgagaatgacgtgccggaacctccaatgccaattgcagatcaggtttcaaatgacgatagacccgaggggtccgtcgaagatgaggaaaaaaaggagagcagcttgccgaaatcattcaagcggaagattagcgtggtgtccaccaaaggcgtaccagcaggcaacagcgataccgagggcgggcagccagggaggaagaggcggtggggtgcgtctaccgccacaactcagaagaaacctagcatctcaatcacaaccgagagtctcaaggaggccgtagtggatctgcatgcagacgattcacggattagcgaagatgagacagagcggaacggggatgatggcacacacgataaagggttgaaaatatgccgcacagtaacgcaggtggtacctgccgagggccaggagaacggccagcgcgaggaggaggaggaggagaaggagccggaggctgaaccacctgtgccaccccaggtatctgtggaggtcgcacttccaccaccagctgaacacgaggtcaaaaaagtcaccctaggcgacacactcacacggcggagtataagtcaacagaaatccggtgtcagcatcacaattgatgacccagttaggactgctcaagtccccagtcccccccgcggtaaaattagtaatattgttcacatctccaatttggtcaggcctttcactttgggacagctcaaggagctgcttggccgcactgggacccttgtcgaagaagccttttggatcgataagatcaaaagtcactgcttcgtgacctacagcacagttgaagaagccgtcgctaccagaactgcgctgcatggggtgaaatggccacagtcaaatccaaaattcttgtgcgcggactatgctgagcaggatgagctagactatcatcgcggtctgctcgtggaccgtccttccgaaaccaaaaccgaggagcaaggcattcccaggccactgcatcccccacctcctcctccggtgcagcccccacagcatccccgtgccgagcaacgcgagcaggaaagggccgttcgtgagcagtgggcagaacgggagcgggagatggaaaggcgagagcggacaaggtcggagcgggagtgggatagagataaggtgcgcgaaggtcctaggtcaagatcacgatctcgcgatcggcggagaaaggagagagcaaagagcaaggagaaaaagtccgaaaaaaaggagaaagcacaggaggaaccccccgccaagctgctcgatgatctgttcaggaaaaccaaggcagctccttgcatctattggctcccattgacagattcccaaatcgtgcaaaaggaagccgagcgcgctgagcgtgccaaagaacgggagaaacgcaggaaggagcaagaggaagaagaacagaaggagagagagaaggaagcagagagagagagaaacagacaactcgagcgggagaagcgtagagaacattcccgagagcgtgatagagagcgagaaagagagagggaaagggacaggggcgatagggatagagacagagagagggatagggagagaggcagagagcgtgaccgacgagacactaaaaggcacagcagatcccggagccgctccactcccgttcgggaccgaggaggtcggcgctag

SEQ ID NO: 27160 - DNA, 1089 bp, Artificial Sequence
  Description of Artificial Sequence: Synthetic coding sequence
atggcccacagcagcttcttccccgacgagtacttcacctgcagcagtctatgcctgtcttgtggagtggggtgtaaaaaatccatgaaccacgggaaagagggggtgccccatgaggccaagtcccgttgccgctatagccaccagtatgataacagggtctatacgtgcaaagcctgctacgaacggggtgaagaggtaagcgtggttcccaagactagcgcttcgaccgactcaccctggatgggactcgccaagtacgcctggagcgggtatgtgattgaatgccctaattgcggagtggtgtatagatcaagacagtactggttcgggaaccaggaccctgttgatactgtggtcaggacagagatcgtgcatgtctggcctgggaccgatggattccttaaggataacaataacgccgcccagcgcctactcgacggtatgaatttcatggctcagagtgtaagcgagctgagtctgggaccaactaaagcagtcacaagttggctcacagatcaaatcgcccccgcttactggaggcccaatagtcagattctatcctgcaacaaatgcgcaacctctttcaaggataacgacaccaaacatcactgcagggcttgtggcgagggcttctgcgacagttgctccagcaagactcggcccgtaccagaaaggggatggggaccagcccccgtgcgtgtgtgcgacaattgttatgaagctcggaacgtacaacttgccgtgaccgaggctcaggtcgacgacgaaggtggcacccttatcgccaggaaggtgggagaggcggtacagaacacactgggggctgtagtgaccgccattgacattcccttgggcctggtaaaagacgctgctcgaccagcttactgggtcccagaccatgagatcctgcactgccacaactgcaggaaggaattctctataaagttatctaaacaccactgccgagcttgcggccagggcttctgcgacgagtgtagccatgatcgccgggctgttccatctcggggatgggaccaccccgtgcgagtctgtttcaactgcaacaagaaacctggcgacctttag

SEQ ID NO: 27161 - DNA, 420 bp, Artificial Sequence
  Description of Artificial Sequence: Synthetic coding sequence
atggagaccgactgcaaccccatggagctgagcagcatgagcggctttgaggagggtagcgagctgaatggatttgaaggcactgatatgaaggatatgcgtctggaagccgaagcagttgtcaatgacgtcctgttcgcggtgaacaatatgtttgttagcaaatcactgaggtgcgcagacgatgttgcctacattaacgtggagacgaaggaacggaatcgttactgcttggagcttaccgaagcaggcttgaaggtcgtgggatacgcttttgaccaggtagacgatcacctccaaacgccgtaccacgagactgtctacagcctgctcgacacacttagtccagcatatcgagaagcctttgggaacgcccttttgcagagactggaggctctcaaacgggatggacagtcttag

SEQ ID NO: 27162 - DNA, 2256 bp, Artificial Sequence
  Description of Artificial Sequence: Synthetic coding sequence
atgagcgaggaggagctgaccaaggccatggagggcctgggcatggatgaaggagacggtgagggcaacatacttcccattatgcaatctattatgcagaatttattgagtaaagatgtgttgtacccctctttaaaagagattacggaaaagtaccctgaatggcttcaatcacaccgcgagagcctcccacctgaacagttcgaaaagtatcaagagcaacactcggtgatgtgtaaaatatgtgagcaattcgaggccgaaacgccgaccgacagcgagaccacacaaaaggctcgctttgagatggttttagacctgatgcagcagctccaggacctggggcatccccccaaggagctggccggtgagatgctgacctggttgtttttctgcggaagtcaatgggtgtacggcccatggctgacctatgttggttggctgcagcagactagtttcaagatgtcctcgaagggcagcagtactgacgggcgcacagatcttgccaacggcagcctgtccagctctccagaagaaatgtccggggccgaggaaggccgagaaacatccagtggtatagaagttgaggctagtgacctgagcttaagtctcactggagacgatggaggccccaaccgcacttctacagagagcaggggcactgacacagaaagtagcggcgaggacaaagattctgattcaatggaggatacaggccactattctattaacgatgaaaacagagttcacgatcgtagtgaagaagaagaggaggaagaggaagaggaagaggaagaacagcccaggcgaagagttcaacgaaagagggctaatcgcgatcaggactcctcagatgatgagagggcccttgaggactgggtcagcagtgagacaagcgctctgcccaggccccgctggcaagcactgccggcgctgagagagagggagctgggcagcagtgccagattcgtgtatgaggcatgcggtgcgcgggtcttcgtgcaaaggttccgactgcaacacggactcgaggggcacacaggctgtgtcaacaccctgcatttcaatcaacggggtacctggctcgcatccggcagtgacgacctgaaagttgtcgtgtgggattgggttcgaaggcaaccagtattagattttgaatctgggcacaaatctaatgtgttccaagctaagtttttgccaaactctggggattcaaccctggcaatgtgtgcaagagacggacaggttcgcgtggcagagctatcagctacccagtgctgtaaaaacacgaaacgtgtcgcgcaacacaaaggtgcgtcccataaactagccttagaacctgactcaccttgcaccttcctgtctgcgggtgaggatgccgtcgtgtttacaatcgatctcaggcaggacaggcccgcaagcaagctagtagtcactaaggaaaaagagaaaaaggtgggcttatacacaatttatgtgaatcctgccaatacccatcagtttgcggtaggtggtcgagaccagtttgtccgaatctacgatcagcgaaaaatagacgaaaacgagaataatggagtactaaagaaattctgtccacatcacctggtgaacagcgagtccaaggctaacattacgtgcttggtgtactcacatgatggaactgagctgctggcctcttacaacgatgaagatatctacctgtttaattcctcacactccgacggggctcagtatgtaaagcgatacaaggggcaccgcaacaacgctaccgtgaaaggtgtaaacttttatggacctaagtctgagtttgtagtgtcgggctcagattgcggccatatttttctctgggagaagagttcctgtcagatcattcagtttatggagggagataaaggtggagtagtgaattgtctggaacctcaccctcacctgcccgtgctggcaacatcgggcttagaccatgacgtgaaaatttgggcacctactgccgaagcgtcaactgagctgactggtctgaaagatgtgatcaagaagaacaaacgagaacgggatgaggatagcctgcaccagactgacctgttcgactcgcatatgctgtggtttttgatgcaccacctgcgacaaagacggcaccacaggcgttggcgtgaacctggcgtaggtgccaccgacgccgactcagatgagagcccatctagctccgacacttccgatgaagaggaagggccagatcgcgtgcagtgtatgcctagttag

SEQ ID NO: 27163 - DNA, 1056 bp, Artificial Sequence
  Description of Artificial Sequence: Synthetic coding sequence
atgatcgtgcagcgggtggtgctgaacagccggcccggcaagaacggcaatcctgtagcagagaattttcgcatggaggaagtgtacctcccagataacatcaacgaaggccaggttcaggtacgcacactatatctgtctgtggacccatacatgcggtgtaggatgaacgaggacactggtaccgattatataaccccctggcagctcagtcaggtggttgacgggggcggcattgggatcatcgaggaatccaaacacacgaaccttactaaaggtgatttcgtgacaagcttctattggccttggcaaacaaaggtgattctggacggaaatagtctggagaaggtggatccccaactggtcgacggccacctttcgtacttcctcggagcaatcgggatgcctggcctcacttcactcatcggaatccaggaaaagggacacataaccgctggatctaataagaccatggtggtgtccggagctgcgggcgcctgtggaagtgttgccggccagattggccatttcctcgggtgcagccgggtggttggaatctgcggcacccacgagaaatgtattctgctcacttcggaactcggcttcgatgctgcgatcaattacaaaaaagacaacgtcgccgaacaactaagagaatcctgccccgccggagttgacgtgtatttcgataacgtgggcgggaatataagcgataccgtgatctcccaaatgaatgagaattcccatattatcctttgtggccagatcagccagtataataaagatgtaccgtacccgccacccctgagtccagcaatagaggcaatccagaaagagcggaacataacccgggaaaggttccttgtgctgaactacaaagataaatttgagcccggcatcctgcagctttcccaatggtttaaggaaggcaagctcaagatcaaagagaccgtcataaacggactggagaacatgggcgcggcgtttcaatcaatgatgaccggtggcaatatcggaaaacagatcgtctgcatctctgaggaaatcagcctgtag

SEQ ID NO: 27164 - DNA, 588 bp, Artificial Sequence
  Description of Artificial Sequence: Synthetic coding sequence
atgcccctgcccttcggcctgaagctgaagcggacccggcggtacacagtgagtagcaaaagctgtctggtggcacgcattcagcttctgaataatgagtttgtagaattcacacttagtgttgaatccaccggtcaggaatccctggaagccgtcgcccagcggcttgaactgcgcgaagtgacatacttctccttgtggtactataacaaacagaaccagcgccggtgggtcgacctggagaaacctcttaaaaaacagctcgacaagtacgctttggaacctactgtttatttcggggtcgtgttttacgtacctagcgtgtcgcagttacagcaggagattactcgctaccagtactatcttcagctaaagaaagacattcttgagggctccattccatgcaccctggagcaggccattcaactggctggtctggcagtgcaggcagattttggtgacttcgaccagtacgagtcccaggacttcttgcagaaattcgcattgtttcccgtggggtggctccaagatgagaaggttctcgaggaggctacgcaaaaagtcgcacttctgcaccagaagtattag

SEQ ID NO: 27165 - DNA, 354 bp, Artificial Sequence
  Description of Artificial Sequence: Synthetic coding sequence
atgggcgacaagaagagccccacccggcccaagcggcagcccaagcctagcagcgatgaagggtactgggactgctcagtctgcacctttagaaattcggccgaggcttttaagtgcatgatgtgtgatgttcgcaagggaaccagcacacgggacagtaaggagggaggaaagctcgtgtcctattctacagcctcactgggcgttcgcgggacactgcgcaatcgggttgggggcggcagctctgaggagaagaagcaagctgaatatctagcaccaggcaggcgcagaaacattgttcatcgtggggtggggccaggacagaggtccggcccttctctgaaagaggcttag

SEQ ID NO: 27166 - DNA, 3285 bp, Artificial Sequence
  Description of Artificial Sequence: Synthetic coding sequence
atggccgagagcagcagcgagagcgaccacttccggtgccgggaccgactgtccccctgggccgcccgatccacccaccggggcactcggagtctccctaccgtcgaagtaacagagaaggtgaacactatcacatctacactgcaggatactagtagaaaccttcgccaggttgatcagatgctagggcgctacagggagtactctaatggacaggccggcgccatcgagcaccttaaggagtcccttgagcaaagcatagaccagctgaggtctcaacgcttgttacggaactctggcgggagaagcatttcagtaacgtctctaagtgcttccgatctagacggaggcaccgggagtgagctacaccactttcccccaaccagccctctaaaagactacggagacccgcaggggatcaaacgaatgcgcagtagaacaggcgtgcgcttcgtgcaggagactgatgacatgacacagcttcacggtttccatcagtcgcttcgcgatttatcatccgagcagatccgcctcggggacgactttaaccgcgagctttcaagacggtctcgaagcgatgccgaaacaaaacgggccctggaagaactcaccgagaagttaaacgaagctcagaaacaggaggttgtgagcgaccgtgtagaaagaagattgcaggaattggagagggagatgcggactgaaagggaattggtcgagcgcaggcaggaccagttaggtttgatgtctctccagctccaggaggccctgaaaaaacaggaagccaaggctgatgagcacgaaggcgccattaagaataagttgagacaaaccgagaccgaaaagaatcaactggaacaggagctagaactttcccgacgacttctgaaccagtccgaggggtcccgagaaacacttctacaccaggtcgaggaactgcgaacacagctcaccaaagcagagggagatagaaaaggattacagcaccaggtgtctcagatttcgaaacagcagtctaactaccaggacgaacagggagaggactggagatttcggcgcggcgttgagcgcgagaagcaagacctggaaaagcagatgagtgatcttagggtccagctcaatttttctgccatggcttctgagcttgaagaagtcaagcgttgcatggagagaaaggacaaagaaaaggcccacttggcatcccaagtcgagaatcttacccgcgagcttgagaatggggagaaacaacagctccagatgctcgacaggctgaaagagatccagaatcattttgacacctgcgaagctgaaaggaagcacgccgatctccagatttccgagctaactagacacgccgaagacgctaccaagcaagcagaacgatatctgtccgagttgcagcagagtgaagcacttaaggaagaagctgaaaagcgaagggaggacttgaaacttaaggctcaggagagcattcgacaatggaaactgaagcataagaaacttgagagagctctggagaaacagagcgaaactgttgatgaattgacaggcaaaaataatcagatcctgaaagagaaagacgaactcaagacacagctctacgctgccctccagcagatagagaacctgcgcaaggaactgaatgacgtcctgaccaaacgcgctttacaggaggaagaactccatagcaaggaggagaagctgcgcgatatcaagagccatcaagctgatttggaactcgaagtgaaaaactcactggacaccattcatcgactggaaagcgagctgaaaaagcagtctaaaatccagtcacagatgaaggtggagaaggctcacctagaagaggaaatcgccgaactcaagaaatcccaggcccaggacaaggccaagctgttggagatgcaggagagcataaaggacctctcggctattcgcgccgatttggccaataagttagctgaagaagagcgcgctaaaaaagcagtgctaaaagatctgagtgacctcactgcgcaggcgaagtcgcgggatgaagaaaccgccactattattacacagcttaagctggagcgtgacgttcaccagcgcgaactgaaagacctgacctcctctctacaatctgtgaaaacaaaacacgagcagaatatccaggaattgatgaaacacttcaaaaaggaaaagagcgaggctgagaaccacattagaacactgaaagccgagtcactcgaggagaaaaacatggcaaaaatccatagaggccagctggagaaactgaagagtcagtgcgatcgcttaactgaggaactgacccagaatgagaacgagaacaaaaaactcaagcttaaatatcagtgtctcaaagaccaactcgaggaaagagagaagcatattagcatcgaagaggaacacctgagacgaatggaagaggcgcgcctgcaattaaaagatcagttactctgtttggaaaccgaacaggagtctatccttggcgtcataggtaaggagattgacgctgcttgtaaaactttcagtaaggatagtgtagagaagttaaaggtgttcagctccgggcctgacattcactatgatccacacaggtggttggcagaatcaaagacgaagctgcagtggctctgcgaggaactgaaagagagagagaaccgagagaagaacttaaggcatcagctgatgctgtgtcgccagcagttgcgaaacctgaccgagaataaagaaagcgagcttcagtgtttattccaacagatcgagcgacaagagcaactgcttgatgaaatccacagagagaaacgcgacttgctggaggaaacacagagaaaggatgaagagatgggaagcttgcaggaccgagttattgcccttgaaacaagcacccaggtggcgctcgaccaccttgaatcagtgccagagaagttgagcctccttgaggattttaaggacttcagagactcctgttccagcagcgagcgcactgatgggcgatatagtaaatacagggtgaggaggaattcccttcagcaccatcaagatgacaccaagtatcgtactaagagcttcaagggagacagaacctttttagaaggatcccacactaggggcttagatcactcaagctcgtggcaagaccattctaggttcctcagctcacctcggttttcttacgtcaatagctttacgaaaaggaccgttgcaccagattcagctagcaataaagaggacgccacaatgaatggtaccagcagccagccaaaaaaagaggaatacggctcttag

SEQ ID NO: 27167 - DNA, 1353 bp, Artificial Sequence
  Description of Artificial Sequence: Synthetic coding sequence
atgcgggagatcgtgcacatccaggccggccagtgcggcaaccagataggtgcaaaattttgggaggtgatctcagatgaacacggcatagaccctagcggaaattacgtcggcgattccgacctgcagttggagcgcattagcgtttattacaatgaggcgtcatcacacaagtatgtgccccgcgccatcctggtggatctagaacctgggacaatggactccgtccggtctggcgcctttggtcacctgtttagacctgataatttcattttcggtcagtcaggggctggcaataattgggctaaggggcattacacagaaggggctgagttggtggactctgtattagatgtggtaaggaaggagtgcgagaattgcgattgccttcagggatttcagcttacacacagcctggggggcggcaccgggtctggcatgggcaccctgctcataagcaaggttagggaggaatacccggatcggattatgaataccttctccgttgtgccctcacctaaagtttcggatactgtggtggaaccgtataacgccacactctccatccaccaactcgtggaaaacacagacgaaacctattgcattgacaacgaggcgttgtacgacatttgcttccggaccctgaagctcgcaaccccaacctatggggaccttaatcacctcgtgagcgccacaatgagcggcgtaacaacatcgctgagatttcctggacagctaaacgctgatctcaggaaattagcggttaacatggtgccgttcccccggctgcactttttcatgcccggctttgccccactgaccgcgcgcgggagtcagcagtaccgtgcgctgacggtgcccgagttaacccagcagatgtttgacgctaagaatatgatggctgcctgtgacccgagacatggtcggtatttgaccgtggccactgtgtttcggggtaggatgtcaatgaaggaagtagatgaacagatgctggcaattcagtcaaaaaattcgtcatatttcgtggagtggattccaaacaatgtgaaagttgctgtttgtgatataccccctaggggacttaaaatgtcttctacgtttattggaaactccaccgcgattcaggaattatttaagaggatctcagagcaatttacagcaatgtttaggcggaaggcatttctgcactggtatacaggagaaggaatggacgagatggaatttaccgaagcggagtccaacatgaatgacttggtgagcgaatatcaacagtaccaggacgctactgcagaagaagaaggcgagatgtatgaggacgacgaggaagaaagtgaagcccaggggccgaaatag

SEQ ID NO: 27168 - DNA, 240 bp, Artificial Sequence
  Description of Artificial Sequence: Synthetic coding sequence
atgaacgagagcaagcccggcgacagccagaacctggcctgcgtgttttgtagaaagcatgacgattgtccaaataagtatggcgaaaaaaagacgaaagagaagtggaatcttactgttcactactattgcctgttgatgagtagcggaatctggcagcgcgggaaggaagaggagggcgtgtacggattcctaatcgaagatatacggaaggaggtcaaccgagcgagtaagctgtag

SEQ ID NO: 27169 - DNA, 1785 bp, Artificial Sequence
  Description of Artificial Sequence: Synthetic coding sequence
atgaccgacacccggcggcgggtgaaggtgtacaccctgaacgaggataggcaatgggatgacaggggcaccggccacgtgtccagcgggtacgtagagaggttgaaaggcatgtctctgctcgtcagagcggagtctgatggaagtctgttgctggagtcgaagatcaaccctaataccgcataccaaaagcagcaagaggatgagaaattcttgactgatctgtttgcccagcttaccgacgaggctactgacgaggagaagcggcaggagctggtcaacttcctcaaggagttctgtgccttttcccagactctgcagccccaaaacagggatgcatttttcaagacactttctaatatggggattctgccagccctggaagtcattctcggcatggatgatacccaagtgaggtcagcggccacagacatttttagctacttggtggaatataaccccagcatggttcgcgagttcgtaatgcaggaagcgcagcagaatgacgacgtgagcaagaagctcaccgagcagaagattacctcaaaggacatcttgcttatcaatctgattattgagcatatgatttgcgataccgacccggagctcggaggagccgtccagcttatggggttgctgagaacgcttgtggatcccgagaatatgctggccaccgctaataagaccgagaaaaccgagttccttggatttttttacaagcattgtatgcacgtcctgaccgccccactgttggccaacacaactgaggacaaaccaagtaaggatgattttcaaaccgcacagcttctcgccctcgtgcttgaactgctaaccttttgcgtagagcatcatacataccatataaagaactacattattaacaaggatattcttcggcgggtcctcgtgctaatggcttccaagcacgccttcctggctctgtgtgctttgcggttcaaaagaaagatcatagggctcaaagatgagttttacaaccgctacattatgaaaagctttctgttcgaacctgtggtgaaagctttccttaataatggatctagatataatctaatgaactcagctatcattgagatgtttgagtttatccgggtggaggatattaaatcattaaccgctcacgtcattgaaaattattggaaggcactggaggacgtggactacgttcagacatttaagggcctgaagttgaggtttgagcagcagagggaaagacaggacaacccaaaattagactctatgaggagcatcctgcgcaaccacaggtaccgtcgagatgctaggacgctagaggacgaggaggagatgtggtttaatactgacgaggatgatatggaggacggtgaggctgtggtgtctcctagcgataagacaaaaaatgatgacgatattatggaccctatcagtaaattcatggaacgtaaaaagctgaaggagagtgaggaaaaggaggttctactgaagaccaacctgagtggccgacagagccctagttttaaactgagtctgtcctcaggaaccaagactaatctaacatcccaaagctccacgactaacctgccgggctcacccggcagccctggcagccccgggtcacccggatccccggggagtgttcctaagaacacttcacagaccgccgctataaccactaaaggaggtctggtgggcctcgtcgactacccggatgatgatgaggatgacgatgaggatgaggacaaggaggatacgctcccactgtcaaagaaggccaagttcgattcctag

SEQ ID NO: 27170 - DNA, 540 bp, Artificial Sequence
  Description of Artificial Sequence: Synthetic coding sequence
atggccgagagcagcagcgagagcgaccacttccggtgccgggacagactttccccatgggccgcccgatcaacccatagaggtacccggtctttgccgactgtcgaggtgactgagaaggtcaacaccattacaagcaccctccaggacacgtctaggaatctgcgccaggtcgaccagatgctcgggagatatagagagtattcgaatggacaggccggcgcgatagagcacctaaaagagtcattggagcagagcattgaccagcttcgatcacagagactgctgcgtaactccgggggccgctcaatttctgtgaccagcctctctgcatctgacttggacggtggtactggatctgagttacaccattttccacccacatctcctctgaaggactatggtgatcctcaggggatcaagagaatgcggtcaagaaccggggttagattcgtccaagagacagatgacatgactcagctgcacggcttccaccagtcactccgcgacctgtccagtgaacaaatcagattggggtag

SEQ ID NO: 27171 - DNA, 1056 bp, Artificial Sequence
  Description of Artificial Sequence: Synthetic coding sequence
atgatcgtgcagcgggtggtgctgaacagccggcccggcaagaacggcaatccagtggctgagaacttccgaatggaggaggtctacctccccgacaacataaatgagggccaggttcaggtgcgtaccctgtacttgtctgtcgacccatatatgaggtgtcgtatgaatgaggatacagggactgactacataactccttggcagctcagccaggtggtcgacggaggtggcatcggcattattgaagagagcaaacacacaaatctgactaaaggcgattttgttacttcattctactggccatggcagactaaagtgatattagatgggaacagtttagaaaaggtggaccctcagctggttgatggtcatttgtcctatttcctaggggcgattgggatgcctgggctgacatcgctgatcggtatccaggaaaaaggtcacatcacagccggaagcaataaaacaatggtagtgagcggcgctgccggagcatgcggctccgtggctggacagattggccactttctgggctgttcaagagtggtcggaatctgtgggacacacgagaagtgcattctgttaacaagcgagttgggattcgatgctgccataaactacaaaaaggataatgtcgctgagcagcttcgcgagtcctgtcctgctggagtcgacgtctatttcgacaacgtgggcggcaatatctcggatacagttatctcacagatgaatgagaattcacacattatcctgtgcggccaaatttcccagtataataaagacgttccatacccccctcctctgagcccagctattgaagccatccagaaagaaagaaacatcacacgcgaacggtttttggttttgaattacaaagacaagtttgagccagggattctccagctgagccaatggtttaaggaagggaagttaaaaatcaaggagacagtcattaacggcttagaaaacatgggcgcagccttccagagtatgatgactggcgggaacatcgggaaacagatcgtgtgcatcagcgaggaaataagtctttag

SEQ ID NO: 27172 - DNA, 330 bp, Artificial Sequence
  Description of Artificial Sequence: Synthetic coding sequence
atggagaccgactgcaaccccatggagctgagcagcatgagcggcttcgaggagggttcggagctgaacggctttgaaggcacagacatgaaggacatgcgattagaagcggaagcggtcgtgaacgatgtgctctttgcggtaaataacatgttcgtaagtaaatcacttaggtgcgcagacgatgtggcatatattaatgtcgaaacgaaagagagaaatcgctattgtttggaactcaccgaagccggactcaaggtggttggatacgctttcgatcaagtagatgaccacctccaaaccccctatcatgaaactgtgtatagttag

SEQ ID NO: 27173 - DNA, 387 bp, Artificial Sequence
  Description of Artificial Sequence: Synthetic coding sequence
atggccgagagcagcagcgagagcgaccacttccggtgccgggaccgcctatctccttgggcagccaggtccacgcaccgagggacacgtagcctccccaccgttgaggtgaccgagaaagtcaacaccattacgagcaccctgcaagacacctctcggaacctgcgccaggtggaccagatgctggggcgttaccgcgaatactccaatgggcaggctggagctattgaacatctcaaggaatccctggagcagtccatagaccaacttagaagtcagcgtctcctgcgtaactctggcggtcggagtattagtgtaacgagcctttccgcctccgatctcgacggtggtactggatccgaattacatcatttcccccctacctag

SEQ ID NO: 27174 - DNA, 369 bp, Artificial Sequence
  Description of Artificial Sequence: Synthetic coding sequence
atgctgttcgccccctgctgccaccagtgcggcgagttcatcatcggcagggtaataaaagcgatgaataattcctggcaccctgagtgtttcaggtgcgacctctgtcaagaggtgctggccgacatcggatttgtgaagaacgcgggaaggcacttatgtagaccatgccacaaccgcgaaaaagccagaggattaggcaagtacatatgtcaaaagtgccacgctatcattgacgaacagcccctcatttttaaaaacgacccgtaccatcccgaccactttaactgtgcaaactgcggccaggaggggagcgactgccggtgcactggagccgaaaggggggccattttgccagccatgccatag

SEQ ID NO: 27175 - DNA, 420 bp, Artificial Sequence
  Description of Artificial Sequence: Synthetic coding sequence
atggagaccgactgcaaccccatggagctgagcagcatgagcggctttgaggagggctctgaacttaatggttttgagggcacagatatgaaagatatgcgtctagaagccgaggcagtggtaaacgacgtcctgttcgctgtaaacaacatgttcgtttcaaaatccctgcgatgcgcagacgacgtcgcctacatcaacgtggagactaaggaaaggaatcgctattgtttagaactgacggaggccgggcttaaggtagtcgggtacgcctttgaccaggttgatgatcatcttcagaccccctaccacgaaaccgtctactctctcctggatactctgagccccgcctatcgggaggcattcgggaacgccctgcttcagaggttagaagctcttaagagggacggacagtcctag

SEQ ID NO: 27176 - DNA, 4602 bp, Artificial Sequence
  Description of Artificial Sequence: Synthetic coding sequence
atgcccgtgaagcggctgcgggaggtggtgagccagaaccacggcgaccacctggtcttactaaaggacgagctgccatgcgttccccctgccctgtctgctaataagcgcttgcccgttgggactggtacctctctgaacggcaccagcagggggtcatctgatctgacatcggcaaggaactgttaccagcctctattggaaaaccccatggtgtctgaatccgatttttctaaggatgttgccgtccaggttcttcctctcgataaaatcgaggagaacaacaagcagaaagcaaatgacatcttcatctcccagtataccatgggacagaaagacgctttgagaaccgtgctgaagcagaaggcacaatccatgcccgtgtttaaagaagtcaaagtgcacctactggaagacgcgggtatcgaaaaggacgctgtcacccaggaaacccgaatctccccctctggaattgattccgcgactaccgtcgcagccgctaccgccgcagccattgccaccgctgctcccttaattaaggttcagagcgacttagaggctaaagtcaactctgtcacggaacttcttagtaagctgcaggaaaccgacaagcacctacaacgcgtcaccgagcaacagacatcgattcaaagaaagcaggagaaactgcactgccacgaccatgagaaacagatgaatgtatttatggaacagcatatccgtcatttggaaaagttgcagcaacaacaaatcgatatacaaacacacttcatcagcgcagccctgaagacatcctcatttcagcccgtctccatgccatcatcccgggctgttgagaagtatagtgtaaaacccgagcatcctaatttgggcagctgtaatcctagcctttacaataccttcgcctctaaacaagcacccctcaaagaggtggaggacacatcgttcgacaaacagaaatccccccttgagactccagcaccccggagattcgctcccgtcccagtcagccgcgacgatgagttgtccaagagagagaacctcctggaggaaaaagagaatatggaggtgtcatgccatcggggcaatgtccgtctcctggaacaaattttaaataacaacgattctttgactagaaaatccgaaagtagcaacacaacttccctgacccggagcaaaattggctggaccccagagaagaccaaccggtttccatcatgcgaagagttggagaccacaaaggtaacgatgcagaaaagcgacgacgtacttcacgatttagggcagaaagagaaggagaccaattccatggttcagcccaaagagtccttgagtatgttaaaactgcctgacctgccacagaactccgtcaagcttcagactaccaacaccactcggagcgtgctgaaagatgccgaaaagatcctgcgcggagtgcagaataacaaaaaagtgctggaagagaacctagaagcaattataagagccaaagatggcgccgccatgtattctctgatcaatgccctgtcgacaaaccgcgaaatgtcggaaaaaattcgaatcagaaaaaccgttgacgagtggatcaagaccattagtgccgagattcaagacgagctctcccggaccgattacgagcaaaagaggttcgaccagaagaaccagagaaccaagaaaggccagaacatgaccaaagacatccgaacaaacacccaggataagactgttaataaatccgttatcccacgtaaacactcacaaaaacagatagaagagcacttccggaacttgcccatgcgggggatgcctgcctcttcacttcagaaagagaggaaagagggtttgctaaaagcaacaaccgttatccaagatgaagactatatgctccaggtatatggtaagccagtgtaccaaggacaccggagtactttaaagaagggaccatacctgagattcaacagcccaagtccgaaatcccgccctcaacgacccaaagtcatcgaacgcgtcaagggcaccaaggtgaagagcatcagaactcagacagacttttacgccactaaacccaagaagatggacagcaaaatgaaacactcagttcccgtgctgcctcatggggaccagcagtaccttttcagcccttccagagaaatgcccactttttccggcactctagaaggtcaccttattcctatggcaattcttctgggccagactcagtctaactccgacactatgcctcccgcaggggtgatagtgtctaagccccaccctgtgacagtcaccacaagcatccctccttcatctcgcaaggttgaaaccggggtgaagaagccgaacatcgccattgtggaaatgaagtccgagaagaaagatcctcctcaattgacggtccaggtcctcccatccgtggatatagatagtatttcaaattcatcggcagacgtcctctctcccctttccagccctaaggaagcgtctttgccacccgtccagacatggatcaagacgcccgaaataatgaaggttgacgaggaggaagttaagttccctggtacaaacttcgacgaaataatcgacgttattcaagaagaggagaaatgcgatgagatccccgattctgaacctattctagagtttaatcgctcggtgaaggcagacagcaccaaatataatgggcccccatttcccccagtagcatctaccttccaaccaaccgctgacattctggacaaagtcattgagagaaaggagacgctagagaactcactgatccagtgggtggaacaggagattatgtctcgaatcattagcggccttttccctgtgcagcagcagatagccccgtccatcagtgtctctgtcagtgaaacgtcggaacctctgacctctgacatcgtggaaggcacttcctccggtgcgttgcaactttttgtagatgcaggggtgccagtgaacagcaacgtgataaaacattttgttaacgaagcgcttgccgagacaattgccgtaatgctgggtgaccgcgaagccaagaaacagggcccggttgcgaccggggtctcaggggatgctagtacaaacgaaacgtaccttcctgccagagtctgtacccccttgccgactcctcagccaacaccaccatgttctccttcaagtcccgccaaggaatgcgttctggtcaaaacacccgactcttcaccttgtgattcagatcacgacatggcttttccagttaaggagatctgtgcagaaaagggtgacgacatgcctgcaattatgctcgtcaacacccccacagtaacgcctactaccactccgcctccagcggcggccgtgtttaccccaacactgtctgacattagcatcgataaactgaaagtgtcatccccggagctgcctaagccctggggggatggtgacctgcccctcgaagaggagaaccccaatagtccgcaggaggaactacacccacgcgcgatcgttatgagtgtagccaaagacgaggagcctgaatccatggatttcccagctcaaccacccccccccgaaccagtaccattcatgccgttcccggcaggcactaaggccccctccccgagccagatgcccggttcagacagctctacgctagaatccactctgtcagtcaccgtcactgaaacagaaacgctcgataagcccatatcggagggcgagatcttattcagctgcggacaaaagctcgcaccaaaaatcctggaagacatcggtttgtatttgacaaacttgaatgatagcctgagtagcaccctccacgacgccgtcgaaatggaggatgacccaccttctgagggccaggttatcaggatgtctcacaagaaatttcacgccgatgctatcctgagctttgctaaacagaaccaggaatcggctgtgtcgcaacaagctgtgtatcatagcgaggacctcgagaacagcgtgggtgaactgagtgaaggacagcgtccacagctcacggccgccgccgagaacattctcatgggccatagcctgtacatgcagccaccagtcacaaacactcaatccttggatcaacaatgtgaccccaagccccttagccgacagtttgatactgtgagcggatctatttacgaggatagttgcgcctctcacggcccaatgagcctcggcgagcttgagctggagcccaacagtaagctagtgttaccaacaacccttctaacagcccaggagaacgatgtgaatcttccggtggcggcagaagacttcagccagtaccagctgaaacagaaccaggacgtgaagcaagtggagcataaaccatcccagagctacctgagagtgcgcaataagagcgatattgctccaagccagcagcaggtctcacctggcgacatggaccgtacccagatcgaactgaacccctacctgacatgcgtgttctcaggtggtaaggcggtgccgctgtcggcatcacagatgccaccagccaagatgtccgtgatgctcccatctgtcaatctggaagactgcagtcagtctttatccttgtcaactatgcaagaggatatggagtctagtggagccgacacgttttag

SEQ ID NO: 27177 - DNA, 2334 bp, Artificial Sequence
  Description of Artificial Sequence: Synthetic coding sequence
atgagcgcccagaccagccccgccgagaagggcctgaaccccggccttatgtgccaggaaagctatgcgtgttctggtaccgacgaggcgattttcgagtgtgatgaatgctgttccctccagtgcctgaggtgcgaagaggagctccataggcaagagcgactgcggaatcacgagcggatcaggctgaagccaggacatgttccctattgtgatctgtgtaaaggtttaagcgggcacctgcccggcgtccggcagcgtgcaatagtgagatgtcagacctgcaagattaatttgtgtctggaatgccagaaacggacacatagcggaggtaataaaaggcgacacccggtgacagtttacaacgtgtccaatcttcaggagtcattggaggctgaggagatggacgaggagactaaaagaaagaagatgaccgaaaaggtggtctcctttctcttagttgatgagaatgaagagatccaagtgaccaatgaagaggacttcatacggaaactggactgtaaacctgaccagcacctgaaggttgtttcaatatttggcaacactggcgatggcaagtctcacacactgaaccatacttttttttacggcagagaggtctttaaaacctctccaacacaggagagctgcactgtcggcgtctgggctgcctatgatcctgtccataaagttgccgtcatcgatacggaaggcctgctgggcgccaccgttaacctgtcacagcgtacacggctgttgcttaaagtgttggctatatccgatctcgtgatctatcggactcacgcagaccggctccataatgacctgtttaagttcctgggcgatgctagcgaggcttacttaaagcattttacaaaagaacttaaggccacaacagccagatgcggcctggacgttcctctctctaccctgggtcctgcggtgattatcttccacgagactgttcatacccaactcctggggtcagaccacccttccgaggttcccgaaaaactgattcaggaccggttcaggaagctgggccggttccccgaagcgttctcttccattcattacaagggcactagaacgtataaccctcccacggactttagcggactgagaagagctctggagcagctcttggagaataacacaacgagaagcccacgccatccaggcgtcattttcaaggcactcaaggctctgagtgaccgattctccggtgagattcctgatgatcagatggctcattcatcttttttccccgatgaatattttacttgctcgtccctgtgcctgtcctgcggcgttggatgtaagaaatccatgaaccatggcaaggagggagttcctcacgaagctaagtctaggtgtaggtactcccaccagtatgacaatcgcgtgtatacctgtaaggcatgttacgaaagaggtgaggaagtcagcgttgtccccaagacgtctgcctcaaccgacagcccatggatggggcttgcgaaatacgcctggtcgggctatgtgatagaatgtcccaattgtggcgtggtgtaccgctcacgccagtactggtttggaaatcaggacccagttgacacagtagtgcgcaccgagattgtgcatgtttggcctggcacagatggattcctgaaagacaacaacaacgctgcccagcgactgctcgatggcatgaactttatggctcagtctgtgtccgagctgtcactaggccccactaaggcagtgacttcttggctcaccgatcagatcgcccccgcctactggcgccctaacagtcagattctgtcctgtaataagtgtgccaccagcttcaaggacaacgataccaagcatcattgcagggcttgtggcgagggattctgcgatagttgctcctctaagactcgtccggttccagaacgcggttggggtcccgcccctgtcagagtgtgcgataattgttacgaggcgagaaacgttcagcttgccgttaccgaagcccaggtagacgacgaaggtggcacgttaatagcccgaaaggtgggggaggccgtgcaaaataccctaggggctgttgtcacagcgattgacattcctctgggcctggtgaaagacgccgcaagaccagcctattgggtcccagatcacgagattctgcattgccacaactgccggaaagagtttagtatcaagctctccaagcaccattgccgggcctgcgggcagggtttctgcgacgagtgctcccacgatagacgggccgtacctagtagagggtgggatcacccagtgagagtgtgttttaattgcaataaaaaaccaggtgatttgtag

SEQ ID NO: 27178 - DNA, 867 bp, Artificial Sequence
  Description of Artificial Sequence: Synthetic coding sequence
atggagaagctgagcgccctgcaggagcagaagggcgagctgcggaaaagactttcctatacaacccacaaactagaaaaactagagaccgagttcgactctactcgtcactacctcgaaatagaattaagaagagcccaagaagagcttgaaaaggttacagagaagctgaggagaattcagtctaattacatggccctacagcgtattaaccaagagttggaggataaattgtatcgtatgggtcagcactatgaggaggagaagcgggctttaagccacgagatcgtcgccttgaattcacacttgctggaagcgaaggtaacaatcgacaagctatcagaggataatgaactatatcggaaggattgcaatctggccgctcaactgctgcaatgtagtcaaacttatggcagagttcacaaggtctcagagttaccatccgattttcaggagcgggtgtccctgcacatggaaaagcacggatgctccctgccttccccactgtgtcacccggcctacgctgacagtgtgccaacctgtgtaatcgccaaagtgctggaaaaaccagaccccgcttctctcagttcccgtctctcagacgcatcagctcgggacctggccttttgtgatggcgtggaaaagcccggcccccgccctccttacaaaggtgacatttactgtagcgacaccgccctttactgtcccgaagaacggcggcgagatcgtcgtccttccgtggacgcaccggtaaccgacgttgggttcttacgagcacagaacagtacagatagcgcggccgaggaagaggaagaagcagaggcagcagcctttcctgctggctttcagcacgaagcgttcccttag

SEQ ID NO: 27179 - DNA, 1263 bp, Artificial Sequence
  Description of Artificial Sequence: Synthetic coding sequence
tgaacccaggccatggccctggagacccccacccccggcccccccagagaaggacagtccccagccagccaggcaggcacccagcatccaccagcccaggcgacggcccattcccaaagcagccccgagttcaaaggttctctagctagtctgtcggatagtttaggcgtttccgtgatggccactgaccaggactcgtacagcactagctccacagaagaggagctggaacagtttagctctcccagcgtgaagaaaaaacccagcatgatcctcggaaaagcgcggcataggttgtcattcgcttcattctcctcgatgttccacgccttcctttccaataaccgaaagctgtataagaaggtggtcgagctcgctcaggacaagggctcctattttggaagcctggtgcaagattacaaggtgtactcactggaaatgatggcccgccaaacaagcagcaccgaaatgctgcaagaaatccggactatgatgacccagctcaagtcttacttattacaatctactgaactgaaagctttggtcgacccagccctgcactctgaagaagagctcgaagctattgttgagagtgccctttataagtgcgtgctcaagccgctcaaggaggctataaactcctgtctccaccaaatacactctaaggacgggagtctccagcaactgaaggagaaccagctggtcattctggctacaacaaccactgacctaggagtcaccacatcagtgccagaggtgccaatgatggagaaaatcttgcaaaagtttacatctatgcacaaggcgtactccccagaaaagaagatctctatcttgctgaagacctgtaagcttatctatgactccatggctctaggaaatccaggaaagccatacggcgctgatgatttcctgcccgtactcatgtatgtcctggctcgctctaatctcaccgaaatgctcctgaacgtggaatacatgatggagctgatggaccctgccctccaactgggtgaaggatcttactaccttacaacaacatacggtgcgctggagcacatcaaaagctacgacaagattacagtgacgcggcaactgtccgtggaggtgcaggactcgatccacagatgggagcgcagaaggaccctgaacaaggcaagggcttcaaggagctctgtgcaagtcagacccgagtctggcaggggtcccgtgggaccttgccctaggcaccatccatgttgtctcctggccaaagaaccttag

SEQ ID NO: 27180 - DNA, 2466 bp, Artificial Sequence
  Description of Artificial Sequence: Synthetic coding sequence
atggccggcagcgacgccgagtgggtgaccatcgccaacaacctgctcttcaaatgccacattcatctgagaatacatgaattgcaggactgcgacgctaacgtcttcatcgccctgtaccagagcattctcggggaaaaagtccccgacctgatagtgatcccgcgatcacaggaggacgatgcacataacgtgcaggctgtgattgactcgctggccctggattatctccaagtgtctctgagccacatcaccggggagaatattgttaaaggagacaaggaaagcatcaagaatctcctggagattttcgacgggcttctggagtatctgaccgagaggatcagcgaaacatctcatgagaaaagcgaaactgagcaatacttcaaggaaagcgatcggggggagcgcctagaggaacccgaatccacaaaagagtccaagagctcatggaagagggtttcatttggaagatgcagcctgagcagcgaaatgctgggtcccagctgggatggagacgaagcggagtcaacgggggagatcattcggttgggcgatacggcccacacattttcactgcgctcaaatggcgcgcaatgtccgaatgagatgctctctaaaaaagcacttgcaagcccctcttccaagtcacatgaggacatgctgtatccgccctccgtgctatcaaagagtcggacgtctttcgtcgaggacacggaaacgctctctgttagtggaatcccaaatgcccgtaagctgggtgaacccatccgcgccgctataccccttcatcctccatatcacccatccgagccccgagctccctgtcccatcggcaaagagtacctgcactctagccattgctcaccggccgtaaactctacaggagagcatacagaatttagcggtgaccttgatgatggcctcttcctgatttcaaagctccctaaaggatccaagtgggaggtttacccagcccaggttcaaggtccccggacgcgcaagcccccgaaggggaagagaaatgagaaccgggcgacggcatcatcctgcaattcgccgtttccccagagaccaaggaaacgattaaccgagcaggaacttcacgacgtctccgagaagctttcacagcggctctccgagctggattggatgctgaagtccgcactaggggataggattaaagagaagacggatcacaaggaagagaataccgggaacgaagaggttgaggacgggacagaagaaaccttgagccaacattccgatggaatcgtggaatacgggcccaaaaagtccagacccggcctgagcatgcgccgaaagccaccataccggagccattcattaagccctagccccgtgaataaacacaaacagtttcatcttgagcgcaagcggcagagaaagcccagagagaccgacgtcagacagtttcaagctcaggctttcactgaggcctttgaaagagagctcagacgccataaagtgcaggaaaatatcgggccactccggatccacgagaaagaggaagagactgaaaagatctatcgcggagaagctgtcaggaaggggactccggagtgttctcagccatggaaaatttacagccgaaagaccaccactcaatcgctacggggcggcctgcccaaacctaacaaggcggtccccatgaaggtgagcgagcactccctcctgcccttgatgctggaacaattccccttcctgtatgtgtctgggcccaccctctctaaaatgtggaagcagcaaatagcacaggttgaacaacttaaaaaagaggcatgtagggagaataggtcaaagaaaaaattgcaggatgagatcgaggaagccttgcggcggcatgacctacttacaacactcgttaagaaagaatatgaacacaacaagcggctgcaggactttaaagactgcattcgacgccagaggctgacccagtccaaaatcaaggagaaccgtcagcagatcgtgcgggctagaaaatattatgacgattacagagtccaactctgcgctaaaatgatgaggatgaggacacgtgaagagatgatctttaagaagttgttcgaggagggtctcaacatccagaaacagcggctaagagacctgcgaaactacgccaaggaaaagagggatgagcagagaaggcgtcaccaagacgagctcgactcaatggaaaattactacaaggatcagtttagtctcctcgcagaagccatcagccaggagcaccaggaactgaaggcacgagagaagagtcaggcgcagacattgcataaggtcaagcgcgagctgagatcaaagatggagaaagaaatccagcaattacaagatatgataacacaaaacgatgacgacgtcttctttcgagagttggaggcggagcgattccgtagcaggctccagttggcaagctttcagtattctaaaagccccagcctctag

SEQ ID NO: 27181 - DNA, 4560 bp, Artificial Sequence
  Description of Artificial Sequence: Synthetic coding sequence
atgcggatccccgaccagaagtacgtgaccctgaagctgaacgacgtaatccgattcgggtatgactcgaacatgtacgttctggagcgagtgcagcatagagtgcccgaagaagccctgaagcacgagaagtacaccagccagcttcaagtcagcgtgaagggccttgctcctaagcggagcgaggccctgcctgagcacacaccctactgcgaggccagtaatccaaggcctgaaaaaggcgaccggcgcccagggactgaagcagcaagttatagaactccgttatacgggcaaccatcttggtggggggaggacgatggctctaccctacctgacgcccaacgtcagggcgagccatatcccgaacggcctaaaggcccagtgcaacaggacggggaactgcacggttttcgggcccctgccgaacctcaggggtgctcttttagaagggaaccgtcctatttcgagattcccacgaaggagacgccccagcccagccagcctcctgaggtacctgctcatgaaatgcccacaaaggacgctgaggctggcgggggaggagctgctccagtggtccaaagtcatgcctcctttaccattgagtttgatgactgttccccaggaaaaatgaagatcaaggatcatataacaaagttctcgttgcggcagcggcgtccccccggcaaggaggccacacccggagagatggtctcagctgaaaccaaggttgccgactggctggtacagaatgacccttcacttctgcatcgggtgggacctggggacgatcggcatagcacgaagagtgacttacccgtccatacaaggaccttgaagggccataaacacgaggacgggacacagtccgacagtgaagacccgcttgctaaggcggcatctgctgctggagtgccgttagaggcctcaggcgagcaagtgaggttacaaagacagatcaagagagatccgcaggaacttctgcacaaccagcaggccttcgtaatagaattttttgatgaagacactccacgaaagaaacgatcccaaagctttacccatagcccaagcggagatcccaaagctgacaaaagacggggtcctacccccgccgatcgggacagacccagcgtaccggccccagttcaggccgggggtcgaagctccggtcctcagagggctggctctctgaaacgggagaagactgaagagagactaggctctccctctcctgcctcgcgtacgcctgcacgacccttcggaagcgtgggtcgcaggtctcgcctagcccaagatttcatggctcagtgtctccgagagtccagcccggcagctagaccgtctccagagaaggtgccacctgtgctgcctgcaccactgaccccgcatggcacctcccctgtcgggccacctacgcctccaccagccccgaccgatccgcagttgacgaaagcgagaaaacaagaagaggatgactccctctctgacgcaggaacgtacactatcgagacggaagctcaggatactgaggtggaagaggcccgtaagatgatcgatcaggtattcggggtgttggagtctccagaattgtctcgcgcctcttccgctacatttaggcctgtcatccggggggaccgagacgagtcggacgacggcggagtggcccagaggatggccctgctgcaggagtttgctagcagacccctgggagctgccccacaggctgaacatcagggtctgccagtgcctggttcccctggaggacaaaagtgggtgagccgatgggccagtctggctgactcctacagcgaccccgggctgacggaggacggcctcggcagacggggcggagagcctgaaggctcgctcccggtcagaatgcgtcgccggcttccccaactgccatccgaacgggcagacagtcccgccgggcctgaatcatcaaggaggtcagggcccggcccgcccgagctggattccgagcagcccagccgactgttcggccaggaagagctagacccagattcattgtcagatgctagcggcagtgatgggggacgcggtcctgagcccggggtggaaccgcaggatagtagaagaaggtcaccacaggagggacccacttggtctcgaggccgcaggagcccacgtgccccaggggaacccacacccgcatctttcttcattggcgaccagaatggggacgctgtcctgagccgcaagccgctggcagctccaggcgatggtgaaggcctgggacagacagcccagccctcccctccagctagagacggggtgtatgtgtcggccaacggcaggatggtgatccaacttcggcctggtcgaagtccagaacctgatggtccagcccctgcctttcttaggcaggagtctttcacaaaggaaccagctagtggcccacctgcaccggggaagcctccacacatatctagtcacccactgctacaggatctggccgcaaccagagccgccagaatggatttccattcccaagacacccatttgattctcaaagaaacagagaccgctttggccgccctggaggcgcgacttctgtccaacagtgtggacgctgagtgcgagggagggtcaacgccacgcccccctgaggatgccttatccggcgactctgatgtggacactgcctctacagtgagccttcgctctggcaagtcaggcccttcacccaccactccacagcctctgcgcgcccagaaagagatgtctccttcgcctcccgcagctcaagatcccggtggaacagccctggtctccgcgcgggaacagagtagcgagagacagcaccacccactaggtcccacggacatgggaagaggcgagccggtgaggcgaagtgctatccggaggggtcatcgtccccggggcagtctcgattggcccagcgaagagagagggcccgtcctggcgcaccttccgagttccgatgtgatggcctctaatcatgagaccccggaagcaacgggcgcagggcgccttggatctcggcgtaagcccgcagctcctccgccctcccccgctgcccgcgaggagcagagccgcagtagtgcctccagtcagaagggcccacaggcactgacaagaagcaattcactctctacccctaggccaactcgagccagcaggctgcggagggccagactgggtgatgcttcggatactgaagccgcagatggggagaggggcagtctcgggaaccctgaacctgtgggtaggcccgcagccgaacaggcaaaaaagttgtctaggctggacatactggcaatgccacgcaagcgggcagggagttttacaggcacaagcgacccagaagccgcccctgctagaaccagtttttcaggacgtagtgtagagctctgctgcgcaagcaggaaacccacaatggccgaggccagagccgtttctcgaaaggccgccaacaccgcaacaacaacaggcccaagacagcctttttcccgagctcgcagcgggagtgcgcgatacacctccaatacccggcgtcggcagcaaggctccgactatacgagcacatctgaagaggagtacgggagcaggcacggtagtccaaaacacacgcggagtcatacctccaccgccacacagacacctcgtgcaggatcatcctcaagagcacgtagccgggccccaggacctcgggataccgacgacgatgaagaggaaccggatccttacggctttatcgtgcaaaccgcagaaatcgcagaaattgcccggctgtcgcagacattagtcaaagatgttgccatcttggcacaagaaatccatgatgttgcaggagacggagatactctgggttcctccgaacccgcgcacagtgccagcctatccaacatgccctctacgcctgccagcacaattagcgcacgggaagagcttgtgcaaagaatccccgaagccagtctgaacttccagaaggttccacccggaagcctaaatagcagagactttgaccagaatatgaatgactcatgtgaggatgctttggcaaataagaccagaccgaggaatcgcgaagaggtgatatttgacaacttaatgttgaaccctgttagtcagttgtctcaggccatccgggagaacaccgagcatctggctgagaaaatgaagatcttgtttcagaatacaggaagagcgtgggaggacctagaggctcgcatcaacgctgaaaatgaagttccaatccttaagacctcaaacaaggaaatcagctccattctgaaggaactgaggagggttcagaaacagctggaggtgattaatgcgatagtggaccccagtggcagtcttgaccttctgaccggaaatagatctctggcttctagtgcacaacccggcctgggtaagggcagagtggccgctcagtcacccccatctccggcatccgctgaggcgctgctgcccgccttgcctctgaggaattttccgcaaagggcttcatgcggacctccaagcctcccagatccgaccttcttgccagatgccgagcgcttcctaatctag

SEQ ID NO: 27182 - DNA, 378 bp, Artificial Sequence
  Description of Artificial Sequence: Synthetic coding sequence
atgcccagcgagaagaccttcaagcagcggcggaccttcgagcagcgcgtagaagatgtgcgtttgataagagagcaacatccgacgaaaatccccgttatcattgaacgctacaagggagaaaagcaactccccgttctcgacaaaacaaagtttctggtgcccgaccacgtcaacatgtctgagttgattaagattattcgcaggaggctccaattgaatgccaatcaagcgtttttcctcttggtcaacggacactctatggtatctgtttcaacgcccatctctgaggtgtatgagagtgaaaaggacgaagatgggttcctatacatggtatgtgctagccaggagacgttcggaatgaagttgtccgtgtag

SEQ ID NO: 27183 - DNA, 3525 bp, Artificial Sequence
  Description of Artificial Sequence: Synthetic coding sequence
atgcccctgcccttcggcctgaagctgaagcggacccggcggtacaccgtgagcagcaaaagttgcctcgtggcccgcatccagcttctcaataacgaattcgtggagttcactctatcagtcgaatctactggacaagagtcactggaggccgttgctcaaagactcgaactccgcgaagtaacctatttctctctatggtattacaataaacagaaccagcgtagatgggtggaccttgagaaacctctgaagaagcaactggacaaatatgcattagagcccaccgtttatttcggagtcgtgttttacgtgccctccgtgtcacagctccagcaggagatcacccgctaccagtactatctgcagctgaagaaagatatcctggagggttcaatcccttgcaccctcgagcaggctatccaactggccggactcgcggtacaggctgatttcggagatttcgatcaatatgaatcacaagactttctgcagaagttcgctctcttccctgttgggtggttgcaggatgagaaagtgcttgaagaagcaacgcagaaggtggccttgctgcaccagaagtacagaggcctcacagctccagatgcggaaatgttgtatatgcaggaagtcgagcgcatggacgggtatggggaagaatcctaccccgcaaaagactcccaaggaagtgatatcagtataggtgcctgtttggagggcatttttgtcaagcacaaaaatggccgacaccccgtggtctttcgctggcatgacatcgcaaacatgtcccacaacaaatcttttttcgcactcgaactggccaacaaagaggagaccattcaatttcagacagaagatatggaaaccgctaaatacatatggaggctctgcgtggcacgacataagttctatcgcctgaaccagtgcaatctgcagacacagaccgtcacagtgaatcctattaggcggagatcttcctctcgaatgagtctgcctaaaccccagccctacgttatgcccccacctccccagctccattacaacggacattatactgaaccatacgcttcttctcaggacaatctattcgttccaaatcaaaacggctattactgtcactctcagacgtctctggacagagcccagatcgaccttaatggacggattagaaacgggtccgtgtatagcgctcatagcaccaactctctgaacaacccgcagccttatttgcagcccagcccgatgtcatccaacccctccattacaggatctgacgtgatgcgcccggactacctgccctcacaccggcatagcgccgtaatccctcctagctatcgccctacaccagactacgaaaccgtgatgaagcaattgaatcgcgggctcgtgcatgctgagcgacagtcccattccctcaggaatctcaacatcggaagctcgtatgcttactccagacccgcagccctggtctattctcagcccgagatccgagagcacgctcagctgccttcgcccgccgccgcccattgcccattcagcctgtcctactcctttcactccccatccccctacccatacccagctgagcgcagacctgtcgtgggggcagtctctgtgccagagctcacaaatgcccaacttcaggcccaggattacccatcgccaaatattatgagaacccaagtataccgtccccctcctccctatcccccacctcggccagccaactcaactccagacctcagtaggcacctgtatatttcaagtagcaatccagatctgattacccgtcgcgtacatcacagtgttcagaccttccaggaggacagcctccccgtggctcacagtctgcaggaggtctcagagcctctaactgctgcacgtcatgcacagctgcacaagcggaactccatcgaggttgcaggattaagccatggcctggaaggtctgcggctaaaggaaaggaccctgagtgcttctgcagctgaagtcgctcccagggccgtgtctgtgggatcccagcctagtgttttcactgagcgtacccaacgcgagggccccgaagaggccgaggggctgagatacggccacaagaagagtctatcagatgcgactatgctgatccactcatcagaagaggaggaggatgaagattttgaggaggagtcaggagcccgcgcccctccggcccgggctcgcgagccccggccgggcctcgcccaagatccaccgggatgccccagggtgctcctggctggtcctctgcatatcctggagcccaaagcacatgtgcccgacgctgagaagagaatgatggatagttcacccgtccgcacgaccgccgaagcccagcgaccatggcgcgatggactgctgatgccatcaatgagcgaaagtgatcttaccacctccggccggtacagagcccggcgggatagcctaaagaaaagacccgtctccgacctgctgagcgggaagaaaaacatcgttgaggggctgccaccactgggagggatgaagaaaacccgtgtggatgcaaaaaagatcgggccactgaagctcgccgccctgaatggactttccctctccagggtgccactgcctgacgaggggaaggaggtggctacacgtgcaaccaatgatgagcgctgtaagatcctggaacagcgcctggaacaaggtatggtgtttacagaatatgagaggatattgaagaaacgcctggtggacggagagtgcagtacagcccggcttccagaaaatgctgagcgtaatcggttccaggacgtgctcccttacgatgacgtgcgtgtggaacttgtcccaacgaaggaaaacaacaccgggtacatcaatgcaagtcacattaaagtttcagtttccggcattgaatgggactatatcgcaacccaaggcccactgcaaaacacctgccaggacttctggcagatggtctgggagcagggaatagcgatcattgcaatggtcaccgccgaggaggagggtggacgggaaaaatcctttcgatattggccccgcctcgggagccgccataacaccgttacctatgggcggttcaaaatcaccacgcgatttcgtacagacagtgggtgttatgcgaccacagggttaaagatgaaacatcttcttactgggcaagaaagaactgtgtggcacctgcagtacacagattggcccgagcatgggtgccccgaagacttaaaaggttttctgtcatacctagaggagatccagtccgtgcggcggcatacaaactctacttccgacccccagagccccaacccccctctcctagtgcactgtagcgccggggtcggacgcactggggtcgttattctctctgagattatgattgcttgtttggagcacaatgaggtgctagatatccctagagtgctcgatatgctgagacaacagcgaatgatgctggtacagacgctctgtcagtacaccttcgtgtatcgtgttcttattcagtttctgaagtctagccgtctaatttag

SEQ ID NO: 27184 - DNA, 1245 bp, Artificial Sequence
  Description of Artificial Sequence: Synthetic coding sequence
atgcagaccttcctgaagggcaagcgggtgggctactggctgagcgaaaaaaaaattaagaagctgaacttccaggcattcgctgaactttgtcgtaaacgggggatggaggtcgtgcagcttaacctgtctcggcctattgaggaacaaggtccactcgacgtgattattcataagctaaccgacgtaattcttgaggcagatcaaaacgattcacaatctctggaacttgtccacagatttcaggagtatatagatgcacacccagaaactatcgtcctcgatccactgcccgcgataagaacgctcctggaccggagcaaatcttatgagctgataaggaagatcgaggcatacatggaggatgaccgcatctgcagtcccccttttatggaacttacctcactttgtggtgacgacactatgcgtctcttggaaaagaacggccttacgtttccattcatctgcaagacccgcgtggctcatgggaccaactcccacgagatggcaatcgtgtttaatcaggaaggattaaatgcaatacagcccccatgtgtggtacagaacttcattaatcacaatgccgtactatacaaggttttcgttgttggcgagagctatactgttgttcaacgcccctcgctgaaaaactttagcgctggaaccagtgatagagagtctatattctttaactctcataatgtgtctaagcctgagtcgagcagtgtgttaaccgagttggacaagatcgagggggtgtttgagaggcctagcgacgaggttatccgtgaattaagtagggcccttagacaggcccttggcgtaagcttgtttggcattgatattataatcaacaaccagaccggacagcacgcagtaattgatataaacgcattccccggctatgaaggcgtcagcgagttcttcactgacctgctgaaccatatcgcaaccgtcttgcaagggcagtctacagccatggccgccactggagacgtggcactgctgcgccattctaaattgctagcagagcccgccggcggactggtgggggaaagaacctgttctgcctccccgggctgctgtggaagcatgatgggccaggacgcaccctggaaagccgaggcagacgccggaggcacggcgaaactaccccatcagcgactcggatgcaacgctggcgtcagtcctagcttccaacagcactgtgtggccagcctggccacaaaagcctcttcgcaatag

SEQ ID NO: 27185 - DNA, 2256 bp, Artificial Sequence
  Description of Artificial Sequence: Synthetic coding sequence
atgagcgaggaggagctgaccaaggccatggagggcctgggcatggacgaaggagatggtgagggtaacatcctcccaatcatgcagtccataatgcaaaatctattaagtaaagatgtgttataccccagcttaaaggaaataactgagaaatacccagagtggcttcagtcacaccgggaatccctcccaccagagcagtttgaaaaataccaagagcagcatagcgttatgtgtaaaatatgcgagcaatttgaggcagagacccctaccgactccgagacgacacagaaagcaaggttcgagatggtccttgacctaatgcagcagctgcaagatcttggacaccctcctaaagaattagcaggagagatgctcacgtggttgtttttctgcgggagccagtgggtttatgggccgtggctgacttacgtgggttggcttcagcaaaccagtttcaagatgagtagtaagggtagctcaaccgacggacgcaccgatctggcaaatggatccttgtccagctctcctgaagaaatgtcgggggccgaggaaggtcgcgaaacctcttctgggatcgaggttgaagcatcagatttgagtctcagcctgacaggcgacgacggagggccaaatcggacgtctactgaatcacgtggaaccgataccgagagctcaggagaggacaaagactcagattccatggaagatacaggccattattcgattaatgacgagaaccgagtccatgatcgcagcgaagaagaagaagaagaggaggaggaggaagaggaggagcagcctaggagaagagtccaacgtaaacgtgctaatcgggaccaggacagtagtgacgatgagcgagccttagaggattgggtgtcctctgagacctcagcactacctcgcccacgctggcaggcgctgcccgcgctgcgggagcgcgaactgggatcttcagcaaggtttgtatatgaggcttgtggcgcgcgcgtcttcgtccagaggtttaggctgcaacatggactggaaggacacacgggttgcgtcaatactttacacttcaaccagagagggacatggttggcaagcgggtcagatgatctgaaggtcgttgtgtgggactgggtgagaagacagcccgtcttggattttgagtccggacataaaagcaatgtgttccaagctaagttcttaccaaattcaggggattctaccctagcaatgtgcgcccgagacggccaagttcgggtggcagaacttagcgccacgcagtgctgtaagaacactaaacgcgtggctcaacacaaaggtgcctcgcataaactggctttagagcctgattccccgtgtacattcttgagcgctggagaagatgcagttgttttcacaatcgacttgcggcaggacaggcctgccagcaagctagttgtgaccaaggaaaaggaaaaaaaggtcggactttacaccatttatgtgaaccctgccaacactcaccagttcgcggtgggaggacgggatcagttcgtgcgtatctatgaccaaaggaaaatcgacgaaaatgagaacaatggggttctgaaaaagttttgtcctcatcacctagttaacagtgaatctaaagctaacatcacatgcctcgtctattcccatgacgggactgagctgcttgccagctacaacgatgaggacatctatctgttcaattcatcccacagcgacggcgcgcaatacgtgaagaggtacaaaggccaccggaataacgctacagtcaagggggtgaatttctacgggcctaaatccgaattcgtggtgtctggttcagactgtggacacatatttttatgggagaagagtagctgtcaaattatccagtttatggagggggacaagggtggcgtagtgaattgtctggagccacatccacacttgcctgttctcgccactagcggcctggaccatgatgttaaaatctgggccccaaccgctgaggcatccacagagctcactgggctgaaggatgtcattaagaagaataagagagaaagggatgaggactcactccatcagactgatctgtttgacagtcacatgctttggttccttatgcaccatctgcgacagcgccgccaccaccgccggtggcgtgagcccggcgtgggagccacagacgcagattccgatgagtcaccctccagttccgacacctcagatgaggaagagggccccgaccgggtgcagtgcatgccgagttag

SEQ ID NO: 27186 - DNA, 1056 bp, Artificial Sequence
  Description of Artificial Sequence: Synthetic coding sequence
atgaccctgcggctgctggaggactggtgccggggcatggacatgaacccgcggaaagccttgttaatagctggaatcagccaaagctgcagtgtggcagagatcgaggaagccctgcaggctggactcgcccctctgggcgaatacaggctgctgggcaggatgttccgaagggacgaaaataggaaagtggctttggtggggttgacagctgagacgagtcatgctctggtgccaaaagagatccccggaaaaggaggcatatggagagtgatttttaagcctcccgatcccgataatacctttttgtcacgccttaacgagtttttagccggagaggggatgacagtaggggaactctctagagcattgggccacgagaacgggtccctcgatccagaacagggtatgattccagaaatgtgggctcccatgctggcccaggctctcgaagcactgcagcccgccctgcagtgcctgaaatacaaaaagttaagggtattttcaggccgagaaagcccagaacccggagaagaggagtttggtcgatggatgttccataccacccagatgatcaaagcctggcaagtccccgatgtggagaaacgaaggaggttgctagaaagtttaaggggacctgccctggatgttattagggtgctaaagatcaacaacccactgatcacggtggatgagtgtctgcaggcgcttgaagaggtgtttggcgttaccgacaacccgcgcgaactacaggtgaaatatctcacaacataccagaaggatgaagaaaagctctctgcgtacgtcctgaggctggagccactgctgcagaagctcgtgcagcgcggggctatcgagagagacgcggtaaaccaagcgcgattggaccaggtcatcgcaggagccgttcacaagaccatcagacgggagctcaatctccctgaggacggccccgctcccggattcctccagcttctagtgttgattaaggactatgaagctgccgaggaagaggaagctctgctccaagctatcctcgaaggcaactttacgtag

SEQ ID NO: 27187 - DNA, 2394 bp, Artificial Sequence
  Description of Artificial Sequence: Synthetic coding sequence
atggccgtgcagggcagccagcggcggctgctgggcagcctgaacagcaccccaacagcaattccgcagctgggtctcgctgccaaccagactggtgcccggtgcctggaagttagtatctccgatggactcttcctctcattgggtctggtgagtctcgtggagaacgccctggtggtggctaccattgctaaaaaccgtaatctgcacagcccaatgtactgcttcatttgctgtctggcactttccgacttgctggttagcggctcgaacgtgctggaaacagcagtcatcctactgctggaggctggggccctcgtggcgcgcgccgcagtgctgcagcagctggataacgtcattgacgtcataacctgttccagtatgttatcttcactttgctttctgggtgctatcgctgtcgatcgctacatcagcatattctatgccttgcgctaccattcaatagtgacgctgcctcgcgcccgaagagcagtcgccgcaatctgggtagcttctgttgtgttttcaaccctgtttattgcttactacgatcacgtggcggttctgttatgtctggtcgtgttttttctggcgatgctggttcttatggccgtgctgtacgtgcatatgttagccagggcctgccaacacgctcagggaatcgcgcgactccacaagagacaaaggcctgtgcaccaggggttcggactgaagggtgccgtcactctgaccattcttctcggcatttttttcctgtgctggggccccttctttctgcatttgacactcatagttctatgccctgaacatcccacatgtgggtgcatctttaagaactttaatctctttctggcgttgataatctgcaatgcaatcattgaccccttgatctacgccttccactcccaagagctccggcgcactcttaaagaggtgctgacttgtagctgcagtcaggatagggccctcgtctcctgggatgtgaagagcttgggtggaagcgtttgccaggagttgttgccacaacagccccaggagaaaggactgtgtgaccaaaaggcatcgagcaccgccctgcaacgccttttacagaaggaattttgggaggttataagcgatgagcatggcatcgacccctctggcaattacgttggggacagcgatctccagctagagcggatctctgtgtattacaacgaggccagcagccataagtatgtcccccgtgcaatcctggtggacctggagcctggaaccatggatagcgtgaggagcggtgctttcggccacctgttcagaccagataatttcatctttggacaaagcggtgccggaaacaattgggctaagggacattacacagaaggggcagagttggttgattcggtgcttgatgtggtaagaaaagagtgcgaaaactgtgactgtctgcaaggttttcagctgacacatagcctgggaggaggaactggaagcggaatggggacccttctgatctcaaaggtgcgagaagaatacccagacaggatcatgaacactttcagtgtggtccccagcccaaaggtctctgacaccgttgtggagccttataatgccacactctctatccaccagctggtcgagaatacagacgagacctattgcattgataatgaggcactatacgacatctgttttcgcactttgaaactggcaacaccgacctacggtgatctcaaccacttggtgagtgctacgatgagcggcgtgacaacttctttacggtttcccggacaactaaacgctgacctgaggaagcttgccgttaacatggttccatttccccggctgcacttttttatgcccggattcgcccccctgacagctcgcggctcacagcaatacagggctcttacagtgccggagctgacacagcaaatgttcgacgcaaagaacatgatggccgcctgtgacccgcgtcacggtaggtaccttactgtggccaccgtatttaggggtagaatgagcatgaaagaggtggatgaacaaatgctggctatccagtcaaaaaattcctcttacttcgtcgagtggatccccaacaacgtcaaggtagccgtgtgtgacattcccccgagaggtctcaaaatgtcatctacattcataggcaattcaactgctatccaggagttatttaagcggatttccgagcaatttactgctatgtttcgcagaaaggcgttccttcactggtataccggagaagggatggacgagatggaattcaccgaggccgagtccaacatgaacgacctcgtgagcgagtatcagcagtaccaagatgccacagccgaagaggaaggtgaaatgtatgaggatgatgaagaagagtcagaagcacaggggcccaagtag

SEQ ID NO: 27188 - DNA, 99 bp, Artificial Sequence
  Description of Artificial Sequence: Synthetic coding sequence
atggccgagagcagcagcgagagcgaccacttccggtgccgggaccgactgtcaccctgggccgcaaggagtacgcataggggcaccaggagtctgtag

SEQ ID NO: 27189 - DNA, 453 bp, Artificial Sequence
  Description of Artificial Sequence: Synthetic coding sequence
atgaccgacacccggcggcgggtgaaggtgtacaccctgaacgaggacagacagtgggatgatcgggggactggccacgtgtcgagcggctacgtggagcgactcaagggcatgtcactgctcgtccgcgctgagtcagatgggtctctgctgctggagtctaaaatcaatcccaacaccgcttaccagaagcaacaggacacactgatcgtctggagtgaggctgagaattacgatctagcgctgagcttccaggaaaaagccggctgcgatgaaatctgggagaagatctgccaggttcagggcaaagacccatcagtggacattacgcaggacctggtcgatgaatccgaggaggaacggtttgacgatatgtcatcaccgggcctcgaactgccttcatgcgagctcagccgtttggaggagatcgctgagctcgtggcaagcagctag

SEQ ID NO: 27190 - DNA, 504 bp, Artificial Sequence
  Description of Artificial Sequence: Synthetic coding sequence
atggactggaaggaggtgctgcggcggcggctggccacccccaacacttgcccgaataagaaaaaaagtgagcaggaactcaaagacgaggagatggatctgttcacaaagtactactctgagtggaaggggggtcggaagaacacaaacgaattttataaaacgatcccaagattctactataggcttccagctgaggacgaggtattgctccagaagctgagggaagaatcacgtgcggtttttctgcaaaggaagtcccgagagctcctagacaatgaagagctgcaaaacctatggttcctgctagataagcaccaaacacccccaatgattggagaggaggctatgattaattacgaaaatttccttaaagtgggcgagaaagccggcgccaagtgtaagcaattttttactgccaaagtgttcgcaaagctccttcataccgattcatatggccgaatttcaattatgcagttcttcaactacgtgatgcgaaaatag

SEQ ID NO: 27191 - DNA, 507 bp, Artificial Sequence
  Description of Artificial Sequence: Synthetic coding sequence
atgcagaccttcctgaagggcaagcgggtgggctactggctgagcgagaagaagatcaagaagcttaatttccaggccttcgcagaactgtgcagaaaacgtggcatggaagtggtacagcttaatctcagtcggcccatcgaggagcagggacccctcgacgttattatccacaaactgactgacgtcatccttgaggcagaccagaatgattcccagtcacttgagctggttcatcgctttcaggaatatattgatgcacacccagaaactatagtgttggatcctctccctgctatcaggaccctgctggaccggtccaagtcctacgagctgattaggaaaattgaagcctatatggaggatgataggatctgtagtccaccctttatggagcttacatccctgtgtggcgatgatacgatgcgcctgctggagaagaatgggcttaccttccccttcatttgtaaaacccgggtggctcatggtaccaactctcacgagtag

SEQ ID NO: 27192 - DNA, 822 bp, Artificial Sequence
  Description of Artificial Sequence: Synthetic coding sequence
atgcccggcctgagctgccggttctaccagcacaagttccccgaggtggaggacgttgtgatggtgaatgtgcggtcaattgcagagatgggcgcatatgtgtcgctcctggaatataacaacatagaggggatgattcttttgtcagagttaagtcggaggcggatacgaagcatcaacaaacttatcaggatcgggaggaatgaatgtgtggtagtgatccgagtagacaaagagaaaggttacatcgatctctctaaacgccgcgtaagcccggaggaggctattaagtgcgaagataagtttactaagagtaaaacagtctacagcattttacggcatgtggctgaggtgctggagtacaccaaggacgaacagctggagtcccttttccagaggacggcatgggtatttgatgacaaatataaaaggccagggtacggggcgtatgatgcctttaaacacgcagtgtccgacccgtctatcctggactctctcgatttaaatgaggacgagcgggaagtcctcattaataacattaaccgcagactcacacctcaggcagtcaaaatccgggcagatattgaagtagcatgctacgggtacgaaggcatagacgcagtgaaggaggctctgcgcgccgggctcaattgtagcacagaaaacatgcccatcaagatcaatcttatcgccccacctcgatacgtgatgactactactacactggaaaggacagaaggcttgtcagttctctcccaggccatggctgtgataaaggagaagatcgaggagaagagaggagtgtttaacgtgcagatgtag

SEQ ID NO: 27193 - DNA, 2757 bp, Artificial Sequence
  Description of Artificial Sequence: Synthetic coding sequence
tgacggaccaacagccggttcgtgaaggtggtgctgatgagcgccactatttcatgtaaggagtttgcagactacttcgcggttcctgtccagaacaagatgaacccagcttacatttttgaggtggaggggaaacctcactcagttgaggagtactatttgaatgatctcgaacatatccaccattctaagctgtcaccgcacctgcttgaggaaccggtcataacaaaggatatctatgaggtggcagtgagcctgattcagatgtttgatgacttggacatgaaggagtcagggaacaaagcatggtccggggcccagtttgttctggaacggtcctctgtgcttgtcttcttgcctggcctcggagaaattaattacatgcatgaactgctgacttcactcgtgcacaaacggctacaggtgtatcccctccacagctccgtggccctggaggaacagaataatgtgtttctctctcccgtgcctgggtacaggaaaatcatcctgtctacaaacatcgcagaatcctctgtgacagtgccagatgtgaaatatgttatcgacttttgcttgactcgcacgctcgtctgtgatgaagatacaaattatcagtcactgaggctgtcatgggcgtccaagacttcttgcaatcaacggaagggtcgagccgggcgagtctcccggggatactgttacaggcttgttcacaaagatttctgggataactccatccctgatcacgtggtccccgaaatgttacgttgccctctcggcagcaccatcctcaaggtaaaactcctggatatgggggaaccgcgtgctctgctagctacagctctgagtccacctgggctctctgacatcgaacggactatattgcttcttaaagaagtgggtgcattggctgtttccggccagcgggaagacgagaatccacacgatggcgaactgacttttcttggacgcgtgcttgctcagctacctgtgaatcaacagctcggcaagctgatagtcttaggccacgtcttcggatgcttggacgaatgtctcattatcgcggccgcgctcagtttgaagaatttttttgcgatgccctttaggcagcacctggacggttatagaaacaaggtgaacttctccggctcatcaaaatccgattgcatcgccctggtagaggcctttaagacttggaaggcttgcaggcagaccggcgaactccgttatcccaaagatgaactcaattggggcagactgaactatatacaaataaagagaatacgggaagtcgccgagctatacgaggaactgaaaactaggatttcccagttcaacatgcacgtggacagtcggagacctgtgatggaccaagagtacatctacaagcagcgttttatcttacaggtcgttctggccggtgcattctatcctaactacttcacctttggccagcccgacgaagaaatggctgtccgggagctcgccggaaaggacccgaagaccactgtagtcttgaagcatatccctccatacggattcctgtactataagcagctgcagtctctcttccgtcagtgcggtcaggtgaaaagtatcgtctttgacggtgccaaggcctttgtggaattctctcgcaaccccaccgaaaggttcaagacgctgcccgcggtatatatggccataaaaatgtcccagctgaaagtttccctagaactcagtgttcactcagctgaggagatcgaagggaaggttcaaggcatgaatgtgagtaaacttcgcaacacacgcgtcaacgtggacttccaaaagcagaccgtcgaccctatgcaggttagcttcaacaccagtgaccgaagccagactgtgactgatctgcttctgaccattgacgtcaccgaggtggtcgaggtcggacatttctgggggtaccgaatagacgaaaacaactcagagattctcaaaaaactgacggctgaaatcaaccagttaacgctggtgcccctgcctacccatccgcatcctgatctggtgtgtctggcccccttcgctgactttgacaagcagagatatttcagagcccaggtcctttatgtgagcggaaacagcgccgaggtgttttttgtggattatgggaacaaatcccatgtggacctgcaccttctgatggaaattccatgtcaatttttggagctgcctttccaggccttggagtttaaaatatgtaagatgaggcccagcgccaagtccctggtatgcggaaagcactggagtgacggggcgtctcagtggttcgcttccctagtcagtggatgtacactgttagtgaaggtctttagtgtggtccactccgttctgcacgtggacgtgtaccagtacagcggcgtgcaggatgcaatcaacattagggatgtattgattcagcaaggctacgcggaattgaccgaggaaagctatgaaagcaaagtcaatattctaagagccgccataaataagctcgtctgtgacgggccaaacggatgtaaatgtctgggcccggaacgcgtggctcagttgcaagacatcgcacgccaaaagctgctggggctgttctgccagagcaaaccaagagaaaagatcgtccctaaatggcatgagaagccatacgagtggaatcaggttgatcctaagctagtcatggagcaggccgacagggagtcatcgcggggaaagaatacctttctataccagttacacaaattagtagtcttggggacgtag

SEQ ID NO: 27194 - DNA, 507 bp, Artificial Sequence
  Description of Artificial Sequence: Synthetic coding sequence
atggagaagctgagcgccctgcaggagcagaagggcgagctgcggaaacgcctaagttatacaacgcacaaattggaaaagctagaaaccgagttcgactctacacgccattacctggaaatcgagctcagacgggcgcaggaagagctggagaaagtgactgagaagttaagacgtatccaatcaaattacatggcactacaacgaataaatcaggagctagaggataaactgtatcgaatgggccaacattatgaagaagaaaagcgcgccctgtcccatgagattgtagctctcaactcacacctgctcgaagctaaggttactatagacaagctgtcagaggataacgagctgtatcgtaaagattgcaacttggccgcgcagctgctgcagtgtagccagacatatggaagagtacacaaggttagtgaattaccctccgatttccaggagagggtcagcctgcatatggagaaacacggctgctccttgcccagcccctag

SEQ ID NO: 27195 - DNA, 636 bp, Artificial Sequence
  Description of Artificial Sequence: Synthetic coding sequence
atggacatgggcaaccagcaccccagcatcagccggctgcaggagatccagaaggaggtgaaaagcgtcgagcagcaggtgattggtttcagcggcctttcagacgataaaaactataagaagctggaaagaatacttacgaaacagctatttgaaattgatagtgtcgacacagagggaaagggagatatccagcaggccaggaaacgcgctgctcaggagaccgaaaggctcttaaaggaactggagcagaatgccaatcatcctcacaggattgaaatccagaatatctttgaggaggctcagagcctggtacgggaaaaaatagttcctttttacaacggagggaattgcgtcactgacgagttcgaggaaggcatccaggacatcatattaaggcttacgcacgtgaagacaggcggcaagattagcctacgcaaggccaggtaccacaccctgacaaaaatctgcgcagttcaagagattattgaggattgcatgaagaaacagccgagcctgccattgtccgaagatgcccatccctccgtcgcaaagataaattttgtgatgtgtgaggtaaacaaggctcgcggagtgctcattgccctgttgatgggagtgaacaataatgaatag

SEQ ID NO: 27196 - DNA, 2985 bp, Artificial Sequence
  Description of Artificial Sequence: Synthetic coding sequence
atgagccagtggacccccgagtacaacgagctgtacaccctgaaggtggacatgaagagcgaaatcccatccgatgccccaaaaacccaagaatcgcttaagggaatcctgttgcaccccgagcccatcggcgccgcaaaatcatttccggctggcgttgaaatgattaatagcaaggtaggaaacgagttcagccacctttgcgacgactcacaaaaacaggagaaagagatgaacggaaatcagcaagagcaggagaaaagtctcgtagtcagaaagaaaaggaagtctcaacaggcaggcccgtcttatgttcagaactgcgtgaaggaaaaccaaggcattctggggttgagacagcatctcgggacaccctccgatgaggacaatgactctagtttctcagactgcctgtcgtcacccagctcatccctccacttcggagatagcgatacggttacgtctgatgaagataaggaagtgtccgtacggcactctcagaccatcctgaacgccaagagcagaagccactctgccagaagccacaagtggcccaggactgaaactgaaagcgtttccggtttactgatgaagcgtccgtgcctgcatgggtcctccctgcggagactgccctgtaggaagagattcgtgaagaacaacagcagtcaacggacacaaaaacagaaagagcgtatcttaatgcagcgcaagaaacgcgaagtcttggctcgccgcaaatatgcactgcttccatcttcatcatcatctagcgaaaacgaccttagcagcgagtcttcgagctcatcaagtaccgaaggtgaagaagatctgttcgtatccgcttccgaaaaccaccagaacaacccagctgtaccttcaggctccattgacgaggacgtggtagtgatcgaggcatcttctacaccccaggtgacagcgaatgaggagattaatgtgacctccacggactcagaggttgaaatcgttacagtgggcgagtcttatcggtcgcggagcaccctggggcacagtagatcacactggtctcagggctccagtagccatgcaagccgtcctcaggaacctcgaaaccgctctcgaatttctaccgtcatccagcccttacgacagaatgcagcagaggtggtggaccttacagtcgacgaggatgaaccaacagttgtgcctaccacttccgctaggatggaatcccaggccacctctgcatctattaacaattccaacccttctacaagcgaacaggcttctgacaccgcaagcgccgtaacctcttcgcaaccaagcacagtttcggagacctccgctactctgacgtctaattccactacagggacaagcatcggggacgactcacgacgaaccacttcctccgccgttacggagaccgggcccccagcaatgcccaggttgccttcttgttgcccacaacacagtccatgtggagggtcttcacagaaccaccacgcccttggccatccccacacaagttgtttccagcagcacggacaccatttccagcaccaccatcaccatcaccatacgcctcaccccgccgttcctgtgagcccttcattttccgatccggcctgtccagtggagagaccacctcaggttcaggcaccctgcggcgcaaacagctccagcgggacttcataccatgaacagcaggctttaccggtagatctcagcaatagcgggattcggtctcacggttccgggagttttcacggcgctagcgcctttgacccatgttgcccagtgtcaagcagtcgggctgctatctttggacaccaggctgcagctgctgccccaagtcagcctctatcctcaatcgatggatatggaagtagcatggtggctcaacctcagccccagccacctccccagcccagcctgtctagttgtcggcattacatgccaccaccatacgcttctctcacccgcccactccaccatcaggcctctgcctgtccacactcccatggaaatccaccacctcaaacacagcccccccctcaggtggactacgttattcctcatcctgtgcacgcatttcactcccagatctcgagccacgcaacctcacatccagtggccccacctccccccacccatctggcttctacagcggccccaattccacagcacctgccccccactcatcaacctatttcccatcacatccctgccactgccccacccgcacagagattgcacccccacgaagtcatgcagcggatggaagtgcagcggcggcgtatgatgcagcatcccacaagggcccatgagagacctcctccacacccacaccgcatgcatcccaactatggacacggacaccacattcatgtgcctcagaccatgtcatcccacccacgacaggcccctgaaaggtcggcttgggagttgggtatcgaagctggtgtgacggctgcaacctacacacccggggccctgcacccccatttggctcactatcatgctccccctagactgcaccacctgcagctgggagctctgccactgatggtgcccgacatggctggctacccccatatccggtatatcagctccggcctggatgggacatccttcaggggtccctttcgtggcaactttgaggagctgatccacctggaggaaaggttagggaatgtaaacagaggggcttcgcagggtactatcgaacgatgcacgtacccacacaaatataagaaagtcactaccgactggttttcccagcgtaaactccactgcaagcaagacggtgaggaagggactgaagaggacacagaggaaaagtgcacaatctgcctgagtatcctcgaggagggcgaggacgtccgccgcttaccttgtatgcacctattccaccaggtttgcgtggatcagtggctcattaccaacaaaaaatgcccgatctgccgcgtcgacatcgaggcacagctgccttctgagtcatag

SEQ ID NO: 27197 - DNA, 1158 bp, Artificial Sequence
  Description of Artificial Sequence: Synthetic coding sequence
atggccctgccccacgacagcaacgagaccagctacctgctgccccctaataacgaggactggggacgtcagaccatacccgacttcgtgtacgggcagaaagacctgatggcagagggaattcagtggcctagaaacgcacctggcatccccgatgctctgcctcaaagcccgttcgatgcggccctgtgttcagcctggaagcagcgcgtcgagctggggctcttccggtataggttgagagagctccagacccagatattgccaggggcggttgggttcgtcgcgcagctgaatgttgaacgcggagtgcagaggcggcctccccagactatcaaatccgtccgccaagcctttgaccctgtgcagtttaacttcaacaagatccgaccgggtgaggtattgttccgtttgcatagagaacccgacctgccagggacattgctgcaggaagatatcctggttgtgattaatgttagtcccctcgaatggggccatgtgctgctggtccctgaacccgctcgtcaattgccccagcggctgttacccggagctctcagggcaggtatagaagccgttctgttatcccttcatcccggatttagagtgggtttcaattctctcggtggacttgcttctgtgaaccacttgcacttacatggatattacttggcccataggttgcccgttgaacaagctccgtctgagccactagaccctggggggcacctgcacttacttcaagacctacctgcgcccggttttctattctacacgcgtgggccaggaccagatctggagagcctaatttcccgggtgtgccgagctactgattacctgacagaccatgagatcgcgcataacctgttcgtgacacgtggcgccccccctggcaaaacctccccttcctccgcacttaccggtgttagggtcatcctttgggctagaaaaagttccttcggtattaaggacggggaggctttcaacgtggccctctgcgagctcgccggtcatctacctgtgaagaccagccaggattttagctctctgacagaagcagccgccgtggccctgatccaggattgcaggctgcctccttcacaggccgaagatgttcaagctgccttggtggctctgatgtctcaggaggagcagtag

SEQ ID NO: 27198 - DNA, 7464 bp, Artificial Sequence
  Description of Artificial Sequence: Synthetic coding sequence
tgagaggaggaggaggacgacgacgacgaggaggaggaggtgagcgaggtggagagttttattcttgaccaagatgacctggagaaccctatgctggagacggcctctaaactgctgctttctggcacagccgacggggcggatttgagaacagtcgatccagagacccaggccagactagaagcactgctcgaagccgcagggatcggaaagctttcaacagctgatggtaaggctttcgcagaccccgaggtgctcaggcggttaacttcttctgtgagctgtgcactggatgaggccgctgcagcactgacccggatgagggctgaatcaacagccaacgctggccagagcgataataggtccctggccgaggcatgtagtgagggggatgtgaacgctgtcagaaagctgctaatcgaaggtcgtagtgtgaatgagcacaccgaggaaggcgaatccctgctctgccttgcatgctctgccgggtattacgagctcgcgcaggtattactagcaatgcacgccaatgttgaagaccggggtatcaagggcgacatcaccccattaatggccgcagcaaatggcgggcatgtcaagatcgtgaagttactgttggctcacaaggccgatgtcaatgcccagagcagcaccggtaacaccgcacttacctatgcctgcgccggaggctacgtggacgtggttaaggtgcttctggaatcgggcgcctctatcgaggatcataacgaaaacggccacacccctcttatggaggctgggagtgctggccacgtcgaggttgcccggctgctgctggaaaatggcgccgggatcaacacccactcaaacgagtttaaggaaagcgctttgactctagcatgttacaagggacatctcgaaatggtgaggtttttgctcgaagccggcgccgaccaggaacataagacagatgagatgcacaccgcccttatggaggcctgcatggatggccacgtagaggttgcccgcctgctccttgactcaggcgcccaagtgaacatgcctgctgactcgttcgaaagtccactgacgcttgctgcttgcggaggacacgtggaacttgccgcactgttgatcgagagaggtgcctctctcgaagaggtgaatgacgaagggtataccccacttatggaagcggcccgggaaggccacgaggaaatggttgccctcctgctggggcaaggcgcaaacattaacgcccaaactgaagagacacaggaaaccgctcttaccttagcatgctgtggggggttcctggaggtggccgatttcctaataaaagccggagctgatattgagctagggtgtagcacacctctaatggaagctgcgcaggaaggtcacctggaactggtcaagtatctgctggctgcaggcgccaacgtgcatgccactaccgctactggcgacactgccctcacctacgcctgcgagaacgggcacaccgacgtcgccgacgtcctccttcaggccggagccgatctggagcatgaaagcgaaggggggcgaacaccactcatgaaggccgccagagccgggcatgtgtgcaccgtgcagttcctgataagcaaaggcgccaatgtcaataggactacagctaataatgaccacactgtcctatcgttggcttgcgccgggggccatctagctgtggtcgagctgctgctggcacacggggcagaccctactcacagattaaaggacggctccacaatgctcattgaggccgctaaaggagggcacacttcagtcgtttgttacctgctggactatccaaacaatctcctatccgcaccacctcctgacgtcacccaactgacccctccttcgcatgatctcaacagagcacctcgagtacccgtgcaggccctccccatggtggtgccgcctcaagaaccagacaaacctcccgcgaacgttgcaacaaccctacccatccgaaataaggccgcaagtaaacaaaagagcagctcacacttaccagctaatagccaagatgtacagggatatatcacgaatcaatcccccgaaagcatagtggaggaggcacaaggcaagctgaccgaactggagcagaggataaaggaggcaattgaaaaaaatgcccagctgcagtcacttgaactagcccatgccgaccaattgactaaggaaaaaatcgaagagctcaacaaaacaagggaagaacaaattcagaagaagcaaaagattcttgaagaactgcagaaagttgagcgtgagctccagctgaaaacccagcaacagttgaaaaaacagtatttggaggtgaaggcccagcgcattcaattgcaacaacagcagcagcagtcctgccagcatttaggacttctgacacccgtgggcgtgggagaacagctgagtgagggcgactatgctagactgcagcaagtagaccccgtgctgctaaaagatgagccccagcagacagcggcccagatggggtttgcgcctattcaacctctcgccatgccccaagccttgccgttggccgcaggaccccttccgcctggctccattgctaatcttacagagctacaaggggttatcgtggggcagccggtcctgggacaggctcaacttgctgggctgggacagggcattttaactgaaacacagcagggactgatggtggctagcccagcccagactttgaatgataccctggatgatattatggctgtatcaggaagggccagcgccatgtcaaacacccccacccattctatcgcagccagcatttcccagcctcagacaccgaccccatctccaatcataagtccttctgccatgctacccatctacccggccatcgatatagacgctcaaacagagagcaaccacgatacagctcttacactggcttgcgctggtggacacgaagagctggttcagaccctcttggaacgaggcgcgtcgattgagcatcgcgataaaaaggggttcacaccacttatcctggccgctacggccggacatgtaggagtcgtggaaatattacttgataacggggcagatatcgaggcgcagagcgaacgtacgaaagatacacccctcagcctggcatgctctggggggcgacaggaggtggtcgagctcctacttgctcgaggagcgaataaggaacataggaatgtcagtgattacaccccactttcactcgccgcctcaggaggatatgtaaacattattaaaatactccttaatgccggcgccgaaatcaattctcggaccggaagcaaattgggtattagtcccctcatgctagctgctatgaacggccataccgcagcggtgaagcttcttctcgatatgggcagcgacatcaatgctcagattgagacaaaccgcaatactgcactcaccctcgcatgttttcagggaagaacagaggttgtgtcactcctgttggacaggaaagcgaacgtggaacatagagccaagactggcctgacccctttgatggaggccgcgagcggagggtacgcggaggtgggccgagtcctgctggataaaggcgcggatgtgaatgcgcctcctgtcccctctagcagagatacagccctcacaatagcagcagacaagggccactataaattttgcgaactcctcatcggaaggggagcgcatattgacgtgcgcaacaaaaaaggaaacacacccctttggctggctgccaacgggggccatctcgatgtggtgcagttactggtacaagcgggcgcagacgtagatgcagccgacaacaggaaaatcacaccactcatggcagccttcaggaaaggccacgttaaagttgtccgctatctagtgaaagaggtcaatcagttcccatcagactctgaatgcatgcggtatatcgctaccattaccgataaggaaatgcttaagaaatgtcacctttgtatggaatccatcgtacaggccaaagatagacaggctgcggaggcaaacaaaaatgcttctatcttgctggaggaattggatcttgaaaagctgagagaagaatcccgcagactggctctggccgccaagcgggagaagcggaaagaaaagagacgcaaaaaaaaagaagagcagagaagaaaactggaggaaatcgaagcgaaaaataaggaaaatttcgaactgcaggcagctcaggaaaaagagaagctcaaggtggaagacgaacccgaggtgctcacagaaccaccaagtgctactaccaccaccactataggcatatccgccacctggaccacactggctgggtcacacggaaagcgcaataacaccattacaaccactagttccaagaggaagaaccggaagaacaaaatcaccccagagaacgttcagattatattcgatgacccacttccaatctcctatagccagcccgaaaaggttaacggggagtccaagagttcatcgaccagtgagtccggggattccgataatatgcggatctccagctgttccgatgagtcgtcgaactctaacagtagccgcaaatctgataatcattcccctgccgtggtaacgactacagtgagttcgaaaaaacaacccagcgtcctagtgactttccctaaggaggagcggaagtctgtgtctggaaaggcctcaatcaagctgtctgagactatttccgaaggaacttcaaacagcctttctacatgcacaaagagcggaccaagtccgttgagcagccccaacggaaaactcactgtcgcatcacccaagaggggccagaaaagggaggagggatggaaagaagtggtgaggcggtctaaaaaagtgtctgtgccatccaccgtaatcagtagagtgattggtagaggcggctgcaacattaacgctatcagggaatttacaggcgcccacatcgacatagataagcagaaagataagactggtgaccggatcattaccatcaggggtgggactgaaagtaccagacaagcaacgcagctcatcaacgccctgattaaggatccagataaggagatcgacgagctcatccctaaaaaccgtcttaagtcttcctctgcgaattccaaaattggcagttctgccccaactactacagctgctaataccagcctgatggggatcaagatgacaaccgtggccctctcttcaacatcccagaccgccactgctctgacggtccctgctatttcaagcgcgtcgactcataaaacgattaagaatcccgtgaacaacgtgcgcccaggtttccccgtttcccttcctcttgcttatccgccaccacagtttgcacacgcactcctagccgcccagacgttccagcaaatacgacccccaagactacctatgacccattttggtggtacgtttcctccagcgcagtctacatgggggcctttccctgtcaggcccctgagtccagcaagggcgaccaattcccctaaaccacacatggtgccacggcatagcaatcagaatagttccgggtcccaggtgaactccgcggggagtctgacctcgtccccaacaacaaccacatcttccagcgctagcacggtgcccgggacaagcacgaacggcagccccagttcaccaagcgtccgtcgtcagctgttcgtcaccgtggttaagacttcgaacgccactaccactaccgtgaccacaaccgcaagcaataataataccgcccccacaaatgcgacttaccccatgccaactgcaaaggagcattaccccgtgtcatctcctagctctccatcaccacctgcccagcccggcggagtctcccggaactcaccactcgattgcggaagcgcgagcccaaataaagtagccagcagctctgagcaagaggccggcagtccacctgttgtggaaaccactaacacacgaccccccaattcctcttcgtcatctgggtcaagtagcgcacattccaatcagcaacagcctccagggagcgtctcccaggaacccaggcctcctctgcagcaaagccaggttcctcctccggaagtgagaatgaccgtcccacctctcgctacaagttccgctccagtcgctgtaccgtctactgctccggtaacctacccaatgcctcagacccctatgggttgccctcagcccacacctaagatggaaacccctgccattagaccacccccccatggtaccaccgcccctcataagaatagcgccagcgtgcaaaactcctcggtcgctgtcctgtcagtaaatcatatcaagcgacctcacagcgtaccgagcagcgtccagctaccctctactctctccacacagtctgcttgccaaaatagcgtccatccagccaacaaacctattgcacccaacttttccgccccactgcctttcgggcccttcagtaccctcttcgaaaattcacctaccagcgcccacgctttttggggtggatctgtggtgagcagtcagagtacccccgagtcaatgcttagcgggaaatctagttaccttcccaattccgaccccctgcatcagagtgacacaagtaaggcccctggctttcgacctccccttcagcgtcccgctccatcccccagtggcattgtcaatatggactcaccatacgggtccgtgacccctagctctacacacttgggcaactttgcctcgaatatcagcggcgggcagatgtatggtccgggtgcgcctctggggggcgcacccgccgctgcgaattttaataggcagcacttttcacctctttctctgttgactccctgcagctccgccagtaatgacagctcagctcagtcggtttcatcaggtgtacgagccccatctccagcaccttctagtgtgccactgggcagcgagaaacctagtaatgtaagccaggataggaaggtgccagtgccaatcggcacagaaagatctgcccgaatacggcagaccggaacgagcgcgccctctgttatcggcagcaacctgagtacctcagttgggcactcaggcatctggagcttcgagggaatcgggggcaaccaagataaagtcgactggtgtaaccccggtatgggtaatccaatgatccatcgccctatgagcgatcctggtgtgttcagtcagcatcaggctatggaacgtgattctacaggcatagtgactccatccggcacattccaccagcatgtgccggcaggctacatggatttcccaaaagtaggcgggatgcccttttcagtttacggaaacgccatgatccccccagtggctccaatccccgacggcgcaggtggcccgatcttcaacgggcctcacgccgccgatccgtcttggaattccctgataaaaatggtaagtagctctacggaaaacaacgggccccagactgtctggacaggcccttgggcccctcatatgaattccgttcacatgaaccagctcggctag

SEQ ID NO: 27199 - DNA, 33 bp, Artificial Sequence; identical to SEQ ID NO: 13651
  Description of Artificial Sequence: Synthetic coding sequence

SEQ ID NO: 27200 - DNA, 462 bp, Artificial Sequence
  Description of Artificial Sequence: Synthetic coding sequence
atggccaccatgatcccccccgtgaagctgaagtggctggagcacctcaattcatcttggattacagaggattctgagagcattgccaccagagagggcgtcgctgtgctttacagcaagttggtgtctaacaaggaggtggtgcctctcccccagcaggtgctttgtctgaaaggccctcagctacctgattttgaacgcgagtctctgtctagcgatgagcaagaccactatttggacgccctgctctctagtcaactagccctcgccaagatggtgtgttcagacagcccctttgctggtgccctgcggaaaagacttctcgttttgcagcgggtgttttacgctctgtccaataaatatcatgacaaggggaaggtgaagcagcagcaacattcccccgagtcttcgtctgggagcgcagacgtgcatagtgttagcgagcgacctaggtcaagctag

SEQ ID NO: 27201 - DNA, 111 bp, Artificial Sequence
  Description of Artificial Sequence: Synthetic coding sequence
atgctgccccccaagcacctgagcgccaccaagcccaagaagagctgggcaccaaatctttacgagctcgacagtgatctaactaaagagccggacgtgatcattggctag

SEQ ID NO: 27202 - DNA, 315 bp, Artificial Sequence
  Description of Artificial Sequence: Synthetic coding sequence
atggcccagagcggcggcgaggcccggcccggccccaagaccgccgttcagatcagggtggcaattcaagaggctgaggatgtggacgagctcgaggacgaagaagagggcgccgaaacccggggagcaggggatcctgcccgctatctgagtcctggctggggctccgcttctgaggaggaaccatcccgaggacatagaacggcccagctcccgtggttggaaagccagcaggtgttctctttgaagcctttcctgctgccgacgggaatcgagttgacacccgagaatccctgggggagcagtgtctcctag

SEQ ID NO: 27203 - DNA, 645 bp, Artificial Sequence
  Description of Artificial Sequence: Synthetic coding sequence
atggccctgccccacgacagcaacgagaccagctacctgctgcccccaaacaacgaagactgggggagacagacgatccccgactttgtttatgggcagaaggacctcatggcagagggaattcagtggccacgcaatgcccccggtattcccgacgcccttccgcagtctcctttcgacgctgcactttgttcagcttggaagcagagagtcgagctgggactgtttcgatacagattgcgggaactccagacccagatccttccaggcgccgttggcttcgttgctcagctgaatgtagaacggggggtgcagagacgaccgccccagaccataaagtctgtacgccaggctttcgacccggtccagttcaacttcaataaaatcagaccgggagaggttctgttcaggctgcatcgcgaacctgatctgcccggaaccctgttacaggaggacatacttgtggtaattaatgtgagccctttggagtgggggcacgtgctgctcgtgcccgagccagctcggcagctaccacagcgtctgctgcctggagctttgcgagccggcatcgaagcagtcttattatctctgcacccaggcttccgggtgggatttaacagtctgggaggtctcgcctcagtgtag

SEQ ID NO: 27204 - DNA, 2988 bp, Artificial Sequence
  Description of Artificial Sequence: Synthetic coding sequence
atgagccagtggacccccgagtacaacgagctgtacaccctgaaggtggatatgaagtctgagataccttccgatgctcccaagacccaggaatctcttaaaggcatcctgttacaccctgaaccaataggggccgctaagtcctttccagccggagtagaaatgatcaattccaaagtgggtaacgagttctctcatctttgtgacgactcacagaagcaggagaaggaaatgaatggtaatcagcaagagcaggaaaagagcttagtggtgaggaaaaaaaggaaaagtcagcaggcaggtccttcttatgtacagaactgcgtaaaggagaatcagggaatcctcggtctacgccaacacctcgggacaccgtcggatgaggacaacgactctagcttctcggactgcctatcttcaccatccagtagtctgcactttggggactcagatacagttaccagcgatgaggataaagaggtgagcgtacgtcactcccagactatactgaacgccaagtccaggtcacactctgcgcgctctcacaagtggcccaggactgagactgagtctgtctctggcctgttaatgaagcggccctgtctgcacgggtcatcattgagacgcttgccgtgtaggaagaggtttgtgaaaaacaacagctctcagagaacgcagaagcagaaagagcgaatcctgatgcagcgcaagaagcgagaggtgctggccaggagaaaatacgctctgctgccttctagttcctcctcgagtgagaatgatctgtcttccgagtctagttcgagctcaagcaccgagggtgaagaagatttgttcgtgtctgcatccgaaaaccatcagaataaccctgctgtgccctctggttccatagatgaggacgtggtggttattgaggctagttcaaccccacaggtgaccgctaacgaagaaataaatgtaactagcaccgacagcgaggtggaaattgtaacggtgggcgagtcatataggtccaggtcaaccctaggccattctagaagccactggtctcagggcagctcctctcacgcctcaaggccacaggaaccacgcaatagatcaaggatttcgacagtcatccagccactgagacagaacgctgccgaagtagtggatctgaccgtggacgaggacgagcctacagttgtgccaacaacctccgccaggatggaaagccaggccacatctgcatctatcaataattcaaatcccagcaccagcgaacaggcctcagatactgccagtgccgtgacctcaagccagcccagcaccgtttcagaaacatctgccacgttgaccagcaacagtactaccggcaccagtattggcgacgacagcagaaggaccacctccagtgccgtgacggaaacaggtcctcctgcgatgcctcggctcccctcctgttgtccacaacattctccgtgcggcggttcttcacagaaccaccacgcactaggccacccccacaccagctgtttccagcagcatggacaccactttcagcaccaccaccatcaccaccacactcctcaccctgcagtgccagtctcgccttcgttttcggaccccgcctgtcccgtcgaacggcctccccaggtgcaagccccttgcggtgcaaattcatccagtggaacctcctatcatgagcagcaggccttgcctgtggacctatccaactctggcattcgttcccacggcagcggctcttttcacggagcttctgcattcgacccttgctgcccagtctcaagctctcgagccgccatctttgggcaccaggcggcagctgccgctccatcccaacccctgtcctccatagacggatacgggtcaagcatggtagcccaaccccagcctcagccccctcctcagccgtcgctgagcagctgtaggcattacatgccacctccatatgcttcccttaccaggccacttcaccatcaggcctcggcatgcccccactcccacggcaacccgcctcctcaaacgcaaccaccaccccaagttgattatgtcattccccacccggttcacgccttccactcacagatctcttcacatgcgacaagccatccggtcgccccgcctccgcccactcatcttgcttccaccgcagcccccattcctcagcacctcccccctacgcatcaaccaattagccaccacatcccggccaccgctccccctgcgcagcggcttcatcctcacgaagtaatgcagcggatggaagtgcagagacgaaggatgatgcagcacccaactggtctgttcgtgttttgtgtgagtcggagggcgcatgaacgtcccccgccacacccccatcggatgcaccctaattacggccacgggcaccacatccacgttccacagaccatgtcgtcgcatccccggcaagctcctgagagatcagcatgggaattgggtattgaggctggcgtaaccgcagctacatacaccccaggcgccctccatccgcatctcgcacattatcacgcgcccccccgcctccaccaccttcagttgggcgcattgcccctgatggtcccggatatggccggatacccgcatatccgctacatctcaagtggcctcgacggcacctcctttcgcggccctttccgcggtaatttcgaggagctgatccatctggaggagagacttggtaatgtgaacaggggcgcaagccagggcaccatcgaacgctgtacatatcctcacaagtacaagaagagaaaactccactgtaagcaggatggggaggaaggaacagaggaggacacggaggaaaagtgcacaatttgcctgtcaatcctcgaagagggagaggatgtgagaaggctgccttgcatgcacctcttccaccaagtttgtgtcgaccagtggctaattacaaacaaaaagtgccctatatgtagagttgacatcgaagctcagcttccaagcgaatcatag

SEQ ID NO: 27205 - DNA, 1851 bp, Artificial Sequence
  Description of Artificial Sequence: Synthetic coding sequence
atggccggcggccggggcgcccccggccggggccgggacgagccccccgaaagttacccacagcggcaggatcacgagcttcaggccctggaagctatctatggtgccgacttccaggacctgaggcccgacgcatgtggccctgtgaaggaacccccagagatcaacctcgtgttgtatcctcagggtttgactggtgaggaggtgtatgtcaaggtggatctgcgcgtcaaatgtccaccaacttacccagatgtggttcccgaaattgaacttaagaacgccaagggattaagtaacgaatctgtgaatcttctaaaatccagactagaagaattagcgaaaaaacactgtggtgaagtgatgatcttcgaacttgcgtatcatgtgcagagctttctgagcgagcataataaaccccctccaaagtcattccacgaagagatgctagagagacgcgcccaagaggagcagcagcgcctgcttgaggccaagcgcaaggaagaacaagaacaaagggaaatcctccatgaaatccagagaaggaaggaggagattaaggaggagaagaaacgaaaggaaatggctaagcaggaaaggctggaaattgcttccctatctaaccaggatcatacctctaagaaagaccccggcggacatcggacagccgcaatcctgcacgggggcagcccagatttcgttggcaatgggaagcatcgagcgaatagctccgggcgaagcagacgcgaaaggcagtacagcgtgtgcaatagcgaggatagccctggttcatgtgagattctttacttcaatatgggaagccccgatcaacttatggtgcataagggaaagtgtatcggatcagacgagcagctgggaaaactggtgtacaatgccctggagacggcaaccggcgggttcgtcctcctttatgaatgggtgctccagtggcagaagaagatgggccctttcctgaccagtcaggagaaggaaaagatagataagtgtaagaaacagatccagggcacagaaaccgaattcaatagcctggtaaagctcagccatcccaacgttgtccgctatctggctatgaacttaaaagagcaggacgatagcatagtagtggatatacttgttgaacacatatcaggggtgtcactggctgctcatctgtcacattcaggcccaattcctgtacatcaattaagacggtacacagcccagctgttatctggtttggattatctgcactccaattccgtggtgcacaaggtgctgagcgcaagcaatgtcctcgtcgatgcggaggggaccgttaaaatcacagactattccatctctaagcggcttgccgacatctgcaaggaggacgtctttgagcaaactcgagttagattctctgataatgctttgccatataagacaggtaagaagggggacgtttggcgcctggggctattactgctcagcctcagccaaggccaggagtgtggggagtaccctgtaactatcccttctgacctgcctgccgactttcaggacttcctgaagaagtgcgtctgcctagatgataaggagcggtggagtcctcaacagttgctgaaacactcatttatcaacccccagcccaagatgcccctcgtagagcaaagtcccgaagattctgagggtcaggactacgtcgagacggttatacccagtaatcggctcccatccgccgctttcttttctgaaactcagcggcagttctctcggtacttcatcgagttcgaagagctacaactgctcggaaaaggtgcctttggcgcagttatcaaggtgtggtaccgggtgatccccagccccttgtag

SEQ ID NO: 27206 - DNA, 396 bp, Artificial Sequence
  Description of Artificial Sequence: Synthetic coding sequence
atgagccagtggacccccgagtacaacgagctgtacaccctgaaggtcgacatgaaatccgaaatcccttcagatgctccaaagacccaggaaagtctgaagggaatactgctccaccctgagccgatcggggctgccaagagctttcccgcaggcgtagagatgattaatagcaaggtgggtaatgaattctcgcacctgtgcgatgactcacaaaagcaggagaaagagatgaacggtaatcagcaggaacaggagaaatctctggtagttaggaagaaaagaaaaagccagcaagcaggaccgagctacgtgcagaattgtgtgaaggagaaccagggcatcctgggcttgcgccagcaccttggcaccccctcagacgaggataatgactag

SEQ ID NO: 27207 - DNA, 1863 bp, Artificial Sequence
  Description of Artificial Sequence: Synthetic coding sequence
atggcccccgacagcgaccccttccccgagggccccctgctgaagctgctgcctttggacgctagagatcggggtacccagcggtgtcgactgggaccagctgcattgcacgcactcggcgcaagactcggctcggctgtaaagattagtctgcccgacggcgggtcgtgtctgtgtacagcgtggccaagacgggacggagccgatggatttgtccagctggaccccctctgcgcctccccaggggccgccgtgggggccagtcggtcccgaagaagcctttccctgaatcgccttctcttagtgccctgccccccacttaggcgcgtagcagtgtggcccgttttaagggaaagagctggagcacccggcgctagaaatacagccgctgtgctggaggccgcccaggagctcttacgcaatcgccccataagcctcggtcacgtcgtcgtggcacctccaggcgcacccgggctcgttgctgcactgcacatcgttggcggcacaccttccccagaccctgcaggtctggtcactccaagaactagagtgtcactcggtggagaacctccgtccgaagcacagccacagccagaagtgcctcttggaggactctcagaagctgccgactctctgcgggaacttctcagactccctctgcgttatccgagagccttgacggctctgggcttggcggtcccccgaggcgttctgcttgccggccccccgggggtggggaagacccaacttgtgagggctgtcgccagagaggccggggctgagctgttggcagtgagcgctcccgcgctgcaaggatcacgcccaggggagaccgaagaaaacgtgaggcgagtttttcaacgggccagagagctcgccagccgcggacctagccttctatttttggatgaaatggatgctctctgtccccagcggggcagtcgcgccccagaatcacgcgttgtcgcccaagtgctgacactgctggatggtgccagcggggaccgtgaggtggtggtggtgggggctactaatagacctgacgccctcgatccggcacttaggcgacccggacggtttgatcgcgaggtagtcattggcaccccaaccttgaagcagaggaaagagattctccaggtcattacatctaagatgcccatcagctcgcatgtagatctgggcctgcttgcggagatgacagtggggtatgttggcgctgatctgaccgctctgtgcagagaagctgctatgcacgcccttctccattcagaaaagaatcaggataatcctgtcatcgatgaaattgacttcctcgaggctttcaaaaatatacaaccttcatcgttccggtcagtcatcggccttatggatatcaaacctgtggattgggaggaaatcggggggttggaggatgtgaaattaaaactgaagcagtcaattgagtggccgctgaaattcccatgggaattcgtgcgtatgggcttgacacagccaaaaggggtgctgctgtatggacccccgggctgcgcaaaaacaacccttgtgagagcgctggccactagctgccactgttccttcgtttctgtttcaggagcagacctgttttcaccgtttgtgggggattctgagaaagttcttagccagatatttcgccaagcgagggcatccacacccgcaatcctgttcctagacgagatcgactcaatcctgggagcacgaagcgccagcaagaccgggtgcgatgtgcaggaacgcgtcctctctgtcctgctcaatgaactggacggagttggactgaagactatcgaacgaagaggctctaaaagcagtcaacagggtaagtataaggagctcaaaaagtag

SEQ ID NO: 27208 - DNA, 4767 bp, Artificial Sequence
  Description of Artificial Sequence: Synthetic coding sequence
atgctgccccccaagcacctgagcgccaccaagcccaagaagagctgggccccgaatctttacgagctggattctgatttgaccaaggaaccggacgtgatcatcggcgaggggcccacggactcagagtttttccatcagcgtttccgcaacctgatctacgtagaattcgtgggcccccgtaaaacattgattaaacttcggaatctgtgcctggattggcttcagcccgagacccgcaccaaagaggagatcattgaactgctggtgctggagcagtatctgacgatcatacccgaaaaattgaagccttgggtgagagctaagaaacccgagaactgtgagaaactggtcactttgctagagaattataaggaaatgtatcaaccagaagatgacaacaacagtgacgttaccagtgatgatgacatgacccgcaacagacgagaatctagtcctcctcactccgtgcattcgttttccgatagggactgggaccggagagggagaagcagagatatggaaccccgcgacaggtggtcccatacaagaaaccctaggagtcggatgccccccagggatctctccctccccgtagtggcaaagacatccttcgagatggacagagaagatgaccgcgattcacgtgcgtacgagtccaggtcgcaggacgctgagtcctatcaaaacgtggtcgacctcgctgaagatagaaaacctcacaataccatccaggataacatggagaactaccggaaactcctgtctttggtgcaactcgcggaagacgacgggcactcccacatgactcagggacacagctcccgttctaaacgcagcgcttatccgagcacctctaggggcctaaaaacaatgccagaggccaagaaatctacgcacagaagaggaatttgcgaagatgagagcagccatggcgtgattatggaaaagtttataaaggacgtgtctaggagctctaaatccggtcgggcccgcgagtcatctgacaggtcccaaaggtttccccggatgtctgacgataattggaaggatatttcccttaacaagagggaatctgtgattcagcagcgagtgtacgaggggaacgcttttcgcgggggctttcggttcaactccacactggtgtctcgcaaaagagtgctagagagaaagaggcggtatcattttgacaccgatggcaaggggagtattcacgatcagaagggttgtcctagaaagaagcccttcgagtgcgggtcggagatgcggaaagccatgagcgtctccagcctaagtagcctgtcaagtccgtctttcactgagtcacagcctattgattttggcgccatgccatacgtttgcgacgaatgtggacgatctttctcagtgataagcgaattcgtcgaacaccagattatgcacacgagagagaacttgtatgagtacggagagtcgttcatacattcagtggccgtgtccgaggtacagaagtcccaagtaggaggcaaacggttcgaatgcaaagactgtggggagacattcaacaagtctgccgcactggccgagcatcggaaaatccatgctcggggttacctcgtggagtgcaagaatcaagagtgtgaggaagcgtttatgccaagccctacattttccgaactgcagaagatatacggcaaggacaagttttacgagtgtagagtctgtaaagagacattcctgcactcatcggctctcattgaacatcaaaaaatccacttcggtgatgacaaggataacgaacgggagcacgagagagagcgggaacgagaacgcggtgaaacatttaggcccagcccagcgctgaacgagttccagaaaatgtatggaaaagagaagatgtatgagtgcaaggtctgtggtgagacattcctgcattcctcatccctgaaggagcaccagaaaattcatacacgaggaaatcccttcgaaaataaagggaaagtgtgtgaggaaacctttattcctggccagagccttaagagaaggcagaagacttacaacaaggagaagctgtgcgactttaccgacggtcgagatgcgttcatgcagtctagcgaactcagtgaacatcagaaaatccatagcaggaaaaacctgttcgaaggcaggggatatgagaagtcagtcatccattccggccctttcacagagtcgcaaaagtcccacaccatcaccaggccactagagtctgacgaggatgagaaagcgttcaccatctccagcaacccctatgaaaaccagaaaatacccaccaaggaaaatgtgtacgaggcaaagagctatgaaaggtccgtgatacattcactggcctcagttgaagcacaaaaaagtcatagcgttgccggaccaagtaaacccaaagtgatggctgaatcgactatccagtcttttgacgcgatcaatcaccagagagtgcgggctggtgggaatacgagcgaaggaagagagtactcccgaagcgttattcactccctcgtggcttcaaaacccccccgcagccataatggaaatgaactagttgagtctaatgagaagggagaaagcagtatatacatcagtgatctgaacgacaagagacagaagatcccagccagggaaaacccctgtgaaggaggttcaaagaaccggaattatgaagattctgtcatccagagcgtttttagggctaaaccgcaaaagagcgttcccggtgagggttctggcgagttcaagaaggacggggaattcagtgtcccttctagcaacgtacgcgaataccagaaggcgcgagctaaaaaaaaatatatcgagcatagatcgaacgaaacttcagttatacacagcctgcctttcggggaacaaaccttccggcctagagggatgctctatgaatgccaggaatgcggagagtgctttgcgcacagcagtgacctgacggagcatcagaagatccatgatcgagaaaagccttcaggaagtcgcaactacgagtggtccgttattagaagtctcgcccctaccgaccctcagaccagctacgcccaggaacaatatgcaaaagagcaggcacgcaacaaatgcaaagactttaggcaatttttcgctacctctgaagatctgaatacaaatcagaagatctacgatcaagagaagtcccatggggaggagtctcagggagagaacaccgacggggaagagactcacagtgaggagacccacggacaggagactattgaggatcctgtcatccagggatcagatatggaggacccccagaaggacgatccagatgacaaaatttacgagtgtgaagactgcggtctgggttttgtggatctgacagacctgacagatcaccagaaggtgcacagtagaaagtgtctggtcgacagccgggagtatacacactccgtcatccacacccactcaatttctgaataccagagagattacaccggggagcagttatacgagtgtcccaagtgtggcgaaagctttattcacagctcatttttatttgagcaccagcgtatacatgaacaggaccagctgtatagtatgaaggggtgtgatgacggattcatcgctctcctgccaatgaaaccacggaggaatagggcggcagaaagaaatccggctttagccggaagcgccattcggtgtctgctttgtggacagggcttcatacattcaagtgcactgaacgagcatatgagactacaccgggaggatgatctcttagagcagagccaaatggcggaggaagccatcatccctgggttggccctgactgagttccagcgttcccagaccgaggaacggctgtttgagtgcgccgtatgtggcgagtctttcgtcaaccctgccgagcttgcggaccatgtcacagttcataaaaatgaaccctatgagtatggctcctcctacacacatactagcttcctgaccgaaccgctgaagggggccataccattttacgaatgcaaagattgcgggaaaagcttcatccattccacggtgctaactaagcataaagaactccaccttgaggaagaggaagaagacgaagcagctgccgctgctgccgcggcagcccaggaggtggaggccaatgttcatgtgccacaggtcgttctcaggatccagggcctgaacgtggaggccgcagagcctgaggtggaggctgccgagcccgaagtagaggctgctgaacctgaggtggaagcagctgaacctaacggcgaagctgaaggcccagacggggaggccgccgagccgattggagaggctggtcagccgaacggtgaggcggagcaacctaatggagacgctgacgagcctgatggcgcgggaatcgaggaccccgaggagcgcgcagaggagcccgaaggcaaagctgaggagccagagggtgacgccgatgagcccgatggtgtaggtattgaggatcccgaggagggggaggatcaagagatccaagtcgaggaaccctactacgactgccacgagtgtaccgaaacatttacatcatcaacagcattttctgaacatctcaagacacacgccagcatgattattttcgagcctgctaacgcattcggggaatgcagtggatacatagagagagcctcaacatctactgggggggcaaaccaagcagacgagaagtacttcaagtgcgacgtgtgtggccagctgttcaatgacaggctctctctcgcccgacaccagaatacccatactggctag

SEQ ID NO: 27209 - DNA, 63 bp, Artificial Sequence
  Description of Artificial Sequence: Synthetic coding sequence
atggccaccatgatcccccccgtgaagctgaagtggctggagcaccttaattcttcttggtag

SEQ ID NO: 27210 - DNA, 4389 bp, Artificial Sequence
  Description of Artificial Sequence: Synthetic coding sequence
atgtaccagcccgaggacgacaacaacagcgacgtgaccagcgacgacgatatgacgcgcaacagacgcgagtcatcacctccacacagcgtgcacagtttctctgacagagactgggatcgccgcggtcgatcccgggatatggagccgcgcgaccgttggagccatacgcggaacccgcgctcgcgaatgccacctagggacctgtctttgcccgtggtcgccaaaacctccttcgagatggatagggaggacgatcgagactcccgagcctacgaaagtaggagccaggacgctgaaagttatcagaatgtggtggacctcgcagaagaccgaaagcctcataatacaatccaagataacatggagaactacagaaagctgctcagtctggttcaactggcagaagacgacggacatagccacatgactcaggggcactctagtagaagtaaaaggtccgcatacccatccacctcccgcggcctgaaaacaatgccggaggccaagaagagcactcacaggagaggtatctgtgaggatgaatcaagccatggcgtgataatggaaaaatttataaaagacgtatcccgcagttctaaatccggaagagctcgtgagagttccgatcgcagtcagcggtttccaagaatgtctgacgataattggaaggatatatctttgaataagcgcgaatctgtcatccagcagagggtttatgagggaaatgcattcaggggcggtttccggtttaatagcacattagtgtcacgaaagcgcgtgctggagcgaaagcggcggtaccacttcgacaccgacgggaaaggctccattcacgaccagaaaggttgcccccggaagaagccgttcgagtgcggtagtgaaatgaggaaagctatgagtgtctcatcgctttctagcctgtcgtctccttcattcacggaatcccagcccatcgatttcggggctatgccctacgtgtgcgatgagtgtggcaggtctttttctgtgattagcgaatttgtggaacaccagattatgcacacgcgagaaaacctgtatgaatacggcgaatctttcatacattcagtggcagtttcagaggtccaaaaatctcaggtgggtgggaaaagatttgaatgcaaagattgcggtgagacatttaacaagtccgcagctcttgccgaacacagaaaaattcacgcccgaggctacttagtcgagtgtaaaaaccaggagtgcgaagaagccttcatgccttcacctacattcagcgagcttcagaagatttacggtaaagataagttttacgagtgcagggtgtgcaaagagacgttccttcacagtagcgccctgattgaacatcagaagatccactttggtgacgataaggataatgaacgggaacatgaaagagagcgagagagagagcgcggggaaacctttcggcctagtcctgccttgaatgagtttcaaaaaatgtatggaaaggagaaaatgtacgaatgtaaggtttgcggtgaaaccttcctgcacagttctagcttgaaggagcatcaaaaaatccatacccgcggtaaccccttcgagaataagggaaaggtttgcgaggaaactttcatccccggtcaatcactcaaaaggcgccagaaaacatacaataaagaaaagctctgcgactttactgatggccgagacgcgttcatgcagagttctgagttatccgagcatcagaaaatccattcgaggaaaaatctgttcgaggggaggggctacgagaagagcgttatccactccggtccttttactgagagccagaagagtcatacaatcaccagacctctggaaagcgatgaggatgagaaagcgtttaccatttcttccaacccgtacgagaatcagaagatacccacaaaagaaaatgtgtatgaggccaaatcctatgagcggagcgtgatccatagcctggcatctgtggaagcgcagaaaagccacagtgtggctggtccctctaaacctaaggtcatggcggagtccacaatacagtctttcgatgccattaatcaccagagggtccgggccggaggtaacacctccgagggtcgagagtatagccgctcggtgatccatagcctcgtggcatctaaacctcccagaagccacaacggcaacgaactagtagaaagcaacgagaaaggagaatccagcatctacatctccgatctgaatgataaaaggcagaagatccccgcccgcgagaacccttgtgagggaggttcaaaaaatagaaattatgaggattccgttatccagtcagtatttagggccaagccacagaagagtgtacccggtgagggttccggtgaatttaagaaggatggcgagtttagcgtaccaagttcaaatgtcagggaatatcagaaggcccgtgccaaaaaaaaatatatcgaacacagaagcaacgagacaagcgtgattcacagtctgccattcggcgaacagaccttccgcccccgtggaatgttgtatgagtgtcaagaatgcggcgagtgtttcgctcactctagtgatttaactgaacatcagaagatccacgaccgcgagaaaccttccggcagtagaaattacgaatggagcgtgatacgcagcctggctccaacagatccccagacttcttacgcgcaagagcagtatgcaaaggagcaagcgcggaacaagtgtaaggactttcgccaattttttgcgacatccgaggacctgaatacaaaccagaagatatacgaccaggaaaagagccacggagaggagtcccagggtgaaaatacggatggggaggagacacactccgaagagacccatggccaggaaacaattgaagatccggtgatccaaggatccgacatggaagatccccaaaaggacgatccagatgataaaatttatgaatgcgaagactgcggcctggggtttgtggatctcaccgatctgaccgatcaccagaaggtgcactcaagaaaatgcctggtcgatagccgagaatacacccattcggtcatccatacacactccatcagcgaatatcagcgggattacactggagagcagctctacgagtgccctaagtgtggcgaaagttttatccatagtagtttcctgtttgagcatcaaagaatccatgagcaggaccagctttatagtatgaaaggttgtgacgatgggtttattgccctgctgccgatgaaacctcgcaggaatagggcagccgagcgaaacccagcactggcagggagcgccatcagatgcctcctgtgtggccaagggttcattcacagcagcgcactgaacgaacatatgcggttgcaccgagaggatgacctacttgaacaatcacagatggcagaggaggccataatacctggcctggccctgaccgagttccagaggagccagacagaggagcgcctgtttgagtgcgccgtgtgcggggagtccttcgttaatcctgccgaattagcggaccacgtcaccgtgcataaaaatgaaccttacgaatacggaagctcctatacgcacacaagtttcctcactgagcccctcaagggcgcaattccgttttacgaatgcaaggattgcggtaagtcattcattcacagcaccgtcttaactaagcataaggagttacatctggaagaggaggaggaagatgaagccgcagccgccgctgctgctgccgcccaggaggtcgaagccaacgtccacgtgccccaagtggtgctgcgcatccaaggcctcaatgtcgaggcagccgagccagaagtcgaggcagctgagcccgaagtggaagccgctgagccagaggtggaggccgctgaacccaacggcgaggccgagggccctgatggcgaggctgccgagccgattggcgaagcaggccagccgaatggcgaggccgagcagcccaacggggacgctgacgagccagatggggcgggcatcgaggacccggaggaacgcgccgaggagcctgaaggcaaggcagaagaaccagagggtgatgcagatgaaccggatggcgtaggaatcgaagatcctgaagagggggaggaccaggagatccaggttgaggagccttactacgattgtcatgaatgcaccgaaacgttcacctcctcaaccgcattcagcgagcatttgaaaacgcatgcaagtatgataatattcgagccagcaaatgctttcggcgagtgctccggatacatcgagagagcttccacatccaccggaggggcaaaccaggctgacgaaaaatatttcaaatgcgatgtgtgtgggcagttattcaatgataggctatcattggcgcgccaccaaaacacccacaccggctag

SEQ ID NO: 27211 - DNA, 438 bp, Artificial Sequence
  Description of Artificial Sequence: Synthetic coding sequence
atggccaccatgatcccccccgtgaagctgaagtggctggagcacttgaacagttcctggattaccgaggactccgagtcgattgctacaagggagggcgtggccgtgctgtactcaaagttagtgtctaacaaagaagtggttcccctcccccaacaagtactctgcctcaaagggccacaactacctgatttcgaacgagagtccttgtcttctgatgaacaggatcactacctggatgctctgttgtcaagtcagcttgcacttgccaagatggtgtgtagcgatagcccttttgcaggtgccctgagaaaacggctcctcgttctgcaacgtgtattctatgctttgtctaacaaataccatgacaagggaaaggtgaagcaacagcagcattctcccgaaagctctagtggatccgccgatgtgcacagttag

SEQ ID NO: 27212 - DNA, 4284 bp, Artificial Sequence
  Description of Artificial Sequence: Synthetic coding sequence
tgagccaagcaggagcggctggagatcgccagcctgagcaaccaggaccacacatctaagaaggaccctgggggtcaccggaccgccgctatcctgcacgggggctcacccgacttcgtcggaaatggtaagcatagagctaattcctctggaaggtcccgacgagaacgccagtattccgtatgcaatagtgaggacagccctggttcatgcgagatactgtatttcaacatggggtcaccagatcagctcatggtgcataaaggaaaatgcatcggatctgatgaacagcttggcaaactcgtgtacaacgccctcgagacagccacaggtggcttcgtgctcctgtatgagtgggtgctgcagtggcagaaaaaaatgggtccattccttacttctcaggaaaaggaaaagattgataagtgtaaaaaacagatccagggtaccgaaactgaatttaatagcctagttaagctgtctcaccctaacgtggtgagatatctggccatgaacctgaaggagcaggacgatagcattgttgtcgatatcctagtggagcatatcagtggggtttctctcgccgcccatctgtctcactcggggccaattcctgtgcaccaactgaggcgatacacagcgcagctgctgtccgggctggactatctgcattcaaatagcgtggttcacaaggtgttgtctgctagcaacgtcctagttgatgcggagggcactgtgaagattacggactactccataagcaaaagactggccgacatatgtaaggaagacgtgttcgagcaaaccagggtaagattttctgacaatgccctaccgtacaaaactggcaagaaaggcgacgtttggaggctggggcttctgctactctctctctcccaaggccaggaatgcggagagtatcccgttacaataccctccgatctccccgctgacttccaggactttttgaagaaatgtgtctgcctggatgacaaagaaagatggagccctcagcagctgctgaaacattcttttatcaacccacagcccaagatgccactcgtagagcagagcccggaagatagcgagggacaagactacgttgaaacagtcattccttcaaaccgcttgccttctgccgcgttcttctcggaaacccagcgccagttctccagatattttattgaattcgaggaactgcagctcttgggtaaaggcgccttcggcgcggtgatcaaagtgcaaaataagctcgacggctgctgttatgctgttaagaggattcccatcaatcctgcttcccgccagtttcgccgcattaaaggcgaagtgaccttgctcagccgcctgcaccacgagaacattgtgcggtactacaatgcatggattgagagacatgagcggcccgccggacctggaacaccgccaccagattccggcccactcgccaaagatgaccgcgcggccagaggccagccggcctctgacaccgacggactggatagtgttgaagccgctgctcctccccccatcctgagctcatccgtagagtggagcaccagtggcgaaaggtctgctagcgcccggtttccggcaaccggaccaggctcctctgacgacgaagatgatgacgaagatgagcacgggggagtgttctcccagagctttctgcctgcctctgattctgagagcgatattatcttcgataacgaggatgagaattccaaaagccagaatcagatggagtactgcgaaaagtctactctgagggacactattgaccaaggcctgtatcgggacacggtgcgcttatggagactcttcagggaaatccttgacgggctcgcctacatacacgaaaaaggcatgatacaccgggaccttaagccggtaaatattttcttggatagtgacgaccacgtgaaaattggcgactttggtctggcaaccgaccacctggccttcagtgccgacagcaaacaagacgaccaaacaggcgatctcattaagtccgaccccagtggccatttaaccggcatggtcggtaccgcactttacgttagccctgaggtgcaggggagtacaaagtcagcctacaaccagaaagtggatttattctccctcgggatcatcttctttgaaatgagctatcaccccatggtgacggcctccgaacggatctttgtgttgaatcagctgcgagacccaacttctccaaaattccctgaagacttcgacgatggggaacacgccaaacagaaatctgtgatcagttggctgctgaatcacgacccagccaagaggcccacagcaaccgagttactgaagtccgagctgttgccacctccccaaatggaggaatctgagctgcacgaggttcttcatcacacgctgacgaacgtggatggcaaggcttatcgaaccatgatggcccagatcttctctcagaggatcagcccggctatcgactatacatatgattccgatatccttaaaggaaacttctctatcagaaccgccaaaatgcaacagcacgtatgcgaaaccatcattcggattttcaagcgccacggcgccgttcagctctgtactcccctactcttgcctaggaatcggcaaatctacgaacacaatgaggcggccctctttatggatcattccgggatgctagtgatgttaccttttgacctgcgaattcccttcgcccgatacgtagctcgcaacaacatcttaaatctcaaacggtactgtatcgaaagggtgtttaggccccggaaactggataggttccatccaaaggagttgctggaatgcgcattcgatattgttactagcacaaccaactctttccttccaaccgccgaaatcatctatacgatttatgagattattcaggagttccccgctcttcaggagcgcaactatagcatctaccttaaccatacaatgctgctgaaggctatactcttgcactgtggaatccctgaggacaagttgtcacaagtatacatcatcctgtatgatgccgttactgaaaaacttaccaggcgggaagtggaagctaaattctgtaacctctctttgtcgagtaactctctttgcaggttgtataagttcatagaacaaaaaggggatctgcaggatctaatgccaaccattaacagtttgataaagcaaaagaccggcatagcacagcttgtcaaatacggcctgaaggacttggaggaagtggtggggctgctaaaaaagctcggcataaagttacaagtcttgatcaatctcgggcttgtctacaaagtgcaacagcacaatgggattatttttcaattcgttgctttcatcaaacggcgccagcgcgccgtccctgagatcttggcagcaggaggtaggtatgacctcctcattccacagttcaggggccctcaggccctaggccccgtgcccactgctattggggtgtcaatcgccattgacaagatctccgctgcagttctcaacatggaagagtcagtgacgatcagctcatgcgatctactggtcgtctcagttggtcagatgtccatgtctcgcgctattaatctcactcaaaagctctggaccgctggcatcaccgccgaaattatgtatgactggagccagtcccaggaggaactgcaggaatattgccggcatcatgagatcacatacgtagctctggtgtccgataaggaaggttcacatgttaaggtcaagtccttcgaaaaggagaggcaaacagaaaagagggtactcgaaacagaactcgtggaccatgtgcttcagaagctacgtaccaaggtgacagatgagaggaatggccgcgaggcaagtgataacctcgcggttcagaatctcaagggaagctttagtaacgctagtggtctcttcgaaattcacggggcaactgtagtacccatcgtatccgtgttagctcctgaaaagcttagcgcctcaacccgccgacgatatgagactcaagtgcagactaggctgcagacaagcctcgcaaatttacaccagaagtcaagcgagatcgagatcctcgcagtggatttacccaaggagaccatcctgcaattcctgagcctcgaatgggacgctgacgaacaagcctttaacacaactgtgaaacagctgctgagtcggctacctaaacaacggtatttaaaactggtctgtgacgaaatttataacataaaggttgaaaaaaaggtgagtgttctgttcctgtattcatatcgcgacgactactaccggattctgttctag

SEQ ID NO: 27213 - DNA, 4767 bp, Artificial Sequence
  Description of Artificial Sequence: Synthetic coding sequence
atgctgccccccaagcacctgagcgccaccaagcccaagaagagctgggctccaaacctatatgagctcgatagcgacctgacgaaggaaccagatgtgatcattggagagggtcccactgatagtgagttttttcaccaaaggtttagaaatctgatctatgtggagttcgtgggaccccgcaaaactctcataaaattgcggaatctgtgtttggattggcttcagcccgagactcgcacaaaggaggaaatcatagagctgctggtgctggagcaatatcttacaattatcccggaaaagttgaaaccttgggtgcgtgcgaaaaagccagaaaactgtgagaaactggtgaccctattggaaaattacaaggagatgtatcagccagaagacgacaataatagcgacgtgacctctgatgatgatatgacccgcaacagacgagagtcttccccaccacatagcgtccactccttttcagatcgggattgggaccggagaggtcggtcgagggatatggagcctcgggatagatggagccatacgaggaatccccgaagcagaatgcctcctagagatctgagcctgccggttgtggcgaagaccagctttgaaatggatcgggaagatgaccgggatagcagggcctacgaatctcgaagtcaggatgctgaatcctaccagaacgtggtcgacctcgctgaggatagaaagccacacaatactattcaggacaatatggaaaattataggaagttgctgtctctagtgcaactcgcagaagatgacgggcactcccacatgacccagggtcattcatccaggtcgaaacgctcagcttacccttcgacaagccgtggccttaagaccatgccagaggctaaaaagtccacccacaggcgaggaatttgcgaggatgaatcgtctcacggcgtgatcatggagaagttcattaaagacgtatctagatccagtaagagcgggcgcgctagggagagcagtgacagatctcaacgctttccccgtatgagcgatgataactggaaagatatcagtttaaataagcgtgagagcgtgattcagcagagagtatatgaaggtaacgcttttcggggcgggtttaggttcaattccaccctggtgagcagaaagagggtcctggaacggaaacggcggtaccatttcgatacagatgggaagggatcaattcatgaccaaaaaggctgcccacggaagaagccctttgagtgtggcagcgaaatgcggaaagctatgagtgtgagctctctctcttctttgagctctccaagtttcacagaatcccagcccatcgactttggcgctatgccgtacgtgtgcgatgagtgcgggcggagcttcagcgttatttctgaattcgtcgagcaccagattatgcatactcgggagaatttgtatgagtacggagaatcattcatccatagcgtggctgtatctgaagtgcaaaagtcccaggttggcgggaaaaggtttgaatgcaaagactgtggcgaaacgttcaacaaaagcgccgccctggctgagcacaggaaaattcacgccagaggatatctggtggagtgcaaaaaccaggagtgtgaggaggccttcatgcccagccctaccttctctgaactgcagaaaatctacggcaaggacaagttttacgagtgcagagtgtgcaaggagacctttcttcatagtagtgccctgattgaacatcaaaagattcacttcggcgacgataaagacaacgagcgggaacatgaacgtgagcgcgagcgtgagagaggtgagaccttccggccgtctcctgcactgaatgaatttcagaagatgtacgggaaggaaaagatgtatgagtgcaaagtgtgtggtgaaactttccttcatagctcctcccttaaggagcaccagaaaatccacacacgaggaaacccctttgagaataagggaaaggtttgcgaggaaacctttatccctggacaatctttgaaacggaggcagaaaacctacaataaggaaaaactttgcgatttcaccgatggcagagatgcattcatgcagtcttctgaactgtctgagcaccagaagatccacagcagaaagaacctcttcgagggccggggatacgagaagagcgttatccactcaggcccctttaccgagtcacagaagtcccatactataacacggcccctagagtctgacgaggacgaaaaagctttcactatttcctccaatccttacgagaatcaaaaaattcctacgaaagagaacgtgtatgaggcaaaatcttacgagcggtcagtaatccactctctggcaagtgtggaggcacagaaatctcacagcgttgccggccccagcaagcccaaggtgatggcggagagtactattcagtcttttgatgccatcaatcaccagcgggtcagagctggaggtaatacatcagaaggtagggaatattctcgaagcgtaatccattccctggtggcctccaaaccgccacgcagtcacaacggaaatgagttagtcgaatctaatgaaaagggagagtcttctatctacatctccgacttgaacgataaacgtcaaaagatccccgctcgtgagaatccttgcgagggaggttctaaaaatagaaactacgaggacagtgtcatccagtcagtgtttcgagccaagccacagaagagcgtgcccggcgaaggcagcggagaatttaaaaaggacggcgagttctccgtacctagcagtaatgtaagagaataccagaaggctcgcgctaagaagaagtatattgagcacaggtctaatgaaacgagcgtcatccatagcctcccttttggggagcagaccttcagaccccgcggcatgctgtacgagtgtcaggagtgtggagaatgctttgcccatagcagtgacctgacagagcaccagaaaattcacgaccgcgaaaaaccttccggctccagaaattatgagtggagcgtgattcgttcactggccccaaccgatccccaaacctcctacgcacaagagcagtacgctaaggagcaggctaggaacaaatgcaaagatttcagacagttcttcgcaacctccgaggacctgaacaccaatcagaaaatttatgaccaggaaaaaagccacggagaggagtctcagggcgaaaatactgacggtgaagaaactcatagtgaagaaactcatgggcaggagaccatcgaagatcctgtcattcaggggagtgacatggaagatccccaaaaggacgaccctgacgacaagatatatgagtgcgaggattgcggacttggatttgtggatctaaccgatctgacagaccatcagaaggtgcatagccgtaagtgcctggtggattcgcgcgaatatacacacagcgtgattcatacgcacagcatcagcgagtatcagcgcgattacactggcgagcagctgtacgaatgtcctaagtgtggtgagtcctttatacattcaagcttccttttcgagcaccagagaattcacgaacaggatcagttatactctatgaagggatgtgacgatggcttcattgctctactccctatgaagcccaggcggaatagagcggccgagaggaatccagccctggcgggaagcgcaatcagatgcctgctgtgtggacaaggcttcatccatagtagtgctctgaatgagcatatgcgactccatcgtgaggacgacctgctggagcaaagtcaaatggcagaagaggccatcattcccggcttggctctcacggaattccagagatctcagaccgaggagcggttgtttgagtgtgccgtctgcggcgagtcattcgttaacccagcagaattggcagaccacgtcaccgtccacaaaaacgagccatatgaatacgggagcagctatacccatacttcgttcttgacggaaccgctgaaaggcgccattcccttttatgagtgcaaggattgcggcaagagctttatccacagcacagtcctcacaaaacataaggaattacatcttgaggaagaggaggaggacgaggctgcggccgcagcagctgcagccgctcaggaagtcgaagcaaatgtccacgttcctcaagtcgtgctgcggatacagggactcaatgtggaggccgcagaacctgaggttgaggccgccgagccggaagtggaagctgctgaacctgaggtcgaagcggcagagcctaatggcgaggctgagggtcccgacggagaggccgctgaacccattggagaagcagggcaacctaatggtgaggctgagcagccaaacggtgacgccgatgagcccgatggcgccggcatcgaggacccagaggagcgcgcagaggagcccgagggcaaggccgaagagccagagggcgacgctgacgaacctgacggcgttgggatagaggatcccgaagaaggagaggaccaagagatccaggtggaggagccatattacgactgtcacgagtgcactgaaaccttcaccagcagtaccgcattcagcgaacacttgaaaacccacgcttccatgattatcttcgaacctgccaatgccttcggcgaatgtagcgggtacatagagagagccagcacttccacaggtggcgccaatcaagcagacgaaaagtatttcaaatgcgacgtctgcggccaactcttcaatgatcggctaagcctggctcgtcatcagaacacacacacggggtag

SEQ ID NO: 27214 - DNA, 3012 bp, Artificial Sequence
  Description of Artificial Sequence: Synthetic coding sequence
atgagccagtggacccccgagtacaacgagctgtacaccctgaaggtagatatgaagtcagagataccttcagacgctcccaagactcaggagagtttaaaaggcatcctgctgcatccagaacccatcggggcagcgaaatcttttccagctggagtggagatgataaactctaaggtgggcaacgagtttagccatctgtgtgacgattcccagaagcaggaaaaggagatgaatggcaaccagcaagagcaggagaagagccttgtcgttaggaagaaaagaaagtcccagcaggccggaccatcctacgtacaaaactgtgtgaaggagaaccagggcattctaggcctgcggcagcaccttggcaccccttccgacgaggacaatgattccagttttagtgactgcctgtcttcacccagctccagcctgcactttggcgactccgacactgtgaccagcgatgaagacaaggaagtatcagtccgccattcacagaccatcctcaacgcaaagtcacggtcacatagcgctcgctcccacaagtggcctagaaccgagacagagtccgtgtccgggctgctgatgaaacggccatgtctgcatggatcaagtctgcgacgcctgccatgcagaaaacggttcgtcaagaacaatagctcccagaggacccagaaacagaaagagaggattctgatgcagcggaagaaacgtgaggttctggcacggagaaaatacgcattactcccatctagttcatccagttctgagaatgacctgagctcagagtcgtcttcatccagcagcaccgaaggtgaggaagatctttttgttagcgcctccgaaaatcatcaaaataatccggcagtgcccagcggcagcatagatgaggatgtggtcgtgattgaagccagctcgactcctcaggtgacggctaatgaggagatcaatgttacttcgacagacagcgaagtagagattgtaacagtaggcgagagttataggtcgaggtctactcttggccacagccggtcacactggtcccaaggatcgtcttcccatgcgagccgccctcaggagccaaggaacaggtcgcgaatcagtacggtgatccagccattgcggcagaatgccgctgaagtcgtcgacttgactgtagacgaggacgagccaacagttgttccgaccaccagcgcaaggatggaaagccaggccacttctgcgagcatcaacaactcaaacccatcaacaagtgagcaggcctctgataccgccagtgcggttactagctctcagccttccactgtctccgaaacaagcgcaaccctgacatcaaactcaacgactgggacatccatcggcgatgattccaggcgcacgacctcatcagcagtaactgagaccggcccccccgctatgccccgactgccttcttgttgtcctcagcattccccctgcggaggtagttcacaaaaccaccatgcattgggacatcctcacacttcgtgtttccaacagcatggacatcacttccagcaccatcatcatcatcatcatacgccacaccccgctgtacctgtttcgccttctttttccgatcccgcatgtcctgtcgagagacctccccaggtgcaggcgccatgcggcgcgaacagttcatcaggcacaagctaccacgaacagcaagcactgccagtggatctctccaattcaggtatccgatcacacggctccggtagcttccatggcgcttcagccttcgatccatgttgtccagtttcatctagtagggccgcaatcttcggacatcaagcagccgctgccgccccatcacagccactgtcttctatcgacggctatgggtcgagtatggtggctcagccccaacctcagcccccccctcaaccgagcttatcttcttgcagacactacatgcctcctccctatgccagcctgacacggcctctccatcaccaggcttctgcttgcccccactctcatggcaaccctccccctcagactcagcctcccccccaagttgactacgttattccgcatcccgtccacgccttccattcacagattagctcgcatgccacaagccaccccgtcgctccgccgccgccaacgcatctcgcatccaccgccgcccccattcctcagcacctgccgccaactcaccaacccatatcgcaccatatacccgcaactgcacccccggctcaacgcctgcatcctcacgaggtcatgcaacgaatggaggtacagcgacggcgaatgatgcagcaccccacaggcctgttcgtattttgcgtgagcagaagagctcacgagcgtccccccccgcatccccaccgcatgcatcccaattatgggcatggccaccatatacatgtgccccagaccatgagctcccaccctcgccaagcccctgagagatctgcgtgggagctgggtatagaagctggagtgaccgccgctacatacacgcctggtgctctgcacccccacctagcccactaccacgcaccaccccgcttgcaccacttgcagttgggcgccctgcctctcatggtcccagacatggccgggtatcctcacatccggtacattagttctgggttggatggaacatcattcagaggacccttccggggaaattttgaagagctcatccacttagaggaacgactgggcaacgtgaatcgtggagcttctcaaggcacaatcgagcgttgcacctatccacataagtataagaaggtgacaacagactggttctcacaacggaagctgcattgtaaacaggatggcgaggagggaactgaggaggatacggaggagaaatgtaccatttgtctgagtatcctggaggagggggaagacgttaggcgcctcccatgcatgcatctgttccaccaagtctgtgtggatcagtggctcatcacaaacaagaaatgtcctatctgtagggtcgacatagaagcacagctcccatccgaatcctag

SEQ ID NO: 27215 - DNA, 150 bp, Artificial Sequence
  Description of Artificial Sequence: Synthetic coding sequence
atggccctgccccacgacagcaacgagaccagctacctgctgccccctaataatgaggactgggggcgccaaaccatccccgactttgtgtatggccagaaagacctgatggccgagggaatacagtggcccaggaacgcccccggctag

SEQ ID NO: 27216 - DNA, 375 bp, Artificial Sequence
  Description of Artificial Sequence: Synthetic coding sequence
atgcgggccagcccctgcatcagccagcccgccgccagctggcaccctagacccagcgctttgcggccaacggccggatccggcccagacacccgcacccctggaaccgtcgaggacggcagcgcgccctgcccggccttccgcagcccagctgtatctccatgtggggaagaaccatgctgtttccaaattagtcccgcagaggagactctcgagctgggccgtctggttagccccggcaactgcgatactctaagtcctagggcagccgggttctacgcctgtcacgtgcgctcattgatcccatgtagatccaccaaagggagatggcctcttaccgccagtgcggcgggcttatcatcttttagcggatag

SEQ ID NO: 27217 - DNA, 93 bp, Artificial Sequence
  Description of Artificial Sequence: Synthetic coding sequence
atggccaccgacagctgggccctggccgtggacgagcaggaggccgccgctgaatcacgcaccgagcttccctccccctattctacttcctag

SEQ ID NO: 27218 - DNA, 804 bp, Artificial Sequence
  Description of Artificial Sequence: Synthetic coding sequence
atgtgggaccagcggctggtgaagctggccctgctgcagcacctgcgggcgttctatggtattaaggtcaagggggtgagagggcagtgtgatcggaggcggcacgaaactgccgcgacagagataggcgggaagattttcggagtgccattcaatgcattaccacactctgctgttccggaatatggacacattccgtcatttctggtcgacgcctgcacgtctttggaggagcatattcacacagaaggcctgttccggaagtccggctccgtgattcgcttgaaagctctgaaaaataaagtcgaccatggagaggggtgcctgtcgagcgctcccccttgtgacatcgccgggctgcttaaacaatttttccgtgaactgccagagccaatcttacccgctgatcttcacgaggctctgttgaaagctcagcagctgggaactgaggagaagaataaggcgatactcctcttgtcttgcctgcttgctgaccacacggtgcacgtgctgcggtatttcttcaattttctgcgtaatgtttctttaagaagcagcgaaaataaaatggattccagcaacttggccgttatcttcgcgccaaacctgctgcaaactagcgaagggcacgagaagatgagctcaaacgctgagaaaaaaggagtctaccagacgctgagttggaagaggtaccagccttgctgggtgctgatggtcagcgttctgctgcaccattggaaggccctgaaaaaggtcaatatgaagttactggtgaatatcagggaaagggaggacaacgtgtag

SEQ ID NO: 27219 - DNA, 1113 bp, Artificial Sequence
  Description of Artificial Sequence: Synthetic coding sequence
atgggcttcaaccggcccagcaagatccaggagaacgccctgccccttatgcttgccgaaccaccccagaacctgatcgcccagtctcagagcggcaccggaaagacagctgccttcgtcctcgctatgttgagccaggtcgagcctgccaataaatacccacagtgtctctgcctgagccctacctacgagcttgcccttcaaactggcaaagtgatcgaacagatggggaagttttaccctgaattgaagcttgcttacgcggtgagaggtaataaattggagagaggtcaaaagatcagcgagcagatcgtgatcggcacccctgggacagtgcttgattggtgctccaaattaaaatttattgatcccaagaaaattaaagtattcgtgctggatgaagcagatgtgatgatcgctacacaaggacaccaggaccagtcaatcagaatacagcggatgctaccaagaaattgtcaaatgctcctgttttccgcgaccttcgaggattctgtatggaaatttgctcagaaagttgtgccagaccccaatgtgattaagctgaagcgcgaagaagagacactcgacacaatcaaacagtactacgtgctttgtagcagccgggatgagaagttccaagccctctgtaatctttacggggccatcactatcgcacaagcgatgattttctgtcatacaagaaagaccgcctcgtggctggcagccgaactgtcaaaagaaggtcaccaggtggccctcctgtctggggagatgatggtggaacagagagccgccgtcattgagcgctttagggagggcaaggaaaaagttctggtgaccactaacgtttgcgcacgggggattgatgtagaacaagtgagcgtggtgattaacttcgacctccccgtggacaaggacggtaatcctgacaatgagacttatctgcatcgaattgggcggaccggacgatttgggaagcgcggcctagccgtgaacatggtagactccaaacattcaatgaatattttgaaccgtatccaagagcacttcaataagaaaattgagagactggataccgacgatcttgatgagatcgaaaaaattgctaattag

SEQ ID NO: 27220 - DNA, 2712 bp, Artificial Sequence
  Description of Artificial Sequence: Synthetic coding sequence
atggccaccagcgccgacagccccagcagccccctgggcgccgaggaccttcttagtgacagttcagagcctccgggcctcaaccaggtctcttctgaagtcacgtctcaactctacgcgtctctgagattgtcacggcaggccgaagccacggcaagagcccagttgtacctgccctctacgtcccccccccacgagggcttagatgggttcgctcaggagctgtccaggtccctgtcagtgggcctggagaagaacctgaagaagaaagacggctctaagcatatcttcgagatggagtcagtcagaggacagcttcaaaccatgctacaaacaagcagagacacggcttatagagatcccctcatacctggcgctgggagtgagagacgggaagaggactcattcgacagtgacagtaccgccaccctgcttaataccaggccactccaggatctgtcaccgagtagctcagctcaggccttggaggagctatttcctagatacacctccctcagacccggcccacctctgaatccccccgattttcaaggactacgcgatgcgttggattcagaacatacccggcggaagcactgtgaaaggcatatccagagtctccaaacaagggtgctggagctgcagcagcagctggctgttgccgtggcagctgaccggaagaaggataccatgatcgagcagctcgataagacattggcgcgggtggtggagggttggaaccggcacgaggctgaaaggacagaggtattgcgcgggctccaggaggagcaccaggccgctgagcttactcgatcaaaacagcaggaaactgttactagactcgagcagagtctcagcgaagccatggaggcgttgaatcgcgagcaggaatctgctcgtttacaacagcgggagagagagaccctggaggaagaacgtcaggctctgacacttaggctggaagctgaacagcagcggtgttgcgtactacaagaggagagagatgccgcacgggccgggcagctgagcgaacaccgcgaactcgagaccctgcgggccgcactcgaggaagagcggcagacttgggctcagcaagagcaccagctgaaagagcattaccaagccctgcaggaggagtctcaggcacagctcgagcgggagaaggagaaatcccagcgtgaagcccaggccgcatgggagactcagcaccaactcgctttagttcaatcagaggtccggagactggagggtgaactagatactgctcgtagagaaagggatgccctccagctagagatgagcttggtgcaggccaggtacgaatctcagagaatacagctggagtccgagcttgctgtccaactagagcagcgcgtgaccgagaggcttgcacaggcacaggagtcctccctgcgtcaggctgcaagcctgagggagcaccacaggaaacagctgcaggatctgagcgggcagcaccaacaagaactggccagccagctggcccagttcaaggtcgagatggccgaacgtgaggaaaggcagcagcaagtggcagaagattatgagttaagattagcccgggaacaagcgagagtgtgtgagctgcaaagcggtaaccagcagttggaagagcagcgtgttgagctcgtggagcgtctccaagccatgctgcaagcccactgggacgaggctaatcagcttctctcaaccacactgcccccgcccaaccctcccgccccacctgcaggtcctagcagcccaggcccccaggaacccgagaaagaagagaggagagtgtggaccatgccccccatggccgtggcactgaaacccgtcctccagcagtccagagaagcacgcgacgagctgcccggcgctccgcccgttctgtgtagcagttcttctgaccttagtctgcttctcgggccatcctttcagagtcaacactcatttcaaccactggaacccaaaccagatctgactagctctactgcaggggcattttccgcacttggcgccttccaccccgatcatcgggctgagaggccctttccagaggaggaccctgggccggacggagaaggcctcctgaaacaaggacttcctccggcccagctcgaagggcttaagaactttcttcatcagctgctcgaaacagtgccgcagaacaatgaaaatccctcagtggacctgctgccccccaaaagtggtccattaaccgtcccgagttgggaagaggcgccacaggtgccaaggattcccccgccagtgcacaaaacgaaagtgcccttagccatggctagctctctcttccgggtgcccgagccccctagcagtcactcacagggatcaggtccaagctctgggtcccccgaaagaggaggcgacggactcacattccctcggcagctgatggaagtgagtcagctgctgcgcttgtaccaggccagaggctggggtgccttgcccgccgaagatctgcttctgtatctgaagcggttggagcattctggcaccgatggaagaggcgataatgtgccacggcgcaacactgatagtaggttaggtgaaattccacgcaaagaaattccctctcaagccgtacctaggcggctcgctacagctcccaagacagagaaaccccccgcgaggaaaaagtccggccatcctgcaccatctagcatgaggagcaggggaggcgtgtggcggtag

SEQ ID NO: 27221 - DNA, 138 bp, Artificial Sequence
  Description of Artificial Sequence: Synthetic coding sequence
atgcccctgctggtggagggccggcgggtgcggctgccccagagcgcgggggacctggtgcgggcccaccccccactggaggccccaagcccattttgggtgctgatgatgcccttgttggttactctctggagctag

SEQ ID NO: 27222 - DNA, 1083 bp, Artificial Sequence
  Description of Artificial Sequence: Synthetic coding sequence
atggaggagctgagccaggccctggccagcagcttcagcgtgagccaggacctgaacagtacggcagccccgcatccccggctttctcagtacaagtcaaagtactcttcgctggagcaatcagagagacggcgcaggctgctggagctccagaagtccaagaggctcgactacgtaaaccatgccagacggctggccgaggacgattggaccggcatggaatccgaggaagaaaataaaaaggacgacgaggaaatggatattgatacagtgaagaagctcccaaagcattacgctaaccagctgatgctgagcgaatggctgatcgatgttccttccgacctggggcaagaatggatagtggttgtctgcccggtcggaaaaagagccctgattgttgcgagtagggggagcacatctgcctacactaaatcgggctactgcgtgaacaggttctcttccctgttgcctggcggaaacaggagaaactccacagccaaggactatacaatactggattgcatctataatgaggtgaatcagacgtactatgtactagacgtgatgtgctggcgaggacaccctttttatgattgccaaacagattttaggttttactggatgcactcaaaattgcccgaggaagaaggactgggcgaaaaaaccaaactgaatccatttaaattcgtaggtcttaagaatttcccttgtacacccgaatcactttgtgatgtgctgtctatggacttccccttcgaggtggacgggcttctgttctatcacaagcagacgcactatagtcccggatctacccccctggtaggctggttaagaccatacatggtgagcgacgttcttggtgttgccgtccccgcgggcccgctcacgacaaagcccgactatgccggccaccagctgcagcagatcatggagcacaagaagtctcagaaggaaggcatgaaagaaaagcttactcacaaagcctcagagaatggacactatgagttagagcacctctccacacctaagctgaagggctcatcccatagtcctgaccaccctggatgtctcatggagaactag

SEQ ID NO: 27223 - DNA, 1353 bp, Artificial Sequence
  Description of Artificial Sequence: Synthetic coding sequence
atggtgcccctggtggccgtggtgagcggcccccgggcccagctgtttgcctgcctgctacgtctgggtacccagcaggtgggccctctccaactgcatacgggcgcctcccacgcggccagaaaccattacgaagtgctggtcttagggggcgggtcgggcggcattactatggccgcccgcatgaaacgaaaagttggagctgaaaatgtcgccattgtggagcccagcgaacgccatttctatcagcccatttggacccttgtgggggccggtgccaaacaactgtcaagcagcggtcggccgaccgcgagcgttattccgagcggggtcgaatggattaaggcgagagtaacggaactcaatccagacaagaattgcatccatactgatgacgacgagaaaatcagttacaggtacctgatcattgccttgggaatccaactcgactatgagaaaattaaggggcttcctgagggctttgcacacccgaagatcggatcaaactattccgtcaagaccgtcgagaaaacttggaaggctcttcaagacttcaaagagggtaacgccatattcaccttccccaataccccagttaagtgcgctggcgccccacagaaaataatgtatctttcggaagcctattttaggaaaaccgggaagcggtctaaggctaacataatctttaataccagtctcggagctatctttggcgtgaaaaaatatgctgacgccctacaggagatcatacaggaaaggaatctgaccgttaattacaagaagaacctgattgaagtgcgggcagacaagcaagaagccgtcttcgaaaatctagataagcctggtgaaacccaggtgatttcgtacgaaatgttgcatgtgactccccccatgtctccccctgatgtcctcaaaacctcccctgtggctgacgccgcaggatgggtggacgtggacaaggaaactctgcagcacagacgctatcctaacgtatttggtattggcgactgcacaaacctgcctaccagcaaaaccgccgccgccgttgcagcacagtctggtatactcgaccgcaccatctcagtaatcatgaagaatcagacacctactaaaaaatacgatgggtatacctcgtgtcccttggttaccggctacaacagagtgattctggccgaattcgattacaaggctgaacctctggaaacgtttccgttcgatcagtccaaggagaggctgtccatgtacctgatgaaggccgacttaatgccctttctgtactggaatatgatgttaagagggtactggggaggccccgcatttctgagaaagctgtttcatttgggtatgagttag

SEQ ID NO: 27224 - DNA, 1113 bp, Artificial Sequence
  Description of Artificial Sequence: Synthetic coding sequence
atgggcttcaaccggcccagcaagatccaggagaacgccctgcccctcatgctggcagagccaccgcagaacctgatcgcccaaagccaatccggcacaggaaaaacggccgccttcgttctggcgatgttgtcacaggtcgagccggcaaacaaatacccacagtgcctctgcctgtcgcccacatatgagctagctcttcaaacggggaaggtgatcgagcaaatgggaaagttttatccggagttaaagctggcgtacgctgttaggggaaataagctagagagggggcagaaaatttcagaacaaatcgtgatcgggacccctggaactgtcctggactggtgttccaagctaaaatttatagatcctaaaaagattaaggtgttcgtgctggacgaggccgatgtgatgatagcaacacaggggcaccaggatcaatccattaggatccagcgcatgttacctagaaattgtcaaatgctgttgttctcagcaactttcgaggatagcgtgtggaaattcgcccagaaagtggtccctgaccccaacgtgatcaagctgaagcgagaggaggagaccctggatactatcaagcagtattatgtgctgtgctcttcacgggacgagaaatttcaagcattgtgcaatttgtatggcgcgatcacgattgcgcaggcaatgatcttctgccacactaggaaaactgcttcgtggttggccgccgaactgagcaaagagggccatcaggtcgcattgcttagcggcgaaatgatggtcgaacagagggctgccgtcattgagagatttagggagggcaaagagaaagtgctggtgacaacaaacgtctgcgctcgggggattgacgtggagcaagtttctgtagttatcaactttgacttgccagtggataaggatgggaatccggataacgagacttatctccatagaatcgggaggacaggtcgatttgggaagcgcggcctcgccgtgaatatggtcgattctaagcacagcatgaatatccttaacaggatccaggaacactttaacaagaagattgagaggcttgacacggatgacttggacgagatcgagaagatcgcgaactag

SEQ ID NO: 27225 - DNA, 738 bp, Artificial Sequence
  Description of Artificial Sequence: Synthetic coding sequence
atgggcggcggctacgacctgaacctgttcgccagcccccccgacagtaactttgtttgctcagtgtgtcacggggtgctgaaacggcctgcacgcctcccctgtagtcacatattctgcaagaaatgtatcttgcgatggctggctaggcagaagacctgcccatgctgtagaaaagaggtgaaacggaaaaaagtcgtgcacatgaacaaattaaggaagaccattggccggctcgaggtgaagtgtaagaacgctgacgcgggttgtatcgttacctgcccactggcacataggaagggtcatcaggattcatgtcctttcgaattaactgcatgtcctaacgaggggtgcacaagccaggtcccacgcggcacactagcagaacaccggcagcactgccagcaaggcagccagcagcgttgccctctgggctgtggcgcaaccctcgatcctgccgagagagctaggcacaattgctatcgggagcttcacaatgcatggagtgtgcgtcaggaaagacggcgtcccctgctgctatccctgctgaggagggtgcgctggctggaccaggccacgagcgtagttagacgagaactagctgagctgtctaacttcttagaggaggatacagcactgctcgagggcgctccacaggaggaagcggaggcagcccccgaaggcaatgtgggtgctgaggtggtgggcgagccacgcgccaacattccttgcaagtag

SEQ ID NO: 27226 - DNA, 309 bp, Artificial Sequence
  Description of Artificial Sequence: Synthetic coding sequence
atgcgggccagcccctgcatcagccagcccgccgccagctggcacccacggccatctgctttgcggcccactgctgggagcggtccagataccagaacccctggtaccgtcgaggacgggtcagccccctgtcctgcattccgatctcctgctgtgtcaccctgcggagaggaaccgtgctgctttcagatttcacccgctgaggaaactctcgagctgggcagactggtgtcacccggttgtcataagtcctcagctccccaggagagaaggttggatccgcgagccaggtgtgtggttcacatctag

SEQ ID NO: 27227 - DNA, 1473 bp, Artificial Sequence
  Description of Artificial Sequence: Synthetic coding sequence
atggaggacagcgccagcgccagcctgagcagcgccgccgccaccggcacttcaacatcaacacctgcagccccaaccgcacgaaaacagttggacaaggagcaggtacgcaaggctgttgacgctctcctgacccactgcaagagcaggaaaaacaactacgggctgttgctaaacgaaaatgaaagtctcttcctcatggtggttctgtggaagattcccagtaaggagcttcgagtacgactgactcttccccacagtatccggtccgattccgaagacatttgtctatttaccaaagacgagccaaactcaacccctgagaaaaccgagcaattttatcgaaagctgcttaacaagcacggaattaagaccgtgagtcagatcatatctctccagacacttaagaaggaatataaatcttacgaggctaaacttcggctgttgtcctcttttgatttcttcctcaccgacgcccggatccggaggctgctcccctcactcattggccgacatttttaccagcgcaaaaaggtgccagtttctgtgaatttactttccaagaacctcagccgggagatcaacgactgtatcggtgggacagttctgaatatctctaaatcaggaagttgcagcgcgatcaggatcggccatgttggaatgcaaatcgagcacataatcgagaacatcgtcgctgtgaccaagggactgtccgagaaactgccagagaaatgggaatcggtcaagttactgttcgtgaagacagaaaaatctgcagccctgcccatcttcagctcttttgtctctaactgggacgaagccactaagagatctctattgaataaaaaaaagaaagaggctcggcgcaaaagacgcgagagaaatttcgagaagcagaaagagcgaaaaaagaaacgacagcaggcacgcaaaacagcgagcgtcctctccaaggacgatgtcgcgcctgagtctggcgacaccactgtcaaaaaaccggagtctaagaaggagcaaaccccagaacacggaaagaagaaacgcggcagaggaaaagcgcaggtgaaggctacaaacgagagcgaagatgagatcccacagctagtaccgatcggaaaaaaaactccagcgaacgagaaagtcgaaatacagaagcatgcaacggggaagaagtcccctgcaaagtcccctaacccatctactccaagaggcaagaaaagaaaggcactgccagcctccgaaaccccgaaagcagctgagtcggagaccccaggaaagagtccagagaagaagccaaagattaaggaggaggccgtcaaagagaagtctccatctctgggcaagaaagatgcccgacagacccctaaaaagcctgaggcgaagtttttcactacgcctagtaaatctgtgaggaaagcttcgcacacgccgaagaaatggcctaagaaacctaaagtgccccagtccacctag

SEQ ID NO: 27228 - DNA, 1809 bp, Artificial Sequence
  Description of Artificial Sequence: Synthetic coding sequence
atggccgagttccgggtgcgggtgagcaccggcgaggccttcggcgctggcacgtgggataaagtctctgtcagcatcgtcggaactcggggcgagagtccgccccttcccctggacaatttagggaaggagttcactgcgggcgccgaagaggacttccaagtgaccctccctgaagatgtggggagagttctgctgctgagggtccacaaggccccacccgtgctgcctctgcttggaccgctcgcccccgatgcatggttctgcaggtggttccaactgactccaccaagagggggccatcttttattcccctgttatcagtggctggaaggtgctggcacactggtgcttcaggaggggacagccaaggtgagctgggctgatcaccaccctgttcttcagcaacagcgacaagaagagcttcaggcacgacaggagatgtaccaatggaaagcttacaacccgggatggcctcattgcctggacgagaagaccgtggaggacctggagttaaacattaaatatagtacagccaagaacgccaacttttacctgcaggcagggagcgctttcgccgaaatgaaaattaagggactcttagatagaaagggtctttggaggtcgctgaacgaaatgaaacgtatttttaacttcagacggacccccgcagccgagcacgccttcgagcattggcaagaagatgccttctttgccagccaattcttgaacggcctgaaccccgtactcatccgccggtgtcactatttgcctaagaattttcctgtcactgacgctatggtggcatccgtgctggggcccggtacctccctgcaagccgagctggaaaaagggagcctgttcttggtcgaccacggtatactgtctggtattcagacaaatgtcattaacggaaagccacagttctctgccgcccccatgacgcttctgtatcagagccctggctgcggcccactgcttccgctggccatacagttaagccagacccccggcccgaattctccgattttccttcccactgatgacaagtgggattggctattagccaaaacctgggtgaggaatgccgaattcagcttccatgaggcattaactcacctattacatagccatctcctcccagaagtctttaccctggccaccctgaggcagctgccacattgtcaccctctgttcaagtctaccggaatagggattgagggatttagtgaactgattcaacgcaacatgaaacagctgaattactccctgctgtgcctacccgaggacatcagaacaagaggtgtggaagatattcccgggtattattatcgcgatgacgggatgcagatctgggggataccgagttcgttggagactcgggaggccttggtgcagtacgtgaccatggtgatctttacctgttcagccaaacacgcagcagttagcgctggccagttcgactcctgcgcatggatgccgaacttacctccctcaatgcagctccccccacccaccagcaaaggcctcgccacttgtgagggctttattgcaacgctgccacccgtcaacgcgacatgcgatgtgatccttgcactgtggcttttgagtaaagagcccggggatcagagacctcttggaacctatccagatgaacacttcaccgaggaggcaccaaggcgtagcattgctacctttcagagcagactcgcgcagataagcaggggaatccaggagagaaatcaaggactggtgcttccctatacatacctcgacccacccttgatcgagaactcagtttccatctag

SEQ ID NO: 27229 - DNA, 618 bp, Artificial Sequence
  Description of Artificial Sequence: Synthetic coding sequence
atgagcgtggaccccatgacctacgaggcccagttcttcggcttcacacctcaaacctgcatgctgcggatttatatcgcgttccaggattacctttttgaggtgatgcaggccgttgagcaagtgatcttgaagaagttggatggcattcccgactgcgatatctcacccgtgcagatacgtaagtgcacggaaaaattcctgtgcttcatgaaaggccatttcgataatttattcagcaaaatggagcagttgttcctgcagctgattttgcgtattcccagcaacatcctgctgcctgaggataagtgtaaagaaaccccttacagcgaggaggactttcagcacctacaaaaggaaatcgagcaactccaggaaaaatacaaaactgagctgtgcacaaagcaagctctgctcgccgagcttgaggaacaaaagatcgtgcaggcaaagttgaagcagactctgacctttttcgatgagctgcataacgttggaagagaccatggcacgagcgacttccgggagtctttggtctctctcgtacagaattctcgcaaattgcagaatattcgggacaatgtcgagaaagagtctaaaaggctcaaaataagttag

SEQ ID NO: 27230 - DNA, 360 bp, Artificial Sequence
  Description of Artificial Sequence: Synthetic coding sequence
atgatcctgcagcagcccctgcagcggggcccccagggcggcgcccagcgactgccaagggctgcactgggtgtcacttgggggctcgacgccagggagcctttacgcaaacagtttctgagcgaagagaatatggccacccattttagccagctgtctttacacaacgaccacccatattgtagtccgccgatgacattttccccagccctccctccattgcggagcccatgcagtgagctactcctgtggcgctaccctgggagtctgattccggaggctcttcgcttgctgagactcggcgacacccctagcccgccttacccagccactccagcgggagatatcatggaactgtag

SEQ ID NO: 27231 - DNA, 1473 bp, Artificial Sequence
  Description of Artificial Sequence: Synthetic coding sequence
atgcccatgcccaccgagggcacccccccccccctgagcggcacccctatccccgttccggcatactttcgtcatgcggagccagggttctccctaaagagaccacggggtctgtccaggtccctcccccctccaccccctgccaagggtagtatacctatttcacgtctatttccgcccagaacgcccggctggcatcaacttcaacccagacgtgtatccttcaggggtgaggcttccgagacactccagtctcctgggtatgacccgtccagaccggaaagcttcttccagcaaagttttcagcgcctgtccagattgggacacggctcttatggtgaggtgttcaaggttaggtccaaagaagatggaagactgtacgccgtgaagcggagcatgtccccattccgtggcccaaaggatcgagcccggaaactcgcggaggtggggagccacgagaaggtggggcaacatccatgctgtgtgcgcctggagcaggcttgggaggagggcggcatcctctatctgcagactgaactgtgtggaccctcacttcagcagcattgtgaggcttggggagctagtcttcccgaggcccaagtctggggctatctcagagacactctgcttgcgctcgcccacctccactcccaggggctcgtgcatttggacgttaagcctgccaacatctttcttggccctcgaggcagatgtaagctgggggacttcggcctgctcgtagagctaggaacagctggcgcaggagaggttcaggagggagaccccaggtacatggcacctgaactgctccagggatcgtacggcactgcggcggacgtattttctctgggactcaccatcctggaggtggcctgtaacatggagttgccacacggaggcgaaggatggcaacagctgaggcaaggttatctaccccctgagtttaccgccggattgtcttcagaactgagatccgttctcgttatgatgctggaacccgatcccaagctccgtgccacagcagaagctctgttagccctgccagtactgcgtcagcccagggcatggggagttctctggtgtatggccgcagaagcgctttcccgaggctgggcactttggcaggctctgctggccctattatgttggttatggcacgggcttgctcatccagcaagctggctgcagccgctgggcccccctgcaacccctcccggcagtcccccttgctctcttctgctcgacagttccctgtccagcaactgggacgacgactctttgggccccagcctgagtccagaggctgtgctggctcggactgtcggaagcacaagtacaccacggtccagatgtactcctagggacgcccttgatctgagtgacattaatagcgagccccccagaggctccttcccctccttcgaaccacggaatctcctgtctctgtttgaggatacactggaccccacgtag

SEQ ID NO: 27232 - DNA, 1293 bp, Artificial Sequence
  Description of Artificial Sequence: Synthetic coding sequence
atgctggagcggtggcaccagctgcagccccggcgggtgagcttcagaggagaggccagcgagaccctgcagtcacccgggtacgacccctcccggcctgagtccttctttcaacagtcctttcaaagactctcgagacttggccatggcagctacggcgaggtgttcaaggtgcggtccaaggaggacggcagactttatgccgtcaaaagatccatgtccccctttagaggacctaaggacagggccagaaagcttgccgaggtgggctcacatgagaaggttggacagcatccctgctgcgtcaggctggagcaggcttgggaggaaggcggcatcctgtacctccagactgagctctgtgggcccagccttcagcagcactgcgaagcatggggagcttctctgccggaggcccaggtatggggatatcttcgcgacaccctgttggccctcgcacacctgcattcacaggggttggttcacctagatgttaaacctgcaaatattttccttggtcccagagggcgttgcaagctaggggacttcggcttgctcgtggaactgggcactgccggtgctggcgaagtgcaggaaggtgaccccagatacatggcccctgagctcctgcaggggtcgtacggcaccgctgcagatgtgttctctctggggctaaccattcttgaggtggcgtgcaatatggaacttccacatgggggcgagggatggcagcaattgcgtcagggatatcttccccccgagttcacagccggcctgagcagtgaattacggtccgtcctagtgatgatgctggagcctgatcctaagctgagggccactgctgaagcattgttggccctgcccgtgctaagacagccgcgggcctggggagtgctctggtgcatggccgccgaagctctgagccgcggctgggcactctggcaagcccttttagccctgctgtgctggctttggcacggtctggcccatcccgcatcctggctgcagcctcttggtccccccgccactccacccggcagcccgccgtgtagcctattgctcgacagtagtctgtctagcaattgggatgatgatagtctgggaccatctttatcgccagaggctgtgctggcaaggacagtcggctccacgtccactccccgatcccgatgcacgcccagagacgcactcgatctttcggacatcaacagcgagccacccaggggcagctttcccagctttgagccccgcaatctcttatctctgtttgaagacaccctcgaccccacatag

SEQ ID NO: 27233 - DNA, 666 bp, Artificial Sequence
  Description of Artificial Sequence: Synthetic coding sequence
atgcaggtgcaggacgacggcgtgaacctgatccccttcgccaagtgctctcgtgttgtgagcagatcccccccaccccgcctcccttcacaaagtttgcgtcctatgcctcagagatacggagacgtgttctggaagaatttgaatcagagacccacaccaacctggttggaagaacagcatatcccacccatgctgctgccccctccggagatgttatggaggaggaagaagagacgcccttgcctggagggcatgcagcaacagggtctggggggagtgccagctcgcgtcagggctgtgacttatcatctggaagatctgaggaggaggcaatctatcatcaatgaactcaagaaagctcagtgggggagctctggggcggcctctgagcctgtagtgctgggggaagagggctgcggattccctagtacgaatgagtacccggatttagaggaggaacgcgctacatatccccaagaagaggatcggtttctcaccccaggacgggcccagctgctttggtccccctggtcacccctcgatcaggaagaagcatgtgcaagccgccagctgcattcattagcctcctttagtaccgtgactgccaggaggaatccactccacaacccatggggcatggagctggctgcctcggaagagtag

SEQ ID NO: 27234 - DNA, 2232 bp, Artificial Sequence
  Description of Artificial Sequence: Synthetic coding sequence
atggaggccgccgccgtgaccgtgacccggagcgccacccggcggcgtcgcagacagcttcaggggttagcagcaccagaggctggcacccaggaggagcaggaggaccaggaaccgagacccagacggaggcgccccggcaggtccatcaaggacgaagaggaagaaacagtattccgggaggtcgtaagtttctcgcctgaccccctgccagtgcggtactatgataaagacaccactaaacctatcagcttttatctctccagtttggaggagctcttagcttggaagccacggctggaggacggattcaacgtcgccctcgagccactagcgtgccgccagccacccttgtcttcacagcgacctcgcaccctcctgtgtcatgacatgatgggtggataccttgatgatcgattcattcagggatctgttgtgcagacgccgtatgccttttaccattggcaatgcattgacgtgtttgtttacttttcgcaccatacagtgaccattccccccgtggggtggactaatactgcacaccggcatggcgtgtgtgtgctggggacattcatcaccgaatggaacgagggcggaagactatgtgaggcctttctggccggagatgagcgcagttatcaggccgtcgcagaccgtcttgttcagattacacagttctttcggttcgacggctggctcatcaacattgagaattccctttctctggctgctgtcggcaatatgccgccgtttctgagatatctcaccacccaactgcatagacaggtacccggcgggttggttctctggtatgactctgtggtacaaagcggacaactgaaatggcaggatgagctgaaccaacacaacagagtcttttttgatagttgtgacggtttcttcactaactacaactggagagaagagcatcttgagcgaatgcttggccaggccggcgagagaagggcagatgtgtatgttggggtcgacgtgtttgcgagaggcaacgttgtgggaggaaggttcgataccgataaatctctggagctcataaggaaacatggcttcagtgtcgcactcttcgctcctggttgggtttacgaatgcctggaaaagaaagattttttccagaatcaagacaagttctggggccgactggagcggtaccttccaacccattcaatttgctcgctccccttcgtgacatcattttgtctgggcatgggtgcgcgacgggtgtgctatggacaagaggaggccgtgggcccatggtaccatttaagtgcccaggaaattcagcccctcttcggggagcatcgactgggcggagacggacgtggttgggttagaacccattgttgcctcgaggacgcttggcacggcggatcttctctgttggtcaggggagtaatccccccagaagtagggaacgtagcagtccggttattcagcttacaagctcctgtaccccctaaaatctacctgtctatggtgtataaacttgaagggcccaccgacgtgaccgtggctctcgagctgaccacgggcgacgccggatcatgtcatatcggcggtatatccgtgctgaatgcagaaacgtcttcacgacactcactacgcccacttcgggtgccacccaccaaactggctcgatgggtcggcaggtgcggaagacaactgagcggcggatgggttcagcactgctacgaagtaagcctccgtggctgtttgctcctggatcttttagtttgtttttccagaccacccgggtccagggaagaagaatcattcacgtgccgactgggggaaattcaagtggtggacgctgccagcctgcttgcccccctccctcaggtgcaggcggtcactatcagccacatccgatggcaaccatcggcctctgaacgagaaggcccgcctgccctactgcagctctcgtgcacactccactggtcgttcttgctctcccaagtgaggtgctttcgcattcactgctgggggggaatgtctgatgacagtccagggagggagctgccacggcccgagatgcccatgttcttaggcctcgcattcgctacacagtacagaatcgtggatttattggtggaagccgcagggcctggtcaggatagacgcatggagttcttggtcgagcctgtccctaaggagggattcagggtgcctcaggctgagtggggtcgggctgtgttgctgtactcagcgccagcttag

SEQ ID NO: 27235 - DNA, 579 bp, Artificial Sequence
  Description of Artificial Sequence: Synthetic coding sequence
atgagcaccgccgccgtgcccgagctgaagcagatcagccgggtggaggccatgagactcgggccaggctggtctcacagctgccacgctatgctatacgctgccaaccccggacagctgtttggccggattccaatgaggttctccgtgctcatgcagatgcgcttcgacggcctactggggtttccagggggtttcgtcgaccgccggttttggagcctggaggatggattgaaccgcgtgttgggcctaggtctggggtgcttaagactaacggaggcggactacctgagctctcacctcacagaaggacctcaccgggtcgtagctcacctgtacgcaagacagctcacgctggagcagctgcacgctgtggaaatcagcgcggtccacagccgtgaccacggcctagaggtggggccgcctcctggaccaagacctccgccaagggggctagctttggccccatggaaagccccgatgggggccggcccccgagcagggcccgccgtgcaccccgaggggccctccaggcgcctcccgcagcttcctgaacagcgcctacgagaacatggatag

SEQ ID NO: 27236 - DNA, 2553 bp, Artificial Sequence
  Description of Artificial Sequence: Synthetic coding sequence
atgctggagcggcgggccctgctgtggcagcgggaggccggccccggttggggagatagggctcgcgctgggactgggggggcaggcgggggctgcggaggggctatggcagaaagaggaccagcgttctgtggactgtacgatacttcctcactgcttcgatattgtaatgatgacaatctgagcggtactagcgggatggaggtggacgatcgcgttagcgccttggagcaaaggctccagcttcaggaagatgaacttgccgtgcttaaagccgccctggccgatgctcttagacgcctgcgcgcttgcgaagaacagggcgccgccctcagagctcgcgggacgccgaaaggacgggccccccctcgtttgggcactacggccagtgtttgccagctcctgaagggactgccaactagaacaccgcttaacggctctgggccccccagaagagtgggtgggtacgccacttccccaagttcgccgaaaaaagaggccaccagcggacggagttccgtccgacggtacttgtcccccgaaagactcgccagcgttcgcagagaagacccaagaagccgtactacatcttccagctccaattgttcagcgaagaaagagggaaaaacgaaagaggttattttctccgtagaagacgggagcgtaaagatgttccttcgtggcagacctgtgccaatgatgattcctgacgagctcgcccccacctatagtctggacacacggtccgaattaccatcctgtcgactaaagctggaatgggtctatgggtaccgcggcagagattgccgagctaacctgtatctgctgcctaccggcgagattgtgtattttgtggcctccgtcgccgtgctgtactctgttgaagagcaaagacagcggcactatctgggccacaacgatgacatcaagtgcctcgctatacaccccgacatggtgacaatcgctacgggacaggtggcaggaacgaccaaagagggtaagcctctaccaccgcatgtcagaatttgggactccgttagcctgagcacattgcatgtgctgggattaggtgttttcgatcgagctgtatgttgcgtgggattctcaaaaagtaacggcggcaacctgttatgtgccgtggacgaatcgaacgatcacatgctatctgtttgggactgggccaaggagactaaagttgtagacgtcaaatgctctaatgaagcagttttggtggccacctttcaccctaccgaccctacagtgctgatcacttgcgggaagagtcatatttacttttggaccctggagggcgggtccttgagcaagagacagggactctttgagaaacatgaaaagccgaaatatgtgctctgcgttaccttcttagagggcggagatgtggtgacgggtgacagcggtggaaacctatatgtctgggggaagggcggcaatcggatcacacaggcggtcctgggcgcccatgacggcggagtgttcggactatgcgcattgcgggatgggactctggtttcggggggcgggagggaccgccgggtggtcctgtggggtagcgattattctaaattgcaggaggttgaggtgcccgaagactttgggccggtccgcactgtggctgaaggccacggagacaccctgtacgtaggaactactcggaatagcattttgcaagggtccgtacataccgggttcagtttgctcgtgcagggccacgttgaagagctctggggcttggccactcatccaagccgggcacagtttgttacctgtggacaggataaattagttcatctttggagttcggattcccaccagccactgtggagccgcatcatcgaggacccagccagaagtgccgggtttcacccctccgggtctgttctagcagttgggacggtgaccggtcgatggctgctgctggatacagagacccacgacctggtagccatccacacggatgggaacgagcaaatctcggtggtgtctttttctcctgacggcgcatacctcgccgttggatcacatgataacctcgtttacgtttataccgttgaccagggaggacgcaaagtcagtcggctcggtaaatgctcggggcattctagcttcatcacgcatctggactgggctcaggattctagctgtttcgtgaccaatagtggtgactatgagattctctactgggaccccgctacctgcaagcagattacatcagcggatgccgtgcggaatatggaatgggcaactgcaacctgtgtgctcggattcggagtatttggcatttggtctgaaggcgccgacgggactgacatcaatgctgtggccaggtcccacgatgggaaactgctcgcgtccgccgacgactttgggaaggttcatctgttttcttacccgtgttgtcaaccccgcgcgttgtcccacaaatacggagggcactcttcccacgtgactaatgtcgcgtttctgtgggatgatagcatggctttgacaacaggcggtaaagatacttcagtgctccagtggcgggtggtgtag

SEQ ID NO: 27237 - DNA, 2502 bp, Artificial Sequence
  Description of Artificial Sequence: Synthetic coding sequence
atggccgtggaggacagcaccctgcaggtggtggtgcgggtgcggcccccgaccccaagggaacttgactcacagagacgccctgtggtgcaagtagttgatgagagggtgttggtgtttaacccggaagagccagacggcggtttccccgggctgaagtggggcggcacccacgatgggccaaagaaaaagggaaaagacctgacatttgtgttcgatcgcgttttcggggaggcggctacccagcaggatgtcttccaacacaccacacactcagttcttgatagcttcctccagggctacaattgcagtgtattcgcctacggggccacgggcgctggaaagacacatactatgctcggccgagaaggcgaccctggaatcatgtatcttacaaccgtcgaactgtatcggcgcctggaggctcggcagcaagagaagcattttgaagtgctaatttcttaccaggaggtgtacaatgaacagattcatgatctgctggagccgaagggtcccctggccatacgtgaggatccggataagggcgtggttgtacagggcctcagcttccatcaacctgcatctgccgaacagctgctcgagatcctgactagagggaacagaaaccgcactcagcaccccactgacgcaaatgcgacttcctccagatcccacgccatttttcaaatatttgtcaaacagcaggacagggtgcccggcctgacccaggctgtgcaggttgctaagatgagcttaatagacctagcgggcagtgagcgggcgagctctactcacgcaaaaggcgagcgcttgcgagagggagccaacatcaataggtctctgcttgccctaattaatgtcctcaacgctctcgctgatgcgaaaggcagaaaaacacacgtgccatatcgcgactctaagctgacaagacttttaaaggactctttaggcggtaactgccggacagtgatgatcgccgcgatttctccaagcagcttaacctacgaggacacatacaataccctcaaatacgccgacagggccaaggaaatccgcctaagccttaaaagcaatgttaccagtttagattgccacatctcacagtacgcaaccatttgccaacaattacaggcagaggtcgccgcgttacggaaaaagcttcaagtgtacgaaggtggtggccagccccccccccaggacctcccaggctcccccaaaagtggtccaccacctgagcatcttccatcttcaccactgcccccccacccccccagccagccctgcaccccagagctcccagctgggcctcgggcgctgcaagaagagtccctcggtatggaggctcaagtggaacgtgctatggagggaaattcttctgatcaagagcagtcacccgaagatgaggatgagggcccagctgaggaggtgccaactcagatgcccgaacaaaacccaactcatgccctgcctgaatcaccccgcctgacactacaacccaagcctgttgtgggacacttcagcgcccgtgagcttgatggggatcgcagcaagcagctcgcactgaaggtgctgtgtgtggcccagcggcagtacagtctgcttcaagccgccaatcttctgacccctgacatgataacagagttcgagaccttacagcagctcgtccaggaggaaaaaatcgaaccaggagccgaagctctgcgtacgagcggtctcgctagaggagcacctctggctcaggaactctgctccgaaagtatccccgttccaagccctctgtgcccggaaccgccaggctataccgggcctgtcactcgaacaatggctcgccggctgagtgggccactgcacacactgggcatccctccagggccaaattgcacccccgctcagggtagtagatggccaatggagaaaaaacggagacggccatccgccttggaggcagactcacctatggcaccaaagcgtggcacaaagcggcagcgtcagtctttcctcccttgcctccgccgggggtctctgcctgatacgcaaccaagccaggggccaagcactcccaaaggagaaagagctagtagcccgtgccatagccctcgggtttgtcctgcaactgtgatcaaatcaagagtcccgctgggcccctcagcaatgcaaaattgtagcactccgttagcacttcccactagggacctgaacgccacattcgatctctccgaggagcccccaagcaagccaagctttcacgagtgcatcggttgggacaagatccctcaggaattatcaagactcgatcagccatttattccacgagcaccagtgcctctgttcacgatgaagggaccaaagcctacatcttctttacctgggaccagcgcctgtaagaagaagcgcgtggcaagcagctccgtgagtcatggtagatcaaggatagcccgcctgccctcctctacgcttaagagacctgctgggcccctcgtcctccctggcgattggcactag

SEQ ID NO: 27238 - DNA, 3351 bp, Artificial Sequence
  Description of Artificial Sequence: Synthetic coding sequence
atgtacggcagcgcccggagcgtgggcaaggtggagcccagcagccagagccctgggaggagtccacgcctgccccgcagccctcggttgggtcaccgcagaaccaactctactgggggatccagcggtagttccgtgggaggtggatctggaaagacactcagcatggagaatatccagtccctgaacgcagcctacgcaacttctgggccaatgtatctttccgatcatgaaaatgtcggcagcgaaactcccaaaagtacgatgacactaggtcgatcaggaggaaggctgccctacggcgtgcgcatgacagcaatgggatctagtccaaacatcgcgtcatcaggggtggcctctgatacaattgccttcggggagcaccatctgccgcccgtctcaatggcctccacggtaccccactctctgcgccaggcgcgcgataatactatcatggacctccaaacccagctcaaagaggttctaagagaaaacgacctgttgcggaaagatgtagaagtcaaggagagcaagctgagctcctctatgaattccattaagaccttttggtcacctgagctgaaaaaagaaagggctctcaggaaagacgaggccagtaaaatcacaatttggaaagagcaatatagagtagttcaggaggagaaccagcacatgcagatgactatccaggcactgcaggatgaattacgcatccagagggacctgaaccaactctttcagcaagattcctcctcgagaaccggcgaaccttgcgtagctgagcttaccgaagaaaactttcaacgtctccacgcagagcacgaaaggcaggctaaggagctgttcctactcaggaaaaccctggaggagatggaactcagaattgaaacccagaaacagactttgaacgcgagggacgagtcaatcaaaaagttactagaaatgctgcagagtaagggcctctcagccaaggccaccgaggaagatcacgaaaggacccgaaggctggcggaggccgagatgcatgtccaccacctggaaagcttgctcgaacagaaggagaaagagaactccatgctgcgcgaggaaatgcatcggagattcgagaacgccccagacagtgcaaagacgaaagcacttcagactgttatcgagatgaaagattctaagattagcagtatggagaggggactccgggacctggaagaagaaattcagatgctcaaatcaaatggcgcattgagtaccgaggaaagggaagaagaaatgaaacagatggaggtttatcggagccacagtaaatttatgaaaaataaggtcgaacagctgaaagaggagctgtcctccaaggaagcacagtgggaggagctcaaaaaaaaggctgcggggttacaggccgagatcgggcaggtaaagcaggagctgagccgaaaggacacagaactgctggctctgcagactaagctggagacgctgacaaaccaattctcagattcaaaacaacacatcgaagtgttgaaggaaagccttacagccaaggaacagagggccgctattctgcagactgaggtggatgcgctccgactccgcctggaagagaaagagacaatgctcaacaaaaaaacaaagcagatacaagacatggcagaagaaaaaggcacccaggctggggaaatccacgatctgaaagacatgctggatgtgaaggaaagaaaagtaaacgtgttgcagaagaaaatcgagaatcttcaagaacaactccgggacaaggaaaaacagatgagttcattaaaagagagagtaaagtctcttcaagccgatacgacaaatactgacacggccttgaccacactggaagaagccctggctgagaaggaacggaccattgagagactcaaagaacaacgggaccgggacgagagggagaaacaggaggagatcgataactataagaaggacttaaaggatctgaaagagaaggtttccctgctgcagggggatctgtctgagaaagaggcctctctgctggatctgaaagaacatgcatcctccctggcttcttcaggcctgaagaaagacagcaggctcaaaacgctggaaatcgccctggagcagaaaaaggaagagtgcctgaagatggagtcacagctaaagaaagctcacgaggcagccctcgaagctagagcttccccagaaatgtccgaccggatccagcatctcgagcgagagattacacggtataaagacgaatcttccaaggcccaggccgaggtcgaccgactgttagaaatacttaaggaagtcgagaacgagaagaacgataaggacaagaagatcgcagagctggagcgacaagtcaaggatcagaataaaaaagttgccaacctcaagcataaggagcaggtggaaaagaaaaaatccgcccagatgttagaagaagcacgcaggagagaagacaacctcaatgactcttctcaacaacttcaagactctctgcgtaagaaggatgacaggattgaggagcttgaggaggcccttcgggagtccgtgcagatcacagccgaacgcgaaatggttctggcacaggaggagtcggccaggacgaatgctgaaaagcaggttgaagagctgctgatggcaatggagaaagtaaaacaggagctggaatccatgaaggctaagcttagttccacccaacagtctttggccgagaaagagacccacctcacgaatcttagagcggaaaggagaaagcacctcgaagaggttctggaaatgaagcaggaggcccttctggccgcaatctccgaaaaggatgccaacatagctctgttagagctctcatccagcaaaaaaaaaactcaggaggaagtggccgctctaaagagggagaaggacaggttggttcagcagttgaaacagcagacccagaaccggatgaaactcatggcagataattatgaggatgaccactttaagtcttcccactcaaatcagacaaaccacaagccttccccagatcagatcatacagcctctcttggagctggaccaaaatcgctctaaacttaagctttacattgggcacctgacaacgctgtgccatgaccgtgatcccttgatcctcaggggattaacaccaccagcgagctataacctcgatgacgaccaggcagcatgggaaaatgagctccagaagatgacccgtgggcaactgcaggatgagctcgagaaaggggaaagagataacgccgagctgcaggagttcgctaatgcaatcctgcaacagattgccgaccactgcccagatatcctcgagcaggttgtgaatgctctagaggaatcttcctag

SEQ ID NO: 27239 - DNA, 2055 bp, Artificial Sequence
  Description of Artificial Sequence: Synthetic coding sequence
atgatccccccccaggaggccagcgcccggcggcgggagatcgaggacaaattgaaacaagaggaagagaccttgtcctttatcagggatagcctcgagaagagcgaccagctgaccaagaatatggtctcaatactctcttcctttgagtcaaggcttatgaagctggaaaactctattattcccgtgcataagcagaccgaaaatcttcagagactgcaggaaaatgttgagaagaccttgagctgcctggaccacgttatatcctattatcatgtggcgtctgacacggagaagattatacgcgaaggcccaacaggccgtctggaggaatacctcggctccatggcaaaaatacagaaggccgttgagtatttccaagacaatagtcccgactcccctgagttgaacaaggttaaactgctatttgagagaggtaaggaagctttggagtcggagttccgatcgttgatgactcgccactcaaaggtagtgagccctgttcttatcttggatctgattagcggcgatgatgacctggaagctcaggaagatgtcaccttggaacatttgcccgagagtgtgttacaggacgtgattcggatatcacgatggttggtggaatacggtcgcaaccaggacttcatgaacgtctactatcagatccgaagcagccagctggatcgctccataaagggtctgaaggaacactttcacaagtcctcttcatcctccggagtgccctattcaccagccattcctaacaagcgcaaagatacacctactaagaaacccgtgaagcgcccaggtacaattcgcaaggcccagaatctgctgaaacagtactctcagcatgggcttgacggcaagaagggaggctctaatctcattccgcttgaaggtcgagacgatatgcttgacgtagaaacagatgcctatatccattgtgtgtcagcttttgtgaagctcgctcaaagcgagtatcagcttctcgctgacatcatccctgagcaccaccagaaaaagacatttgattctttgatacaggatgctctagacggtcttatgctggaaggggagaatatagtatctgctgcacggaaggccatcgtgcgtcatgacttctccacagtactcacagttttccccatcctgcggcatttgaagcagacaaaacctgagtttgatcaggtcctgcaggggaccgccgcgtcaactaaaaacaagctgccgggattgataacgagcatggagacaattggagcgaaagcactcgaggatttcgccgacaatattaaaaatgatccagataaggaatataatatgccgaaagacggaacagtccatgagctcacatcaaacgctattctattcctgcaacaactgctcgacttccaggagaccgccggagcaatgcttgcttcccaagaaacaagttcgtcggcaactagctactccagcgaattctctaagcgattgctgagcacttacatctgtaaggttttggggaacttacagttgaatctgctgtctaaaagtaaggtctacgaagaccccgctctgagtgctattttcctgcacaacaactataattacattttgaaaagcttggaaaagagcgaacttattcagctggttgcagttactcagaagacagccgaacggtcctatagagaacacatcgaacagcagattcagacctaccagcgtagttggttgaaagtgacagactacatcgctgagaagaacctacctgtgtttcagccaggggtaaaattaagagataaggaacgacagatcatcaaggagcggtttaaaggctttaatgatggactggaagagctgtgtaaaatccaaaaggcatgggccataccagacacggaacagagggaccgaattagacaagcgcagaaaaccattgtaaaagagacatacggcgcttttcttcagaagttcggctccgttccattcactaagaatcctgagaaatatattaagtatggggtggagcaggtgggcgatatgatcgaccgactgttcgatacaagcgcttag

SEQ ID NO: 27240 - DNA, 378 bp, Artificial Sequence
  Description of Artificial Sequence: Synthetic coding sequence
atggccgacgaggagctggaggccctgcggcggcagcggctggccgagctacaggctaaacacggggaccccggagacgctgcccagcaggaggctaagcacagagaggcagaaatgaggaactctatcttggcccaagtgttggatcagagcgctcgggctcggttgtctaacctggctctggttaagcctgagaagactaaggccgtagagaattatctgatccagatggctagatatgggcagctgtccgagaaggtctccgagcaaggtctcattgagatcttgaaaaaagtctctcagcagacagagaaaacaactactgtgaagtttaataggcggaaagtcatggacagcgatgaggacgacgattactag

SEQ ID NO: 27241 - DNA, 3327 bp, Artificial Sequence
  Description of Artificial Sequence: Synthetic coding sequence
atggccctgcggcccggcgccggcagcggcggcggcggcgccgccggggccggggcgggaagcgcgggcgggggcggcttcatgttcccggtggcgggtggaatccggccaccacaggccggcctgatgccaatgcagcagcagggctttcctatggtgtccgtcatgcagcctaacatgcagggcattatgggaatgaattatagtagccagatgtcacagggacctatcgcgatgcaggcaggtattcccatgggcccgatgccagccgccgggatgccctatcttggacaggcccccttcctggggatgcgcccacccggtccacagtacactcctgacatgcaaaaacagttcgctgaagaacagcagaagaggttcgagcagcaacaaaagctcctggaagaagagcgcaagcgacgccaattcgaggagcagaagcaaaagcttaggttgctgtctagtgtaaagcccaagaccggggagaagtccagagacgatgcgctggaagctataaaggggaacctggacggatttagcagagatgccaaaatgcaccccacacctgctagtcatcctaagaagcctggggtgggggtctttccaagccaagatcccgctcagcctaggatgccgccgtggatctacaacgaaagcctcgtgcccgacgcctacaagaagatcctggaaaccaccatgactccaactggaattgacacagctaagttgtatcccatcctcatgagcagcgggctcccacgggagaccttggggcaaatttgggcgctggccaatagaaccaccccaggtaagttgaccaaggaagagctgtataccgtcctggcgatgatcgcagtcactcaagtggtaaaacctgaggaggacgacttccaggactttcaggatgcatcaaaatctgggtccctggacgacagcttttctgacttccaggaactgccagcatcttccaaaacttctaattcccagcatggcaatagcgcaccttctctcttaatgccactgcctggcactaaagctctcccttctatggacaaatacgccgtgttcaaagggatcgccgccgataagtcaagcgaaaatacagtgccgccaggcgacccgggtgacaaatactctgccttccgggagttggagcaaacagccgagaataagcctctgggcgagagctttgctgagttccgttccgccggaacagacgatggattcactgacttcaaaacagccgattctgtctcacccctcgagccgccgacaaaagacaaaacttttccgccaagttttccgtcgggtactatacagcagaaacagcaaacacaagtgaaaaaccccctgaatctagccgacctagatatgttttcatccgtgaattgctcctctgagaagcccctgagtttcagcgctgtattctccacatcgaagagtgtgtctaccccacaatcaaccggctcagcggctactatgactgcccttgctgctacaaaaactagctctctagccgacgatttcggagagttcagcctattcggcgagtattctggcttggctccggtgggagagcaggacgactttgcagattttatggccttcagtaactcatccattagtagcgaacagaaacctgatgacaagtacgacgcgttaaaagaggaagctagcccggtgcccttgacttctaatgttggatccacggtgaaagggggccagaatagcaccgcagcctccactaagtacgacgtcttcaggcagctgtctctggagggaagcggactgggtgtcgaagatctgaaggataatacaccctccggcaagtccgatgacgatttcgctgatttccattcgagtaaatttagttcgataaactcggacaagtcactgggggaaaaggctgtcgctttcagacatacaaaggaagacagcgcttctgtcaagagtctcgatttaccgtcaatagggggaagctctgtcggaaaagaggactccgaggacgctctttctgttcagtttgacatgaaattagccgatgtgggcggggacctgaaacacgtgatgtcggactctagtttagaccttccaactgtcagcggacagcacccaccagcggccgctgggtctggcagtccgtcggccactagtatacttcagaagaaagagaccagctttgggagctccgaaaacataacaatgaccagcttaagtaaagtgaccacatttgtgagtgaggatgccctgccagagacaacatttccggccctcgcctccttcaaggacaccattcctcagacaagcgagcaaaaggaatacgagaatagagattataaagactttaccaagcaggacctcccaacggcggagcgcagccaagaagcaacttgcccatctccagcatcatccggagcatctcaggagacccctaacgaatgttcagatgacttcggggagtttcagtccgaaaagccgaagatctcaaagtttgattttttggtcgccacaagccaaagcaaaatgaaaagttctgaggagatgatcaagtctgagttggcaacgttcgacctgtccgtgcagggaagtcataagcggtctctcagtcttggagacaaggaaatcagcagaagctcccccagccctgcattggaacaacccttccgggaccgcagcaatacactgaatgaaaagcctgctttgcccgtcatcagggataagtataaggacctcacgggcgaggtcgaggagaacgaacgctacgcctatgagtggcaacgttgtttaggaagcgccctgaatgtgatcaagaaagccaacgacacactgaatggaatttcctcgagctcagtgtgtacagaagtgattcagtctgcgcagggcatggaatacctgctgggagttgtagaggtgtaccgagtcacaaagagggtagagctgggaattaaggccacagcagtgtgttcggagaaactgcaacaacttcttaaggatatcgacaaagtatggaacaatcttatcggtttcatgtcacttgctacacttacacccgacgagaattccctggacttttcctcctgcatgctgcgtcccggcatcaaaaacgcccaggaactggcctgcggggtgtgtcttctgaacgttgattccaggtcacggaaagaagagaaaccagccgaggaacatccaaagaaggcatttaattctgagactgattctttcaagctcgcctacggagggcatcagtatcatgcgagttgtgcaaacttctggataaattgtgtcgaacccaaaccacctggccttgtgttacccgacctgctgtag

SEQ ID NO: 27242 - DNA, 594 bp, Artificial Sequence
  Description of Artificial Sequence: Synthetic coding sequence
atggccgccttccgggacatcgaggaggtgagccagggcctgctgagcctcctgggagccaatagagcagaagcgcagcagaggagacttctagggcgacacgagcaggtggtcgaacgtcttcttgagacccaagatggcgcggaaaagcagctccgggagatcctcactatggagaaggaagtggcacaatcgctgttgaatgctaaggaacaggttcaccagggcggtgttgagctgcaacagctcgaagctggcttgcaggaggcgggagaggaagatactaggctaaaagcgtccctactccaactcaccagggaattggaagagctaaaagagattgaagccgacctggagagacaagagaaggaggtggacgaggacacaaccgtcaccataccaagcgctgtttacgtcgcccagctgtaccaccaggtgtctaaaatagagtgggattatgaatgcgaacctgggatggtgaagggaatacaccacggcccatctgtcgcacagcccatacacctagatagcacacaactgtcacggaaatttatctccgattacctctggtctttagtcgacactgagtggtag

SEQ ID NO: 27243 - DNA, 906 bp, Artificial Sequence
  Description of Artificial Sequence: Synthetic coding sequence
atgacccggcacggcaagaactgcaccgccggcgccgtgtacacctatcacgaaaagaagaaagacaccgcggcctctgggtacgggacccagaacatccgtctgtcccgggacgctgtgaaagactttgattgctgttgcctgtctctgcagccatgccatgatcctgtggtcacaccagacggctacttatatgagcgggaggcgattctggaatacattttacatcaaaagaaggagattgcacgacagatgaaggcctatgaaaagcagagaggcacgaggagagaagagcagaaggagctgcaacgcgctgcctctcaagaccatgttagaggatttctggagaaagaaagcgccatcgttagccgccccttaaacccattcacagccaaagccttgtcaggaacttcccctgacgacgtccagcctggaccatctgtgggcccaccttccaaagacaaagacaaggtgctcccttcgttttggattccgagcctgactcccgaggccaaagccaccaagttagagaagccttcaaggaccgttacctgtcctatgagcggtaagccactgcgcatgtccgacttgacccccgtccatttcacccctttggactcttccgtagaccgagttggcctgattactcgttccgagcgatatgtctgcgcggttactcgtgattccctaagcaacgctacgccttgcgcggtacttagaccttctggcgcggtggtgaccctggaatgcgtggagaagctgatcaggaaagatatggtggatccagtgaccggagataagctgaccgacagagatatcatcgtacttcagcggggtgggactggattcgcaggttccggcgtgaaattgcaggcagaaaagtctagacccgtgatgcaggcttag

SEQ ID NO: 27244 - DNA, 990 bp, Artificial Sequence
  Description of Artificial Sequence: Synthetic coding sequence
atggaggtggccgagcccagcagccccaccgaggaggaggaggaggaggaggaacacagcgccgagccgcgacctaggactcgatctaaccccgagggggccgaagatagggccgtgggggcgcaggcttctgtcggctcaagatcagagggggagggtgaggctgctagcgctgacgacggaagcctcaacacgagcggggcgggacccaaatcatggcaggtcccccctccagctcccgaggtgcaaattagaacgccacgagtgaactgtcctgagaaggtcatcatctgcctggacctaagcgaggagatgtctctgcccaagctcgaaagttttaatggctccaaaacaaatgccctgaatgtcagtcagaagatgatagagatgtttgtgcgtactaagcacaagatcgataagagccatgagttcgctctcgtggtcgtgaacgacgatactgcctggctgagtggccttacctcagacccacgcgagttatgctcttgcctctacgacctcgagacagcatcctgtagcactttcaacctcgaagggctgttttctctgatccagcaaaaaaccgaactccccgtgacggagaatgtccagaccatcccgccaccctacgttgttcgcaccattcttgtgtacagccgccctccttgtcagccgcagtttagtctgactgaacccatgaagaagatgttccaatgtccgtacttcttttttgacgtggtttatattcataacggcacagaggagaaggaagaggagatgtcctggaaggatatgtttgcgttcatgggatcacttgatacaaaaggtacatcatataagtacgaggttgccttagcaggtccagcccttgagctccataattgtatggccaagctgttagcgcacccccttcaaagaccatgtcagtcccatgccagttatagtttgcttgaggaggaggacgaggccatcgaagttgaggcgacagtatag

SEQ ID NO: 27245 - DNA, 1263 bp, Artificial Sequence
  Description of Artificial Sequence: Synthetic coding sequence
atgctgagcagcttccccgtggtgctgctggagaccatgagccactacacggatgaaccccgattcaccatagagcagattgatctgctgcagcgactgagaagaactggtatgaccaagcatgaaatcctgcacgcgctggaaacactggaccggctggaccaggaacattctgataagtttggtcggcgcagctcttacgggggctccagttacgggaactccactaataatgttcccgcttccagcagcaccgcaacagcatctacgcaaacacaacattctggcatgagtccaagcccttccaactcatacgatactagcccacagccatgcactactaaccaaaatggtagggaaaataacgagcgtttatctacctcgaacggcaagatgtcacccacgcggtatcacgccaactctatgggtcagagaagttactcatttgaagcaagtgaggaggatcttgatgtagatgacaaagttgaggagctgatgagacgagactcgtcagttatcaaggaagaaatcaaagcattcttggctaatcgccgtatttcgcaggcagtggtcgctcaagtcacagggatcagtcagtcgaggatatcccactggctcctgcagcaggggagtgacctgagcgaacaaaaaaaacgtgcattctatcggtggtaccaactggagaagactaatccgggtgccacattatccatgcgccctgctcccattcccatagaggatccagaatggcggcagactcccccacctgtgagtgcaacctctgggactttcaggcttcggagaggtagtagatttacatggcggaaggaatgcttggcggtgatggaatcatatttcaacgagaatcagtaccctgacgaggcaaagcgcgaggagattgccaacgcatgtaatgctgtgattcagaagccgggtaaaaaactgagcgacctggagagggtcaccagtctaaaggtatataactggttcgccaacaggaggaaagagattaagaggagggccaatattgaagccgccatccttgagagccatggtatcgacgttcagagcccaggaggccactccaactccgacgatgtcgatggaaacgactattctgaacaggatgattctacatctcactccgaccaccaggaccctattagcctggccgtggaaatggctgccgtgaaccacaccatacttgccctcgcccggcagggcgctaacgagataaagacagaagctttggacgatgactag

SEQ ID NO: 27246 - DNA, 1263 bp, Artificial Sequence
  Description of Artificial Sequence: Synthetic coding sequence
atgctgagcagcttccccgtggtgctgctggagaccatgagccactacaccgatgaaccccggtttactatcgagcagattgacctgctccagcgactgcggagaacgggcatgacaaagcacgagatcctgcacgcgcttgagacactggaccgtcttgatcaggaacactctgataaattcggtcgacggtcatcttatggaggaagttcatacggcaacagcacaaataatgtgcccgccagcagttctactgctacagcatctacccagacccagcatagcggcatgagcccaagtccttccaactcctacgacacctcacctcagccttgtacgacaaatcagaatggcagagagaacaatgagaggttgagtaccagtaatggcaagatgagtccaacaagataccacgccaactcaatggggcagcgctcctacagctttgaggcctcagaagaggacctggacgttgacgacaaggtggaggagctcatgcggcgcgattcttccgtgataaaagaggaaattaaagcttttctggcaaacagacgtatttcacaggcagtggtggcccaagtgacagggatctctcagtctagaatctcacattggctactccagcagggcagtgacctgtctgaacaaaaaaagcgggcattctacaggtggtaccaactggagaagacaaatccaggagcaactcttagcatgagaccagctcccattcccatagaggaccccgaatggcgccagactccaccccccgttagcgcaacctccggcaccttccgcctgagacgaggctcaagatttacctggcgcaaggaatgtcttgctgtcatggaatcctatttcaatgagaatcagtaccccgacgaagccaagagagaggagatagcgaatgcttgtaacgcagtcatccagaaaccagggaagaagctgagcgatcttgagagggtaacatctttaaaggtttataattggtttgcaaatcggaggaaagagatcaagcgccgcgcaaacatcgaggccgcgatcttggaatctcatggtatcgacgtccagagcccagggggacatagcaatagtgacgacgtcgatggaaacgattactctgagcaggatgattccacttcgcatagtgatcaccaggacccaatttcccttgcagtggagatggcagccgtcaatcacacgatcctggcgctggctcggcagggcgcgaacgagatcaaaacagaggctttagacgatgactag

SEQ ID NO: 27247 - DNA, 915 bp, Artificial Sequence
  Description of Artificial Sequence: Synthetic coding sequence
atgctgagcagcttccccgtggtgctgctggagaccatgagccactatacagacgaaccgcggttcacaattgaacagatcgatctactccagcgtctgcgccgaactgggatgacaaaacatgagatactgcacgccctcgagaccttggatcgcttggatcaggagcactcagacaaattcggaagacgcagcagctacggcggatccagttacgggaactccacgaacaacgtgcccgctagttcgtcaacagctacggcttccacgcagacacaacacagtggcatgagcccttcgcccagcaactcttacgacacgagtcctcagccttgcacaacaaaccaaaatgggagagagaacaatgaacggctcagcaccagtaatggaaagatgagtcctactaggtaccacgcaaacagcatgggtcagcgctcatatagtttcgaggctagcgaagaagacttggacgtggacgacaaggtggaggaattgatgcgacgcgacagttctgtcatcaaggaggaaatcaaagcatttcttgccaaccggcgcatctctcaggcagtagtcgcacaggtgaccggcatttctcagtcaaggattagccactggctactgcagcagggctccgatcttagcgagcaaaagaagcgagccttctatcgctggtaccagttggagaaaactaatcctggggcaactttatccatgcggccagccccaataccaatcgaagacccagaatggcggcagactcctccacccgtgtccgccaccagcgggacgtttcgcctgcgccgcgggtcacggttcacctggagaaaagagtgcttggccgttatggaaaggaacacgtggtctccagagcggcggatggaggaaaataagtggaagctgctgtcggccggctag

SEQ ID NO: 27248 - DNA, 1332 bp, Artificial Sequence
  Description of Artificial Sequence: Synthetic coding sequence
atgctgagcagcttccccgtggtgctgctggagaccatgagccactatacagatgagcccaggtttactatcgaacagatcgacttgctgcaacgtctacgccgcacaggcatgacgaagcatgagatccttcacgccctggaaactttggacagactggatcaggagcacagtgacaagtttggaaggcgctcatcctacggagggagttcgtacggcaattccaccaacaatgtccccgcttcctcttctaccgctacagcttcgacccagacccagcatagcggcatgagcccctcgcccagcaacagttatgacactagcccccagccatgtaccactaaccagaacggccgcgaaaacaacgagaggcttagcacctccaacggtaagatgtctccaactcgctaccatgccaactctatgggccaacgtagctatagcttcgaggcgtcggaggaagatttagatgtggatgataaggtcgaagagttaatgaggagggatagttctgttattaaggaagagatcaaggccttcctggcaaacaggcgtatttcgcaagcggtggtggctcaggtgacaggcatcagccagtcaaggatctcgcactggttgctgcagcagggctctgacctgtccgagcagaaaaaaagagcattctatcgatggtaccagctggagaaaacgaacccgggggccacattatccatgagacctgcaccaataccgatcgaagaccccgagtggcgacagacaccaccaccggtctcagccacgagcgggacttttcgccttagacgcggcagtcggttcacctggcgcaaggagtgcctagcggtcatggagtcttacttcaatgaaaaccagtatccagatgaagccaagagagaggagattgcaaatgcctgcaacgccgttatccagaagcccggtaaaaagctgtctgacctagaacgcgtgaccagtctgaaagtgtacaactggtttgcaaatcgcaggaaagaaattaagaggcgcgcgaatatcgccgcgatcctggagagccatggaattgatgtgcaatctccagggggtcattctaacagcgatgacgttgatgggaacgactattctgaacaggacacctggcaggttagaaatggggaagaggaggaaggtaggtcatccgagggaggcagagaagcagagaaagacgattctacctctcatagcgaccatcaggaccctatcagcctagcagtggaaatggccgccgtgaaccataccatactggcgcttgctaggcaaggcgctaatgagattaagactgaggcattggacgacgattag

SEQ ID NO: 27249 - DNA, 357 bp, Artificial Sequence
  Description of Artificial Sequence: Synthetic coding sequence
atgctgagcagcttccccgtggtgctgctggagaccatgagccactacacggacgaaccccggtttactattgagcaaattgacctgctccagcgcctgcgacggaccggcatgaccaagcacgaaatcctacacgccctggagacattagatcgtctggaccaggagcattccgacaaattcggcagaaggtcaagctatggcgggagctcctatggcaattcaacgaacaacgttcctgcatcaagctcaaccgccaccgcgtccacacagacacagcacagcggaatgtctccgtcacctagtaacagttatgatacctcaccccaaccgtgtactaccaaccaaaacggctag

SEQ ID NO: 27250 - DNA, 1332 bp, Artificial Sequence
  Description of Artificial Sequence: Synthetic coding sequence
atgctgagcagcttccccgtggtgctgctggagaccatgagccactacaccgacgaacctaggttcaccatcgaacagatagacctactgcagcgcctgaggcgtacgggcatgacaaaacacgagattctccacgcactcgaaactctggacaggttggatcaagaacattctgacaagttcggtcggcggagctcttacggaggaagctcttacggcaactctaccaacaatgttccagcttccagctccactgctactgcctccacccagacccagcattctggaatgagtccgtcgccctctaattcatacgatacttctccccagccctgtactactaatcagaacgggagagaaaataacgagcggctgagcactagcaacggaaaaatgtccccaactcggtatcatgcaaattccatgggccagcggagctacagttttgaagccagcgaggaagacctggacgtagatgacaaggttgaggagctgatgaggagggacagcagcgttattaaggaagagataaaagcattccttgctaatcggaggatatctcaggctgtagttgcgcaagtgaccggaattagccaatcaagaatttcccactggctgcttcagcaggggtctgacttatccgaacagaaaaaacgagctttttataggtggtatcaactggaaaaaacaaaccccggggctaccctctcaatgagacccgcgccaatacctatcgaggaccctgagtggcgccaaacccctccacccgtgagcgcaactagtggtaccttccgcctgcggagggggtcccgatttacctggaggaaggaatgtctggctgtgatggagagctacttcaatgaaaaccagtaccctgatgaagccaagcgcgaagagattgccaatgcgtgcaatgcggtgattcaaaagcccggaaaaaagttgagcgatctggagagagttacttcgctcaaggtatacaactggttcgccaaccgtaggaaagaaattaagcgccgagcaaacatcgcggctattctcgaatcccacggcatcgacgtccagtctccaggaggtcacagcaactcagacgacgtcgatggcaacgattacagcgagcaggacacatggcaggtgagaaacggagaggaggaggagggcagatccagcgaaggcgggcgagaagccgaaaaggatgattcaacgtcccactcggaccatcaagatcccatctccttggctgtcgagatggctgctgtgaatcacacaatccttgctcttgcgcgtcagggcgccaatgagattaaaactgaggctctcgatgacgactag

SEQ ID NO: 27251 - DNA, 1218 bp, Artificial Sequence
  Description of Artificial Sequence: Synthetic coding sequence
atgctgagcagcttccccgtggtgctgctggagaccatgagccactataccgacgaaccaaggtttactatcgaacagatcgatttgctgcagagacttcgcagaacagggatgactaaacacgaaatccttcacgctcttgagactctcgatagactggatcaggaacactcagataagttcggaagaagatcctcttacggaggttcgagttacggcaattccacgaacaacgtgcccgcatcatcaagcaccgccaccgcgagtacacaaacccaacacagtggtatgagtcccagtccctctaactcctacgacacctccccacaaccttgcacaacaaaccagaatggtcgcgagaataacgaaagactgagcactagcaacggaaagatgtcacccacaaggtatcatgcgaacagcatggggcagaggtcgtactcgttcgaagcctccgaagaggacctggatgtagatgacaaggtggaggaactgatgcgacgagatagctcagttatcaaagaagagataaaggcctttctcgctaatagacgcatttcacaggctgtggtagcgcaggtcacaggtatttcccaatccagaatctctcattggctgctgcagcagggcagtgacttgtctgagcagaagaagcgcgctttttacagatggtaccagctagagaaaacaaatcctggagctactctcagtatgagacccgcacctattcctatcgaagatcctgaatggaggcaaacacctcctccagtgtccgccacctctggtactttccgcctccgccgaggaagtaggtttacatggagaaaggaatgcctcgctgtgatggaatcctactttaacgaaaatcagtatccagacgaggccaagagggaggaaattgccaacgcatgtaatgccgtgatacagaaacccggcaagaaactgtctgacctggagagggtgacctctctgaaagtctacaactggttcgccaatagaagaaaagagatcaagaggagggccaacatcgcggccattctagaatcacatggcatcgacgtgcagagccctggcggccacagcaattcggatgatgtcgacggcaacgactattctgagcaggacacctggcaagtaagaaatggcgaagaagaagaggggcgctctagtgagggcggcagggaagcggagaaggttgaggaagagagacgcatttag

SEQ ID NO: 27252 - DNA, 1380 bp, Artificial Sequence
  Description of Artificial Sequence: Synthetic coding sequence
atgactgctgaagagatgaaggctacagagagcggagcccaatcggcgcctctcccaatggaaggcgtagacatatctcccaaacaggatgagggcgtcttgaaggtcatcaaaagagagggaaccggtactgagatgcccatgatcggagatcgcgttttcgtgcactacacaggctggttactggacggaacaaaattcgacagttcccttgatcgcaaagacaagttcagcttcgatctcggtaaaggagaggtgattaaggcatgggatattgccattgcaaccatgaaagtgggagaggtgtgtcatattacttgcaagcctgagtatgcttatggctctgccggatcccccccaaagatcccacccaatgccaccttggtttttgaagtagagctgttcgagtttaagggggaagatttgaccgaggaggaggacggaggaattatccgtaggatacaaacgcgaggtgagggttatgctaaacccaacgaaggagctatcgtagaagtggcactggaggggtattacaaggataagctctttgaccaaagagaacttcgcttcgaaataggggagggtgagaatctggatcttccttacggactggagagagccatccagcgaatggagaaaggtgagcattccattgtgtacctgaaaccttcatatgcctttggtagcgtggggaaagaaaaatttcagatacccccaaacgcggaacttaagtatgagctgcatctgaagagcttcgaaaaggctaaggagagctgggagatgaactctgaagaaaaactggagcaaagcacgatagtgaaagagagggggacagtctattttaaggaagggaagtacaagcaggctctgttgcagtacaaaaagattgtgtcctggttggaatatgagtcgtctttctctaacgaggaggcccagaaagcccaggccctgcgcctcgcttcccacttgaatctggctatgtgccacctcaaactgcaggcctttagtgctgcaatcgaatcatgcaacaaagcactcgaactggattctaataacgaaaagggactcttccgcaggggcgaagctcatctggccgtgaatgattttgagctggccagagcggatttccagaaagtgctgcagctgtacccaaacaataaggctgccaaaacacagctggctgtttgtcagcagcgtattcgcaggcagctggccagggagaaaaaactttacgccaacatgttcgaacgcctggcagaagaagaaaacaaggccaaggcggaggcctcgagcggcgaccacccaaccgacacggagatgaaggaagaacagaaatcaaatacggcaggtagccagagtcaagtcgaaactgaagcatag

SEQ ID NO: 27253 - DNA, 477 bp, Artificial Sequence
  Description of Artificial Sequence: Synthetic coding sequence
atggagcctccggagggggcaggtactggtgaaatcgtgaaagaggccgaagtgccgcaggctgccttgggcgtgccagctcaaggaactggagataacggtcatactcctgtcgaagaggaagttggaggcatccccgtgcctgcaccaggattgctgcaggtgactgaacgcaggcagcctctgtcctctgtgtccagtttggaagttcattttgacctcctcgacctgactgagctgaccgacatgtcggatcaagagctcgctgaggtgtttgctgatagtgacgacgaaaaccttaacacagaatctcccgcaggactccaccccctgcctcgagcaggctacttgaggtcaccttcttggacgagaactcgagcggaacagagtcacgaaaaacaaccgctgggggacccagagcggcaggcgacagtgctagatacatttctgactgtggaacgaccccaagaagattag

SEQ ID NO: 27254 - DNA, 954 bp, Artificial Sequence
  Description of Artificial Sequence: Synthetic coding sequence
atggcatctgtcatcccagcaagcaatcggtctatgagatctgatcggaatacctatgtagggaaaagatttgtccacgtgaaaaacccataccttgatctgatggacgaggatattttgtatcatcttgatcttggtaccaagactcacaatctccctgccatgttcggggatgtgaagttcgtatgcgtgggagggagccccaatcgcatgaaagccttcgccctattcatgcacaaagaactgggctttgaggaggctgaggaagacattaaagacatctgcgcaggtaccgaccgctattgcatgtacaaaacgggaccagtgttggcgatcagccatggcatgggcatcccatctatctcgatcatgctgcatgaattgatcaagttgctgcatcatgccagatgttgtgatgttaccattataaggataggcacaagtggaggaatcggcatcgcccctggtactgtcgtgataacagatatcgctgtggatagctttttcaagccccgatttgagcaagtcattcttgataatatcgtaacgcgcagcacagaactagacaaggagctctctgaagaattgtttaactgtagcaaagaaattccgaatttcccgacactggtggggcataccatgtgcacatacgacttctacgagggacaagggagattggacggagctctctgctctttttctagggagaaaaagttggattatctgaagcgcgcttttaaagccggtgtccggaacattgagatggagtctaccgtgtttgccgcaatgtgcgggttgtgcgggctcaaagcagccgtggtatgcgtgacactcttggaccgtttggactgcgatcagatcaacctgcctcacgacgtcctggtcgagtatcagcagagaccccagctgctgataagtaacttcatccgcagacggctggggttgtgcgattag

SEQ ID NO: 27255 - DNA, 1095 bp, Artificial Sequence
  Description of Artificial Sequence: Synthetic coding sequence
atgtcagaagtggaagccgctgcaggcgctactgccgtgcctgcggcaactgtccccgctactgccgctggggttgtggcagtggtcgttcctgttcccgctggcgaacctcaaaagggcggtggcgcaggtgggggaggcggagccgcatcggggccagcggcaggcacaccttctgcccctggcagccgtacacccggtaatccagccacagccgtgtctggaactccggctccccctgcacggagccaagctgacaagcctgtgttggcaattcaggttctaggcacggtgaaatggtttaacgtcagaaacggatacgggtttatcaacagaaatgatacgaaggaagatgttttcgtgcatcaaacagctattaagcggaataacccacgaaaattcctccggtctgtgggggatggcgagactgtcgagttcgatgtggtcgagggagaaaagggggcagaggcaaccaacgtgacaggacccggaggcgtgcctgtgaagggcagtcggtacgcccctaacagaagaaaatctaggaggtttatcccacgccctccatcagttgccccacccccaatggtcgccgagattccctcagctgggactggccctgggagtaaaggcgagcgcgctgaggatagtgggcagcgaccgaggagatggtgcccacctccgttcttctaccgaagaaggttcgttaggggacccaggccacccaaccaacagcagcccatcgagggaaccgatcgtgtggagccgaaagaaacagcgcctcttgaggggcaccagcagcagggagatgagcgggtgcccccaccccgattccgcccaaggtatcgtcggcctttcagacccaggcctagacagcagccaactaccgaggggggagatggagaaaccaagccttctcaaggcccagctgatggctccagacccgaaccccagcggcctaggaataggccctacttccagcgtcggaggcaacaagcccctggcccacagcaggccccaggcccacggcagcctgcagccccagagacttccgcacctgttaactccggggatccaacaactactatattggagtag

SEQ ID NO: 27256 - DNA, 5706 bp, Artificial Sequence
  Description of Artificial Sequence: Synthetic coding sequence
atggctaccttccggaataaccatatgaagacgaaagcctccgtgcgcaagagtttttctgaggacgtttttcaaagcgttaagtctctgctccagtcccagaaggaactctgctccgtgactgccgaggattgccttcagcaagatgagcacgcaaatctgaccgaggttacatttctcggcttcaacgaggaaaccgatgccgcacacatccaggatctcgcagccgtgagccttgagttacctgatattctgaactcattgcatttttgtagcctgaatgaaaacgaaatcatctgcatgaagaacatcaataagcccctcgacatttcaagtgacccattaaaccaatctcatccttcaggcatgctgtgtgtcatgagagtgagtccaacatcaccccgtctgagaatagactttatctttagcctgctttcaaagtatgcaactggcatcagatacacactcgatacatttcttcaccagaaacaccaattggaaacaaccgacgaggacgacgatgataccaaccagagcgtaagctctatcgaggacgatttcgtcaccgctttcgagcatctcgaagaggaggagacgtccaagccttacaacgacggtatgaacatcactgttctgaggtctcagtgtgatgccgcttctcagaccgtgactggacaccatttggagacccatgatctaaagatcctgatttcaagtggtcaacagaagtctttggcaaagcccagcacctccagtgtgaatgtcctggggcacaaggaactgccgtctgtgaagacatcagtgacaacgtctattagcgaaccatggacgcagagatccttttatcggtccagcaatgcttccgataaagatagtgatttgcagaaaacattttttagctcatcccccgcttactcctcagagagcgagtgcagttctccttcgccggtgatttttctggatgaagaaggataccaaaaatcacttaaggccaaactcgagttgccaaagatccccgtcatgaaagacgatatagaagattcagactccgaagtgtctgaattctttgatagctttgaccagtttgatgaactggaacagactctggaaacttgtctgtttaataaggatccagtgatcggtaaaagctctcagcggaagggtcacaagcatggaaagagttgtatgaacccccagaagttcaaattcgatcggccagcacttccagccaatgtacggaaacccaccccccgaaagcccgaatccccatacggcaacctctgtgatgcacccgacagtcctaggcctgttaaggcctcaagagaggattcaggcctgttctctccaatccgctcctcagcttttagtccccttggaggttgcactcctgcagagtgcttctgccagactgatattgggggagaccgaatacatgaaaaccatgattcagtgtactatacatatgaagattacgcgaagagcattagctgtgaagtactggggtccgtgctgagaactcatcataccaacactttatcaaacataaactccatcaaacatggagagaacaagaccgtgacattcaagcatggaaacctcgatcagaaaaataagagcaagaacaagtctctgatgattaaggactcaatccagaaatttgcagcagatcttgtggagaagtcttttggttcagcgtttaaagaccttcagaagggagtgagttcctgtaccaacgctttgtaccatttggcaattaaattaacgtcttccgtgctgcagatggccttcgacgaactgaggagacaaagggccttctccctgaaggagagggcgatttcagggttagcgaatttcctagtgtcagaggctctgtccaacgctttgaaggacctgcagtatgttaagaagcaaatattcaccaacactgttgccagattcgcagcagacctagcagaggagctcgtgttcgagggaataatggaagtttgccaatttagttatcctcagacccctgctagcccacagtgtggctcattcgactttgaggataaggtggtgaaactgtatgcaaaagatctctctgagtctgtgattcaagaggccttcattgaactgagtcaggtcgacgtcacattcaccacaaaggctgccgtgagtgttagcacggataacattaagtacgtgtctgccgaatccgttgtgccatctacacaagccgttacattttccccgagctttcacaaccaagccatcatggtgactaagcccgtgcaagaatataagaaagaatataccgtgcagcaagccctgttctgcactagtgggattgtgactagcataccagttcccctcgcaggaagcgctttgctcccataccatatttcttccactgcatgccaagccaaagctcatctttcatctgacgactcaaactccaacggagactctgctcaagtgcatatcgccaccaagaaccgagaggagaaggctgcctgtcttcgaaacatttgcctgcccagcgaacataacccaggcaatcaaaatgatttcaagcccaccaatgacgatatcgaaatgcagtcaagctccaaactgccaaacgatcctgctatcatttctaatttctccgccgctgttgtgcacaccattgtgaatgagaccttggaatcaatgacgtccctggaagttaccaaaatggttgatgaacgaaccgactacctcaccaagagtctgaaagagaaaacccccccattctcccattgtgatcaggcagtgctgcaatgttccgaggcatcaagcaataaagacatgtttgccgaccgcctgtccaaaagcataattaaacacagtatcgacaagtctaagagcgttattcccaatattgacaagaatgctgtgtataaagagagtttaccagtatcgggagaagaatcgcagctgacaccagaaaagtctcccaaattccctgacagccaaaatcaacttacacattgtagcttgtcagcagccaaagactgcgtgccggagtgcaaggtgtccatggtccacgggtcgtctcttgaaaccttaccctcctgtccggcagtgaccggccaaaaaagcgatttgaaagagagtgccaaagaccaaccactgaagaaacacaacctgaattctacctccctggaagcactgtcatttgggcaggagaatccattcccgcactctcacactttctcttccacagccctaacctgtgttgacgggctgcatgtcgaggacaaacaaaaggtcagagataggaatgtcatcccggatacgcctcctagtactccactggtgccttcacgggcatcaagcgagtgggacataaaaaagcttaccaaaaagctgaaaggtgaactggcaaaagagtttgcacctgctaccccaccatctaccccacacaacagctccgtcggcagcctctcagagaacgaacagaacaccatagagaaagaagagttcatgctgaagctgatgcggtccctgagtgaggaagtggaaagctcggaaagcggagagctccccgaggttgacgttaagtccgagcattcaggcaagaaggtacagttcgccgaggctctggccacccatattctgtctctcgccacggagatggcagcttcacacctggataataagatcatccaggagcccaaggtcaagaacccatgtctgaatgtccaatcacagcgttctgtctcaccaaccttcctgaatccttcagatgagaacctaaagactttgtgtaactttgccggagacctggccgcagaggtaatcacagaagccgaaaaaatcgccaaggtgcgcaactgtatgttgttcaagcagaagaagaactcctgctacgctgacggggatgaagactataaggtggaggagaagttggacattgaggctgtcgtccaccctagagaagtggatcctttcatcctgtcccttcccccatcctcctgtatgtcaggcttaatgtataagtacccgagttgcgagagtgtgaccgatgagtacgctggacatctgattcagatcctaaagcaagagggaggaaattctgaattaattatggaccagtatgccaatagactggcatatagatcagtcaagtcagggctgcaagaggctgccaagaccactaaagtacagtgcaactcacgaatgttcccagttcccagctctcaggtgaagaccaataaggagttattaatgttttctaataaagaacaccatcaggaagcagacaagaaacgccaatctaagcgtaatgaaggctatttctgtaagaaccagacctgtgagcgtacgctagatccttaccgaaacgaggtgtcgcagctgtacagtttctctaccagcctggttcacagcatcaccaaggacgcgaaggaagagctgaccgcttctttggtcggtctccccaagtccctgactgacagctgcttgtttgaaaagtccggctatgaagaggacaacgagtgccacgtaacacctgagctgcccaaatctctgcagccgtcctcccagaatcaccgcttttaccactcaaccggaagtctcaacggatacggctgcggggacaatgtcgtacaagccgtggaacagtacgcaaaaaaagtggtggatgacaccctggagttgaccttaggcagcactgtgttccgggtctcagagactacaaagtcagccgacagagtgacatatgcagagaagctgagtcccttgactggccaggcttgtaggtattgcgatctcaaggaattgcacaattgtacggggaactccagtcagcacttctttcgccagggctcactggcaagcagcaagcccgcaagtaaccctaagttcagtagtcgttaccaaaagtcccggatcttccacctcagtgtgcctcagatccacgtgaacctcgataagaaggcggtattggccgaaaaaatcgtcgccgaggcaatcgaaaaagccgaaagggaactctcctccacatcactggctgctgatagcggaataggacaggagggtgccagttttgcagaatcgttggcaacagaaacgatgactgcagctgtgacaaacgtcggccatgccgtgtcatcctctaaagaaatcgaggattttcagtcaaccgagtcagtaagttcacaacagatgaacctgagtatcggggacgacagcacagggagctggagtaacctctcttttgaagacgagcaccaggacgagtcatctagcttccatcatctttcagagagtaacggcaatagcagttcctggagctccttgggattggagggcgatttgtacgaagataatctgtcctttcccactagcgactcagatgggcctgacgacaaagatgaggaacatgaagatgaagtcgagggactcgggcaggacggcaaaacacttttaatcactaatatagatatggaaccatgtactgtggaccctcaactcagaatcatccttcagtggctgattgccagtgaagcagaagttgctgagttatattttcacgattccgctaataaggagttcatgctcctctctaaacagttacaggaaaagggatggaaggtaggagacttgctacaggcggtcctgcaatattacgaagtgatggagaaggcttcatccgaggagagatgcaagagcctgttcgattggctgctggaaaacgcttaa

SEQ ID NO: 27257 - DNA, 417 bp, Artificial Sequence
  Description of Artificial Sequence: Synthetic coding sequence
atggccgagctccagcagttacgggtgcaggaggcagtggaaagtatggttaagagtctagaacgggagaacataagaaaaatgcagggcttaatgtttagatgctcggccagttgttgtgaggactcgcaggcctcaatgaagcaggtgcaccagtgcatagagcggtgccatgtcccgctcgcccaagcccaggccctggtgacttccgagcttgagaaatttcaggacagacttgctagatgcacaatgcattgcaacgacaaagctaaggactccattgatgccggtagcaaagagttacaggtcaagcagcagctcgatagttgcgttacgaagtgtgtggatgatcacatgcacctgatacccaccatgactaagaagatgaaagaagcactgctgtctatcggcaagtag

SEQ ID NO: 27258 - DNA, 1110 bp, Artificial Sequence
  Description of Artificial Sequence: Synthetic coding sequence
atgactctggaagctattcgttacagccgagggtcactgcagattcttgatcagctgcttcttcccaagcagtcgagatacgaggctgtcgggtctgtccatcaagcttgggaggctatccgcgcaatgaaggtgcggggagccccagccattgcactcgtgggatgcctgtcattggcggtcgagctacaggcgggtgccggagggcctggtctggctgcactggtggccttcgtgagagacaagctcagcttcctggtgactgctcgtccaacagctgtaaatatggcccgagcggctcgggacctggcggatgtcgccgctcgcgaagccgagcgggaaggggctacagaggaagcagtccgcgaacgagtgatctgctgtacggaggacatgcttgaaaaagacctgagggataataggtccataggcgacctcggcgctaggcacttgctcgagcgagttgccccaagcggaggcaaagtcacagtgctcactcactgcaatactggggctctggctacagccggatacgggacagccctgggggttatacgttcactgcattcactcggcagactggagcacgctttctgtacagaaaccagaccctataaccaaggggctaggctaacagcattcgaacttgtgtatgagcagatcccagcaacgttgatcaccgactcgatggttgcagccgctatggcccatagaggagtgtcggccgtcgtggtgggtgcggaccgtgttgtagcaaatggggacaccgccaacaaggtcggcacttatcaactagccattgtggcgaaacatcatggaattcccttctacgttgctgctccaagtagctcctgcgatcttagacttgagaccggcaaagaaatcatcatagaggagcgacctggtcaggagctgaccgatgtgaatggggtgcggatcgctgcccctgggatcggagtttggaaccccgctttcgatgtcaccccgcacgatctcatcaccggaggtatcatcaccgaattaggggtcttcgccccagaagagctgaggactgctcttaccactacaatcagcagcagagacggcacactcgatggccctcagatgtag

SEQ ID NO: 27259 - DNA, 3660 bp, Artificial Sequence
  Description of Artificial Sequence: Synthetic coding sequence
atgatgtctttgagcgtgaggccacagagacgcctcttgagcgccagggtgaaccgtagtcagagcttcgccggagtactaggatcccacgagcggggaccacgttcatttccagtgttcagcccgcctgggcctccccgtaaaccccctgccctcagccgtgtgtcccggatgtttagcgtggcacatccagccgcaaaagtaccacaacccgaacgccttgacctggtgtatacagcattgaaacgcggattgacagcttatctggaagtgcatcagcaagaacaggaaaagctacaaggtcagattcgagaaagcaagcggaacagccgtctgggcttcctttacgacctggacaaacaagtgaagagcattgagaggttcctgcgcagactggaattccacgcctccaagatagatgaattgtacgaagcctactgtgtccagcgtagactgcgagatggggcttacaatatggtgcgtgcttataccacggggtctcccggttctagagaggcccgagacagcctagctgaagccacgagaggacaccgcgagtataccgagagtatgtgcctgctggagagcgaactggaagcacaattgggagaatttcatctgcgcatgaagggtctggccggatttgctcgtctatgcgtcggagatcaatacgaaatctgcatgaagtatggcagacagaggtggaagctgagaggacgcatcgaaggctccgggaaacaggtgtgggactcagaggagactatatttctgccattgctgacagaattcctcagtatcaaggtgaccgagctgaaagggctcgcgaaccacgtggtggtgggatcagtttcatgcgaaactaaggatttgttcgcggctctgccccaggtcgtggctgtggatatcaacgacctgggaacaattaagttgtcactggaggtgacttggtctccgttcgataaggacgatcagccttccgctgcctcctctgtgaataaagcatccacagtcaccaagcggttttctacttactcccagtcacccccagacaccccaagtttgcgcgagcaggccttttacaatatgttaagacgccaggaagagctcgagaatggcacagcatggagcctgtccagtgagtctagtgacgactcatcgagcccacagctgagcgggaccgcacggcattctcccgcacctagaccactagtacagcagccggaacccctgcctatccaagtggccttcaggcggccagagaccccgtcttccggcccactcgacgaagagggagctgtcgcccctgtgctcgctaatggccacgccccatattcacggacactgtcgcacatcagcgaagccagtgttgatgctgctctggcagaagcttccgtggaggcagtcggcccagaatcgctggcatgggggccttcccccccaacacatccagcaccaacacacggggaacacccctcccccgtacccccagctctcgatccgggacactccgcaacttcgtccactttgggaacaacgggttcagtccctactagtaccgatcctgccccatccgcccacctcgactcggttcataaaagtactgactcagggcctagcgaactgccaggccctacacacactacaactggctcaacttattcagccataactaccacccactccgccccatctccactaacacacacaactacaggctccactcataaaccgatcatcagtacacttactacaactgggcctaccctgaatatcatcggtccagtccagactacaacctccccaactcacacaatgccatcgcccactcacacaaccgcatcccctacgcatacctcgacttctcctacccacaccccgacctctcctacccacaaaacttccatgtctcctcccacaaccacaagccctacacccagtggaatgggcctagttcagaccgccacatcgcctacccaccccaccacatccccgactcaccccaccacatctccaattttaatcaacgtctcgccgagtacatctttggaactggctaccctgtcgtccccttctaaacattctgatccgacgctgccgggaactgactccttgccatgcagcccgccagtcagcaactcgtacacccaagccgatcctatggccccacgaaccccacatccgagtcccgctcactctagccgcaagccgctcacaagccccgcaccagatcctagcgagagtacagttcagagcctctccccgaccccttctccacctacacccgctccacaacactctgatctttgtttagctatggccgtgcagacgccagtgcccacagcagccggtgggtcgggagatcggtcacttgaagaggctcttggcgctctcatggccgctctggatgattatcgtggccagttccccgaactgcagggcttagaacaggaagtgacaagattggaatccctcttgatgcagcgccaggggcttacccgatcacgtgcatcatcgctgtccattactgtcgagcatgccttggaaagtttcagcttcctaaacgaagatgaggatgaggacaacgacgtgccaggggacaggcccccttcgtcacccgaagctggtgccgaagattcgatcgattcgccttctgccaggcccttgtcaacaggctgtccggcactagacgccgcactggttaggcatctctaccactgcagccgactgctactgaagttggggacttttggtccacttcgctgtcaggaggcgtgggcactagaaaggttactccgtgaggctcgggtcctagaagccgtctgcgagttcagtaggaggtgggagatccctgctagttctgctcaggaagtggtccagttcagcgctagcaggcccggatttctaactttctgggatcagtgcacagagaggctgtcctgtttcctgtgtccagtggaacgcgttctgctcaccttttgcaaccagtacggtgcccgactgtcactgcgacaacctggcctggccgaagcagtgtgcgtgaagttcttggaggacgccttggggcagaaattgcccagacgccctcaacctggaccaggggaacagctgaccgtctttcagttctggtcattcgttgagacacttgacagccccactatggaggcctatgtgacggagaccgctgaagaggttctgttagttcgtaatttgaattccgacgatcaggcggtggtacttaaggctcttaggctcgcacccgaggggagactgaggagggatggcctacgggcactgtcatctctgctggtgcatgggaacaacaaggtcatggcagctgtttctacacagctgcggtcccttagcctgggaccgacgttcagggagcgcgcactgctgtgttttcttgaccagctggaagatgaagacgtgcagacccgggtcgctggctgccttgcactgggctgtatcaaagccccagagggtatcgaacctttagtttatttgtgccagaccgatactgaggctgtgagggaagctgctcgtcagagtttgcagcagtgtggcgaggaaggacagagcgctcatcgtaggttagaggagtcgcttgacgctctgccgaggatttttgggcctggttctatggcctccaccgccttttag

SEQ ID NO: 27260 - DNA, 1326 bp, Artificial Sequence
  Description of Artificial Sequence: Synthetic coding sequence
atggcatcagtggcagccgctagagccgtgccagtggggagtggtctgcgaggcttgcaaagaaccctgcctctagtggttatactgggggctaccgggacagggaaaagtacattggcgctgcagctgggtcaacgccttggaggagaaatcgtttccgcagactctatgcaggtgtacgagggattagatatcataacaaacaaggtgagtgcccaggagcagaggatatgtcgacaccacatgatcagcttcgtggatccccttgttacgaattacacagtggtggatttccggaatagagctactgcccttattgaagacatcttcgccagggataaaataccaatcgttgtggggggaacgaactactacatcgagtccctgctgtggaaggtgctggtaaatacaaagccccaggagatgggtacagaaaaggttatcgatcgcaaagtagagttggagaaggaagatggactggtgctgcacaagcgccttagccaggtggacccagaaatggcagctaagctgcatccacacgataagcgcaaggtcgcgagatcccttcaagtgttcgaagagaccggcatttcacatagcgagtttctgcacagacagcacacagaagaaggaggaggtcccctgggaggccctttgaagtttagcaacccctgcatcttatggctccacgctgatcaagccgttctggatgagcggttggataagagggtcgatgacatgctagctgctggattactcgaggagctgagggattttcataggaggtacaaccaaaaaaacgtttccgaaaactcccaggattatcagcatggaatcttccaatctataggctttaaagagtttcacgagtacctgatcactgagggcaagtgtactctggagaccagtaatcagctcctgaagaagggacccggtccgattgtacctcctgtctatggacttgaggtaagcgacgtttcaaaatgggaggagagtgtgcttgaaccggctttggagattgttcaaagctttattcaggggcacaagccaactgccacccctattaagatgccttataatgaggccgaaaacaagcgcagttaccacttatgtgacctttgtgataggatcataatcggagatcgtgagtgggccgctcacattaaaagcaaaagtcatctgaatcagcttaaaaaaaggcggaggctggattcagacgcagtgaacacaattgagagccaaagcgtttctccagaccacaataaggagccgaaagagaaaggtagtcccggacagaacgaccaggagttgaagtgtagtgtgtag

SEQ ID NO: 27261 - DNA, 618 bp, Artificial Sequence
  Description of Artificial Sequence: Synthetic coding sequence
atggcagaacctctgcagccagaccccggagctgccgaggacgctgctgctcaagctgtagagacccccggttggaaggctccggaggatgccggtccccaacctgggagttatgagattcgccattacggccctgccaagtgggtgtcaacctccgtggaatcaatggattgggactcagctatccagactgggttcactaaacttaattcatacattcagggcaaaaacgaaaaggagatgaagattaagatgaccgcccctgttactagttatgttgagcccggttccgggcctttcagcgagagcaccatcaccattagcctctacatcccatcagaacagcagttcgatcctccaaggcctcttgaaagcgacgtgttcattgaagacagggcagaaatgaccgtgtttgtgagaagctttgatggtttctccagtgcgcaaaagaaccaggaacagctactgaccctagccagcattctgcgggaggacggaaaagtttttgacgaaaaggtctactataccgctgggtataattcgcccgtcaagttgttgaatcgcaataacgaagtctggttaattcagaagaacgaaccaacaaaagaaaacgagtag

SEQ ID NO: 27262 - DNA, 624 bp, Artificial Sequence
  Description of Artificial Sequence: Synthetic coding sequence
atgtcttgcacgattgagaaaattctcacggatgccaaaactttattagaacggttaagagaacacgacgcagccgctgagagtctggtggaccagtccgccgctttgcatcgcagggtagctgcaatgcgtgaagctggaacagcgctgcctgatcaatatcaggaggatgccagcgacatgaaggacatgtccaagtataagccccacatcctgctgtcccaggaaaacacccagataagggatctccagcaagaaaatcgagaactgtggatcagtctggaggagcatcaggatgctctggagctgattatgagtaaataccgtaagcagatgctccagctgatggtcgctaaaaaagccgtggatgcagagccagttttaaaagcacaccagtcacatagtgcagagatcgaaagtcagatcgaccgcatttgtgagatgggggaagtgatgcggaaggcagtgcaagttgacgatgaccagttctgtaagatccaggagaaactcgcccaactggaactcgagaacaaggaactcagagagcttctttctattagttccgagtcgctgcaggccaggaaagaaaattccatggacactgcatcccaggctatcaagtag

SEQ ID NO: 27263 - DNA, 1032 bp, Artificial Sequence
  Description of Artificial Sequence: Synthetic coding sequence
atgaacatccacagaagcactcccatcacaattgcaagatatggcagaagtcgaaataagacccaggacttcgaagagctgtcctccataagaagtgccgaaccgtcgcagtccttctctcctaatctgggaagcccatctcccccagagacaccaaatctcagtcactgcgtgtcatgtattggtaagtatcttttgttagaacctttggagggagaccacgtgtttcgggctgtccatctgcattccggtgaggagcttgtgtgcaaggtcttcgacatctcttgctaccaggagtccctcgcgccttgtttttgtctcagtgctcactctaatattaaccagattacggagattatactaggtgagacaaaggcctacgtgtttttcgagaggtcctacggcgacatgcatagctttgttcgcacatgtaaaaaattacgggaggaggaagctgccaggctgttctaccagatagcgtccgcggtggctcattgccatgacggcggtctggtcttaagggatctcaagctccgcaaatttatcttcaaggatgaagaaagaactcgagtgaagcttgaatcacttgaagacgcctatatactccgcggtgacgatgattcactgagcgacaagcatggctgtcccgcatacgtcagcccagaaatactcaacaccagcggctcctactccggtaaggctgctgatgtttggtcactgggtgtgatgctgtacactatgttggtcggacgatacccctttcacgatatcgagccatcttcactgttttccaaaattcgcagggggcagtttaacatacccgagacactctcacccaaggccaagtgcttgatcagaagcatcctgcgaagggaaccttcagaacgactaacaagtcaggaaattctggaccacccctggttctccactgacttctctgtaagtaacagtgcttatggcgctaaagaagtgtccgaccaactggttccagatgtcaatatggaggagaatttggacccgtttttcaattag

SEQ ID NO: 27264 - DNA, 3048 bp, Artificial Sequence
  Description of Artificial Sequence: Synthetic coding sequence
atgcgtcggtttctgcgacctggccacgatccagtgcgagaaagacttaagagagatctgttccaatttaacaagactgtggaacacggtttcccacaccaaccgtcagccttaggctactcccctagtctgcgtattctagccattggaacccgtagcggggcaataaagctttacggtgcccctggggtcgaattcatgggattgcaccaagagaataatgccgttacacagatccatctgctgccaggtcagtgccagctggtaacgctgctggatgacaacagcctccatctgtggtccttaaaggtgaaaggaggggctagtgaactgcaggaagatgagtcttttacactacgaggaccacctggggcagcgccatcagcgactcagataacggtggttctccctcatagctcgtgtgagctcctatacttgggtacagagtctggcaatgtatttgtagtgcagcttcccgcattcagggcactcgaggacaggacaatcagttccgacgccgtcctccagagattacccgaagaggcccgacaccgccgagtgttcgaaatggtcgaggcgcttcaagaacacccgagagatccaaaccagattctgatcgggtacagcagagggctggtggtgatctgggatctccagggaagccgcgtcctgtatcactttctttcttcacaacagctagaaaacatctggtggcaaagggacggaagacttcttgtgagttgccattccgatggctcgtactgccagtggccggtgtcttctgaagcccaacagcctgagcccctcagatccttagtgccttacgggccttttccttgcaaggctatcaccaggattctgtggctgacaaccaggcagggactgccatttactatctttcagggcggaatgccccgagcctcctacggcgataggcactgcattagcgtgattcatgacggtcagcagacagccttcgacttcacttctcgggtgatcgggttcactgtactcactgaagcagatccggctgccactttcgacgacccctatgccctcgtcgtgttggccgaggaagagctagtcgtgattgacctgcagactgccggttggccgccagtccagctcccgtatctggcctctctccactgtagcgcgatcacctgctcccaccatgtgtccaatattcctctcaaactctgggagagaattattgccgctggcagcaggcaaaacgcgcatttttctaccatggagtggcctatcgacgggggaacaagtctgacccctgcacctccccaacgcgacctcctgcttactgggcatgaggacggcaccgtgaggttctgggatgcatctggtgtctgcctgaggctcctttacaagctgagtaccgttcgcgtttttctgacagacacagacccaaatgagaattttagcgcacagggcgaggatgagtggcctccattacgtaaagttggtagttttgacccctattccgatgatccaagactgggcattcagaagattttcctttgcaaatacagtggttacctcgctgtcgccggaaccgccggtcaggtgttagtgctcgaactgaatgacgaggcagctgagcaagctgttgaacaggtggaggcagatctcctgcaggatcaagagggttaccgttggaaaggccatgagagacttgccgcaagatcaggacccgtgcgtttcgagccgggttttcagcctttcgtgctggtgcagtgccagcctccggctgttgtcaccagcctggccttgcattctgaatggcgtttagttgcattcgggacctcacacgggtttgggctctttgaccatcaacagagaagacaggtctttgtcaagtgtaccctgcacccgagcgatcaattggctctggaagggccactgtctcgcgtgaagtcccttaagaagtccctaaggcagagcttcaggagaatgcggagatccagggtatcctctcgtaagagacaccccgcaggccctccaggagaggcacaggaaggctcagccaaggcagagcgccctggtctgcagaatatggagctggcgcctgtccagaggaagatagaagctaggtcagccgaagactcgttcactgggtttgtccgcactttatacttcgctgacacctacctaaaggactctagtcgtcactgccccagcctgtgggctggaaccaacggaggaacaatatacgctttttccctgagagttccccctgctgaaagaaggatggatgagccagtgagagcggagcaggcaaaggagatccagttaatgcaccgtgcacccgtggtcggcatcctagtgctcgacggacattcagtgccactgcccgagcctctcgaggtagcccatgatctttccaagtctcctgacatgcagggaagtcaccagctgctagttgtttcagaagagcagttcaaggtcttcacacttcccaaggtttccgccaagttgaagctaaaactgactgctcttgagggaagtagggtacgaagggtttcggtggcccactttggctcccgcagagctgaggattacggtgagcaccacctggccgtactcaccaatttgggagatattcaggttgtgagcctgcccctgcttaaacctcaggtaagatattcctgtatacgcagggaagatgtaagcgggatcgcttcctgtgtgtttaccaagtacggccagggattctacctcatctcgccctccgagttcgagaggttcagccttagtactaagtggctcgttgaacctaggtgtctagtggatagtgctgagacaaagaaccatcgacccggtaatggagcaggacccaaaaaagccccaagtagggcgcgaaattctggaacacagagtgacggcgaggagaagcaacctgggttggtcatggaacgcgctttactttccgatgagcgcgcagcaacaggcgtccacatcgaaccaccatggggagccgcttcagccatggccgagcagtccgagtggttgagcgttcaagccgctagatag

SEQ ID NO: 27265 - DNA, 897 bp, Artificial Sequence
  Description of Artificial Sequence: Synthetic coding sequence
atggcagccgcagaaccagcagtcctagcattaccaaacagcggcgctggaggagcaggggcaccctcaggtactgtaccggtcctgttctgcttctctgtgttcgccaggccttcatccgtccctcacggcgctggatacgagttgctgattcagaagtttctgtccctctacggcgaccagattgacatgcatcgcaaattcgtagtacagttgttcgccgaggaatgggggcagtacgttgacttaccaaagggatttgctgtcagcgagcggtgcaaggtccgactagtccccttgcagatccaactgaccactttaggcaacttgacgccatcaagcactgtcttcttttgctgtgacatgcaggagcgcttccgacctgcgatcaagtacttcggtgacattatctccgtcggacaacgcctcttacagggagctcggattctcggcataccagtcattgtgacagagcaatatcccaaggggcttggctctacagtgcaggagattgacctgacgggcgttaaactcgtcctgccaaaaacaaagttttccatggtcttgcctgaagtcgaagccgcactcgctgagatccctggcgtgcgcagcgtggtgctgtttggtgtagagactcacgtgtgcatccaacagaccgcactggagcttgtcggacgcggagtggaggtgcatatagttgctgacgcaaccagttcaaggtcgatgatggatcgtatgttcgccctggagcgtctggcccgtacaggcatcattgtgactacatctgaggccgtgcttctccagttagtggcagataaggatcaccccaaattcaaagaaatccagaacctcattaaggcttcagctccagagtccggcctgcttagcaaggtgtag

SEQ ID NO: 27266 - DNA, 2439 bp, Artificial Sequence
  Description of Artificial Sequence: Synthetic coding sequence
atgagcgagcagggggacctgaatcaggccattgctgaggaggggggtaccgagcaggaaaccgctacaccggagaacgggatcgttaaatctgaaagtctcgacgaagaagaaaagctggagctgcaacgccgtctggaagcccagaatcaagagaggcgcaaatctaagtccggcgcaggtaagggaaaactcacccggtcgctggcagtatgcgaagaatccagtgccagacctggcggtgagtcccttcaggaccaagagtccatccacctgcagctctcctccttctcttccttgcaggaagaagacaagagcagaaaggatgactccgaacgcgaaaaggagaaggacaagaacaaggacaagaccagtgagaagcctaagatcagaatgctgagcaaagactgttcccaggagtataccgacagcactggaatagatcttcatgagttcctgattaatacacttaaaaacaactctagagatagaatgatactcctcaaaatggagcaagaaattatcgattttatcgccgacaataataatcattacaagaaatttccccagatgtcatcgtaccagagaatgttggttcacagggtggccgcatattttgggctcgatcacaacgtagaccagacaggtaagtcagtgattatcaacaagacgtcttccacacgcattccggaacagcgcttctgtgagcacttgaaggacgagaaaggggaagagtcacaaaagcgatttatcctgaaacgggataactcatctattgacaaagaagataaccaacagaaccgaatgcacccttttagggatgacagacgaagcaaatccattgaggagagagaggaagagtatcaacgggtgagagagagaatctttgcacacgactctgtatgtagtcaggagtccctctttgtcgagaattctagactgctcgaggacagtaatatttgtaacgagacatacaagaagagacaactatttagaggaaaccgtgacggctccggcagaacctccgggtcacgtcaaagttcttccgaaaacgaactgaagtggagcgaccatcaacgagcctggtcctctactgacagtgacagctctaatagaaatctcaaacctgccatgaccaaaactgcttcttttggcggaataacagtgctaacgcgtggagactcaacatccagtacccgctctaccggtaagctctctaaagccggatccgaatcatcttcctctgcaggatctagtggctcgctcagcaggacacatccacctttgcagtccactccgctggtctctggcgttgccgctggttcaccaggctgcgttccctaccccgagaatgggatcggtggccaggttgcaccctcgagtacgtcttatattctgctgcccctggaggccgctaccggtatccccccagggtcaatactgctgaatccccatactggccagccattcgtcaaccctgacggaactcctgcgatatacaatccacccacctcccagcagccactgagatcagccatggtgggtcagtcccagcagcagcctcctcagcagcaaccaagtccgcagcctcaacagcaggttcaacctcctcagccgcagatggctggaccacttgtgacccagcgtgacgacgtggctacccagtttggacaaatgacgctttcaaggcaatcctccggagaaaccccagagcctccttctggccctgtgtatccgtctagtttaatgccacaacctgcccaacagccatcctatgtgattgcatcaacaggccagcagctgcccacaggaggtttctcgggatctggccctcctatctcccaacaggttcttcagccaccgccttcacctcagggttttgttcagcagcccccaccagctcagatgccagtgtactactacccatcggggcagtacccaaccagcacaacacaacagtacagacctatggcccctgttcagtataacgctcaacggagccagcagatgcctcaggcagctcagcaagctggataccaaccagtcctgagcggccaacagggcttccagggcctgatcggagtccagcaaccaccacaatcgcagaatgttatcaacaaccagcagggaacacctgtgcagagtgtgatggtgagctatcctacaatgagctcatatcaagtgcccatgactcagggcagccagggactaccgcagcagtcctaccagcagccaatcatgctgcccaaccaggcagggcagggcagcctccctgccaccgggatgcctgtctactgtaacgttacaccgccaacaccgcagaacaacctcagactaattgggccacactgccccagctcgactgtccctgtgatgtccgcatcttgtcgtacgaactgtgcaagcatgtccaacgcagggtggcaagtcaaattctag

SEQ ID NO: 27267 - DNA, 1191 bp, Artificial Sequence
  Description of Artificial Sequence: Synthetic coding sequence
atgaccactctggtcctggataacggggcttacaatgcgaagatcggctactcacacgagaatgtatccgtaatcccgaattgccagttccggagcaagactgcacgcttgaaaaccttcacagcgaatcagatcgacgaaatcaaggaccctagtggactgttctacattttacccttccagaagggctatttggtgaattgggacgtgcagcggcaggtgtgggattaccttttcgggaaagagatgtaccaagtggattttctagatacgaacatcatcataaccgaaccttactttaactttacgtctattcaagagtctatgaacgagatcctttttgaggaatatcagtttcaggctgttttgcgcgtcaacgcaggagcattgtccgcacatcgctacttccgcgataatccctctgaactttgttgcattatcgtcgactccgggtacagtttcacgcatatagtcccttactgccggagtaaaaagaaaaaggaggctattattagaatcaatgttgggggaaaactcctgactaaccacctcaaagaaataatcagctatcgccagttacacgtcatggacgaaacacacgttattaatcaggtgaaggaagatgtatgttacgtgtctcaggacttctacagggatatggacatagccaagctgaaaggagaggagaatacagtcatgattgattatgtgttaccggatttttcgactattaaaaaggggttttgcaaacctagggaagagatggtactgagtgggaaatacaagagcggggaacaaattctaaggctagcaaacgagaggttcgctgtccctgagatcctgtttaatccttccgatataggcatccaggaaatgggtatcccagaggccattgtgtatagcattcagaatctccctgaggagatgcagccccacttttttaagaatatcgtcctgaccggcggtaattccctgttcccagggttcagggatcgtgtttactccgaggtacgctgtctcacccccactgactacgatgtgtcagtcgtactgccggaaaatcccataacctacgcatgggaagggggtaaactgatctctgaaaatgatgattttgaagatatggtggtcacgagagaggattacgaagagaacgggcacagcgtttgcgaggagaaattcgacatttag

SEQ ID NO: 27268 - DNA, 1005 bp, Artificial Sequence
  Description of Artificial Sequence: Synthetic coding sequence
atggagcctggacctacagctgcacaaagacggtgtagtttgccaccttggctccccctggggctgttgttgtggtctggactggcactcggcgctttgccctttggatcaagcccacacagggtctttcacgacctgctcagcgagcaacagctgctcgaggtggaggacctcagtttgagcctcctccaagggggaggtttaggccctctttctttacctcccgacctgcccgatctcgacccagagtgccgggaactgctactggactttgccaacagtagtgcggagctcaccggctgtctggtccgatctgcccgaccagtgcggctgtgtcagacctgttatcccctgtttcagcaggtggtgtcaaaaatggataatatatcacgcgcagccggaaataccagcgagtcgcagagttgtgcaagatccctgctgatggcagaccgaatgcagattgttgtgattctgtctgagttcttcaacactacgtggcaagaggccaattgcgcgaactgtcttacgaacaacagtgaggagcttagtaacagtaccgtttatttcttgaatcttttcaatcatacacttacatgctttgagcacaaccttcagggcaatgctcactctcttctgcagaccaaaaactattcagaggtttgtaagaactgccgcgaggcttataaaaccttgagttctctgtatagcgagatgcaaaaaatgaatgaacttgagaataaagccgagcccggaactcatctgtgcattgacgttgaggacgccatgaatataacaaggaaactgtggtcccgaacatttaattgttcagttccttgttcagataccgttcctgtgatcgccgtgtctgtgttcatcctgttcctgccagtggtattttacttatctagcttcctgcattccgagcaaaaaaagcgaaagttgatcctgccgaaaagactcaagtcctctaccagctttgctaacattcaagaaaactccaactag

SEQ ID NO: 27269 - DNA, 2172 bp, Artificial Sequence
  Description of Artificial Sequence: Synthetic coding sequence
atgtcaacggccaccggtcccgaggcggcacctaaaccatctgctaagtccatttacgagcagcgcaaaagatacagcacagtggttatggccgatgtttctcaataccctgtgaatcaccttgtgaccttttgcctgggcgaagacgacggtgttcacactgtggaggacgcctcaagaaagctcgccgtgatggattcccagggtagggtgtgggctcaggaaatgctgctgagggtttcaccagatcatgtcacattattagacccagcatcaaaagaggagcttgaaagttaccccctgggtgctatcgtcagatgcgatgctgtaatgcctccaggacggagtcggagtttgctcctcctggtgtgccaggagccagaacgcgctcagccagatgtgcatttctttcaaggtcttcggctgggtgctgagttaatacgcgaagatattcaaggagccctccacaactacaggagcgggcgaggcgaaaggcgggcagccgctctgcgagcgacgcaggaagagttgcagcgcgaccgaagcccggctgctgaaacaccaccgcttcagcggaggccatctgtgcgcgcagtcatatcaacagttgaaaggggggctggaagaggtcgtccgcaggctaaaccaatccctgaggccgaagaggcacagcgccctgagcccgtgggcacaagtagtaatgctgatagcgcatcaccagatttaggaccacgagggcctgatttggctgttttgcaggccgagagggaggtagacattctgaaccacgttttcgacgacgtggagagtttcgtgagccgcctgcagaagagcgccgaagcagctcgtgtgttggaacatcgcgagagaggcagaagaagccggcgacgggcagctggtgagggtctcctcaccttgagagctaaacccccttctgaagctgagtacacggatgtcctgcagaaaattaaatacgcatttagccttctggccagattgcgaggcaacattgccgaccctagtagtcccgaactgctgcactttctcttcggccctctgcaaatgatcgtcaacacttctggaggcccagagttcgcttcatccgtgagacgccctcacctgacatctgacgctgtcgctttactacgggataatgtcacaccacgcgagaatgaactctggacaagccttggagattcctggacacgacccggtctggagctgtcaccagaagagggccctccctaccgccctgaattctttagcggttgggaaccgccagttactgacccccagtcccgcgcttgggaggatcctgtggagaagcaattgcaacatgagagacggaggaggcaacagtcagccccacaggtggctgttaatggtcacagagaccttgagcctgagagcgagcctcagctggaaagcgagactgccggaaagtgggtattgtgtaattacgatttccaggcaagaaactcctccgagctatccgtgaaacagagagacgtgctcgaggttcttgatgattccaggaaatggtggaaagtacgcgatcctgctggccaggagggttacgtgccctacaatatattgacaccatacccgggtcccaggctacatcactctcagagtcctgctcgctccttgaacagcacccctcccccacccccagcaccggcacctgccccacccccagcgctggctcgacccaggtgggaccgacctcggtgggatagttgtgactccttaaacggtttggacccaagcgagaaggaaaagttcagtcagatgcttattgttaatgaggagctgcaggctcgcctggcccaaggacgatccggacctagtcgggcagtgcctggtcccagggcccctgagccccagctgagcccaggatcagatgccagtgaggtgcgggcatggcttcaggccaaaggtttctcttctggaactgtcgacgcgctcggggtgttgacgggtgctcagctcttctcactgcagaaagaggaactgcgagccgtttcccccgaagagggggctagagtttatagccaggtgaccgttcagcggagtctattggaggacaaagaaaaagtctcggaactggaggccgtcatggagaagcagaaaaagaaagtcgaaggggaggtcgaaatggaggtcatctag

SEQ ID NO: 27270 - DNA, 5622 bp, Artificial Sequence
  Description of Artificial Sequence: Synthetic coding sequence
atgttttccagaaggtcccacggtgatgtgaaaaagagcacccagaaagtgctggaccctaaaaaagatgtgcttaccagactgaagcacctgagagccttgcttgacaacgtcgatgctaatgacttgaaacaattttttgaaaccaattacagccagatctattttatcttctacgagaacttcatcgcactcgagaacagcctgaagcttaagggcaacaataagagtcaaagagaagagctcgactctattctattcctgttcgagaaaatcctgcagttccttccagagagaatcttttttagatggcactaccagtccatcgggagtacgctcaaaaaactacttcacactgggaactcaattaagattaggtgcgaggggattagactgttcctgctctggctgcaagctctgcagactaactgtgctgaagagcaggtgctgatcttcgcatgcctagtgcccggttttcctgctgtcatgagcagcaggggaccctgcactctagagaccttgattaacccttccccatccgttgctgacgtgaagatctaccccgaggaaatcaccccactgctgccagccatttcgggagaaaagattgccgaggatcagacctgcttctttctccaaatcctgctcaaatatatggtaatccaggcagcctctctggagtggaagaacaaagagaatcaggacactggctttaaatttctgtttacgctgtttcgtaagtattacctgccacacctcttcccctcctttacaaagctgacaaacatctataagcctgttctggatattccccaccttcgcccaaagcccgtctatattactactacacgcgacaacgagaatatctattccacaaagatcccttatatggccgcacgtgtagtgtttatcaaatggatcgtcaccttttttcttgagaagaaatacctcacagctacacagaataccaagaatggagttgatgtcctgcccaagatcatccaaaccgttggaggcggagctgtgcaggaaagggcccctgagctggatgggggaggtccgacagaacaggacaagtcacactccaattcctctaccctttccgacaggcgcctctctaattcctctctttgttctattgaagaagagcatcgcatggtgtacgagatggtccagcgtattttgctgtccacccgcggatacgtaaactttgtgaacgaggtgtttcaccaagcgttcctgctgccttcatgtgagattgctgtaactcggaaagttgtgcaggtgtaccgcaagtggatcctgcaggataaacctgtatttatggaggaacccgatagaaaagatgttgcccaggaggacgccgagaaactcggattttccgagaccgactctaaggaggccagttctgaaagctccggtcataaacggtcctctagttggggacgaacgtactcgtttacctctgcaatgtcccggggatgtgtgaccgaggaggaaaataccaatgtcaaagctggagtacaggccctgctccaggtgttcctcacaaactccgcaaacatatttctactggaaccgtgtgctgaagtgcccgtactgctgaaagaacaggttgacgcgtgcaaagctgtgttaatcatctttcgcagaatgattatggagctgactatgaacaagaaaacctgggagcaaatgctacaaatcctcctgagaattacagaggccgtcatgcaaaagcccaaggacaaacaaatcaaagatctgttcgctcagtctctggctggcctgctctttcgaacactcatggtcgcctggatacgggctaacctctgcgtgtacatcagtcgagagctgtgggacgattttttgggtgtgctgtcttccctgaccgaatgggaggagcttattaatgagtgggccaacattatggattcccttactgctgttcttgcacgaactgtgtatggtgttgaaatgacgaacttgccgctcgacaaactgagcgaacagaaagagaaaaagcagaggggcaaaggctgcgtgttagacccccaaaaagggaccactgtcggtaggtctttcagcctcagttggcgcagtcaccccgacgttacagaaccaatgcggtttagatcagcaacaaccagcggagcccctggagtggagaaggctagaaacatagtgcgccagaaggctacagaggtcgaggaatgccaacaatctgaaaacgcacccgcagctggaagtgggcacctcacggtaggccagcagcagcaggtgctgcggtccagcagtacaagcgacattcccgagcctctttgtagcgattcttcacaaggacaaaaagctgaaaatacccaaaatagctcttcatctgaaccccagcccatccaggagaacaaaggccacgtaaaacgtgagcatgaaggaatcaccatcctggtccgcagaagtagctcccccgctgagctggatcttaaggatgatcttcaacagacacagggcaaatgcagggaacggcagaagtctgaatccaccaactccgacacaacgctgggctgcaccaacgaggccgaactctctatgggaccctggcagacctgcgaagaagatccagaactgaacacccctacagatgtggtcgcagatgctgatgctcgccactggctgcaactgagccctaccgacgcatccaacttaactgatagctccgagtgtctgacagacgattgcagtattattgccggtggctcactcacgggctggcatcccgatagtgctgcggtgttatggcggagggtgctgggaattctcggcgacgtaaacaatattcaatcaccgaagatccatgctagggtcttctgctatctttacgagttatggtataagctcgcgaaaatcagagacaatttggctatcagccttgataatcaaagttcgccgagtccccctgtgctgatcccgccactgcgcatgttcgccagctggctgttcaaggcggctacattacccaacgagtataaggaagggaaactccaggcctatcgtcttatttgcgctatgatgaccagacgccaagacgtgctccccaattccgattttctggtgcacttctatttggtgatgcatctggggctcactagcgaggatcaggatatattgaatactatcatcagacactgccctccaaggttcttcagcctcggcttccctgggttcagcatgcttgtgggggactttatcaccgccgcagccagggttttgtccacggatattctgacagccccaagatccgaggccgtgaccgtgttgggctccctggtgtgcttcccaaacacttatcaggagattccactactgcagtctgtgcccgaagtgaatgaggccattaccggaaccgaggacgtcaaacactatctcattaacatcctgttgaagaacgcaacggaggagcccaacgagtacgcgagatgtattgccgtctgctcgctgggggtatggatatgcgaggagctggcacagtgcaccagccaccctcaagtgaaggaagccataaatgtcatcggggtgactctgaagtttcctaataagattgtcgctcaagtggcctgtgatgtgctccagctgctcgtcagctattgggagaagctgcagatgtttgaaacttccctcccgaggaaaatggccgagatcctcgtcgccacagtggcctttctgctacccagcgctgaatatagctccgtggaaacagataaaaaattcatcgtgtcgctcctattatgtctcctggactggtgtatggctctgcctgtaagcgtgcttctccatccagtgagcactgccgttctggaggaacagcactcagccagagctcctctcctggattatatataccgcgttctccactgctgcgtatgtggatcttccacctatacacagcagtctcattacatcctcaccttggcggacctctcgtctactgactatgaccccttcctgcctctggctaatgttaaatcgtctgaaccagttcagtatcactcctctgcggaactgggcaatcttttgactgtggaagaggagaagaagagaaggtctctggagctgatccccctaacagccaggatggtcatggcacacttggtgaaccatctggggcactatccgttgtctggcggtcctgctatcctgcatagcctggtgtccgaaaaccacgataacgcacacgtggagggtagcgaactatcctttgaggtcttccgatctccaaatttgcagctctttgtctttaacgattccacacttatctcttatctgcaaacccctaccgaaggtccagttggagggtcacccgtggggtcgctttcagatgtgcgggtgatcgtgcgcgatatcagcggaaaatactcttgggacggtaaagtcttgtacgggcctctggaggggtgcttggctccaaacggtagaaacccgtcattcttaatatcatcttggcacagggatactttcggtcctcagaaagatagctcgcaggtggaagagggagacgatgttctggacaaactgcttgaaaatataggtcacactagtccggaatgcctattaccgtctcagttaaacttgaatgagccttcactgacaccctgcgggatgaactacgatcaggagaaagagatcatcgaggttatcctgcgccagaacgcccaagaggacgagtacatacagtcccacaacttcgatagcgctatgaaggtcacatctcaaggacagccatcccccgtagagccgcgagggccattttatttctgccgcctgctccttgatgaccttggcatgaattcttgggacagaagaaaaaacttccacttgctgaagaaaaactcaaaactgcttagagaattaaaaaaccttgactctaggcagtgcagagaaacacacaagatcgctgtgttctatatcgccgaaggccaggaggataagtgttccattctttcaaacgaacgcggatcccaggcttacgaagacttcgtggccggactcggctgggaggtcgatctgtcaacgcattgcggcttcatgggagggttgcaacgaaacggcagtactggccagaccgccccatattacgctacctctacggtcgaagtgatcttccacgtcagcacgagaatgccttctgacagcgatgactcactcaccaagaagctccgccatctcggaaacgatgaggtccacattgtgtggagcgagcacagccgggattaccggagagggattatccctaccgcattcggggatgtcagcattatcatctaccctatgaagaatcacatgtttttcatagccatcacgaagaagcccgaggtcccgttcttcggcccattatttgacggcgctatcgtgtcaggcaaactcctgccaagcctggtctgcgccacgtgcattaatgcctcgagggcagtaaagtgtctcattcctttgtaccagtccttctatgaagaaagagcactgtacctggaggccattatccagaatcaccgcgaggtgatgaccttcgaagacttcgccgcacaggttttttcgccaagcccaagttactcattaagtggtacagattas

SEQ ID NO: 27271 - DNA, 1041 bp, Artificial Sequence
  Description of Artificial Sequence: Synthetic coding sequence
atggcaaggcccggacagaggtggctgggaaagtggctagtggcgatggtagtttgggcactgtgtcgattggctacgcctttagctaaaaatctcgagcccgtaagctggagctcattgaatcctaaattcttgtctggaaaagggctggttatctacccaaagataggggataaattggacattatctgcccacgggcagaagccggacggccttacgaatattacaagttgtatcttgtgaggcctgagcaggctgccgcttgctccaccgttctggaccccaacgttctagtaacatgcaaccgacctgaacaggaaatccgattcactattaaattccaggaattttctcccaactatatgggattggaatttaagaagcatcacgactactacattaccagcactagcaatgggtcactggaaggcctggagaacagagagggaggagtatgccgtaccaggaccatgaaaataataatgaaggttggtcaggaccctaacgcggtcactccagagcagctgaccactagtagacctagcaaagaggccgataatacagtgaaaatggccacgcaggcacccggttccaggggatccctgggcgacagcgacggaaagcacgagaccgtaaatcaggaagagaaaagcgggccaggcgcttcaggcggttcatccggggaccccgatggtttttttaactctaaagttgcccttttcgcggctgtaggcgctggctgcgttattttcttgctgataataatctttctgacagtgcttctgttaaagcttcgcaaacggcaccgcaagcacactcagcagcgcgctgccgctctgagtctgagtacactcgcctccccaaaaggagggagtggcactgccggaacagaaccctccgatattatcatccctttgcggacgactgagaataactattgtcctcactatgaaaaggtgtctggggactacggccatccagtatatatcgtccaggaaatgccccctcagagcccagctaatatctattacaaagtgtag

SEQ ID NO: 27272 - DNA, 1617 bp, Artificial Sequence
  Description of Artificial Sequence: Synthetic coding sequence
atggccagtgacccaatttttactctcgcgccacctctccactgtcactatggggctttcccgcctaacgccagcgggtgggagcagccacccaatgcctcaggtgttagcgtagcttcggctgctctcgcagcttccgccgcatctcgcgtcgcaacatctacagatccgtcttgctccggattcgctccaccagactttaatcactgcttaaaggactgggactacaacgggctgcccgttcttacgactaacgccatcggtcagtgggacctggtgtgtgatcttgggtggcaggttatcctcgagcaaatactttttatcttggggtttgcctctggctatctgtttctggggtacccagcagatagattcggccgtcgaggcatcgtcctgctgactctcggcctggtgggtccatgcggagttggtggagcagccgctgggagttctaccggagtgatggcgctgaggtttctgctgggctttctcctcgccggagtcgacctgggtgtgtatcttatgagactggagctctgcgatcccacacagaggctgcgggtcgctctggccggagaactggtgggcgtggggggtcactttttgttcctggggctagccctagtaagcaaggattggcgatttctgcagcgtatgataaccgccccatgcatcctgtttcttttttatgggtggcctggactctttctcgaatccgccagatggttaattgttaaaaggcagattgaagaagcgcaatcagtcctgcgcattttggccgagcgcaataggccccatggacaaatgctgggagaggaagcgcaggaagccctccaggacctggaaaacacctgtcctctccctgccacgtccagttttagttttgcctccctattgaactatcggaatatctggaaaaacctcctgatactggggttcaccaactttatcgctcacgcaatcagacattgttaccagccggttggaggtggcggaagcccttcagatttctacctgtgctccttactggcctcaggaactgccgctttggcctgcgttttccttggggttaccgtggaccgcttcggtaggaggggtatcttactgctgtctatgactctcactggtatcgccagcctggtcctactgggtctttgggattgtgagcatcccatttttcctaccgtgtgggcccagcaaggcaaccccaatcgggatctcaacgaggctgcgatcactaccttctctgtactaggtctatttagctctcaggccgcagccatcctcagcacgctcctggctgcggaggtaattcctaccaccgtgaggggccgtggccttggcctcatcatggccctgggcgcattgggtggattaagcggaccagcccagagattgcacatgggtcacggtgcattcctccaacatgtcgtcctggccgcttgtgccctgctgtgcatactgagtattatgctcttgcccgaaacaaaaagaaagctactaccagaggtccttagagatggtgaactatgcaggcggccaagtctgctgagacagccgcctccaacccgctgtgatcacgtccctctgctggcaactccgaatcctgccctttag

SEQ ID NO: 27273 - DNA, 1128 bp, Artificial Sequence
  Description of Artificial Sequence: Synthetic coding sequence
atgagcaccgctgggaaggttattaagtgcaaggccgcagttctctgggaactgaaaaagccttttagcatcgaggaggtggaggtggctcctcctaaagcacacgaggtgcgcatcaaaatggttgccgtgggtatttgtggaaccgacgaccatgtcgtatcgggcactatggtgacacctctgccagtcattcttgggcatgaggccgcaggaattgtggagagtgtgggggaaggcgtgactactgtgaagcctggagataaggtgattcctctggccatccctcagtgtggaaagtgccgaatttgcaagaaccctgaatcaaactactgcttgaagaacgatgtgagcaatcctcagggcactctgcaggatgggacgtcacgctttacatgcaggagaaaacctatccatcacttcctgggtatctctaccttctcgcagtataccgtggtggacgagaatgccgtggcgaagatcgacgccgcttctcctcttgaaaaggtttgcctcatcggttgcggatttagcaccggctatgggtcagcagtcaatgtagccaaggtcacccctggatcgacatgtgcggtttttggcctaggtggggtcggcttgtccgcaatcatgggatgtaaagctgctggtgctgccagaattatcgcagtggacattaataaggataaattcgcgaaagctaaggaactgggcgctaccgagtgtatcaaccctcaggactataaaaagcctatccaagaggtccttaaagaaatgacggacgggggtgttgacttctcctttgaagttatcggtcgccttgacactatgatggcctcactcctgtgttgccacgaagcttgtggaacatccgtgattgtaggcgtcccgcctgactctcaaaacctgtccatgaatcctatgctactactgactggaaggacctggaaaggcgcaattttgggtggctttaagtcaaaagagtgcgttccgaagttagtggcagatttcatggccaagaagttctctcttgatgctttaattacacatgtgcttcccttcgagaagatcaatgaaggattcgacttgttgcacagcggcaaaagtatcagaaccattttaatgttctag

SEQ ID NO: 27274 - DNA, 1641 bp, Artificial Sequence
  Description of Artificial Sequence: Synthetic coding sequence
atgtgtagcctgggtctgtttccccctccaccccctagggggcaggtgaccctgtacgaacataataacgaactggttactgggagctcttatgaaagcccaccaccggacttccgaggccaatggataaatctacccgtgttgcaactcacgaaagacccgttgaagacgccaggcaggctcgatcacggcactcggacggcatttatccaccatagagagcaggtgtggaaacgctgcataaatatttggcgagatgtgggcctgttcggtgtgctcaacgagattgcaaactcagaagaggaggtgttcgaatgggtgaaaaccgcctctggatgggcgttagcactctgccggtgggcaagttcactacacggcagcctctttccgcatctgtcactcaggtccgaggaccttattgctgaattcgcccaggtgactaattggtcctcttgctgtctgagagtgtttgcctggcatccacacaccaataaattcgctgtggccctgttggacgacagtgtgagggtgtataatgcctcatcaaccatcgtgccgtctcttaagcacagactgcaacgcaacgtggcatcattagcatggaagcccctttcagctagtgttcttgcggtggcctgccagtcttgcatcctgatttggacactcgaccctactagccttagcacgcggcctagttccggatgcgctcaagtattatcccacccaggtcatacccccgtcactagtctagcatgggctccttcgggcggtcgcctgttgtccgcgtcccctgtggatgctgccataagggtctgggacgtgagcacagaaacttgcgtgcccctgccatggtttaggggtgggggagtgactaatttgctctggagccccgatggaagcaagatcctggccacaaccccctcagccgtgtttagggtgtgggaggctcaaatgtggacctgcgaacggtggccgactctgtcagggaggtgccagactggatgctggtcaccggatggttcaagactgctcttcacagtgctgggcgaacctctgatctattcactgagctttcccgaaagatgcggtgagggaaagggctgcgtcggcggagctaagtccgccaccatagtggcagaccttagcgagacgactatacagacgcctgacggagaggagcgcctgggcggtgaggctcattctatggtctgggacccttcgggggagcggttggcagttctcatgaaaggcaagcctagagtacaggacggaaagcccgtgatacttctgttcaggaccaggaattctcccgtgttcgagcttctcccttgcggaattattcagggagaacccggagcacaaccccagctgatcacttttcacccaagcttcaacaagggagctctgctgagtgtcggatggagcaccgggaggatcgcacacatccccctgtacttcgtgaatgcccagtttcctagatttagtcctgtgctcgggagggctcaggaacctcccgcagggggagggggttccatccacgacctgccattgttcaccgaaacatcaccaacatccgccccttgggatccacttcctggaccccctcctgtgctcccacactctccccatagtcatttgtag

SEQ ID NO: 27275 - DNA, 576 bp, Artificial Sequence
  Description of Artificial Sequence: Synthetic coding sequence
atggggaaaaagacaaaacgcaccgccgacagctcttcttcagaagacgaggaggagtatgtggtggagaaggtgctggatagacgggttgtcaaggggcaggtggaatacttgctcaaatggaaggggtttagcgaagagcacaacacatgggaacccgagaagaatcttgattgtccagagttgatcagtgaatttatgaagaaatataagaaaatgaaggagggtgagaacaacaagccacgggaaaagtccgaatcaaacaagagaaaatccaacttttcaaacagcgctgatgacattaaaagtaaaaagaagagggaacagtccaacgatatcgctaggggatttgagaggggcctggagcccgagaagatcattggagcaacggattcttgtggcgaccttatgtttttaatgaaatggaaggacacagatgaagcagatctggtcttggccaaggaagcaaacgtgaaatgtcctcagatagtcatagccttttacgaagaacgcctgacatggcacgcctatcctgaggatgcagaaaataaagagaaagaaacagcgaagtcatag

SEQ ID NO: 27276 - DNA, 1554 bp, Artificial Sequence
  Description of Artificial Sequence: Synthetic coding sequence
atgggccgaaaaagtaagaagtgggggaagaaggtatcacgatacgagggcaaggtgaggctcaagaaggtacccgctaagaaactggtccctgcttggaaagagaaggttctgtgggctctgctcgccgtgctactggctagctggcgcttgtgggctataaaggattttcaggagtgcacttggcaagtggtgctgaatgaattcaaacgcgtgggcgaatctggggtgtccgattcattcttcgagcaagagccagtggacacagtcagttccctgtttcacatgcttgtggacagtccgatagaccccagtgaaaagtatctgggatttccatattacctcaagattaactatagttgtgaggagaaaccgtctgaagacctggtgagaatgggccacctcacaggcttgaaacccctcgtacttgtgacctttcagtctccagtgaatttctatagatggaagatcgagcagctccaaatccagatggaagctgcacccttccgctcaaagggcggtcctgggggagggggacgcgaccggaatctggctggaatgaacataaatggattcctgaagcgcgaccgcgacaacaacattcagtttacggtgggtgaggaactctttaatttaatgccccagtatttcgtcggagtctctagtcgccctctgtggcatactgtcgatcaaagccccgttctgatattggggggaattcccaacgagaagtacgttctgatgacagatacctccttcaaagacttttcacttgttgaagtgaatggtgtgggtcagatgcttagcatcgacagttgctgggtgggctccttttactgccctcatagcggttttacagccactatatacgatacgatcgctaccgaatctacgctgtttatcagacaaaatcaactcgtgtactacttcaccggaacctataccaccctatatgagaggaacagaggctctggcgagtgcgctgtcgctggtccgacgccaggggaggggacccttgttaatccatctactgaggggtcttggatccgcgtattggcttcagagtgtatcaagaagctgtgcccagtgtacttccacagcaatgggagcgagtatataatggctcttacgacagggaagcacgagggctacgtgcactttggcactatcagggtgaccacatgcagcatcatttggagcgaatacattgcgggagagtacactctgctgctgctggttgaatcagggtatggtaatgcgagtaagcgctttcaggtggttagctataatactgccagcgacgacctggagctgctgtaccatatcccagaatttatcccggaggcaagaggtctggaattcttgatgatcctcggtactgagagctatacctctacggccatggcaccgaaaggcatattctgcaatccctataacaatcttatctttatctggggaaatttcctgctgcaaaggtccggcacgagttggcgggctgccactgggagcacatcctgtagcctcccacgtgctggcaggtgcacatcggcgtag

SEQ ID NO: 27277 - DNA, 1203 bp, Artificial Sequence
  Description of Artificial Sequence: Synthetic coding sequence
atgagtggaagggtcggcgacctttccccaaaacaggcagagaccctagccaaattccgcgagaacgttcaggatgtgctccccgctctaccaaatccagatgactacttcctcttacgctggttacgggctcgcaattttgatctgcagaaatctgaagccctgctgaggaaatatatggaatttaggaaaacaatggatatcgatcatattttagactggcagccacctgaggtgatccaaaagtatatgcccggaggtctatgcgggtatgacagggacggctgccctgtatggtacgatatcataggaccactggacccaaagggcctgctcttctccgtgaccaaacaagaccttctgaaaacaaagatgagggactgcgagcggatcctgcacgagtgtgatttacagaccgagcgactggggaagaagatagaaacgatagtgatgatattcgattgcgaaggcttgggtctgaaacatttttggaaacctttggtcgaagtgtatcaggagttcttcggcttgctggaagagaattaccccgagacattgaagttcatgcttatcgttaaggcgactaagctctttcctgtggggtataatctaatgaaaccatttctgagcgaagatacacgccgaaagattatcgtccttgggaacaactggaaagaagggctgctgaaattaatcagtccagaagaacttccagcccaattcggcggtaccttgaccgatccggatggcaaccctaaatgccttaccaagattaattacgggggagagatccctaaaagcatgtacgtgcgggaccaggtcaagactcagtatgagcattccgtccagatcaaccgcggatcctcccaccaggtcgaatatgagatactatttcctggctgcgtactaagatggcagttctccagtgacggggctgacattggcttcggtgttttcctgaaaacgaaaatgggcgaacggcagcgtgccggagaaatgactgatgtgctacccagccagcgatacaatgcgcacatggtccctgaagatgggaaccttacgtgttcagaagctggagtttacgtgctgagattcgacaacacttacagctttgtgcacgctaagaaagtgtcttttacagtggaagtgttgctgcctgacgagggcatgcagaagtacgacaaggagctgaccccagtctag

SEQ ID NO: 27278 - DNA, 636 bp, Artificial Sequence
  Description of Artificial Sequence: Synthetic coding sequence
atggcagagcagcacggagctcccgagcaggctgccgctgggaagtctcatggagatctagggggtagttacaaggttatcctgtacgaacttgagaatttccaaggcaagcgatgcgagctgtccgccgagtgtcctagcctgacagattccctcctcgaaaaggtgggctctatccaggtcgagtcgggcccatggctcgcctttgagagtcgggcttttcggggtgaacagtttgtgctggagaagggggattaccctcgctgggacgcctggtcgaactccagagatagcgatagtttgttgtcgctgcgaccgttgaatattgatagcccacaccacaaactgcacttattcgaaaaccccgctttttcgggcagaaagatggagattgtcgatgacgacgtgccttcactctgggcccacgggttccaggatagagtggctagcgtgagggctatcaacggtacatgggtagggtatgaattccccggatacagaggacgccaatacgtgttcgaacgaggcgaatatcgacactggaacgagtgggatgcaagccagccccagctccagtcagtgaggagaattcgtgaccagaagtggcacaaacgcggacgcttccccagttcatag

SEQ ID NO: 27279 - DNA, 387 bp, Artificial Sequence
  Description of Artificial Sequence: Synthetic coding sequence
atgacagaagctgacgttaaccctaaggcctatcctttggccgatgcccatctcaccaagaagctgttggatcttgtgcagcagagctgtaattacaagcagctgcgcaaaggtgccaacgaggctaccaagaccttaaacagaggaatttcggaattcatcgtcatggcagcggatgcagagccgttggaaatcatcctgcacctccccctgctttgtgaggataagaacgtaccatacgtttttgtccgatcgaagcaggcgctggggcgagcatgcggggtgtcacgcccagtcattgcctgctctgtcaccataaaggaggggagccagctaaagcagcagattcagtcgatccaacagtcaatcgagcgcctgctcgtgtag

SEQ ID NO: 27280 - DNA, 2592 bp, Artificial Sequence
  Description of Artificial Sequence: Synthetic coding sequence
atggcaggtccgaggggggctctgttagcgtggtgtaggcggcagtgtgaggggtaccggggtgtagagattagagacctatctagttccttccgagacggattagcattctgcgccatccttcaccggcaccgaccagaccttctggactttgacagcctgtctaaggacaatgtctttgaaaacaatagattggccttcgaagttgccgagaaggagcttggtattcccgctcttctcgatccaaatgacatggtatcaatgagcgtcccagactgtctcagcattatgacatacgtgtcccagtattacaaccatttctgctccccaggccaggcgggtgtgtcccccccacggaaagggctagccccttgtagcccccctagcgttgcccctactccggtggaaccagaggacgttgctcaaggggaagaactctcatcaggtagcctgagtgagcagggcacaggacagacccctagctctacatgcgcagcttgtcagcagcacgtccatctggtgcagaggtacctggcagatggacggttataccacaggcattgttttaggtgtaggaggtgcagcagcactctgcttcctggcgcatatgaaaatgggcctgaagaaggaacattcgtctgtgccgaacactgcgcacggctgggacctggtacgcgaagtgggaccaggccgggtcccttctcccaacctaaacagcagcaccagcaacagctcgccgaggacgccaaggacgtccctggcggaggtccctcatcaagcgcgccagccggagccgaagccgacgggccaaaggcctcacctgaggcgcgaccccaaataccgacgaaaccaagggtcccaggcaaactgcaggagctcgcaagccccccagccggaaggcctacccctgccccacgaaaagcttccgaaagcaccaccccggctcccccaacccctagaccccgaagtagtctgcagcaggaaaatttggttgagcaggccggttcctcttctctggttaacggcagactgcacgagctcccggtccctaaacctagaggcacacctaaaccctccgaaggtacacctgcacccagaaaagaccctccttggattacacttgtgcaggcggaaccaaagaaaaaaccagcacccctgcctccatcaagttcgcccggacctccctctcaggactctcgccaggtcgaaaacgggggaacggaggaagtagcacaaccctcccctactgcctctctcgaatctaaaccctacaatccgttcgaagaagaggaggaggataaggaagaagaggcacctgcagccccttcgttggcaaccagcccagccctgggccatccggaaagcacccccaaatcattgcatccctggtatggcatcacacctacttctagtcctaaaactaaaaagcgcccagcgccacgagcgcctagtgcctctcctctcgcactgcatgccagtcgcctcagccacagcgaaccgccaagcgcgactccctcaccggctctatccgttgaatccctgagctctgaaagtgcatctcagacagccggtgccgaactgttggagcctcctgccgtgccaaaatcaagtagcgagcccgctgtgcacgcacctgggacacctggaaacccggttagtttgtctacgaattccagcctcgcctcttccggcgaactcgtcgaaccaagagtcgagcagatgccacaggcttctccaggacttgcgccacgtacgcgaggctctagcgggccacagccagcgaagccatgcagcggcgcaacacctactccgctgcttctggtgggggaccgttcccctgtcccatcacctggatcgtcctctcctcagctccaggtcaagtcaagctgcaaggaaaatccatttaatagaaaaccatctcccgcagcatctccagctacgaaaaaagccactaaggggagtaagccagtgaggcccccagcgcctgggcacgggttccccctaatcaagcgtaaggttcaggcggaccagtacatacccgaggaggatatccatggtgaaatggataccattgagagacgcttggacgccctggagcaccgcggagtgttgctggaagagaagcttcgcggagggttgaacgagggtcgggaggacgatatgctggtggactggtttaagctgattcacgagaaacatcttcttgtgcgacgcgagtccgaacttatttacgtttttaagcagcagaaccttgagcagcggcaggccgatgttgaatacgagttgaggtgcctgctgaacaaacccgaaaaggactggacagaagaagatcgcgcacgggaaaaagtgttgatgcaagagctcgtcactctgatcgagcagcgaaacgcgatcattaattgtctcgacgaggaccggcagcgcgaggaagaggaggacaagatgctcgaagctatgatcaagaagaaggaatttcagagggaggcggaacccgaaggcaagaaaaagggtaaatttaagaccatgaagatgctcaagctcttgggtaataaacgtgatgccaagtctaagagcccacgagacaaatcctag

SEQ ID NO: 27281 - DNA, 708 bp, Artificial Sequence
  Description of Artificial Sequence: Synthetic coding sequence
atgtggcggggtagagcaggcgctctgctgcgagtctgggggttctggcctactggagtcccgaggagacgccctctctcctgcgacgccgctagtcaggccggtagtaattatccccgatgctggaattgtggtgggccatggggaccaggtcgtgaggacaggttcttttgcccccagtgcagagcattgcaagccccagatcctacacgggattatttctccctgatggattgcaatagatcatttagggtcgacacagccaagctgcagcaccggtaccagcagctgcaaaggctggtacatcccgacttcttcagtcagagatcccagactgaaaaggactttagcgaaaagcatagtactctagtgaatgacgcgtacaagacactgctggccccattaagccggggtttgtacctcttaaaactgcatgggattgaaatccctgagcgaaccgattacgagatggatcggcagtttctgatcgagattatggagataaacgaaaagttggccgaagccgagtctgaggccgcaatgaaggaaatcgaatctattgttaaagctaagcagaaggaattcactgacaatgtctcctccgcgtttgagcaggatgatttcgaggaggctaaagagatcctgactaaaatgcgttattttagtaatatcgaagagaagatcaagttgaagaagatccccttgtag

SEQ ID NO: 27282 - DNA, 2010 bp, Artificial Sequence
  Description of Artificial Sequence: Synthetic coding sequence
atggcgaccgaacggagtcgatcggcaatggactcccctgtgcccgcttccatgttcgcaccagaaccaagctccccaggggctgctagggctgccgcagcagccgctcgcttgcatggaggttttgacagcgactgcagcgaagatggggaggctctgaacggggaacccgagctggacttaactagcaagcttgtactggttagtcccaccagcgagcaatacgattccctattgcgccagatgtgggaacgcatggacgaagggtgcggggagactatctacgtgatcggacaagggtctgacgggactgaatatggactgtccgaggcagatatggaggcctcctatgcaaccgtaaaatccatggcagagcaaatcgaagctgatgtcatcctcctgcgcgaacgacaggaggctgggggacgggtgcgggattaccttgtcaggaaacgcgttggcgataatgacttcctcgaggtccgggtggccgtagtgggcaacgtggacgcaggaaaaagcactctgcttggtgtgctaactcacggggagcttgataacggcagaggcttcgccagacaaaagctgttccgccacaagcacgagatcgagtcaggccgtacatcctccgtgggaaatgatatcctgggcttcgactcggaaggaaacgtggtgaataaacctgattctcatgggggatccttggaatggacaaaaatttgtgagaagagtaccaaagtaatcacatttatcgacctggcaggccacgaaaaatatctgaagacaacggtgttcggcatgactggccatctgcccgatttctgcatgctgatggtgggttcaaatgccggtattgttgggatgaccaaggaacacttgggtcttgcactggctctcaatgtgccggtctttgtggtggtcacgaagatcgacatgtgtccagcaaacatacttcaggaaacacttaagctgctgcagcggctgttgaaaagcccagggtgcagaaaaatccctgtacttgtccaatccaaggacgatgtgatagtgacagccagcaatttcagttccgagagaatgtgccctatctttcaaattagcaatgtcactggggagaacctggatctcctgaagatgtttctgaacctcctgagtcctaggacaagctacagggaagaagaacctgccgaattccagatcgacgacacttactctgttcctggcgtggggaccgtggtatctggtaccactttacggggactaataaaactgaatgacaccctgctgctcgggccagatccccttggaaacttcctctccattgccgtcaagagtattcaccgcaaacgaatgcctgtgaaggaggtgcggggaggtcagactgcttcatttgcactcaaaaaaatcaagcggagctctattcgcaagggcatggtgatggtgtcaccccgactgaacccacaggctagctgggaatttgaagctgaaatcctggtgctgcatcatcccacaaccattagcccgagatatcaggccatggtccactgcggaagcatacgccaaaccgccaccatcctgtccatggacaaggattgccttagaaccggcgacaaggcaacagtacatttccgctttataaagaccccggagtacctgcacatagaccagaggcttgtctttagagaaggcaggaccaaagctgttggtacgatcacaaagctgctccaaacaacgaataacagtcctatgaatagcaagccacaacagataaagatgcagtctacgaagaaggggcctttgaccaagagagatgagggaggacctagtggaggaccggctgtgggcgctcccccaccaggagatgaagcctcctccgtcggcgctggacaaccagctgcttcctctaatctgcagcctcagcccaagccctcctctggtgggagacggaggggtgggcagcgacataaggtgaaatctcaaggagcgtgtgtgaccccagcctcaggctgttag

SEQ ID NO: 27283 - DNA, 1656 bp, Artificial Sequence
  Description of Artificial Sequence: Synthetic coding sequence
atggccgctcccgctctgtcttggagactgcccctcctgattctcctactgcccttggcaacttcttgggcaagcgcggctgttaacgggacatctcagttcacatgtttttataattccagagctaatatttcatgtgtgtggtctcaagacggggcattacaagacactagttgtcaggtgcacgcgtggcctgatagaaggaggtggaaccagacttgtgagcttttgcccgtatcccaggcatcttgggcttgcaacttgatcctcggagctcctgattcacagaaacttactaccgttgacatcgttacgttgagggtgctttgtcgggaaggggttaggtggcgcgtcatggcaatccaggactttaaacccttcgagaacctgaggctgatggccccaatcagcttgcaggtggtgcatgttgaaacccatcggtgtaatatatcgtgggagatttctcaggcctctcactactttgagagacaccttgagtttgaggcccgaaccctctccccaggccatacttgggaggaagccccactgctaaccctgaagcagaaacaagagtggatctgccttgaaaccttgacacctgacactcagtacgagtttcaagtgcgtgtgaagccgctccaaggggagttcacgacatggtctccatggtcgcaacctttggccttccggaccaaacctgcagcactgggaaaagatacaattccctggctaggtcacctcctggttggcctcagtggcgctttcgggttcattattctggtgtacctgctgataaactgtcggaatactggcccttggctaaagaaggtcctgaaatgtaacacacccgacccctccaagtttttcagccagctgtcctccgagcatgggggagacgtgcagaagtggctgagttcaccctttccatcttcttctttcagccccggaggtcttgctccagaaatctcgcccctggaggtgctggagcgagacaaggtgactcagctgctgctgcagcaggacaaagtgcccgaacccgcatccttatcctccaaccactccctcacgtcttgcttcacgaaccagggctatttctttttccacctgcccgacgcccttgagattgaagcctgccaggtgtatttcacttatgatccatacagcgaagaggatccagacgagggagtggccggtgctccaacaggttcttcaccacagccactgcagcctctgagcggtgaggatgacgcgtattgcacgttcccctcaagagacgacctactcctgtttagtccttccttactaggcggtccctcccctcccagcacagcccctgggggatctggggcaggggaggagaggatgcccccttccctgcaggaaagagtgcctcgcgactgggatccccagcctctggggcctccaacacctggtgtcccggatctggtggacttccagcccccaccggaactggtccttcgcgaagccggtgaggaggttcccgatgcaggcccacgcgagggcgtttcattcccttggtctcggcctcctggacaaggtgaatttcgggctttgaatgcaagactcccactgaatactgacgcttacctgtccctccaagagctgcagggtcaagaccctacacacctggtgtag

SEQ ID NO: 27284 - DNA, 3516 bp, Artificial Sequence
  Description of Artificial Sequence: Synthetic coding sequence
atggaaaacaatttgaagacttgccccaaagaggacggggactttgtaagtgacaagataaaatttaagatcgaagaggaagatgacgacggcatcccaccagactcactcgagcggatggatttcaagtccgaacaggaggatatgaaacagacggattccggcggagagcgcgctggcctggggggaacgggttgtagctgtaaaccgcctggcaaatacctttcagcagaaagcgaagatgattacggtgctttgtttagccaatactcctccacactgtacgacgtggcgatggaggccgttacccagagcctgttgtcttcacgcaacatgagttctcgaaagaaaagtcctgcatggaaacacttcttcatctcacccagagactccactaaggccatctgcatgtactgcgtaaaggagttcagtcgagggaagaatgagaaagatctgtccaccagctgccttatgcggcacgtgcgtcgagctcaccccacagttctgatacaggaaaacggctccgtgtcagcggtcagttcgtttcccagccctagtctgctcctgccgccacaacccgctgacgcgggagacctttctacgatcttgagcccgatcaagctggtgcagaaagttgcttccaagatcccaagcccagaccgaataacagaggaaagcgtgtcggtggtttcttcagaggagatctcaagcgatatgagcgtaagcgagaagtgcggccgtgaagaggccctggtcggcagttctcctcatttgcccgctctgcactatgatgagccggcagaaaatctggctgagaagagccttccactgccaaagtccacatcaggatctcgtagaaggtccgctgtgtggaagcacttttatcttagccccctcgacaattccaaagccgtgtgcatacattgtatgaacgaatttagcagaggcaagaatgggaaggatctcggcacctcctgcttgattaggcacatgtggcgagctcatcgggcaatagtcctacaggagaacggtggcacaggaattccaccgctttatagtaccccacctacactgctcccttctctgctcccccctgaaggcgaattgagttcggtttcctcatctccagtgaaacctgtgagggagtcgccttctgctagctcatccccagatcgcctgaccgaagaccttcagtcacacctaaatcctggggatgggttgatggaggatgtggcagctttttcgtcttctgacgacatcggtgaggcctcggcctcatccccggagaagcagcaggcggatgggctctcccctagactttttgagagtggcgcaattttccagcaaaacaaaaaggttatgaaacgactgaaaagcgaagtgtggcatcacttctcacttgctccaatggattctctgaaggccgagtgccggtactgcgggtgcgcgatatctcggggaaagaagggagatgtagggactagttgtttgatgcgccatttgtacaggcggcatccagaagtcgtgggttcacaaaaaggtttccttggtgcatcccttgccaattcaccttatgctactctggcttcggccgagtcatcctcaagcaaacttacggaccttcctactgtagtaactaagaacaatcaggtgatgtttccagtgaattctaagaaaacttctaaactgtggaaccacttcagcatctgttcggcagatagcaccaaggtggtgtgcctccactgcggtcgaacaatttctcgaggcaaaaaaccaactaatttagggacatcctgtctgctccgccatctgcaaaggtttcactcaaatgtcctgaaaaccgaggtctccgaaacagcaaggccatcctcacccgatacacgggtcccccgagggactgagctgtctggagcttcttcattcgacgacactaatgagaagttttatgattcacaccccgtcgccaaaaagataacatctctgattgccgagatgattgccctggacctgcaaccgtacagctttgttgataacgtcgggttcaaccgcctgctggaatatctgaagccacagtattcattgcctgctccgtcctatttcagccgtacagctatcccagggatgtatgacaatgtgaagcaaatcattatgtctcatctcaaagaggccgaaagcggcgtgattcatttcactagtggcatttggatgagtaatcagacacgggagtacctcactctcacagctcattgggtgtcttttgaatctcccgctaggcccagatgtgacgatcatcattgcagtgctctgctagacgtctcacaggtggactgcgactattctggaaatagcatccagaagcaactcgagtgctggtgggaagcttgggtcacgtcgactggcctgcaagtcggaataaccgtaaccgataacgcatccatcgggaagactcttaacgagggtgagcatagcagcgtacagtgcttttctcacacggtcaacctgattgtttcagaggccattaagtctcagcggatggtgcaaaatctactgagcctcgcgaggaagatctgtgagagggtgcataggagcccaaaggctaaagagaagctagctgaacttcaaagagagtatgctttgcctcaacaccaccttattcaggacgtcccctccaaatggagcaccagtttccatatgctggagcgcttaatcgagcagaagcgagctattaacgaaatgtcagtggagtgcaatttccgggagctgatttcctgtgatcagtgggaggtcatgcagtccgtgtgcagagccctcaaacctttcgaggctgcaagtagagagatgagcacacagatgtcaaccctttctcaggtgatacccatggtccacatactgaatcggaaggtggaaatgttgtttgaggagacaatgggcatcgacacgatgctgcggagtctgaaagaggccatggtgtcgagactctccgcaacactgcatgatcctagatatgttttcgctacccttctggatccacggtataaggcctctcttttcacagaagaggaggccgagcaatacaaacaggacctgattagagagcttgagctcatgaactccacatcagaggatgtcgctgcatcacatcggtgcgatgccggtagcccttcaaaagactccgctgcagaggagaatctgtggtcccttgtggccaaggtgaaaaagaaagacccacgagagaagttgcctgaggcaatggtcctcgcatacttggaggaagaggtgctggagcacagttgcgacccccttacatattggaacttaaagaaggctagctggcccggactctctgctttggccgttagattcctgggttgtcctccgtcaatagttccctctgaaaaattgttcaacactccgaccgagaatggctcattaggccagagcagactgatgatggagcatttcgagaaactgatcttcttgaaagtcaacttgcccttgatctacttccaatactag

SEQ ID NO: 27285 - DNA, 744 bp, Artificial Sequence
  Description of Artificial Sequence: Synthetic coding sequence
atgcagcctatcctgctgctgctcgctttcctgctgttgcccagagctgatgcaggtgaaatcataggcggacacgaagctaagcctcactccaggccatacatggcatacctgatgatttgggaccagaaatccttgaagagatgtggaggttttctgatacgtgacgactttgtcttgaccgccgcacactgttggggaagcagtataaatgtaaccctcggggcacacaatattaaggagcaggaacccacacagcagtttatccctgtaaagaggccaatcccccaccccgcatacaaccccaagaacttctctaatgatattatgttgctacagttggagagaaaagccaagcgaaccagagccgtccagccgctcagactgccctcaaacaaggcgcaggtgaaacccggtcagacatgtagcgtggccggttggggccaaacagcacctttgggcaaacacagccatacactgcaggaggttaaaatgactgtacaggaagataggaaatgcgagagcgatctgagacactattatgactccacgattgaactgtgtgtaggggatcctgagattaagaaaactagctttaagggagattctggtggtcccctggtttgtaataaggtggcccaaggaatcgtaagctatggcagaaacaacggaatgcctccccgagcctgcaccaaggtctcctcctttgtgcactggattaagaagacgatgaaacgatactag

SEQ ID NO: 27286 - DNA, 1062 bp, Artificial Sequence
  Description of Artificial Sequence: Synthetic coding sequence
atggaagacggtgtgctaaaggaaggcttcctggtgaagagaggccatatcgtacacaactggaaggcgcgttggtttattcttcgacagaacaccttggtttattataaactcgaaggcggtcggcgtgttacacctcccaagggccgaatcctgcttgatggatgcaccataacttgcccttgtttggagtacgagaacaggccactgttgattaaactgaagacacagacttccactgaatattttcttgaggcctgctcaagagaggagcgtgacgcttgggcttttgagatcacgggcgctatccatgccggacagcctggaaaagtccagcagctccattcgctgagaaactcttttaagttgcctccacatattagcttacatcgcatagtggataagatgcacgacagcaacactggaattcggagtagcccaaatatggagcagggaagtacatataagaagacattcctcggctcctctctggtggactggctcatctcaaatagttttaccgcgagccgcctcgaggccgtcacgctggcctcaatgcttatggaggagaactttcttaggccagtgggcgtcagatctatgggcgcaattagatctggggatctcgcggagcagttccttgatgattccacagccctttacactttcgccgagagttacaaaaagaaaatctctcccaaagaagaaatcagcctctcaaccgtggaattgagcggaactgtggttaagcagggctatctggctaaacaggggcacaaacgcaaaaactggaaggtcagaaggtttgtgctgcgcaaagaccctgctttccttcactactatgatccaagcaaagaggagaaccgcccagtgggaggcttttcgctcagagggtcacttgtcagcgctctggaggacaatggcgtcccaactggcgtgaaaggtaatgtacaggggaacctatttaaggttatcaccaaagacgatacccattattatatccaggcatcctccaaagctgaacgggctgagtggatcgaggctattaaaaaactcacgtag

SEQ ID NO: 27287 - DNA, 2025 bp, Artificial Sequence
  Description of Artificial Sequence: Synthetic coding sequence
atggcagaagtgcctgaggactatgatagtgggcctgacgaagacggcgaactggagcccgagcgtcctgagttaccaggactccataaactttacgagaatgccgagccagatactatggcgaaagccgactcaaaattacccgcagaaatttatcaggaaccccaaccagagacagaggaagaagatttcaaggagggtgagccagactcggccaagaatgtacagttaaagccaggtggaaccagtcaggaaggtatagccaaggaatccaagagggacgtgccctccgaaacagagccgggtatccaccaggaggtgaagtccgagacgtcgcgtgagatgggcgagttctttaaagatctggaggcacccatggacgaaacacataaggaatccgaccttgaacctccagaggaggccaagcctaacgtgaccgaagacgtttttcttgaatctgccatggagaccgatcctgatcccgtgcccccaacagaaaccatgtccgaggtgtcaggcgctactgtaagggaaagaaatcttgagcttctagaagaggagactgaaccaggggtccctgaggagtcactgagggtacagcacgaagagacaggcctggagccaccagagcagacgaagcaagacttcccttcagagaaactcggggagagcctggaagaaaccgatttacagcctcccaaaatgacgaaaccggagactccagaagagacacagcgagagagtacagaaaaaaagagaaccgaacctccagagcaggctagattagaatttcttgagaaagagccgcgaaaatcctctgaggaggccggtctggaaccacctgaggagacccagcccgaggtccccgaagagatgcaacgcaaagctacagaggaaaaaggcactgagctgcctgagcgcaccaagccagatttcccagatcataaacccaggaagtccacagatgagaatgtgcccgaaccgttagaggagattaagcttgaatttcctgaagaggagtctaggaaaacaaacgaagaaacaattctggagcagtccgagatgatgaaaccagagtcaccagaggagatacgcaaaagtaatgagaaaaagaaccctcagccaccagaagagactggaccagtgttacctcaggaaattaacccccaagtggaagagaagacacagaccaaaccaaccgagaaaatacttgagctccccgatgaaactaaacctcgggagactcacgttgagttttcaaaggaagaccgacccgagcctatcaagagcaagtacagtgttggtaatgacgaattggagcaccgggagcccaaacgaggtaagttgtccctgtccgacaagttcaggaaagaatactacgccctaggctctctccgagagtctgaagagtctattggtacgcattatgaattcttacagccactgcaaaaactgctgaacgtctccgaagagtgctcttatagtgaccctagtgaaagtcaaactgagctatcagaattcgtccacgaaaaggaagttgttgatttatctcaggagctcaaggagcgagtcagtgaagacgatgagacacaacctgaaaaagggaccgaactccagttcgagcacctgaactgggatccagaagaagttgccgaatggatctcacagctcgggttcccccagtataaagaatgctttattacaaattttataagcggcagaaagctaattcacgtcaactgtagcaacctgccgcagatggggatcacaaatttcgaagatatgaaggcaatctcccgtcacacccaagagctcctggaaattgaggagccactgttcaagagaagcatatctctgccttatcgggacatcattggtttatatttggagcagaaagggcatacaggcattaagtcagattctttaacgttgtcagagttcgtgaaagcagccggtctgcaggactacgcccctgaaataactgcccctgaggaaaacgaggagctgccctgtacggagccctag

SEQ ID NO: 27288 - DNA, 1689 bp, Artificial Sequence
  Description of Artificial Sequence: Synthetic coding sequence
atgcggcctgagccaggaggctgctgctgccgcagaacagtgcgggctaatggatgcgtggctaacggagaggtgaggaacggctatgtccgatcttcagccgcagccgctgccgcagcagccgcaggtcagatccaccacgtaacccagaatggtgggctgtacaagcgtccattcaacgaggcctttgaagaaactcccatgctagttgctgtactgacctacgtgggctacggagtcctgaccttattcggttatctgcgggattttctgcgctattggaggatcgaaaaatgtcaccacgcaactgaacgggaagaacaaaaggacttcgtgagcctgtaccaggacttcgaaaacttctatactcgcaacttgtacatgcgcatacgcgacaactggaacaggccgatatgctcggtaccaggggctcgtgtggatattatggagagacagagccacgactacaattggtccttcaagtacaccgggaacatcattaagggagtaatcaacatgggtagctacaattatctcggttttgcacgcaacactggaagttgtcaggaggccgctgctaaggtgcttgaagagtatggcgcaggcgtttgctccaccagacaagagatcgggaatctggacaagcacgaagaactggaggaactggtggctcggttcctgggagtcgaggcagcgatggcctatgggatgggattcgcaactaatagcatgaatatcccggcactggtggggaaaggttgtttgattttgtccgatgaactgaaccatgcgtctcttgttctgggcgcacgcttgtccggtgcaacaatacgcatattcaaacataacaacatgcaatccctagagaaactgctgaaagatgcaatcgtatatggacagccaaggacccggaggccttggaagaaaattctgatactggtggagggcatttacagcatggaaggttccattgtgcgactgccagaagtgatcgctctgaaaaaaaagtacaaagcctacctgtatctagatgaggcccacagtattggcgcactcggacctacaggcaggggcgtggtcgaatattttgggctcgacccggaggacgtggatgtgatgatggggacgtttacaaaaagcttcggagcatctggtggctatatcggagggaagaaggagctcattgactacctgcggactcactcccactctgcggtatatgctactagtcttagcccacctgtagtcgagcaaattattacaagcatgaagtgcattatggggcaggatgggactagcctcggaaaggagtgcgttcagcagctggctgagaacacccgctactttcgcagacggttaaaagaaatggggttcataatttacggcaacgaagatagccctgttgttccgttgatgctgtacatgcccgctaaaatcggggctttcgggcgtgagatgctgaaacgcaatatcggagtcgtggtcgtagggttccccgctactccaattatcgagtccagagcccgtttctgcctttccgccgcacacacgaaagaaatactcgacaccgctttaaaggaaatcgacgaggtcggcgaccttttgcagctaaaatattctaggcacaggctggtgccccttctggataggccttttgacgaaactacatacgaagagactgaggattag

SEQ ID NO: 27289 - DNA, 2346 bp, Artificial Sequence
  Description of Artificial Sequence: Synthetic coding sequence
atgagctcctcctctcctaccgggcaaatagcatccgctgccgacatcaaacaggagaatggaatggagagtgcatctgagggacaggaggctcatagggaagtggccggaggcgcagccgtgggtcttagcccacccgctccagccccttttcctctagagccgggagatgctgccaccgccgctgctagggtgagtggggaagagggagcagtggccgcagccgctgccggagcagcggcagaccaagttcagctacactccgaactcctggggcgacatcatcacgctgcagctgcagctgcccaaactcccctggcttttagcccggaccatgtcgcgtgcgtctgtgaggccctgcagcaagggggtaacctggaccgacttgccaggtttctgtggtctctcccccaatccgacttgctgcggggaaacgaaagtttactgaaggctagagcactggtcgcctttcaccaggggatatatcccgaattgtactcaatactggagtctcactcctttgagagcgcgaaccaccccctgttgcagcaactgtggtataaagctagatatacggaagctgaaagagcccgtggacggcctttgggcgcagtagataagtatcgcctgcgcagaaagtttcctctcccccgaaccatatgggatggagaagaaactgtgtattgtttcaaagagaagtctagaaacgccctgaaagagttgtacaagcagaatcggtatcccagccccgctgaaaaaagacatctggccaagatcaccgggctgtcactgacacaggtttcaaattggtttaagaatcggaggcagagggatagaaacccttctgagacacagtctaagagcgagtcagacggaaaccccagtaccgaggacgagagttctaagggacacgaagacctgtcacctcaccccctgagctcctctagtgatggcatcacgaatctcagcctcagctctcacatggaacccgtatatatgcagcagattggcaacgccaaaatcagcctgtccagcagcggagtgcttctaaatggctctctggtgccagccagtacgtcacctgtattccttaatggaaactctttcatacagggaccatccggagtgatcctgaatggactgaacgtgggtaacacccaggctgttgccctgaatcctccaaagatgagctcgaatatcgtgtccaacgggatttctatgacggacattctgggttctaccagtcaggacgtgaaagaattcaaagttctccagagctccgccaactcggccacaactactagctatagcccctctgttcccgtcagtttcccaggcctcatcccttctaccgaggtcaagcgggagggtatacagaccgtggcttcgcaggacggtgggagcgttgtgacatttaccacccccgttcagattaaccaatacggaatagtccagatccccaattctggcgctaattctcaatttctgaatggcagtattggtttcagtccacttcagttgccaccagtatctgttgccgctagtcaaggtaatatcagcgtgtcttcaagtaccagtgatggatccacgtttacaagtgagtctacaacggttcagcagggtaaggtgttcttgagtagcctggccccatctgccgttgtctacacagttccgaacaccgggcagacgatcggctcagtgaaacaggaggggcttgagagatcactagtttttagccagcttatgcccgtgaatcagaatgcccaggtcaatgcgaatctatcctcagaaaacatttctggctctggcttgcaccctttggcttccagcctagtgaacgtctcgcctacccataacttcagtctgagtccttctacactgctgaaccctacagagttaaatcgcgacattgcagactctcagccaatgtcggcccctgtggcttcaaaaagcaccgtcacaagcgtgtctaacaccaactatgccactttgcagaattgtagcctgatcactgggcaggatttactgtcagtacccatgactcaggccgcactaggcgagattgtccctaccgctgaggaccaggtaggccaccccagcccagcagtccaccaagacttcgtgcaggagcaccgcctcgttcttcagagcgtggccaacatgaaggaaaattttctgtccaattcagagagcaaggcgaccagctcattgatgatgctggacagtaagtctaaatacgtcctggatggaatggttgataccgtttgtgaggatttggaaaccgacaagaaagaactggcgaagctacagactgttcaattggacgaagacatgcaggacctgtag

SEQ ID NO: 27290 - DNA, 1392 bp, Artificial Sequence
  Description of Artificial Sequence: Synthetic coding sequence
atgggtaaggagaagactcacatcaacattgtggtgattggacatgtcgatagcgggaaatctactaccactggccacctcatctacaagtgtgggggtatcgataagcgtactattgagaaattcgagaaggaggcggctgagatgggaaagggctcctttaaatatgcatgggtgctcgacaagttgaaagctgaacgcgagagaggtatcactattgacatttccctgtggaagttcgagaccactaagtattatattaccatcattgatgctcctggccatcgcgattttatcaaaaacatgatcacaggtacatcccaggccgactgcgcagtcttgattgtggctgcaggggttggagagtttgaagcgggtataagcaagaacggccagacacgagaacacgcgttactcgcctacaccctgggcgtgaaacagctaatagtgggagtgaacaaaatggattctacagagcctgcttatagtgagaagaggtatgacgaaatcgtgaaagaggtaagtgcttatataaagaagatcggatataatcctgccactgtcccctttgttcccatcagcggctggcatggcgataacatgctggaacctagccctaatatgccctggttcaaagggtggaaagtggaacgaaaagagggcaacgcgagcggggtatctctactcgaagctctcgataccatcctgccccctacgcggccaaccgataagccgctgcgcctccccctccaagatgtgtacaagatcgggggaattggcactgtacccgttgggagggtcgagaccggaatcctcagacccggaatggttgtgacgttcgccccagtgaacatcaccaccgaggtcaaatcagtggagatgcatcacgaggccctgagtgaagcactgcccggagacaatgttggttttaatgtgaagaacgtttccgtgaaagatataaggcggggaaatgtttgcggagattccaagtccgacccgccacaagaggccgcacagtttacgtctcaggtcattattctgaaccaccctgggcaaatttcagccggttactctccagtgattgactgtcacactgctcacatcgcttgtaaattcgcggagcttaaagagaagatagatcgtcgaagtggaaagaagcttgaagacaatcccaagtcactgaaatcaggcgacgccgctatagtcgaaatggtgcctggcaaacctatgtgtgtcgagtctttctcacagtatcccccattaggccgatttgcggtgcgcgacatgcgccaaactgtggccgtcggcgtcatcaaaaatgtcgagaagaagtcgggtggcgctggaaaagtaacaaaaagtgcacagaaagcccagaaggcagggaaatag

SEQ ID NO: 27291 - DNA, 600 bp, Artificial Sequence
  Description of Artificial Sequence: Synthetic coding sequence
atggccgctgccaataaggggaaatgtcttccaggtgtggtgggcctggcccaagctttacccgtcgggccagggagacgagcaatcgccgcaggcaacaagcctagagtgcgttcaatacggttcgctgcgggacatgacgccgaggggtcacatagccacgttcacttcgacgagaaacttcacgacagcgtggtgatggtcactcaggagtctgacagctccttcctcgtgaaagtgggattcctgaagatccttcatcggtatgaaattaccttcactttgccaccagttcatagactctcaaaggacgtgagggaagctccagtgcctagcctccaccttaagctgctgagcgttgtaccagtgcctgaaggctattcagttaaatgtgagtacagcgcacacaaagaaggcgtcctgaaggaggagatactcctggcatgtgaaggcggtaccgggacctgtgtgcgagtgaccgtccaagctcgcgtgatggaccgtcatcatggcactccaatgctgctcgacggcgtaaaatgtgtcggggcagagctcgagtatgacagtgaacattccgattggcacggatttgattag

SEQ ID NO: 27292 - DNA, 270 bp, Artificial Sequence
  Description of Artificial Sequence: Synthetic coding sequence
atgcaactacaggcatctttatcattcctgttgattctgactctctgtttagaactgaggtctgagctggcaagggacaccatcaaagacctgctgccaaatgtgtgcgcttttccgatggagaaggggccatgtcagacctatatgactcggtggttttttaattttgaaactggagaatgcgagctgttcgcctatgggggatgcgggggtaatagcaataacttcctccgcaaagagaaatgtgagaagttctgtaagtttacctag

SEQ ID NO: 27293 - DNA, 1251 bp, Artificial Sequence
  Description of Artificial Sequence: Synthetic coding sequence
atgtcagaagccgatggtctcagacagcgcagacctctgaggccccaggtcgtcactgacgatgatggacaagctccggaagcaaaagacggcagctctttttcgggacgcgtcttccgtgttacctttcttatgttggcagtctcattaacagttccactgttgggggcaatgatgctcctagaaagccctatcgatccacaacctctgagctttaaggagccacccctcctgctcggagttctccatcctaacaccaagctacggcaagctgagaggctgtttgaaaaccagcttgtggggccagaaagcatagcccatatcggcgacgtcatgttcaccggaacggcagacggacgggtggtgaagcttgagaatggtgaaatcgaaacaatagctcgctttggatctggaccttgcaaaactagggatgatgagcccgtttgtgggagaccgttagggattcgggcaggtcccaatggaaccttgttcgtggcggatgcctataaggggttgttcgaagtcaatccatggaaaagggaagtgaaattactgctatcctctgaaacacctatagaaggaaagaatatgtctttcgtgaatgacctgacagtcactcaagacggtaggaaaatttacttcactgactcctcctctaagtggcaaagaagggactacctgttgttggtgatggaaggcaccgacgacggcagactcttggagtacgacactgttactcgcgaagtgaaagtcctgctggaccagcttcgctttccaaatggcgttcaactctccccagccgaggattttgtgttggtggccgaaaccacaatggcacggatccgtagggtctatgtttcagggctaatgaaaggaggggctgacctgttcgttgagaacatgccaggctttcctgacaacatcaggccctcaagcagcggaggctactgggtgggcatgtccactatccgcccaaatccaggattttccatgctggatttcctcagtgagcgaccgtggattaagcggatgatctttaaactgttcagccaagagaccgtcatgaagttcgtaccaaggtacagtctggttttggaattgagcgactccggagcattccgcagatcactccacgaccccgatggacttgtggctacttatatctcggaggtacatgagcatgacggacacttgtaccttggctcattccgctcgccatttttatgtcgtctgtccctacaggcagtgtag

SEQ ID NO: 27294 - DNA, 870 bp, Artificial Sequence
  Description of Artificial Sequence: Synthetic coding sequence
atggttggcgtgaagccagtgggatccgacccggatttccaacccgagcttagcggggctggttcacggctggcagtcgtgaagttcaccatgaggggctgtggcccatgtcttcgaatagccccagcgttttcatcaatgtccaacaagtacccacaggcagtgttcttagaagtcgatgttcatcaatgtcaaggcacagcggctacaaataacatttccgcaacacccactttcttgtttttccgaaataaggttagaatcgaccagtatcaaggcgctgatgcagtggggttagaggaaaagatcaagcaacatctggagaacgatccgggaagcaacgaggacactgacatacctaagggatatatggacctgatgcccttcattaataaagccggatgcgagtgtctaaatgagagtgatgaacacggattcgacaactgtctcaggaaagacaccacttttctcgagagtgattgtgatgaacagctgctgatcactgtggcttttaatcagccagtgaagctctacagtatgaagttccaagggcctgataacggacaagggcctaaatacgtgaaaatatttatcaatctgcccagatctatggactttgaggaggctgaaaggtctgaaccaacgcaggctctggagctgaccgaagacgacatcaaggaagacggaatcgttccactgcgttacgtgaagttccagaatgttaactcggtgactatcttcgtgcagagtaaccagggagaggaagagactacccggatctcctacttcactttcataggtacaccggtccaggctaccaatatgaatgattttaagcgggtggtcggcaaaaaaggggagagtcactag

SEQ ID NO: 27295 - DNA, 1164 bp, Artificial Sequence
  Description of Artificial Sequence: Synthetic coding sequence
atggtttttgccttttggaaagtgttcctgatcctgtcttgcctcgccggacaagtgtcagtcgtccaggtgaccatccctgatggattcgttaatgtgaccgtgggatctaacgttactctcatttgcatctataccacaacagtggcatcaagagaacagctaagtatccagtggtcttttttccataaaaaagaaatggaaccaattagtatttatttttcccaggggggacaggccgtggctataggtcagtttaaagatcgaataaccggaagcaacgatccaggaaacgccagtattacaatctcccacatgcagccagcagacagtggcatttatatttgtgacgtcaataacccaccagattttctggggcagaaccagggcattctgaacgtatcagtcctcgtcaagccatcgaaacccctctgctccgtccagggcaggcccgagacaggacacacaattagcctgtcttgtttgtcggctctcggtaccccctcacccgtgtattactggcacaagctggaaggacgggatatcgttccagtgaaagaaaacttcaatccaaccacgggaatcctggtcattggaaatctcaccaacttcgaacaaggatactatcagtgcacggcaataaatcggttgggtaactcatcctgcgagattgatctgactagcagtcatcccgaagtaggcatcattgtcggcgctctcattggttcacttgtgggcgcagctataattatctctgtagtgtgtttcgctagaaacaaggcaaaggctaaagcgaaggaacgaaatagcaaaacaattgctgaactggaacccatgaccaagataaacccgcgtggggaatctgaggccatgcccagagaggatgcaacccagttggaagtcactctgccctcttccatacatgagaccggacccgacacaatccaagaacccgattatgaacctaaacctacccaagagccagcacccgagcccgctccagggagcgaaccaatggccgtcccggacctcgacatcgagctcgagctggagccagagacacagagtgaactggaaccagagccagaaccagaacccgaatctgaacctggagtggtcgtggagccactctcggaggatgagaaaggtgtcgttaaggcttag

SEQ ID NO: 27296 - DNA, 1821 bp, Artificial Sequence
  Description of Artificial Sequence: Synthetic coding sequence
atgtcagacacatccgagagtggggcaggactgacaaggtttcaggctgaagcctccgagaaagactcctcatcaatgatgcagacactgttgaccgtaacacagaacgttgaagtacctgagacaccaaaggcctccaaagccctggaggtgtctgaggatgttaaagtcagtaaggcgtccggagtgagtaaagctactgaggtgtccaagactccagaggccagagaagcccctgcaacacaggcctcaagcaccacgcagctcaccgacacacaggtgcttgccgcagaaaataagtccctagcggctgataccaaaaaacaaaatgctgatccacaagccgtaacaatgcctgcaaccgagaccaaaaaagtcagccatgtggcagataccaaggtaaatacgaaagctcaggaaactgaggccgcaccatcccaggcacccgcagacgaaccagaacccgaaagcgctgccgctcaatctcaagagaaccaggatacaaggcctaaggtgaaagccaagaaagcccgaaaagttaagcacctcgatggggaagaagacgggtcaagcgaccagtcgcaggcttccggaacaaccggcggacgcagggtgagcaaggccctgatggctagcatggcgaggagagcaagccgtggcccaatcgcattttgggccaggcgcgcatctagaaccagactagctgcctgggcgcgtagagcattactcagcctgcggtcgccgaaggcaaggagaggaaaggctagaagacgagctgcgaaactgcaatccagccaggaacctgaggctccgccacctagggacgtcgctctgctgcaggggagggcaaatgatttggtgaagtacctgcttgctaaagatcaaaccaaaatcccgataaaacggtcagatatgctgaaagacatcattaaagaatacacagacgtgtatccagagattattgagcgagcaggctacagcctcgagaaggtgttcggcattcagttgaaggaaattgacaaaaacgatcatctgtatattctgctgtccacgctggagccgacggacgccggaatccttggtactaccaaagactcccctaaactcgggctgctgatggtgctgctttccattatctttatgaatggaaatcgttcttctgaggccgttatctgggaagtacttcggaaactaggcctgaggccaggcattcaccactccttattcggcgacgtcaagaagttgatcacagacgagttcgtcaagcaaaagtacctcgattacgctagagtgcccaacagcaacccgccagagtacgaattcttctggggtctgcggtcctactacgagacctctaaaatgaaggtcctgaagttcgcctgtaaagtgcaaaagaaggacccgaaggagtgggcagcccagtatcgagaggccatggaggccgacctgaaggccgcagcggaagccgcagcagaggccaaagcacgtgcagagataagagcgaggatggggatcggactgggtagcgaaaatgccgcaggaccatgtaactgggacgaagctgacataggcccttgggcgaaggcgaggatccaggcaggggctgaagccaaagctaaggctcaggaatccggctccgcatcaacaggtgcctcgacatctacgaacaactccgcctccgcctcagcctcaacttccggtggcttcagcgccggtgcctcactgactgcaaccctcacatttggcttattcgctggtctgggtggggctggagcctccacatccggctcctcgggcgcttgcggcttctcgtacaagtag

SEQ ID NO: 27297 - DNA, 369 bp, Artificial Sequence
  Description of Artificial Sequence: Synthetic coding sequence
atgaccacagcgaccagacaggaagtcctcggcctgtacagatctattttcagactcgccagaaagtggcaagccacctccgggcagatggaggacactatcaaagaaaagcagtacatcctgaacgaagcccgtaccttattccgcaaaaacaagaacctcacagacacagacttgatcaaacagtgtattgacgagtgtaccgctagaattgagatcggcctccactataaaattccgtatccacgtcctatacacctgccgcctatggggctgacacctttacgcggaaggggtttgcgctctcaggagaagttaagaaagctctccaaaccagtctacctgagaagccacgatgaagtctcttag

SEQ ID NO: 27298 - DNA, 582 bp, Artificial Sequence
  Description of Artificial Sequence: Synthetic coding sequence
atgctgggggtgttggaacttcttctcctgggagccgcttggttggccggaccagccagaggacaaaacgaaaccgagcccatcgttttagaaggcaagtgtcttgtggtgtgcgatagtaaccccacctcggaccccactggcacagcactgggcatatctgtgcgctcgggatcagcaaaagtggctttttcggccattagaagtaccaaccacgagcctagtgaaatgagcaaccgcactatgataatttactttgaccaggtactcgtcaacattgggaacaatttcgactccgagcgaagcaccttcatcgctcctcgtaaggggatatactctttcaactttcacgtcgtgaaagtgtacaataggcagaccattcaggtgtccctgatgctgaacgggtggcccgttatctccgctttcgcaggcgaccaggacgtgacccgggaggctgcgagcaacggcgtcctgattcagatggaaaagggcgaccgggcatacctcaagctggagcggggtaatctcatggggggatggaagtattctaccttctcaggattcctcgtgttccccctatag

SEQ ID NO: 27299 - DNA, 1578 bp, Artificial Sequence
  Description of Artificial Sequence: Synthetic coding sequence
atgtcaaggcaattgctgcccgttctcctactcctactactcagggctagttgtccttgggggcaggagcagggcgcaaggagccccagcgaggagcctcccgaagaagaaatccccaaggaagacgggatcctcgtactgtcccgccacacactcggccttgcactgcgtgaacatcctgccttactggtcgaattttacgctccgtggtgcggacattgtcaggccctggcccctgaatactcaaaagctgccgcagtcctggcagccgagagcatggtggttacgctcgccaaggtggacggccctgcccagagagagctagcagaagaatttggagtcactgagtatcctaccctgaaattttttcgcaacgggaatagaactcatcccgaggaatataccggacctcgggacgccgagggcatcgccgaatggcttcgaagaagggttggtcctagcgccatgagactggaagacgaggcagctgctcaggctctgataggagggcgagatctggttgtgatagggtttttccaagacttgcaagatgaagatgtcgctacgttcttggcgctggcgcaagacgcactggatatgacatttggcctgacggacagaccgagattgtttcaacagttcggacttactaaggacactgtagtattgttcaagaaatttgacgagggaagagccgatttcccagtggatgaggagctcggcttagatctgggcgacctgtccagatttctggtgacccactcaatgcgacttgtgaccgaatttaattcccagacaagtgccaagatcttcgccgcacgcattcttaaccatctgctgttatttgtgaaccagactctcgctgcccatagggagctgctcgcgggatttggcgaagcagcccctaggtttaggggccaggttctgttcgttgtagtagacgtggctgccgacaacgaacacgttctgcagtacttcggtctgaaagcagaagccgcaccaaccctgcggttagtaaatctcgagactactaagaaatacgcccctgtggacggcggtccagtcactgccgctagcatcacggcattttgccacgccgtgttgaacgggcaggtcaagccttatttgctctcccaggaaatccctccggattgggatcaacggccagtaaaaaccttagtgggtaaaaactttgagcaagtggcattcgatgagactaagaatgtgttcgtgaagttctatgcaccatggtgtacccactgcaaagaaatggctcccgcatgggaggcactagcagaaaaataccaggatcacgaagatatcatcatagcagaacttgatgctacagcgaatgagttagatgcatttgccgtacatggcttccctactctaaagtacttccctgccggacctggtagaaaggtaatagagtacaaatccacccgtgacctggaaacgttcagcaagtttctggacaacgggggagtgttgcctaccgaggagcctcccgaggaacccgcagctccatttccggagccgcctgcaaatagtaccatggggagtaaggaagagctctag

SEQ ID NO: 27300 - DNA, 2262 bp, Artificial Sequence
  Description of Artificial Sequence: Synthetic coding sequence
atggccgacaagcgaaaactgcagggcgaaattgaccgctgtctgaagaaggtgtcagagggtgtcgaacagttcgaggacatctggcagaaactgcacaatgcagcaaacgcaaatcagaaggagaaatacgaagcggatctgaaaaaagagattaagaagctccagagattgagggaccaaattaagacgtgggtcgcgagcaacgaaataaaggataaacgacagctgattgacaatcgtaagctcatcgaaacgcaaatggagcggtttaaggtggttgagcgcgagactaagactaaggcttacagtaaggaaggccttggccttgcccagaaggtcgatccagcccaaaaggaaaaggaggaagtgggccagtggcttaccaatactatagatactctcaacatgcaggtggaccaatttgaatcagaggttgagagcctgtctgtacagaccagaaaaaaaaaaggcgataaagacaagcaggacaggattgagggtctcaagcgacacatagaaaaacatcggtaccacgtgcgcatgctagagacgattttgcgaatgctggataacgactctatactcgtcgacgccatacgaaaaatcaaagacgatgttgaatattatgtggactcatcacaggaccctgactttgaggaaaatgagtttctctacgacgatctggatctggaggatatcccgcaggcccttgtcgccacttcacccccatctcacagccacatggaagacgagatattcaaccaatcaagtagtactccaacctcaaccacttcttctagtcccattcctccttcccctgcaaactgcactacggagaatagcgaagacgacaaaaagaggggcagatcaacagacagcgaggtttcccaatccccagctaagaatgggagcaaaccggtgcattccaaccaacaccctcagagccctgcagtgccccctacttatcccagcggccctcccccagccgctagcgcattgtcaacgacccctggaaataacggagtgccagctcctgccgcaccaccgagtgctctggggcctaaggcatcgccagccccatcacacaatagcggaacaccagcaccctacgctcaagcagttgcacccccagctcctagtgggccatcaaccacacagcccaggcccccatccgtccagccctccggcggtggaggagggggttcaggcggtgggggatccagttctagctcaaactcgtctgccggtggcggagccggaaaacaaaacggagccacgagttacagctcagttgtggccgactccccagccgaagttgccctctcttctagcgggggaaataatgccagttctcaggcgcttgggcctccttctggcccacataatccccctccttccactagcaaggaacccagtgctgccgctcctaccggggctggcggagtggctcctggctctggtaataattcaggcggtccgtcattgctggtcccccttcctgtcaatccccctagtagcccaaccccctccttttcagatgccaaggcggcaggagccctgctcaacggtcccccacagttttcgacagccccagaaattaaggctcctgagccactttcttcactgaagtcaatggccgaacgggcagctattagcagcggcatcgaggatcccgtacctaccctgcatctcactgagcgcgatataatccttagcagtacaagcgctccgcctgcgagtgctcagcctccactccagttgtccgaagtgaacattcccctgtccctgggagtgtgccctctcgggccagtaccactgacaaaggaacaactgtaccagcaggcaatggaagaggcagcatggcatcatatgccccacccctccgactctgaacgcattcgccagtacctcccgaggaatccctgtcccacccccccatatcatcaccagatgcccccacctcacagcgataccgtggaattttaccagcgcctctccaccgaaactttatttttcattttttattaccttgagggcactaaagcacagtatctggctgccaaggctcttaagaaacaatcttggcggtttcacactaaatacatgatgtggtttcagcggcacgaagagccgaaaactattacggacgaatttgaacagggcacctatatatacttcgactacgaaaagtggggccagaggaagaaagaaggtttcaccttcgagtatcggtacctggaagatagggatctgcaatag

SEQ ID NO: 27301 - DNA, 1146 bp, Artificial Sequence
  Description of Artificial Sequence: Synthetic coding sequence
atgcccttcggaaacactcacaataagtttaagctcaattacaaaccggaagaagaataccctgatctctccaagcataataatcatatggctaaggtcctgaccctcgaactctacaagaaactccgcgataaagagacaccttccggctttacagttgacgacgtcatacagacaggggtggacaatccagggcacccattcatcatgacggtggggtgtgtcgccggtgacgaagagtcctacgaggtctttaaggagctgtttgacccaattatcagcgaccgccacggaggttacaagcccactgacaaacataagacagacctgaatcatgagaaccttaaaggcggagatgatctggatccaaattatgtattaagctcccgggtcaggacagggaggtccattaaaggctacaccctaccacctcactgcagcaggggggagcgcagggctgttgagaaattatctgttgaggcgctcaatagcttaaccggcgagtttaagggtaagtattatcctctgaaaagtatgaccgagaaagagcaacagcagctgattgacgatcattttttgtttgacaaaccggtgagtcccctcttgttggctagcggcatggccagagattggcccgacgctagaggtatctggcataacgataacaagagctttctagtctgggtgaacgaggaggatcatctccgtgtgatctcaatggagaagggagggaatatgaaggaagtgtttcgcagattctgtgtaggactccaaaagatcgaggagatcttcaagaaggcgggtcatccatttatgtggaatcaacacctgggatacgtcctgacgtgcccctccaatctagggacaggtcttagagggggtgttcacgttaaacttgcccatttatctaaacaccctaaattcgaggaaattctcaccaggctcagactgcaaaaacgaggcacaggaggagtggatactgccgctgttggctcagtttttgacgtctcgaatgctgatagactgggctcctccgaggtggaacaagtgcaattggtcgttgacggtgtgaaattgatggtcgaaatggagaaaaagcttgagaaaggccagtctattgatgacatgatccccgcacaaaaatag

SEQ ID NO: 27302 - DNA, 300 bp, Artificial Sequence
  Description of Artificial Sequence: Synthetic coding sequence
atggcccagggccagcgcaagttccaggcccataagcccgcaaaaagtaaaacagccgcagcagcctcagagaaaaatcgcggtccacgcaagggcggacgtgttatcgccccaaaaaaggcaagagttgttcagcaacagaagctcaaaaagaacctggaagtggggataagaaaaaaaatcgagcatgatgtcgtgatgaaggctagctcgagtttgcccaagaaattggccctacttaaggcacccgcaaagaagaaaggcgctgcggctgctacctcctccaaaactccatcatag

SEQ ID NO: 27303 - DNA, 1491 bp, Artificial Sequence
  Description of Artificial Sequence: Synthetic coding sequence
atggacgacgtgcctgctcctactcccgctcctgccccacctgccgcagccgctccaagagtcccctttcactgttccgagtgcggcaagtctttcaggtatcgctccgacctgcggaggcactttgctcgccacactgcccttaaaccgcacgcgtgtccacggtgtggtaaaggattcaagcatagctttaatctagccaatcatctgagaagccatacaggggaaaggccatacagatgctcagcttgtccaaaaggatttagggactccaccggcttattgcaccatcaggtggtgcacactggagaaaagccttactgctgcctggtctgtgaattaaggttcagctcccggtcaagcctcggcaggcacctgaagcgacagcacagaggggtgttgccctccccacttcagccaggccctggcctccctgctctgtcagctccttgctccgtttgttgtaacgttggtccttgctcagtctgcggcggatctggcgctgggggtggagaagggccagagggggctggtgctggcctggggagctgggggcttgccgaggccgcagccgcagcagctgccagcctgccccctttcgcctgtggcgcatgtgctcgtaggtttgatcatggccgagaactggccgctcactgggccgcacatacagatgtaaagcccttcaaatgcccacggtgtgagagggacttcaacgctcccgcactgctggagagacataagctgacgcacgatctacaggggccaggggcaccgccagcccaggcctgggcagcgggaccaggagccggtcccgagacagcaggcgaaggtacagcagccgaggccggagatgcaccactcgcttccgacaggagacttctcctgggtccagctgggggtggagttccaaagttgggcggtctgctaccggagggcggtggagaggccccagccccagcggcagcagccgagccctcagaggatactctgtaccagtgtgactgtgggaccttctttgcttcggccgctgccctcgcttcccacttggaggctcacagcgggcctgcgacctatggctgcggccactgtggggcactgtatgccgcactcgctgcactcgaggaacataggagagtgtcccacggggaagggggaggggaggaggctgccactgccgctcgcgaaagagagcccgctagtggggagccaccttctggctccggacggggaaaaaagatttttggctgtagcgaatgcgaaaagctcttcaggtccccccgtgacctggaacgccacgtgctcgtgcataccggtgaaaaaccatttccctgtctcgagtgcggaaaattctttcgccacgaatgctatctgaagcgacatcgtcttttgcacggcacggaaaggcccttcccttgccatatctgtgggaaaggattcatcaccctttccaacctgtctcgacacctgaagctacatcgagggatggactag

SEQ ID NO: 27304 - DNA, 663 bp, Artificial Sequence
  Description of Artificial Sequence: Synthetic coding sequence
atgaagagtgtgatatatcatgccttaagtcagaaagaggcaaacgatagcgacgtgcaaccttctggggctcagagagccgaggcgtttgtcagagcattcctgaagaggtctacgccccgaatgtctccgcaggcacgtgaggatcagttgcagagaaaagccgtcgtgttggagtattttacacgccataaaaggaaagagaagaagaagaaggcaaagggactgtcagccaggcagagacgtgagctgcggctgttcgatataaaacctgagcagcagaggtatagcctctttcttcctctgcatgaactgtggaaacaatatattagagatttgtgttctggactgaaaccagacacccagccccaaatgattcaggccaaattacttaaagccgatctgcacggtgcaatcatttccgtcacaaagtcaaagtgtccatcatatgtaggaattacaggaatcctgctgcaggagacaaagcacatctttaaaataataaccaaggaagaccggctgaaagtgattcccaagctcaactgtgttttcactgtggaaacagacgggtttataagctacatctatggtagcaagttccaactccggagttccgaacggtccgcgaaaaagttcaaagccaagggcacaatagatttgtag

SEQ ID NO: 27305 - DNA, 768 bp, Artificial Sequence
  Description of Artificial Sequence: Synthetic coding sequence
atggccagagcgaaagcactgttgggagggcctggagaagagttggaggcagacactgaatacctggatcccttcgatgctcagccacacccagccccaccggatgacgggtatatggagccttatgacgcccaatgggtgatgagtgaactaccgggaaggggtgtccagctctatgatacaccttacgaagagcaagatccggaaacagcagatggccctcccagcggccagaaaccacggcagtccagaatgccacaggaggatgaaagaccggctgacgagtatgaccagccttgggaatggaagaaggatcacatctctcgcgcatttgcggtccagtttgactcaccagaatgggagcggactcccggaagcgcgaaagaactgcgtaggcctccccctaggagcccacagccagctgagagggtagatccagctttgcccctcgagaagcagccttggttccatgggccacttaaccgtgccgacgcagaatcgttgctgagtctgtgcaaggaagggagctatctcgtgagactctctgagacaaacccccaggactgttcactgtcacttagatcttcccaggggtttttgcacctcaagttcgctagaactcgcgaaaaccaagtggtgctgggccaacattcaggaccttttccaagcgtccccgagttagtcctgcactatagttcccggcctctgcccgtgcagggggctgaacacctggctttgctttatcccgtggtaacccagactccttag

SEQ ID NO: 27306 - DNA, 858 bp, Artificial Sequence
  Description of Artificial Sequence: Synthetic coding sequence
atgtctgacgacttcctctggttcgaaggcattgcattcccaaccatgggcttcagatccgagaccctgagaaaggtgcgggatgagtttgtgatccgcgacgaggacgtcatcatcttgacttaccccaagtctggcacgaattggttggctgagattctgtgtctgatgcatagcaaaggcgacgccaagtggatccagagcgtcccaatatgggaaaggtccccctgggtcgagagcgaaatcggatataccgccctctctgagacggaatctccaagattgttttcatcccacttacccattcagctctttcctaaatctttttttagctccaaagcaaaggtaatctatctaatgagaaatcccagagatgtccttgtgtcgggatatttcttctggaaaaacatgaagtttatcaagaaacccaaaagctgggaggaatactttgaatggttctgccagggcactgtgctgtacggctcttggtttgatcatatacacgggtggatgcccatgagggaggaaaagaacttcctccttctgtcctacgaggagctgaagcaggatacagggagaactattgagaaaatttgtcaattcctcggaaagacgctcgaacccgaagagctaaatttaattcttaagaacagctcatttcaatcaatgaaggaaaataagatgagcaattacagcctactgagtgtggactatgttgtagataaggctcagctgctgcggaaaggagtgtctggagactggaagaatcattttactgtggcccaggccgaggacttcgataaactgttccaggaaaaaatggcagacctccccagagaactgttcccctgggagtag

SEQ ID NO: 27307 - DNA, 1647 bp, Artificial Sequence
  Description of Artificial Sequence: Synthetic coding sequence
atgaagacacctgcagacaccggtttcgcgttcccagactgggcgtataagccggagagcagcccagggagccgtcagatacagctctggcacttcattctggagttactgcggaaggaggagtaccagggtgttatagcatggcagggcgactatggggaattcgtgattaaggaccctgatgaggttgctaggctctggggcgttagaaagtgtaaaccgcagatgaactatgacaaactgagtcgcgcattgcggtattactacaacaagaggattctgcataagactaaggggaaacgatttacttataaatttaattttaataagctcgtattggtgaattacccgttcattgacgtaggactagccggaggtgcagtgccccaaagcgccccacccgtcccaagcggcggatcccacttccggtttccgccttcaactccttccgaggtgttatcacctacagaggaccctagatccccacccgcatgctcttcctcgagctccagcttgttctctgccgtcgtagctagaagactgggtaggggctcggtcagcgactgtagtgatggcacctctgagcttgaagaacctctgggggaggacccacgtgcccgacctccagggccacctgacctaggggcatttcggggaccgcctctggccagattaccccacgatcctggcgtgtttagagtgtacccaagacctcgaggcggacccgaacccttgtcgccttttcccgtctccccactagccggtcctgggagtctgctgccgccacagctatcacccgcactgccaatgactcccacccatttggcctacaccccgtcccctacactatctcctatgtatcccagtgggggtggagggcctagtggcagcggcggtggctctcatttttcatttagccctgaagacatgaaacgctacctccaagcccacacccaatccgtgtataactaccatctttctccacgagcattcctgcactatcctgggttggtggtaccacagccccaaaggcctgataagtgtccgcttcctcctatggcacccgagactccccctgtgccatccagcgccagtagctctagctcttcctcgtcttctccatttaaattcaagctacagccccctccgttggggagaaggcagagggcggcaggggaaaaagcagtcgctggagccgataagtcgggcggatcagccggagggctcgctgaaggcgcaggggctctcgctcctccaccccctccgcctcaaatcaaggtggaacctatctccgagggcgaaagtgaggaagtagaagtcactgacatcagcgacgaggacgaggaggacggggaggttttcaagaccccccgagcccctcccgcaccccctaaacccgagcctggagaggctcctggggcttcacaatgtatgcccctcaaactgagattcaagaggcgctggagtgaagactgccgcctggagggagggggaggacctgcagggggattcgaggatgagggggaagacaagaaagtacgcggagaaggtcccggtgaggcgggaggcccacttacgccaagacgcgtaagctctgatcttcagcacgcaacagctcagctgtcattggagcatagggactcttag

SEQ ID NO: 27308 - DNA, 1530 bp, Artificial Sequence
  Description of Artificial Sequence: Synthetic coding sequence
atgggcgtcctgaaatttaagcacatcttcttcagatcctttgtcaaatcctcaggcgtctcccagattgttttcaccttcctcctgattccctgctgtctaactctgaacttccgggctccaccagtaattcctaacgtgccctttctctgggcctggaatgctccctcagaattttgcctgggaaagtttgacgaacccctggacatgtccctttttagttttatcggttctccccgaataaatgcaaccgggcagggggtcacaattttttatgtggaccgcctaggttattatccgtatatagacagtataactggagtgacagtgaatggcggaatacctcaaaaaattagcttacaggatcacctggataaggccaagaaggatatcacgttctacatgccagtcgataatcttgggatggcggtgattgactgggaagaatggcgcccaacctgggcacgaaattggaagccaaaagatgtgtataaaaatcgaagcatagagctggtgcagcagcaaaatgtacagctctcgctcacagaggccactgagaaggctaaacaggagttcgaaaaggccggaaaagattttctggttgagactattaagctgggtaaactgttaagaccaaaccacttgtggggctattacttattccctgactgctacaatcaccattacaagaagcctggctataatggatcttgtttcaacgtggagattaaacggaacgacgatctttcatggctgtggaatgagagcacagcactctacccctctatatatctcaacacccagcagtctcccgtagccgcaactctttatgtccggaatcgcgttagagaggctatcagagtatctaagattcctgacgcaaagtccccgctaccggtgttcgcctatacaaggatcgtttttacagatcaggttctaaaattcttgtcccaggacgaactggtgtatactttcggcgagaccgtggcgctcggagcctccggtattgttatctggggaaccctgagtatcatgcgttctatgaagtcttgcctacttcttgataactatatggaaactatcttaaatccatacattatcaacgtgacgctcgccgctaagatgtgttcacaagttttgtgtcaggagcagggcgtgtgtatccgcaagaattggaattcatcagactatctgcacttaaatccagataactttgccatccagttagagaaaggaggaaagtttacagtgagaggcaagcctactctcgaggatctggagcagttttctgaaaaattctactgctcctgttattctactctgtcatgtaaggaaaaggccgatgtgaaggatactgacgccgtagacgtatgcatagccgatggcgtctgcatagacgctttccttaaacctcccatggaaactgaagaaccgcaaatattttacaacgcaagcccctccaccctaagtgccaccatgttcatcgttagcatcctgtttctgatcatttcctcggtagcctctctctag

SEQ ID NO: 27309 - DNA, 1041 bp, Artificial Sequence
  Description of Artificial Sequence: Synthetic coding sequence
atggagacccaactctcaaatggcccaacctgcaacaacaccgctaacgggcctacaaccattaataataactgctcttcgccagtagactccggtaatactgaggattctaagaccaacctgattgtcaattatctcccccagaatatgactcaggaggaattgaagtctctctttggctcaataggcgaaatcgagagctgcaagcttgtgcgggataagataaccggccagagtctgggctacgggttcgtgaattacattgatcctaaagacgccgaaaaggccatcaacacgctaaacggtcttagacttcagactaaaaccattaaagtctcctatgctaggccatcatccgcttccatcagagacgctaatctgtacgtgagtggtctccctaaaactatgactcagaaggagctggaacaactgtttagccagtacgggagaataataacctcaaggatactcgtggaccaagtcacaggcattagccggggagtaggattcatccgctttgacaagaggatcgaggccgaggaggccattaaggggctgaatggtcagaaaccacccggtgccacagaacctattactgtgaagttcgccaacaatcccagccagaaaactaaccaggccatcctctcccaactgtatcaaagcccaaaccgacgatatcccggacccctggctcagcaggcacagcgcttccggttctctccaatgacgatcgatggaatgacatcgctggcaggcattaacattcccggtcatccaggaacgggatggtgcatcttcgtgtataatctggctccagatgccgacgaatctatactctggcagatgttcggaccattcggcgctgtcactaacgtcaaagtcatcagagactttaataccaataaatgcaagggcttcgggtttgtgacaatgaccaattacgatgaagccgcaatggcaatcgcctcccttaacgggtatcggctcggggatcgtgtactgcaagttagctttaagacaaacaagacccataaggcgtag

SEQ ID NO: 27310 - DNA, 1437 bp, Artificial Sequence
  Description of Artificial Sequence: Synthetic coding sequence
atggctcacgtgcccgcacggacttccccaggacccggaccccaattacttctgctgttactgcctttatttcttttgctcctgagggacgttgccggttcccacagggcacccgcatggtcagcacttcccgctgcggctgacggactccaaggagatagagacttacagcgccaccccggtgacgcggctgccaccctaggcccatccgcccaggacatggtcgctgtccacatgcatcgcctctatgagaagtatagccggcagggagccagacccggaggtggcaacaccgtgagatcttttcgcgctagactggaggtcgtggaccaaaaggcggtttacttctttaaccttacctcgatgcaagatagcgaaatgatcctaacggcaacatttcacttctattccgagccgcctcgctggcctcgagcactagaagtactgtgtaaacctcgcgcaaaaaacgcctcaggtcggccactgccacttggcccacccacacgccagcacctcctgttccggtccctgagtcagaacaccgccacacagggtctgctgcgcggagcgatggccctggccccacccccaagaggcctatggcaggcaaaggacatttcacccatcgtgaaagcagccaggagagacggggagctccttctgtccgcccagctagatagtgaggagcgtgaccctggggtgccaagaccctccccctacgcgccttacatacttgtctacgccaatgacctggctatctctgaacccaactccgtggcggtgacgctccagcgctatgatccattcccagccggtgatcccgaacctagggcggctccaaataacagtgccgatccgagggtgagaagagcagcccaggctactggcccactccaagataacgagcttccaggtctggacgaacgccctccgcgagcacacgcgcagcacttccacaagcaccagctgtggccatctcctttcagggccctaaagcctcggccagggcgaaaagatcgtagaaaaaaaggccaggaggtcttcatggctgcctctcaggtgctagacttcgatgagaagactatgcagaaagctaggcgaaaacagtgggacgagccaagggtgtgttcacggcgttacctcaaggtggatttcgctgacatcgggtggaatgagtggataatttcccctaagtcatttgacgcctattattgcgctggagcatgtgagtttcctatgccaaaaattgtccggccttctaaccatgcaacaatccagagcattgtccgcgctgtgggaatcatcccaggtatccccgagccctgttgtgtgcccgataagatgaactcgctgggtgtcctgttccttgacgagaatcggaatgtggtgctgaaagtgtatccgaatatgtccgtggacacttgcgcatgccgctag

SEQ ID NO: 27311 - DNA, 978 bp, Artificial Sequence
  Description of Artificial Sequence: Synthetic coding sequence
atggaatccaaaatgggagagctgccgcttgatatcaacattcaggagccaaggtgggatcagtcaacttttctcggcagggcaagacactttttcaccgtcaccgacccaagaaacctgctgctcagtggtgcgcaattggaggcgtctagaaatatagtgcagaattaccgggcaggcgtggtgactcccggaattaccgaggatcagctgtggcgcgctaaatacgtctacgattctgcttttcatccagacacaggcgaaaaggtcgtactgatcgggcgaatgtctgcgcaagtgccaatgaacatgaccatcactggttgtatgctgacattctaccgaaagacacccacagtggtgttttggcagtgggtcaatcagagttttaatgctatcgtgaattattctaataggtcaggcgacacccctatcacagtacgtcaactgggcacggcctatgtctctgcaactacgggcgctgtggctacagcactgggactgaaatctctgacgaagcacctcccccctttggtgggtaggttcgttcccttcgctgctgtcgccgctgcaaattgcattaacattccactgatgcgccaacgggaactgcaagtagggatcccagttgctgatgaggccggacagcgactagggtacagcgtaacagcagcaaagcagggaattttccaagtcgtcatctcaagaatctgtatggctattcctgccatggcaatccctcccttgatcatggatactctggaaaagaaagacttccttaaaaggaggccgtggctgggggctccacttcaggtggggctagtgggcttctgtctggtgttcgccacgcctctctgctgcgcgctgttcccgcagaaatcctccatccatattagcaatctggagcctgagctgcgagcgcaaattcatgagcagaacccctccgtcgaagtggtgtattataacaagggcctgtag

SEQ ID NO: 27312 - DNA, 1068 bp, Artificial Sequence
  Description of Artificial Sequence: Synthetic coding sequence
atggaacctcacctgcttgggctactcctgggcctgcttctaggcggtacacgagtcctggctggctatccaatctggtggagccttgccttaggccaacagtacacctctctcgggtcacagccactgctttgcggcagtattcctggtctcgtgccaaagcagcttagattttgccggaattatattgaaataatgccaagtgtagccgagggcgtcaaactaggcatacaggagtgccagcatcagttccgcggtcggaggtggaactgcacaacgatcgatgatagcttagccatattcggtcccgtgctggacaaggcaaccagagaatcggcttttgtgcacgccattgctagcgccggagtcgcctttgcggtgacacgctcgtgcgctgagggcacatcaaccatctgcggctgtgactcccaccacaagggaccacctggggagggctggaaatgggggggatgcagtgaggacgcagattttggggtgcttgtctcgcgggaattcgcagacgcgcgagaaaataggcctgatgctcgttcagccatgaataaacacaacaatgaggcaggacgcaccaccatcctggatcatatgcaccttaagtgcaaatgtcatggactgagtggcagctgtgaggtgaagacatgttggtgggcacaacccgacttccgggctatcggggacttcctgaaggataaatacgactccgcaagtgagatggtcgttgaaaagcacagggagagccgcggatgggtggagaccctacgggctaaatattccctctttaagcctcccactgagcgtgacctcgtctactacgaaaacagccccaatttctgtgagcccaaccctgaaactggcagttttggcacccgcgacaggacctgcaatgtcacatcacacggtattgacggatgtgacttgctgtgctgtggaaggggccataacacacggaccgagaaaagaaaggagaaatgccactgcatcttccactggtgttgctatgtctcctgtcaggaatgtattaggatctacgacgtccacacctgcaagtag

SEQ ID NO: 27313 - DNA, 1437 bp, Artificial Sequence
  Description of Artificial Sequence: Synthetic coding sequence
atggcagcgaggcctataactctgggtatcgatctgggcaccacttccgtgaaggcagccctgttgcgcgcagcgcctgacgacccgagtggtttcgcagtgttagcgagttgtgccagagcagcccgtgcagaggccgctgtcgagagtgccgtagctggcccacagggacgagagcaggatgttagtaggatccttcaggcactgcacgagtgcttagctgccttacctcggcctcaattgagatctgtggtcggcatcggggtttccggccagatgcatggcgtcgtgttctggaagacagggcagggatgcgaatggaccgaaggtggcatcactcctgtgttcgagccaagagcggtttctcacctggtgacctggcaggacggcaggtgttcatccgaattcctggcatcactgcctcagccaaagtcccacctctcggtggcaaccggattcggctgcgccacgattttctggcttctcaagtatagacccgagttcctgaagagctacgatgcagcgggaaccatccacgactatgttgtggctatgctgtgcggtctgccgaggccccttatgtcagatcagaacgccgcttcttggggttactttaatacccagtcccaatcgtggaatgtcgaaactctaagatcttctggattcccggtgcacctgctcccagatattgccgagcctggctcagtcgccggacgcacttcccacatgtggtttgagataccaaagggtacccaagtgggagtcgccttgggcgacctgcaagcctctgtctactcctgtatggctcagcggacagacgcggtgctcaacatcagcacatcagttcagctcgcagcatcaatgcctagtgggttccagccagcccagacccctgatcctaccgctccggtagcgtactttccgtatttcaaccgaacttacctgggagtagcagccagcctgaatgggggaaatgtgctcgcgacattcgtccatatgctggtgcagtggatggcggatctgggtctggaagtcgaggaatcaaccgtgtactcccgaatgatccaggctgccgtgcagcagagggatacacatttaacaatcaccccaaccgtgctgggcgaacgccacctgccagaccaattagcaagtgtgacacggatatcttccagcgatctgtccctggggcatgtaaccagggccttgtgtcgcggtattgtgcagaatctccacagtatgctgccaatccagcagctgcaggattggggggttgagcgcgttatgggaagcgggagtgccctatctagaaatgatgtgctcaagcaagaggttcagagagcttttccactgcctatgagttttggccaagatgtggatgccgctgtgggggcagctctggtcatgctccgtcgccatctgaatcagaaggaaagctag

SEQ ID NO: 27314 - DNA, 1578 bp, Artificial Sequence
  Description of Artificial Sequence: Synthetic coding sequence
atgcgacggagaaggcgtagagacggattttaccctgcccctgactttagagacagagaagcggaggatatggcaggcgttttcgatattgatctggaccagccagaggacgcaggcagcgaggacgagctcgaagagggcggacagctcaacgagagcatggatcatgggggagtgggtccttacgaactgggcatggagcactgcgagaagtttgaaattagcgaaacaagcgtgaacaggggaccagagaaaatccggccagagtgctttgagctcttacgcgtcctaggcaagggaggatacggaaaggtgtttcaggttagaaaagtgacaggcgctaatacagggaagattttcgctatgaaggtacttaaaaaagctatgattgtccggaacgcgaaggacaccgcccacactaaggctgagagaaacatccttgaagaagtgaaacaccccttcattgtggacctgatttacgcctttcagactggaggtaagctgtacctaatccttgagtacctcagcggcggagaactgtttatgcaactagagcgcgagggcatttttatggaggatacagcctgcttctacctggctgagataagtatggctctcggacatttgcaccagaagggcattatttatagggacctgaagccggaaaatataatgctcaaccatcagggccatgtgaagctcactgatttcgggctgtgtaaggagtctatccatgatggcaccgttacacataccttctgcgggacaatagagtacatggccccagaaatacttatgagaagcggacataaccgagctgtcgactggtggtcgctcggcgcacttatgtatgacatgctaacaggcgctccgccatttaccggcgaaaaccgaaaaaagacgatagacaaaatcctgaagtgcaagttaaacctgcctccttaccttacgcaagaggccagagacctcctcaagaagctcttgaagaggaatgcagcctccagactgggcgctggccctggtgatgccggagaagtacaggctcacccttttttcagacacataaattgggaggaactactggcccgaaaagtggagccccctttcaagcctttactccaatctgaggaagacgtgtctcagtttgattcaaaatttacccgtcagaccccggtggattcaccagacgattctactctatcagaatccgccaatcaggtgttcctaggattcacctacgtggcccctagtgtactcgaatccgttaaggagaaattcagctttgagccaaagatacgttccccacggcgtttcatcggctctcctcgcacccctgtatccccagtcaagttttcccccggagatttctggggaaggggggcttccgccagcaccgctaatccccagacccccgtggagtacccaatggagacctctgggatcgaacagatggacgtgaccatgtccggcgaagcgtctgccccattacccatacgccagcctaacagcggcccatataagaagcaggcattccccatgatttcaaaaagaccggaacatcttcggatgaacctctag

SEQ ID NO: 27315 - DNA, 987 bp, Artificial Sequence
  Description of Artificial Sequence: Synthetic coding sequence
atggcaagaacagtggtactgatcaccggttgcagctcaggaattggcctccacctagcagtaagacttgcctctgaccctagccagtcgttcaaggtgtacgccacactgcgggacctgaaaacacagggtagactctgggaggcagcgagagctttggcatgcccccctggtagcctggaaacattgcagctagacgtaagggactctaagtcagtagccgctgctcgggaacgagtgactgagggccgagtggacgtgctggtctgcaacgcaggcctcggacttctgggaccgctcgaggccctcggcgaagacgctgtcgctagtgtgctggatgtgaatgttgttgggacggtgcgcatgctgcaagcctttctgccggacatgaagcgtcgtggttctggacgggtcctcgtcaccgggagtgtcgggggactgatggggctgccattcaatgacgtatactgtgcttccaaattcgcattagaaggcttgtgtgaatcactcgccgtcctgctgctcccctttggggttcacctcagtctgattgaatgtggcccagtccatactgccttcatggaaaaggtgctaggatctcctgaggaagtgctggatcgcacggatatccatacttttcacagattctatcaatatttagctcacagcaaacaggtctttagagaggctgcccagaacccggaagaggtcgcggaggtgttcctcacggcactgagagctccgaaacccacactgcggtacttcaccactgaacgttttttgcccttactgcggatgcggctcgacgatccgagtggatcgaattacgtcactgcaatgcaccgagaggtcttcggcgatgtccctgctaaggcagaggctggtgccgaggccggtgggggtgccggaccgggagccgaagacgaagctgggaggggagccgtgggagaccctgagctgggagacccacctgccgcaccacagtag

SEQ ID NO: 27316 - DNA, 1626 bp, Artificial Sequence
  Description of Artificial Sequence: Synthetic coding sequence
atgccagggctgcgccgagacaggctgctgacccttctcttactgggtgcactcctctcagccgacctttattttcacttgtggccccaggtgcagaggcagttgcgccctcgagaaagaccacggggttgcccatgcactggcagggcctcatcactggcaagagatagtgcagccgctgcgagcgatccaggaaccattgtacataacttttctcggaccgaaccacgcacggagcccgcaggtgggtctcactctggttccagttctaagttgcaggccctcttcgcccatccgttgtacaatgtgccggaggagcctcctctgctgggggctgaggactccctgctcgcctctcaggaggcccttagatattaccgccgaaaagttgcaagatggaatcgcagacataaaatgtaccgcgagcagatgaacttgactagcctcgacccccctctgcagctcaggctggaagcttcttgggtgcaattccaccttggcatcaatcgccatggactgtactccagaagttctcctgtggtcagtaaactgctgcaggatatgcggcactttcctacaatctcggccgattatagccaagacgaaaaagctctgttaggagcttgcgactgcactcagatcgtgaaacctagcggcgtccacctgaaacttgttcttcggttttccgattttgggaaggccatgtttaagccaatgcggcaacagcgggatgaagagacacccgtggactttttttactttatagacttccagagacataacgccgaaattgcagctttccacctggataggatcctggatttcaggcgagtgcctccaaccgttgggagaattgtgaatgtgaccaaggaaatcctggaagtaaccaagaacgaaatcctgcagtccgtgttcttcgtttctcccgcttcaaacgtatgtttctttgccaaatgcccttacatgtgtaaaacagaatacgccgtctgcggcaacccccaccttttggaggggagtttgtccgcttttctcccatctctcaatttggctcctagactgagcgtgccaaatccctggattcggagttatactctagccggtaaagaggagtgggaagtgaatcccttgtattgtgatactgtgaagcagatctatccttacaataattcccagcgtctgctgaatgtgatcgatatggcaattttcgattttctgattgggaatatggatcgccatcactatgagatgtttactaagttcggcgatgacggcttcctgatacaccttgacaatgccagagggtttgggagacattcacacgatgaaatctctattctttcaccgctgtcacagtgctgtatgataaagaagaagactcttctgcatctgcagcttcttgcacaggccgactatcgactttccgatgtgatgcgcgagagtcttctggaagaccagctgagtcccgtactgaccgagcctcatctgctcgcactggataggcggttgcaaacaatccttcggacagttgagggctgcattgtagctcacggccaacagagtgtgatagtcgatggccctgtggagcagctggccccagattctggccaagctaatctcacaagctag

SEQ ID NO: 27317 - DNA, 954 bp, Artificial Sequence
  Description of Artificial Sequence: Synthetic coding sequence
atgaagacggctttaatcttgctgagcatcttagggatggcctgcgccttctccatgaaaaacctgcataggcgggttaagatcgaagacagcgaggagaacggtgtatttaaatacaggcccaggtattacctgtacaagcatgcgtacttctacccgcatttaaagaggtttcccgttcagggatctagcgactcctccgaagaaaacggcgacgactctagtgaggaggaggaggaagaagaggagacctctaacgagggggaaaataacgaggagtctaatgaggatgaggacagtgaggcggagaacacaaccttaagcgccactacactcggatatggggaggacgcaaccccgggtaccggatacaccgggcttgctgcaatccagctccccaagaaagctggagatattacaaataaggccaccaaagagaaagaaagtgatgaagaagaagaggaggaggaggagggcaatgaaaatgaggagtcggaggctgaagtggatgagaacgagcaaggtattaatggaacgagtacaaattccacagaggccgagaatggaaatgggtcgtctggcggagacaacggggaagaaggcgaggaagagtccgtgaccggggcaaacgccgaagatacaactgagaccggcagacaggggaaaggaacatctaaaaccactaccagcccaaacgggggatttgagcccacaaccccacctcaggtttatcggacaacgagtcccccattcggcaagacgactacggttgagtatgagggtgagtatgagtacactggggctaatgaatatgacaacggatacgagatttacgagagtgaaaatggtgagcccagaggcgataattaccgggcttacgaggatgaatatagttactttaaagggcagggctacgacggctatgacggacagaactactatcatcatcagtag

SEQ ID NO: 27318 - DNA, 345 bp, Artificial Sequence
  Description of Artificial Sequence: Synthetic coding sequence
atgtctttgccttcttcgcgtgcagccagggtgcccggacccagcggctcactttgcgccctcctagccctcttgctgctgctgactccacctgggccactggctagcgccggtcctgtgtcagcagtgctcacagagctgcgttgcacatgcttgcgagttaccttgagggtgaatcccaagaccattggaaaactgcaggttttccctgccggtccccaatgcagtaaagttgaagtagttgcgtcgctcaagaatgggaaacaggtttgtctggatccagaagcaccctttctgaagaaggtaatccagaaaatcctggacagcggcaataaaaagaactag

SEQ ID NO: 27319 - DNA, 2100 bp, Artificial Sequence
  Description of Artificial Sequence: Synthetic coding sequence
atgccttcactgtggcgggaaattctgctagaaagcctgctggggtgtgtcagctggtctctctaccatgacctaggacccatgatatattattttcccctgcagacactggagctgacaggattggaggggttttctattgcgtttctgagcccaatctttctcactattaccccgttctggaagctggtgaataagaagtggatgctcaccctgctcagaataattaccattggctctatcgctagtttccaggctccaaacgctaaactgaggctgatggtgctggctcttggagtctcaagttccctcatcgtgcaagccgttacctggtggtcagggagccacttacagagatacttgagaatatggggtttcatcttaggccagatagttctggttgttctgcggatctggtacacaagtctgaatccaatttggagttatcagatgagcaacaaagtgattctgactctgtctgccattgcaactttggatcggataggaaccgatggtgattgtagtaagccggaggaaaagaaaaccggcgaggtagccacaggcatggcgtccaggcccaactggctgctcgctggagccgcttttggaagtcttgtgttcctcacacactgggtcttcggcgaagtgtctttggtgagccgatgggccgtctctggacatccccacccaggacccgaccccaacccctttggcggagcagtgctcctttgcctggcatcaggtctgatgctgccaagctgcctttggttccggggtacaggtctgatttggtgggtgaccggaacggctagtgccgctgggttgctgtatttacacacttgggctgcggctgtttcaggctgtgtcttcgcaatctttacagccagtatgtggccccagacactgggacatttaatcaatagcgggaccaaccccggtaaaacaatgactatagcaatgattttctatttgttggagatcttcttctgtgcttggtgcactgccttcaagttcgttcccggaggcgtctatgctcgtgagcggagcgacgtgctgctcggtactatgatgcttatcatcggactcaacatgctgttcggccctaagaaaaacctcgatttgttgttgcagacaaaaaactcaagcaaagtgctgtttcgcaagtccgagaagtacatgaaacttttcttgtggctgctcgtaggagtgggtctgctggggctgggcctgaggcataaagcttatgaaagaaagctcgggaaggtcgccccaactaaagaggtgagcgcagcaatctggccattccgatttggctatgataacgaaggatggtcgtcactggagagaagtgcacaccttctcaacgagacaggggcagattttatcacaatcctggagagtgacgcgtccaagccctatatgggtaacaacgacctgaccatgtggcttggcgagaaacttgggttctacaccgacttcggcccttctactcgctaccacacctgggggatcatggcgctgtcccgatacccaatcgtgaagagcgaacaccacttgctgcctagccctgagggagagattgctcctgccattacactgactgtgaacattagcggaaaactcgtggacttcgtagtgacacactttgggaatcacgaggatgacctggatcggaaactgcaagctatcgccgtgagtaagctgttaaagtcctcaagcaaccaggtgatttttctgggatacattacctctgccccaggctcccgcgactacctgcagctgacagagcatggtaatgtcaaggacattgactctacagatcacgaccggtggtgtgaatacatcatgtaccgcggacttatcagactcgggtacgcaaggatttcacatgccgagttgagtgattccgagattcagatggctaaattcagaattcctgatgatccgactaattatagagataaccagaaggtcgtcatcgaccacagggaagtgagcgaaaagattcactttaatccaagattcggctcttataaagagggccataactacgaaaataatcaccatttccacatgaatacacccaaatacttcttgtag

SEQ ID NO: 27320 - DNA, 1449 bp, Artificial Sequence
  Description of Artificial Sequence: Synthetic coding sequence
atgctcttcgaaggtaaagtgaatccacagactcagagcctgcttgccgaatgtggcgagtggacgagacgatccctacatttaagagtgctgggtagacagcttattctcccaactgataagggggtgcaacactttcaggggagcacgccggcatctgccgtgcatcggcctcctctgtctgcctgtggccactcaagtaacattcgggagctttgcatctcaggtagccagattgtgccagctgctcttagtgcctctgctctgccgggtcctgacgacacaggcgttgcagatctgactgcacggtctagcttggaagaagaggtataccatgttgatgggaagatcgaggagtattttgcctttgatcgtaaagaggatgatgatgagtgcttggagcagaagcccgcacagccgggacggaagtggaggaaactgggtctccctccagtgagtccacgcgattgtgtgaaagatgccgttgctgctgaagtgtttgaccacgtgtggaccaatatggtagagctattggaggagctgataaggaagcactgggaaaccactttaaccgagggaaagaaacagagggaaacactgaaagttgctggcaataggttccctcatgtcctggttccgcacgctcacgcggacggcgcatcaggccctccgtcaggccatgccgaggctcacggcattagcctcgcaagcagattaaaccctccccaaatccaccacttctcaagctcattttactcagacatgaatggggtgatgacaattcaagctaaacctctgcagcgccgacctgcatatttcgctgacagaactcagaacgagaaagaggacaaagcttcggggggaggcgctggcgcactgagctctgcgccacatagacttgggagagcaagtgatacccacggactcagcccctctgcaaaaaagacaccggtaccttggcgtctccccagccttgctagtgacagtcagagactaaaaacgcctaatatttactcagacgaagtgctgaggggaacgaagctgcctactggcgtagaccacatggcctccccactggtgcagacgagtcgaagtagattccctccgctggtaaccgagaccaggggtcaaaatacagctgtccctggttgtaggctggtgagttataggggccgtcatctccagaatcgcgtccttagcgcaatgcctgacggcacagaacggtccaggcttagagaaagaactgcaactttggagcggctgtcaagaccttcaaccacccatactttccgacagagtgacacgcccagaaagtccagtctcacccaaatggagtttgctgcccacacctggacgggccagtcaatcttgaccggaagccagtacgtgcccaagtcattccaaagaaccacactcaccttcaagcggaggttccaggtgaccagttag

SEQ ID NO: 27321 - DNA, 1392 bp, Artificial Sequence
  Description of Artificial Sequence: Synthetic coding sequence
atgggagccggaccaagtctcctgcttgccgcactgcttctcctgttgagcggagacggcgctgtgaggtgcgatacccctgctaattgtacttacttggatttactcggcacctgggtgtttcaggtgggctcctccgggtctcagcgagacgtgaattgctccgtgatgggccctcaagaaaaaaaggttgtggtctacctgcaaaagcttgacacagcatacgatgatttgggaaacagtgggcactttacgattatatacaaccaggggttcgaaattgtgttgaatgactacaaatggttcgctttctttaagtataaggaggaaggcagcaaagtgaccacttactgtaacgaaactatgactgggtgggttcatgacgtccttggcaggaactgggcatgttttaccggtaagaaggtgggcaccgcttccgagaacgtatacgtgaatatcgcccacttaaaaaattcccaggagaagtactcaaatcgattatacaaatacgaccacaacttcgtgaaggcgattaatgccatccaaaagtcatggactgcaacaacatacatggaatacgagactctgaccctaggagatatgattcgtcggagtggaggtcactcgcgcaagattccgcgacccaagcctgccccattgacagccgagatccaacagaagatcttacatctgccaacttcgtgggattggcgcaacgtgcatggcattaacttcgtttcacccgtaagaaatcaggcgagttgtggcagttgctattcgttcgcatccatgggcatgctggaagctcgcatcagaatcttgaccaacaattcgcagacgcctatcctgagcccccaagaagtcgtcagctgctcgcagtatgctcaaggatgtgagggagggttcccatacctgattgctggtaagtacgcacaggactttggtctggtggaagaagcatgcttcccctacactggcaccgacagcccctgtaagatgaaggaggactgtttcaggtattattccagtgaatatcattacgtcgggggattttatggcggatgcaatgaggctctgatgaagctggaattggtccaccacggccctatggctgttgcattcgaggtgtacgacgatttcttgcattacaagaaagggatttaccatcacactggattgagagaccccttcaatccttttgagctcacaaatcatgccgtgcttctggtgggctatgggaccgacagtgcctccggaatggactattggatcgtgaagaatagctggggcaccggctggggtgagaatggctactttcgcattcggaggggtacagacgaatgtgccattgaatctatagcagtcgcagctactcccatccccaaattatag

SEQ ID NO: 27322 - DNA, 1941 bp, Artificial Sequence
  Description of Artificial Sequence: Synthetic coding sequence
atgtctaaaggccctgccgtcgggatcgatctggggacaacctattcctgtgtcggcgtatttcagcatggaaaagtagaaataatcgctaacgaccaaggcaacagaaccactccctcatatgttgcctttacagatactgagagacttattggagacgcagctaaaaaccaggtagctatgaaccctaccaatactgtgttcgacgcgaagagattaattggcagacgctttgatgacgccgtggtgcaatctgacatgaaacactggccgtttatggtagtgaatgacgctgggaggccgaaagtacaggtggaatataagggagagacgaaatcattctatccagaggaggtgtctagtatggtcctgacgaagatgaaggagatcgccgaagcatatctgggcaagaccgtaaccaatgccgtggttaccgtgcctgcttattttaacgattcacagcggcaggccactaaggatgcaggtaccattgcaggcctaaatgtgcttagaataattaatgagcctactgctgcggcaatcgcctatggtcttgataagaaagtcggcgctgagcgcaacgttctgatattcgacctaggcggaggcacgttcgacgtctcaatacttacaattgaagatggaatttttgaagtaaagtctactgctggtgacacgcacttggggggagaggacttcgataatcgcatggtcaatcatttcatcgccgagtttaagaggaaacacaaaaaggatatctctgagaataaacgggctgttagaaggctgcgcactgcgtgcgagcgcgcaaagcggacactgagcagctcaacccaagcctccatcgagatcgatagtctctatgaaggaattgatttctacacttctatcacccgcgcacgctttgaggagctgaacgcagacctcttccgtggcacactcgatcccgtcgagaaggctctgcgcgacgccaagttggataagagccagattcacgacatcgtgcttgtgggaggatctacccgcatcccgaagatacagaagctcctccaggacttcttcaacggcaaggagttaaacaaatccataaaccccgacgaggccgttgcatacggggcagctgtgcaagccgcaattttgtctggggataagtctgagaacgtgcaggacttgctgctgctggatgttacccctctgagccttggaatcgagaccgccggtggtgtcatgaccgtgctgataaagagaaatacaaccatccctaccaaacagacccaaactttcactacgtacagcgacaaccagcccggtgtgctgatccaggtctacgagggggagagagccatgaccaaggacaacaacctcctaggcaagttcgaactcacaggcatcccacctgctccgaggggtgtcccacagattgaggtgaccttcgacatcgacgctaatggtattctcaacgtttctgctgtggataaatccactggcaaggaaaataagatcaccatcaccaacgataaggggagactgagcaaggaagatatcgaaagaatggtgcaagaggccgagaaatacaaagctgaggacgagaagcagcgcgacaaggtgagctctaagaactcattagaatcgtatgcctttaacatgaaggcaaccgtcgaggacgagaagctgcagggcaagatcaatgatgaggataagcagaagattctcgataagtgtaacgaaatcattaactggctggataagaaccagaccgccgagaaagaggaatttgaacatcaacagaaagaactcgagaaagtttgcaacccaatcatcacaaaattgtaccagagtgcaggagggatgccaggcggaatgcccggtggctttccaggcggaggggcacctccctccgggggagcctcatctggacccactatcgaagaggtagattag

SEQ ID NO: 27323 - DNA, 1017 bp, Artificial Sequence
  Description of Artificial Sequence: Synthetic coding sequence
atgtgggaggcaaacccagagatgtttcacaaagcagaagaactgttttctaagactaccaataacgaggttgatgacatggatacatctgacacacaatggggctggttctatcttgcagaatgtgggaaatggcacatgtttcagccagacacaaattcccagtgcagcgtgtctagtgaggacatagaaaagtctttcaagaccaatccctgcggcagcattagttttaccacttctaaattttcatacaaaatcgatttcgcggaaatgaaacagatgaatcttacaactggaaagcaaagacttatcaaacgggcacccttttcgatatccgccttctcttacatttgcgagaatgaggctattccgatgcctcctcactgggagaacgtgaacacccaagtcccttatcagctgatccctctgcacaaccagacccacgaatacaacgaggttgcgaacttgtttggcaagacaatggaccggaacagaatcaaacggattcagcgaatccagaacttagatctctgggaatttttttgcagaaagaaggcacaactcaagaagaaacgaggggtcccccagatcaacgagcagatgctgttccacggcactagctcggaattcgtggaagccatctgtatacacaactttgactggcggataaacggcatccacggagccgtcttcggcaaaggaacgtacttcgctcgggatgcagcctattcctcgagattttgcaaagacgatattaaacacggcaatacatttcagattcacggcgtgtccctccagcagcggcacctgtttaggacatataagtcaatgttcttggcacgggtcttgattggggactatataaatggcgattctaaatatatgagaccaccgtcaaaagatggcagctacgtcaatttgtacgattcatgcgtagacgatacatggaacccaaagatctttgtcgtctttgatgcaaatcagatttatccggaatatctgattgacttccactag

SEQ ID NO: 27324 - DNA, 1059 bp, Artificial Sequence
  Description of Artificial Sequence: Synthetic coding sequence
atggttcgccctgtccgccataagaaaccagtgaactactcacaatttgatcactcagactctgatgacgattttgtcagtgcaaccgttccccttaataaaaaaagccgcactgctccaaaagagctgaagcaggacaagcccaaaccaaacctcaataatctccgtaaggaggagatcccagtgcaagagaagacaccaaaaaagcggctgcctgagggcactttttctatcccagcatcagccgtaccctgcaccaagatggccttggacgacaaactctaccagcgcgacctggaagtcgcccttgctctgagcgttaaggagctccctactgtgaccacaaacgtgcaaaactctcaggacaaatctatagagaaacatgggtctagtaagatcgaaactatgaacaagtccccgcatatatcaaattgctccgtggcttctgactatctggacctggacaagataacggtggaagacgatgtgggtggggtgcagggtaaacgaaaggcagcatctaaggccgctgcccagcagagaaaaattctgttagaggggtccgatggcgatagcgccaacgatacagagcctgatttcgcccctggagaggattccgaggatgactctgatttctgtgagtccgaagataatgatgaggatttttctatgagaaaatctaaggtgaaggaaatcaagaaaaaggaagttaaggtcaaatcccccgtcgagaagaaagagaagaagtcaaaatcaaagtgcaatgcactggtgacttcggtggacagtgctcccgctgctgttaagagtgagtctcagagcctcccaaagaaggtgagcctgtcctccgatactacccggaagcccttagaaatccgcagcccatccgccgagtccaagaagcccaagtgggtgccacctgccgcaagcgggggtagtaggtccagttccagcccgttagttgtcgtgtctgttaaaagcccgaaccagtctttgcgccttggactctcgcgattggccagggtgaaacctcttcatccaaatgcgacaagtacctag

SEQ ID NO: 27325 - DNA, 1488 bp, Artificial Sequence
  Description of Artificial Sequence: Synthetic coding sequence
atgaccgtcatgtctggcgaaaatgtggatgaggcctccgctgccccaggacatccccaagacgggagttacccgagacaggcagaccacgacgaccacgagtgttgtgagcgcgtggtaattaatattagcggattacggtttgagactcaactgaagacactcgcacagtttccgaataccctgctgggcaatccaaagaagaggatgaggtactttgacccactcaggaacgagtattttttcgatcggaacagaccctctttcgacgccattttgtattattaccaaagcggagggaggttgagaagacctgtgaacgtacccctagatatgttctcagaggaaatcaaattctacgagctcggagaagaggccatggaaaagtttcgggaagacgaaggttttattaaggaagaagagcggccactgcccgagaaggagtaccagcgccaagtgtggctgctctttgagtatcctgagtcttcaggtcctgctcgagtcatcgccattgtgtcagtgatggttattcttatttccatcgtgattttctgcttggagacccttcccgagttaaaggacgataaagactttactggcacagtgcataggattgacaataccacagtcatctacaatagcaacatctttacagacccttttttcatcgttgaaacactgtgtattatatggtttagcttcgagttagtcgtgcggttcttcgcctgcccttccaagactgacttctttaagaatattatgaatttcatcgacatcgtcgccattataccctacttcatcacattaggtacagagatcgctgagcaggagggcaatcagaagggagaacaggccacatcccttgccatccttagagtcatcagactggtccgagtcttccgcatttttaaacttagtcgtcactccaagggacttcagatcctgggacagaccctcaaggcctctatgcgggagttgggtctccttattttctttttgttcattggcgttatcctgttttcaagtgctgtttattttgctgaggctgaggaggccgagtctcatttctcctcgattcccgacgcattttggtgggccgtggtgtccatgactaccgttggctatggtgatatgtatcccgttacaatcggcggaaagattgtggggtccctgtgtgctatcgctggcgtcctgacaatcgccctgcctgtgcctgtcatcgtgtctaactttaactacttttaccatcgggaaacagagggggaggagcaggcacagctcttacacgtgtccagccctaatctggcatctgacagcgacttgagcaggcgttcctcttcaacaatgtccaagtctgagtatatggagatcgaggaagatatgaataattctattgcccactatcgccaggtaaacattaggactgcgaactgtaccaccgccaaccagaattgcgtaaataagtctaagctgctgaccgatgtttag

SEQ ID NO: 27326 - DNA, 1632 bp, Artificial Sequence
  Description of Artificial Sequence: Synthetic coding sequence
atgagaaagccagcagcaggctttctcccctcccttcttaaggtgctgctgctacctctagcacctgcggctgcccaggattccacccaggccagtacccccggatccccactctcacctaccgagtatgagcggtttttcgccttactcaccccaacctggaaagccgagactacatgccgactgcgagctacacatggatgccgaaaccccaccctggtgcagctggaccagtatgagaatcacgggctagtcccagacggcgctgtgtgttcaaatctgccatacgcttcttggtttgagtctttttgccaatttacacattaccggtgctcaaatcacgtgtactacgcaaaaagggtgctctgctcccaacctgtgagtatcttgtcaccaaacacgctgaaggaaattgaggctagtgccgaggtaagtcccactaccatgacttctcccatttccccgcactttaccgttaccgagcggcagacctttcagccctggccagagaggctgagcaataacgtggaagagctgcttcaatcaagtctttccctgggaggccaggaacaggcccctgagcacaaacaagagcagggcgtcgagcaccgccaggaacctacgcaggagcacaagcaggaggagggccagaagcaagaagaacaggaagaggagcaggaggaggagggaaaacaagaggaaggacagggtactaaagagggccgagaggcggtatcacaattgcagaccgatagtgaaccgaagtttcactcggaatctcttagttctaacccctcatcattcgctccgagagtgcgcgaggtcgaatctacacctatgattatggagaatattcaagaactcattcggagcgcgcaggagatagatgagatgaatgaaatctatgatgagaactcatactggaggaatcaaaatcccggaagcctgctgcagctgcctcataccgaagccctgttagtgctgtgctactcaatagtcgagaacacttgcatcattactcccaccgcgaaggcttggaagtacatggaggaggagattctcggttttgggaagtccgtatgtgattctcttgggcgtcgccacatgtcaacgtgtgcactgtgtgacttttgcagcctgaaactggagcaatgccatagtgaagccagcctgcagcgacagcaatgcgatacctcacacaaaacacctttcgtcagtcccctactggccagccaaagtttgagcattggaaaccaggtcggtagccccgaatcaggcaggttctatgggctggacttgtatggcggtctgcatatggatttctggtgcgcacgcctcgccacaaaggggtgtgaggacgtgagagtcagtgggtggctgcagaccgagtttctctctttccaggatggcgattttccgacgaaaatatgtgacacagattatatacagtatcccaattactgtagttttaagtcacaacagtgtctgatgaggaacaggaatcggaaggtgagtagaatgcgctgcctccagaacgagacttactccgccctgtcacctggcaagtccgaggacgtagtgcttcgatggagccaggagttctccacccttaccctcggccagttcggttag

SEQ ID NO: 27327 - DNA, 666 bp, Artificial Sequence
  Description of Artificial Sequence: Synthetic coding sequence
atgtcgggatgggctgacgagagaggcggtgaaggcgacggaaggatttacgtcggcaatctgcccaccgatgttagggagaaagaccttgaagaccttttttataagtatggaaggatcagggagattgagttaaaaaatagacatggcctcgttcccttcgctttcgtcagattcgaagatccacgcgatgccgaggacgcgatctatggtcggaacggatacgactatgggcagtgtcgtctccgggtggagttccctagaacctatggcggtcgaggtggatggcctaggggtggtagaaatggcccacctacgaggcgatctgactttcgggttcttgtctcagggctgccgccatccggaagttggcaagacctgaaggaccacatgcgcgaagcaggagacgtctgctatgcagatgtccaaaaagacggggtcggcatggtcgagtatctgaggaaggaagacatggagtacgctttacgtaaactcgacgatacgaagttcagatcccacgaaggagaaacatcatatatacgcgtctaccccgaacggagtacctcctatggctattcgagatctagaagcggtagcagggggagggatagtccctaccagtccagaggctcaccgcactatttctctcctttcagaccctattag

SEQ ID NO: 27328 - DNA, 2523 bp, Artificial Sequence
  Description of Artificial Sequence: Synthetic coding sequence
atgagcgctttccgcctttggccgggacttctgattatgctcgggtctttgtgccaccgtggatccccatgcggtttgtccacacatgtggaaattggtcatcgcgctctggagtttctccagcttcataacggtagagtgaactatagagagctgttgctggagcatcaggatgcatatcaagccggaattgtttttcctgattgcttttacccttctatctgtaaaggcggaaagtttcacgatgtgtccgagtccacgcattggacacctttcctcaacgcaagcgtccattatatcagagagaattatccactgccatgggagaaagatactgagaagttggtggctttcctgtttggaatcacttcccatatggccgcagatgtttcttggcattcattaggactggagcagggcttccttagaacaatgggcgctatcgactttcacggcagctactccgaggcgcatagcgctggggacttcggcggagacgtcctgagtcagttcgaattcaatttcaactacctggcgcgacgatggtatgtgcctgtgaaggacctccttgggatttacgagaaattgtatggcaggaaggtaataaccgagaacgtgatagtagactgctcccatatacaattcttagaaatgtacggcgaaatgttggcagtaagcaaactgtaccctacttacagcaccaagtcgcccttcttggtagaacagtttcaggagtacttcctgggtggtctggacgacatggcgttctggagtacgaacatctatcatctgacgagttttatgcttgaaaatggcactagtgattgtaacctccctgagaaccctctgttcattgcctgtggtgggcagcagaaccatacccaagggtcaaagatgcagaagaacgactttcaccgaaatcttaccactagccttacagagagcgtcgatcgcaatattaactacacagagcgcggtgtttttttcagcgtgaactcttggacccccgattcaatgtcttttatctacaaagccctggagcgcaacattcgcacaatgttcatcggagggagtcaactgtcacagaagcacgtgagttctcctctggcctcatacttcctttcctttccatacgcacgcttgggatgggccatgacaagcgctgacctgaatcaggatggccatggcgatctggttgtcggcgctcccggttatagcagaccaggccacatccatattggcagggtgtaccttatctacggaaatgacttggggctaccacctgtcgacctggacttggataaagaagcccataggatcctcgagggattccagccctctgggagattcgggtcagccctggccgtgctggactttaacgtggacggcgtgcccgatttggccgtaggggctccttctgtaggaagcgagcagctgacatacaagggggctgtgtacgtgtattttgggtctaaacagggtggaatgtcaagctcacccaacatcactatctcatgccaggacatctattgcaacctgggctggacccttctcgctgccgacgtaaacggtgacagcgagcccgatctcgttatcgggtcaccttttgcaccagggggagggaaacagaaggggatagtcgccgcattttatagcggcccttctttaagcgacaaagaaaagctgaatgttgaggccgcaaattggaccgtccggggtgaagaggatttttcatggttcgggtacagcttacacggagtgacagttgataacaggaccttgcttctggtcggctcccctacatggaagaatgcaagtcggttgggccacctcctgcacatcagggatgagaagaagagtctgggccgagtgtatggctattttccacccaatgggcagagctggttcaccatcagtggcgacaaagcaatgggcaagctggggacctctctctcgtcagggcacgttttgatgaatggcaccctgaaacaggtgctgctggtgggggctccgacatacgacgatgtgagcaaggtggctttcctgacagtcaccctccaccagggcggagccacgcgaatgtatgctctgacaagcgatgcccagcccctgctcttgagtaccttctctggggaccggagattctccagattcggaggagtcctgcatctatctgacctggatgacgatgggctggatgaaataatcatggccgctcccctgcgcattgctgatgtgaccagcggcctcatcgggggagaggatggcagagtttacgtttacaatggcaaggagacgacactgggcgatatgactggcaagtgcaagagctggatcacaccttgcccagaggagaaggcccaatatgtgttgatctcacctgaagctagtagtcgctttggcagctctcttataaccgtaaggtccaaagcgaagaaccaggtcgtcattgctgccggtcgttcctctctaggagccaggctgagcggagcgctgcacgtgtactccctcggcagcgactag

SEQ ID NO: 27329 - DNA, 972 bp, Artificial Sequence
  Description of Artificial Sequence: Synthetic coding sequence
atgaagtcggcattgttcaccaggtttttcattctattaccgtggattcttatcgtgatcataatgctagacgtcgacacccggcgtccagtgccccctttgacgcccagaccgtactttagcccatacgccgtcggcaggggtggcgctcgcctacctctgcggcgaggtgggccagcgcacggaacccaaaaacgcaatcagagccgcccacaacctcagcctgaacctcagttgccaacaatctacgcaatcacacccacctacagccgccctgtccagaaagccgagcttacacgactggccaatacttttcgccaggttgcccagctccattggatccttgtcgaggatgctgctgccaggtctgagttggtatcgcggttcctggcacgtgcgggtctccctagcacccacctgcacgtgcctacgcctcggagatacaagaggccaggactcccgagagctaccgagcagagaaatgcaggtctggcatggttgcggcaaaggcatcagcaccagcgggcacaacctggcgttctgttttttgctgatgacgacaatacctattctttagagctgttccaagagatgcggacaacacgaaaggtgagcgtatggcctgttggcctagtcggtggacgcaggtatgagaggccactggttgaaaacggaaaggtggtcggctggtacaccggatggagggcagaccgccctttcgcaatcgatatggctggattcgctgtgtccctgcaggttattctgagcaatcccaaggccgtgttcaagaggaggggaagtcagcccggaatgcaggagtcagatttcttgaagcaaataacaacagttgaagaattggagccaaaggccaataattgcacaaaggtgctggtgtggcacacgcgcactgagaaggtgaatctggccaacgagccaaagtatcacctggatacagtgaaaatagaagtttag

SEQ ID NO: 27330 - DNA, 3213 bp, Artificial Sequence
  Description of Artificial Sequence: Synthetic coding sequence
atgggagccgctcggggttctccagccaggccccgaaggctacctctgctgtctgtcttgctgttaccgcttcttggagggacccagacggctatcgtgttcataaaacagccttctagccaggatgctttacagggccgacgggcattacttcgctgtgaagttgaagcacccggacccgtccacgtctactggctattagatggtgcgccagtgcaggataccgagcgtaggttcgctcagggcagttcactgtccttcgccgctgtagacaggcttcaagattcaggaaccttccaatgtgtggctcgagatgatgtgactggcgaggaggccagatctgccaatgcctcttttaatatcaagtggattgaagcaggccctgtagtcctgaagcatcctgcgagtgaggccgagatccagcctcaaacacaggttactctgagatgccatatcgacggtcacccccgtcctacttaccaatggtttagggacggaactcctctctcggacggccagtctaaccatacagtttcttctaaagaacgcaacctaacgttgagacccgcaggtccagagcattctggcctgtattcttgctgtgcccatagtgcctttgggcaggcgtgttcatcgcagaatttcaccctgagcattgcagacgagtcttttgctcgggtggtgctggcccctcaggatgttgtggtcgctaggtacgaagaggcgatgttccattgtcagttttccgcccagccccctccctctctacagtggctatttgaggacgaaacacctatcacaaaccgctcacgcccaccgcatctgaggagagccactgtttttgccaatggctccctgctgctcactcaggtcaggccccgaaatgccggaatctacagatgcattggccaggggcagcgcggaccgcctatcatcttagaggcaacactgcacctggcggagatcgaggatatgccgctgttcgagcccagggtgttcacggccggttccgaggaaagagtcacgtgcctgccacctaaagggctgcctgagccatctgtttggtgggagcatgctggagtgaggctgccaacccacggcagagtataccagaagggacacgagctggtgctggctaatatcgcggagtcggatgcaggggtgtatacctgccatgccgctaaccttgctggacaaagaagacaagacgtaaacatcaccgtggccaccgtgccctcatggctcaaaaagcctcaagactcccaactcgaggaaggaaagcccggataccttgattgtctcactcaggctactccaaaaccgaccgttgtatggtataggaaccaaatgctgatctctgaggacagcagatttgaagtgttcaaaaacgggaccttaaggatcaactcagtagaggtttacgacggaacttggtatcgctgtatgtcttccaccccagctggtagtattgaggcacaggccagggtgcaggtgctagaaaaacttaagttcacacccccaccccagccacagcagtgtatggaattcgacaaagaagcgaccgtgccttgtagtgccaccggcagggaaaagccaacaattaagtgggaacgtgcagacggctcatccctccctgaatgggtaacagacaacgccggaactctgcactttgcgagggtgaccagggacgatgcaggcaattacacctgcatagcatccaacggaccacagggtcaaatccgagcccatgttcagctaaccgtagccgtttttattacgttcaaagtcgagccagagcgcacaaccgtttaccaggggcacacggccctgctccagtgcgaggctcagggcgacccgaagcccctgattcagtggaaggggaaagatcgcattctagaccctacaaaattgggtccaagaatgcatatattccagaatggttcactggtcattcacgacgtcgcaccggaagactcaggaaggtatacatgcatcgctggcaattcctgtaatatcaaacataccgaggctcccctgtatgtggtagataaaccagtgcctgaggaatctgaggggccaggcagcccaccaccttataagatgatccagacaatcggactgtcagtcggtgctgcagtggcctatattatcgccgtgcttggcctcatgttctattgcaagaagaggtgcaaggccaaacgcttgcaaaagcagccagagggcgaggagcccgagatggagtgcctgaatggcggtccactgcagaacggccaaccgtctgctgagatccaggaagaagtcgccttaaccagcttgggctctggacctgcggcaaccaataagagacactccacctctgataaaatgcatttcccaaggtcatctttgcagcctatcaccaccctcggcaagagcgaatttggggaagtgtttttggcgaaggcacagggtctggaagagggggtagcagagaccctggtcctggtaaagagcctgcagagcaaggatgagcagcaacaactggacttccgtcgggagcttgaaatgttcggtaaactcaaccatgcaaacgtcgtgcgtttgttggggttgtgtcgggaggccgagccccattatatggttctagagtacgtcgacctgggtgacttgaaacagtttttacgtattagtaagtccaaggatgaaaaacttaagtcgcaacctctgtcgaccaagcagaaggtggcactgtgcacacaggtggctctgggtatggagcacttgtctaacaacaggttcgtgcataaagacctcgctgctcggaactgtctcgtgtctgcccagaggcaggttaaggtaagcgctctcgggctctcaaaggacgtctacaacagcgagtactaccactttcgccaagcctgggtccctctccggtggatgtcccccgaagccatcctagagggagacttctcaaccaagagcgatgtgtgggcattcggcgtgctgatgtgggaggtgttcacacatggcgagatgccacacgggggtcaagccgacgacgaggtcctggccgatctccaggcgggaaaggctcggctccctcagcccgagggctgccctagcaaactctacagactgatgcagcgatgctgggccttgagtcccaaggacagaccatcatttagcgagattgcatccgctctcggcgactctacagtcgactcaaaaccctag

SEQ ID NO: 27331 - DNA, 1521 bp, Artificial Sequence
  Description of Artificial Sequence: Synthetic coding sequence
atgccactgttgggacttctccctcgacgcgcttgggccagcctcctgtcccagcttctccgtcccccttgtgcttcatgtaccggggctgtcagatgccaatctcaggtagccgaggccgtgctcacatcacaactgaaggcacaccaggagaagccgaacttcatcatcaagactccgaaagggacacgggatcttagcccacagcatatggtcgttcgcgagaaaattttagacctggtgatttcttgttttaaaagacacggagccaaggggatggatacccctgcctttgaattgaaggaaactctcacagaaaagtacggagaagactccgggctgatgtacgatctcaaggaccagggaggcgagttgctgtctctgcgatacgatctgactgtgccattcgcccgttacctcgcgatgaataaagtgaagaaaatgaaacggtatcacgttgggaaggtgtggcgcagagagtccccaaccattgtccaaggcagatacagagagttctgccagtgtgatttcgacattgcaggccaattcgatccaatgatccccgacgctgagtgtctaaagatcatgtgcgagatactctctggcttgcaactgggcgatttcttaataaaggtgaatgataggcggatagtggatggtatgtttgcagtctgcggcgtgcctgaatctaagtttagagctatctgctctagcatcgacaaattggataagatggcttggaaagacgttaggcatgagatggtcgttaagaagggcctggctcctgaagttgctgatcggattggggattacgtgcaatgtcacggaggcgtctctcttgtcgaacagatgttccaggacccaagattgtctcagaacaagcaggcactggaggggctcggtgatctgaagctgctgtttgagtacttaactttattcgggatcgctgataagatcagtttcgatctgagccttgctcgcggattagactattacaccggcgtcatttacgaggcggtgctgcttcagacacccacccaagcaggcgaagagccactgaatgttggatcagttgcagccggtggtaggtacgatgggctggtaggcatgttcgacccaaaaggacacaaggtcccttgtgtaggcctcagcatcggcgtggagagaatcttctacatcgtggagcaaagaatgaaaaccaagggggagaaggtgcgcaccacagaaacccaggtctttgtggcgacgcctcaaaagaacttcctgcaggagcgcctaaaattgattgccgagctgtgggactcagggatcaaggcagagatgctctataagaataaccccaagctccttacacagctgcactattgtgagagtactggcattcctctggtggtgatcataggggagcaggagctgaaggaaggggtcattaagattagatcagttgcaagtcgagaagaggtggcaatcaaacgcgaaaatttcgttgccgagattcaaaaacgattatccgaatcttag

SEQ ID NO: 27332 - DNA, 912 bp, Artificial Sequence
  Description of Artificial Sequence: Synthetic coding sequence
atgcgcgcatggatatttttcctcctctgtctggctgggcgtgcactagccgctccccagcaggaagctctgcccgacgaaaccgaggtagtggaggaaacagttgccgaggtgaccgaagtatccgtgggagctaatccagtgcaggttgaagtaggcgagttcgacgatggagccgaggagaccgaggaggaggtggttgctgagaatccttgtcaaaatcaccattgcaaacacggcaaggtgtgcgagctggacgagaataacacccctatgtgtgtgtgccaagatcctacttcctgtcctgcacccattggggaatttgagaaggtctgttccaatgacaataaaaccttcgactcatcgtgccatttcttcgccaccaagtgcacgcttgagggaaccaagaaaggccataagttacacctggattatataggaccttgtaaatatatacctccctgtttagactctgagctcacggaatttcccttacgcatgcgcgattggctcaagaacgtactggtcaccttgtatgagagagacgaggataataacctgttgactgagaaacagaagctgcgagtgaagaagatccacgagaacgaaaagcggcttgaggcaggtgaccatccagtggagctgttagcccgtgacttcgaaaagaattataacatgtatattttccccgtccactggcagttcgggcagctagaccagcaccctatcgacgggtatctgtcccacacagagctcgcaccactgcgcgctccgttaatacccatggagcactgtacaacccggtttttcgagacttgtgatctggacaatgataagtacatcgccctggatgagtgggccggatgtttcggaataaagcagaaggacattgacaaggacctcgtaatttag

SEQ ID NO: 27333 - DNA, 2634 bp, Artificial Sequence
  Description of Artificial Sequence: Synthetic coding sequence
atggctcgacctcgtcgggctcgggaaccactcctagttgcactgcttcctctggcttggttagctcaagcaggccttgcccgagcggctgggtccgtccgcctagccggtgggttaactttaggaggtctgttccccgtgcatgctcgcggtgccgcaggccgagcttgcggccaacttaaaaaagagcagggagtgcaccggttagaagccatgctgtatgcactcgaccgggttaacgcagacccggaactgctgcctggtgtgcgacttggggcacgcttgctggatacatgtagtcgggacacttatgccctagaacaggccttgtcttttgtgcaggctctgattcgtggccgtggtgacggggacgaggtgggcgtccggtgcccaggaggggttccgccactgcgcccagccccaccggaacgagtcgtggcagttgtgggcgctagtgcaagctctgtaagtattatggtggccaacgtcctgcggcttttcgccatccctcagattagctacgcctccactgcccctgaactctccgatagcactcgatatgatttcttcagtagagtggttcctcccgatagctatcaggcccaggctatggtcgatatcgtcagagcactcggttggaactacgttagcacactggcctccgaaggtaactatggcgagtccggggtggaggcctttgtacaaataagccgtgaggcgggaggagtctgtatcgcccaaagcattaaaatccccagggagcccaagccaggggagttctccaaggttattaggcgcctgatggaaacgccgaacgccagaggcatcatcatcttcgccaacgaggacgatattcgccgagtcctggaggccgcaagacaggcgaatttaaccgggcacttcctctgggtggggtccgatagctggggcgctaagacgagtcctatcctgtcacttgaggacgtagccgtgggggctattacaatcctccccaagagagcctctatcgacggctttgaccaatactttatgacaagatcattagaaaacaaccgacggaatatctggttcgccgagttttgggaagagaatttcaattgtaagctgacgagctcggggactcagtctgatgacagtacaagaaaatgcactggtgaggaaagaatcgggagggattcgacgtacgagcaggagggcaaagtccaattcgtaattgatgccgtgtacgccattgcacacgcactccactcaatgcatcaggctctgtgcccgggacatacagggttgtgcccggctatggaaccaacagatggacggatgctgctgcagtatatcagggccgtaaggttcaatggctctgccggtacacccgtgatgtttaatgagaatggggacgcccctggccgttatgatattttccagtaccaggcaacaaacgggtcggccagcagcggaggatatcaggccgtggggcagtgggcagagaccctccgcctggatgtcgaagccttgcagtggtccggagaccctcacgaagttcccagcagtctatgctccctcccatgcggtcccggtgaacgcaaaaaaatggtaaagggagtcccttgttgttggcattgcgaagcatgcgatggctataggttccaggtggatgagttcacgtgcgaagcttgcccaggagatatgaggccaacaccaaatcataccgggtgccggccaaccccggtggtccgcctctcatggagcagtccatgggccgctccccctttactgctggcagtcctggggatcgttgcaaccaccaccgtggtggctacctttgtacggtacaacaacaccccgatcgtgcgtgctagcggcagggagctttcctacgtcctgttgacaggcattttccttatctacgcaatcacgttccttatggtggccgagcctggtgccgcagtttgcgcagccaggcgcctgtttttgggactgggtactacgctgagctatagcgctctcctgaccaagactaaccggatttaccgcatctttgagcaaggaaagcgatccgtgacccctccccctttcatttctccaacttcccagctagtcatcactttctccctgacatctctgcaggttgttggcatgatcgcttggctgggtgcgaggccccctcactctgtaatcgattacgaggagcagagaaccgtggaccccgagcaggctagaggggtgctcaaatgcgacatgagtgacctgtctttaattggttgtctggggtactcattgctcctgatggtgacctgtacagtgtacgctatcaaagcccgaggggtaccggagacttttaacgaagcgaagcctatcggttttacaatgtacacgacttgcattatctggctcgcttttgtccccatcttttttgggactgcacagtctgcggaaaagatttatatccagactacaacgctgacagtgtctctctcgctttccgctagcgtcagtctcggtatgctttacgtgccgaagacatacgttatactctttcatccagaacaaaacgttcagaaacgaaaacgtagcctcaaagctaccagtactgtcgcagcccctcctaaaggagaagatgccgaagcacacaagtag

SEQ ID NO: 27334 - DNA, 798 bp, Artificial Sequence
  Description of Artificial Sequence: Synthetic coding sequence
atggccgcagctgtgccaaagagaatgcgcggtcccgcacaggccaagcttctccccggatctgccatccaggctctggtgggcctggcgcgacctttggtcctggctctgcttctggtctccgcggctctgagctcagtggtgtcacgcacagactccccatcacccacagtgttaaactcacatatctccactcccaatgtgaacgctctgacccatgaaaatcagaccaaaccatcgatcagccagatctctaccactctgcccccaacgactagtacaaaaaagagcggaggagcttctgtggtgccacatccaagtcccactcccctgtctcaagaagaagctgacaataacgaggacccttcaatagaagaagaggatcttctgatgcttaacagttccccctctacagctaaggacaccctggataacggagactacggggagccagattatgactggaccactgggccaagagacgacgacgaaagcgacgataccctggaggaaaatcgcggttatatggaaattgaacagtccgttaaatcgtttaagatgcccagcagtaatatcgaggaggaagactcgcattttttcttccacttgataattttcgcattttgcatcgctgtggtgtatatcacctaccacaataaaaggaaaatctttctcttggtccagtcccggaagtggcgtgatggcctatgtagtaaaaccgtggagtaccacaggctcgaccagaacgtgaacgaggctatgccatctttaaaaattacgaatgattatatcttttag

SEQ ID NO: 27335 - DNA, 2349 bp, Artificial Sequence
  Description of Artificial Sequence: Synthetic coding sequence
atggcgccttctgcctgggcaatctgttggctgctgggagggcttctgctccatggagggagttcaggccctagcccgggaccttctgtgcccaggctccggctttcgtaccgagatctcctctccgccaaccgtagtgccatatttctagggcctcagggctctctgaatttacaagccatgtacctggacgaatacagggacagactgtttttaggaggcctagacgcactttattctctgaggttggaccaggcctggcctgaccctagggaggtcctgtggcctcctcaacccggacagagggaagaatgtgtacgaaaagggagggacccacttaccgagtgcgcgaatttcgtccgagtgctgcagcctcacaacaggactcacctcctggcttgcggtactggagcattccagcctacttgtgccctgataaccgttgggcataggggcgaacatgttctgcatctcgagcccggaagcgtagagtcaggcagggggcgatgtccgcatgagccaagtcgccctttcgccagtactttcattgacggtgagctatatacggggcttaccgcggacttcctagggagggaggcaatgatcttcagatccggagggcctcggccagcactccgatccgattcagatcagagcctactgcacgacccacgatttgtcatggccgctcgcatacccgagaatagcgatcaggacaatgataaggtgtacttcttcttcagcgaaactgtgccttctcctgatggtgggtcaaaccatgttaccgtcagccgcgttgggcgagtgtgcgtgaacgacgccggaggacagcgggtcctcgtcaacaaatggtctacatttctaaaggcgagacttgtgtgtagcgtcccaggccctggcggagccgagactcatttcgatcaactggaggacgtattcctcctgtggcccaaagccggaaaaagccttgaggtttatgccctgttttctaccgtgagtgcggtttttcagggtttcgcggtgtgcgtgtaccatatggcagatatctgggaagtctttaacggcccttttgcccaccgagacggcccacagcatcagtggggcccttatggcggtaaggtgcctttccctcggccaggcgtgtgccctagcaaaatgacagcccagccaggaagaccattcgggtccacaaaagattatcctgacgaggtgcttcagttcgcgagagcccaccccctgatgttttggcctgtgcggcctcgccatggtagacccgtcctggttaagacacaccttgcccagcagctgcaccagattgtggtcgatagggtagaggcggaagatgggacttacgatgttatttttctcggcactgactccgggagtgtgctgaaagtaattgcgctgcaagctgggggatctgcagagcctgaagaggttgtgctcgaagagcttcaggtctttaaggtccccaccccaatcacagagatggaaatctccgtcaaacgtcagatgctgtatgtcggaagtagactaggagtggcccagctgcgactgcatcagtgcgagacctatggcactgcgtgtgccgaatgctgtctcgctagggatccctactgtgcatgggacggagcttcctgtactcattatcggccttcacttggcaaaagacgcttccgacggcaggatattagacatggaaaccctgcactacagtgtttggggcagtcgcaagaagaggaagctgtgggtttggtggctgcaacgatggtgtacgggactgagcacaactccaccttcctggaatgtctcccgaagtctccccaggccgctgtgcgttggttacttcagcgtcccggagatgaaggccctgatcaagtaaagacagatgaacgggtgcttcataccgagagaggtctactctttagaagattaagtagattcgacgccggaacatacacgtgcacaacattggaacacggtttctcccaaactgtggtgcgcctggccctggtggtgattgtcgcctctcagcttgataatctgtttccgcctgagcccaagcctgaagaaccacccgcaagaggaggcctcgcatctaccccacccaaggcgtggtataaggacatcctccagctaataggcttcgctaatctaccccgtgtagacgagtactgtgaacgggtatggtgccggggtaccacagagtgcagtggctgttttcgatcacgctcaagaggcaagcaggctagagggaagtcatgggccggtcttgaactcgggaagaagatgaagagtagagtccacgccgagcacaaccgaaccccgagagaagtagaggccacatag

SEQ ID NO: 27336 - DNA, 1725 bp, Artificial Sequence
  Description of Artificial Sequence: Synthetic coding sequence
atggtcgaggacggggctgaagagttggaagatctagtgcacttttctgtcagtgagctgccaagccgtggttacggagtcatggaagagatacggcgacaggggaaactgtgtgacgtcacccttaagataggagatcacaagtttagcgctcacaggattgttctcgcagcctcaatcccttactttcatgcgatgtttactaacgatatgatggaatgcaaacaggatgaaattgtcatgcagggcatggatcctagtgctttggaggctctaatcaacttcgcatacaatggtaacctggctattgaccagcaaaatgtgcaatctctgctgatgggcgcatcatttctgcagcttcaaagcatcaaagatgcctgctgtactttcttgcgagaacgtctacaccctaaaaattgtctgggagtgcgccagttcgccgaaacaatgatgtgcgccgtattatatgacgctgcgaatagtttcatccatcagcacttcgtcgaggtaagtatgtcggaagagttcctagctttgccactagaggatgtgttagagttagtttctcgggacgaactgaatgtcaaaagcgaagagcaggtgtttgaggctgctttagcgtgggtccggtacgatagggagcagagggggccttatctcccagagctactgtctaacatcaggctccctctgtgtaggccacaattcctttcagacagggtgcaacaggatgacctggtcagatgctgccataagtgccgtgatctcgtggatgaagctaaagattaccacttaatgcctgagaggaggccgcacctgcccgcatttcgcactagacctcgatgttgcacctcaatcgccggtctgatctacgcagttggtggcctgaactcagctggtgattcccttaatgtcgtagaagtgtttgatcctattgccaactgttgggaaaggtgccggcctatgactactgcgaggagcagagtgggagtcgccgtcgtgaatggtctgctgtacgcaattggcggatacgacggccagctcagactgagcaccgtagaagcatacaaccccgagacagacacctggactcgggtaggcagcatgaacagcaagcgtagcgctatgggcaccgttgtgcttgacggacagatttacgtctgtggcggttatgacgggaacagttccctttccagtgtggagacttactctcccgagaccgacaagtggacggtggtgacatctatgagctcaaataggagtgccgcaggcgtaactgtgtttgaggggaggatttacgtctcgggcggtcatgacgggctacagatttttagcagcgtggagcactataatcatcacacggcaacatggcatcccgctgctggaatgctcaataagcggtgtagacacggagcagcctccttgggctccaaaatgttcgtgtgcggcggttatgatgggagcggatttctgagcattgccgagatgtacagctccgtcgccgatcagtggtgcctgatagtgcccatgcatacccggaggtcgcgagtttcactggtggcctcctgcgggagactctatgcggtgggcggatacgatggacagagcaatttgagcagtgtggagatgtacgatcccgagactgactgctggacgttcatggcaccaatggcttgccatgaggggggagtgggagtgggatgcataccactcctgaccatatag

SEQ ID NO: 27337 - DNA, 486 bp, Artificial Sequence
  Description of Artificial Sequence: Synthetic coding sequence
atggctaaggaagagcctcagtcaatctccagagacttacaggagttacagaaaaagctgtctttgctcatcgactcttttcagaacaactcgaaagtggtggcttttatgaagagcccagtgggccaatacctggattcccaccctttcttggctttcaccctcctcgtgtttatcgtgatgtcagcggtcccagtcgggttctttctcttgatagtggtgttgacaactctggcagctctgctaggtgtgataattttagagggtctggttatctctgtaggaggcttttctcttttatgcatcctctgcggattgggattcgtatccctggctatgtccggcatgatgatcgcctcatacgtggtcgtgtccagcctgatctcgtgttggttctcccctaggcccctgactcagcagaacactagctgtgattttcttcccgcaatgaaaagcgccgaattcgagggcctttatcaggagtag

SEQ ID NO: 27338 - DNA, 4503 bp, Artificial Sequence
  Description of Artificial Sequence: Synthetic coding sequence
atgactcgtatcctgactgcctttaaagttgtgcgaaccttgaaaacaggtttcgggttcacaaatgtcaccgcccatcaaaagtggaagttctctcgccctgggatcaggctgctgagcgtgaaggcccagactgcacacatagttctggaggacgggactaaaatgaagggctactcatttggccatccaagttctgtggccggagaagtggtctttaatacagggctgggcggatatcctgaggcgatcactgaccctgcctataaggggcagatcctcactatggctaacccaatcatcgggaacgggggtgctccagatacgacagcactggacgagctcggcctgagcaaatacctggagtccaacggcattaaggtgtccggcctgttagtgctcgattacagcaaagactacaaccactggctagccactaaaagtttgggtcagtggctgcaggaagagaaagtaccagcaatttacggggtcgatactcgtatgttgactaaaatcatacgggacaagggcacaatgctcggaaagattgagttcgaaggacaaccggtggactttgttgatcccaacaagcaaaacctgatcgctgaggtgtccacaaaagacgtcaaagtctacggcaagggcaatccaactaaagtggtggccgtggactgtggaatcaagaacaacgtgatccggttgcttgtgaaacgcggagcagaggtgcatctagtgccttggaaccatgacttcaccaaaatggagtacgatggaattttaatcgcaggagggcctggaaaccccgcattagctgagcctctaatacagaacgtgaggaagatactcgagagcgatcggaaagaaccactctttggtatatccacagggaacttgataactggcctcgctgctggcgcaaaaacgtataagatgtccatggctaacaggggtcagaatcagcccgtgctgaatattactaacaagcaagcatttatcaccgcacagaaccacggttatgccctggataacactctgcctgccggttggaaacccctgttcgtcaacgtgaatgatcagaccaatgagggaatcatgcacgagtctaaacctttctttgcggtgcaattccaccccgaggtgaccccaggtccaatcgacactgaatatctgttcgattccttcttctccctgataaaaaaagggaaggctaccaccataacctccgtcttgcccaaacccgctctggtggcctctagagtagaggtgtccaaggtgctcattctggggagcggtggcctgtccatcgggcaggctggagagttcgattactctggtagccaggctgtgaaggccatgaaagaagaaaacgtcaagactgtgctcatgaaccccaatatagcatcggtccagacgaatgaggtaggtctgaagcaagcagacaccgtgtacttcctgccaatcacacctcagtttgtcaccgaggttattaaagctgagcagccagatgggctgatattgggcatgggcggtcagaccgctctgaactgtggggttgagctgttcaagcgcggtgtcctaaaggagtatggagtaaaggtgctcggtactagcgttgagagtatcatggcaacggaagatcgccagctcttcagcgataaactgaatgaaattaatgagaagattgcccctagttttgctgtggagtccatcgaagatgccctaaaagccgcagacactatcggatatcctgtgatgataagatcagcatacgccctcggagggctagggagtgggatttgccccaaccgagaaacactgatggatctgtccacaaaagcattcgcaatgaccaaccagattttggtcgaaaagagcgtgaccggttggaaggaaattgaatacgaggtagttagggatgccgacgacaactgcgttactgtctgcaacatggaaaatgttgatgccatgggggttcatacaggcgactctgtggtggtggcgccagcccagaccttgtcaaacgctgagtttcaaatgctccggcgtacaagtattaacgtagtccggcatctgggcatagtgggggaatgcaatattcaattcgctttgcaccccacttctatggaatactgtatcattgaggtgaacgccagattgagtagaagttccgctttagcttccaaggccactggttaccccctcgcatttattgcagccaagatagccttaggaatccctctccccgaaattaagaatgtggtgagcggaaaaacttccgcgtgcttcgaaccctccctcgattacatggttacaaagataccccgatgggatctggatcgatttcacggcacctctagtcgcataggatcctccatgaaatccgttggtgaggtgatggctatcgggagaacttttgaggagtcattccagaaggccttgcgcatgtgtcacccaagtatcgaagggtttactcctaggctaccgatgaacaaggagtggccgtcaaacttagatcttcggaaagagctgtcggagccaagttctacacgaatttacgcaatagccaaggctatcgatgacaatatgtctctcgatgagatagaaaagctcacatacattgataagtggttcctttataagatgcgggacatcctgaacatggagaaaacacttaaaggcttgaacagtgagtcaatgacagaggaaaccctcaagagagcgaaggaaattggtttttcagacaaacaaatcagcaaatgcctgggccttacagaggcccagaccagggaacttaggctgaaaaagaacattcatccgtgggttaaacagatagataccctcgcagccgaatatccctcggttacaaactacctgtacgtgacttacaacggacaggaacacgatgttaacttcgacgatcacggaatgatggtcctcgggtgtggcccttaccacattggcagttcagtggagtttgactggtgcgccgtttctagtatcaggactctgcgacaactgggaaagaagaccgtggtggtgaattgcaatcccgaaaccgtgagcacagatttcgacgagtgtgacaaactttacttcgaggagctgtccctcgagagaattctcgatatctaccatcaagaggcctgtgggggttgcatcatatcagtgggcggacaaattccgaataacctggccgtcccattgtacaaaaacggcgtgaaaattatgggaacttcaccattacagattgatcgagccgaggaccgcagtattttctctgccgtgctggacgaactgaaggtggcccaagccccttggaaagcagtgaatacactgaatgaggcactcgagttcgcaaaaagcgtagattatccatgcctcctgcgccctagctacgtgctgtcaggatccgctatgaatgtggtgtttagcgaagacgagatgaaaaagttcctggaagaggccactagagtgagtcaggaacatccagtggtgcttacaaagtttgtggaaggagcacgcgaggttgaaatggacgccgttggcaaggacgggcgagtaatctctcacgcaatctctgagcacgtggaggacgctggcgttcattctggcgacgctaccctgatgctgccgacacagactatcagccagggtgctatcgaaaaagtgaaagatgccacgcggaagattgcgaaggcctttgccatcagtggtccgttcaatgttcagttcctcgtgaaaggaaacgatgtgctggtgattgaatgtaacctccgcgcatcgcggtcgtttccttttgtatccaagaccctgggagtagactttattgacgtggccacgaaggtcatgataggggagaacgtggatgaaaaacacctgccaactctggatcacccaataatacccgctgattacgtggccataaaggcccctatgttcagctggcctcgtctgagggatgctgatcctattcttcgatgtgagatggcctccaccggagaggtagcttgcttcggggagggcattcacaccgccttccttaaggcaatgctctccactggctttaagattcctcagaaaggaatcctcatcggaattcagcagtcattccggcctagattcttgggggtggcggaacagctgcacaatgagggcttcaagcttttcgccactgaggcaacctctgattggctgaatgccaacaatgtgccggctacacccgtcgcatggccttctcaggagggccagaacccctccttgtcatcaattagaaaattgatcagggacggcagcatagatctggtcatcaacctccccaacaataataccaaattcgtacacgataattacgtcattagacggacggcagtggatagcggaatcccactcctgacaaactttcaggtcacgaagttgtttgcagaagccgtccagaaatcaaggaaagtggactctaaatctctgttccactataggcagtatagcgccggaaaggccgcatag

SEQ ID NO: 27339 - DNA, 846 bp, Artificial Sequence
  Description of Artificial Sequence: Synthetic coding sequence
atggcagtgaacgtctattccacctccgtcacaagcgagaacctgtccagacacgacatgttggcttgggtcaacgattccctgcatctgaactacacgaagattgagcagctctgttctggagcggcttattgccaattcatggatatgttgttccctgggtgtgtgcatttgaggaaagtcaagttccaggctaaactcgaacatgaatatatacataacttcaaagtgcttcaggccgcattcaaaaaaatgggcgtggacaagataatccctgtggagaagcttgtcaagggaaagttccaggacaattttgaatttattcagtggtttaaaaagtttttcgacgcaaactacgatggcaaagactacaatccgctactagctcgtcaggggcaagacgtagcgccacccccaaacccaggggaccagatcttcaataagagtaagaaactcatcggcacggcagtgccgcagcgaacatcgccaacagggccaaaaaacatgcaaacatctggcagattgtctaatgtagctccaccctgtattttgcgaaaaaaccctcccagcgcccgtaatggaggacatgagacagatgcccagatcctagagctgaatcagcagctcgtggatctgaagctcacagttgatggcctggagaaggaaagagatttttatttttccaagttgcgcgacatagagctgatttgtcaagagcatgagtctgagaactctcccgttattagtgggattattggcattctgtatgctacagaggagggatttgcgccaccagaggacgatgaaatagaggagcaccagcaggaggaccaggacgagtactag

SEQ ID NO: 27340 - DNA, 531 bp, Artificial Sequence
  Description of Artificial Sequence: Synthetic coding sequence
atggctctctggagagcttaccagagagccctggccgcacacccttggaaagtgcaggtactgactgcaggtagcctgatggggttaggcgacattatctcccaacagctcgtggaacggcgtgggctgcaggagcaccaaagggggagaaccttaacgatggtgagtctcggctgtggtttcgtgggacccgtcgtgggaggatggtacaaagtcctggacaggtttatcccaggaactacaaaagtcgacgctctgaagaagatgctactggatcaggggggtttcgcgccatgtttcttaggctgctttctccccctggtgggcgcactgaacggcctatctgcccaggataactgggcgaagctgcagagagattaccccgacgctctgattactaattactacttatggcccgcagtccagcttgctaacttctacctcgtccccctacattaccgtctcgctgtggtccagtgcgtcgccgtgatttggaactcttacctgtcctggaaagctcaccggttgtag

SEQ ID NO: 27341 - DNA, 1143 bp, Artificial Sequence
  Description of Artificial Sequence: Synthetic coding sequence
atggccagcctccctgtactacagaaagagagtgtgtttcagagtggagcccacgcatacaggatccccgcacttttatacctgccagggcagcaaagccttcttgcttttgccgagcagcgagcctctaagaaagacgagcacgcagagctcatagtcttgcgacgcggtgactacgatgccccaacacaccaagtgcagtggcaagctcaggaagtggtcgcccaggccaggttggacggccatcggtccatgaacccttgccccctctatgacgcgcaaacgggcactttgtttctgttcttcattgccatcccgggtcaggtgaccgagcagcaacaactgcaaacccgagccaatgtcacccggctgtgtcaggtgaccagcaccgaccatggcaggacttggagcagccctcgggacctcaccgacgccgctatcggacctgcttacagggaatggagcacatttgccgtcggcccaggccactgcctgcagcttcacgatagagccaggtctctcgtggtgccagcctacgcgtataggaagttgcaccctatccagagaccgatccctagcgctttttgtttcctatcacatgatcatggacgaacttgggccagaggccattttgttgcccaagacacccttgagtgccaagtcgccgaggtcgaaaccggcgaacagcgcgtagtgaccctcaacgcccgatctcacctgcgggctagagtgcaggctcagagcacgaacgacgggctcgacttccaggaatcccaactcgtgaaaaagctcgtggaacccccacctcagggctgtcagggttctgttataagcttccccagccctagatccggaccgggatccccagcccagtggcttctgtacactcatccaacgcactcttggcagagggccgacctaggagcctacctcaatccccgaccccctgcaccggaagcctggtcagagccggtgctgctggccaagggcagttgtgcctactctgatctacagtccatgggcacgggacccgatgggtccccgctgttcggatgcctgtacgaagcaaacgactatgaagaaatcgtttttctgatgttcacactcaagcaggcatttcctgctgaatacctgcctcagtag

SEQ ID NO: 27342 - DNA, 3165 bp, Artificial Sequence
  Description of Artificial Sequence: Synthetic coding sequence
atggccgctgtgaaggagcccttggaattccacgctaaacggccatggaggccagaggaagccgtggaagatccagacgaggaggatgaggataacacttcagaggcagagaacggctttagcttagaggaggtcctgcggctggggggaacgaaacaggactacctgatgctagcgaccctggatgaaaatgaggaagtgattgatggaggcaaaaaaggagccatagacgatttgcagcaaggagaactggaggctttcatccagaaccttaatctggctaagtacactaaggcttctttagtagaggaagatgaacccgcagaaaaagagaattcatccaaaaaggaggtcaaaatacccaagatcaacaacaagaacactgccgaaagtcagcggacatctgttaataaagtcaagaataagaaccgcccagaaccacacagtgacgagaacggctccaccactccgaaggtgaaaaaagataagcagaacatcttcgaattctttgaaaggcagacccttcttctgagacctggtggtaagtggtacgacctggaatactccaatgaatacagtctcaagcctcagcctcaagacgtggtttctaagtacaagaccttagcccaaaagctgtaccaacacgagattaacctgttcaaaagcaaaaccaacagccaaaagggagcctcatctacatggatgaaggccatcgtgtcgtccgggaccctcggggatcgcatggcagccatgatcctgctcattcaggatgatgccgttcatactttacagtttgtggaaacgctggtgaatctggtgaaaaaaaaagggtctaaacaacagtgtttaatggctctggatacgttcaaggagttactcatcacagacctgttgccagacaatagaaagctcagaatattctcccaacgtcctttcgataaactcgaacagctgagcagcggaaacaaggactcgcgggaccgacggcttatactgtggtattttgagcatcagctgaaacacctggtcgccgagttcgtgcaggtgctcgaaactctcagtcatgacaccctcgtaaccaccaagacacgcgcactgacggtcgctcatgaactgctttgcaataaaccggaagaggaaaaggcccttttagtgcaagtcgtcaataagctcggtgacccgcaaaatcgcatagctacgaaggcctcccacctactcgaaaccctcctctgcaaacaccctaatatgaagggtgtggtgtccggggaggtggaaaggctgctgttcagatcaaatatcagctctaaggctcagtactacgctatatgcttcctcaaccagatggctcttagtcatgaagaaagcgaactggcaaataagctgataaccgtgtacttctgtttctttaggacgtgcgttaaaaagaaggatgtggagtctaagatgctttccgctctgctgactggagtgaaccgggcttatccgtactctcagaccggcgatgacaaggtccgagaacaaattgacaccctcttcaaggtccttcacattgtgaatttcaataccagcgtgcaagcacttatgctgctattccaagttatgaactcccagcagacgatctctgataggtactacacggcactttaccggaaaatgcttgatcccggactgatgacttgtagcaagcaggctatgtttctgaacctcgtgtataagagtcttaaagccgatattgtactccgaagagtcaaagcttttgttaaacggcttctccaggtgacttgccagcagatgccaccctttatctgtggcgcactctatttggtcagcgaaattcttaaagcaaaaccgggtctgagaagccagctggatgaccatcctgagtctgatgatgaagagaacttcatagatgcgaatgacgatgaggatatggagaagttcaccgacgcagacaaagagacagagattgtgaagaagttagagactgaggagactgtacccgagacagacgtggaaactaagaaacccgaagtggccagctgggtgcacttcgataatctaaagggaggaaaacagctaaacaagtacgatccattcagcaggaatccgttgttctgtggtgccgaaaatactagcctttgggagctgaaaaaactgtcagtccacttccacccaagcgtggctctgttcgcaaagaccattctgcaaggcaactacatccagtactccggcgaccccctacaagacttcacactgatgaggttcctagataggtttgtgtaccgaaaccctaaaccccacaaaggaaaggagaacactgacagtgtggtaatgcagccaaaaaggaagcacttcatcaaagatatcagacatttgccggtaaactcaaaggaatttcttgctaaggaggaaagccagattccagttgacgaagtgttcttccatagatattataagaaggttgccgtcaaggaaaaacagaagagggacgcagacgaagagtcaatcgaggacgttgatgatgaagagttcgaggagctgatcgacacattcgaggatgataactgttttagttccggcaaagacgatatggacttcgccggaaatgtgaaaaagaggactaagggggctaaagataatacccttgacgaagatagcgaggggagtgatgacgagctggggaacctggacgacgacgaagtcagcttgggcagcatggatgatgaagagttcgcagaggtggatgaggatgggggaacgttcatggacgtgctagatgacgagtcagagtccgtgccagagctggaggttcactcaaaggtttccacaaaaaaatctaaaaggaagggcaccgacgattttgacttcgcaggtagtttccaggggcctcggaagaagaagcgtaatctgaatgattctagtctttttgtatccgctgaggagtttggtcatctccttgatgagaacatgggcagcaaattcgacaatatagggatgaacgctatggccaataaagacaacgcctctctgaaacagcttagatgggaagctgagcgggacgattggctccacaatcgagatgcgaagagcattataaaaaaaaagaaacattttaaaaaaaagagaatcaagactacacagaagactaagaaacagcgaaaatag

SEQ ID NO: 27343 - DNA, 1107 bp, Artificial Sequence
  Description of Artificial Sequence: Synthetic coding sequence
atggagcccggacagccccgagagccacaggagccacgagagccgggtcccggagcggaaacagcagcggctcctgtctgggaagaggccaaaatcttctatgataatttggccccaaagaagaagcctaagtcaccaaaaccacagaatgcagtcaccatcgccgtgagttctcgcgcattattccggatggacgaggagcagcagatttacactgaacagggggtcgaagaatacgttcggtatcagctcgaacatgaaaacgagccctttagccccggacctgctttcccttttgtgaaggccttggaagcagtcaatagaagactgcgggaactgtatcctgattctgaagatgtctttgatatcgtcctcatgactaacaaccatgcccaggtcggtgttagactgatcaacagcatcaaccactacgacctgttcatcgagcgattttgtatgaccggcggaaatagcccaatctgttacctgaaggcctaccataccaatctatacctcagtgcagacgccgagaaggtgagggaagctatcgacgagggcatcgccgctgccactatcttttccccctccagggatgtcgttgtttcccaatctcagctccgtgtggccttcgacggagatgccgtcctttttagtgacgagagcgagcgaatagtgaaagctcacggtctggaccgcttttttgagcatgaaaaggcccacgagaacaagcctttagctcagggtcccttgaaaggttttctggaggccctcggccgacttcagaaaaagttctactcgaagggcctgaggctggagtgcccaatccggacgtacctggtgaccgcgagatctgccgcatcgtcaggtgcacgcgcactcaagactctgcgtagctggggcctcgagacggatgaagctctgtttctggccggagctcctaaaggtccactgttggagaaaattcgccctcatattttcttcgacgaccagatgttccatgtggccggtgctcaggagatgggcaccgtggccgcacacgtgccatacggggtggcccagacccctaggaggacagcccctgctaagcaagcaccttcggcccagtag

SEQ ID NO: 27344 - DNA, 1080 bp, Artificial Sequence
  Description of Artificial Sequence: Synthetic coding sequence
atgctgtcagctgcctctcgcgtggtgtcacgggcagcagtgcactgcgcgctgcggtctcctcctccggaggccagagccctggctatgagccggccaccccctccacgagttgccagcgttctgggaaccatggagatggggaggcggatggacgccccagctagtgctgccgctgtccgcgcttttctagaacgcggtcacacagagcttgatactgctttcatgtattcagacgggcagagtgaaacaatcctgggcggacttggcctgggcctcggaggaggggattgtagggtgaaaattgccaccaaggccaatccctgggacggtaagagtctgaaacctgactctgtcaggtctcagctagaaacttcactaaagaggctgcaatgtccgcaggtggatctgttctacctgcacgcacccgaccacggcactcccgtcgaagagactctgcacgcctgccagagattacaccaagagggcaagtttgttgagctgggcctgagcaattatgcatcgtgggaggtcgcagagatctgtactctgtgcaagtctaacggttggatcctgcccaccgtctatcaggggatgtacaacgccacaacccgtcaagtcgagactgaattgttcccatgtctgaggcacttcggcctgcgcttttatgcatataatcccttggccggaggcctgcttacaggaaagtacaagtacgaggacaaggatgggaaacagcctgtggggaggttcttcggcaacagttgggctgagacctaccgaaaccggttttggaaggagcaccactttgaagcgatcgccctggtagaaaaggctttgcaggctgcctatggtgcgtcagccccatcagtcacgagcgccgctctacgctggatgtaccaccattcacagctgcaaggcgctcatggagacgctgtgattctgggaatgtcatccctcgaacagctggagcagaatctggcggcaacagaggagggccctttagagcccgcagttgtagatgctttcaaccaagcctggcaccttgtggctcacgagtgtcccaactacttccgctag

SEQ ID NO: 27345 - DNA, 561 bp, Artificial Sequence
  Description of Artificial Sequence: Synthetic coding sequence
atggacgcagattccgatgtcgccttagatatacttataactaacgtcgtttgtgtatttcgcactagatgccacctgaatctgaggaaaattgctctggagggcgcaaacgttatttataaacgtgatgtgggcaaagtgcttatgaaattgagaaagcctcgaattactgccactatatggtcttcaggcaagataatttgtaccggcgcaacctcagaggaggaggccaagttcggcgcaaggagactcgccagaagcctgcagaaacttggcttccaggttatctttacagatttcaaagtggtcaatgttcttgcggtgtgtaacatgcccttcgaaatacgtctgccagaattcaccaagaacaacaggcctcacgcgtcttacgagcccgagctgcaccctgccgtctgctataggataaagtctctccgggctacactgcaaatcttttccactgggtccataaccgtcactggcccaaatgttaaagctgtagccacggccgtcgagcagatctacccctttgtattcgagagtaggaaggagattctttag

SEQ ID NO: 27346 - DNA, 537 bp, Artificial Sequence
  Description of Artificial Sequence: Synthetic coding sequence
atggctgcgcctttgggaggcatgttcagcggacagcctcctggcccaccacaggccccacctggactgcctgggcaagccagccttctgcaagcagctcctggggctcctaggccttctagctccactctcgtcgacgaactcgagagttcctttgaagcgtgcttcgcgagcctggtgtctcaggattacgttaacggaacggaccaggaagagatacggaccggcgttgatcaatgtattcagaaattcctcgatattgctcgccagaccgagtgcttttttctccagaaacgccttcagctctccgttcaaaagcctgagcaagtcataaaggaagatgtcagcgagttgcgaaacgagcttcagcggaaggatgctctcgtgcaaaagcacttgaccaagctgcgacactggcagcaggtgctggaagatattaatgtgcagcacaagaaacctgccgacatcccccaggggtcgctggcctatttggagcaggctagcgcgaacattcccgctcctctgaagccgacctag

SEQ ID NO: 27347 - DNA, 738 bp, Artificial Sequence
  Description of Artificial Sequence: Synthetic coding sequence
atggaaaaaacagagctgatccaaaaggctaaactggctgagcaggcagagcgttacgatgacatggcgacttgcatgaaagctgtgacagagcagggcgcagagctgtcgaacgaagaaaggaacctgctgtctgtcgcgtacaagaacgtggtgggcggtcgccgaagcgcatggcgtgtgatatcttctattgagcaaaagactgacaccagtgacaagaaactgcagctgatcaaggattacagggaaaaagttgagtccgaattgaggagcatttgcaccacagtactggaacttctggacaaatatctgatcgcaaatgctactaatcccgagtccaaagtgttctacctgaaaatgaagggggattatttcagatatttggcagaagtcgcctgtggagacgaccgcaaacagacgatagacaactcccagggcgcataccaagaagccttcgatatctctaagaaagagatgcagcctacacatcctatacgcctgggccttgccctgaatttctccgtgttttattatgagattttaaacaaccccgaactggcttgcactctggccaaaaccgctttcgacgaggctatagccgagctggatacactcaacgaggattcctacaaagacagcacgctgatcatgcagctgcttagagacaatctgacattgtggacttccgattctgcaggagaagaatgtgatgctgccgaaggcgctgaaaattag

SEQ ID NO: 27348 - DNA, 534 bp, Artificial Sequence
  Description of Artificial Sequence: Synthetic coding sequence
atgcccggactcaccgcctattttgggctcctggaaatttgtggagtcaaaggaggggagacagttatggtaaacgccgctgcaggagcagttggctctgtggtcggacagattgctaagctcaagggttgtaaggtggtgggagcagtgggctctgatgagaaggtggcatatttacagaaattaggcttcgacgtggtctttaattataagactgttgaaagtctggaggaaaccctgaagaaggccagccctgatggctatgactgctatttcgacaatgtaggcggagagttctcaaatacagtcataggccagatgaagaagttcggccgaattgctatttgtggagctatatctacatacaaccgcaccggtccactgccccctgggccacctcccgagattgttatttatcaagaactgagaatggaagcattcgtggtctaccggtggcagggcgacgccaggcagaaggccctgaaggatctgctcaagtgggttttagagctgccatactttgtgatcgactag

SEQ ID NO: 27349 - DNA, 3660 bp, Artificial Sequence
  Description of Artificial Sequence: Synthetic coding sequence
atgttcggggctggagatgaggacgacaccgatttcctgtctcctagtgggggagcgagattagcgagtctgtttggcctggaccaggcggcagcgggacacggaaacgagtttttccaatataccgcaccaaaacagcccaagaagggccagggcacggcggcaacgggcaatcaggcaactcccaagacagcccctgccaccatgtcaaccccaaccatcctggtggcaaccgccgttcatgcttaccgctatactaacgggcagtatgtcaagcaaggaaaatttggcgctgcagtactcgggaaccatacagcacgggagtatagaatcttgctgtacatttcacaacagcaacccgtgacggtagctaggatccacgtcaatttcgagctgatggtcaggcccaataattattccaccttttacgatgaccagcgccaaaactggtcgataatgtttgaaagtgagaaggctgccgtggagtttaataagcaagtgtgcatcgctaagtgcaattcaacaagtagcctggatgccgtccttagccaggacctgattgttgccgacggcccagccgtggaagtgggagactccttagaagtggcttatacgggctggcttttccagaaccacgtgctggggcaggtctttgactccaccgcgaacaaggacaaactgctgcggctgaaattgggaagcggtaaggtaatcaaaggctgggaagatggcatgctaggaatgaagaagggcggaaaacgcctgctgattgtgccccctgcttgcgcggtaggttcagagggcgtcatcggatggacccaggctacagactcgattctcgtgtttgaagtagaagtccgcagggtaaaattcgctcgagacagtggtagcgatggacactctgtgagcagccgggacagtgccgctccctccccaatcccaggcgctgataatctctccgctgaccccgtcgtgtccccccctacaagtatcccattcaaatccggggagcctgccctgcgaaccaagagcaactcgctctctgagcagttggcgataaacacaagtcctgacgctgtcaaggcgaagctgatctctaggatggctaagatggggcagccgatgctgccaatcctgcctcctcagctcgatagtaatgactcagagattgaagatgttaacacactgcagggcggagggcagccggttgttaccccatccgtccaaccatcactgcatcctgcacaccccgcactgccgcagatgacatcccaggcaccacagccatccgtgacagggctccaggccccaagcgccgctttgatgcaagtgtcctcactggacagccatagtgccgtgtccggaaatgcccagtccttccagccctatgcaggcatgcaagcttacgcctatccacaggcctctgctgtaacctcccaactgcagcctgtgagaccactgtacccagctccattgtcccagccaccccacttccagggatccggggatatggcatctttcttgatgactgaagcacgccagcacaatactgagatacgcatggctgtgagcaaagttgccgacaagatggaccacttaatgactaaagttgaggagttgcagaagcactctgccggtaatagcatgctgatcccgagtatgtccgtcacgatggaaaccagcatgattatgagtaacattcagcggattatccaggaaaatgagaggctgaagcaggaaattctagaaaaatccaacaggattgaagaacaaaacgataaaatttcggagctcattgagcggaatcaacggtacgttgagcagtcaaatcttatgatggagaaacggaataacagtttacagactgccaccgagaatacccaagcaagagttcttcatgcagagcaggagaaagcaaaggtcacagaggagctggctgctgctacagcacaggtcagccacttacagctaaagatgacagctcatcaaaaaaaagaaactgaactgcagatgcagcttacagaatctcttaaggagaccgatctcttgcgcggacagctgacgaaggttcaagctaaactgagcgaattacaagaaacttcggagcaggcccagagtaagtttaagtctgaaaaacaaaatcgaaaacagctggagctgaaagtgacctctctcgaagaagagctgaccgacctccgggttgaaaaggagtcactagaaaagaatctctctgagcgaaagaaaaagagcgcccaggagcgctctcaggctgaggaagagattgacgagattaggaaaagctatcaggaggagttagacaaacttcgccagttgcttaagaaaactcgcgtctctacagaccaggccgctgcagagcagctctctctcgtgcaggccgaactgcagacccaatgggaagctaaatgtgagcatctgctagctagtgcaaaagatgagcacctccaacaataccaggaagtttgcgcccagagggatgcctaccagcagaaactagtccaactgcaggagaagtgcctggctctgcaggcccaaattacagccctgactaagcaaaatgaacagcatattaaagagttggagaaaaataagtctcagatgtcgggtgtagaagcggctgccagtgaccctagcgagaaagtgaagaaaatcatgaaccaagtgtttcagagcctcagaagagagtttgagctagaagagtcatataatggtaggaccatacttggaacgatcatgaataccataaagatggtcactctgcaacttctaaatcagcaagaacaggagaaggaagaatctagtagtgaggaagaggaggagaaagctgaagagcggccacgacgtccttctcaggagcagtcggctagtgcgagtagtggacaacctcaggccccactcaacagagaaagaccggagagccccatggttcccagcgagcaggtggtcgaggaggccgtccccttgccaccccaagccctaacaacctcacaagacggccatcggagaaaaggggattctgaggccgaagccctcagcgaaattaaggatggatcccttccaccggaactgagttgtattccttctcaccgtgtactaggccctccgaccagcatcccaccagaaccgctgggaccagtctcaatggactccgagtgcgaggaaagcttagcagcaagtcctatggcagcgaaaccagacaacccctctgggaaagtgtgcgtgcgagaggttgcacccgacggacccctacaggagtcctccacaagactgtccctgacatctgatccagaggagggtgatcctcttgcccttggtccagaaagccctggtgaaccgcaacctccgcagctaaaaaaagatgatgtgactagctctactggtcctcacaaggagctgtccagtaccgaagccggaagcacagttgcaggcgctgctttgcgcccttcccatcactcgcagcggtcctccctgagcggcgacgaggaagacgagctctttaaaggtgccacgctcaaggctctgagacccaaagctcagccagaggaagaggacgaggatgaggtctctatgaagggaaggcccccaccaactccactctttggagatgatgatgatgatgacgatatagattggcttggctag

SEQ ID NO: 27350 - DNA, 6978 bp, Artificial Sequence
  Description of Artificial Sequence: Synthetic coding sequence
atgaaaaagggttcgcagcagaagatcttctctaaggcaaaaatcccaagctcctctcacagtccaattcccagtagcatgtcaaacatgaggtccaggagtctcagtccgctgataggatccgagactctgcccttccacagcggcggacagtggtgcgaacaggtcgagatagctgatgaaaacaatatgctgctggattatcaggatcataagggtgccgacagtcacgccggagttcgatacatcacagaggcccttataaaaaaactgaccaaacaggataacctagctctgatcaaaagcttaaatttgagcctgtccaaggacggtggtaaaaagttcaaatacatagaaaacctcgagaagtgcgttaagctagaggtgctgaatttgtcgtacaatctgatcggaaaaattgagaagctcgacaaactactcaaattgcgtgaattgaacctctcatataacaagatctcgaaaattgaaggaatagagaacatgtgtaatctgcagaagctaaatctggctgggaacgaaatagagcatattcctgtctggttaggtaaaaagcttaagtccctcagagtcctcaacctgaaaggcaacaagataagtagtctgcaggatataagcaagctgaagccgctccaggacttgataagcctgatacttgtggaaaacccggttgtcaccctgccacattatctccagttcacaatctttcaccttcgctcactggagtccctggaagggcagcccgtgaccacccaggatcgccaggaagcattcgaacgtttttcacttgaggaggtggagagactagaacgagacctagaaaaaaaaatgattgagaccgaagaactcaagagcaaacagactcgatttctggaagaaatcaagaatcaggataaactaaataaaagcctgaaggaggaagccatgttgcagaaacagtcatgtgaggaacttaaaagtgacttgaatacaaagaacgagctcctcaaacagaaaacgatcgagctgacccgagcatgtcagaaacagtatgagctagagcaagaattagccttctacaagattgacgctaagtttgagcccttgaactattatcccagcgaatacgccgagatcgataaggccccagatgagtccccctatataggaaagagtcggtataaacggaacatgtttgcgactgaaagctacatcattgattctgcacaagccgtacagatcaagaagatggaacccgacgaacagctgcgtaacgaccacatgaatctgcggggacacactcctctagacacccagctggaggacaaagagaaaaaaatctcagccgcacagactcggctgtctgagctgcatgatgaaatagagaaagcagagcagcagatactccgagcgacagaagagttcaaacagctggaagaagccattcagctcaaaaagatcagcgaggccggtaaggacttgctgtataagcagctcagtggaaggctgcagctggtgaacaagctgcgccaggaagcgctggacctggagcttcagatggagaaacaaaaacaagaaatcgccggaaagcagaaagagatcaaggatctgcaaatagcaattgactcactcgattccaaggatcctaaacatagtcatatgaaggcccagaagtccggaaaggagcagcagcttgacatcatgaacaagcagtaccaacagctggaaagcagactcgatgagattctgagccgcattgccaaagaaaccgaggaaatcaaggaccttgaagagcagttaaccgaaggacagatcgccgcaaacgaagccctgaaaaaagacctggaaggtgtgatctcgggactccaggaatacttaggcaccatcaaaggtcaagccacccaagcacagaatgagtgcaggaagctcagggatgaaaaagaaaccctgctgcaaagactcacagaggtcgagcaggagcgcgatcagctggagatcgtcgcaatggacgcagaaaacatgaggaaggaactggctgagctggagtcagccctgcaggaacagcacgaagtgaacgctagtctccaacagacccagggcgacctgtctgcgtacgaggccgaacttgaagcacgattgaacctccgcgacgcggaagccaaccagctgaaagaagaactcgagaaggtcacccggttgacccagctggagcagagcgcactccaggccgagttagagaaagaacggcaggctctaaaaaatgccttgggaaaagcccagttttctgaagaaaaagagcaggaaaacagcgagctgcacgcaaagttgaagcacctccaagatgacaacaacctcctcaagcaacaactgaaggacttccagaatcacctgaatcatgtcgtggacgggctcgtccggcctgaggaggtagcagctcgggtggatgaattgcggcgtaagctgaaattgggcaccggagagatgaacatccacagtccatcagatgttttagggaaaagtcttgcggacctgcaaaaacagttcagcgaaatactagccaggagcaagtgggagcgggatgaggcccaggttcgcgagcgcaaacttcaggaggagatggccttgcagcaggagaaactggctaccggacaggaggaattcagacaggcttgcgagcgtgcccttgaagcacgcatgaattttgataaacgccagcacgaagcgcgaatccagcagatggaaaatgagatccattacctccaggagaatctgaagtccatggaggaaatacagggcttgaccgacctccagctgcaggaggcagacgaagaaaaggaaagaatcctggcccagttaagagaattagaaaagaagaaaaaactggaagatgccaagtcacaggagcaggtctttggcctggataaagagctgaagaaactgaaaaaggccgttgctacaagcgacaagctggcaacagccgaactgaccatcgcgaaagatcagctgaaatctttgcatggcacggtaatgaaaatcaaccaggagcgagcagaagaattacaggaagctgagaggttcagcaggaaggcagcgcaggctgctcgtgaccttacaagggccgaggcagaaattgagctcctgcagaacttgcttagacagaagggcgagcaattccgactggagatggagaagaccggcgtgggtacaggcgcaaattcccaggtcctggaaatcgagaagctaaacgaaaccatggagcgacagaggacagagatcgcgagactacagaatgtgctagacctgactgggtctgataacaaagggggattcgaaaatgttctggaagagatcgctgaacttaggcgggaagtgtcttatcagaacgactacatatcatctatggcggatccatttaagcggagaggctattggtattttatgccccctccgccttcttccaaggtttcttcccatagctctcaggcaaccaaagattcaggagtaggcctgaagtactcggcaagcaccccagtgaggaaacccagacctggccaacaagacggcaaggaaggctcccagccgccacctgcctccgggtactgggtttactcgcctatccgatccggactgcataagttattcccttcacgggacgctgattccggcggagacagccaggaagagtctgaattggatgaccaggaggaaccaccttttgtgccgcctcccggatatatgatgtacaccgtactccccgacgggagccctgttccacaggggatggctctgtacgcgccaccacccccactgcctaataatagcagacccctcacccccggaacggtggtgtacggcccacctccagctggagctcccatggtgtacggaccacctccaccaaacttcagcatcccattcataccaatgggagtgctgcactgtaacgtaccagaacatcacaacctggagaacgaagtctcacgcttagaggatatcatgcagcatcttaagagcaaaaaacgggaggaaaggtggatgagggcaagtaaacggcagtccgagaaagaaatggaagagctgcaccacaacattgatgaccttttgcaggaaaagaagtccctggaatgcgaggtggaggagttacataggactgttcagaagcggcaacaacagaaggacttcatcgacggtaatgtggagagcctaatgactgaactagagattgagaaatcgcttaagcaccacgaggatatcgtcgacgaaattgagtgcatcgagaagacccttctcaaacggagatcggaattgcgggaggctgataggctattggcggaagccgaatctgagctctcttgtactaaggaaaaaacgaagaacgccgttgaaaagttcaccgatgctaagcgaagtctgctgcagacagagtctgacgccgaagaactcgagaggcgtgcacaggaaactgctgtcaacctggtaaaagctgaccaacaattgcgaagccttcaggcggacgccaaggatttggaacagcataagattaaacaggaggaaattctgaaggaaattaataaaatagttgcagcgaaggactctgactttcagtgtcttagtaaaaagaaggaaaagctgactgaggaactgcagaaactgcagaaggatatcgaaatggccgaaagaaacgaagatcatcacctccaggttctgaaggaatctgaggtccttctgcaggctaaacgggcagaacttgagaaacttaagagccaagtgacctcccagcagcaggaaatggccgtcctggacagacaactgggtcacaaaaaggaagagctgcatctgctgcagggttctatggttcaagccaaagctgatctccaggaagctctgcggttgggagagaccgaggtaactgagaaatgtaatcatatccgcgaagtgaaaagcctgctcgaggaattgagctttcagaaaggcgaattgaatgtgcagatctctgaacgcaagacacagttgaccctcattaaacaggaaattgagaaagaagaggagaatttgcaggtggtcctgcgccagatgtctaaacataagaccgagctgaaaaacattctggacatgttgcagctggaaaatcatgagctgcaagggttgaagttgcaacacgatcagagggtcagcgaactagaaaaaacacaggttgccgttcttgaagaaaaactagagcttgagaatttgcagcaaatttctcagcagcagaagggtgaaattgagtggcagaagcaactgttggagcgagataagcgggaaattgaacgcatgactgccgagtctcgggcactccagagctgcgtcgagtgcttgagtaaggagaaggaggacctgcaggaaaaatgcgacatatgggagaaaaaacttgcccaaactaaacgtgtgctagctgccgctgaggaaaactctaagatggagcagagcaacttggagaagctggagctcaatgtcagaaagctgcagcaggagttagatcagttgaaccgggataaactgagtctgcataacgacatcagcgcaatgcaacaacagctgcaggagaagagagaggccgtgaactcactgcaggaagaactggccaacgttcaggatcacttgaacttggctaaacaggaccttctgcatacaacaaagcatcaggatgtgctgttatctgagcagacccgcctgcagaaggacatctccgagtgggcaaatcgttttgaggattgtcagaaggaggaagaaaccaaacaacaacagctgcaggtgctacagaacgagattgaagagaacaagctgaaactcgtacagcaggagatgatgttccagagattgcagaaggaaagagaaagcgaagagagcaagcttgaaacctctaaggtgactctaaaggaacagcagcatcaattagaaaaagaactgaccgaccagaagtccaaactggaccaggtcctgtctaaagtgcttgcagctgaagagagagtccgaaccttgcaagaggaagagcgttggtgcgagtccttggagaaaaccttgagtcagaccaagcgtcagctgtctgaacgcgagcagcagttggttgagaaatcaggggaactgctggcattgcaaaaagaagctgattccatgcgggcagattttagtcttttgcgcaatcagtttctgacagaaaggaagaaagccgagaaacaggtcgcaagtttgaaagaggccttaaagattcagagaagccagcttgaaaagaacttgctggagcagaaacaagagaattcctgcatacagaaggaaatggccactatcgaactggtggcacaggacaatcacgaacgtgctaggagactgatgaaggagctgaatcaaatgcagtacgaatacacagaactgaaaaagcagatggccaaccagaaggatctggaaagacggcagatggaaatttccgatgcaatgcgtacgctgaagagcgaagtaaaggacgagatccgtacctcgctgaaaaatctcaatcagttcctacccgaactcccagccgacttggaagccattctggaacgcaacgaaaacctggaaggcgagctggagtcgctaaaagaaaacttacctttcaccatgaatgagggaccatttgaggagaaactcaacttctctcaagtacacatcatggacgaacattggcgcggagaggctctgagggagaaactccgacacagagaggataggctgaaagcacagctaaggcattgtatgtccaaacaggctgaagtgctgatcaagggcaagaggcagacggaaggaactctccatagtctgcggagacaggtggacgcgcttggagaactggtgacctcgactagcgctgattctgccagcagtccatctctttcccaactggaatccagcctgactgaagactcccagctgggtcagaatcaggagaaaaacgcctcagcaagatac

SEQ ID NO: 27351 - DNA, 2811 bp, Artificial Sequence
  Description of Artificial Sequence: Synthetic coding sequence
atggaacctgacatcattaggatgtatagcagtagtccacctcctctggataacggagccgaagatgacgatgacgatgagtttggggagttcgggggttttagcgaggttagtccgtcaggggtgggtttcgtagactttgacaccccagactatacacggcctaaggaggagtttgtgcccagcaaccatttcatgccaattcacgagtttagcgagaacgtggatagcctgacttctttcaaatccatcaagaatggtaatgataaagatataacggccgaactgagcgcacccgtcaaaggccagagcgacgttctgctgagcacaacctcaaaggaaatcataagctcagagatgctggcaacaagtatagatggcatggagaggccaggaaacctaaataaagtggttgaacagcgacagaatgtggggaccttagagtcattcagtcccggtgacttcaggactaatatgaacgtagtccaccagaacaagcagttagagtcctgtaatggggagaagcccccttgtctggaaattctaactaacggttttgccgtgttggagactgtaaacccccagggaacggacgatttggataacgtagcagactccaagggtaggaagccattgtcaactcactctacagagtataatctggacagcgtgccatcccccgctgaagagttcgccgattttgcaaccttcagcaagaaggagcgcatccagctggaggagatcgagtgcgccgtgcttaatgatcgggaggctctgacgattagggagaacaacaaaattaacagagtcaacgagctgaatagcgtgaaagaggtcgccctgggaaggagtttagataataagggtgacaccgacggcgaggaccaggtctgtgttagcgaaattagtatcgtgaccaaccgcggattcagcgtcgagaaacagggactacctacacttcagcaggacgaatttcttcagtccggcgtccagtccaaagcctggtcactcgtggatagcgccgataacagcgaggccatcagacgcgaacagtgtaaaacagaagagaagctggacttactcacctctaaatgtgcccacttatgcatggactcagtgaagactagcgacgatgaggtgggcagccccaaggaagagagcagaaagtttaccaatttccagtctcccaatatcgatcctacggaagaaaatgacctggacgatagtcttagcgttaagaacggcgatagttccaacgattttgtcacatgtaacgacattaacgaagatgatttcggcgacttcggggatttcggctctgcgagcggtagcactcctcctttcgttacgggaacgcaggactctatgtccgatgccacgttcgaagagtcgtcagagcacttcccccatttcagtgagccaggggacgacttcggggagttcggagatatcaacgcggtgtcttgtcaagaggagaccattcttaccaagtccgacctgaagcaaacatctgataatctttcggaagagtgtcaactggcccgtaagtcctccggaactggtactgagcccgtcgccaagctcaaaaatggccaagagggagaaataggccacttcgactcggtcccaaatattcaagacgactgtaatggatttcaggactccgacgatttcgctgatttctcttctgccggtccaagccaggttgtcgattggaacgccttcgaagacgaacagaaagacagctgtagctgggctgcctttggtgaccagcaggccacagagtcacaccacagaaaggaagcatggcaatcacatcggacagacgaaaacattgacaccccaggtactcccaaaacacactcagtgccatctgcgacatctaagggggcagtcgcaagcgggcatctccaggaatcagctacatccgtgcagaccgccctgctgaaccgcctcgagcggatctttgaggcctgctttccaagtattctggtccccgacgccgaagaggaggttacctccctgaagcatcttctggagaccagcaccctgcccattaagacccgcgaggccctgccggagagcggagaactgctcgacgtatggacagagctccaggacattcatgacgcccacggcctgagataccaatggggaggctcacacagcaataagaagctcctgtcttccttgggcatagatacccgtaacattcttttcactgggaacaaaaagcaaccagtcatcgtgcctatgtacgcagctggcctgggaatgctggaacctacaaaggaaccactgaaaccactctccgcagctgagaaaatcgcgtccatcggccagacagcaactatgtccccagacatgaatacgtgcactagcgatcagttccaggaaagcctacccccagtgcagtttgattggagctctagcggcctgacaaaccctctggacgcctccggaggttctactttgctgaacttggacttcttcggaccggtggatgacagtagctctagctcgagtacaactatcccaggggtcgatcctgaactatatgagctcacaacgtccaaactggagatttccacatctagcttgaaggtgacagacgcatttgcaaggctgatgagcacagtagagaaaacctctacgtcaacgcggaagcccaagcgagaggagcacctgagcgaggaagccataaaggtgattgccggattacccgacttgactttcatgcatgctaaagtactcatgtttccggcaaccctgactccctctacttcgtcgcaggaaaaagctgacgggtag

SEQ ID NO: 27352 - DNA, 2730 bp, Artificial Sequence
  Description of Artificial Sequence: Synthetic coding sequence
atggagcctgatatcattaggatgtatagttcttcacccccacccttggataacggggctgaagacgatgacgatgatgaatttggcgagtttggtggtttttccgaagtctcgcccagcggtgttggcttcgtcgatttcgacacaccggactataccagaccgaaggaagaattcgttccatcaaatcactttatgcccattcatgagttttctgagaacgtggattcattgacaagcttcaaatccataaaaaatggtaatgacaaagacatcaccgcagaactgtccgccccagtgaaggggcaatcagatgttcttctgagcaccacgtcgaaagagataatctcttctgagatgctggctacaagcattgatggcatggagcggccaggtaacctaaacaaggtcgttgagcagagacagaatgttggaactttagagtctttctcccccggagacttccgaactaacatgaatgttgttcaccaaaataagcagctagagagctgcaacggcgaaaaaccgccatgtctcgagatcctgactaatggctttgccgtgctcgaaaccgtgaacccccaaggtacagacgacctggataacgtcgccgatagtaagggacgcaagccgctcagcacgcacagtacagagtataacctggactctgttccaagccccgctgaggaattcgccgattttgccacattcagtaaaaaggaacggattcagctggaggaaatcgagtgcgctgtgctaaatgaccgggaggcactgaccatccgcgaaaacaacaagatcaatcgggtgaatgagttgaatagcgtgaaagaggtcgctctcgggaggagtctcgataataaaggtgacacggatggcgaggaccaggtgtgtgtgtccgaaataagcatcgtcacaaacagagggttttctgtggagaaacagggactgccaaccttgcaacaggatgaattcttacagagtggggtgcagtctaaagcatggagcctggtcgattcagctgataattcggaggcgattaggagggaacagtgcaaaacagaagaaaagttggatctcctaacctccaagtgcgctcacctatgcatggattcagtgaaaacctcagacgatgaagtgggatctccgaaagaagagtcaaggaagttcactaactttcagtcacctaacatcgatcccaccgaagagaatgatctggatgattccctgagtgtcaaaaatggcgattccagtaacgatttcgttacatgcaatgatatcaacgaagatgattttggcgattttggcgactttggtagcgcctccggaagcactcccccatttgtaaccgggacccaggactctatgtccgacgctacctttgaggaaagctctgagcactttccacatttcagcgaacccggagacgattttggggaattcggcgacattaatgcagtgtcatgtcaggaagaaactattctgactaagagcgacctgaagcaaacttcagacaatctctctgaagaatgccagctggccagaaaatcgagcggcacagggacggaaccagtggccaaactgaagaatggccaggagggggagataggtcatttcgattctgttccgaacatccaggatgattgcaacgggtttcaggactcagacgactttgctgacttttccagtgctggcccatctcaagtagtggactggaatgccttcgaggacgaacagaaggattcctgctcctgggctgctttcggcgatcagcaagccacagagtctcatcatcgtaaagaggcgtggcaatctcacaggactgacgagaacatagatactcccggaactccgaaaactcatagcgtgccctcggccacctcgaagggggctgtagcatccgggcacctgcaagagagcgcgacaagtgtgcagaccgccctgctcaaccggttagagcgaattttcgaggcatgctttccgagcattctggtgccagacgccgaagaggaggttacctccttaaagcacttactggagacaagcacactgcccatcaagacgagggaggctcttccagagtcaggtgagctgctggatgtctggactgaacttcaggacattcatgacgcccatggcctgcggtaccagtggggtgggtcccactctaataaaaagctattgtcctccctgggcattgatactagaaacatcttgttcactggtaacaaaaaacagccagtaatcgtgcccatgtacgcagccggtttggggatgttggagcctactaaagaaccactaaaaccactctccgccgcagaaaaaatcgcctcgatcggtcaaacagctactatgtccccggatatgaacacttgcacctccgatcagttccaagagtccctgccacccgtgcaattcgactggtcttcgagtgggctgaccaacccacttgacggggtggaccctgaactttacgagctgactacatctaagctggaaatttcaacatcctctctcaaggtgactgatgcctttgcgagactgatgagtacagtagaaaagacatcaacttcgacctcaagaaagcccaagagggaggagcatctctctgaggaggcgatcaaagtcattgccggacttcccgacctcactttcatgcatgcaaaagtactgatgttccccgctaccctcacaccgagcacgtcgtcccaggagaaggctgacggctag

SEQ ID NO: 27353 - DNA, 306 bp, Artificial Sequence
  Description of Artificial Sequence: Synthetic coding sequence
atggtgtgcgaaaagtgcgaaaaaaagctgggtaccgtgatcacacctgatacttggaaggacggggcacggaataccaccgagtctggcggacgcaaacttaatgaaaataaagcactgacatcaaaaaaggcaagatttgatccgtacggcaagaataagtttagtacctgtcggatctgcaaaagtagtgtccatcagcccggttcacattactgccagggatgcgcttataaaaagggaatttgtgcgatgtgtgggaagaaagtgctggacacgaaaaattataagcagacttctgtctag

SEQ ID NO: 27354 - DNA, 1467 bp, Artificial Sequence
  Description of Artificial Sequence: Synthetic coding sequence
atgaattttactcccacccacaccccggtttgtaggaagcgcacagttgttagtaaacgtggagtggccgtctcaggaccaacaaagagacggggaatggccgacagcctggagagtacccctctcccttctccagaagataggcttgctaagctgcacccgtcaaaggagctgctggaatactatcagaagaaaatggccgagtgcgaggctgaaaacgaagacctgctgaaaaaactcgagttatacaaggaagcatgcgaaggccagcacaagctggaatgtgatctgcaacagagagaggaggagatcgccgagttacagaaagccctctcagacatgcaggtatgtctattccaggagagggaacacgtgctgcgcttgtatagcgaaaatgatcgactccgcatcagggagctcgaggacaagaaaaaaatccagaatctcctggcactggtcggcacagacgctggggaggttacatacttctgcaaagaaccacctcacaaggtgacaattctgcagaagacaatccaggcagtaggagagtgcgagcagtccgagagcagtgcattcaaagctgatcccaagatcagtaaaaggcggccttctagagagaggaaagagtcatcagagcattaccagagggatatccaaaccctgatcctccaggtggaggccctccaggcccagctcggtgagcaaaccaaactgagtcgcgagcagatcgaggggctaattgaagatagacggatccacctggaggagatccaggtccagcatcaacgaaatcagaacaagattaaggaactaacaaagaatctgcaccatacccaagagttactctacgaaagcacaaaagatttcttacagctcaggagtgagaatcagaataaggagaaaagttggatgctggaaaaggataacctcatgtccaaaattaaacagtacagagttcagtgcaagaagaaggaggacaaaattggaaaggttctgcccgtgatgcacgagtcccatcatgcccaaagtgagtatattaagagcctcaaggataaactcgtgcaagaaaaaaaactgtctaatatgtaccaggagcagtgcataagtctcgaagaagaactggcaagaatccgtgaagaagaagggatgaggcgggagattttcaaagaccggactaacaaaatggggaagcgtttgcagatcatgacgaaacgctatgaagcactagaaaggaggcgaattctggaagtggaaggtttcaagaccgacatcaaagtgcttcggcagaagctgaaagacctggagcagatgttgtataaggctaccgttaacgccagggcaaatcaggatttggctctgctgtgcgaggtgagggatagcaacaggagggcccataagatacaaggagaacttaagaacctgaaatctaaggtgtttgggcttgaaaatgagctcagattgtgctag

SEQ ID NO: 27355 - DNA, 258 bp, Artificial Sequence
  Description of Artificial Sequence: Synthetic coding sequence
atgtcaaaggttagcttcaaaatcaccctgacttctgatcctagactgccatataaggttctgagtgttccagagtccacaccctttaccgccgtgctgaagtttgcagcggaagagttcaaagttcctgccgctactagtgctatcataacaaatgacgggatcggcattaatccggctcaaacagcaggaaacgtgttcctgaagcatggcagcgagctgcggattattccacgcgaccgggttggctcatgctag

SEQ ID NO: 27356 - DNA, 585 bp, Artificial Sequence
  Description of Artificial Sequence: Synthetic coding sequence
atggatgaagacggcctcccactcatgggcagcgggatagacctgacgaaagtcccggctattcaacaaaagagaactgtagcctttctcaatcaatttgtagtacacaccgtccagttcctaaataggttttccacagtctgtgaggagaaactggcagacctgtccctcagaatccagcagatcgagactacattaaacatcctggatgctaaactaagttcaattccgggactcgacgatgtaaccgtcgaagtctccccccttaacgtgaccagtgtgactaacggggctcaccccgaggccacttcagagcagcctcaacaaaatagtactcaagattctgggctgcaggaaagtgaagtgagtgccgagaatatcttaacagtcgccaaagaccctaggtacgccagatacctgaagatggtgcaggtcggcgtgccggttatggccatacggaacaagatgatctctgaaggccttgatcctgatcttctcgagcggccagatgctccagtccccgacggggagagtgaaaagacagtcgaagagtctagtgactctgagtcttcatttagtgattag

SEQ ID NO: 27357 - DNA, 2226 bp, Artificial Sequence
  Description of Artificial Sequence: Synthetic coding sequence
atgggccctccaggaccagcattgcccgcaactatgaataattcttccagtgaaactcgaggacatccccactccgcctcttctccctccgaacgggtttttcctatgcccctgccaaggaaagctcctctcaatatccctggcacgccagttttagaggacttcccgcagaatgatgatgaaaaagagagacttcagaggaggcgttcaagggtgttcgatctgcagttctcaaccgactctcctcgactgctggcctcacccagctcccggagcatagatatctccgccactataccaaagttcacaaacacccagatcactgaacattattcgacctgtattaaactctcgactgaaaataaaatcactaccaagaatgctttcggactgcacctgatcgattttatgagtgagatcctaaagcagaaggacactgaacccaccaacttcaaggtcgctgcgggaaccctggatgcctccacaaaaatttacgcagttcgggttgacgctgtccacgccgacgtgtatcgcgtgctcggcggactaggtaaggacgctccttcattagaagaggtcgagggccacgtggcagacggatctgcaacagaaatgggcacgaccaagaaggccgtcaagcctaagaagaagcatctgcaccggaccatcgagcagaacattaacaacctgaatgtgtctgaggctgatcgcaaatgtgagattgatccaatgtttcagaagacagcagcaagctttgacgagtgctccacagcaggcgtgttcttaagcacactgcattgccaggattataggtctgaactgcttttcccatctgacgtccagacactgtctaccggcgagccactagagcttcctgaactgggatgcgttgagatgaccgacctcaaggctcctctgcagcagtgcgcagaggatagacagatatgcccctcacttgcgggttttcagtttacccagtgggatagcgaaacccacaacgagtccgtctccgctctggtagacaaattcaagaagaacgaccaggtctttgacattaacgcagaagtggacgagtctgactgtggagacttcccggatgggagcttgggggacgatttcgacgccaacgacgagcccgatcatacggcagtcggggaccatgaggaatttcggtcatggaaggaaccctgccaggttcaatcctgtcaggaagaaatgatatccctcggggacggggacatcaggactatgtgccctttgctctcaatgaaacctggcgaatacagctatttctcaccccgaacaatgtccatgtgggctgggccagatcactggagattcaggcccaggagaaaacaagacgcgccatcccagagcgagaacaaaaaaaaatccacaaagaaggacttcgaaattgacttcgaagatgacatcgattttgatgtgtactttcgcaaaacaaaggctgccaccatcttgaccaaaagtacattggagaaccagaattggcgtgctaccacacttcccactgactttaattacaacgtggatacattggtgcagctgcaccttaaaccaggcacccgcttactgaaaatggctcagggacatagagtcgagacagaacattacgaggaaattgaggattatgactataataaccccaatgacacttcaaacttctgcccaggcctgcaggccgcagattcggacgatgaggatctggatgacctgtttgttggcccagtcggcaacagcgatctctcaccgtacccttgccacccacctaaaaccgctcagcaaaacggagacacacctgaggctcaaggtctggacattacaacctatggagaaagcaacctggtggcggagccccaaaaggtgaacaagattgagatacactacgcgaaaaccgcaaagaagatggacatgaaaaaactcaagcaaagcatgtggagccttctcaccgcactgtctgggaaagaagccgatgcggaggccaaccaccgcgaggcgggaaaggaagcagcattagcagaggtcgccgatgaaaagatgctgtctggtctgactaaagacctgcagcgttccctgcctccggttatggcgcaaaatctgtcaatccctttagctttcgcctgcctactacaccttgccaatgaaaagaacctaaaattagaaggtaccgaagatctgtctgatgtactggtgaggcagggggattag

SEQ ID NO: 27358 - DNA, 510 bp, Artificial Sequence
  Description of Artificial Sequence: Synthetic coding sequence
atgaaaggcagtcggattgaactgggcgatgtgaccccacacaacatcaagcagctcaaaagactaaatcaggtgattttcccagtgagttataatgacaaattctacaaggatgtgcttgaggtgggcgagctcgcgaagttggcatacttcaatgacatagcggtgggggctgtttgttgccgagtcgatcattctcaaaaccagaaaagactctatattatgaccttaggttgtttggcaccctatcggcgattgggtattggaactaaaatgctgaatcatgtgctcaacatttgtgagaaagacgggactttcgacaacatctatctgcacgttcaaatttcgaacgagtctgccattgatttttaccgtaagttcggttttgagatcattgaaactaaaaagaattattataagcgaattgaacccgcagacgcgcacgtgctacaaaagaaccttaaggtgccgtccggccaaaatgccgacgttcaaaaaacagataattag

SEQ ID NO: 27359 - DNA, 1245 bp, Artificial Sequence
  Description of Artificial Sequence: Synthetic coding sequence
atggcagccgcacctcctagttactgcttcgtggcgttcccgccacgcgctaaggatggcctggtggtcttcggtaagaactcagcacgtccacgcgacgaagtccaggaagttgtgtatttttccgccgcagatcatgaacccgagtcgaaagttgaatgcacttatattagtattgaccaggtcccaagaacttacgcaataatgatttcacggccagcctggttgtggggggctgaaatgggcgctaatgagcatggcgtctgcatagccaatgaagcgataaacacccgggaacctgcagctgaaatcgaggctttgctgggaatggatctcgtccgcctcggcctggaaaggggagagactgccaaggaagcattggatgttatcgtgtccctcctggaggagcatgggcaggggggtaactattttgaggacgcaaatagctgtcattcttttcagtcagcatatctgattgttgacagggatgaggcctgggtgcttgaaactataggcaaatattgggcagctgagaaggtgacggagggcgtgaggtgtatttgttcccaacttagcctgaccacaaaaatggatgccgagcatcccgagctgcggtcctatgcacagtcacagggttggtggaccggggaaggagagttcaacttttcagaggtgttctccccagttgaggaccacctggattgtggtgctggcaaagactccttggagaagcaggaggaaagcatcacagtccagaccatgatgaatactctccgcgataaggcatccggtgtgtgcattgattcagagttcttccttactactgctagcggcgtgtccgtgttaccccagaatcggtcttcaccttgcatccactactttactggcactccagatccaagccggtctattttcaagccttttattttcgtggatgacgtgaaattggtgccgaaaacgcaatctccctgtttcggagatgatgatccggcaaagaaggaaccacgattccaagaaaagccagacagaaggcacgagctctacaaggcccacgagtgggcccgagccattattgaatctgaccaggaacaaggcaggaaattgagaagcactatgctggagcttgaaaagcaggggctggaggccatggaggagattctgacctcatctgagccactggacccagcggaagtgggggacctgttctatgattgtgtcgatactgaaattaagttctttaaatag

SEQ ID NO: 27360 - DNA, 2031 bp, Artificial Sequence
  Description of Artificial Sequence: Synthetic coding sequence
atgtcggatcagatcaaatttataatggactctttaaataaggaaccctttcgtaagaactacaatcttatcaccttcgattcactggaacctatgcagctgttacaagtgctgagtgatgtgctagcagaaattgatcctaaacagctcgtggacatcagggaagagatgcccgaacagactgcaaagaggatgctctcactcctgggcatcttaaaatataaacctagtggcaatgcgaccgacatgagtacctttagacaaggacttgtaattgggagcaagcctgtgatatatcccgtactgcactggctgttacagcggaccaacgaacttaagaaacgagcctacttggcccgtttcctcattaaacttgaagttccaagcgagttcctgcaggacgaaactgtggctgatacaaataagcagtatgaggagcttatggaagcgttcaaaacgctccacaaggagtacgagcagctgaagataagcggcttctccaccgcagagataagaaaagatatttcagcaatggaggaggagaaagaccagctcatcaaaagagtcgaacatctgaaaaagcgggtcgagacggcgcagaatcaccagtggatgttaaagatagccagacagctgcgggtcgaaaaagagcgagaagaatacctggcccagcagaagcaggagcagaaaaatcaacttttccacgccgtacaacgcctacaaagagtgcagaatcagctgaaatccatgcgccaggcagccgcagacgcaaaacctgagagcctcatgaagcggttggaagaagagataaagtttaacttgtatatggtcaccgaaaaatttcccaaggagcttgaaaataagaagaaagagttgcactttctgcagaaagtggtgtctgaacctgccatgggccatagtgacctgttggaactggagtctaaaattaacgagatcaacaccgagattaaccaattgatagagaaaaagatgatgcgcaatgagccgatagaggggaagctgtcactttataggcagcaggcaagcattatatcccgcaaaaaggaagccaaggcagaggagctgcaagaggctaaggagaaactcgcgagtcttgagagagaggcgtctgtcaagaggaaccagaccagggagttcgacggcaccgaggtgctcaaaggagatgaatttaagcgctacgtaaacaaactgaggagcaaaagcaccgtctttaaaaagaagcaccagataatcgccgaattgaaagccgaattcggtctgctccaaagaacagaggagctactgaagcagagacacgagaacattcaacagcaactacagaccatggaggagaagaaggggatctccggctactcttacactcaagaagagctggagagagtgagcgcactgaaaagcgaagtggatgaaatgaaaggccgaactttggacgacatgtctgagatggtgaagaagctgtacagtctggtcagcgagaagaaaagcgctcttgcctcagttatcaaggagcttcggcaactccgccaaaaataccaggaactcacacaggaatgtgacgagaagaaaagccagtacgattcgtgcgctgcaggactggagtctaatcgcagcaaattagaacaggaggtgcgaaggctgcgagaggaatgcttgcaggaggagtcccgctatcattacaccaactgtatgattaagaacctcgaggtgcaactgcggagggcaactgacgaaatgaaagcctatatctcctctgatcagcaggaaaagaggaaggctattagggaacagtacacaaaaaacaccgcagaacaggagaacttaggcaaaaagttgcgagaaaagcagaaagtgatccgcgagtctcacgggcctaacatgaaacaagccaaaatgtggagggacctcgagcaactgatggaatgcaaaaagcaatgttttctaaaacagcaatcacagaccagcatcggacaggtcatccaggagggcggtgaagatcggctgattctgtag

SEQ ID NO: 27361 - DNA, 948 bp, Artificial Sequence
  Description of Artificial Sequence: Synthetic coding sequence
atggctttcccagagccaaagcctagaccaccggagctcccacagaaaagacttaaaaccctggattgtggacaaggagcagtgcgggctgtcagattcaatgtggacggcaattactgccttacatgcggctctgacaagactttgaaactgtggaatcctctgcgcggtactctgctgcgcacctactccggacacggatatgaggtattggacgcagccggaagctttgacaattctagcctgtgtagcggtggaggtgataaggctgtggttctctgggatgtagcatcaggtcaggtggttaggaaatttagaggacatgccggtaaggtgaatacagttcagttcaacgaggaagctaccgtaatattgagtggtagtatcgatagcagcatccgctgctgggactgtcgatcaaggagacccgaaccagtgcagacattagatgaggccagggacggagtgagctcggtgaaagtgagtgaccacgagattcttgcaggatccgtggatgggcgagtcaggagatacgatttgcgcatgggtcagctgttctcagactatgtgggaagcccaatcacatgtacgtgtttctcaagggatggtcagtgcacactggtctcatcgctcgacagtaccctgcgacttctggataaggataccggcgagcttctcggcgagtataagggccataaaaaccaggagtataagctcgactgctgcctttccgaacgcgacacccatgtggtctcttgctccgaagacggtaaagtgttcttttgggacctggtggaaggagctctcgctcttgcactccctgtcggttctggtgtggtgcagtccctagcctatcaccctacggagccctgcctgctgaccgccatgggcggaagtgtccaatgttggcgggaggaggcttacgaagccgaagatggcgcaggatag

SEQ ID NO: 27362 - DNA, 1803 bp, Artificial Sequence
  Description of Artificial Sequence: Synthetic coding sequence
atggttcttatcctgggtaggcgcctgaacagagaggacctgggggtcagagatagccctgccacaaaaaggaaggttttcgaaatggatcctaaatctctaacggggcacgagttctttgacttttccagtggctcttctcatgcggaaaacatcctgcagatatttaacgagttccgggacagcaggctgtttacagatgtcatcatctgcgttgaaggcaaagagttcccttgtcatcgcgcagtcctgtccgcatgcagcagctattttcgcgctatgttctgtaacgatcacagggaatccagagaaatgctggtagaaattaacggaattttagctgaggcgatggaatgtttcttgcagtatgtgtacaccgggaaggtaaagatcactacagaaaatgtccagtaccttttcgaaaccagttccctgttccagatcagtgtgctgagagacgcctgtgccaaatttttggaagagcagctagacccctgtaattgcctgggaatccaacgctttgccgatactcacagcttgaagacactcttcacaaaatgtaagaatttcgccctgcaaacttttgaagatgtcagccagcacgaagagttcctcgaactcgacaaagacgagctgatcgattatatatgctcagacgagttagtgatcggaaaggaggaaatggttttcgaggccgtgatgcgctgggtgtatcgagcagtggacctgcggaggcccctgctgcacgaactcttaacgcacgtgagattacctttactgcatcctaattactttgtccagacagtcgaagtggaccagttaatccagaattctcctgagtgttaccaactgttgcatgaagctagacggtatcatattttgggtaatgaaatgatgagccctagaacccggcctcgccgtagcacaggatactcagaggttattgtggtggtcgggggttgcgaacgcgtgggtgggtttaatctgccctataccgaatgttacgacccagtgaccggcgaatggaagtcccttgcgaagctgccagagttcacaaagagtgaatacgccgtctgcgcccttcgaaacgatatcttagtctccggtggccgaatcaattccagagacgtctggatttacaactcacagttgaacatttggatacgagtagcaagcctgaacaagggccgatggaggcataaaatggctgtgctcttgggaaaggtctatgttgtgggaggttacgacggtcagaatcggttgagctccgtggaatgctacgattcgttttcaaacaggtggacagaggtggcccctctcaaggaagccgtgtcatcaccagctgtgacgagttgcgtagggaagttgttcgttattgggggtggtcccgatgacaacacatgtagtgacaaagtgcagtcgtatgaccctgaaactaattcatggctcctacgcgctgccatccctattgctaagcgctgtattacagcggtaagtctgaataatctcatttatgtagcaggcggtctcactaaagcgatctattgctacgatcccgtggaggattactggatgcatgtgcagaatacattttccaggcaggaaaattgcgggatgagtgtctgtaacgggaaaatctacattctcggaggcaggagggagaacggggaagcgactgacaccattctctgctatgatcctgcaacttccattatcacaggggtagcagctatgccgagacccgtgagttaccacgggtgtgttacaatacatcggtataatgaaaagtgttttaagctgtag

SEQ ID NO: 27363 - DNA, 810 bp, Artificial Sequence
  Description of Artificial Sequence: Synthetic coding sequence
atgaaccaagaggatctggatccagactctacaaccgatgtgggcgacgtgaccaatacggaagaggagctaatccgggagtgcgaagagatgtggaaggacatggaggaatgtcagaacaaactgagcctcatcgggaccgaaacccttaccgactctaacgctcagctcagccttctgataatgcaggtgaaatgcctcaccgcagaactgagccagtggcagaaaaagacaccagagaccattccactaactgaggacgttctgatcactctgggcaaggaagaattccagaagctccgccaggatttagagatggtactctctaccaaagaatcaaagaatgagaagctgaaggaggatttggagcgggaacagagatggctcgatgagcagcaacagatcatggagtctctgaacgtgctccatagcgagctaaagaataaggtggagacatttagtgagtctcgaatttttaatgagctgaagacaaagatgttaaatatcaaggagtacaaggagaaattgctgtctacccttggggaattccttgaagatcactttcctctcccagacagaagtgtgaagaaaaaaaaaaaaaatatccaggaatcgtccgtcaacctgatcacactgcacgaaatgttggaaatccttatcaataggcttttcgacgtccctcacgatccatatgtgaagattagcgacagcttctggcccccttatgtagagctgcttttgcggaatggaatcgccttacgccaccctgaagaccccacccggatcaggctggaggcctttcaccagtag

SEQ ID NO: 27364 - DNA, 1041 bp, Artificial Sequence
  Description of Artificial Sequence: Synthetic coding sequence
atgtgtgaagggccatccagaatttccgggcctatcccaccagaccctacattatgcccagataattataggaggccaacatccgcccagggtagactggaggggaatgcattaaaactggacctgctaacttcagatcgcgcactggatacaacagcaccacggggtccctgcatcgggcctggagctggcgagattctagaacgcggacagcggggagtcggagacgtgctattgcaactggagggtatatcattaggccctggggcatcccttaagcggaaggaccccaaggatcacgaaaaagaaaatttgagacggatcagagagattcagaaacggtttcgcgagcaagaaaggtctagggagcaaggccagccacggcctctcaaggcgttatggcggagcccgaagtatgacaaggttgaaagtagggtcaaggcacagctccaggaacccggaccagcttctgggactgaatctgcccatttcctgcgtgcacattctaggtgtggtcctgggttacctccccctcacgttagcagtccacagccgaccccccctggaccagaagcaaaggaaccaggactgggagtggacttcatcagacacaatgctagggccgctaaacgagcccctaggagacactcgtgcagtctgcaggtgctggctcaggtcctggaacagcagaggcaggctcaggagcactacaacgccacccagaaggggcacgttccacattacctgttagagcggcgagacctctggcgaagggaggcagaggctagaaagcagtcacaaccagaccccgctatgcccccagggcatacacgtatgccagagaaccagcgacttgaaactctgacaaaactcctgcagagccagagccagctgctccgcgaattagttctgctgcccgcaggagccgatagtctccgcgcacaatcccaccgggcagagctggatcgcaaactggtccaggttgaggaggcaatcaagatattctcccgccctaaggtgttcgtgaaaatggacgattag

SEQ ID NO: 27365 - DNA, 1824 bp, Artificial Sequence
  Description of Artificial Sequence: Synthetic coding sequence
atggccgctaatgtattcccctttcgggacgctagagctgctcccgatcccgtcttggaagccggaccggtagctcatggacccctcccagtgccgctcgttctcgataatgggtcattccaggtacgggctggttgggcctgtccgggtcaagatccaggacctgaacctagattgcagtttcgagccgtgtgtgcacgcggtcggggaggggctcgcggagccagcgggcctcaggtgggtaatgctctcggaagtcttgagcccctaagatggatgctgcgtagtccttttgaccgcaacgtccccgtcaatttggaactccaagagctgctgttggattactcattccaacacctaggggtttccagccagggatgtgtggatcacccgatcgtgctcaccgaagccgtgtgtaaccccctttactctcggcagatgatgtcagagctgctcttcgagtgctatggcatccccaaggttgcctacgggatagattctctcttcagtttctaccacaacaagcccaagaactcgatgtgtagcggcctcataattagctcagggtaccagtgcacccatgttctgcccattctggagggcagactggacgcgaagaactgtaagagaataaacttaggaggttcccaggccgctggctaccttcagcgtttactgcaactgaagtatcccggacacctggccgctataacactttcacgcatggaggagatcttgcatgaacacagttacatcgccgaagactacgtggaggagcttcacaaatggcgatgccctgattactatgaaaacaatgtgcataaaatgcaacttccgttttcatccaagttgttggggagcacactcacatctgaggagaaacaggagcgacgccaacagcagctccggcgactccaggagctaaatgcaagacgccgtgaggagaagttgcagctagatcaggaaagacttgataggctgctctacgttcaggagttgctcgaggacggtcagatggatcagttccataaagccctgattgagttaaatatggacagccctgaggagctccagtcatatatacagaagctgtctatcgccgtggagcaagccaagcagaaaatcttacaggcagaggtgaacctggaggtcgacgtggtcgactccaaaccagagaccccagacctagaacagctggaacccagcctcgaagacgttgaatctatgaatgactttgatcctctgttttcggaggagaccccgggagtggagaaacctgtcaccaccgtgcagcctgttttcaacctggccgcataccaccagttgttcgttgggacggaaaggattagagcccctgagatcatcttccagccctctttgatcggcgaggagcaggccggaatcgccgagacgctccagtacatcctggatcggtacccaaaagacatacaagagatgctcgttcaaaacgtgtttctgacagggggaaacacaatgtaccctgggatgaaggcacggatggagaaagaacttctggaaatgaggccgttcagatcttccttccaggtgcagctcgcctccaaccccgtgttagacgcctggtacggcgcaagagattgggcgttgaaccacctcgacgacaacgaggtgtggatcacacgcaaggagtatgaggagaagggaggcgagtacttgaaggaacattgtgcttccaacatctacgtaccaatcagacttcccaaacaagcgagcaggagtagcgacgcacaggcaagctctaagggtagcgcagccggaggaggtggcgctggcgaacaggcttag

SEQ ID NO: 27366 - DNA, 1383 bp, Artificial Sequence
  Description of Artificial Sequence: Synthetic coding sequence
atggcctcgagggaggaggttctggccctacaggctgaggtggcgcaacgtgaagaggagctgaattccctgaagcagaaactggcttcagcgctgctggccgaacaggagccccaacccgaacgcctcgtgcccgtatcccctcttccacccaaggcagccctttcaagagacgagatcctgcgctactctcgacagctggttctcccagagcttggtgtgcatggccagttaagattaggcactgcttgcgtgctgatagtcggctgtggcggtctggggtgtcctctggcccagtaccttgctgctgcaggcgttgggcgtcttggactcgtggactatgatgtcgtggaaatgagtaacttagccagacaggttctccacggggaggctctggctggccaggccaaggctttttcagcggcagcttcgctgcgcagactcaatagtgctgtagagtgtgtcccctatacacaggctctgacccctgcaactgcgttggacttggtccgccgttacgacgtcgtcgccgattgctccgataatgtccccacccgatacctggtgaacgatgcctgcgtgctggccggaagaccgcttgtgtccgcttctgcgctacggttcgaaggacagattacggtgtaccactatgatgggggaccgtgttaccgctgtatttttccccaaccccctcccgcagagacggtgaccaattgtgccgacggcggagtgttgggagttgtgaccggcgtgttgggatgccttcaagccctcgaagttctgaagattgcggcaggccttggtccttcctactccggaagcttgctcctcttcgacgcactcagaggccacttccggtctatacggctgcggtctagaagactggattgtgctgcctgtggagagcggcctaccgtgacggacctgttggattatgaagccttttgtggctccagtgccacggacaaatgtcggagtttgcagctgctttcaccggaagaacgcgtctccgttacggactacaagcggctccttgactccggagcttttcacctacttcttgatgtgcgccctcaggttgaggtggatatatgcagactgccccacgccttacatattcccttgaagcacctcgagagaagagatgcagagtctctcaaactgttaaaggaggccatatgggaggagaaacaaggtacccaggagggtgcagcggtccccatatatgtaatctgtaagcttggtaatgattcacaaaaggctgtgaagatcctgcagagcctgtccgccgcacaggagctggacccccttaccgtaagggacgttgtgggcggattgatggcctgggctgcaaagatcgatggcacattcccacaatactag

SEQ ID NO: 27367 - DNA, 1041 bp, Artificial Sequence
  Description of Artificial Sequence: Synthetic coding sequence
atggaatctgtctcgtgcagtgctgctgccgtgaggactggcgacatggagtcacagcgggatctttccctagttcccgaaagactccagaggagagagcaggagcggcagctcgaggttgaacgcaggaagcagaagaggcagaaccaggaagtcgagaaagaaaacagccattttttcgtggccacattcgtgcgtgagcgggcagctgtcgaggaactgctggagagggctgagtccgtggaaagattggaggaagctgcctctcggctccaggggctacagaaactgatcaatgattcagtctttttcctcgccgcttacgatttgcggcaggggcaggaagccctggcgaggcttcaggccgctttagcggaacgtcgtaggggactccagccaaagaagagatttgcatttaaaacaagggggaaagacgctgcttccagcaccaaggtggacgccgctccaggcattcctccagccgtcgagtccattcaggattcacccttgcctaagaaggcagagggtgacctcggtccctcttgggtctgcgggttctcgaatctggagtcacaggtgcttgagaagagagcgtcggaactgcatcagcgggacgtactcctgactgagctgtctaattgcaccgtgcgtctgtacggaaacccgaatactctccgtctaactaaagctcactcctgtaaacttttatgcgggcctgtcagcactagtgtgtttctggaggactgctcagattgtgtgctcgccgttgcctgccaacagttaagaatccacagcaccaaagatacccgcattttcctgcaggtgactagtcgggcaattgttgaggactgttctggcatccagttcgctccctacacatggagctatcctgagatcgataaggattttgaatcctccggtctcgacaggtctaaaaacaattggaacgacgtagatgattttaattggctggccagagacatggccagccccaactggagcattttacccgaagaagaaagaaatatccagtgggattag

SEQ ID NO: 27368 - DNA, 747 bp, Artificial Sequence
  Description of Artificial Sequence: Synthetic coding sequence
atgacgcctaagggtccggcaatgtgtagtatgccactcacttcagccgactgtttcagcaacgatattcataagctagatacatctactatgacctggactctaatctgcacgaaggggagcccagcccgatggagggattttcactctgctaccatgctggggtctcacatgtatgtgtttggcggacgcgcagaccggtttggcccatttcactccaataatgagatttactgcaaccgaatccgcgtcttcgacacaaggaccgaggcatggctggactgtccgcctacacccgtgctcccagagggccgtcggagccacagcgcgttcggctacaacggagaactgtacatattcggcggatacaatgcacgactgaatagacactttcacgatctctggaagttcaaccctgtgtcctttacgtggaaaaaaatagaaccaaagggcaaaggtccttgtccacgcaggcgacagtgctgctgtatcgtgggggataagatcgtcctgttcggcggtactagtccctccccagaggagggactgggggatgagtttgacctgatcgaccattctgacctgcacatcttggacttttcaccttctctgaaaacgctttgtaagttggctgtcattcagtacaatctcgaccagagctgcctgccacatgatatccgctgggagctcaatgccatgacgacaaacagcaatatctctaggcctatagtcagctctcacggttag

SEQ ID NO: 27369 - DNA, 1401 bp, Artificial Sequence
  Description of Artificial Sequence: Synthetic coding sequence
atggagtacgaatcatattatttcgtgaaattccagaaatatcccaaaatcgtgaaaaaaagttcagatacggctgaaaataacttgccccagagaagcagaggaaaaaccaggcgaatgatgaacgatagctgtcaaaacttacccaaaataaatcagcagcgcccacgcagcaaaacaactgcaggtaagactggtgatacaaagagtctaaataaagagcaccccaatcaggaggttgtggataacacccggctggaaagcgcaaacttcggacttcacatctctcgcataaggaaagactcaggcgaggaaaacgcccaccccagacggggacaaattatcgactttcagggcctccttacagacgccattaagggcgctaccagcgagctggctctcaatactttcgatcataacccagatccgtccgagcgacttcttaaaccactcagcgcgtttattggaatgaattcagagatgcgcgaacttgctgctgtcgtgagcagagatatctatctgcataatcctaatatcaaatggaacgacatcattggtttagacgccgcaaagcagctggtcaaagaagctgtggtctacccgatcagatacccacaattgttcaccggaattctgtccccctggaagggcctgttattgtacggaccacctggcacgggtaagaccctgctcgctaaggccgtcgccacagagtgcaaaacaacattttttaacatttccgcctcaaccatcgtttccaagtggcggggagattcggaaaagctggtgcgtgtgctgttcgagttagcaagatatcatgcccctagcaccatatttctcgacgaacttgaatctgtgatgtcacagagaggaacagccagtggtggggagcatgaaggctctctgcgcatgaagactgagctgctggtgcaaatggacggcctggccagaagcgaggacctggtcttcgtgcttgcggcatccaatctgccatgggagctggactgtgccatgctgcggcgattagagaaaaggatactcgtagatcttcccagccgcgaggcgcgacaagcaatgatataccactggctgcctcctgtgtccaaatccagagcccttgaactacacacagagctggaatacagcgtgctgtcacaggagacagaaggttattcaggttctgacattaagctggtctgtcgagaggccgctatgcggcctgtgaggaagatcttcgacgccctggagaatcaccagagcgagtcttccgacctgcccaggatccagcttgacattgtgactacagcagactttctcgacgttctgactcataccaagccctccgcaaaaaacttggcacaaaggtactccgattggcagagagagttcgaatcggtttag

SEQ ID NO: 27370 - DNA, 6402 bp, Artificial Sequence
  Description of Artificial Sequence: Synthetic coding sequence
atggatgaggtagaacaggaccaacacgaggccagactgaaagagctctttgactcttttgacacaaccggaaccgggagcttgggtcaggaggagttgacagatctctgccacatgctgtctctcgaggaggtcgcccctgttctacagcagacactcctccaggataacctccttggccgagtgcattttgaccagttcaaagaagctctcatactgatactctctcggactctttctaacgaggagcattttcaggagccggactgcagtctcgaggcacaacccaagtatgtgagagggggaaagcgatacggcaggaggagtctacccgagtttcaagagtctgtagaagaattccctgaagtcacagtgattgagccccttgacgaggaagccaggcctagtcatatccccgctggcgactgttcagagcactggaagacccagcgctctgaagagtacgaggctgagggccagctaagattctggaatcctgatgatcttaatgcgagtcagtctgggtctagtcccccacaggattggattgaggagaaactgcaagaggtatgtgaggatctgggcatcacacgcgacggacatttaaaccgcaaaaagctggtttccatttgcgagcagtatggccttcagaacgtggacggcgagatgctggaagaagtgtttcataatcttgatccggatgggacgatgagtgtggaagacttcttttatgggctcttcaagaacggcaagagtctcactccgagcgcctcaacaccctatcgccagcttaagcgtcacctgagcatgcagagttttgatgagtcgggcaggagaaccacaacgtcctctgccatgacctcaacaatcggcttccgggtgttcagttgtttagatgacggaatgggccacgccagcgttgaacgcattctggacacttggcaggaggagggcatcgaaaactcccaggagatccttaaggcccttgatttcagcctggacggaaatattaatctcaccgagctgacattagccttagagaacgaactgctggtaacaaaaaattcaattcaccaggcagccctggccagttttaaagccgaaatcagacacctactagagagagtggatcaggttgttagggagaaggaaaaactaaggtcggatctggataaggccgaaaagttaaaatcgctaatggcgtctgaagtggacgatcaccacgctgccatagaacgccgaaacgagtacaatttgcggaagttggatgaggagtataaagaacggatcgcagcattgaagaacgagctcaggaaggaacgggaacagatactgcagcaagctggaaaacaaaggctggaactggaacaggaaattgagaaggccaaaaccgaggagaactatatcagagaccgacttgcactgagcctgaaagagaactcacgactggagaacgagctgttggagaatgccgaaaagctggcggagtatgagaacttaacaaacaagctgcaaaggaacctggaaaatgtactggcggagaagttcggcgatctcgacccaagcagcgcagagtttttcctgcaggaagagaggttaacccaaatgaggaatgagtacgaacgacagtgtcgggtgctgcaggatcaagttgacgagttgcagtctgaactggaagaatatagggctcaagggcgagtgctcaggctcccactcaaaaattccccaagtgaagaggtggaggcgaatagtgggggtatcgagccagaacatggactgggctcagaggagtgcaatccacttaacatgtccatcgaggcagagctcgttattgagcagatgaaagagcagcatcacagggacatctgttgtctcaggcttgagctggaggataaagtcagacactacgagaagcaacttgatgagacagtcgttagctgtaaaaaagcccaggaaaatatgaagcagagacacgaaaacgaaacacacaccttggaaaaacagatttctgacctgaagaatgagattgccgagctccaagggcaggctgccgtgctgaaggaggcacatcatgaagctacttgtcgacatgaggaagagaagaaacagctccaggtgaaattagaggaagagaaaacacatctccaagagaagctgcgattgcaacatgagatggagctcaaagcgaggctgacacaggctcaggcaagttttgaacgcgaacgcgaaggactgcagtcttcggcctggactgaagagaaggtccgcggtctcacacaggaactcgaacaattccaccaggaacagttgacctccttagtggagaagcatacgctcgagaaggaagagctgcgcaaagaactccttgagaaacatcaacgggagcttcaggaaggacgggagaaaatggaaaccgagtgtaatcgaagaacttctcaaatcgaggcccagtttcaatcagattgtcagaaggtcaccgaacgctgtgaatccgccttgcaatctctggaagggcgataccgacaggagctcaaggacctccaggagcaacagcgcgaggagaagtcccagtgggagtttgaaaaggacgaactgacacaggaatgcgccgaggctcaggagctgctgaaggaaaccctgaagagagaaaagactacctccctagttctgacacaggagcgtgagatgctggagaagacttacaaggagcatctgaattctatggtagttgaacgacagcagctcctgcaggacctagaagacctgaggaacgtgtcagagactcagcagtctctgctatcagatcagatcttagagctgaagagttctcacaaaagggaactgagggaacgggaggaagtgctctgccaggccggagcaagtgaacagctggcgtcgcagcgtttggaacgcttggaaatggagcacgaccaggagcgacaagaaatgatgtcaaagttactagcaatggaaaatatacacaaagctacgtgtgaaacagctgacagggaaagggctgaaatgtcaacagagatttccaggctgcaatctaaaatcaaagagatgcagcaagctacctcccccctgtccatgctccaatcgggctgtcaagtgatcggagaggaggaagtggagggtgacggagccctcagcctgttacaacaaggggagcagttgcttgaagagaatggcgacgtactcttgagcctgcagagagcccacgaacaggcagtcaaagagaatgtgaagatggctaccgagatcagtagactccagcagaggttgcagaagctggaacccggactcgtgatgtcttcatgcctggacgagcctgccacagaattcttcggaaacacagctgaacagactgaacagttcttgcagcagaataggacaaaacaggtcgagggggtgacaaggaggcacgtcttgagcgacttagaagacgacgaagttcgagatctgggttcgactggaacatcttcagtgcaacgccaggaagtgaagatcgaggaatccgaggccagcgtagaggggttcagcgagctcgagaattccgaggaaacacgaaccgaatcatgggaattgaagaaccagattagccagttacaggaacagctgatgatgctgtgtgccgactgcgacagggccagtgagaagaaacaggacttgctgtttgatgtgtccgtgctgaagaaaaaactcaaaatgctggagcgaatccccgaagccagtcctaagtataaactactctacgaagacgtgagccgagaaaacgactgccttcaggaggaactgcgaatgatggagacaagatacgacgaggctctggaaaacaacaaagagctgaccgcagaagtcttccggctgcaggacgagttgaagaaaatggaggaggttaccgagacgttccttagtctggagaagagctatgatgaagtcaaaattgaaaatgaggggctgaatgtcctggtactgcggctgcagggaaaaattgagaaactgcaggagtccgtggttcaaagatgtgattgttgtctgtgggaagccagtctggagaacctggaaatcgagccagacggtaatatcttacaactgaatcagacgctcgaggagtgcgtcccacgagtgagatccgtccaccatgtcatcgaagaatgcaagcaggaaaatcagtacctagaggggaatactcaactgctagagaaagttaaggcacatgaaattgcctggttgcatgggaccattcaaactcaccaggaaaggcctagggttcagaaccaggtaatcctggaagagaatacaactctactaggttttcaagacaaacacttccaacatcaggccactatagcggaactcgagctggaaaagacaaaattgcaagaactgacaaggaaattaaaggaacgcgttaccattctggtgaaacaaaaagatgtactatcccatggagagaaagaagaagaactgaaggcaatgatgcacgacctgcagattacgtgttcagagatgcagcagaaagtcgaactcctgagatacgaatcggaaaagctacagcaggagaattcaattttgcggaatgaaatcactaccctgaatgaagaggattccataagcaaccttaaactgggtacactcaatggcagccaggaggagatgtggcagaaaaccgagacagtaaagcaggagaacgcagccgtccagaagatggtggagaatctaaaaaaacagatctctgaactgaagatcaagaatcagcagttagatctggagaacacggagctgagccagaaaaactcccagaatcaggaaaagcttcaggagctcaaccagcgcctgactgagatgctttgtcagaaagagaaggaacccggaaattctgctttagaagagcgcgaacaggagaagttcaacctcaaggaggagctggagcggtgcaaggtgcagtctagtaccctagtcagctctttagaagctgaattgtccgaggtgaaaattcagacccacatcgtccagcaggaaaatcacctgctcaaagacgagctcgagaaaatgaagcagctgcaccgctgtccagacctgtccgattttcaacagaagatcagtagtgtgttgtcctacaatgagaagctcctgaaggaaaaggaggcattatcagaagagctgaacagctgcgtggataagttagctaagtcatccctgttagagcataggatagcgacaatgaagcaggaacaaaagagctgggaacaccagtcagcttctcttaagtctcagctggtcgcctcccaggagaaggtacagaacctggaggatacagtgcaaaacgtgaacctccagatgtcgagaatgaaatctgacctgagggtcacacaacaagaaaaggaagctcttaaacaagaggttatgagcttacataagcaactgcagaatgccggaggaaagtcgtgggcaccagagattgctacgcacccatcaggacttcacaatcaacagaagcgcctatcttgggataagctggaccacctcatgaatgaagaacagcaactgctgtggcaggaaaatgaacggctccaaaccatggtacagaacactaaggccgagttgactcactccagggaaaaagtacggcagttggagagtaatctgctgccaaaacaccaaaagcacctgaacccttctggaaccatgaatcctacagaacaggaaaaattgagtctcaaaagagaatgcgaccaattccaaaaggaacagtccccagccaaccggaaggtttcgcaaatgaacagcctcgaacaagagctggaaactattcacttggaaaacgagggtctgaaaaaaaagcaggttaaactcgatgagcagctgatggagatgcagcatctgagatcaaccgcaacgcccagcccgagccctcacgcctgggacctgcagcttctgcagcagcaagcctgcccgatggttccacgtgaacagtttctacagttgcagcgacagctgctgcaggctgagcgcatcaatcagcatttacaggaggagctggagaatagaacatccgagaccaatactccccagggtaaccaagaacagctcgtcaccgttatggaggagaggatgatcgaagtcgagcagaaactaaagctcgtgaagagactccttcaggagaaagtgaaccagttaaaggagcagctgtgcaagaacacaaaagcagatgcaatggttaaagatctttacgtggagaacgctcagttgctaaaagcactggaggtcacagagcagcgccaaaagaccgctgaaaaaaaaaactatcttctcgaggaaaagatcgcaagcttgagtaatatcgtccgtaatctgacgccggctcccttgacctctaccccaccccttcggtcttag

SEQ ID NO: 27371 - DNA, 1713 bp, Artificial Sequence
  Description of Artificial Sequence: Synthetic coding sequence
atggcaggcggagcacgggaggtcctgacgttacagttgggccacttcgccggatttgtgggggcacattggtggaatcaacaggatgcagccctgggcagagctactgatagcaaggagcctcccggagaattgtgtcctgacgtcctttaccgtacgggtagaacactgcatggacaagagacctacactcccaggctgattctcatggacctgaaggggagcctgagctcattgaaggaggaaggtggactgtaccgagataagcagcttgacgcagccatagcatggcagggaaaactgaccacccacaaggaagagctttacccaaaaaatccctacttacaagatttcctatccgcagaaggtgtgctgtcttccgatggagtctggcgagttaaaagtatccctaacggaaaagggtcgtcaccactgccaacagctacaacccccaagccactgatcccaactgaggcctctataagggtttggagcgatttccttcgcgtccacctgcaccccaggtccatttgcatgattcagaagtacaaccatgatggagaggcaggacggctagaagctttcggacaaggtgagtcggttcttaaggaaccaaaatatcaagaagagctggaggacaggctgcatttttacgtggaggagtgtgattacctgcaaggcttccaaattctgtgcgacctgcacgatggcttcagtggcgttggcgctaaggccgcagagctcctccaggatgagtacagtggtcgcggtattataacctggggcctgctgccgggaccgtatcatcgaggtgaagcccagcgcaacatttaccgactattgaataccgcttttgggttggttcacttgaccgctcactctagcctcgtctgccccttgtccctgggcggtagcctgggattgagaccagagcccccagtgagtttcccctatcttcattacgatgcaactcttccttttcattgcagtgctatactggccactgctttagacacagttacggtaccataccggctgtgtagtagccccgtctctatggtacacctcgctgacatgctgtctttttgtggtaaaaaggtggtaactgcgggagccatcattccgtttccgctcgccccaggccaatctctgcctgatagtctgatgcagtttggcggagctacaccctggactccactgagcgcatgtggcgagccgtcagggactcgctgctttgcccagagtgtggttctccggggaatcgaccgcgcttgtcatacttcacagctcacccccggtactcccccaccgtcagctctccatgcatgcacgaccggcgaggagatactggcccagtatctgcagcagcagcagccaggagtgatgtcatcaagtcacctcttactgactccttgtcgcgtggcccctccatatcctcacctgttttcttcgtgttcccccccaggcatggtgctggacggtagcccaaagggcgcagcagtggaatcaatcccagtgttcggggctctttgcagctcatctagtctccaccaaacactagaggcccttgcaagagacttgacgaaattggatctgcgcaggtgggcgtcttttatggatgccggagtggagcatgacgacgtcgctgagctgctgcaagagctccagtcgctcgcccaatgctaccagggtggtgactccttggtggattag

SEQ ID NO: 27372 - DNA, 1791 bp, Artificial Sequence
  Description of Artificial Sequence: Synthetic coding sequence
atgaacaggacctggcccaggagaatctggggaagctcccaggacgaggcagagctgatccgagaggacatccagggggctctgcacaattataggagcggaaggggggaacggcgagcagctgccctccgcgctacgcaggaggagctgcaacgtgaccgatccccggcagctgaaacccccccactgcaacggagaccctccgtgcgcgctgtcatcagcacggtggagcgtggggcaggcagagggcgtccccaagcgaaacctatacccgaagcagaggaagcccagaggcccgaacccgtcggaacaagttctaatgcggactccgcttctcccgatttagggcctagaggacctgatcttgccgtgctgcaggcagagagagaggtcgatatcttgaatcacgtttttgatgatgtggaatcattcgtctcccggctccagaagagcgcagaagctgcaagggtcctggagcatcgtgaaagaggacgtaggagccgacggagggcagcaggtgagggacttctaacactgcgtgcaaagccaccatccgaagctgagtacacagatgtgttacagaaaattaagtatgccttctcccttttggccagactcagaggcaatatcgctgatccgtcttctcctgagctccttcattttctgttcggcccactgcagatgatcgtgaacacatctggagggcctgagtttgcgtcttccgtgaggagaccgcacctcacttccgacgctgtagccctgctcagagataatgttaccccccgagaaaacgagctttggacatcactgggagactcctggaccagacccggactggagctttctcctgaggaggggcctccttataggcctgaatttttctccggctgggaaccacctgtcaccgatcctcagagtagggcctgggaggaccctgtcgagaaacagctgcagcacgagagaaggaggagacaacagagcgctccccaggtcgccgttaacggtcacagggatctggaacccgagtcggaaccgcagctcgagtcagaaacagccggaaaatgggtactttgcaattatgacttccaggccaggaacagcagcgaactgagcgtaaagcagcgagacgtgctcgaggttctcgatgattcacgcaagtggtggaaggtgagagacccagcaggccaggagggctatgtgccctacaatattctcactccataccccggtcccagactgcaccattcccagagccctgcaaggtcattgaacagcacacccccaccgccacccgctccagctccagctccaccccctgccctggccaggcctagatgggatcgccctaggtgggactcttgcgatagcctgaacgggctcgaccctagcgagaaggagaaattttcacagatgctgattgtaaatgaagagctgcaggcacggctcgcccagggacgttctggcccttcgcgagctgtgcctggccctcgcgcacccgagccacagctcagcccaggatcagacgcaagtgaagttcgggcatggttacaagcaaagggattcagctcgggtacagtggatgcactgggcgttctgacaggcgctcagctgttttctctccagaaggaggaactgcgggcagttagtcccgaagaaggggcacgggtgtattctcaagttactgttcagaggagtctgctcgaagacaaagagaaggtgtccgagttagaggccgtaatggagaagcaaaagaaaaaggtagagggagaggtggagatggaggttatctag

SEQ ID NO: 27373 - DNA, 1950 bp, Artificial Sequence
  Description of Artificial Sequence: Synthetic coding sequence
atgagcagttttggcgctggcaaaaccaaggaagtgatcttttccgtggaagacgggtctgttaaaatgtttcttagaggtcggcctgttcctatgatgattcctgatgagcttgctcccacgtatagcttagacacacgtagtgaattaccatcctgcaggctcaaactcgagtgggtatacggttaccggggacgcgactgcagagctaatctatatctcctccccaccggagagattgtctacttcgttgccagcgtcgctgtgctttattcagttgaggagcagcgacagcggcactatcttgggcacaatgatgacataaagtgcctagccattcatcccgacatggtgactatcgccactggccaggttgccggaacaacgaaagagggcaagccgttaccacctcatgtacgtatctgggactcagtctccctgtccacactgcacgtgctgggcttaggagtgtttgatcgggctgtctgctgcgtgggcttttcaaaatctaacggaggaaacctgctgtgcgctgtcgacgaaagtaatgaccatatgctatccgtctgggactgggctaaggaaactaaagtagttgacgttaagtgtagcaatgaagcggtgctcgtcgcaacttttcaccccacagacccaacagtcctgattacatgtggcaaatcacatatctatttctggaccttggaggggggatcccttagcaaacgccagggattgtttgagaagcacgaaaaaccaaagtatgttctttgtgtgacatttttagaagggggtgacgttgtcaccggggattccgggggaaacctatacgtgtggggcaagggcggtaatcggatcactcaggcagttctgggcgcacacgacggtggtgtgttcggtttatgtgctctgcgcgacggcaccttagttagcggcggaggcagagaccgccgagtggtgctctggggctccgattattcaaaactgcaagaagtggaggttcccgaagactttggacctgtgcggacagtggctgaagggcacggcgacactctttacgtaggcaccacccgtaatagcattctgcagggatcggtgcataccggattctccctgttagtgcagggtcatgtcgaggaactatggggactggccactcacccgagcagagcacaatttgtgacatgcggccaggacaagctcgtccatttgtggtcatcagacagccaccaacctttgtggagccgtatcatcgaggatcccgcacggtccgccggattccatccctcaggtagtgttctggccgttggaacggttactggcaggtggttgcttttggatactgaaactcatgaccttgtagccatccacaccgacggcaatgagcaaatctctgttgtgtcgttcagcccagatggagcctatctggccgtcggatcccacgacaatctcgtttatgtctacaccgttgatcagggcggtcggaaagtttcccgactcggaaagtgcagcggccactcgagttttattacccacctggactgggcccaggattcatcctgtttcgtcacaaattctggcgactacgaaattctctattgggatcccgcaacctgtaagcagattacgtcagctgacgctgtgcgcaacatggagtgggccacagcgacatgcgtgctggggtttggtgtgtttggcatctggagcgagggtgctgacgggactgatattaatgctgttgcccgatcacatgatggaaagctgctcgcttccgccgacgatttcggcaaggtacacctattttcatatccatgctgtcagcctcgggctttgagccataagtatgggggacatagttcccatgtgaccaacgtggccttcctatgggatgattcaatggccctgaccacaggcggtaaggatacttccgtgctgcagtggcgcgttgtttag

SEQ ID NO: 27374 - DNA, 792 bp, Artificial Sequence
  Description of Artificial Sequence: Synthetic coding sequence
atggccggactggaagtacttttcgcgagcgccgctcctgccattacatgtagacaggacgcgcttgtgtgtttcctacactgggaagttgtcactcatggttactttggattgggagtgggagaccagcctggaccaaatgacaaaaaatctgaattactgcccgctgggtggaataacaacaaggatctgtatgtgctgcgatacgaatacaaagatgggtcacggaaattattggtgaaagccatcaccgttgaaagctccatgatcctgaatgttctcgagtacggaagccagcaagtagcggacctgacgctgaatttagacgattacatagacgcagaacatcttggcgactttcatcgtacgtacaagaactcagaggaacttcggagtcggattgttagcggaattatcacaccaatacatgagcagtgggagaaagcgaatgttagctccccacatagagagtttcctcccgcaactgctcgggaagtggatcctcttcgtattcctccccatcatccgcacacgagtcggcagcccccatggtgtgatccgctaggaccatttgttgtcggcggagaggatcttgatcctttcggccctcgacgtggtggcatgatcgtagatccacttcgtagcgggtttccacgggctctgatcgacccatcttccggcctcccaaacagattaccaccaggtgctgtgcctcctggtgccagattcgacccctttggacctattggcacaagccctccgggacccagaccagaccgacgcggtcaatag

SEQ ID NO: 27375 - DNA, 273 bp, Artificial Sequence
  Description of Artificial Sequence: Synthetic coding sequence
atggataacatgtcaccccgactcagagctttcctctcagaacctatcggtgagaaggacgtgtgttgggtggatggaatatcccatgagcttgccatcaatctcgtcacgaaggggataaataaggcttacatcctcttgggtcagttcctcctgatgcataaaaacgaagcagagttccagcgctggctgatttgctgttttggcgcaaccgagtgcgaagcccagcaaacgtcccattgtctcaaagagtggtgcgcctgttttttgtag

SEQ ID NO: 27376 - DNA, 888 bp, Artificial Sequence
  Description of Artificial Sequence: Synthetic coding sequence
atgccagttcacaccctgtcacctggcgcaccctctgcccctgccttgccatgcagactgcggaccagggttcctggatacctactccggggacccgcagatgggggagctcgcaagccttcagcagttgaacgtttagaggcagacaaggcaaagtatgtgaaaagccttcatgttgccaatacgcggcaagaacccgtacagcccctgctttctaagcagcccctgttcagtccagagacccggcgaacggtgctgacgccttctcgcagagccctccccggaccttgtaggaggccccagctggatcttgacatactctcgtctctgatcgacctttgcgattcccccgtttcacctgctgaagcctccagaaccccaggacgggcagaaggtgccggaaggccacccccagccacaccacctagacctccaccttcaactagtgctgtccgaagagtggacgtccgcccactgccagcatcacctgccagaccttgccccagtcccggacctgccgcagcaagttctcccgctagacccccaggattgcagcggagcaagagcgacctttcagaaaggtttagcagagccgctgccgaccttgagcggttctttaatttttgtggcttggaccccgaggaagccagaggcttgggggtagcgcaccttgctagagcctcctccgacattgtgtctctggctggtccctcagcgggaccagggagctctgaggggggatgctctaggaggtctagtgtgactgttgaggaacgcgctcgggagagggtcccatatggggtgagcgttgtcgaacggaacgcaagagtgatcaaatggctttatgggttgcggcaggcccgagaatcaccagctgcggagggttag

SEQ ID NO: 27377 - DNA, 582 bp, Artificial Sequence
  Description of Artificial Sequence: Synthetic coding sequence
atgcctactacatcccgtccagctctcgatgttaaaggcggaaccagccctgccaaggaagacgccaaccaggagatgtcatccgttgcttatagtaacctagctgtcaaggataggaaggccgtagccatattgcattaccctggtgttgcttctaatggcaccaaggctagcggcgctccaacttctagttctgggtcccccattgggagtccaacaacgactccgccaacgaagccccctagcttcaacctgcatcctgccccacatctcctggcgagtatgcatcttcagaaactgaattcccagtatcagggaatggccgctgcaactcctgggcagcccggagaagccggtcccctccagaactgggactttggagctcaggccggtggagcggagtctctcagtccgtccgcgggtgctcagtctcccgctataattgattccgaccctgtggatgaggaagttcttatgagcctcgtagttgaattaggcttagaccgcgcaaatgaattgcctgaactgtggttggggcagaatgaatttgactttaccgctgacttcccatcttcctgctag

SEQ ID NO: 27378 - DNA, 1077 bp, Artificial Sequence
  Description of Artificial Sequence: Synthetic coding sequence
atggccgctgtgctgaagcctgtgctacttggactgcgagatgccccagtgcacggctcacctacggggcctggtgcctggactgcttcaaagctcggaggcatacccgacgccctccccactgtggctgcgccaagaccagtttgccagcgctgcgggcaacctctggccctggtcgtccaagtgtattgtccattggaaggctctccctttcatcgcctcctgcacgtctttgcatgtgcctgcccaggatgcagcacaggcggagcccgtagctggaaggtgttccggagccagtgtctgcaggtacccgagagagaggctcaagacgcccagaagcagggaaactcattagcagcagaagattggtgcgagggcgctgatgattgggggagcgatacagaggaggggccttctccacagttcaccctggacttcggtaatgacgcttcaagtgccaaggacgtagattggacggccaggctgcaggacctccgacttcaggatgcggtactgggagccgctcatcccgttcctccagggctgccattatttctgccttactacatctgtgtagccgacgaagatgattaccgcgattttgtcaacctggaccatgcacactcgctgctgagggattaccagcagagagagggaatagccatggaccagctgttgtcacagtctctgccaaatgatggtgacgagaaatatgagaaaactatcattaaatccggagaccagaccttttataaatttatgaagaggattgccgcttgccaggagcaaattcttagatattcttggagcggcgagcccctgttcctgacgtgtcccacgagcgaggtgacagaactgccggcttgttcccagtgtgggggtcagcgaatattcgaatttcaactcatgcccgctctggtctcaatgcttaaatctgcgaatttagggctgagcgtggaatttggcaccatcctggtgtacacatgcgagaagagttgctggccccctaaccaccagacgcccatggaagaattttgtattattcaagaggaccccgatgagctgcttttcaaatag

SEQ ID NO: 27379 - DNA, 1779 bp, Artificial Sequence
  Description of Artificial Sequence: Synthetic coding sequence
atggcctccgtggtggtgaagaccatctggcagagcaaggagatccatgaagcaggcgatactcccacgggtgtggagtcgtgcagtcaactggtgcctgaggcaccgcgacgtgtgactagccgtgccaaaggaatcccaaaaaagaagaaggcagtttcttttcatggagtggagccccagatgtctcatcaaccaatgcactggtgccttaacctgaagcggtccagtgcttgtactaacgtgagtctgctcaacttggcagccatggaaccaactgacagtaccggcacagactcaactgtcgaggatcttagcggacaactgacattggccggacctcctgcctctcccaccttaccttgggacccggacgacgctgacattaccgagatattgagcggcgtgaattctgggcttgtgagagctaaggacagcattacatctttgaaggaaaagacgaatagggtgaaccagcacgtacagtctctccaaagtgaatgcagcgtcctgtctgagaatctagagagaagacgtcaagaagctgaggagctcgaagggtactgcattcagctgaaggagaactgctggaaggttacccgatccgtggaagacgccgagatcaaaactaatgtgttaaaacaaaactcggctctgctagaagaaaaattgaggtatctgcagcagcagttgcaggatgaaacacccaggcgccaggaagcggagctccaggagccggaagaaaagcaggagccagaggagaagcaggagcccgaagagaagcagaagcccgaggccggactgtcctggaattcactgggccctgccgcaacctcccaggggtgccccggacctcccggaagccccgataaaccttcacgcccacacggcttggtgcccgctggttggggcatgggccctcgcgcaggcgagggtccatacgtgtctgagcaagaattacagaagttgttcacaggcattgaagagctgcggcgtgaagtctcttccctcaccgcccgttggcatcaggaggagggagcggtccaggaggcgcttcggctccttggagggctcggaggccgtgtggacgggttcttgggacagtgggagcgggcacagagggagcaggcccagaccgcccgagacctacaggagctgcgaggcagggcggacgaactctgcacaatggtagaacgttcagcggtgtctgtagcttccctgcggtctgaactcgaaggcctgggaccactgaaacctatactggaggagttcgggcgacagtttcagaacagcaggagaggccctgacctctcaatgaatttagatcgctctcatcagggcaactgtgcccgttgtgcctctcagggatcacagctaagtactgaatccctgcagcagctgctggatagagccctgaccagtctggtggatgaggtaaaacagcgaggccttacacccgcatgtcctagctgccagaggctgcacaaaaaaatcctggaactcgaacgacaggcattggctaagcatgtcagagctgaagccctaagctcgacactccgtctggcacaggatgaagctctgcgggctaaaaatttactgcttaccgataaaatgaagcctgaagagaagatggccaccctggaccatctccaccttaaaatgtgtagtctgcatgaccacctttcgaatctccctctagaaggatcaaccggaacaatggggggtggtagctctgccggaacacctccaaaacaaggaggatctgccccagaacaatag

SEQ ID NO: 27380 - DNA, 2541 bp, Artificial Sequence
  Description of Artificial Sequence: Synthetic coding sequence
atgagctccagtcatttcgcgagccgccaccggaaggatatctcgaccgaaatgatacggaccaagatcgcccatagaaaaagcctctctcagaaagagaataggcacaaggagtacgagcgaaacagacatttcggcctcaaagacgttaatataccgacacttgaggggagaatcttggtggaactggatgaaacaagccagggcttagtgccagaaaagacgaacgtcaagcccagggctatgaagaccatactcggggaccagagaaagcaaatgctgcagaaatataaagaagaaaagcagcttcaaaagcttaaagagcagagagagaaggctaagcgcggtatctttaaggtcggccgatacagaccagacatgccttgtttcttactgagcaatcagaatgccgtgaaagccgaacccaagaaagccataccctctagcgtgcgcattactcgctctaaggcaaaggaccagatggagcagaccaagattgacaacgaatccgacgtccgggctatcagacccggaccaagacagacttcggaaaaaaaggtatcagataaagagaagaaggtggtgcaaccagtgatgccgacaagtctccggatgacgcggagtgccactcaggccgctaagcaagtcccaaggacggtgtcctctaccaccgcgcgaaaacccgtgacacgcgctgcaaacgagaatgagcccgaagggaaagtgccctccaaaggccgacctgccaaaaatgtggaaacaaagcctgacaagggtatctcctgcaaagtggactccgaggaaaatacactgaactctcagacaaacgccaccagcggtatgaatcccgatggagtcctttctaaaatggaaaacttgcccgaaataaatacagcgaaaatcaagggcaaaaatagttttgctccgaaggactttatgttccaacccttggacgggctgaagacataccaagtgacccctatgacacccagaagcgccaacgcgttcctcacgccatcatatacttggactccccttaagactgaggtcgacgagagccaggccactaaggaaatattggcccagaagtgtaagacctatagcactaaaacgatccaacaggactctaataagcttccatgcccgctgggaccactaaccgtatggcatgaggaacacgtcttgaacaagaatgaggcgaccacgaaaaacctgaatggtctgcctataaaagaggtgccctctctggagaggaacgagggcagaattgcacaacctcaccacggagtgccatactttagaaatattctacaaagcgagaccgagaaactgacatcgcattgcttcgagtgggataggaagctggagctggacatcccagacgacgctaaggatctgatacgcacagccgttggccaaacccgcctacttatgaaggaacgctttaagcagttcgaggggcttgtagacgactgcgaatacaagagaggcatcaaggagacaacctgtacggatctggacggattttgggatatggtatcatttcagattgaggacgtgatacacaaattcaacaatctgatcaagctggaagaaagcggttggcaggtcaacaacaacatgaatcacaatatgaacaaaaatgtctttcgtaagaaggtggtttctggaattgcaagtaaaccgaagcaggacgacgctggcagaatcgccgctagaaatcggctggcagcaatcaaaaatgctatgagggaaaggatacggcaagaagagtgtgccgaaacagctgtgtcagtcatacccaaggaggtggacaaaatcgtgtttgacgccggttttttccgggtagaatctcccgtaaagctgttcagtggcctgagcgtctcgtctgagggtcctagccaacggctcgggactccaaagtctgtgaataaggcagtcagccaatcacggaatgaaatgggtataccccagcaaacaacttctcctgaaaacgccggtccccagaacaccaagtctgagcatgtaaagaagactctttttctttcaatacccgagtcaagatctagtatcgaggatgcccagtgtcctggtttgcccgacctcatagaggagaatcacgtggtcaataaaaccgatctgaaggttgactgtttatcttcagagaggatgtccttgccccttctcgctggcggagtcgccgatgatataaatacgaacaagaaggagggcatctcagatgtagttgagggcatggagctcaactccagtattaccagccaggatgttttaatgtccagcccggaaaaaaacactgccagccagaattctatactggaagaaggagagactaaaatctctcaatccgaactgtttgacaacaaaagcctgaccaccgagtgccatttgctagactcaccgggattaaattgctccaacccgtttacccagctcgaacggagacaccaggagcacgcgagacatatcagctttggcggaaaccttattacatttagcccactccaacctggcgagttttag

SEQ ID NO: 27381 - DNA, 1128 bp, Artificial Sequence
  Description of Artificial Sequence: Synthetic coding sequence
atggcttctgcaccctggccagaaagggttcctcgcttgctagcaccccgactgccatcctaccctccgccacctcccactgtaggactacggtctatggaacaggaggagacataccttgagctttatctggatcagtgtgccgctcaagacggactggccccaccacggagtcccttgttctctcctgtggtcccttacgatatgtatattctgaatgccagtaatcctgacaccgcctttaatagcaacccggaagtaaaagagaccagcggggacttctccagcgtggacctgtctttcttgcctgatgaggttactcaagagaataaagatcagcccgtaatttccaagcatgagacagaagagaatagcgagtcacagagtcctcagtcccggctccctagccccagcgagcaggatgtaggcctgggactcaattcatcgtcactgtccaatagccacagccagctgcaccctggggataccgactcagtccagccgagtccggagaaacccaactcggactcattatcccttgccagcatcacgccaatgaccccaatgacccccatctctgagtgttgcgggatcgtgccccaactccagaacatcgtttccacggtaaatttggcttgcaagctcgacctcaaaaagattgctctccatgcaaagaatgctgagtacaaccctaaaaggttcgccgcagttatcatgcggattagagaacccagaacaaccgcgctgatcttctcttccggcaagatggtctgcactggggctaaatccgaggagcagtcacgattggctgctagaaaatacgctagagtggtccagaagctcggatttccggctcgcttcctggacttcaaaatccagaacatggtcggcagctgcgatgtgaggtttcccatccgtctggaggggcttgtcttgacacatcagcagttttcctcctacgagccagaactcttcccgggtctgatctacaggatggtgaagcccaggatcgtactcctgatttttgtctccggaaaagtggtgctcactggcgcaaaagaacgatcagaaatctatgaagccttcgaaaacatttaccctatcctgaaaggcttcaagaaagcatag

SEQ ID NO: 27382 - DNA, 633 bp, Artificial Sequence
  Description of Artificial Sequence: Synthetic coding sequence
atgcaggcggagggccaaggtaccggagggagcacgggagatgcggatggaccgggtggtccaggtatacccgacggtcctgggggtaatgctggtggcccaggagaagccggagccaccggagggagggggccacgcggagcgggagcagcccgtgcctccggaccccgtggtggcgcacctcggggaccgcatggaggagcggcatccgcccaggatggcaggtgtccatgcggcgcacgcaggcccgattcgaggctcctacagctccacataacgatgcccttttccagtcctatggaggcagagctcgttagacgtatcctttccagggatgccgcacccttaccgagaccaggggctgtccttaaagactttaccgtgagtggaaatttactgttcatgagcgttagggatcaggatagagaaggagctgggagaatgcgtgtggtcggctgggggctgggctccgcctcacccgagggacaaaaagccagggatcttcgcactcccaaacacaaggtgtccgagcaaaggcctgggaccccagggccacctcctcccgagggggcacagggggacgggtgtcgcggagtggccttcaatgtcatgtttagcgcaccacacatttag

SEQ ID NO: 27383 - DNA, 582 bp, Artificial Sequence
  Description of Artificial Sequence: Synthetic coding sequence
atggtggtcctgcgcgcaggcaaaaagacgttccttccccctctatgccgagcttttgcatgtcgcggttgccagcttgcccctgagaggggcgcagagcgtagagatactgcccctagtggcgtctcccgcttctgtccccctcgcaagtcctgtcatgattggattggaccccctgacaagtatagcaacctacgacctgtccacttctacattccagaaaatgagtcccctctggaacaaaagctgcgtaagctacgacaggaaacccaggagtggaatcagcaattttgggcaaatcagaatcttacattctccaaggaaaaggaggagtttatccatagtcgactcaagaccaaggggctaggactcagaactgaaagcggacagaaagccacactgaacgcagaggaaatggcagatttctataaagagttcttgagcaagaactttcagaagcacatgtattacaaccgtgattggtataagcgcaactttgccataaccttctttatgggcaaagtagcccttgagcgaatctggaataaacttaagcaaaaacaaaaaaaacggtctaactag

SEQ ID NO: 27384 - DNA, 1383 bp, Artificial Sequence
  Description of Artificial Sequence: Synthetic coding sequence
atggcaaatgacccactcgaggggtttcatgaggttaacctggcctcacccacctcaccagaccttttaggtgtatatgaaagcggcacccaggagcagaccacgtccccctcagtgatctaccgcccacatccatccgccctgtcctccgttcccatacaggccaacgctctcgacgtgagcgaactgcctactcagccagtatattctagccctcgccgacttaattgtgccgaaatctcatccatctcctttcacgtgaccgatccggcaccatgcagcacttcgggcgttaccgccggactgactaaacttacaacgaggaaggacaactataacgcagaacgagagtttctgcagggagcaacaatcaccgaggcgtgtgatggttccgatgacatctttggactgagcactgactctctgagcagactgcggagcccttccgtgctcgaagtccgggagaaggggtatgagcggctgaaggaagagctcgctaaagcccagcgggaacttaaactgaaggacgaggaatgcgaacggctatctaaagtgagagaccagttaggacaggaacttgaggagctgaccgcctctttgttcgaggaggcccataagatggtacgggaggccaatatcaagcaagccacagctgaaaaacaacttaaggaggcacaagggaagattgatgttctgcaggctgaggttgccgctcttaaaaccctcgtgctgtcatcaagcccaacgtcacccacacaggaacccttaccaggcggtaagacccccttcaagaaggggcacaccaggaacaagtctacctcttccgctatgtcaggatcgcaccaggatttgtctgtgattcagcccatagtgaaagattgtaaagaggccgacctgtcactgtacaatgagttcagattatggaaagatgagcctactatggacaggacatgcccatttctggataaaatataccaggaggatatattcccttgcttaacttttagcaaatccgaactcgcctctgctgtcttggaggccgtggagaataacaccctcagcattgaacctgttggcctgcagcctatacgctttgtgaaagcctcagctgtcgagtgcggcggaccaaagaaatgcgctctgaccgggcaatccaagagctgcaaacatagaatcaagcttggcgacagttctaactactactatatctcccccttttgcaggtataggatcacgtcagtgtgtaatttcttcacatacattcgatacatccagcaaggtcttgttaaacaacaggacgttgaccagatgttctgggaggtgatgcagcttcgaaaggaaatgtctcttgctaaactcggatattttaaagaggagctctag

SEQ ID NO: 27385 - DNA, 981 bp, Artificial Sequence
  Description of Artificial Sequence: Synthetic coding sequence
atggccaccttggtcgaattgccagattctgtcctgttggaaattttcagctacctcccagtgagagatcggatcagaatctccagagtctgtcatcggtggaagcgcctcgtcgatgaccggtggttgtggcggcacgtggatttaaccctgtacacaatgaggcccaaggtaatgtggcatctgctcaggcgctacatggcaagccgtcttcattctctgcggatggggggatatctgttcagcggatcccaggcccctcagcttagtccggcattgttaagagctctggggcaaaaatgtcccaacctgaagaggttatgtttgcacgtcgccgacctctctatggtgccgatcacctcactcccttccaccttgcgcaccctggagctgcattcttgcgaaattagtatggcgtggcttcataaacagcaggaccccaccgtcctacccctccttgagtgcatcgttctggacagggttcccgcattccgtgacgagcacctgcagggacttacacggttccgcgctctcagaagcctcgttctgggcggtacctacagagttactgaaaccgggctggatgcgggtcttcaggagctctcatacctgcagaggctcgaggtgttaggatgtactctcagcgcagatagcaccctgctggcgattagcagacacctcagggatgttcgcaaaatcaggttgactgtacgcggactgagcgcccctggactagctgtcctggaaggaatgcccgcactagagagtctgtgcctccagggacccctcgtcacaccagagatgccgagcccaaccgaaatcctctcctcctgtctgacaatgccaaagttgagggtgctcgaactccagggcttgggctgggaggggcaagaggctgagaaaatcctgtgtaagggactccctcactgtatggtgatcgtgagggcctgcccaaaagaaagcatggactggtggatgtag

SEQ ID NO: 27386 - DNA, 3090 bp, Artificial Sequence
  Description of Artificial Sequence: Synthetic coding sequence
atggcaagcgaagcagtgaaggtggtcgtgcggtgtcggccaatgaatcagagagaacgggaactgaggtgtcagccggttgtgactgtagactgcgccagagcccagtgctgcatacagaatccaggagccgcagatgaaccccctaagcagtttaccttcgacggagcctaccacgtggatcacgttactgaacagatctataacgaaattgcttaccccttggtcgaaggcgttaccgaaggatataatggcactatttttgcgtatggccagacaggatctggaaagtcctttaccatgcagggactgcctgatccccctagccagcggggtatcattcctcgagcgttcgagcacgtttttgaatccgtgcaatgcgccgagaacactaaatttctggtgagggcctcatatttggaaatctataacgaggatgtgagggacctgctgggagccgacaccaaacagaagttagagttgaaagaacatcccgagaaaggtgtatatgtcaaaggtctctccatgcacacagtgcatagtgtcgcccagtgcgagcatattatggagaccgggtggaagaatagatcagtcgggtacacactgatgaacaaggactccagcagatcccactctatctttactatctctatcgaaatgagcgctgtggatgagaggggcaaagatcacctccgggctggcaagcttaatctcgtggatttggccggttccgaacgacaaagcaagactggtgccacgggggaaagactcaaggaagcaaccaagatcaacctgtccctgagcgccctcggcaatgtgatatccgccctggtggatgggagatgcaaacacgtgccgtacagagactccaaactgacccgcctccttcaggacagcctaggcggaaatacaaaaacactcatggtggcatgtctatcacccgcagataacaattacgacgagacccttagtaccttacggtacgcaaatcgcgcaaagaacatacgcaacaaaccacgaattaacgaggatccaaaggatgcattgttgcgcgaataccaagaggagatcaagaaactaaaagctatccttacacagcagatgagcccctcaagcctgtctgccctgctttcccgccaagtcccaccagacccagtgcaggtggaagagaaactgctgccacaaccggtcatccagcacgatgtggaggcagagaagcagctgattcgcgaagaatacgaggaacgactagctcgtcttaaggcagattacaaagctgagcaggaatctagagcaagactcgaagaggacattaccgccatgcgtaattcatacgatgtcagactttccacccttgaggaaaatcttaggaaggagaccgaggccgtgctgcaggtaggggtgttgtacaaggccgaggtgatgtcaagggcggaattcgcaagctccgctgaatacccaccagctttccaatacgaaaccgtcgtgaaacctaaagttttcagcaccacggatactttaccgtcagacgacgtaagcaagactcaggtatcatccagattcgcagagctgcctaaagttgagcccagtaaatctgagatcagtcttggttcgtccgagtcctcttcccttgaagaaacttcggtttctgaagcattccccggtcctgaggaacccagcaacgtggaggtgagcatgccgacagaagagtcgcgaagccggtacttcctggacgaatgcctgggccaggaagccgctggccacctgcttggggaacagaactacctgcctcaggaagaaccccaagaggtgcctttacaggggctcctcggcctgcaggacccttttgcggaagtagaagcaaaactcgcaaggctgtcttccaccgtggccagaacggacgcgcctcaagctgacgtgcccaaggtgccggtacaggtgccggcaccgaccgatctactcgaaccttcggatgctaggcccgaggctgaggccgcagacgattttccaccgagacctgaggtggaccttgcttccgaggtcgcgttagaagttgttcggactgctgaaccgggagtctggcttgaggctcaggccccagtggcacttgtcgcgcagcctgagccgttacccgctacagctggcgtgaaaagggaatctgtgggcatggaagtggcagttttaaccgacgatcccctgcctgtagtggatcaacagcaggtccttgcacggctccagttattggagcagcaggtggtgggtggagagcaggctaagaataaggatttaaaggagaagcataagcggaggaagcgctacgccgacgagaggaggaaacagctggtggccgctctgcaaaactcagacgaggatagtggcgattgggtgctgcttaacgtgtatgacagtatccaagaagaggtgagagcaaaaagcaagctcctcgaaaagatgcagagaaagctacgggcagcggaagtggagattaaggacttacagtctgagttccagctagaaaagatcgactacctggccaccatccgcagacaggagcgggacagcatgctgcttcaacagctgctcgaacaggtccagcctctcataaggagagattgcaattactcaaacctcgaaaaaattttgagggaaagctgctgggacgaagataatggattctggaagataccgcatccagtcatcaccaagacttccctccctgtggcggtgtctaccggccctcaaaataagcctgcacgcaaaacctccgctgccgacaatggcgagccaaacatggaggacgaccggtatagacttatgctgtccaggagtaatagcgagaacattgcatcaaattattttcgatctaaacgtgccagtcaaatcttaagcaccgacgctcgcaagtcactcactcatcataattcacctcccggattgtcctgcccactgagcaataactcggcgatccctcccacccaagcgcctgagatgccacagccacggccttttcggctggaatccctcgacattccttttacaaaagctaaaagaaagaagtccaaaagtaacttcggatctgagcctttgtag

SEQ ID NO: 27387 - DNA, 417 bp, Artificial Sequence
  Description of Artificial Sequence: Synthetic coding sequence
atgattctgcaacagcctctgcagcggggacctcaaggaggcgctcaacgactcccccgagctgccctgggagtgacctggggacttgatgcaagtagccctctacgaggagccgtgccaatgtccactaagagaaggctggaggaagaacaggagccacttcggaagcaatttctctctgaggagaacatggctacccactttagccagttgagtcttcataacgatcacccttattgtagcccccctatgactttctctccggcattgcccccacttcgaagtccctgcagcgaattattactctggagatatccagggagtctgatcccagaggcacttcggctgcttcgtttaggtgacacaccctcacccccataccccgcaactcctgccggagacatcatggagctctag

SEQ ID NO: 27388 - DNA, 573 bp, Artificial Sequence
  Description of Artificial Sequence: Synthetic coding sequence
atgttccaagtgcctgatagcgagggcggacgggctggcagcagggctatgaagccaccgggtggagagtcctcaaatctgttcggttcaccggaggaagctaccccctcgtcacgccctaatcgcatggcaagtaatatcttcggcccaactgaggaaccccagaacattccgaagcgtacaaacccaccaggaggtaagggcagtggcatctttgacgagagcacccccgtgcaaacgagacaacacctgaatccgcctgggggaaaaacttctgatatttttgggagccctgtcaccgcgacctccagactcgcacaccctaataaaccaaaggaccatgtttttctgtgtgagggagaggagccaaagtctgacctgaaggccgctcgttctattcctgcaggcgctgaaccaggcgagaagggcagtgcccgtaaagcagggccagccaaagagcaggagccgatgccaaccgtggacagtcacgaaccaagactgggcccacgcccaagatctcacaacaaagtcctcaatccccctggaggcaagtcttcaatctcattttattag

SEQ ID NO: 27389 - DNA, 690 bp, Artificial Sequence
  Description of Artificial Sequence: Synthetic coding sequence
atgacatgttgttcccaggttccccctcgcaggagacccagtctagcgttaagtccaaggctggactgcaacgggctgaatggcgtgccaggatcaatttgggactttgtgtctggatcattttcacctagtccgtcccctatcttatcagccggtccgccaagcagtagtagtgcttcacctaacggcgctgagctggctcgcgtgagacgacagctcgacgaagctaaacgaaaaattagacagtgggaggaatcgtggcaacaagtgaagcaagtctgcgacgcatggcagcgagaagcccaggaggctaaggagagggctagggtggccgactcagataggcaactggcactgcagaaaaaggaggaagtcgaggcacaggtcaagcagcttcaggaggagctggagggactgggagtggcctcaacactacccggtttgaggggatgtggcgatataggtactatcccactgcccaagttacatagcctccagtcacagttgaggcttgatctggaagctgttgatggcgtgatttttcagctgagagccaaacagtgcgtcgcttgtagggaacgcgctcacggcgctgtcctgcgcccttgtcaacaccacatattatgtgaaccatgtgcggctaccgcgcctgagtgcccctactgtaaagggcaacctctacaatggtag

SEQ ID NO: 27390 - DNA, 5460 bp, Artificial Sequence
  Description of Artificial Sequence: Synthetic coding sequence
atggcctccattacacaactcttcgacgatctgtgtgaagcactgttgccggctgcaaagacgcacttgggacaacggtctgtgaataggaaaagagcaaagaggtcactgaagaaagtggcgtataacgctctttttacaaacctctttcaggacgagacacagcagctgcaaccagacatgtccaagctgcctgcccgaaacaagatcctgatgctgagcttcgatcttcgcgtgggaggtcttggacctaaggctgacagattagaagagctggtcgaggagctggaagcggctccatgttgtcctctcttggaggtcggctctgtgttggatctgctggtgcagttggccggttctggacctccgcaagtgctccccagaaagagggattacttcctgaataataaacacgtgggaaggaatgtgccatatagtgggtatgactgcgacgatctgtcagtgtttgaaatggacgtgcaatccctgatcagtcgggaggagtgtctctgtcactcaatgatccaggagaccctgcaggttatggaagccgcaccaggtaccggactgcctaccgtcgggctgtttagctttggcgatccttgtggagatcggtttgagagggacacaagggtttcactatttggagccctagtacattctcggacatacgatatggatgtcagactggggctacccccagtgcccgacaatgcagacctaagcggattggctattaaggtcccaccaagcgtggatcaatgggaagacgaggggtttcaatcggcttcaaatctgactccggattctcaatccgagccatctgttacccccgatgtggatctttgggaggcagccctcacatatgaggcatctaagcggaggtgttgggaacgggtgggttgtcctcctggacatcgggaggagccctatctgacagaggctgggcgagatgccttcgacaaattctgccggctgcaccaaggagaattgcagctgttagctggcggagtgctacaggcacctcagcctgtgctggttaaggagtgcgaattagtgaaagatgtgctaaacgtccttatcggcgtggtaagcgcgaccttttcactgtgtcagccagcacaggcttttgtcgttaagcgaggcgtgcatgtgtctggggctagcccagagtctatcagctccttgctgtctgaggttgccgagtacggaacatgctacacccggctgagtcactttagtcttcagcctgtgctggattcgctctacagcaagggcctggtctttcaggcctttacaagcgggctgagaagataccttcagtattacagggcatgtgtgctgtctactcccccaactcttagcctccttaccatcgggtttctgtttaaaaaactgggaagacagctgaggtatctggccgaactctgcggtgtgggggctgtgttgcctggcacctgtggcggaggtccgagggcagcctttcctaccggggttaaattgctgtcctacctgtaccaagaggcactgcacaactgctccaatgagcactaccccgttcttctaagtctgctgaagacttcgtgtgagccttataccagatttattcacgattgggtgtatagtggcgtctttcgagatgcttacggagagtttatgattcaggttaaccacgaatacctttcttttcgagataaactgtactggacccatggctacgtactgatttccaaggaggtcgaggattgtgtgccagtcttcctgaagcacattgcccacgacatttacgtttgtgggaagacgattaacctgttgaagttgtgctgcccacggcactatctttgttggtccgatgtgccagttccacgcatctctgtcattttttctttagaggagctgaaagagatcgagaaagattgtgccgtatatgtagggaggatggagcgcgtcgcccgacactcttccgtgtccaaggaggagaaagagctgaggatggagattgcgaagcaggagctgattgcacacgctcgagaagccgcttccagagtcctcagtgccctctcggatcgccaaatgagtgaaaggatggcactggacgcccgaaagcgagagcagttccagcgcctgaaagagcaattcgttaaagaccaggagagaagacaggctgctaggcaggaagagttagatgacgacttctcttatgcccgtgagttaagagaccgagagaggagactgaagtctctggaggaagagctagaacgcaaggctcgccaagctctggtggaccactatagcaaactcagcgcagaagccgcacgcagggaacagaaagctctgtggagaattcaacggcatcgactagagtccgcacgcctgcgcttcctcctggaggatgagaagcacatacaggaaatgctgaaggcagttagtgaagcccaccaacctcaggaacctcctgatgttctgctgagcgtgcaccctcaggtgaccagcccgggtcccgagcaccccgagggcggtcaaggctgtgacagtggatcagcagagcagcactcgcccgcttgggatgggtggaacaggccgggattactaactcctcagcccctgaagcccctggctgtaggagctgggggaaggggactgcagcaggccgagggggctagaccttttagcgactccttatctataggcgattttctccccgtggggccaggcgctgaaccatctgtccagactggcatggtccccctgcttgaagtcgccctccagaccataaacttagacctgccacccagcgccccaggtgaagcgcctgccgcagctagcacccagccttctcggcctcaagaatatgacttttcaactgtcctgaggcctgcagttgccacttccccagccccaggcccactccaagcagctgaatgttctctgggcagtagcgggctacagctgtgggaggacagctgcgggaagatggacgcctgtggaagcgcctctcgagagactctacttccctcccatccacctagaagagccgctctcgaggaagggtcaagtcagcccactgaaagattgtttggccaagtgtccggaggtggcctgcctactggtgattatgccagcgaaatcgcaccgaccaggcctaggtggaacacccacggccacgtgagtgatgcaagtatcagggtgggcgaaaacgtctctgatgtggccccaacccagcctcgctggaacacacatggacacgtaagtaacgcttccatatccttgggcgagtccgtcagcgacgtagctcctactcgccctcggtggaatatccacggtcatgtgtcaaacgccagcataagggttggcgagaatgtgtccgatgttgcccctacaaggcccaggtggaacacccatgggcacgtgagtaatgcatcaatccgagttggcgagaatgtctctgacgtcgcaccaaccaggccacgatggaacacacatggacatgtaagcgacgcctccatctccctcggggagtcagttagcgatatggcacctgctaggccaagatggaacacacacggccacgttagcgatgctagcatctcattgggtgagagtgtgagcgacatggctcctacacggcctcgttggaacactcacgggcacgtctcagatacatcaatacgcgtcggggagaacgttagcgatgtggctccaatccgatcccggtgcaatacccatggccatgtttccgacgcaagcataagccttggtgagccagtgtcagatgtggtcagtacccggcctagatggaatacgcacgtgccaattccaccaccccacatggtgttgggagccctgtcaccagaagccgagccaaacacccccaggcctcagcagtctccaccagggcatacatcacagtccgccttgagtttaggcgctcagagcacagtgcttgattgtggccctaggcttcctgtcgaggtgggtccatctctttcctccccctcttctggctgtggagaggggtcaatatctgtgggcgagaatgtgagcgatgtggctcccacccagccctggtggcccaatactcctggcgattcagtcagcgaagaactgggcccaggcaggtcaggcgataccgaggacctttcccctaattggccactgaattcccaggaagatacagccgctcaaagtagtccaggcagaggagaggaagccgaagcttcggccgcagaagctcagggtggcgaacaggcgtatcttgctggccttgctggacagtaccacctcgaacgatatcccgatagctacgaatccatgtcagagcctcccatcgcccacctgttgcgccctgttctgcccagagcattcgccttccccgtggatccccaggtgcagtcagccgctgacgaaaccgcagtgcaattaagtgaactgctcaccctgcctgtcttgatgaagcgcagcattaccgctcccctggcagctcacatctcgctggtcaacaaagccgcagttgattacttcttcgtggagctgcatctagaagcacattacgaagcactcagacactttctgctcatggaagatggcgagttcgctcaatccctgagcgatctgctgttcgagaaactgggggctgggcagacacctggagaactgcttaacccacttgtcttgaattccgtactctccaaagccctccagtgctcactccacggtgatacaccccatgcatctaatctctctcttgctctcaaatatctgcctgaagttttcgcacccaatgccccagacgtgctatcctgtctggaactcagatataaggttgactggcccctgaatatcgttatcaccgaggggtgcgtctccaagtactctggtgtattctcattcctgcttcagctgaagttgatgatgtgggccctgaaggatgtgtgtttccacctgaaacgcaccgcactcctatctcacatggccggaagcgtgcagtttcgacagctccagctgttcaagcacgagatgcaacatttcgtgaaggtcatacagggatacatcgcgaatcaaatcttgcatgttacttggtgtgaattcagagcacgtcttgctactgtaggtgacttggaggaaatccagcgggcacacgcggagtatttacacaaggctgtttttcggggacttttgacagagaaagctgccccagtgatgaacgtaatacactctattttctcactcgtgcttaaattccggtcgcagttaatctcacaggcctgggggccacccggtggaccaagaggcgctgagcacccaaatttcgccctgatgcagcaatcttataacaccttcaagtattattcccacttcctctttaaagtagtgacgaaactggtaaaccgaggataccaaccacacctggaggattttctcctgcgaataaacttcaataattactaccaggatgcttag

SEQ ID NO: 27391 - DNA, 2250 bp, Artificial Sequence
  Description of Artificial Sequence: Synthetic coding sequence
atgagtggcagtcacacccccgcttgcggcccattctcagccctgacaccctcaatctggccacaagaaattttagccaagtacacccagaaagaggagtcagctgaacaaccagaattctattacgatgagtttggattccgcgtgtacaaagaggagggcgacgaaccagggtcctcacttctggcaaatagtcctctaatggaagacgcccctcagcgcctgaggtggcaagcccatctggagttcacacataatcatgacgtgggagaccttacatgggataaaattgctgtgagcctgccacgctccgagaaactccggtctttggtgttggccggtatacctcatggcatgcggcctcagttgtggatgcgtctgtccggcgcactgcaaaagaaacgaaactccgaattgtcctacagagaaatcgtgaagaacagctccaatgatgaaactatagccgctaaacagatcgagaaagatcttttgcgtaccatgccatccaatgcctgcttcgcctcaatgggaagtatcggcgtccctagactgaggcgagtactgcgggctctggcttggctctaccctgagattggatactgccaagggacaggcatggtcgctgcttgcttgcttctctttctggaggaagaagatgccttctggatgatgtcagctattattgaggacttgcttcccgcttcttacttttccaccacactgctgggcgttcaaacagaccagcgtgtgctccggcatctgatcgtgcagtatcttccgagattagacaaactactccaggaacacgatattgaacttagtttaatcaccctccactggttcctgactgcttttgcgagcgtggtggacattaagctccttctgcgtatttgggatctattcttctacgaagggagtagagttctctttcagctaacccttggtatgctgcaccttaaagaagaggagctgatccagtccgagaacagtgcctccatctttaacacgttgagcgacatccccagccagatggaagacgccgagctgctgcttggggtagcgatgaggctcgccggttcccttaccgatgttgctgtcgagacacaaaggaggaagcacctggcctacttgatcgcagaccaagggcagctccttggcgctgggaccctgacgaatctgtctcaggtggtacggaggagaactcagcgaaggaagtccacaattacagccctgctgtttggggaggacgatctggaggctttgaaagccaagaatatcaagcagacagaactcgtggccgacctgcgcgaggcgatcctgcgcgtcgcaaggcacttccagtgcacagatcctaagaattgctccgtggagctcacacctgactacagcatggaatcccatcagcgagaccacgaaaactacgtggcgtgtagcagatctcaccgaaggcgcgcaaaagctttgttagatttcgaacgtcatgatgacgacgagctaggattcagaaagaatgacattatcacaattgtgtcacagaaggacgagcattgctgggtgggcgagctaaacggcttgcgagggtggttcccagccaaattcgtcgaggtgctggacgagagatctaaggagtacagtatcgcaggcgatgacagtgttactgagggagtgaccgacctggtgcgtggcaccctctgccccgctcttaaggccctgtttgagcacgggctgaagaaaccctccttactgggcggtgcttgccacccatggctgttcatcgaagaagccgctggtagggaggttgaacgggacttcgcatcagtgtactcacggctggttctttgtaagacatttcgcctggacgaggatgggaaggtattgactcctgaggaactgttgtatcgggctgtacagtcagtcaacgtgacacatgatgccgtgcacgctcagatggacgttaagctgagatccctgatatgtgtgggactgaatgagcaggtgctccacctatggctagaggtattgtgctcaagtctgccaaccgtggaaaaatggtatcagccgtggagttttctcagatccccaggttgggttcagattaagtgtgagctacgagttctgtgctgcttcgcttttagcctctcacaagattgggagctgccagctaaacgtgaggctcagcagccccttaaggaaggagttagggacatgctggtaaaacaccacttgttttcatgggatgtagacggatag

SEQ ID NO: 27392 - DNA, 2097 bp, Artificial Sequence
  Description of Artificial Sequence: Synthetic coding sequence
atgctgtcccccaaaatcaggcaggcgagaagggctaggtctaagtcattggtcatgggagagcagagccgttctcccggacggatgccttgtccccataggcttggaccagtgctgaaggctggctggctcaaaaaacagcggtcaatcatgaaaaactggcagcagcggtggtttgtgcttcgcggagaccaactgttctactacaaggataaagacgaaatcaagccacagggatttatttctctgcaaggtacccaggtcactgaacttccccctggccctgaggacccaggcaaacatttattcgagatctccccaggaggtgccggagaacgtgaaaaggtgccagccaacccagaggctctgttgttgatggctagtagccagagagacatggaagattgggttcaagccatccggagggttatctgggccccactgggaggaggaatctttggacaaagactggaggagaccgtgcaccacgaaaggaagtacggccctcgcttggctcctctgttagttgagcagtgcgtcgattttatccgcgaacgcggactgactgaagaagggctgttccgaatgccaggccaagcaaatctcgtccgtgacttgcaagacagtttcgactgcggcgagaaacccctctttgatagcactactgacgtgcatacggttgcaagtttactgaaactctatcttagagagctccccgaaccagtcgtgccgttcgccagatatgaggatttcctgagctgtgcacagctgcttaccaaagatgaaggcgagggtaccctggaactcgccaagcaggtcagcaaccttccccaggctaattacaatcttctgcggtacatttgtaaatttctggacgaggtgcaagcttattccaacgttaataaaatgtctgtccagaatttggccaccgtgttcggcccaaacattcttcgcccacaggtggaggacccagtaaccatcatggaggggacctccttagtgcagcacctgatgacggtgctgattagaaagcacagccagctgtttactgcaccggttcctgaaggccctactagtccgagaggcggacttcagtgcgctgttgggtgggggtctgaggaagttacacgggacagccagggcgagcctgggggtccgggactaccagctcacaggacaagctccctggacggcgctgccgttgcggttctttcacggaccgctccaactggaccagggtccagatgctctcccggtaaaaaagttcagaccctcccaagctggaagtcctcctttcgtcaaccacgcagcctctcaggctctcctaagggcggaggctcctcactcgaggtgcctattatctcgagtgggggaaactggctaatgaatggcctgtctagtctcaggggacaccgccgtgcatccagcggggaccgcctcaaggactctggttcagtgcaaaggctctctacttatgacaacgtgccagcaccaggcctggtgcccggtattccctctgtggcttcaatggcctggtcaggcgcaagctctagcgagagctctgtcggtgggagcctgtccagctgtactgcatgtagagccagtgattcttctgctcgatcctccctccacaccgactgggcccttgagccttcacccttgcccagtagctctgaggatccaaagagtctggatttggaccattccatggacgaagcaggggctggcgcttccaacagcgagccttctgagcccgactcacccactcgggagcacgcgaggcgctcagaggctttgcaaggattggtgacggaactacgggctgaactatgcaggcagcgcacggagtacgagagaagtgtgaagcggattgaggagggtagcgctgatcttagaaagcggatgagcaggctagaggaggagttagaccaggagaaaaaaaagtacattatgttagagatcaagctgaggaactcagagagggcccgagaggatgccgaacgacgtaatcagctcttgcagcgcgaaatggaagagttcttttcaactctgggcagcttaacggtgggcgcaaaaggggcacgagcgccaaaatag

SEQ ID NO: 27393 - DNA, 180 bp, Artificial Sequence
  Description of Artificial Sequence: Synthetic coding sequence
atgacaaggggtaatcagcgcgaactggccaggcagaagaacatgaaaaagcagtccgactccgtcaaaggcaagcgacgggatgatggcctgtctgctgctgctaggaaacagagagattcagagattatgcagcagaaacagaagaaggctaatgaaaaaaaggaggagcccaagtag

SEQ ID NO: 27394 - DNA, 372 bp, Artificial Sequence
  Description of Artificial Sequence: Synthetic coding sequence
atggccaggtacgaggaggtgtctgtctccggcttcgaagagtttcaccgcgcagtagaacagcataatggcaagactatctttgcatacttcactggctcgaaggatgctggcggaaagagctggtgccccgattgtgtccaggccgaacctgtggtacgcgagggacttaagcatattagcgaaggctgcgtgttcatctattgccaggtaggcgagaaaccttactggaaagaccccaacaatgacttccggaaaaacctaaaggtcaccgcagttcctactcttcttaagtacggtactcctcagaaacttgtggagagtgagtgcctgcaggccaatttagtcgagatgctgttcagtgaggactag

SEQ ID NO: 27395 - DNA, 1401 bp, Artificial Sequence
  Description of Artificial Sequence: Synthetic coding sequence
atgggatggattactgaggaccttattagaagaaacgcagagcacaacgattgcgtgattttttcattagaggaactgtccttacaccagcaggaaattgaacgccttgaacacattgacaagtggtgtagagatcttaaaatactttatctccagaacaatctaattggcaagattgagaacgtgtctaagctgaaaaagcttgagtacctcaatctggcactcaataatattgagaagattgagaatctcgagggctgtgaagagcttgccaaactcgacctgaccgtgaactttatcggtgaattgagcagtatcaagaatcttcagcataacattcacctgaaggaactgtttctgatgggtaatccttgcgcctctttcgatcactacagggaattcgtggtcgccacgctgcctcagctaaagtggctcgatggcaaggaaattgaacccagtgagcggattaaagctctccaagattactctgtgatcgaaccccagattagggagcaggagaaagatcactgcttaaagagggcaaagcttaaagaggaggcacagagaaagcatcaggaggaggataaaaatgaagacaaacgctctaacgccggtttcgatggacggtggtacaccgatatcaacgcaacgcttagcagtctggagtccaaagatcatctacaggctcctgatacagaggagcacaataccaagaagcttgacaacagcgaggatgatctcgagttttggaataagccatgtttattcacccccgagtctcgattagaaacgctgcgacatatggaaaagcagcgcaagaaacaagagaaactcagcgaaaaaaagaaaaaagtgaaacccccacgcaccctaatcactgaagatggtaaagccctgaatgtgaacgagcccaagattgatttttccctgaaagataacgaaaaacagattatcctggacttggctgtgtacagatatatggataccagcctcatcgatgtggatgtgcaaccaacttacgtccgcgtgatgattaagggcaaaccatttcagcttgttctgcccgcagaagtgaaacctgattcatcttctgccaaaaggagtcaaacaacggggcatcttgttatctgcatgcccaaggttggggaggtgatcactggaggacagcgcgcttttaagtctatgaagaccacaagtgataggagcagggaacagactaacaccaggtccaagcacatggaaaagttggaggtggatccctctaagcatagctttcctgacgtcacgaatattgttcaggagaagaaacacacaccaagacgcaggcccgaaccaaaaatcatcccatctgaggaagatcccactttcgaggataatcctgaggtgccccctctaatctag

SEQ ID NO: 27396 - DNA, 1050 bp, Artificial Sequence
  Description of Artificial Sequence: Synthetic coding sequence
atggaagaccctcagtcaaaggaacccgctggggaggcagtcgctctggctttgctcgagtccccacgccctgagggcggagaagaaccacccaggccatcccctgaagaaacacaacagtgcaaattcgacggtcaggaaaccaaaggtagcaagtttataactagcagtgcatcagacttttccgaccctgtttataaagagatcgccatcaccaatggctgcattaatcggatgtccaaagaggaacttagggcaaagctgtccgagttcaagcttgaaacccgcggtgtaaaagacgtgctcaagaaaagattaaagaactattacaagaagcagaaacttatgctcaaagagagcaatttcgccgattcttactatgattacatttgtatcatcgattttgaagctacctgcgaagaaggaaaccctcccgaattcgtgcatgagatcatcgagttcccggtggtgttgctgaatactcacactctcgagatcgaagacactttccaacagtatgtgcgcccagagatcaacactcagctcagcgacttttgtatcagcctgacaggcataacccaagatcaggtcgatagggccgacacatttccccaagtactcaagaaggtcattgattggatgaagctgaaagaacttgggacaaagtacaagtactctctattaaccgacgggtcctgggacatgtctaagttcctgaatatccagtgccagctctccaggctcaagtatcccccattcgcgaaaaagtggataaatatccggaaaagttatggcaatttctacaaagtccctcgctcccagactaaactcactattatgctggagaagctggggatggactacgacgggaggccacactgcggcttagacgattcaaaaaacatcgccaggattgctgttcggatgcttcaggatgggtgtgagctgagaatcaatgagaaaatgcacgcgggtcagctgatgagtgtgagctcctcactgccaatcgaggggactccaccaccacaaatgcctcattttcgaaaatag

SEQ ID NO: 27397 - DNA, 843 bp, Artificial Sequence
  Description of Artificial Sequence: Synthetic coding sequence
atgttgagtgcagtcgcaagagggtatcagggttggtttcacccatgtgcaaggttgagcgtacggatgagctccacaggaattgaccggaagggggtcctcgcaaaccgggttgccgtcgttactggctcaacatccggcataggcttcgcaattgccaggaggctggccagagatggtgctcatgtggtgatctcgtcaaggaaacagcagaatgtggacagagccatggctaaactgcagggcgagggcctgtctgtcgccggtatcgtgtgtcacgtgggaaaggccgaggacagagagcagctcgtggcgaaagccttagaacactgtggcggagtggattttcttgtgtgttctgctggggtgaacccgttggtggggtcaactctgggcaccagtgagcagatatgggacaagatcctttccgtcaacgttaaatcacctgcactccttctgagccagctgttgccctatatggaaaatcgcaggggcgcagtaattctggtgtcttctattgctgcatacaacccagtggtggcactgggagtgtataatgttagcaaaaccgccctgctcgggctcaccagaacactcgctctggaactggccccaaaggacatccgcgtgaactgtgtggtcccgggaattattaaaacagatttcagtaaagtttttcacggaaatgagtctctttggaagaactttaaggagcatcaccagctgcagcggattggcgagtcagaagactgtgcaggtatcgtgagcttcctgtgctcccccgatgcctcttatgtgaacggagagaacatcgcagttgctggatacagtactcggttatag

SEQ ID NO: 27398 - DNA, 909 bp, Artificial Sequence
  Description of Artificial Sequence: Synthetic coding sequence
atggtgaccgaacaggaggtcgacgccatcgggcaaactctggtggacccgaagcaaccattgcaggcacggttccgagccttgttcacattgagagggctgggcggaccaggcgctattgcgtggatttcccaggcgttcgacgacgacagcgctttgctcaaacacgaattggcctattgccttggtcagatgcaggacgcaagggccattcccatgcttgtggatgtgttgcaggatacaaggcaggagcccatggtcaggcacgaggctggagaggccctgggggcaattggagacccagaggttctcgagatcctgaaacagtactcctccgatccagtgatagaggttgcagagacctgccaactcgccgtcaggaggctcgaatggctgcagcaacatgggggagaaccggctgccggaccttatctctccgtcgaccctgcacccccagccgaagagcgcgatgtcggtcgccttagagaggcgttgcttgatgagtctcggcctctgtttgaacggtatcgcgctatgttcgctctgcgaaacgccggaggtgaggaagccgcattagcactcgccgaaggattgcactgcgggagcgcattgttccgtcacgaggttggctacgtgctggggcagctacagcacgaagctgccgtaccccagctggcggctgccctggcacgatgcacagagaatcctatggttcgacacgagtgcgcagaagccctcggcgcaatcgcacgtcctgcctgtctcgcggctttacaggctcatgctgacgatcccgagcgggtagtcagagagagctgcgaagtcgccctcgatatgtatgaacatgaaacagggagggcatttcagtacgcagatgggttagaacagttacgcggtgccccatcttag

SEQ ID NO: 27399 - DNA, 3384 bp, Artificial Sequence
  Description of Artificial Sequence: Synthetic coding sequence
atggaagtgcaggtttcccaagcgtccttgggtttcgaactcacatcagtggagaagtcacttagggaatggagtcgccttagccgtgaagtgatcgcctggctttgcccaagctccccgaactttatactgaactttcccccacccccttccgcatctagtgtgtcaatggtgcagctcttttcgagcccctttggttaccagagcccttctgggcacagcgaggaagaaagagaaggcaatatgaaaagcgctaaacctcaggtgaaccacagccagcatggcgaatcgcagcgtgctctctcacccctgcaatcgacgctaagtagcgctgcaagcccatcccaggcttacgagacgtatatcgagaatggccttatttgcctgaaacataaaattcgaaacatagagaagaaaaaactgaaactggaggactacaaagatcggttgaagtccggcgagcacctaaaccccgatcaattagaagccgtcgaaaagtacgaggaggtgctgcataacttggaattcgccaaggagctacagaaaacattctcgggcctcagcttagatctgctcaaagcccagaagaaggcacagcggagagagcacatgttaaaactggaagcggagaagaagaagctaaggaccattctgcaggtccagtatgtcctgcagaacctaacgcaggagcacgtgcagaaagatttcaaggggggtcttaatggggctgtttacttgccctcaaaagagctggactacctcatcaaattcagtaagcttacctgtccagagcgaaacgagtcgctcagtgtggaggatcagatggagcagtcatcattatacttttgggacctcctcgagggcagcgaaaaggccgtggtgggcacaacttataagcacctgaaagaccttcttagcaagctgctaaatagtggatattttgaatcaatccccgtcccaaagaacgctaaggaaaaagaggttccgcttgaggaggaaatgctgatccagtccgaaaaaaagacccagctgtccaagacagagtccgtgaaagagtcagaatctttaatggaattcgctcagccagaaatccagccacaggaatttctgaacaggcggtacatgacagaggtggactacagcaacaagcagggcgaggaacagccatgggaagccgattacgccaggaagcctaatctccctaagcgctgggacatgcttaccgaacccgatggacaggaaaaaaagcaggagtctttcaagtcctgggaagcctcaggtaagcaccaagaagtctccaaaccagcagtgagcctcgaacagcgaaagcaggacacaagtaaactccgaagcaccctcccagaggagcaaaagaagcaggagataagtaagagtaagccaagcccgtcacagtggaaacaagataccccaaagtccaaagctggctacgttcaggaagagcagaagaagcaggaaacacccaaactatggcccgttcagttgcagaaagaacaagatccaaagaagcagactccaaagtcatggaccccatccatgcagtcagagcagaataccacaaagtcgtggaccacccccatgtgcgaggagcaggacagtaaacagcctgaaaccccaaagtcatgggagaacaacgtggaaagccagaagcacagcctaacgagccaatcacagatttctcccaagtcttggggggtggccaccgcctcacttatccctaatgaccagctgctgcccagaaaactaaacaccgaacctaaggacgtcccaaaaccggtacaccagcctgtgggatcatcttctacactgcctaaggatcccgttctgagaaaagagaaactgcaggaccttatgacacagatccagggcacctgcaactttatgcaggagagtgtgttagattttgataaaccatccagcgctatcccaaccagccagcctcccagtgccaccccaggtagtcctgttgcttccaaagagcagaatctgtctagccagagcgactttctgcaggagccactccaggccacctcatcacctgttacttgctcaagcaatgcgtgccttgtcactaccgatcaagcctcaagtggcagtgaaaccgagtttatgactagcgaaacacccgaggctgccatcccccctggcaagcagccctcttctctggcttcccctaaccctcccatggcaaaggggtctgagcagggattccagtccccacccgcttcttcttcgtctgttacaattaatacagctccattccaagccatgcagacagtctttaatgtcaacgcacccttgccaccaaggaaagagcaggagattaaagagtcaccctactccccgggttacaatcagtctttcacaaccgcttccacacaaaccccgccacagtgccagcttccgagcattcacgtagagcagacagtgcactctcaggagaccgctgcaaattatcatcccgatggcactattcaggtcagcaatgggtcgttagccttttatcccgcacagactaacgtgttcccacgacctactcagcccttcgtgaattcgcggggatccgtgagaggttgcactcgaggaggcagactgattacaaatagctaccggagcccaggaggttataagggcttcgatacatacaggggcctcccctctatttccaacggaaattattctcagctccagttccaggctcgcgagtatagtggcgcaccctactcccagagggacaacttccagcagtgttataagcggggtggcacctcaggtggccctagggctaattcaagagccggatggtcagacagttcccaggtctcatctccagagcgcgataacgagacctttaactccggagattcgggtcaaggtgatagcaggagcatgacccccgtggacgtgcctgttaccaacccagctgcgaccattctgcctgtgcatgtgtacccactcccccagcaaatgcgggtcgccttctcagcagccaggacatcgaatctggccccagggactttagatcagcccatcgtgttcgatctgctcctgaataacctgggggagaccttcgatcttcagctcggtaggttcaactgccccgttaacgggacttacgtgttcattttccatatgctgaaactggctgtcaatgtccccctgtatgtaaatctaatgaaaaatgaagaggtccttgtcagcgcttacgccaacgatggggcacctgatcacgaaacagcttcaaaccacgccatcctccagctttttcagggcgaccagatctggctgcgtcttcacagaggagccatctacggctcatcctggaagtactctaccttctccggctacctactttaccaagattag

SEQ ID NO: 27400 - DNA, 2448 bp, Artificial Sequence
  Description of Artificial Sequence: Synthetic coding sequence
atggaggtgcgagcttccttacagaaagtttcaggttcttccgatagtgttgctactatgaactcagaagaattcgtgctggtgccgcagtacgccgatgataatagtaccaagcacgaagagaagcctcaacttaaaatcgtgagcaatggcgacgagcagttggaaaaggccatggaggagatcctgcgcgatagcgaaaagcgcccttcttcactgttagtcgactgtcaatcatcctccgagatctctgaccatagttttggcgacattcccgcttcccaaaccaataaaccctcattgcaactcatcctggacccctctaatactgagatctctacccctagaccaagtagtccgggtgggttaccagaagaggatagtgtcctgtttaataagctgacctatcttggctgtatgaaggttagcagccctagaaacgaagtcgaggctctgagagctatggccacgatgaagtcatcctcacaataccccttcccagtgacactctatgtgcccaacgtgcctgagggcagcgtgcgaatcattgatcagtcttctaatgtggagattgctagcttccctatctataaggtgctgttttgcgcccgaggtcacgacggaaccacagagtccaactgttttgcttttacagaatcctctcacggctctgaagagttccagatccatgtatttagctgcgaaattaaggaggcagtaagtaggatcttgtactcattctgcacagctttcaagcgaagtagcagacaagtcagcgatgtaaaggacagcgtcatcccgacaccagattctgatgtttttacattttctgttagcctggaagtgaaagaagatgacggtaaagggaattttagtccagttccaaaggaccgcgacaaattttacttcaaactgaagcagggcattgagaaaaaagtggtaattaccgtgcagcagctctctaataaagaactcgctattgagagatgcttcgggatgctcctaagccccggtcggaacgtaaagaattcagacatgcacctactggacatggaatcaatgggaaagagctatgatgggagagcctacgtgataacgggcatgtggaaccccaacgctccagtttttttggccctgaacgaagaaacgcccaaggacaagcaggtctatatgaccgtagcagtggatatggtggtgaccgaggtggtggagccggtcaggttcttgcttgagactgtggttcgggtgtacccggcaaacgagcgtttctggtacttctctagaaagacatttacagagacatttttcatgcgtctcaagcagagtgaaggtaaaggccacacaaatgccggtgacgctatttacgaggtggtgagcctccaacgtgagagtgataaagaggagccagtcacccctactagcggaggcggacccatgtcaccccaggacgacgaggcagaagaagagtcagacaacgaactttcttcaggcacgggggacgtgagtaaagattgtccagaaaaaattctctactcatggggagagctgttaggtaagtggcattccaacctgggagccaggcccaaagggttatcgaccctcgtaaagagtggcgtgcccgaggccctgagggcggaggtctggcaattgctcgccggatgccatgataaccaggcaatgctggatcggtatcggatcctgataaccaaggacagcgcgcaggaatccgtgattactcgagatatccacagaacatttcccgctcacgattatttcaaagacaccggcggtgacggacaggagagcttgtataaaatctgtaaggcgtactccgtgtacgacgaggacattggttactgtcagggccagagctttcttgcagcagtcctgctgttgcacatgccagaagagcaggctttttgcgtgcttgtaaaaatcatgtacgactatggacttcgtgatctgtacaggaataacttcgaggacctgcattgcaagttctaccaactcgaaaggctcatgcaggaacagttgcccgacctccatagccatttttcggacttgaacctagaggcccatatgtacgcttcacagtggttcctgaccttgttcactgctaagttccccctgtgtatggtgttccacattatcgacctcctgctgtgtgagggtctcaatatcattttccacgtggccctggcattgctcaagacaagtaaagaagatctcttgcaggctgattttgagggtgctttgaagttctttagggtgcaactgccgaaacgttaccgggcagaggaaaatgcccgtcggctgatggagcaagcgtgcaatatcaaggtgcccaccaagaagcttaagaaatacgagaaggagtatcagactatgcgcgagtctcagctgcagcaagaggatcctatggaccgatacaaattcgtctacctttag

SEQ ID NO: 27401 - DNA, 639 bp, Artificial Sequence
  Description of Artificial Sequence: Synthetic coding sequence
atggcacagactgataagcctacttgtattcccccagagctgccaaaaatgctgaaggagtttgcaaaggccgcaatccgtgctcagccacaagacctcattcagtggggcgcagactatttcgaagctctgtctcggggagaaacacctcctgtgcgggaacgttctgagagggttgccctatgcaattgggccgagctgactccagagcttcttaagatactacattctcaggtggccggtcgcctaattattagagccgaggagttagcgcagatgtggaaagttgttaatttgcccacagatttgttcaactccgtcatgaacgtaggtaggtttaccgaggaaatagagtggctaaaatttttagccttggcatgctcagccctgggggtcaccatcactaaaaccctgaagattgtctgcgaggtactatcctgcgatcataatggagggttgccacggatcccattttctaccttccaatttctttacacgtatatcgcagaagtggacggagagatttgcgcatcacacgtatcacggatgctgaattatatcgagcaggaagtaatagggcctgacggattaattactgtgaatgattttacacaaaatccaagagtgtggctggagtag

SEQ ID NO: 27402 - DNA, 1938 bp, Artificial Sequence
  Description of Artificial Sequence: Synthetic coding sequence
atggcctcactgctgcaagaccagctaaccaccgaccaggacctgctcctgatgcaggagggaatgcctatgagaaaggtccggtccaagagctggaaaaagctgcggtactttaggttgcagaacgacgggatgactgtgtggcacgcccgtcaagcaagaggctccgctaagccctctttctccatcagcgacgtcgaaactattagaaacgggcatgattctgaattgttaagatcgttagccgaagaactgcctcttgaacaaggattcactatcgtcttccacggtaggcgatcaaacctggaccttatggctaactccgtcgaagaggcccagatctggatgagaggactgcagctcctcgtggatttagttacctctatggaccaccaggagagactggatcaatggctctcagactggttccagcgaggagacaagaaccaggacggcaagatgagctttcaggaggtccagaggttattgcatcttatgaatgtggagatggatcaagaatatgctttttcgctgttccaggctgcagacacctcccagtccggcacacttgagggggaggaatttgtgcagttttataaagccttgacaaaacgggcagaggtccaggaactgttcgaaagcttctctgccgacggtcagaaactaacactactcgagtttctcgatttcctgcaagaggaacagaaagaacgagattgcacttccgagctcgctcttgagctgatcgatcgctacgagccatccgactccggtaaattgcggcatgttctgtctatggacggattcctgtcctatctttgctctaaggacggagacatattcaacccagcttgcctccctatctaccaagacatgacccagccacttaatcactacttcatctgctcctcacacaacacatacttggtgggagatcagctctgcggacaatcaagcgtggaaggatatattagggccctcaaaaggggctgcaggtgtgttgaggttgatgtttgggacgggccaagcggagagccagtagtttaccatggccatacccttacgtccaggatcttatttaaggatgtggtcgcaactgtggcccagtacgcctttcagacttcagactatccggttatcctcagtctggagacccactgttcctgggagcagcagcagaccatggctcgacacctcaccgaaatcctgggggagcagctgttgagtaccaccttagatggagtcttgcctactcagctgccaagtcccgaggagctgcggagaaagattctcgtgaaggggaaaaaactgacactagaggaggacttggagtacgaagaggaagaggccgaacccgagcttgaagaatcagaactggccctggaaagccagtttgagacagagccggaacctcaagaacagaatttacagaacaaagacaaaaaaaaaaagagcaagccaatcctgtgccccgcattgtcctccctagttatctatcttaagagtgtgtctttcagaagcttcacccactccaaagagcattaccacttttacgaaatcagttctttcagcgaaaccaaggcaaagaggcttatcaaagaagcaggcaatgaattcgtgcagcataatacatggcagctgtcgcgggtgtacccatcgggtctccggactgactcatccaattataacccgcaagagctctggaatgcaggatgccagatggtggcaatgaatatgcaaactgccggactggaaatggatatctgcgatggccacttccgccagaatggcggttgcgggtacgttttgaaaccagattttctgcgggatatacagagttcattccaccccgagaaacctattagtccgtttaaagcccagacactgagcattccttacagacatcttcagctgatcttcccgatcaacagtgtttag

SEQ ID NO: 27403 - DNA, 7554 bp, Artificial Sequence
  Description of Artificial Sequence: Synthetic coding sequence
atggtgggcgagaggcatgccggtgacttgatggtgcctctgggcccaaggttgcaagcctaccccgaagagcttattcggcagaggcccggacacgatggtcatcctgaatatttgatacgctggtccgttttgaagtgcggggaggtagggaaggttggcgtggaagaaggtaaggctgaacacattcttatgtggctgagcgccccagaggtttatgccaactgccctgggttgttaggtgagcgtgctttgtcaaaggggttgcaacacgaacctgccggagtgagcggctccttccccagagatcccggtgggcttgatgaggtggctatgggtgagatggaagccgacgtgcaggcactggttagacgcgctgcacgccagctagcagagagcgggaccccttccctgaccgcggctgttctccacacaatccacgtgctgagtgcatacgcctccatcgggccactgaccggagttttcagggagacaggcgcactggacttgctgatgcatatgctctgtaatcccgaaccgcagataagacgctctgccggaaagatgttgcaagccctcgccgctcacgacgccggtagccgtgctcatgtgttactgtctctgagtcagcaggacggcatcgagcaacatatggactttgacagtaggtacactttgctggagctattcgcagagacgacgagctccgaggagcattgcatggctttcgagggcatccacctgccgcaaattcccggtaagctgttgttctctctggtcaaacggtacctttgtgtgacttccctacttgatcagctcaatagctccccagagctgggagccggagaccagtcctcgccatgcgcaacacgtgagaaaagcagaggacagcgtgaattggagttttcaatggccgtcggcaatctgatttcagagctcgtgagaagtatgggctgggccagaaatctgtccgagcagggtatgtctcctcccagaccgacacggtccatttttcaaccttacattagtggcccatctctactccttccgaccatcgtaaccacgccccgtagacaaggatgggtgttccggcagcggagtgagtttagctctaggtccggctacggggagtacgtacagcagaccctgcagcctggtatgcgagtaagaatgcttgatgactacgaagagatcagcgccggagatgagggagaattccgccagagtaacaatggcatcccgccagtccaggtcttctggcagtcaaccggacgtacttactgggtgcattggcatatgcttgaaatcctgggaccggaggaggccactgaggacaaggcaagcgccgcagtcgagaagggcgcaggcgcaaccgtgctcggaacagcctttccctcatgggattggaaccctatggacgggttgtatccattaccttacctgcagccagagcctcagaagaatgagagggttggatacctcacacaggctgagtggtgggagctgctgtttttcattaaaaaactggacttatgcgaacaacagcccatttttcaaaacctgtggaaaaatctggatgagactctcggcgagaaggcactcggggagatctccgtttctgtggaaatggctgaaagtttactccaggtgctctcatctaggtttgagggctccacgctcaacgatctcctcaactcccagatttataccaagtacggtcttttatctaacgaaccgtcctcctcttcaacctctcgtaatcattcctgcacacccgatcctgaagaagagtccaaatctgaagcctcattttctgaggaggagacagagtcacttaaagccaaggccgaggccccaaagaccgaggctgaaccaaccaagacccgaactgaaaccccaatggctcagagcgactctcaactcttcaatcagttgctagtgacggaaggtatgacactccctacagaaatgaaagaggccgcatcggagatggctcgggctctgcgtggccctggcccacgaagttctttggaccagcacgtggccgctgtggtggctacagttcaaatttcgtccctggacacaaatctccagctgtctgggctgtccgcgctttcccaggccgtagaagaggtgaccgaaagagaccaccctttggtccgtcccgaccggtcactgcgtgaaaagctggtcaagatgcttgtcgagcttctgaccaaccaagtgggcgagaaaatggtggttgtgcaggctctgagactgctttaccttcttatgactaaacatgaatggcgccctctgtttgccagagagggaggtatatatgcagtgttggtgtgcatgcaagagtacaaaacatccgtgcttgtccaacaggcagggctagctgctctcaaaatgttagccgtggcctcctcgagtgagatccctacattcgtgacgggtcgcgactcaatccacagtctctttgatgcacaaatgacccgggaaatcttcgcatccatcgatagtgcaacaagaccgggttccgagagcttacttctgaccgtgccagcggctgtaatcctgatgttgaacaccgaagggtgctcttccgccgcacgaaatggtctcctcctgcttaacctgctgctgtgtaaccaccatacacttggggatcagataatcacccaggaactgcgagatacactctttcgccactcaggaatcgcacctcgcaccgaacccatgcccacaacaaggacaatccttatgatgcttcttaaccgatattctgaacctcccggttctcccgagagagccgcacttgagaccccaatcatccagggtcaagacgggagccccgaacttcttatcagatccctggtggggggtccaagtgcagagctgctcctggaccttgagagagttttatgccgggagggcagcccaggcggagcggttcgtcctctgctaaaacgtctgcagcaggaaacgcagccttttttgttgctgttgcgtacactggacgctccaggtccaaataagactctgctgcttagcgtgcttcgagtaattacacggctcctcgactttcccgaggccatggtcttgccgtggcatgaagttctcgagccttgcctgaactgcctctccggccctagcagtgactccgagatcgttcaggagctgacctgcttcctgcaccgccttgctagtatgcacaaggactacgcggtggtgttatgctgcttgggtgctaaggaaatcctgtcgaaggtgctggacaaacattcggcacaactcctcctgggatgtgaactcagagatttagtcaccgagtgtgagaagtacgcacagctttattctaatctcacgtcaagcatcttggctgggtgtatccagatggtgttgggacagatcgaggaccatagaagaacccatcagcccatcaacatacctttctttgacgtgtttttacgccatttgtgccagggaagctctgtcgaagtgaaggaagacaaatgctgggagaaggtggaagtgagctcaaatccccatcgcgcttcgaaactgaccgatcacaaccccaagacctactgggagtccaatggaagcacaggctcgcactacattaccctacacatgcaccggggagttctggtgaggcaactgactcttctggtcgcctctgaagactcctcttacatgcctgcccgagtggtggtcttcggaggtgatagcacatcgtgcattggcaccgaattgaacacagtgaacgtcatgccttcggcatcaagggtcatacttctggaaaatctgaaccgcttctggcctataatccagatcaggattaaaagatgccagcagggcggtatagatacgcgcgtcagaggagtggaagttcttggtccaaagcctacattttggcccctgtttcgtgaacagttgtgccgcaggacctgtctcttctatactatccgggctcaggcatggtcccgagatattgcagaagaccaccgacgcttactgcaactgtgtccgagacttaatcgtgtgctgagacacgaacagaatttcgccgaccggtttttacccgacgatgaggccgcacaggcattgggtaaaacctgttgggaagctcttgtgtccccactcgttcagaacatcacttcccccgacgccgagggtgtgtcggctttaggatggttattggaccagtacctggagcaacgggagacaagtcggaatcccctctctagagctgccagttttgcctcccgcgtacggaggctctgtcatctgttggtccacgtggagccaccccctggaccctcgcccgaaccttccacaagaccattctcaaaaaattcaaaggggagagatcgttccccagcccctagccccgtactgcctagcagttccctgcgtaatattacccagtgttggctgagcgtggtgcaggaacaggtatctcgcttcctagccgcagcttggagggccccagatttcgtgcctagatattgcaagttgtatgaacaccttcagcgcgctgggagtgagctgttcggacctagggccgcttttatgctggcccttcggtccggcttttctggagctctcctacagcagagcttcctgactgccgctcatatgtccgaacagtttgccagatacattgatcagcaaatccaggggggactgatcggaggcgcaccgggtgtcgaaatgctagggcagctgcaaaggcatctggaacctatcatggtcctctcaggattggagctggcgacaaccttcgaacacttttaccagcattatatggccgaccgtcttctgtcttttgggagcagttggctcgagggcgcagttttagaacagatcggtctgtgtttccccaatagacttccgcaattgatgctgcagagcctgtccacctcagaggaactccagcgtcaatttcaccttttccaattgcaacgtcttgataaactcttccttgagcaggaggacgaagaggagaaacgtctggaggaagaggaggaagaggaggaagaggaggaggcagaaaaggagctgtttatcgaggatccctcccccgcaatcagtatattggttctgtcccccaggtgttggccagtcagtcccctgtgttatctttaccacccaaggaagtgcttgcctaccgagttttgtgacgcattggatcgtttttcaagcttctacagtcagtctcagaatcacccagtgcttgatatgggaccacaccgtcggcttcagtggacttggctcggtcgcgcagagctgcagtttggaaagcagattctccacgtctctactgtccagatgtggctgctcctgaaattcaaccagactgaagaggtaagcgtggagaccctgctcaaagacagcgacctgtctcctgagttacttctccaggccctggtaccacttacaagcggaaacggccctctcacgttacacgaggggcaagatttcccacacggaggcgtcctaaggttgcacgagcccggacctcagcgcagtggggaggccctatggctgatcccaccacaggcatacctgaatgtcgagaaggacgagggaaggacgctggagcaaaagcgtaatctgctgagttgtctactggtcagaattttgaaagcccatggtgagaaaggcctccacattgaccaacttgtgtgccttgttctggaggcctggcagaaagggcctaacccacccggtacgctcggccatacggtggccggtggcgtagcctgcacgagtaccgatgtgctgtcatgcatactgcacctcctcggccagggatatgtcaagcggcgtgacgaccgccctcagatccttatgtacgctgctcctgagccgatggggccttgtaggggacaagccgatgtgcccttctgcggttcccagagcgagacatcaaagccttcccctgaagccgttgccaccctggctagccttcagctgcccgcaggtagaactatgtcgccccaggaggttgaaggactgatgaagcagaccgtaaggcaagtgcaagagacactgaacttagagcctgacgtcgcccaacatctgctagcccactcccactggggtgccgagcagttgctgcagtcgtactctgaggatcccgaacctcttctacttgccgcagggttgtgtgtgcatcaggcccaagccgttcccgtacgtcctgaccactgtcctgtttgcgtgagcccactgggctgtgacgacgatctcccaagcttgtgttgcatgcattattgctgtaagtcctgttggaacgagtatttaacgactagaatcgaacagaacctcgtcctgaactgtacttgccccatcgcggattgcccggcacagcccacaggcgctttcatccgtgccatagtgagcagccctgaggtaatctcgaagtacgaaaaggccctcctgagaggatatgtggagtcatgttcaaatttgacatggtgtaccaatccacagggctgtgatcgcatcctgtgccgtcaaggactcgggtgcggaactacatgtagtaaatgcggctgggcatcatgctttaactgttcttttcccgaagcccactatcccgcatcatgtgggcacatgtcccagtgggtagatgacggaggttattatgacggaatgtcagtggaagcacagagcaagcacctggcaaagcttatttcaaagcggtgcccctcctgccaggccccaatagaaaagaacgaaggttgtctgcacatgacctgcgctaagtgcaaccatgggttctgttggagatgcctgaagagctggaagcccaaccataaggactactacaattgctcggccatggttagcaaagccgctcgacaggaaaagcgctttcaggattataacgagagatgcacattccaccatcaggcccgagagttcgccgttaatcttcggaaccgcgtgtccgctatacatgaggttccgccacccagatctttcactttcttgaacgacgcttgccagggactagagcaggcacgcaaagtgctggcttatgcctgtgtgtactccttctatagtcaggacgcagaatacatggacgtggtggaacagcagactgaaaatctcgaactgcacacgaatgcgcttcagatactgttggaagagacactactgcggtgtagagatctcgcctcctccctgcgcttgctgcgggctgactgtctttccactggcatggaactgctgcggcgtatccaggaacgcctgttggctattctgcagcatagcgcacaggatttccgggtcggcctacaatctcctagcgtggaagcctgggaggcaaagggtccgaatatgcctggtagtcagccgcaggcaagcagcgggccagaggccgaggaagaagaggaggacgacgaggacgatgtccccgaatggcaacaggatgaattcgatgaagagctcgataacgacagcttctcatacgacgaaagcgagaacctggatcaggagactttctttttcggagatgaggaagaggacgaggatgaagcctacgactat

SEQ ID NO: 27404 - DNA, 1476 bp, Artificial Sequence
  Description of Artificial Sequence: Synthetic coding sequence
atggaggagattccagctcaggaggcagccggatcaccgagggtccagttccagtccctggaaactcagtctgaatgtctgagtccagaaccacagttcgtccaggatacagacatggaacagggtctcacaggtgacggggagacacgcgaagaaaacaaacttctgataccgaagcaaaagataagtgaggaagtccatagttacaaggtacgcgttggcagactgaagcacgatatcacgcaggtgcccgaaactcgcgaggtgtacaaatccgaggatagactagagcgcctgcaggaaattctccggaagttcttatacctggagcgagagttcagacaaatcaccattagtaaagagactttcactagtgaaaaaaataacgagtgtcacgagcccgagaagtctttctccttggactctacaattgacgcagaccagagagtcctccgcatccaaaacacagatgacaacgacaaatacgatatgagcttcaaccaaaatagtgcctcaggaaaacatgaacacctcaacctgacagaggactttcaatcgtctgaatgcaaagaaagtctgatggacttgtctcacctgaacaaatgggaatctataccaaacaccgagaagagctacaagtgcgacgtatgtggcaagatcttccatcagagcagcgctctgacccgtcatcagcgaatacacacgagggaaaagccttataagtgcaaggaatgtgagaaatccttcagccagtcttctagcctttcccggcacaagcgaatacacacacgcgagaagccatacaagtgcgaggcaagcgataaatcttgtgaggccagcgacaaaagttgtagtccctcttcgggcattattcagcacaaaaaaatccatacccgggctaaatcctacaaatgttcatcttgcgagcgggtcttctctaggagcgtgcacctcacacagcatcagaaaatccacaaagaaatgccttgtaagtgcaccgtgtgcggttctgatttctgccacacatcttatcttctcgagcaccagcgagtgcaccacgaggaaaaagcttatgagtacgatgaatacggcctggcctatattaagcagcaggggatccatttccgggagaagccgtacacctgctccgaatgcgggaaagacttccggctcaatagtcacctgatacagcaccaaagaatccacactggagaaaaagcccatgaatgcaatgagtgtgggaaggcattctcccagacctcttgtctgatccagcatcacaagatgcacaggaaagagaagtcctacgagtgcaacgaatatgagggaagtttcagccattcgtccgatctcattctgcagcaggaagtactcactagacagaaggcattcgattgtgatgtatgggagaagaattcatcccagagagctcacttggtgcagcaccaaagcatccatacaaaggaaaacagttag

SEQ ID NO: 27405 - DNA, 2709 bp, Artificial Sequence
  Description of Artificial Sequence: Synthetic coding sequence
atgtctgagttcaggattcaccacgacgtgaatgagctgctgtccctgctccgcgtgcatggtggggatggagcggaggtgtatattgacttgctgcagaagaatagaaccccttacgtgacgacaaccgtgtccgcccactcagcgaaggttaagatcgctgagtttagtcggacccccgaagatttccttaagaagtatgatgaattgaaatccaagaacactaggaatctcgaccctctcgtgtacctgctgagcaagttgaccgaagacaaggaaaccctccaatacctgcagcagaacgcaaaggaacgcgcagagcttgctgccgcagctgtcggctcttccactacttcgatcaacgttccagccgcagcctcaaaaatctccatgcaggagctagaggaactccggaaacagctcggctccgtcgccactggctctactttacaacagtctctcgaactgaaacgaaaaatgctacgcgataaacaaaacaaaaaaaatagcggacagcatctgccaatatttcctgcttgggtgtacgagcgtccagccctaatcggagattttctgatcggggcagggatctccaccgacaccgccctccccattggaactctgcccctcgcctcgcaggagagcgcagtcgtagaggatctcctgtacgtgttagttggagtcgacgggaggtatgtctcagcacagccactggctggacgccaatcgagaacttttctcgtggacccaaacctggatctcagtattcgtgagctggttcaccgaattttgccagtggcggcttcttactccgccgtgacaaggttcatagaggagaaatcaagttttgagtatggccaggttaatcacgctcttgcagcagctatgcgaaccttggtcaaggagcacttgatccttgtgtcccagctggaacagctgcaccgccaaggcctgctgtccctgcagaaactatggttctacatccagcctgctatgcgaaccatggatattcttgcttctttggctacatccgtggataagggagaatgcctggggggatccaccctttccctcctccatgaccggtcctttagttatacaggcgattcccaggcacaggaattgtgtctgtaccttaccaaggctgcatccgccccttacttcgaggtgttggagaaatggatttacaggggaattatacacgatccttacagtgaattcatggtggaagagcacgagctgcgcaaggagagaatacaggaagactacaatgataaatactgggatcaacgctataccatcgtgcagcagcagatccccagctttttgcagaaaatggccgacaagattctgtctaccggaaaatatctcaacgtcgtgcgagagtgcgggcacgacgttacctgccccgtcgctaaagaaattatttacactttgaaggagcgggcttatgttgagcagatagagaaggcgtttaattacgcttctaaggtacttcttgacttcctcatggaagagaaggagctcgtcgcccacctcaggagtatcaagaggtacttccttatggatcagggcgacttctttgtgcactttatggatctggccgaagaggaactgcggaaacccgtggaggatataacccccccacgcctggaggcactcttggaactcgccctgcgtatgtctacagccaacaccgaccccttcaaagacgacttaaaaattgacctgatgccacacgacctgattactcagcttttgagagtgctggccattgagactaaacaagaaaaggccatggcgcatgccgaccctacagaactcgcattatcaggcctggaagcattttcgtttgattatatcgtcaagtggcccttaagccttatcattaaccggaaagcgcttacgaggtaccagatgctgtttcggcatatgttctactgtaagcatgtggagagacagctttgcagtgtttggatcagtaataagacagccaaacagcactctttgcattctgcccagtggttcgcaggggcttttactttgcggcaacgcatgttgaacttcgtacaaaacatacagtactatatgatgtttgaggtcatggaacctacatggcacattctcgagaagaatctgaaatccgccagtaacatagacgatgtcctgggtcaccatacaggcttcctcgatacttgcctgaaggactgcatgttgaccaatcctgagctgctgaaagttttttcaaagctgatgagtgtgtgcgtcatgttcacaaactgtatgcaaaagtttactcagtccatgaagttggatggcgagttgggcggtcagactcttgaacactcaacggttttagggctgccagctggtgccgaggagcgcgctcggaaggaactggccaggaagcacctcgctgagcacgccgatacggtgcagctcgtcagtgggtttgaagccaccattaacaagttcgataagaatttctctgcccacctcctagatcttttggcccgtctctcaatatactccacatctgattgcgaacatggaatggcatctgtaattagcaggcttgacttcaacggcttctatacagagagactcgaacgcctgtcagccgaacgcagccagaaggctacgccacaggtcccagtcctcaggggcccacccgcaccggcaccacgggtcgctgtaacggcgcagtag

SEQ ID NO: 27406 - DNA, 2289 bp, Artificial Sequence
  Description of Artificial Sequence: Synthetic coding sequence
atggccatgcaggagaagtaccctaccgaggggataagccacgtgacctccccgtcttctgacgtaatccagaaaggatccagccttggaactgagtggcagactcctgtgatctcagaaccctttcggtccaggttcagccggtgctcgagcgtggcagacagcggggacactgctatcggcactagctgctctgatatcgctgaggatttttgtagctcttccggcagcccgccttttcaacccattaaaagtcacgttacaatccctactgcccatgttatgcccagtaccctgggcaccagcccggctaaacccaattctacacctgtgggcccttcttcatctaagctcccattgtccggtctcgctgaatcagtgggcatgacccgcaacggcgacttgggcgctatgaaacattctcctggcttgtcaagagatcttatgtattttagtggagctacaggcgaaaatggcattgagcagagttggttcccagctgttggccacgaacgccaggaagaggccagaaaattcgacatcccttccatggaaagtactttaaatcagagcgcaatgatggagacgctctacagtgatcctcatcaccgtgtaaggtttcataatccccgaacaagcacaagcaaagaattgtatcgagtgctccccgaagcgaaaaaggccccaggttccggagccgtgttcgagagaaacgggccacattccaatagtagtggcgttctgcccctgggactgcagcccgctcccggactatccaagcccctcccaagccaggtgtggcagccttctccagatacgtggcatccacgggagcagtcctgtgagctctcgacttgccgtcaacagctggaactgattaggcttcagatggagcagatgcagctccagaacggagctatctgtcaccatccagccgctttcggtccctcccttcccattctggaaccagctcaatggatttccatcctgaactcgaatgagcatctgctcaaagagaaagagctccttatcgataagcagaggaagcatataagccagctcgagcagaaggtgagggaaagtgagctgcaggtacacagcgccctcttaggcaggccagcaccgttcggtgatgtttgtctccttagacttcaagagcttcagagagaaaatacattcctgagagcgcagtttgcccagaagactgaggcattatcccgagagaagattgacctggaaaagaagctttcggcctccgaggttgaagtccagctgataagggagagcctgaaggtggccttacagaaacactccgaagaagtcaagaagcaggaagaacgcgttaagggccgagacaaacatataaataacctcaaaaagaaatgccagaaggaaagcgagcaaaaccgggagaagcagcagaggatagaaaccctcgagcggtatttagctgacctgcctacactggaagaccatcaaaaacagagccagcagctgaaggattcagaactgaagtcaacagaactgcaggaaaaagttaccgagctggagagtcttctcgaggagacacaggctatatgtcgcgagaaggagatccagttggaatccctccggcaacgagaggctgaattctccagtgccggacacagcctgcaggacaaacaatctgtggaagagacatcgggcgaaggtccggaagtggaaatggaatcatggcagaaacgctacgactccctgcagaaaattgtggagaagcagcagcagaaaatggatcagctcagaagtcaggtacagtctctggagcaggaggtggctcaggaagagggaacttcccaggccctcagagaagaggcccaacgccgagactccgccttacagcaactgagaacggctgtgaaagaactatcagtgcagaaccaggacctcatcgaaaagaacctcacgctccaggagcatttaaggcaggctcagcccggatctcctccttccccggatactgcccagctcgcccttgaactccaccaagagctggcttcctgtttgcaggacctccaggctgtatgctctattgtgactcagcgggctcagggacacgatcccaacttgagcttgttactgggcattcattccgcccagcatcctgagacacagctagatctccagaaacctgatgtcataaagaggaaactggaagaggttcagcagctgagaagggacattgaagacctgaggactaccatgtctgatcgctacgctcaggatatgggagaaaactgcgtgacacagtag

SEQ ID NO: 27407 - DNA, 1443 bp, Artificial Sequence
  Description of Artificial Sequence: Synthetic coding sequence
atgatcgtggcggattctgagtgcagggccgagctcaaagattacctgcgattcgcacccggtggcgtgggggattctggcccaggcgaggagcagcgggagtctagagctagaagaggccctcggggacctagtgcattcattcccgtcgaagaggttctgagagagggcgctgaaagtctggagcaacatctgggattagaagcactcatgtcatcggggcgagtcgataacctggccgtggtgatgggcctgcatcccgactatttcacaagtttctggaggctccactacttgttactgcacacagatgggcctctggcatccagttggaggcattacatcgccattatggcagcagccagacaccaatgttcttacctggttggatctcacatggcagagttcctgcaaaccggaggtgacccagagtggctcctgggcctccacagggccccagagaagctcaggaagttgtcagaaatcaataagctgcttgcccaccgtccatggttgattaccaaagagcacattcaggccctcttgaagaccggtgaacacacatggtccttggcagagctgattcaggcactagtgcttctgacacactgtcactcactcagcagtttcgtcttcgggtgcggcatcctacctgagggcgacgccgacggtagccctgctccccaggcccctacaccaccgtcagaacaatcatctcctccatcccgggatcctctgaataatagcgggggatttgaatctgcgcgagacgtcgaagctctgatggagcggatgcagcaacttcaagagtcactattaagggatgagggtacatctcaggaagagatggagtcacgttttgagctagagaagagtgagagcctgctggtgaccccaagcgcagacatccttgaacctagcccccatccagatatgttgtgtttcgtcgaagaccctacctttggttacgaagatttcacccgtaggggagcccaggctcctcctacctttcgtgctcaggactatacttgggaggatcacggatactccctcatccagcgactctatcctgaggggggacagctgcttgacgagaagttccaagctgcgtactcactcacatataacactatcgcaatgcacagtggagtggatacctccgtgctaagacgcgctatttggaattatatccattgcgtgttcggcatcaggtacgacgattacgactacggagaagtgaaccagctcttggaaaggaacctgaaagtctacatcaaaacggtcgcctgttatcccgaaaaaacgactaggcgcatgtacaatctcttttggaggcactttcgccactctgagaaagtccatgtcaacctccttctcctcgaagcacgaatgcaggcagcgttactatacgcactgcgtgcgatcactcggtacatgacgtag

SEQ ID NO: 27408 - DNA, 633 bp, Artificial Sequence
  Description of Artificial Sequence: Synthetic coding sequence
atgcctggggtcaagttgacgactcaagcatactgtaaaatggtattacatggggcaaaataccctcactgcgccgtgaatggcttattggttgccgagaaacagaaacccaggaaagagcatttgcctctcggcggacctggagctcatcacaccttgttcgtagactgcatccccctcttccacggaacgctggctttagctccgatgctggaggttgccctcacgcttatcgattcttggtgtaaggatcacagttatgtaatagcgggttattaccaggccaatgagagggtcaaagatgcatcacctaatcaggtggctgaaaaggtggcctcacgcatagccgaaggattttcagacactgcactgattatggtagataataccaaattcacaatggattgcgtggccccaacaatccatgtgtacgaacaccatgaaaatcgctggcggtgcagagatccacaccacgactattgcgaagactggccagaagcgcaacggatcagcgcatccctcttggattcacggtcctatgagaccctagtggactttgacaaccatctagatgacatcaggaatgactggacgaaccctgaaatcaacaaagcagtcctccatttgtgctag

SEQ ID NO: 27409 - DNA, 1059 bp, Artificial Sequence
  Description of Artificial Sequence: Synthetic coding sequence
atgacggaagccggtaaattgccactccccctgcccccaagactggactggtttgtacatacccagatgggtcagcttgcacaggacggcgtccctgaatggtttcatggcgcaatctcacgagaagatgctgagaacctgctcgagagccagccactcggttctttcctgattcgagtctcccactcccatgtgggctacaccttgtcctacaaagcccagagtagctgctgccacttcatggtaaaactcctcgatgacggtacttttatgatccctggggaaaaagtggcacacacgtcgcttgacgctctggtaacatttcaccagcagaagcccattgaaccaagacgagagctgctaacacagccctgtagacaaaaagacccggcaaatgtcgactatgaggacctctttctctacagtaacgcagtggctgaggaggcagcatgtcctgttagcgcgccagaagaggcgagtcccaagcccgttctgtgccatcagtccaaagagcgcaagccttctgcagaaatgaacagaatcaccactaaagaggccacttcctcatgccctcctaagagtccactcggcgagacacggcagaaactctggaggagcttaaaaatgctaccagaaaggggccagcgtgtgaggcagcaacttaagtcccaccttgccacagtaaatctcagtagtctgctcgacgttcgcagatcaaccgtgatcagcggacctggcacagggaagggtagtcaggaccacagcggagacccaactagcggggaccgcggatatacggacccttgtgtagcaacctccctgaagtctccaagtcagccccaggcacctaaagacaggaaggtaccgaccagaaaagctgaaaggagcgtaagctgcatcgaggtgaccccaggtgatcgtagttggcatcagatggtggtccgggcactgtcctcccaagagtcgaaacccgagcaccagggcctcgcggaaccagaaaatgaccagttgcccgaggagtaccaacagccccctccattcgctccaggatactgctag

SEQ ID NO: 27410 - DNA, 480 bp, Artificial Sequence
  Description of Artificial Sequence: Synthetic coding sequence
atgacccactgttgctctccatgctgccagcccacttgctgccgtaccacttgttggaaacctactacggtgaccacttgtagttccacaccctgctgtcagccttcatgttgtgtctctagctgctgccagccttgctgcagaccgacatgttgccagaatacgtgctgtcagccaatctgtgttacctcctgttgccagccaagttgctgctctacaccctgctgccaacccacctgttgcggtcaaaccagttgtgggagctcctgcggacagtcctcatcctgtgcgcctgtgtattgccgcagaacttgctaccacccaaccaccgtctgtctgccgggttgcctcaaccagagctgtggctccaattgttgccagccatgctgccgcccagcctgctgcgagaccacctgttgtagaacaacatgcttccagcctacatgtgtgtcaagttgctgtcagcctagctgttgctag

SEQ ID NO: 27411 - DNA, 615 bp, Artificial Sequence
  Description of Artificial Sequence: Synthetic coding sequence
atggaccctaaggaccggaaaaagatacagttctcagtgcccgcaccccctagtcagctggacccacggcaggtggaaatgatacgaaggcgcaggcctacgccagcaatgctctttcgattgagcgagcactcatctcctgaggaggaagcttctccccatcaaagggcttccggagagggccaccatttaaagtctaaacggccaaacccttgtgcctacactcccccatctctgaaggctgtgcagagaatcgcggaatcacatctgcaatcaatcagcaatcttaatgaaaaccaggcatcggaagaggaagacgaactgggtgaactccgtgagttgggctatccaagggaggaggatgaggaagaagaagaggatgatgaggaggaggaagaagaggaggattcccaggcggaagtgttgaaagtaattcgacagtccgccggacagaaaaccacttgcggacaggggctggagggtccatgggaaaggccgcctcctctcgatgagagcgaaagggacggaggcagtgaagaccaggtcgaagaccccgcactttcagaacctggcgaggaaccccagaggccaagcccttctgagcctggaacttag

SEQ ID NO: 27412 - DNA, 2061 bp, Artificial Sequence
  Description of Artificial Sequence: Synthetic coding sequence
atgaccgacgcgctgctcccggcagcacctcaacccctggaaaaggagaatgatgggtactttagaaaagggtgcaaccccttggcacagacgggacggagcaagttgcagaaccagcgcgcagctctgaaccagcagattctcaaagccgtgcgcatgagaacaggtgccgaaaacctattgaaggtggcaaccaattccaaggtcagggagcaggttaggttagaactctcttttgtgaactccgatttacaaatgctgaaagaggagcttgaagggcttaacatatctgtcggcgtgtatcagaatacggaggaggcattcacaatacctctaataccattaggcctaaaggaaaccaaagacgtggatttcgctgtcgttctgaaagacttcatactcgagcactactccgaagacggctatctctacgaggacgagatcgcagacctcatggacctgcgccaggcttgtcggaccccatcaagggacgaggctggagttgaattgctgatgacttatttcattcagctcggattcgtggagagtcggtttttcccccctactaggcagatgggattgctgtttacctggtacgattccctcactggagtgccagtgtcccagcagaatttactgctggaaaaagccagcgtcctgttcaataccggtgctctttacactcagattggcactcgctgcgatagacaaacgcaagccggactggagtctgccattgatgctttccagagggctgcgggtgttttaaattatttgaaggacacattcacgcataccccttcctatgatatgtcaccagccatgctgagcgtcctggtgaaaatgatgctggctcaggcccaagaatcagtctttgaaaagatatccctgccagggatcagaaacgagttctttatgctggtaaaggtcgctcaagaggccgcaaaggtgggcgaggtttaccagcagctccatgctgccatgagccaggccccagtcaaagaaaatattccttattcatgggccagcctcgcttgtgtgaaagcgcaccactatgccgcacttgctcattactttactgcaattttgcttatcgaccaccaggtgaagcctggaaccgacctcgaccatcaggagaaatgcctgtcccagttatacgatcacatgcccgaggggctgaccccgctcgccactctgaagaacgaccagcaacgtcggcagctgggcaaatctcacctgcgccgagccatggctcaccacgaagagtctgtgagagaggccagcctctgcaaaaagctgcgctccattgaagtgctgcagaaagtgctttgtgcggctcaggagcgcagcaggctaacgtacgcacagcatcaagaggaggatgacttgttaaacctgatagacgccccatccgtggttgcaaagacagagcaggaggtggacataatcctgcctcaattttcgaagcttaccgtgacggacttctttcagaagctcggcccattatcagtgtttagtgcaaacaagagatggacacctcctagaagcattaggttcaccgccgaggagggtgatctcggttttactcttcgcggtaacgcacccgtacaggtccactttctcgacccatactgttccgctagtgtggctggagccagagaaggggattacatagtcagcatacagttagttgattgcaagtggctgactctttccgaggtaatgaagctgttgaagtcttttggcgaggatgaaattgagatgaaagtcgttagccttctggactccacatcgtctatgcataacaaatcagcaacgtactcagtgggtatgcagaagacatactccatgatctgtctggccatcgatgatgacgataagaccgacaagacaaagaagattagcaagaagttgtcgttcctcagctggggtaccaataaaaacaggcagaagtctgcttccacactgtgcttgcccagcgtgggcgcagcgagacctcaagtcaagaaaaagctgccttcccctttttctctccttaattcagattctagttggtactag

SEQ ID NO: 27413 - DNA, 1254 bp, Artificial Sequence
  Description of Artificial Sequence: Synthetic coding sequence
atgccactctacgaaggccttggatctgggggagagaagacagccgttgtgatcgatcttggggaggccttcaccaaatgcgggtttgcaggtgaaaccgggccaaggtgcatcattccatccgtgattaagagggccggtatgcccaagcccgtgagggtggtgcagtataatattaataccgaggagttatactcttacctgaaggagttcatacacattctgtacttcagacatctgcttgtgaatcccagggaccgccgagtcgtgatcatcgaaagcgttctctgtccgtcccacttccgagaaaccttgacccgggtgttgtttaaatactttgaggtgcccagcgttcttctcgctccgtcacacctgatggctcttttaactctcggaatcaatagcgccatggttctggactgcggatatcgcgagtcgcttgtgctgcctatatacgaaggcatcccggtgctgaactgctggggcgctctgccgctgggaggtaaagccttacacaaagagttggaaacacagctgttggagcagtgtaccgtggacacaagcgtggccaaggaacagtcacttccttcagtcatggggagcgtgccagagggagtcctggaagacattaaggcaagaacctgtttcgttagtgatctgaaacgcggtctgaaaatacaggctgctaagtttaatatcgatgggaacaacgaaagaccaagcccccctcctaatgtggattaccctctcgacggcgaaaagattctccacatcctagggagtattagagacagcgtggttgaaattctcttcgagcaggacaacgaggagcaatctgtagccactttgatactagactccctgatccaatgccccatcgatacacggaagcagctggctgagaatctcgtggttattggaggcactagcatgttgccaggattcctgcaccgacttctggcagaaattaggtacctggtcgaaaaacccaagtataagaaggcactgggtacaaagacatttcgaattcacaccccaccagccaaagcaaattgcgttgcgtggctgggcggagccatcttcggcgcactccaggatattttaggatcaaggtccgtttccaaagaatattacaaccagacaggaaggattcccgactggtgctcactcaacaaccccccattagagatgatgttcgacgtaggcaaaacacaacctcctctgatgaagcgggctttctctacagaaaaatag

SEQ ID NO: 27414 - DNA, 2643 bp, Artificial Sequence
  Description of Artificial Sequence: Synthetic coding sequence
atgtcacaacccgcaggcggacggagaaagccacggaccctgggtcccccagtgtgttcaatccgcccattcaagtcttctgagcagtatctcgaagccatgaaggaagatctggctgagtggctgagagatctgtatggcctggatattgatgccgctaattttctgcaggtactcgagaccggtctggttctgtgccaacacgccaacgttgtcactgatgccgctctggccttcctggctgaggccccagcccaggcacagaagataccaatgcccagagtgggagtgtcctgcaacggagcagcacagcccggaacattccaagccagggacaacgtgtctaactttatccagtggtgcagaaaagaaatggggatacaggaggtcttgatgttcgaaaccgaagacctggtattgcgcaagaacgtgaaaaacgtggtattatgtctcctggagctcggccgtcgcgcttggcgattcggagtggcggcacctactctggttcaactcgaggaggagatcgaggaggaagtgcgcagagaactggccctgccacctcccgatccatccccccctgctccacccaggcgtcagccctgccacttccgcaatttagaccagatggtgcaatccctggtttcccattgtacctgcccagtacagttctccatggttaaggtgagcgaaggaaagtatcgggtgggcgacagtaatacgctgatcttcatcagaatcctgcgcaatcacgtgatggtgagagtggggggaggttgggacactctaggtcattacttggacaagcatgatccatgtagatgtacttcattaagtcacaaaccgggaagcttcctgaagcctccagcaccacccgtccagcacgaagtcagggttcaagatggtccctcacaaacccagcccaccatgacaatcagtaggagtcagagtcctcctccacccgtcgactggaaaacgtacacttctagcgatcggagactgcgacctcccactccatcttcgccgcgacctcgacgcgaacgcggagctgggacgggtgccagtagagagatggctcccttcctgcgatgccaggagagatctctgattccgagttggaggcaaccaactgcgggtgatagccccccatcaccacagagctccagcactcagaaaggacgtgaccctcaatgcaccagctcaggcaagagagaagagcgatatcctcctgaactgcctagaggtcgcatcccaacctcttgggtgcatgaagaaactgatagttggggtaccgacgcgggaaatccaacccctcaacgcctaagggccatcgaagccaccactaaaggaattagcgctagaggccctagtccactccccaggtcttttggacccgcagagtgcctgggtcttagattgccgcttcgtgacgaggcaaaaggcgcatttttccagtttagagaaccggaatctgtaagatccccaacaccagtacaggggcttaccaagatcccaatcagattgccgccagccaggccaccaactccgggaaggtcttttccaggggctaccagtggttctccccgaacagagttgggacgggatccaatccctttgagagctgtgaccgttgacctggccggttccacacacggtgattgtagcgtcgaagtccggcaagaggaccagcagttagacatccaagtcatggccgaagctcgcgaatcttgggaccttggactgcaggagcaggaggggcgatacactccactgcccctcggtgggaacaaagagcaagcaatttattgcagcttggaagaggaaatcctgggcaatatgaaactgttggaggttcgtagcgcgtgtcctcagggcactcggtctggcgtgatacctagatccggggtctacatcccgaggttggcaggacagtggcccgaacctggtggcccttatgataaagccatccaagagttagctcaagggtctccctcgttattgaaggttgacctggaggcatggaaggccgctccaactggttcaccaaagcccgctgtaactccagggccaggcagtctcaaaggaaaactcggggctaggcagtccgggcctcggacgaaggcttcattgtctgcaaaagggacccatatgaggaaggttcctccccaagggggacaggattgctcggcatctacggtatcagcctctccggaagcaccaactccatccccacttgacccgaattccgacaaggcaaaggcttgtctcagcaagggtcggaggacgttgaggaagccaaaaagggtgccatctatctacaaactcaaacttcggcctcgcattcggcctcgcagagaccacagacccgaaaaacagccatcacgcatccctaggcccctagcatacgttttcctgggtcccgctcggcagccccctaaggaccggcttctccgggcagtacttgggtccaagggcggtgaagcaagtcgggtggacggtgcgtctgtgggcgaagaagaggaggagggcaaggaggagaaggaacccgctgccccactggaaagttcacctcagcctccagagggtctgcagccccactggctgaatcaggcccctctgcccccagaggaggagtcttgggtatag

SEQ ID NO: 27415 - DNA, 14262 bp, Artificial Sequence
  Description of Artificial Sequence: Synthetic coding sequence
atggtgccagaagagagacgtgtcggcttgagcagtgacgagacatcttccgatagcctgaagtcgtggcattctatctgcgtccttgacagcaaagagcagcctcttgcatgccagcagaagcagagacagtttgtgaagcctgtcaccgagagtgagcagcccactgtgctggagctgctccttgccgagctgaggactttgttttctgcggtcctccaagattcttcaccagccgcttggagatacctgcacgctgtattagggcttctgccaccatacagggagctgttggtcggccacctcgatcttttgccttttctggagcagctctactgttgggccccatgggtgcagacccatctccacctggatttgctgggggctatcgtgcaggcctttccccctgattcctcactgctggattccgccagtcacgctgactgctgtccgcaaaagcgacgactgcatcatcgccctccgtgtccagcctgtccttttgtgcaggcacagtggagccggcaacaggtcaaggaagaactggcaacctggctgcggcctctaaccctacccgagttacaaagatgccttggtatagtgggggctcaagtggccctcgaagaagcggtttggttggacgggctgagtttgctccctctggccttggccgcagatatccccgtccgatatgaatcttccgacactgacaatgcggaagtagagccagtgggcaggaaggagacaagatcccagttggactatgaagtgcccagagaaaaagcattccagaagtcctctaccgggttttcgccggaaacctccttcctggacagccaggtgatgaccgcgttgaaaatggaacggtacctcaaaaaaattcattttctctatctgaatgtggcgccatcaagatactttagaccttactcactgatggtagtgcctcccgacaaggtgaaccccgagcattacatatttagcccgttcggcattctgcatgttcatcctgtcgaaggctccgagacaatgaccctaggaacatggcatcatcattgtgtgctgtggcagcagctccagtttatcccgtttttcaagtattgtctcttgcgtaagagcttcacatgctggaagaagaatgtgcgcctccagggactgcatagactccagaaattcctcgagaaccacttactgctggccgttccacatttcggcgcagggcttctgcatatttctaggctcttacaggagctccacagtgtttcctggctgcctcaggaactagacagatgctatgaattgttagaccttcaaacagccttggcagaggaaaaacacaaggcattgcgcctccttcacaggtgcctcaatctgtgcacaagtatcctgaggctcgtccacgaagacacataccacatgcagcaatgcttgcaagaacgggtgcagaactgtgatcgaatcagaacaggccaaggctctatctatctgcagagagtgcagcataaacagcttgaacaaaaacttaaacaggccgaagcctggtggctccagctcgggaagtttgccagactggtcgactacatgatctgtcagagtctgatctccgtcctggaagagcaaattacatcctttgtcgcaaatatcctgcaagcccctcgccagaaaccctttctatcctcccagttggtgttcgacgatcatggccagctatctcatgtaccttgcgtggagaatatgatccaaaccctgactggcggacttcagagtgtcaagacatctgcactacaggtagtgcagtccgcagatttgaagacatccagtgatagcctctattccgaagaggaggatgaagaagaagattcgaaggacgagtttctcatgccaaaatttcagggtcaaccctctgatgcagttagtattttctgtgggcctaacgtcggcctcgtgtggccttggaagagccaccctattgcaggcatcctggaggttagggggtgcaggctcaggggccagtatttccctcacaactacaaacagctagaggaggatctggacaacaatcccaaaattcaacaggccttgaatatccagcaggttctgcttgaaggtgtactgtgtaaagtgcaggaattctgccgagagcatcactggatcacaggcatatatgaattcttgcagtcatggggcccacagaaactcgaagatatgaggggtggccctattaagaattatgtgactctagtgtccaggctgaatgtgtggcaggcaagggtttccagcatgccgattgagctgttaaccaaaggcggtctgctgctgctctcttgtcacgatgttcaagcagaaatggagtctaagctaaattcgattcgcaaagatatattggcgcacgtccagaatgagtgctggaatctatctcagcagctcatgacggaactaaccgatttcatgcacatctttagaacaattaattccgatatccacgcaattgcacagtgcacccaaaagctgaacgaagctaatgaacaatacgttgagcttgaggagcggatggaatacgtcagggctctccacgaactgatacgcaaccacttttctttgtttagcgctgaaaatgaagccctggatatttccgttagaagacagtttggagagagccccataccaccctgccccccacccccacaaccccatctattacactgtccactgcttgctccacaactgctcgatatgtgggaggcctttcagtttgagaaaagccaagcatcagaattcctactgtccaagaggcacgccattatgcccaaactccaacagctgatggcggcagctttggctgagctagaaggactccttgctaaggcgctctctggcccatttatggatcctacgcaggatcaacgcagtaccgagcaccagttggtctccctggagcggcaatttcagaatactgtgtctgacctctccgagctgcaccacgcttatgcaatctttacagaagatgagacgcctgtgcctctgccaatctgtggtacgcgcccaattgtgcaacagcagagaatatggcatctgtatagggtgatttccgagaacattagtgaatggaaatgcatggcttttgccaaattttcacctgctatggcacaggagaaaactgaggggtggttgaccgaggccgctcgcatgtccacaaccctcgaactccattcacccgttctccagcattgtatgcgcattttaggagaatttagatcctaccttcccttactgacaaagctcggatccctgcacccccagtcccttaactgccagtgcctcctgcgggctctggggctgggctctttgcagacgattgaactgctgacactcggacagctcctcacctaccctctactcgagtttgcggatcgaatcaatcaagtctggcagaatgaaaatgagagaattcatgcccaggagacaatccgcagactgcagaggtattgggaggccaggcagctcaggttgctgaactttatcctgcacgttccttacgaacccccagcatcggagcggtcaaagagacaggtgctaaggtctcctcaatgggaggtagtcgataaagattctggcactttcattctgtctgattactccaatctacaggattcaatacaggagtcactccaggtcctatccaagatactggcgattgagaagtctggcgatctgaacaagatagcccttgaatgggtagccattatgcacggcctgggagccctactcgaagtgtggctaacctttcagcagaaatggatctttttaaataaagttcttcacgagatgaaaatacagtttcccaacgctgacctgaactccaggttcaaggtcatggacgatcagtacagaaccctgatgagaattagcgtggcagatcctatggttctgtcattggtggtgcccagtgctgagaggagcccttacttccagggtcaacaactgcaacagcttctgcaggccggaagtgtcgagctagaaggcataatcatgagcctagagagcgtgctgtacggggtgtgcgcgcactttcctcgcttgttctttctttccgacagcgagttagttgcacttctggcagccagactggaatcttgcgaagctcagctgtgggtgaggcgatgcttcccacatgtgcatgctgtctcctttcgttcttgtcccactggggagaagaacactgatgattgggagtcatcccctaacacacaaacacaggtcgaggcgttagctgtcttgggggctggaggagaagaggtgaagcttcagggaccgttacctctgcatccagacctgcccaaatggctcgcaagcctggagaaatgcctgcgcctcgcacttgtccacatgctgcagggttgtgtggcagcacggctggccagagggccttccctgggagaggccttgaagcagctgcccaaacaaaacaaactgtatttgcagctgtatgtgcagcactggattgatctggtgcaggcattcccctggcagtgcgttctggtggccgaggaagtggtatggcgggcagaaatggaagaagctttgctggaatggggaacactggccatggtatccatgcacatgaggaagctggaagtactcgtcaatttcatgagggcccagcgagccagtcaaggcggacagtctctgccctctgtgcgtcagacttccttactctccgcattgttggttatggcagtgacacaccgtgacatcgcccagctgcttgaacaacaccaggtttccgacctgacagatttccattgggtccggcagttgaagtatcacctgggctcacctcatataattccaaagtccccgctccaatcactcaagactattgcctcaagtgaaccctccttaagccccgcagcgtgttggatcgatgttttaggaaggagtttcttgtacaattacgaatacctggggccaagacttgggcctctacccagtctgctgcccgaaagaccagccctggtcctactgctcgctctggaggaggtcgcttgtggtaccgtgctgggtcctaatggggtgggtaagagggccattgtgaactccctggcacaagccctgggtcggcagctagtcatgcttccatgtagccctcagattgaggcccagtgtctctccaactacctgaatggcgctcttcaagggggagcttggttactcctggagaaggtccaccaacttcctccaggcctcctcagtgcccttggccaacggcttggcgagcttcatcatttgtacgcccctctgtatcaggaagcgtcacgcaatacaagtaccattgatccgacacagccacagctactgggcagttccttctttgaaaagcaccacgtgagcgtccgactgggatacggctgcttgctggtcctcagggccctgagtagcgccgtccctgccaatctgcatctgcttctcaggccagtggctctcgcgctcccagacttacgacaggtggccgagctgacactcctcggagccggaatgagagatgcgttccagatggcgacccggcttagcaaattcttctctctggagagggaactggtcagcgggcctctgccgtgtaggttgcccctgctgaaacaaatcctggaggatacaatccggactttgaatgtgaccaaagaagagccgaagtgtcaaaagcccaggtctctggctgcaattgaggaggccgctctccttcggtccccattgttcagtatcttgaacgggttgcaccttcacaatctgagagggctcctctgtgctttattccccagtgcatcccaggttttggcagaacctatgacttataaactcatgaagccactggtagtggaggagttacagcaggttggattggatccttctcctgatatcttggggagcctggagcagctttcacaggccctgagccgcgcttccggaatcctactgctaggcccagccggatctggaaaaacaacatgttggcactctctattcaaaatacagaaccggttggcagcaatggaggacactagcactcaaggatgtcaacccgtggagatcacgcacctttatccgtccggcctcagtcctcaagaattcctgggctggctcgaaggttcttgttggcaccacggcatattccctaaagtcctgcgggcagccggacagtgcaataacatgggacaaaaaaggcaaaccgaggagagcatcgggattcagcattggattatttgtgatggtgccagtaatggagcctggctcgactcaattacttgcctcctctctgagttgccccagctgagcttgcccagcggccagcaaatagctagaccacctggcacgtttctacttatggaggtggcagacaccaccgggatctctccaaccgtcgtcggttgttgcgcacttgtttggtgcggaggcgagcagacctggcaatgcatccttagtgcactgatggcctctttgccttacgagtatcgccttcagcatcgaaccgtggcagaattaaatcacatggccgaagtgttggttcctgcaacgctccgatttcttacatgccagggtgtgtcatcattgttacaggtgcacgggcagcaagcagtatgcgcgggtgtcgcggaagtgacctctatggccaggattttacacagccttctggacttgcacctgaggctgaaggaggaaaaagctcccggacccgaagacttgtcgtacagtgaccccgtggctcagtcattccgtagtagtaagtcatccttcctgaaccggtcccaggtggacagcgacgacgtcccagacaagtgcagggaacacctcctggctgtgtcctcctttctgtttgccctgatctggggttttggtgcccatctgccgtcaagattttggccgattttcgacacgtttattcgggactctatctcccgcttgagcaattacccggaacctcctccctcagctctcgtgttcgacctgcatgtgagccctgaagatggaaccctggtgccattcacggggcaatacttaagcagtcacatcaaaggcacgttggggacatttcatcccagcattcagactgagcgcctcctctatgtagtggatttgctgttaagtggaggtcagcctgtgctgttggcaggagaagctgctaccggaaaatctgcctttgtggaagtgctggtcgagccacatcacccctatatttactctcccatccatcccgctttttcctcaagccaccttaggttgctactgtcaagaggcatccagggccaaacacaagcaagcccacagccagggcatcatcaggattcgaagccatcactgcttttcctcctggaagacctgcacctggccacctccgatcctgaaaagtcctgccaaccggttctggaaactctccggcaagccatggatggaaccgtgtatgctcacagtacgctggagctacaaaccctccagccgacggtaaattttctagcaactgtgactgtccccggatattgtgaaaggcctctttgcccacggctgttcagactgttcacagttctggccctggagtccatgactcaggccacattactcgaacgccacgtgcctataatccaggcttggctcgaacgttttccatctgtcgagcgggagcgcgcactagcacggggtctggtgagagccagcgtggaggcttgggaggctgtgtgtaattgttttatgccctcacccctgcatcctcactatcattttagtcttcattcagtaagtcatcttttatcatcactacagctactccccaatcgaactggctcaaggggcttcgtcgattaccctaatcatcaggagcacctgcgccgagtgagtggccttaggggtacctgtctgaccgttatgatggctacacgaaatgttgtgaggctgtggcttcacgaggcccagagaactttttgtgataggctcgatagcccgcgtgaaagatcatactgcgcaaagcttcttcttgtagtcgcgcagagcgtgttctgttgcgggccagggccacagcacctgggtaaagatcaccaggaaagcgaggaggaggaagaggaggagcgggttccagaagtggagtctgagggagagctggcacagtgggaggacttctctaactctaactccgagactgaggaggaagaggaaccctacggcctgcaagtcgcaagggtgtcaaacagccgggatcctagtctaaccccttccataggtccggtgtcacgcggaatgaaggaatctatttcccacaaaattagacaggaaaagggaaccagagcctccaactatagactgcaggtgagacgatcattcaaaacctggtggcagaagaagccccagatggacctgatcagccctttactacttccagttctcctcctacatccacaggaaaagccttccgatctggtattttctcaagagctcatactcggacccaacagtgagacaccaaatctttacctggaaagacagtgggaaaagttggaggaacaattggccacctcggctgcccagttgaagctgagcccacacctggccaggtgccacagcatggctcaacatgtcgcccgacttgtccgcgtactggccaggcctcgtcagcacggcctgttgctgagtggtgccctgggaactgggcgacatacggcgataacgctggcttcttccatttgtcaggctcattttttccacctgccctccgggtcagaggaagccatattacagtgccttcgagatgcttcatggcatgctgggatgttaagtcagccagtcgctttacttgtgccttcgggagtggacttgacaacactccacaggctcctggccttagctacgtcagggtcctttcccggtcagtatacggaagccgatctagataggatcggcgagcatcttcctcgtgagaatctgggcgtgaagcagaacatcaagaaagaaatggttttacagcggttccatcagcaggtgtgctctcacctgcacctgttctttttaataggcgacaagcaggcacacaaacaactgccatcaaccctctttctcaggttactgcagctggccaccgcttccatagacaggtacgaaccgtgggaccaggccgcactggcaaaggtcgctcagcatcacctagaaggcgcacagagtgttccactcgacgatgggtcttggaaatatcccgatttgcaggcatccattccgtctgtggctaaagctatggccctcatacacctgagcgccacacattaccatgagcacctgtgcccagccctcccactcgtgacacctaagaccttcctcgatttcttagacactttcctgatgcttcaacaacagactatcttgaagatcaagaacaaagcgcagcgcgtacagaatgccctggaaaacttacgaatgctgataaaagagcatgggacccatgcaaacctgatttttgatttagaacagcagctgaaagacagcggcaagagtttatctatgttccagcagcagttggagcagtctaagctgctttacaaacagcagctcgaggagtgtagacaccaggaaaacctgattgaaaatcttgccagacaaagggatgccctgcaagcccaaagagaggccttcctggaacagatgtccaaggcttttctggagcccctctctcagctgcaggtagccgatttcgaggaaatcagatcataccgtgccccaccagaatcggtggtgcgggtgactgatgcaatgtgtgatcttttccatcacgaaactgggtgggcgtcagcgaagcagctgctttgtacagaagatttttaccaggaactggtgttctttcccaaagagaagattaccgattcagaactcataaagctgcacttgatcttaaaggcaccgggaatggacgacgccgcactcagagcagttagtcggccagctgcgagcttagccgcatggctgtgggcagtgctgcactatggacttgcacattgccgcggattacctaccgacctcttgcttcagcaggtagaggccacactcacacgcgaacaagccagacttggctattatcagtttcaggcacaggagacactcgaacacaatcttgccctggcgaagatggttgaggatgctcaggcatcacacaattgcgtcgctaaaaccttgagccaggctcagtgtggacagtatcacaaatggcccatgaaagcggcactattaaccccaatgcgcgcatggacaacccagttgcagaagttgaaaggcagatgcatgaccgttttcggagacaccctgctgtgctcagccgctatcatatatttgggcccttttcctcccttgcggcgacaggagctactggatgagtggttggctctgtgcagaggttttcaggaggcactgggcccagatgacgtggcacaggcactcaagcggaagcaaaagagtgtgtcaattccgccaaaaaaccctttactcgctacccactctcccttcagtatcctcagcctgctgagttcagaaagcgaacagtaccagtgggacggaaatctaaagcctcaggctaagtctgcacaccttgccggtctgcttttgagatctcctactcactactcatcttgtaggtggccccttctgctcgatccctccaatgaggctctgatctggctcgatccactgccactcgaggagaatcgcagcttcgcccctgccctaactgagggcagaggcaaaggtctgatgaggaaccagaagagggagagcaagactgacatgaaggaggaagacgacgagtcagaagagtccaatgaggcggaggatcagacgaaggagcagaaggccgaggaacgaaaaaatgaacaggagaaggaacaggaggagaatgaagaaaaagaagaggagaaaacggagtcgcagggtagcaaacccgcttatgaaacccagctgccctctctgccgtacttatccgttttgtctggcgcagaccctgagctaggatctcagttgcaagaagctgctgcttgtggactccccgtgttgcttacgaatgtggagctcgggttggggtgcgaggaactgcagtggttgcttcagagggagcaactgtctccgcctcaggtccaacctgggttctgtttatatctgagcacaaccctctcgctctgcgccatggaaaaagtgctaggctgtgaattgctgaagggactgaatgtgttagatcttggactcaacatggagatactggaggagcagatgctccatgagattttatgccgcgaatacccagagctggaaactcggtggcaggatctcaaaattcgggcactggacacttgtaaggcagtggaggccgctgaggagcgcttgcttacgatgcttctgtttcagaatccgaagaggcagaagcctgccaagtttctgcgcaatatcgtgcgtgcgcaagggaaactctgccagcttagggcccactgtgaggaattggagggccagaaactgcaggaaatggtgctgtgggcaccatacaggccagtagtgtggcatggaatggctatggtgaaggcactttctcagctgcagaatctgctgcccttattctgcatgagcccggagaactggttagccgtcactaaacaagcgctggactctatgaagccacgtgagattaatcacggcgaggacctcgcctcacacttattgcaactacgtgctcacctgacgcggcagctgttggggagcactgtgactgctctcgggttgacacaggtcccgctcgttggcgctctgggagctctagccctactgcaggcaacaggaaaagcatcagaattagagagactggctctctggcccggtttggccgcttccccatctacggttcactccaaacctgttagcgatgtcgctcgcccagcctggctggggcctaaggcctggcacgaatgcgagatgctggagctcctgcccccattcgtggggctttgtgcttctcttgccggtcactcctccgcctggcaagcctacctgagcctttcaagcaccgtcttgggacctgctcccggtcccggacctgagcccctctctctgttacagaagttaattctgtggagggtcttaaggcctgagtgtttggcaggcgcacttgcggactttactacttcattgctcggcaggccactggacgaaaacacttacgcaccaaccatgccctttaagcatagccaggctacacagcctatgttgatactgcttcccccacccggtcatccctctgcgaccctgcatcctttgacagtcattcagaaactcgcagctaagtatcagcaggggcagaagcagctgcaggtgattgctctaggctccgaggcatgggacccagtctccgttgtggtgtcaacgctaagtcaggccatgtatgagggccactggctggtgttggataactgccatctgatgccccactggcctaaggaactactgcagctgctgctggagctccttggtcgcgctaaggtcgtggccgacctcgaatcggaacagttactcgatcagcctgagagtcgcaacgtttcaaccgtgcatcgggacttcagactgtggctcattgttccagcggagtcctctgcgagtctgcccgcagtgctgacgcaacattcaatgccggtattctggaaccaatctctggaattaggccatgttctgattgactctgtggagctggcccaacaagttctgtatatgcaaccccctacccaggccctgccactgctgctacttcatggacttcttctccatagacagctttatggaaccagactacaggcgcaccggggtcgctggtcccaggtaactctgacacaagtactgcagacacaagatcagttatgggccagtctgagcaacccaagagctgccatgcaggaactggcggcttcagtgttttatggtggacctctgggtgatactgaggaccgggaggcgttaatttctctcacgcaagcctgcctgagcccgtcctctggctcttgggttcagccacatactccacagagcctgctcgccactcttatgcccctcccagaattaagagaattagatgcaatggctgagtgtaaggcccaaatgcacctgttaccctcgcctccggagcctcgtctctgcggcttgtctgaagggcctcaggcatggctgttgagaagacagagcagagctctgctgagtgccctccagaggtcttctccagtgtgggttcctgaatcccgcagaggcgctcagctggctgagcgcagactccgccagcggctggttcaggtcaatcggagactggaatctctgcaggatctccttactcatgtcattcgccaagatgaatcagatgctccttggtcagtactcggcccaaacgcacgtcgtcccctggagggcgtactggagacagaagccctggagttatcacagttggttggtaccctgcagcgggatcttgactgtctgcttcagcaattgaagggcgcacccccatgtccttctaggcggtgcgcagccgtggcccacgctctgtggaccggacgattgcctctgccttggcgccctcacgcccctgcagggcctcagccgccttggcattggctgcgccaacttagccggcgaggtcaattattggtgcggtacctgggggtcggagccgatgccagcagtgacgtccctgagagggtattccatctgtccgccttccggcatcccaggcgcctgttgctggctttacgtggcgaagcagccctggatcagaatgtgccatcttctaacttccccggtagccgtggcagcgtcagttcacagctgcagtacaagaggttggaaatgaattctaaccctcttcactttagggttgagaacgggcctaatccaactgtgccagagcggggtctgctgctgataggtctgcaggtccttcacgccgagtgggatcccattgccggtgcactacaggattcaccctcatctcagcctagtcctcttcctccggtttcaatcagtacacaggcccctgggaccagcgacctgcctgccccagcggatctgactgtttacagctgccctgtgtacatggggggacctctgggcacagctaaactccagagccggaatatcgtgatgcacctaccattacccactaaactaaccccaaatacctgtgttcaaaggagagtgcacgtctgctctccgccactttcataa

SEQ ID NO: 27416 - DNA, 1179 bp, Artificial Sequence
  Description of Artificial Sequence: Synthetic coding sequence
atggacctgtttggggatttaccggagccagaaaggtcaccacggccagcagccggaaaagaagcccagaagggccctcttctcttcgacgacttgccaccagcctctagcaccgattccggcagcggcggaccccttttattcgacgatttgccacctgcctcatcaggagatagcggatccctggccactagcatctcacagatggttaaaaccgaaggaaaaggcgctaaacgaaaaacatctgaagaggaaaagaatggctcggaagaactggtcgaaaaaaaggtctgcaaagccagtagcgtgatatttggactgaaaggctacgttgccgagaggaagggggagagggaggaaatgcaggatgcccatgtcatattaaacgacataaccgaggagtgccgacccccttcgagtctgataacacgggtttcttacttcgcagtgtttgacggacacggcggaatcagggcctcaaagtttgcagcacagaacttgcatcagaatctgatcaggaaatttccaaaaggggatgttatctccgtcgaaaagaccgtcaaacgctgtctgctggacaccttcaaacatacagacgaggagtttctgaagcaggcttcaagccagaagcctgcttggaaagatggtagcaccgctacatgtgttctggcagtcgataatatcctgtatattgctaacctcggagattcccgtgcgatactgtgccgctataatgaggagtcccaaaaacatgcagcactgtctcttagcaaagaacataacccaacccaatacgaggagcggatgcgaattcagaaggccggtggcaatgttcgcgatggtagagtgttaggggtactcgaggtgagtagaagcatcggggacggacagtataaacgttgcggggtcacatctgtacctgacatccgacggtgtcagttgacacccaacgatcgatttattttactggcgtgcgacggtctgttcaaagtgtttacacctgaagaagccgtgaacttcatcctgtcgtgcctggaagacgagaaaatacaaacccgcgaggggaaatccgctgcagatgcacgctacgaggccgcatgtaatagattggcaaataaagctgtgcagcgcggttctgccgacaacgtcacggttatggtcgttcggatcggacactag

SEQ ID NO: 27417 - DNA, 2193 bp, Artificial Sequence
  Description of Artificial Sequence: Synthetic coding sequence
atgtttggcagaaagcggtccgtctcattcgggggttttggatggatcgataaaacaatgcttgcctccttgaaggtcaagaagcaggagctagctaattcgtcagacgcgactctaccagatagacccctgagtccacccctgaccgctcccccaactatgaaatcatccgagttcttcgagatgttggagaagatgcaggggatcaagttagaagagcagaagcctggtcctcagaagaataaagatgactatataccctacccttcaattgacgaagttgtggaaaagggcggtccctatccccaggtaatactccctcagtttggcggatattggattgaggatccggaaaatgtcggcacaccaacatcccttggaagcagcatatgcgaagaggaggaggaggataatctcagtcccaacacatttggatataaactggagtgtaaaggggaggcccgagcttatcggcgtcattttctgggtaaagaccaccttaatttctactgcaccgggtcttccctgggaaatctgatactgtcagtgaagtgcgaggaagccgagggcattgagtacctcagagtgatcctgcggtccaagcttaagaccgttcacgagagaattcctttggccggactgagtaagctgccctcagtaccccaaattgctaaagccttctgtgacgatgcggtgggacttcgcttcaatcccgtgctgtatccaaaggcctcacaaatgatcgtctcttatgatgagcatgaagtgaacaacacattcaagttcggcgtcatctatcagaaggctcgccagacgctggaggaagagctgttcggcaataacgaagagtcaccagcctttaaggaatttctcgacttgctcggagacaccataacccttcaggatttcaaggggtttcgcggaggtttggatgttactcatggacagactggggtcgaatctgtatacaccaccttccgagaccgggaaatcatgttccatgtcagcactaaactgcccttcaccgacggcgatgcgcagcagctgcagaggaagcgccacataggaaacgatattgtggccatcatcttccaggaggagaatacgccctttgttcccgacatgatcgcaagtaacttcctgcacgcctatattgtggtgcaggtcgagactccaggaaccgagactccatcttacaaggtgtcggtaactgcacgcgaggatgtcccaacctttggccctcctctgccttcacctccagtgttccaaaagggccctgagttccgagaatttctgctcactaagcttaccaatgccgaaaacgcctgctgcaaatcagacaaatttgcaaaacttgaagataggacccgtgcagccctgttagataacctgcatgatgagctccacgctcatacacaagctatgctgggtctgggtcccgaggaggataaattcgagaatgggggtcacggcggattcctggaatcatttaaacgtgctatccgggtccgcagtcactctatggagacgatggttggtggtcaaaaaaaatcgcactccggcggtatcccgggatccctgtctggcggtatctcacacaatagtatggaagtgacgaaaacgacgttctcaccaccagtcgttgccgctactgtcaaaaatcagagtaggagtcccattaaacgacgcagcgggctgttcccaaggctgcataccggatctgaaggccagggggactctcgggcacggtgtgactcaacaagctcaacccccaagactccagacggtgggcacagcagtcaggaaataaagtctgaaacatcatccaatccatcaagtcccgaaatctgtcccaacaaagaaaagccttttatgaagcttaaagagaacggcagggccatttctcggtcatcctccagcactagttctgtgagctccacagctggcgagggcgaagctatggaggaaggggactcaggcggatcacaaccaagcactacgtctcctttcaaacaagaagtgtttgtgtactccccctccccgagttcagagtccccatccctgggcgcagcagccactcctattatcatgtctaggtccccaaccgacgccaagtctcgaaatagcccaaggtcaaatttgaaattccgattcgataagctctcacacgccagttccggagcaggacactag

SEQ ID NO: 27418 - DNA, 1110 bp, Artificial Sequence
  Description of Artificial Sequence: Synthetic coding sequence
atgtggtccggtcggaagcttggttccagtgggggttggttcttaagagttctaggcccaggtggatgtaacaccaaagccgctaggccattgatcagttcggctgtatacgtcaagaaccaactttccggaacccttcaaataaagcccggagtgttcaatgagtatcgcaccatctggttcaaaagttataggacgatcttctcctgcctcaaccgcattaagtcattcagatacccttgggcacgactgtattccacctcgcagacgacagtggattcgggtgaggtgaaaacctttcttgccctcgcacacaaatggtgggatgaacagggagtctacgccccactccactcaatgaacgacttgagggtgcccttcatacgagacaaccttctgaaaacaattcctaaccatcagcctgggaaacctctcctcgggatgaaaattctggacgtgggttgcggtggtggcctacttactgaacccctgggtagactcggagccagtgtaatcggcatcgaccctgtagacgaaaatatcaagacagcccagtgtcataagagcttcgacccagttctagacaaaaggattgagtaccgggtttgtagcttagaggaaatcgtggaggagaccgccgagacattcgatgccgtagtggcgtctgaagtggtcgagcatgtcattgacctggagacattcctgcaatgctgttgtcaagttcttaaacccggaggcagcttgttcattacaacaattaataaaacccaactcagttacgccctgggcattgtattcagtgaacagattgcatcaatcgttccaaaaggcacccacacatgggaaaagttcgtgtcacctgaaactctcgaatctatcctggagagcaatggcctgagtgtccagaccgtcgtgggcatgctctataaccctttctcaggctattggcattggtctgagaatacatctctcaactacgctgcatacgctgtgaagtcgagagtacaggagcatcccgcttccgctgaattcgtactgaagggggaaacagaggaactgcaagccaacgcgtgtaccaacccagctgtacacgaaaagctcaaaaaatag

SEQ ID NO: 27419 - DNA, 1782 bp, Artificial Sequence
  Description of Artificial Sequence: Synthetic coding sequence
atggaggggtgtatgggcgaggaatcgttccagatgtgggagttgaaccgaagactggaggcttacttggccagggtaaaagcactggaggagcagaatgagctgctgtccgccgagttggggggattacgtgcccagagcgctgacacctcctggagggcccacgccgatgatgaattggccgctctgagagccttggttgatcaacggtggcgcgaaaaacacgcagccgaagtggcacgggataaccttgcagaggaacttgagggggtggccggaaggtgccagcagttgcgcctcgcacgagaaagaactacagaggaggtggccagaaataggcgggcagtggaagccgagaaatgtgccagagcatggttatctagccaggtggctgagttggaaagagaacttgaagccctccgggttgctcatgaagaagagcgagtgggtctgaacgctcaggcggcttgcgcacccaggtgcccagcaccaccgaggggcccacctgctcccgctccggaggtcgaggaactggccagacggcttggtgaggcgtggagaggcgctgtccggggataccaggaacgcgttgcgcatatggaaacatctcttgggcaagcacgcgaacggcttggtcgggctgtccagggcgcacgcgagggaaggctagagttgcagcagctccaggccgaacggggtggtctcctcgagaggcgtgcggcactggaacagaggctggaaggcagatggcaggagcggcttcgcgctacagaaaagtttcaattagcagtggaagctctggaacaagagaaacagggtttacagtctcagattgctcaggtgttagagggtcgccaacagctggcccatctgaagatgtccctgtccttggaggtggcaacataccgtaccctgcttgaagctgaaaactcaagactgcagacacccggtggtggctcaaagacaagcttatcgttccaagacccaaagctggaactgcagtttccacgcacccctgagggtcggcgattaggctcactcctgcccgtgctctccccaacgagtctgccttcccctctgccagccactctcgaaacacctgtgccagcttttctgaaaaatcaagaattcctacaagcacgtacacctactcttgctagcaccccgatccctcctacccctcaggctccaagccccgcagtcgatgcggagatcagagcccaagacgcccctctcagcctgttgcagacgcaagggggtcgcaagcaggctcctgagcccctgcgggcagaggccagggttgccatccccgctagtgtgctcccaggcccagaggagccaggaggccagcgtcaggaagcctctactgggcaaagtcctgaagatcatgccagtctggctccacctctgtctccggaccatagcagcctagaggccaaggatggtgaatctggcggttcccgggtgttttctatctgcagaggtgaaggagagggacagatttggggattagtcgaaaaggaaactgccatcgagggcaaagtagtctcttctttacagcaggagatctgggaagaggaagatttgaatcggaaggagatacaggactcccaagttccactggaaaaggagactcttaaatcgctgggcgaggagattcaggagagcctgaagactctggaaaatcaaagccacgagactttagagagggaaaaccaagagtgcccaaggagcctggaggaggacttagaaacactcaaaagcctagagaagaagaagtag

SEQ ID NO: 27420 - DNA, 3456 bp, Artificial Sequence
  Description of Artificial Sequence: Synthetic coding sequence
atgatggccgctgccttggggccacccgaagtgatcgcacagttggaaaacgctgctaaggtgttaatggccccacctagcatggtgaataatgagcaaaggcagcacgccgagcacattttcctgtctttcaggaagtccaaaagtccattcgccgtctgtaaacatattctggagacctccaaagtggactacgtgctgtttcaagccgcaactgctatcatggaggcagtcgtgcgtgagtggatactactggagaaaggctctattgaatccttaagaacttttttgctgacctatgtgctgcagcgcccaaatctacagaagtacgtcagggagcagatcctgctcgccgtggctgtgattgtcaagagggggagcctcgataagagtattgattgcaagtctatatttcacgaggtgtcccagttaatatcgagcgggaatcctaccgtgcagacgctcgcctgctctattctcactgccttactctccgaattttcatcttcgtccaagacatctaacatagggctctcgatggagttccacggtaactgtaaacgggtattccaggaagaagatctgagacagatcttcatgctgacagtggaggtgctgcaggaattttctaggagggagaacttaaacgcacagatgtcgtccgtgtttcagcgatatcttgcactggccaatcaagtactgagttggaattttctgccacccaatttgggccgtcattatattgccatgttcgagtcctcccagaacgtgctgttgaaaccaactgaatcttggcgtgagactctgctggacagtcgggttatggaactgttctttacggtgcaccggaagattcgcgaggattctgatatggctcaggattcgctccagtgtttggcacagctggccagcctgcatggcccaatatttcccgacgagggatcccaggttgactacttagcgcactttattgaaggcctgctaaacaccattaacggcattgagattgaagactccgaggccgtgggtatctcctccatcattagtaatttgataactgtgttcccacgaaatgtcttgaccgctattccctctgagctcttctcatcttttgtaaactgtctcacacacctcacctgttcctttgggcgaagtgccgctctggaggaggtactggacaaggatgatatggtgtacatggaggcatacgacaaacttctggaatcctggctcacgttggttcaggatgataagcattttcacaaggggttcttcacgcagcatgccgtgcaggttttcaacagttatatacagtgtcacctcgcggctcctgatggaacccgcaatctcacagccaacggagtcgcttcccgcgaagaggaggagattagtgaactccaagaggacgatagggaccagttcagcgaccagctggccagcgtgggtatgttgggaagaattgcagccgagcattgcattccattgctgacatccctactggaggagagagtcaccagactacatggccagctccagcggcaccagcagcagttgctggcatcccctggcagctccaccgtcgataataagatgctcgacgatctgtacgaggacattcattggttgattctggttactggctatttgctcgcagatgacacccagggagagactccgttaatccctccagagataatggagtactcgatcaagcattcctccgaagtcgatatcaacacaaccctgcagatcctcggaagccccggtgagaaggcgagttccattcccggatataataggactgattcagtcattaggttgttgagtgccattctgcgggtgtcagaagtagagagccgcgctattcgagctgatcttacacatctgttgtctccacaaatgggtaaagatatcgtctggttccttaagagatgggccaagacctacctactcgttgatgagaagctatatgaccaaatatctctcccattcagcaccgcatttggtgcagacaccgagggcagccaatggatcatcgggtatctcctccaaaaagtcattagcaatctgtcagtctggagtagcgagcaggatctggctaacgataccgtccagctgcttgtgaccctggtggagcgaagagaacgggcaaatctggtcatccaatgcgagaattggtggaatctcgctaagcaattcgcttcccggtccccaccactcaatttcctcagctcccccgtccagaggactctcatgaaggctctggtgctcgggggatttgctcatatggatactgaaaccaagcagcagtattggaccgaagtgctccaacctctccaacagcgcttcctgcgggtcattaaccaagagaacttccagcagatgtgccagcaagaggaggtgaagcaagagatcactgcaaccctggaggcgctctgtgggatcgctgaagcgacccagatcgataacgtcgccatcctcttcaattttcttatggacttccttaccaactgtataggcctgatggaggtttataaaaatacaccagagaccgtgaatctgataattgaagtgtttgtggaggtggcccataaacaaatctgttacctgggggagtctaaagccatgaatctttacgaggcttgcctcaccttgctgcaagtgtatagcaagaacaaccttgggaggcagagaatcgacgtgacagcagaggaggagcagtaccaggacctcctcctgattatggagctcctcaccaatctacttagcaaagaattcatcgacttctcagacacagacgaggtgttccgcggacacgagcctggccaggctgctaatcggagtgtcagcgccgctgacgtggtgctatatggtgtgaatctgatacttcctctgatgtctcaagatttgctgaagtttcctaccttgtgcaatcagtattacaagcttatcacctttatctgcgagattttcccggagaaaatccctcagctccccgaagacctctttaagagtctcatgtacagcttggagctcggaatgacatctatgtccagtgaagtctgccagctatgtttggaagccctcaccccactggccgaacagtgtgccaaggcgcaggaaactgactcacctctttttctggcaacccgtcattttctaaagttggtctttgacatgttagtgctgcagaagcacaatacagaaatgaccacagcagccggagaagccttttacactttggtgtgcctgcaccaggctgaatactcagagctggtcgagaccctgctgtcgtcgcaacaggaccccgtgatataccagcggctggcggatgccttcaataagctgacagcaagtagtaccccgcctacactggacagaaagcagaagatggctttcctgaaaagcctggaagagttcatggccaacgttgggggtctgctatgtgtgaagtag

SEQ ID NO: 27421 - DNA, 1578 bp, Artificial Sequence
  Description of Artificial Sequence: Synthetic coding sequence
atggcagctgggggttccgggggacgcgctagctgtcctccaggcgtcggtgtcggaccaggaacaggtggtagcccaggcccttctgcgaacgcagctgctactccggcacctggcaacgcagctgccgctgctgcagccgcagccgctgctgccgctgccccaggacctacacctcctgctcccccaggccctgggactgatgctcaggcagccggagctgagagagccgaagaggctgctgggccaggcgctgcggcactgcagcgggaagcggcttataattggcaggcctcaaagcccactgtgcaggagcgctttgccttcctcttcaataacgaagtgctgtgcgacgtgcattttctggtgggcaaggggttatctagccagcggattccagcacatcggtttgtgctggccgtcggatctgctgttttcgacgccatgttcaacggaggaatggctactacctctacggagatagagttgcccgatgtggaacccgctgctttccttgcacttctgaagtttctttactccgatgaagtccagattggccctgagacagtgatgaccaccctgtacacagcgaaaaagtatgctgtgcccgcattagaggctcattgcgtggaattcctgaagaaaaacctgcgcgctgacaatgcatttatgctgctcacgcaagcacggctgttcgatgaaccccagcttgccagcctgtgtctggaaaacatcgacaaaaataccgcggatgccatcaccgcagaagggttcaccgacatcgacctggatacactggtggcagtccttgagcgcgataccctcggcatccgcgaagtacgcctcttcaacgcagttgtgcggtggtcagaagctgaatgccagaggcagcagctccaggtgactcccgaaaaccgacgtaaggtgctggggaaagccctgggtttaatccgctttccactgatgacaatcgaggaatttgcagcagggccagcccagtcaggaattctggttgaccgcgaggttgtatccctgtttctgcattttacggtaaatccaaaaccgagagtcgagtttattgatagaccgagatgctgtcttcggggaaaggagtgcagcataaatagatttcagcaggtggagtctaggtggggatattcgggcactagcgaccgaattaggttcagcgttaacaagagaatcttcgtggtggggttcgggttgtatggctcgatccacggaccgactgattatcaggtgaacattcagattatccataccgactcaaatacggtgctcgggcagaacgataccggcttctcctgtgatgggagcgcgtctacattccgcgtcatgttcaaagaaccggtggaagtcctcccaaatgtgaattacacggcatgcgccacgctgaaggggcctgatagccattacgggaccaagggactgagaaaagtcacgcatgaaagtcctactaccggggcaaaaacctgcttcacgttctgttacgcagccggaaacaataacggtactagtgttgaagatggacaaatccccgaggtgatcttttatacatag

SEQ ID NO: 27422 - DNA, 525 bp, Artificial Sequence
  Description of Artificial Sequence: Synthetic coding sequence
atggccaccgtggcagagctgaaggcagtgctgaaagatacactggaaaaaaaaggggtgctggggcacctgaaagctcgcattcgggcagaagtgtttaatgcacttgatgacgatcgggagccacgtccttcactttcacacgaaaatctcctcattaacgaactgattcgtgagtatttagaatttaacaaatacaagtatacagcaagcgtgttgatcgcagaaagcggacaaccagtggtgcctctggacagacagtttctgatccacgaactgaatgcattcgaggaatctaaggacaacacgataccattgctgtacggaattctggcccactttctccgcggaacaaaggacggaattcaaaatgcctttctgaaaggtcccagtctgcagccttccgatccgtcccttggccgtcaaccatctagaaggaaaccaatggacgatcatctaagaaaggaggagcaaaagtccacgaatattgaggacctgcatgtcagccaggccgtgaaccggtag

SEQ ID NO: 27423 - DNA, 1257 bp, Artificial Sequence
  Description of Artificial Sequence: Synthetic coding sequence
atggccggtagcctgcctccctgcgtggtggactgcggcactggttatacgaaactgggatacgcaggaaacacagaaccccagtttatcattccctcttgtatcgccattagagagtccgcgaaggttgtggatcaggcgcagcggagggtgttgcgcggtgtggatgatttagattttttcataggagatgaagctattgacaagcccacatacgcaaccaaatggccgattcggcacgggataatcgaggactgggacttgatggaacgattcatggaacaagtggtgttcaaatatttgcgcgcagagccagaggaccactactttctgatgacggaaccccctctgaatactccagaaaacagagaatacctggcagaaataatgtttgagtctttcaatgtgcctggcctttacatagccgtgcaagccgtcctcgccttggcggcttcttggaccagccgacaagttggcgaacggacactcacaggaatcgtgatcgactccggtgatggagttacccacgtgatccctgtggctgaaggttacgtaattggttcttgtatcaaacacattcctattgctggcagagacatcacttactttatccagcaactcctcagagagagggaagtggggatacctcctgaacagtcactggaaaccgccaaagcaatcaaggagaagtactgctacatctgtccagacatcgttaaagagtttgcaaaatatgacgtcgatccgcgtaagtggattaagcaatacactggaatcaacgcaataaaccaaaaaaagttcgtgatagatgtagggtatgagcgatttctcgggcctgagattttcttccatcctgagttcgcgaaccccgactttatggaaagcatttccgatgtagtggatgaggtgattcagaactgccctattgacgtgagacgcccactctacaagaacgtagtgctcagtggcggatccactatgttcagggacttcggtcggagactgcagcgcgatctcaaacgtgtggtggacgccagactgcgcttaagcgaggagctcagcggtggacgaataaagccaaagccagtagaagtgcaggttgttacccaccacatgcagagatatgctgtctggttcgggggttccatgttagcctccacacctgaattcttccaagtgtgccataccaaaaaggactacgaggaatatggacccagcatctgccggcacaaccccgtgttcggtgttatgtcatag

SEQ ID NO: 27424 - DNA, 1044 bp, Artificial Sequence
  Description of Artificial Sequence: Synthetic coding sequence
atggccgcagctgagccagcttcctctggccagcaggctccggctggccagggccaggggcagcgccctcctcctcagcctccacaggcccaggccccacagcctccccctcctccccagctgggtggcgcagggggaggcagtagtaggcacgagaagtccctgggcctgctcactaccaagtttgtgagcctgctacaagaggcgaaggatggagtcctcgatctgaaagccgcagccgacacccttgctgtgcggcagaaaagacgaatatacgatatcactaacgttcttgaaggcattgatctgatcgagaagaaatcaaaaaacagtattcagtggaagggggtcggcgcaggctgtaacaccaaggaagtcattgatcggctgcgttatctgaaagctgagatagaggacctggagctgaaggagcgcgaattggaccagcaaaagttatggctgcagcagtcgatcaaaaatgtgatggacgactctatcaacaatcgtacattttcctacgtgacacatgaagacatctgcaactgcttcaatggcgacacactcttagccattcaagcaccaagcggaacccaactggaagtgcccatccctgagatgggtcagaatgggcagaaaaagtaccagattaatctcaaatctcatagtggacccattcacgttctgcttataaataaagagtccagtagctctaagcccgtggttttccccgtgccgcctcctgacgatctcacccagcccagtagtcagtctcttacaccagtcacaccgcagaaatcctcaatggccacacagaatctgcccgagcagcacgtgtccgagaggtctcaggccttacagcagacgtctgcaaccgatataagttcagctggcagtattagtggagatataatcgatgagctcatgagcagcgatgtgtttcctttactgagactgagccccactccagccgacgattataactttaatctggacgacaatgagggagtctgcgacctcttcgacgttcaaatcttaaactactag

SEQ ID NO: 27425 - DNA, 636 bp, Artificial Sequence
  Description of Artificial Sequence: Synthetic coding sequence
atgtgccccggaaactggctttgggcctccatgacgttcatggcacggttttcacgatccagcagtagaagccccgttcggactaggggcaccctggaggagatgcctacagtacagcatccattcttgaacgtttttgagcttgagcgcctgctctataccggcaagactgcttgcaatcacgcagacgaggtctggcctgggctatatctcggagaccaagatatggccaataatcgcagagaactgcgtcggctcgggatcacgcacgtgctcaatgcgtctcattctcgctggcgcggaacccccgaggcgtatgaagggctgggtatccgctacctgggtgtggaagcccacgacagcccagcctttgacatgagcattcacttccagactgccgctgattttattcaccgcgctctttcccagcctggaggcaagattcttgtccactgcgcagtgggggtaagtcggagcgccactttggtactcgcctacctcatgctgtatcaccacttgactttggtggaggccattaaaaaggttaaggaccatcgaggcatcattccaaatcgcggatttcttcgccagttgctggcactggaccgcagactccggcagggtttggaggcttag

SEQ ID NO: 27426 - DNA, 948 bp, Artificial Sequence
  Description of Artificial Sequence: Synthetic coding sequence
atgcccggtctcagctgccggttctatcagcataagtttccggaggtggaagatgtagttatggtcaatgtgaggagcattgctgaaatgggcgcttacgtttctcttctggaatataacaacatcgagggaatgattctcctttctgaactgtcacggcgtcgtattagaagcattaataaactcatccgcatcggaaggaacgagtgcgtggtggtaatccgggtggacaaggaaaaagggtacattgacctaagtaagcgacgagtcagtccggaagaagccattaaatgtgaggacaagttcaccaagagcaagaccgtctacagcatcctgcgccacgtcgcagaggtgctggagtataccaaagacgagcagctcgagtccttatttcaacgaaccgcctgggttttcgatgacaaatacaaaagacctggatatggagcatatgacgccttcaaacacgctgtgtcggatcctagtattctcgacagtctcgacttaaacgaagacgagcgagaggtcctgatcaacaatatcaaccggaggctgacacctcaagcagtgaaaattcgggctgacattgaagtggcctgctatgggtatgagggcatcgatgccgtgaaggaggccctccgggctggactgaattgttctacagagaatatgccgatcaagattaacctgatcgcccctccacgatatgtgatgaccactactaccctggagcggaccgagggtctcagtgtgctgtcccaggcaatggccgtcatcaaagaaaagatcgaggagaagaggggcgttttcaatgtccagatggaaccaaaagtggtgaccgacaccgacgaaactgagctggctcgccagatggaacggcttgaacgcgagaacgcagaagtggacggagatgacgatgccgaggaaatggaagcaaaggcggaagattag

SEQ ID NO: 27427 - DNA, 318 bp, Artificial Sequence
  Description of Artificial Sequence: Synthetic coding sequence
atggcaggtcaagaggaccccgttcagcgggagatccatcaggattgggcaaaccgggagtatatagagattatcacatcctccatcaaaaagattgccgatttccttaattcctttgatatgtcttgccgtagtaggctggccacccttaacgagaagctgacggcacttgaaagacggatagagtatatagaggcgagggttactaaaggtgagacgttaagaaccgtcccttgttgttgttgggaagtggcgctgcacaacacagggcatatggggaaggcccctgccgctttcagcagcttcctgtcaccctag

SEQ ID NO: 27428 - DNA, 1902 bp, Artificial Sequence
  Description of Artificial Sequence: Synthetic coding sequence
atggccgctgctgcagctgccgctaccacagccgcatgctcatcaggctctgccggtactgacgccgcaggtgcctctggattgcagcagccgccaccacagccccagcctcagcctgctgccgcagccccagcccaacctcccccagagcctccacgtaagccccgaatggatccgagacgacggcaggctgcactgtcttttctgaccaatatctcgctggacggtcgactcccacctcaagacgctgaatggggcggaggcgaggagggcggagctgccaagcccggtgccggaggtgcgtgcggggcacgtacaaggttcagtctactcgccgctgccgagcgaggagggtgtattgccctggcggctcccggaacaccagccgcaggcctggccgcaggatccgggccatgcctgccacaaccgtcgtccctgcctccacttattcccggaggtcacgcgacagtgtccgggccaggagtagccagagggttcgcatctccactgggcgctggtcgcgcttctggcgaacagtggcaaccgccaagacccgctcccttagcagcctgcgctcagcttcaactgctggatgggagtggggctgcaggacaagaagaattagaggaggacgacgcttttataagcgtgcaggtccctgctgcggcttttctgggctccggaacacctggaagtggcagtggcagcaggggcaggctcaatagttttactcaaggcatcttacctattgcctttagccgccctacttctcagaattattgttcattggagcagccgggacagggtggcagtacatccgcttttgaacaactccagagatccaggcgcaggttgataagccaacgttcaagcttggaaacactagaggacatagaagagaacgctccgctgcgcaggtgtcggacactgtccgggagcccaagacctaagaatttcaagaaaatacatttcatcaagaacatgaggcagcacgacactcggaatggtagaatcgttctcattagcggtcgacggtctttctgtagtatcttcagcgtgctcccataccgggatagtacgcaagtgggcgatcttaaactggatggaggtaggcagtctaccggggctgtttccctgaaagaaataatcggcctcgagggcgtggaacttggagccgatggcaaaacagtttcttacacacaatttttgttgcccactaatgcattcggcgctcgcagaaacaccatcgattctactagctctttttctcaattccggaatctgtcacaccggtccctgtctattggacgggcatcaggtactcaggggagcctcgataccgggtctgacttgggtgattttatggattacgatcctaaccttctggacgatccccagtggccttgcggcaaacacaaaagggtacttatcttcccttcctatatgacaacggtgatagattatgttaagccctctgatctcaagaaggacatgaatgagactttcaaggagaagttcccacacatcaaactaaccttatctaagatccgatccctaaaaagagaaatgcgaaagctggcccaagaggactgtgggttggaagaacctacagttgcgatggccttcgtgtatttcgagaaattggccctgaaaggaaaactcaacaaacagaaccggaagttgtgcgccggagcctgtgtgctcttagcagccaaaattggttctgatcttaagaagcatgaagtgaagcatctaattgacaaacttgaagaaaagttcagactgaaccggagagaattgatcgcattcgaattccccgtcctggtcgcactggaattcgccctccacctcccagagcatgaggtaatgcctcattacagacggcttgtgcagagtagctag

SEQ ID NO: 27429 - DNA, 3423 bp, Artificial Sequence
  Description of Artificial Sequence: Synthetic coding sequence
atgacaaccgctgtcgaaagaaaatacatcaatatacgcaagcggctcgatcagctggggtaccggcaaaccctgacagtggagtgtctgcccttggtcgagaagctgttctcagacctggtgcacacaacggagagcctgcgtcaaagtaagctcagcgccgttaaggccgagaaagaatctgccaactttgactttgtgttagaaccctataagctcgagaacgccaggctcagtagggagaacaatgaactctacctggaactgatgaaattgagggaacactccgaccaacacgtcaaagaactcaaaaccagcctgaaaaagtgcgcgagggaaactgcagacctgaagttcctgaacaaccaatatgcgcacaaattgaagttgctggagaaggagtctaaagccaaaaacgagcggattcagcagctgcaggagaaaaatctgcacgcagtcgtgcaaacacctggtggcaaaaagcgatccatcgcctttcgaagacagaggatgcagatcgacgagcctgtgcccccttctgaagtcagctcctaccccgtccctcagcctgacgatccttacattgcggatcttctgcaggtggctgataaccgaatccaagagctgcagcaggaggtacatcagctgcaagaaaaactcgctatgatggagagtggggtgcgagattattctaaacaaatcgaattacgagaacgggaaatcgagagattatcagtggcgctggatggtggccgaagtcccgacgtactgtcacttgaaagccgaaacaaaacaaacgaaaaactcatagcccatctgaatattcaagtcgactttctccagcaggcaaataaggacctcgagaaacgcatccgagagctgatggaaactaaagagacagtgaccagtgaggtagtcaacctgtccaataagaacgaaaagctgtgccaggagctgaccgaaatcgatcagctagcacagcaactggagaggcacaaggaggaagtcctggaaacagctgataaggagctgggagaagcgaaaaaagagattaaaaggaagctgagtgagatgcaggacctggaagagactatggctaagctgcagttggagcttaacctgtgccagaaagaaaaagagagacttagtgatgaactgctggtcaaatcagatctggaaacagtggtgcaccagctcgagcaggaaaagcagagactgtctaagaaagtagagtcttttgccgttactgagagacaactgactttggaggtagaacggatgaggctcgaacatgggatcaagcgcagggatcggagtccatcgcgcctggacacattcctgaagggaattgaggaggaaagagattactacaaaaaagagctggagcgcttgcagcacatcatccagagacgatcttgtagtacatcatattctgctcgcgagaaatcctctatctttcggaccccagagaaaggcgactacaactctgagatacaccagataaccagagaacgcgatgagttacaaaggatgctcgagcgcttcgagaaatatatggaggacatacagagcaacgtgaagctcttaacagcggaaagagacaagctgagcgtcttatataacgaagcccaggaagagctcagtgcgctccgaaaggaatcgacacaaaccacagcccctcataacatcgtgtctctgatggagaaagaaaaggagctagctttgtccgacctgagaaggatcatggccgagaaggaggctctaagggagaagttagagcacatcgaagaagtgtcactgtttgggaagtccgaactcgaaaaaaccattgagcacttgacttgtgtgaaccatcaactggagagtgagaaatatgagcttaagtcgaaagtgctaatcatgaaagaaacgatcgaaagcctggaaaacaagttaaaggtacaggctcaaaaattttcacacgttgctggtgactccagccatcagaaaacagaggtgaactcacttcgcatagtgaatgagcaactgcagcgctctgtggacgattaccagcaccggctttctataaagcgaggggagctggaatccgcgcaagctcagatcaagattctggaagagaagatcgacgagcttaatttgaaaatgacttcgcaggatgaggaagcccatgtgatgaagaaaaccatcggggtcatcgataaggagaaggacttcctgcaggaaactgtcgacgaaaaaactgaaaaaatcgccaatctacaggagaaccttgccaacaaagagaaagccgtagcccagatgaagataatgattagtgagtgcgaaagctccgtgaatcagctgaaagaaaccctagtcaacagggaccgggagattaacagcctgcgtcgtcaattagacgccgcacataaagagctcgacgaggtgggccgatctagagagatcgctttcaaagaaaaccggaggcttcaagacgacttggcaaccatggctcgcgaaaatcaggaaatttccctggaactcgaggccgctgtacaggagaaggaggaaatgaagtccagagtccacaagtacattaccgaggtctcccggtgggaatctctcatggctgcaaaggagaaggagaaccaggatcttctcgatcgctttcagatgctgcataatcgggcagaggattgggaagtgaaagctcaccaggcagagggagagtcaagctcagtgagactcgaacttctgagcatcgatactgagcgtcggcacttgcgcgaacgagtggaacttctggagaaagaaattcaagagcatatcaacgcccaccatgcctacgaaagccagatttccagcatggctaaggcaatgtctcggttggaggaggaactgcgtcaccaagaggacgagaaagctaccgtgctgaatgacctctcatcactacgggaactctgcattaaactagactccggcaaggacatcatgactcaacagctaaattcaaagaacctggaattcgaacgggtagttgtagagttagaaaacgtcaagagcgaatctgatcttctgaaaaaacagttaagcaacgagcggcatacagtgaaaaacctggaatccctcttggccactaatagggacaaggagtttcactcacatctaacctcacacgagaaggacacagaaatacaactcttaaaagagaagctgacgttgagcgagtctaagctcacgagccagtcccgcgagaacacaatgttgcgagcaaaggtcgcccagctccagactgactacgacgctctgaagaggcaaatatccacggaaaggtacgaacgggaaagagcaattcaggagatgagaagacacggcctagcaactccaccactgagcagtaccctgaggagcccttctcacagtcctgagcatcgcaacgtttag

SEQ ID NO: 27430 - DNA, 1512 bp, Artificial Sequence
  Description of Artificial Sequence: Synthetic coding sequence
atgcccaacgtcgccgagaccgaaaggagcaacgactccggcaacggagagcacaagagcgaaagaaagtcgcccgaggaaaacttacagggagccgtcaaaagcttttgcaccagcgcttccggcgctcccctcggcccaaagggcgatgggcactacccttggtcgtgtcctgtcacccatactagggaaaaaatctacgccatttgttctgactatgcatttctcaaccaggccacatcgatctataagaccccaaatccttctagatcaccctgtttaccggactcaacgagtctgtcggccggtaataactcatcgcgctatattggaataccaacatctacgtctgagatcatctataatgaggagaacagcctggaaaatttgtccaacagcttgggcaaactgcctttagcctgggaaatagataaaagtgaatttgatggtgtcacaactaatagtaagcacaaaagtggaaatgctaaaaagcaggtgtctaagcgaaagactagtgataaaaaaggtcggtaccagaaggaatgcccgcaacactcaccactcgaagacatcaaacagaggaaggttctggatctaaggcgctggtactgcatctccaggccgcagtacaaaaccagttgcggtatttcaagcctgataagctgctggaactttctttattccacaatgggggctggcaacctgcctcccataacccaggaggaagctctgcacatactcggcttccaacctccttttgaagacatacggttcgggccttttaccggtaacacaacgctgatgcgttggtttcgccagataaacgaccacttccacgtgaagggctgctcttacgtattgtacaagccccacggtaagaacaagacagcaggagaaaccgcctcaggggcacttagcaagctcactcgagggttgaaggacgaaagtctcgcgtatatttatcattgccagaaccactatttttgcccgataggcttcgaggcaactcccgtaaaagctaacaaagccttcagcagaggcccactatctcctcaagaggtggagtactggattttaattggggagtctagtcgcaagcatccagccatccattgtaagaaatgggctgatatcgttaccgacctgaatacacagaatccagagtacctggacatcagacacctcgagagaggcctacagtacaggaaaacaaaaaaggtcgggggtaacctacactgtatcattgcattccagaggctcaattggcagagatttggcttgtggaacttcccctttgggacaatccgtcaggaaagtcaacctcctactcatgcccaggggattgctaagtctgaaagtgaagacaacatctcaaagaagcaacacggccgtcttggcagatccttctctgcgagttttcaccaggactcggcctggaaaaaaatgagctctatccacgagagacgtaactccggttaccagggatatagcgattacgatggcaacgactag

SEQ ID NO: 27431 - DNA, 813 bp, Artificial Sequence
  Description of Artificial Sequence: Synthetic coding sequence
atggaagccgaagagctggagcaagaaagagagcagttgcgtctgcagctttgggaagcctactgccaggtccggtatctgtgctctcacctcagaggcaacgacagtgcagactcggccgtttccaccgattccagtatggatgaatcctccgagacttcaagtgcgaaagatgtgcccgcaggctctctgcgcacggctctgaacgaacttaagagactgatccagtccatcgtggacgggatggagccaactggaagccgacggctggatgacgattccttggaggaacagatacgacagactagcgaggatagccgggcactccgcgagctgatggagggggaaaggggaaagctgaggcagagtctggaagaacttcagagactgcactcccaggtgacactcctttctgtcgagatgactgcattaaaggaagagcgtgaccgcttaagggtgacgagcgaggataaagaacctaaagaacagctccagaaggcaattcgcgatagagatgaagccatcgccaagaagaatgctgtggagctagagttagctaaatgcagaatggacatgatgtccctgaactctcagctcctcgacgcgatacagcaaaaactgaacctgtctcaacaattggaggcttggcaggatgacatgcaccgagtgatcgaccgtcagctcatggatactcacctgaaggagagaagccagcccgcagcggctttgtgtcgtggacactccgcaggcaggggggatgagcccagtatcgcagaaggcaaacggttattctcgttttttaggaaaatctag

SEQ ID NO: 27432 - DNA, 2379 bp, Artificial Sequence
  Description of Artificial Sequence: Synthetic coding sequence
atgctgcccgctggcgaaatcggggctagccctgccgctccctgttgttctgagagtggtgacgaacgaaagaacctggaagaaaagagcgacattaatgtgaccgtcctgattggttctaaacaggtgtcggagggcactgataacggagacttgccatcatacgtttccgcatttatcgagaaagaggtgggcaacgacctgaaatccctgaaaaagctagacaagctgatcgaacagcgcaccgtatccaagatgcagttggaggagcaggtactgaccatctcaagtgagatccctaaacgaatccggagcgcccttaaaaacgccgaggaatccaagcaatttctgaaccagttcctcgaacaggaaactcatctgttcagtgcgatcaactcacatcttttgacagcacagccctggatggatgatctcgggacaatgatttcacagatcgaagagattgagaggcatttagcgtacctgaaatggataagtcaaatcgaagagctcagcgacaacatccagcaatacctgatgacgaataacgtccctgaggcagcctcaaccctagtgtcaatggcagagctcgacatcaagttacaggaaagttcatgtacacacctacttggattcatgagagcaactgtgaaattctggcacaaaatactcaaggataaattgacttcagattttgaagaaatcctagcccagctccactggccatttattgcccctccacagagtcagaccgtggggctgtccagacccgcaagcgcccctgagatctactcatatttggaaactctcttctgtcagttgctaaaactccagacaagtgatgaactgttgaccgagcctaagcagctccccgagaagtatagcctccccgctagcccaagcgtgattttgccaattcaggtaatgttgacacctctccaaaaacgatttcggtaccattttcggggaaacagacagactaatgttttaagtaaacccgagtggtatctggctcaggtgctcatgtggatcggaaaccataccgaatttcttgacgagaagatccagcccattctcgacaaggtggggtcccttgtcaatgcacgcctggagttctcacgcggactgatgatgctcgtgttggagaagctagctactgacattccatgccttctctacgacgacaatcttttctgtcacctcgtggacgaggtgttgttattcgaaagagaacttcatagcgttcacggttatccaggcactttcgcatcttgtatgcacattctgtccgaggagacatgcttccaacggtggctaacagttgagcgcaagtttgctctgcagaagatggattccatgctgtcctcggaggctgcatgggtgtctcagtacaaggacattaccgacgtggacgagatgaaggtgcctgactgtgcggaaacattcatgactctactgcttgtcatcactgacagatataagaacctgcccaccgccagtaggaagttacagtttcttgaattacagaaggacctggtggatgattttcggattcgcctgacccaagtgatgaaggaggagacaagggcgagcttgggattccggtactgcgccatacttaacgcagtcaattatatctccaccgtcctggctgactgggccgataacgtcttctttctgcaacttcagcaggccgcattagaagtgtttgcagagaataataccttgagcaaactgcagcttggtcagttagcatcgatggagagctccgtttttgatgatatgattaacctgctggaacgcctgaaacacgatatgctgacacggcaggtggaccacgtcttccgcgaggtcaaggatgccgctaagctatacaagaaggagaggtggttaagcttgccttcacagagcgagcaggccgtgatgtcccttagcagttctgcctgccctttactgctgaccctccgcgaccatcttctgcaattagaacagcagctgtgtttcagcctgttcaaaatattttggcagatgctggtggagaagcttgacgtctacatctaccaggagatcatcttagcaaatcatttcaatgaaggaggggcagcgcagttgcaatttgatatgacccgcaacttgttccccctcttcagccactattgcaagcggccagagaattactttaagcacatcaaagaggcctgcattgtgctcaacctcaatgtagggtcggctctgctactgaaagacgtgttacagtctgctagtggccagctgcctgccacagcggctctgaacgaggttgggatttacaagctggcgcagcaggacgtggaaatcttgttgaacttaagaacaaattggccaaacacaggcaagtag

SEQ ID NO: 27433 - DNA, 1068 bp, Artificial Sequence
  Description of Artificial Sequence: Synthetic coding sequence
gtgagaggcgttagggctgctaccgctgctgccgtcgcagccacagctgcttcagggctaagccgcagagaggcaggcggacgggctggagcagctgccgctgtcgtaaggccacctgggagaaagtgtggcagatgccggaggctcgccaattttcccggacgaaagcggaggcgacgtagaaggaagggattgggagccactaccggaggttgtggagaagccgtctcgtctctccacccagcccctcacagccctagctccgtcagacctgccggaaggcgtgcgagaaggcaacgccgaggggcaggcagtgctgagcggccaatgtcaggggcaggggaagctctggcccctgggccagtcggcccacaaagagtggcagaagcagggggaggacaactgggctccaccgcacagggaaagtgtgataaagataacacggagaaagacataacccaggccaccaatagtcacttcacacacggagaaatgcaggatcaatcgatctggggcaatccctctgatggtgaactcatcagaactcagccgcagagactgccacagttacagacctctgcgcaggtcccctcgggcgaggaaataggcaaaataaaaaatggtcatacgggactgtccaacggcaacggcattcaccacggcgctaaacacggaagcgctgacaatcgcaagctgagcgcacctgtctcccaaaaaatgcatagaaaaatccagtcttccctgtccgtgaactctgacatcagcaaaaaaagtaaagtgaacgctgtgttttctcaaaagactggtagctcccctgaagattgttgcgtccactgcatcctcgcctgccttttttgtgaattcctgaccctttgtaatatagtgttgggacaagcaagctgcgggatttgcacatccgaggcttgttgttgctgctgtggggatgagatgggggacgactgcaactgcccgtgtgacatggactgtggtatcatggatgcctgctgcgaatcgagtgattgcctggaaatttgtatggaatgctgcggcatttgcttccctagctag

SEQ ID NO: 27434 - DNA, 378 bp, Artificial Sequence
  Description of Artificial Sequence: Synthetic coding sequence
atgctgtctagactgttaaaagaacaccaggccaaacaaaatgagcggaaggaactgcaggagaaaagaagacgcgaggccataaccgccgcaacatgtctgaccgaggccttagtggaccacctcaacgttggagtcgcccaggcttacatgaatcaacgcaaactcgatcatgaagtgaaaacactgcaggtccaggctgcgcagttcgcaaagcagactggacaatggattggcatggttgaaaattttaatcaagcgttaaaggagattggggacgtggagaattgggctcggagtatcgagctagacatgcgtaccattgcaaccgcccttgaatacgtctacaagggccagctgcagagcgcaccatcttag

SEQ ID NO: 27435 - DNA, 2337 bp, Artificial Sequence
  Description of Artificial Sequence: Synthetic coding sequence
atgacaacaagacaggccacgaaagacccactgctgcgcggagtgagccccactcccagtaagattccagtccgctcccaaaaacgaacgcccttccctactgttacgtcctgcgccgtcgatcaggagaatcaggatccaaggagatgggtccaaaaaccccctctgaacattcaaagaccactggtcgatagtgccggtcccagacccaaagcccgtcatcaggccgaaacctcccaaagactagtggggatatcacagcccaggaaccctctcgaagaactacgtccatccccgagggggcaaaacgtgggacctgggcctcccgcacagaccgaggccccagggacaattgagtttgtggcagatccagccgctctggctacgatcctgagcggcgaaggcgtgaaatcgtgccacctgggcaggcagccttcacttgccaagagagtgcttgtcaggggctcacagggagggactactcagcgtgtgcagggggtgcgcgcaagtgcttacttagcgcctcgtacaccaacacatcggcttgacccagcaagggcttcttgtttttcacggctggaggggccaggtccaagggggaggaccctatgccctcagcgattgcaggccctcatttctccctctggaccctcattccaccccagcactaggccttcttttcaggagctgcggcgagagacggccggtagtagcagaacgtctgtgagtcaggcctccggcctgctcttggagactcccgtgcagccggctttttcattgcctaaaggagagagggaggtcgttacccattcagatgagggtggagtcgcttctctggggctggcacagagagttcctctgcgggaaaacagagagatgtcccatacaagggacagtcatgactcccacctgatgcctagtcctgctcctgttgctcagcccttacccggacacgtggtgccttgtccgagcccctttgggagagctcaaagggtgcccagtccgggtccgcctacgctcacatcttattctgtgttgagaaggctaactgttcagccaaagacccggttcacacccatgcctagcactcctcgcgtgcaacaagcgcaatggttacggggagtcagcccgcagagttgttccgaggatccagccctcccctgggagcaagttgcagtcaggctgtttgaccaagagtcctgtatccgcagcctggaggggtccggcaagccacccgtcgcgacgcccagtggtccgcactccaacagaaccccttcgctgcaggaagtcaagatccagcgcatcggaatactgcagcaactactgcggcaggaagttgaggggctcgtcggaggtcagtgcgtacctctgaatggaggcagtagcctggatatggtggagttacagccgttgctgacagaaatctcgagaacactgaatgctaccgagcacaatagcggtacctcccacctgccaggcctcctgaagcatagcgggctgccaaagccctgtctacctgaggaatgtggcgaaccacagccttgcccccctgctgagcctggtcctccagaagcgttctgccggtctgaaccagagatccctgaaccgagcttgcaagagcagctcgaggttccagagccctaccctcctgctgagcccagaccccttgaatcctgttgtagatccgaacctgaaattcccgagtccagcaggcaagaacagctagaagtaccagagccgtgtccaccagccgagcctagacccctcgaatcatactgtaggatcgagccagagattccggaaagcagccgtcaggagcagctggaagtgcccgagccctgccctccagctgagcccggacccctccagcctagtactcagggtcagagtggccctccgggaccttgcccccgagtcgagcttggagcctccgagccatgcactctggagcacaggtccttggagagtagcctgcctccatgttgttcccagtgggcccctgccactacctccctgatattctccagccaacatcccctgtgtgcttctcctcccatctgcagcttgcagtcactgcgcccaccggcagggcaggcaggcctctctaatctcgcaccacggacactcgccttacgggagagactgaagagctgtctgaccgctatccactgtttccacgaggccagattagatgacgaatgcgcgttttatacttcacgagctccacccagcgggcctactcgggtctgcaccaatcccgtcgccaccctgctggaatggcaagatgccctttgttttataccagttggttcagctgccccacagggaagcccctag

SEQ ID NO: 27436 - DNA, 1803 bp, Artificial Sequence
  Description of Artificial Sequence: Synthetic coding sequence
atgagctgccgcagttatcgagtttcttctggacacagggtcggtaacttctctagttgctctgcgatgaccccccaaaacctcaacagattccgcgcaaacagtgtttcatgttggagcggtcctggattcagggggctgggaagttttggttctcgaagcgtcataacgttcgggagctacagcccaagaatcgccgcagtggggtctaggcctatccactgcggtgttaggtttggcgcagggtgcggaatgggcttcggtgacggtcgcggtgtaggtctgggccctagggccgactcctgtgtgggtctgggatttggagccggttcaggcataggttacggatttgggggacctggatttggataccgagtaggcggtgtgggagtgcccgctgccccttctataaccgcagtgactgtgaacaagtccctgctgactcctcttaatctcgaaattgatcccaacgcacaacgagtgaagaaagacgagaaggagcagataaagactcttaacaataagttcgcttctttcattgataaggtgcgcttcctggagcagcagaataaactgcttgaaacaaagtggtccttccttcaggagcagaagtgtatacgaagtaatctcgaacccctgtttgagagttacattactaacttgagacgccagctggaggttctggtctcggatcaggccaggctccaggcggagcgaaatcacttgcaagacgtgttggagggatttaaaaaaaagtacgaggaggaagtggtctgccgggcaaacgcggagaatgagtttgtcgcgctgaagaaagacgttgatgcagcctttatgaacaagagcgatctcgaggctaatgttgacaccctgacacaggagatagacttcttgaaaacattatacatggaggagatccagctgttacaatctcacatttctgagacttcggtgatcgtgaagatggataactcccgagatctgaatctggatggaatcatagccgaggttaaggcacagtacgaggaagtcgcgaggcgctctcgtgcagacgcggaagcttggtaccaaaccaaatacgaagaaatgcaagtaactgccggtcagcactgcgataatctcagaaacatccgcaacgaaataaatgagctcactagattaatccagcgtctcaaggcagaaatcgaacatgcaaaggctcaacgagcaaaattggaggcggcagttgctgaagcagagcagcagggggaggctaccttatctgacgctaagtgtaagcttgccgacctggaatgcgcactccagcaagccaagcaagacatggccaggcagctctgcgaatatcaagaactgatgaatgcgaagctggggctggacattgaaattgctacatacaggcgccttttagagggcgaggagagtcggctgtgcgaaggggtgggacctgtcaacattagtgtgagctcttctcgcggtggcctcgtgtgtgggcctgaaccactggtcgcagggtctacgttgagccggggtggtgtcactttcagcggaagttccagcgtctgcgccacctccggcgtcttagcctcctgcggaccttctttaggaggggcaagggttgctccagcaaccggtgatctcttatctactggaacacgctctgggtccatgttgataagtgaagcctgtgtgccgagtgtgccttgtcctctgcctacacagggtggattctctagctgttccggaggacgttcctcctcagtgagattcgttagcaccaccacatcctgccgaactaagtattag

SEQ ID NO: 27437 - DNA, 1542 bp, Artificial Sequence
  Description of Artificial Sequence: Synthetic coding sequence
atgagctaccactcatttcagccagggagcagatgtggaagtcagtctttttcctcctacagcgctgttatgcctagaatggtaacccactatgctgtgagcaaggggccttgcaggcctggcggtggcaggggactccgcgctcttgggtgcctgggtagtagatctctatgcaacgtggggttcggacgtccccgagtagcttcccggtgcgggggaactctgcccggatttggttatagattgggcgcaacatgtggccctagcgcatgtattacaccagtgacgatcaatgaaagtctcctggtccctcttgcattagagattgatcctaccgtgcaaagggtgaagcgggacgagaaagaacagattaaatgcctcaacaaccgctttgcatctttcattaataaggtgagatttctggagcaaaaaaataagctgctggaaaccaagtggaatttcatgcagcagcagagatgttgtcagactaacatcgaaccaattttcgaaggctatataagtgccttgcggcgtcaactagattgtgttagcggcgatagagttagactcgagtctgaactctgcagccttcaggcagctctggaagggtataagaaaaagtatgaggaggagttaagtctgaggccttgtgtggagaacgagttcgttgcactaaagaaagatgtcgacacagcctttttaatgaaagccgatctcgagaccaacgcagaagcgctggtccaggaaatcgattttctgaagtctctctatgaagaggagatttgtttgctacagagccagatctctgaaacctctgtaattgtgaagatggataactcacgtgagcttgacgtggacggcatcatcgctgaaatcaaggcgcagtatgacgacatagcctcacgcagtaaagccgaggcagaggcctggtatcagtgcagatatgaagagctgagagttactgcagggaatcactgcgataacctgagaaacaggaagaatgaaattctggagatgaataagctgattcaacgacttcagcaggaaaccgagaatgtgaaagctcagaggtgcaaactagagggcgcaattgccgaagccgaacaacagggggaggccgctctgaacgacgcaaaatgtaagctcgcaggactcgaggaggccctgcagaaggctaagcaggatatggcttgtctgctgaaagaataccaggaggtcatgaactcaaagctgggcctggatatagagatcgccacttatagacgacttttagagggggaagaacacaggctgtgtgaggggattggtcccgtgaatattagcgtgtcctctagtaagggagcctttctctacgaaccatgcggtgtgtccacacctgtgctttcaacaggggttttacgcagtaacggcggttgttcaatcgtgggcaccggtgagctgtatgtgccatgtgagcctcagggcctgctgagttgtgggtcagggaggaagtctagcatgacccttggtgcaggtggaagctccccctctcacaaacattag

SEQ ID NO: 27438 - DNA, 1632 bp, Artificial Sequence
  Description of Artificial Sequence: Synthetic coding sequence
atgatgccgaccccggtgatcttgctaaaggagggaacggattcctctcagggcataccccagctagtgagtaatatatccgcctgtcaggtcatcgccgaagctgttagaacaaccctaggcccacggggaatggacaaacttatagttgacggcagagggaaggcaaccatctccaacgatggggctacaatcctcaaattactggacgtggtccatcccgcagcaaagactctggttgatattgccaagagccaggacgccgaggttggcgatggtaccactagcgtcaccctgctcgccgctgaattcttaaaacaggtgaagccctacgtagaggagggactgcacccacaaattataatccgggcatttaggactgctacccaactggcagttaacaagatcaaagaaatcgctgttaccgtcaagaaggccgataaagtggagcagaggaagctgctggagaagtgtgctatgaccgccttatcatcaaagctgatttcccagcaaaaggctttctttgctaagatggtggtcgacgccgtgatgatgctcgatgatctgctacaacttaaaatgatcgggattaagaaggttcaaggaggggcacttgaagactcacagttggtggccggagtcgccttcaaaaaaacattctcctatgcgggtttcgagatgcagcccaaaaagtatcataacccgaagatcgccttactgaacgttgagctggaactgaaggccgagaaggacaacgctgagatccgagtacacacagtggaggactaccaagccattgtcgatgccgaatggaatattctctatgacaagcttgaaaagatacaccactcaggtgctaaagtcgtgctcagcaagctcccaatcggcgatgtcgcgacgcaatacttcgcagatcgggacatgttttgcgcaggtagagttcccgaagaggacctaaagaggactatgatggcctgtgggggatcaatccaaacaagcgtgaacgccctgtcagcagacgtgctgggccgatgtcaggtgttcgaggagacccagatcggaggagaaaggtacaattttttcactggctgccccaaagccaagacatgcactttcatccttaggggaggagcagaacagttcatggaagagacagaaaggagcctgcatgacgccataatgattgtccgccgagccatcaagaacgactctgtggtcgctggtggaggggcaatcgagatggaactctctaagtatctgagagactattcacggacaatacctggaaagcagcagctgctgataggggcatacgccaaggccttagagattattccgaggcagctgtgtgacaacgctggtttcgatgccacaaacatcctgaataaacttagagctcgacacgcccagggcggtacctggtacggggtggatattaataacgaagacatagcagataacttcgaagccttcgtatgggaacctgcgatggtgaggatcaacgctctcactgctgcaagcgaggcggcatgtctcatcgtgagcgtggacgaaaccataaagaaccctaggagtaccgtagatgctcctacagccgctggaagaggcagagggaggggcaggccccactag

SEQ ID NO: 27439 - DNA, 1479 bp, Artificial Sequence
  Description of Artificial Sequence: Synthetic coding sequence
atggcacctgtgggcgtggaaaagaaactactcctcggaccaaacggacccgcagttgcagcagccggagatctgacttccgaagaggaggagggccagagtttatggagttctatcctgtcagaggtctcgaccagagcacgatctaaacttcccagtggcaagaatattctggtgttcggagaagacggctcaggcaaaaccacactgatgaccaagcttcaaggggcagagcatggtaagaagggtcgcggactcgaatacctttacctgtccgtccatgacgaagacagggatgaccatacgagatgcaacgtttggatcctggacggagatttgtatcacaagggcctattgaagtttgccgtgagcgcagaaagtttgcccgagactctggtaatttttgtggcagatatgtcccggccttggacagtcatggagtcccttcagaagtgggcctccgtgctgcgggaacacatagataagatgaaaattccccctgagaagatgcgggaactggagaggaaattcgttaaagacttccaggactacatggaacccgaagaagggtgtcaggggtcgccccagcgccgaggtcctctgacctcaggaagtgacgaagagaatgttgcccttcccctcggggataacgtccttacccataacttgggcatcccggtcttggtggtatgcactaagtgcgatgctgtgagcgtgcttgaaaaagagcatgattatcgcgacgaacatcttgatttcattcagagccatctgagacggttctgtctacagtatggagctgcactgatctatacctccgtcaaggaggagaagaacctggacctactctataagtacatcgtgcacaagacctatgggttccatttcaccactcccgctttggtggtcgaaaaggacgcggtgttcatcccagctgggtgggacaacgaaaaaaagatcgcgatattgcatgagaacttcaccaccgtgaagcctgaggatgcctacgaggattttattgtgaagcctcctgtgcggaaactggtgcatgacaaagagttggcagcagaagatgaacaggtcttcctgatgaaacagcagagcctcctcgccaagcaaccggctacaccaacgcgagctagcgagtccccagcacgaggtcctagcgggtctcccagaacccagggaaggggcggacctgcaagtgtgcctagttcatctcccggaacgtctgtgaagaaaccagatcctaacattaaaaacaacgccgcatcagagggtgtgcttgcatccttttttaattcattactatccaaaaaaacagggtcccccggaagtcctggagctggcggagtgcagtccaccgcgaagaagagcgggcagaagactgtgctatcgaacgtgcaggaggaactggaccgcatgacccgtaaaccagactccatggtgacaaacagtagcaccgaaaatgaggcgtag

SEQ ID NO: 27440 - DNA, 540 bp, Artificial Sequence
  Description of Artificial Sequence: Synthetic coding sequence
atggataaggacttcgacaaactgcacgagtttgtcgagatcatgaaagagatgcaaaaagatatggatgaaaaaatggacatcctcatcaacactcagaagaattacaaactgccactgcggcgagctcccaaggagcaacaagagctgcgcctgatgggcaaaactcacagggaacctcagctcagaccaaaaaagatggatggcgcatcgggcgtgaatggggcaccatgcgccctgcataaaaagacaatggccccacagaaaacaaaacaggggagtctggatccactccaccactgcggcacatgctgcgagaaatgtctgctctgcgccctcaaaaataattataacagggcagcacccctcaaagaggcccgtcatctgttaacagccaacagtatcgatccaagcgccgctttagtgctattgattgaatttcttctcttgactctggttacaggcgcagcagcaccaggcctggacgcttgcggccaccagcgcaacatgagagatgaaatcaactccgaacgcaggtag

SEQ ID NO: 27441 - DNA, 3600 bp, Artificial Sequence
  Description of Artificial Sequence: Synthetic coding sequence
atggcctccgccggaacacagcattactcaattggcttgaggcagaagaattctttcaaacaaagcggtccaagcggaaccgttccagccacgccacctgagaagccgtctgaagggcgagtatggccccaggcgcatcagcaagtgaagcctatttggaaactagaaaaaaagcaggtggagacactctccgctggtctgggtccgggactccttggtgtcccgccacagcccgcttactttttctgtcccagtaccctgtgctcatctgggaccaccgctgtgattgcaggacatagttcttcttgctatctgcatagtctgcctgatctgttcaactcaacactcctgtaccggaggtcaagctacaggcagaagccgtatcagcagctggaatcattttgtctccgatcctccccttccgaaaaatctcccttcagcctgcctcagaaatcactgcccgtgagccttaccgccaacaaagctacatcatcaatggtgttcagcatggcccagcccatggcctcgagctcaacagagccgtacctgtgtctggcagccgctggcgaaaacccaagcgggaagagcctagcatcagctatctctggtaaaataccatctcccctctcaagcagctataaacctatgctgaataataattcattcatgtggccaaattctactcctgtgcccctgctgcaaaccactcagggtcttaaacctgtttcaccacccaaaatccagcctgtgtcttggcaccacagtggtgggactggggattgtgctccccagcccgtggatcacaaggttcccaaaagcatcggtacagtgcccgctgacgcttccgcacacatagctcttagcacggcatcgtcccacgatacgagcacaaccagcgtggcatcctcttggtacaaccggaataacctcgcaatgcgggcagagcccctcagctgtgccctcgatgactccagcgacagtcaggatccgacaaaggaaatacggtttacagaagccgtacgcaagctaactgccagaggcttcgagaagatgccccgtcaggggtgccagctagagcagtcctctttcctcaatccaagcttccagtggaacgtcctgaatcggagccgccgttggaaaccccctgctgtaaaccaacaattcccacaggaggacgcgggttctgtgaggcgggtgttacccggagcgagcgatacccttggcctggacaacaccgtgttctgtactaaacggatcagtatacatctgttggcctctcatgcttccggtctcaaccacaatcctgcttgtgagtcagtgatagattcaagcgcattcggtgagggaaaagcccctggccctcccttcccccagactctcggcattgcaaacgtcgccacccggctcagtagcatccagctgggacaatccgagaaagaaaggcccgaggaggcaagagaattggactccagcgaccgggatatttcttccgccaccgacctccaaccagaccaggccgagacagaggatacggaggaggaactggtggatggtcttgaggactgttgttcccgggacgaaaatgaagaggaagaaggggactcagagtgttcatctctgtcagcagtttctccaagcgaaagcgtcgcgatgattagcagatcctgtatggaaatcctcaccaagcctttgtccaatcacgaaaaagtcgtcaggcccgcattgatatactccttgttccctaatgtacctccgaccatctactttggaacgagagacgaacgggtggagaaactcccatgggaacagaggaagctacttcgctggaagatgagcactgtgactcctaacattgttaagcagacaattggtagatctcattttaaaattagcaaaaggaatgacgattggctgggttgttggggacatcacatgaagtcaccatcctttagatccatccgagagcatcagaagctcaatcatttccctggtagctttcagatcggtagaaaagaccgcctgtggcggaatctgtcaaggatgcaaagcaggtttgggaagaaggaattctcattttttccgcagagtttcattctgcctcaagacgctaaactgctgcgtaaagcatgggagagctcctccagacagaagtggattgtgaagccacccgcatctgctcggggtatcgggattcaagtgattcacaaatggagccagttaccaaaacgccgacccctgttggtgcagcgctaccttcacaaaccatacctgattagtggtagtaaattcgacctgaggatttatgtgtacgtgacaagttatgaccctctacgcatatacctcttttctgacggactggtgcggttcgcatcatgcaaatattcccctagcatgaagtctctggggaataaatttatgcatttgactaattatagcgttaataagaagaatgctgagtatcaggccaacgctgatgaaatggcctgtcagggacataagtgggcactaaaggcgctctggaactacttatctcagaaaggagtcaactctgatgcgatctgggagaaaatcaaggacgtcgtggtgaagactatcatctctagcgagccatacgtgacctctctgctgaagatgtatgtccgtagaccctacagttgtcacgaactcttcggttttgatatcatgctggacgaaaacctgaagccttgggttttggaagtgaatatctccccctccctccactcttcctcgccattggatatttcaatcaaaggccagatgatccgggatctcctgaatttggcgggatttgttcttcccaatgcagaagatatcatttcctcaccatcaagttgttcttcatctacaacatctctgcccactagcccaggggataaatgtagaatggcaccggaacatgtgactgcacagaagatgaaaaaagcgtattatctcacacagaagatacccgaccaggacttctatgcaagcgtactggatgtcctcactcccgacgacgtgaggatcctggtggagatggaagacgagttttccaggagaggtcagttcgagcggatattcccttcccacatctcttcccgatacctgagattcttcgagcagccgcgttattttaacattctgaccacgcaatgggagcagaaatatcacgggaataagctgaaaggagttgatcttctgagatcctggtgttacaagggattccacatgggcgtcgtgtcagattcagcccctgtctggagcttacccacttcattgctgactatctcaaaggatgacgtgattcttaatgcgttttcgaaatcagaaacctctaaacttggcaaacagtccagctgcgaggtttctctcctgctcagtgaagacggcacaacccccaagagtaagaagacccaggccggactgtcaccctatccccaaaagccaagcagcagcaaagattcagaggatacctccaaagaaccaagtctatctacccagaccctccccgtaataaaatgtagcggacagaccagcagacttagtgctagtagcacatttcaatcaatctccgactcccttctggcagtctcaccctag

SEQ ID NO: 27442 - DNA, 2772 bp, Artificial Sequence
  Description of Artificial Sequence: Synthetic coding sequence
atgctgagaaggggttcccaagctctcagacgattcagtactggcagggtctacttcaaaaacaaacttaaactggccttgatcggacagtcccttttcggacaggaggtgtattctcacctgaggaaagagggccatcgtgtagttggcgtgtttaccgtgccggataaagatggaaaggccgaccctctagcccttgccgcagagaaagatggcacacctgtattcaaactgcccaagtggcgtgtgaaaggaaaaacgatcaaggaggtggcagaggcttatcggtctgtgggggctgaactcaacgtcctgccattctgcacacagtttattcccatggatatcatagacagcccaaagcacggcagcatcatttaccatccctccatactgccaagacaccggggagcaagtgcaatcaactggacattaattatgggagacaagaaggcagggttttcagtattttgggcggatgacggacttgacacgggcccaatcctcctgcagcgttcttgtgatgtagaacctaatgatactgtcgacgccctctataacagattcctgtttcccgaggggatcaaggccatggtcgaagctgtgcagctgatcgcagatggcaaggccccacgcatcccccaacctgaggagggcgcaacttatgagggcattcaaaagaaagagaatgcagagatcagctgggatcagagcgcagaagtattgcataattggattagagggcacgataaggtcccgggagcatggaccgagatcaacggacagatggtcacattttacgggagtacactcctgaacagtagcgtcccacccggagagccgctggaaattaaaggggctaagaaaccgggtctcgtaactaagaacggtttagtcttattcggcaatgatggcaaagccctgacggtgaggaatctccagttcgaagatggtaagatgatcccagcatctcaatatttttctaccggggagactagcgtcgtggagctcacagctgaggaggtgaaagtagccgaaactattaaggtcatctgggctggcatcctatccaatgtcccaattatagaagactctaccgatttcttcaaatctggcgcaagtagcatggacgtggccaggctcgttgaagaaataaggcagaaatgcggtggcctgcagcttcagaatgaggatgtctacatggccactaagtttgaagggtttatacagaaagtagttcgcaaactgaggggagaggaccaggaagtggagcttgtggtggactacatttctaaggaagtcaacgagatcatggtgaaaatgccatatcagtgttttatcaatggtcagtttactgacgcagacgatgggaaaacctacgacaccatcaaccccactgatggttcaactatctgcaaggttagttacgccagtctcgctgatgttgataaagctgtcgctgctgccaaggacgcctttgagaacggagagtgggggcgaatgaatgccagagaaagaggcaggttgatgtaccgactagcagatctgctggaggagaatcaagaggagctcgcaacaatagaggccctcgacagtggagccgtgtacacactggccctgaagacgcacataggcatgagtgtgcaaacctttcgctattttgctggttggtgtgataagatccaggggagcaccattcccattaaccaggctagacctaacagaaatctgactttcactaagaaagagccactcggtgtttgtgccatcattatcccttggaattaccccctcatgatgttggcttggaagagtgcagcttgcctggccgcaggcaacacccttgtgttgaagccagctcaggtcacacccctgacggcactcaaattcgccgagctctcagtcaaggcagggttcccaaaaggggtgatcaacatcattcctggtagtggcggaatcgcgggacagcggctgtctgagcatcccgatatccggaagttgggcttcaccgggagtacaccaatagggaaacagataatgaaatcatgcgctgtttccaatctgaaaaaagtcagcctagagttaggcggaaaaagtccactcattatttttaacgattgtgaactcgataaggccgtgagaatgggcatgggagccgtctttttcaacaaaggcgaaaattgcatagccgcagggagactgttcgtcgaggagtctatacacgacgagtttgtgactcgcgtcgtggaagaaattaaaaagatgaaaattggggatcctttagaccgttccaccgatcatggacctcagaaccataaggctcatctcgagaagctgttgcagtattgtgagactggagtgaaagagggggcaacgctggtctatggaggaagacaagtccaacgaccaggtttcttcatggagcccacagtgtttactgacgtggaggattacatgtaccttgctaaggaggaaagcttcggacccatcatggtgatttctaaattccaaaacggtgacattgacggagtgctgcagcgggctaacagtacagagtacgggctggcatctggcgtttttactcgcgatatcaacaaggccatgtacgtcagtgagaagttagaagcaggaactgtttttataaatacttacaataaaaccgacgttgccgcacccttcgggggagttaagcagtctgggtttgggaaagaccttggagaggaagcactgaacgaatacctgaaaaccaaaactgttaccttggaatattag

SEQ ID NO: 27443 - DNA, 1323 bp, Artificial Sequence
  Description of Artificial Sequence: Synthetic coding sequence
atggagggcgtgctgtacaaatggactaactacctctctgggtggcagccacgttggtttcttctgtgtggtgggatccttagttattatgattcccccgaggacgcctggaaaggatgtaaaggctcgattcagatggcagtttgtgaaatccaagtccactccgtggacaacacacggatggatctgatcatacctggggaacagtatttctacctgaaggctagaagcgtcgcggaaagacaaaggtggctcgtggcactgggatccgcaaaagcctgcctcaccgattcgcgaacccagaaggagaaagaattcgccgaaaatacagaaaatctgaaaaccaaaatgtccgagctaaggttgtactgcgatctgctggtccagcaggtagacaagaccaaggaagtgaccaccaccggggtgtctaattccgaggaaggcatagatgtgggcacacttctgaaatcaacctgcaacacattccttaagacccttgaagagtgtatgcagattgcaaacgccgcttttacgtccgaacttctgtatcgtacaccgccaggctcaccacagctggctatgctgaagagctctaaaatgaagcacccaatcattccgatccacaactctttggagcgacagatggagttgtccacttgtgaaaacggcagcctcaacatggaaattaacggagaagaagaaattctcatgaaaaataaaaacagcttatacctaaagtccgccgaaattgattgtagtatttcttccgaggagaatactgatgataacatcactgtgcagggggaaatccgcaaagaggacggcatggagaatttaaagaatcacgataacaatttaacgcagtcaggatccgactcctcttgttccccagagtgcctgtgggaagagggtaaagaggtcatcccaactttcttttcaactatgaacacatcattcagcgacatcgagttgctggaggactcaggaattcctacagaggccttcttggcaagctgctatgcggtggtgcccgtcctggacaagctgggcccaaccgtcttcgctcctgtgaagatggacctcgtgggcaatatcaaaaaagtgaaccagaagtatatcacaaataaggaggagtttactactctacagaagatcgtactgcacgaagttgaggctgatgtggcccaggtgagaaatagtgcgacagaggcactgctatggctcaagcgtgggctgaaatttctgaaaggatttctgactgaggtaaagaacggagaaaaggatatacagacggctctgagaaatcccacggagaacacatag

SEQ ID NO: 27444 - DNA, 1272 bp, Artificial Sequence
  Description of Artificial Sequence: Synthetic coding sequence
atggccatttgccagttctttttgcagggccgttgtcgattcggggacagatgctggaacgaacatcccggtgcccgtggcgctgggggtgggaggcagcagccgcagcagcagccaagcggtaataaccgaagaggctggaatactactagccagagatacagcaacgtgattcaaccaagtagtttcagcaaatccaccccgtggggcggatcgcgggatcaggaaaagccatacttttctagcttcgactcaggggcttcaacaaatcgcaaagagggcttcggattaagtgagaatccctttgcatccctatcccctgacgaacagaaagatgaaaagaagctgttggaaggcatcgtgaaagatatggaggtatgggagtcctccggccagtggatgttctccgtatatagcccagttaagaagaaaccaaacatttccggattcaccgacatatctccggaagaattgaggttggagtaccataactttctgacttctaataacttgcagtcctatctgaactctgttcagcgactcattaaccagtggaggaatcgtgtcaacgagctgaagtctctaaacatctccacgaaagtggccctgttgagcgatgtgaaagacggcgtgaaccaggcagcacctgctttcggcttcggttccagccaggctgctacatttatgtcccccggattccctgttaataatagtagtagcgacaatgcgcagaatttcagtttcaagaccaactctggatttgccgctgcgagtagtggcagcccagcaggctttggctcatccccggcattcggcgcagccgcatcaacctcttcaggaatctccacaagtgcccctgctttcggttttggaaaacctgaggtgacatctgcagcctcttttagtttcaaaagccctgctgcttccagtttcgggtcacccggattcagtgggctccccgcatcactagccaccgggccagtgcgcgctcctgtggcacctgcttttgggggtgggagcagcgttgctggtttcgggtctcctggatcccacagtcataccgcattctctaagcctagctctgacacattcggcaactcatccataagcactagcctgtccgcaagctccagcatcattgccactgataacgtgctctttacaccccgagataagctgacagttgaagagctcgaacagttccagtccaagaaatttacgttgggcaaaatccctctcaagccccctcccctggagctccttaacgtgtag

SEQ ID NO: 27445 - DNA, 1323 bp, Artificial Sequence
  Description of Artificial Sequence: Synthetic coding sequence
atgatggctgacgaagaggaggaagttaaacccatccttcagaagctgcaggagcttgtcgaccagttatattccttccgggactgttacttcgaaacgcattctgtcgaggacgcagggcgtaagcagcaggatgttcagaaggagatggaaaagaccctacagcagatggaagaggtcgttggatcggttcaaggcaaagctcaggttctgatgttgaccgggaaggccctgaacgtaactcctgactacagtccaaaagccgaggaacttctgtcaaaggcggtgaaactggagcccgaactggtggaggcctggaaccagctcggcgaggtctattggaagaaaggagatgtggccgcagctcacacgtgcttttcaggggctttgactcattgtagaaataaagtgagtttacagaacctgagtatggtgctgcggcagctccgtaccgacaccgaagacgaacattctcaccacgtgatggattccgtgcgtcaggcaaagttggctgtgcagatggacgtccacgatggaagaagctggtatattctcggtaatagttatttgtctctgtatttctccactggtcaaaatcctaaaatttcccagcaagccctctccgcgtacgcacaggctgagaaagtggaccggaaggccagctcaaatccagaccttcatctcaaccgcgcaacactgcataaatacgaggaatcatacggtgaagcattagaaggctttagccgagccgctgcactcgacccagcatggccagaaccacggcagcgggaacagcagctgctcgagtttcttgatagactgacttccctactggaaagtaaaggcaaggtgaaaacaaagaagctgcagtcgatgctgggctcccttaggcccgcacacctaggcccttgctccgatggtcattatcagagcgcatccggccagaaagtcaccctggagcttaagcctttgtcaaccctccagcctggcgtgaactccggcgctgtaatcctcggaaaagtggttttctccttaaccactgaggagaaggtgcctttcacattcgggctcgtggattccgacggaccatgttatgccgtaatggtgtacaacatcgtgcagtcctggggcgtattaataggggattcagtggcaatccctgaaccaaacctgaggctacaccgcattcagcacaagggcaaggattactcgttcagcagcgtgcgggtagaaaccccattgctacttgtagtcaacggcaaacctcaggggtcatcctcgcaggctgttgccaccgtggccagcagacctcaatgcgagtag

SEQ ID NO: 27446 - DNA, 1341 bp, Artificial Sequence
  Description of Artificial Sequence: Synthetic coding sequence
atggaggagacgataaaagaccctcctaccagtgcggtgctgcttgatcactgtcactttagtcaggttatcttcaactccgttgagaagttctatattcccggaggagacgttacctgccactatacatttacgcaacatttcattcctagacgaaaagactggatcggcatattcagggttggttggaagacgacgcgcgagtattacacgtttatgtgggtcacactccccattgacctaaataacaagtccgccaagcaacaggaggtccagtttaaggcatactacctgcccaaggacgacgagtattaccagttctgttatgtggatgaagatggggtcgtgaggggtgcttccattccttttcagtttcgaccagagaatgaggaggacattctcgtggtgactacacagggcgaggtcgaagagatcgaacagcacaataaagaactgtgcaaggagaatcaggagctgaaggatagttgcatcagcctgcaaaaacagaactccgatatgcaagctgagcttcagaaaaaacaggaggagctggagaccctgcaatccataaacaagaagctcgagctgaaagtgaaggagcagaaagactactgggagacagagctgcttcagctgaaggaacaaaatcagaagatgtctagcgaaaatgaaaaaatgggtatcagagtcgatcaacttcaagctcagctaagtacacaggagaaagaaatggagaagctggtgcagggcgaccaggataaaacagaacagttggagcaactgaaaaaggagaacgaccacctcttcctatccctgaccgagcagaggaaagaccaaaaaaaactcgaacagaccgttgaacagatgaagcagaacgaaaccaccgcaatgaaaaagcagcaggaacttatggacgagaactttgatctttccaagcggctgagcgaaaatgagatcatctgcaatgcactgcagcgccagaaggagaggctggaaggcgaaaatgacctgctaaaacgtgagaatagcagactcctgtcttacatgggattggatttcaactcactgccctaccaggtccccacgtctgatgaaggaggggctaggcagaaccccggactggcctacggcaatccatatagcgggattcaggaatcatcaagtccgagcccactgagcataaaaaagtgccccatctgcaaggcagacgatatatgcgatcatacattggaacagcagcagatgcaaccactctgcttcaattgtcccatttgcgacaagattttcccagcaaccgagaaacaaatatttgaagaccacgtcttctgccatagcttgtag

SEQ ID NO: 27447 - DNA, 1329 bp, Artificial Sequence
  Description of Artificial Sequence: Synthetic coding sequence
atggctcttccaggtgcacgggcacggggatgggctgccgcagcacgcgcagctcagcgaaggcgcagggttgagaatgccggagggtcccctagtccagagcccgcaggcaggagggccgcactgtacgtgcattggccctattgtgagaagagatgttcctattgtaactttaacaagtacattcctaggcgactggaggaagctgccatgcagaagtgcctggtgacagaagcccagaccctgctgcgcttatctggcgtgcaacgagttgaatcagtgttttttggcggaggcaccccctccctggcgagcccccatacggttgcggcagtactggaagcggtggcacaggccgcacacttaccagcagatctcgaagtaactctggaggctaacccaacctccgcaccagggtccaggttggctgaatttggagccgcaggtgttaaccgcctgtccatagggctgcagtctttagatgacactgagctgcggctgttgggcaggactcacagcgcttgcgatgccttaaggacactcgccgaggccagaaggctttttcccggtcgcgtctcggttgatcttatgctagggctgcctgcacagcaggtgggcccatggctgggccagctccaagagttacttcaccactgtgacgaccacctttccctgtatcaactctctctggagcggggaaccgccctttttgcccaggtccagcgcggagcccttccagcaccagaccctgaactggccgcagaaatgtatcaacgaggccgagccgtcctgagagaagccggatttcaccagtatgaagtgagcaatttcgcacgcaacggagctctttcaacgcataactggacctactggcaatgcggacaatacctcggggtgggcccaggcgcacacggacgtttcatgccacaaggtgccggagggcacactcgggaggcccgtattcagacacttgaaccagacaattggatgaaggaggtgatgctgtttggccatggtaccaggaagcgagtgccactcgggaggctcgagctgcttgaggaggtgctggctttaggcctacgcaccgatgtgggaatcacgcaccagcattggcagcagtttgagcctcagcttacactgtgggacgtgttcggagctaacaaagaagtgcaggagctgctagaaaggggccttctacagcttgaccatagaggactgagatgttcctgggaagggctcgcagtcctggacagcttgcttttaacactgctcccacagcttcaggaagcctggcagcagcgaacacccagtcctgtgccgggtggatag

SEQ ID NO: 27448 - DNA, 1278 bp, Artificial Sequence
  Description of Artificial Sequence: Synthetic coding sequence
atggacaaaaatatcggggaacagctaaacaaagcttacgaggcattcaggcaggcatgcatggaccgcgactccgctgttaaagagttacagcagaagacagagaattatgagcagcgtataagggagcagcaggaacagctctcactccagcaaaccatcattgacaagctgaaatctcaactcctgctcgtgaacagtactcaagataataattatgggtgtgtccctctgttggaagactccgagactagaaaaaacaatctcaccctcgaccagccacaggataaagtgatctctgggatcgccagagaaaagctgccaaaagtgcggagacaggaagttagcagcccccgtaaggaaacctcagctagatctctaggaagcccattgcttcacgagcgcggaaacatcgaaaaaactttctgggacttaaaggaggaatttcataagatctgtatgttggcgaaagctcagaaggatcatctgtcaaagctaaatatccccgataccgcaactgaaacccagtgtagcgtgcccattcagtgtacagacaaaaccgataagcaggaggctctgttcaaacctcaagcgaaagatgatatcaaccgcggagcgccatccatcacaagcgtgactccccgtggcctgtgcagggacgaagaggatacctcattcgagagcctgtctaagttcaatgttaaattcccgccaatggacaatgattccacattcctgcacagcactcccgaacgccctggcatcttatctcctgctactagtgaggctgtatgccaggaaaagttcaatatggagttcagagacaaccctggtaacttcgtcaaaacagaggaaacactgttcgagatccaaggcatcgaccccatcgcttccgcgatccagaacttaaagacaaccgacaaaaccaaaccaagcaacttggtcaatacctgtatcaggaccacactggatagagccgcttgcttgcccccaggcgaccataatgcgctatacgtaaatagcttccctctcctcgatcctagtgatgcaccgtttccatctttagactccccaggaaaagctattagggggccacaacaacctatatggaagcccttccccaaccaggatagcgatagcgtcgtcctgagtggaacagatagcgaattgcacattcctcgggtgtgtgagttctgtcaggccgtctttccgccttccatcacatcaaggggagatttcctgcggcacctgaattcccactttaacggcgagacctag

SEQ ID NO: 27449 - DNA, 2055 bp, Artificial Sequence
  Description of Artificial Sequence: Synthetic coding sequence
atggagaatcttcagacaaacttctctttagtccaggggagtaccaagaaactgaacggcatgggagacgacggctcccctcccgctaagaaaatgatcacagacatccatgcgaacggtaagacaatcaacaaagtgccgactgtcaagaaagagcacctcgatgattacggagaggcccctgtcgagaccgatggagaacatgtgaaacgtacatgtacatccgtgccagaaacccttcatctaaatccctctctgaagcatacccttgcacagtttcacctcagttcccagagctcactgggcggtcctgcagccttctccgccagacactcccaggagtccatgtccccgacagtgttcctgcctcttccatctccacaggtgcttcctggccctctactgattcccagtgacagcagtaccgagctgacccagacagtgctagagggcgagtccatttcttgtttccaggttggcggagagaagagactgtgcctacctcaggtcctgaattctgtgctgcgcgagtttaccctacagcagatcaataccgtgtgcgacgaactttacatctactgttcaaggtgcacaagcgaccagcttcacattttaaaggtgctcggaattctgccattcaacgccccatcctgtggtctgataaccctgacagacgcccagcggttatgcaatgccctcctccgaccacggactttccctcagaacggctcagtcctgcccgcaaaatcatcactggcacaacttaaggagacgggcagtgcattcgaagtggaacacgagtgccttggaaaatgtcagggtctcttcgccccacagttttatgtacagcccgatgccccatgcattcagtgtctcgagtgctgtggcatgttcgcccctcagactttcgtaatgcacagccatagatcccccgacaagcggacttgccattggggattcgaatcagctaagtggcactgctacctgcacgtaaaccagaaatacctcggcactcctgaagaaaaaaaactcaagattattcttgaggaaatgaaagagaagtttagtatgcgcagcgggaaaaggaaccagtctaagactgacgcaccctcagggatggaactgcagtcttggtacccggtaataaagcaggaaggtgaccatgtgtcccagacacattcttttctccacccctcttactatctctacatgtgcgataaggtagtggctcctaatgtctcactgacatctgcggtgtctcagtctaaagaactaaccaaaaccgaggcctcaaaatccatctcacgccagtcggagaaagcccacagttcaggtaagttgcagaaaaccgtttcctacccagacgtgtcactggaggaacaggaaaagatggacctcaaaacttcccgagaactgtgttcaaggctggacgcgtcgatcagcaacaacagcactagcaaacgcaaatccgagtctgcgacttgcaatttggtcagggacatcaataaggtgggaatagggttagtggctgccgcaagctctcctttgctggtgaaggatgtaatctgcgaggatgataaaggtaaaatcatggaggaggttatgcgcacatatttgaagcagcaggaaaagctgaaccttatcttgcagaagaaacagcagctacagatggaggtgaagatgctgtcatcttcaaaaagcatgaaggagctgaccgaagaacagcaaaatctccagaaggagctggaatctctacagaacgaacacgcccaacggatggaggagttctacgtggagcagaaggaccttgagaagaagctggagcagatcatgaaacaaaaatgtacctgcgacagcaatcttgagaaggataaagaggctgaatatgccggacaactggcggagctaagacagcggctggatcatgctgaagcggatcgacaggaattacaggatgagctccggcaggagcgcgaggctcgccagaaattggagatgatgattaaggaattaaaactccaaatcttaaaatcctccaagacagcaaaggaatag

SEQ ID NO: 27450 - DNA, 1080 bp, Artificial Sequence
  Description of Artificial Sequence: Synthetic coding sequence
atgtcatatcgcagggagctggaaaagtaccgggacctggatgaggacgaaatcctcggggcattgactgaggaggagttgcgcactctcgaaaatgaactggacgagctggatcccgataacgccctgctgcccgcaggcctccggcagaaggaccaaacgaccaaggcacctactggtccatttaaacgcgaggagctgctggaccacctggagaaacaagcgaaagaattcaaagacagggaagatttggtgccctataccggcgagaagagaggaaaggtgtgggtgccaaaacagaaacccctggaccccgtactggagtcagttacactggagcccgaactcgaagaggccctggcaaacgcaagcgacgccgagctgtgcgatatcgctgccatcctgggcatgcacacgctcatgagtaaccagcagtactaccaagcactgtcatcctcgagcattatgaataaagaaggtttaaacagtgtgataaagcccacacaatacaaacctgtccccgacgaggaacccaattctacagacgtagaagaaacactggagaggataaaaaataatgatcccaagctggaggaagtgaatcttaacaatattagaaatatccctatacccacactgaaggcgtacgcagaggcattgaaggaaaattcgtatgtgaaaaaattcagcatcgtgggtacccgaagcaacgatcccgtggcctacgcactcgctgagatgctcaaagagaataaggtcctgaagacccttaatgtagaatcaaacttcattagtggcgcaggaattcttaggttggtggaagcactcccttacaatacaagcctcgtggagatgaagatcgacaatcagagtcagcctctgggcaataaggtggagatggaaattgtttcaatgcttgagaagaacgcaacgttgcttaagttcggttatcattttactcagcaggggcctcgcctgagggctagtaacgctatgatgaataacaacgatctagtgaggaaacgaagactggcagatctcactggtcctatcattcctaagtgtaggtcaggcgtctag

SEQ ID NO: 27451 - DNA, 1941 bp, Artificial Sequence
  Description of Artificial Sequence: Synthetic coding sequence
atggaggagcgcggatctcccgatggggacctggcccgaagcctcgagcaaggtcctgagggaccggaaacgcctatccaagtggtacttcgtgtgagacccatgtcagcagctgagctacggagagggcagcaatcagtgctgcattgtagcgggacccgaacccttcaaggcggacccgaagtggcctttaggtttggggctgttctggacgctgctcggacacaagaggacgtgtttcgggcttgcggagtgcgtaggctgggagaacttgcgctgagaggtttcagttgcacagtgttcaccttcggacagacaggcagcggtaaaacctatacactgaccgggcctccaccacagggtgagggggttcctgtgcctccttcactggcaggcatcatgcagagaaccttcgcctggcttttggaccgggtgcagcacctgggtgcccctgtgacattgagagcttcctacctggagatctacaacgaacaggtccgtgatttgctgtccctgggatcgccaagaccactgccggtgaggtggaacaagactcgagggttctacgtggagcagctgcgcgtggtggaatttgggagtctggaagcacttatggagttgctgcagaccggcttgtcccgacgacgaaatagcgcacacacattaaatcaagcgagcagccgcagtcatgcactacttactctgtatatatcacgtcagacagcccagcagatgccaagtgtggatccgggtgagcctcctgtggggggtaaactgtgttttgtggacctggcaggaagtgagaaagttgccgcaacgggttcacgtggggaactgatgctggaggccaactcaattaacagatcgctgcttgccctaggtcactgtatttcactgctgctggaccctcagaggaagcagagtcacatcccattcagagattcaaaactgactaagctgttggctgactctctgggaggcaggggagtgactctgatggtggcatgcgtctccccttccgcccagtgtttacctgagaccctgtcgaccttacgttacgccagtcgcgcacagcgggtgacaactcgcccacaggcaccaaagagtcccgtcgctaagcaaccacagcgcctcgagacagagatgcttcaactgcaagaggagaacaggcgtctgcagtttcaattagatcaaatggattgtaaggcctcagggctctctggagctcgcgtggcatgggcccagaggaacctgtatggtatgttgcaggaatttatgctggaaaatgaaaggctgagaaaagagaagtcacagcttcagaacagcagggacctagctcagaatgagcagcgcatcctagcccaacaggtgcatgcacttgaaaggcggctgttgtctgcttgctatcaccaccagcagggtcccggtctgaccccaccctgtccgtgcttgatggcacccgctccgccatgccacgcactgccacccttgtattcttgcccatgctgtcatatttgccctctgtgccgggtacccttagctcactgggcttgtctgccgggtgaacaccatctccctcaggtgctcgaccccgaggcaagtggaggacgaccccctagtgccagacccccaccatgggcccctccgtgctcccccggatctgcaaagtgcccaagagaacgttcacactctgattggactcaaactagggtactcgctgagatgctcactgaggaagaagtggtaccgtcagctcccccactgcccgttaggcccccaaagacttcacccggtctgcggggtggggctggtgtacccaacctggcccaacgacttgaggctctccgggatcagattggctcttcgctgcgaaggggaaggagccagcccccatgtagcgaaggagcgcgttctccaggacaggttctgccaccccactag

SEQ ID NO: 27452 - DNA, 462 bp, Artificial Sequence
  Description of Artificial Sequence: Synthetic coding sequence
atggcgcgtaataccctatcaagcaggttcaggcgagtggatattgacgaattcgacgaaaacaagttcgttgacgaacaggaagaggctgccgcagcggctgctgaaccgggaccagatccctctgaggtggacggcctgttgaggcagggcgacatgctgagagcttttcatgctgctctgcgcaattcaccggttaacaccaagaatcaggctgtgaaagagcgcgctcagggcgtcgtgctgaaggtgctaaccaatttcaaatcttcagagatcgaacaggcggtccagagcctggatcgcaatggtgttgacttgctcatgaagtatatctataaaggtttcgagaagccgactgagaactccagcgcggtgctgctccaatggcatgaaaaggctcttgccgtggggggtctgggctccattattcgcgtcctgaccgccaggaagaccgtctag

SEQ ID NO: 27453 - DNA, 3318 bp, Artificial Sequence
  Description of Artificial Sequence: Synthetic coding sequence
atggcggcaaccgcatcagccggtgtcccggcaacggtgtctgagaaacaggagttttaccagctgttgaaaaatctaatcaatcctagttgcatggtgcggagacaagccgaggagatctatgaaaacattcctggactgtgtaagacaacttttctgctggacgctgtccgcaatcggagggctgggtacgaggttcgccagatggctgccgctctcttgaggaggctgctatctagcggatttgaagaagtataccctaatcttcccgcagatgtgcaaagggacgtgaagatcgaacttatcctcgccgtgaagcttgaaacacacgcttctatgaggaaaaagctgtgcgacattttcgcagtgttggcacgcaacctgatcgacgaagatggcaccaatcactggccagagggactgaagttcctgatagattccatttattctaaaaatgtggtgctgtgggaggtcgcgctccacgtgttttggcactttcctggcatctttggaacgcaggaaaggcacgatttggatattataaagcgcctgcttgaccaatgcatccaggatcaggagcaccccgcaatcagaacgctgagcgcaagggccgcagcagcctttgtgctggccaacgagaataatattgcactttttaaggatttcgctgacttgttgcccggaattctccaggccgtgaatgattcttgttaccaggacgatgattccgtgttagaatcattggtggaaatcgccgatactgttcctaaatacctaggaccctatctcgaggacacactccagctcagtctcaaactctgcggagactccagactgtctaatcttcagagacagttggctctggaggtgatcgtcactttatcagaaacggccactccaatgctgaaaaagcataccaacattatcgcccaagcggttccccatatcctggctatgatggtcgatcttcaagatgatgaggattgggtcaacgctgacgagatggaagaagacgacttcgacagcaacgctgtagccgcagaatccgcattagacagactggcatgcgggcttggcggtaaagtcgtcttgccgatgaccaaggaacacataatgcagatgctgcagtctccggattggaagtatcgccacgcgggactgatggccttgtcggctatcggtgaagggtgtcaccagcagatggagtctattcttgacgaaaccgtcaactctgtactgctttttttgcaggatccacaccctcgcgtgagagcggctgcctgcaccaccctcggtcagatggcaaccgactttgctcctaacttccagaagaagttccatgagaccgtgatcgccgctctgttgaggaccatggagaatcaggggaaccagagagtacagtcacatgctgcatctgctctgataatattcatcgaggattgccctaagtctctactggtcctgtacgtcgatagtatggtgaaaaatttgcactcagtcctcgtgattaagctccaggagctgattcgtaatgggaccaagttagctttagagcagctggtcaccacaatagcttctgtggctgacacaattgaggaaaaatttgtgccctattacgacatctttatgccttccctgaagcacatagtagaactcgctgttcagaaggaactgaagttgcttagaggtaaaacaatcgagtgcatctctcatatcgggctcgccgtaggaaaggagaaattcatgcaagatgccagtaatgttatgcagttgttactgaaaacacagtcggacctcaacaatatggaggacgacgacccccaaacaagttatatggtcagcgcctgggcgagaatgtgtaaaatcctggggaaagacttccagcagtatctcccccttgttattgaacccttgatcaaaaccgcatccgcaaagccagatgtagccctcctcgatacgcaggacgtcgaaaatatgagcgatgatgatgggtggcaattcgtgaatctcggcgatcaacaaagcttcggtatcaagacttccgggcttgaggctaaggcaaccgcctgtcagatgctggtgtattatgctaaggaactgagggaagggtttgtggagtacactgagcaggtagtgaaactgatggtcccactgctaaaattctactttcatgacaacgtacgggttgcagcagctgagagcatgccctttctcctggagtgtgccagaattcggggtcccgagtacctggcacagatgtggcagtttatctgtgaccctttgatcaaagccatcgggaccgaaccagatacagatgtgctgagcgagatcatgaatagcttcgccaagtcaattgaagtcatgggagacggctgtctgaacgatgagcacctcgaagagcttgggggaattctgaaggctaagctggagggccactttaagaaccaggagttaagacaggtgaaacgccaggaggaaaactacgaccagcaggtggaaatgtccttacaggacgaagacgagtgcgacgtgtacattctgaccaaagtttcagacatcttgcattctctttttagtacatacaaggaaaagatcctcccatggtttgaacaactgcttcctcttattgtgaatcttatttgttcctctaggccttggcctgatcgccagtggggcctatgcatcttcgacgacatcatagagcactgttcaccaacttcgtttaagtacgttgaatacttcaggtggcccatgttgttgaacatgcgggacaacaatcccgaagttcgacaggccgcagcctacggcctaggtgtcatggcacagtttggtggggacgattataggtcattatgttccgaagcagtgcccttactggtcaaggttattaaatgcgctaactcaaaaaccaagaagaatgtcatcgccactgagaattgcatctcagccattgggaagatcctgaagttcaagcctaactgtgtgaatgtggatgaggtgctgccacactggctctcatggctgcccctgcatgaggataaagaggaagcaatccaaaccctctcttttctgtgcgatctgatcgaatctaaccatcctgttgtaattggtcccaacaatagcaacttgcctaagattatctctattatcgccgagggaaaaattaatgagactattaactatgaagatccttgcgccaaacgactcgctaatgtagtacgccaagtccagacttccgaggacttatggttggagtgcgtgtcacagctggatgatgagcagcaagaggcattacaagagctccttaattttgcatag

SEQ ID NO: 27454 - DNA, 1914 bp, Artificial Sequence
  Description of Artificial Sequence: Synthetic coding sequence
atggaagtcaccggcttcggggttactaggcccggaaaagttccacaggctagaatgagtggtctggttttagggcaacgggatgagcccgctggacaccggttatcccaggaggagatcctaggctccaccaggttggtctcccagggtctggaggcacttaggtctgagcatcaggcagtgctacagtcactaagccaaacaatcgagtgcttgcagcagggaggacatgaggaggggctggtgcacgaaaaagctaggcagctccgtagaagcatggaaaacattgaattgggtctttccgaggcacaggtaatgctggcactagcttcacacctgtctacggtggagagtgaaaagcagaaactccgtgcacaggtgcggcgattgtgtcaggaaaatcagtggttgagagatgaactggccggaacccaacagcggctgcaaagatccgagcaggccgtggcccagcttgaggaggaaaagaagcatctggagtttctaggacagttgcgccagtacgatgaggacggacacacctctgaggaaaaggaaggggacgccactaaggatagtcttgatgacttattcccaaatgaagaagaggaggaccccagtaatggcttatcccgcggtcagggagcgactgcggctcagcagggtggttacgagataccagctcgcttgaggacactgcacaacctggtcattcagtacgcagcgcaagggagatacgaagtcgctgtgcccctctgtaagcaggccctcgaggacctggagaggacaagtggcagaggccatcctgatgtggccactatgcttaatatcctggccttagtgtaccgcgatcagaataagtacaaggaagcagcacatctgctcaacgatgcactgagcatacgagagagtacgctgggccctgaccatcccgcagtcgctgccacactcaacaatctggccgtactctacggaaaaagaggcaagtacaaggaggccgagcctctctgccagcgggctttggaaatcagggagaaagtgttgggaaccaaccatcccgacgtcgcaaaacagttgaacaatctcgcccttctctgccagaaccaaggaaaatacgaagcagtggaacgctattatcagcgggcactcgccatctatgagggtcaacttggcccagacaatcccaatgtagcgcgaaccaagaataacctggcttcctgttacctgaaacagggcaaatacgccgaagcagagactctctacaaggaaatattaacaagagctcacgtgcaggaatttggaagcgtcgacgacgaccataaacctatttggatgcacgccgaggaaagggaagagatgagcaagagccggcatcacgagggcggtacaccatatgcagagtacggtgggtggtacaaggcctgtaaggtgagttcccccactgtcaacaccacactgcgcaatctgggcgctctttatcggcgtcagggcaagctggaggctgctgaaactttggaggagtgcgcactgaggtcccgcaggcagggcaccgatcccataagtcagactaaggttgcggagcttcttggggagtctgacggcagaagaacaagtcaggaggggcctggagacagcgtaaagttcgagggcggtgaagacgccagtgttgccgtggaatggagtggtgacgggtctgggacattgcaacggagcgggagcctcggcaagattcgggacgtattgcgccgttcttcagagttgctggttaggaaactacagggcaccgagcctcgtcccagctcgagtaacatgaagagagcggcaagcctaaactacctgaatcagccttctgctgcacccctgcaggtgtcgcggggattgagtgcatcaactatggacctctctagcagctcctag

SEQ ID NO: 27455 - DNA, 3966 bp, Artificial Sequence
  Description of Artificial Sequence: Synthetic coding sequence
atgcaatgcctggccgcagcgctgaaggacgaaaccaatatgtccggagggggagaacaggctgatatactgcccgcaaattacgtggttaaagacagatggaaagttctgaaaaagattggtggaggtggatttggtgagatctacgaggctatggatcttttaacgcgtgagaacgttgccctcaaagtggagtccgctcagcagcccaagcaggtcctcaagatggaggtggctgtcctgaaaaaactgcagggaaaggatcacgtctgcaggtttatcggatgcggtagaaacgaaaagttcaattacgttgttatgcagctgcagggtcggaatctagccgacctgaggcggtcccagcctcggggaacttttacactgagtacgaccttacgcctcgggaagcaaatattagagtctatcgaggccattcactctgttgggtttctgcatcgagatataaagccatctaattttgccatgggacgcttgccttccacctaccgaaagtgctacatgctcgactttggtctggcgcgacagtacaccaacaccaccggtgacgtcaggcctccgagaaacgtggccggattccgaggaaccgtaaggtacgcttccgtcaacgctcacaagaacagggagatgggcagacacgacgatctgtggtctctgttttacatgctggtggaatttgccgttggacaactaccttggaggaaaatcaaagataaagagcaagttgggatgatcaaagagaagtatgagcaccggatgctgctgaagcatatgcccagcgaattccacctgttcttggaccatattgcaagtcttgactacttcacaaagcccgactatcagttgataatgtccgtctttgagaactcaatgaaggaacgcggaattgccgagaacgaggccttcgactgggagaaggccggtacagacgccttgctgtccacttccacctcgacgcctccccagcaaaatacgcggcagactgctgcaatgttcggagttgttaacgttactcccgtgcccggagacctgctgcgtgaaaataccgaagatgttctgcaaggggaacacctgagtgatcaagaaaacgcgcctcctatactgccaggaagaccaagcgagggtctcgggccttcacctcacctcgtccctcatcccggaggccctgaagctgaagtgtgggaggaaaccgacgttaataggaataagcttaggatcaatatcggaaagagcccttgcgttgaggaggaacagtccaggggaatgggcgtcccatcctcccctgttcgtgcccctcctgactcacccactacacctgtgcgttccctgcgttatcgaagggtcaactcccccgagagcgagcggctgagcacagcagatggaagggtggaacttcccgagcggagaagtagaatggacctgcctggaagtcccagccgacaggcttgctcatcgcagccagcacagatgctgagcgtggacacgggccatgcggaccggcaggcatcaggcagaatggacgtcagtgcctccgtggaacaagaggctctctctaatgcgtttcgtagtgtgcccttggcagaggaagaagattttgatagtaaggaatgggtaattatcgataaagagacagaactgaaggattttcctcctggggcagagcccagcacctctggaacaaccgatgaggaacctgaggaactgagacccctgccggaggaaggggaggaacgtcgcagactaggcgcagaacccactgtgagacccagaggcaggagcatgcaagcactggccgaggaggacctccagcaccttccaccacagcctctgcctccacagttgagccagggagacggtcgtagtgaaaccagtcagccaccaacgcctggcagtcctagccactccccgttacacagcgggccaaggccaagaaggagagagagcgatccaacaggaccacagcgccaggtcttttccgtggctcccccattcgaggtgaacggcctgcctcgggctgtgcctctttcattaccttaccaggactttaagagggatctgtccgattatcgggagcgagcccgtctattaaacagagtacgaagggtcggtttctctcacatgttactgacaacaccgcaagtccctttagccccagttcagccccaggctaacggtaaggaagaggaggaggaagaagaagaagatgaggaagaggaagaagaggacgaagaagaggaagaagaagaggaggaggaagaagaggaagaagaggaggaggaagaggaggaggaggaggctgctgctgctgtcgcacttggcgaggttctcggtccacggagtggctctagcagtgagggctccgagagatccactgaccggagccaggaaggagccccaagtactcttctggctgacgaccagaaggaatcccgcggaagagcctcaatggcggatggggacctggagccagaagaaggctccaagacactggtattagtgtcgccaggggacatgaagaaatctccagttactgctgaacttgcgccagaccctgatctgggaaccctcgctgcactcactccacaacacgaaagaccacagcccaccggtagccaactggatgtcagcgaacctggcaccctgagcagcgtccttaaatccgaacctaaacctcctggccctggcgcaggtctgggcgcagggactgtcaccacaggagtcggcggtgtggctgtcaccagctcccccttcaccaaagtggaaaggactttcgtgcacatcgcagagaaaacacacctcaatgtcatgtcaagcgggggtcaggcactgagatctgaagagttctccgccggaggcgagctgggactggagctggcaagtgacggaggcgctgtcgaggagggcgctcgcgctcctttggaaaatggactggctctaagtggcttgaacggagccgaaatcgaggggtcagccctgtccggggcacccagagagaccccctcagagatggcaactaactccctgcctaatggaccagcactagcggacgggcctgccccagtttctccactcgaaccttctccagagaaggtcgccacgattagcccaaggagacacgcaatgccgggatcacgccctcggagtaggatccctgtcctgcttagtgaggaggacacagggtcagaaccttccggctcgctgagcgccaaagaacggtggtcgaagcgggctaggccacagcaagatttagcgaggcttgtcatggagaagagacaggggaggctgcttctgaggttggcctctggggcaagcagctcttcgagcgaagagcagcgccgagcctctgaaacgttgagcggcaccggctccgaagaggatactcccgctagtgaacccgctgcagcccttcccaggaaatctggtagggctgctgcgactcggtccagaatccccaggccaatcggcttgcgcatgcccatgcctgtggccgctcagcaacctgccagtcggagtcatggagccgcacctgccctggacactgcgatcacatcacgcttgcagcttcagactccgcctggtagcgctaccgcagctgatctccgtccgaaacaacctcccggacgcggtctcggccctggaagggcacaagccggagctcgccctccagcccctcgctctcctaggctaccagctagcacctccgccgctcgcaacgcaagcgcgagtcccaggagtcagagcctgtctcgcagggaatcaccctccccgagccaccaagcgaggccaggggttcccccacccagaggcgtgccccctgcgagggcacaacccgacggaacaccttcacccggaggaagcaagaaggggccaagaggaaagctccaggctcagagggctacgacaaagggacgagcagggggagctgagggacgagcaggcgctcgttag

SEQ ID NO: 27456 - DNA, 1818 bp, Artificial Sequence
  Description of Artificial Sequence: Synthetic coding sequence
atgagccaattatcgtctaccctgaagcgctacacagaatctgcacggtataccgacgcacactacgcgaagtccggatacggcgcatacaccccctcaagttacggagccaacctcgcagcgtcgctcctggaaaaggaaaaattaggctttaagcccgttcccaccagctcattcctgacacggccaagaacatatgggccttcatcactgttagactacgacagaggtcggccactcttgcgtcctgacatcaccggcggagggaaacgtgctgaatcccagaccagaggcaccgagcgacctctggggagcgggctgagtggtggaagcggcttcccctacggggttacgaacaactgcctgtcctacctgccgataaatgcctatgatcagggagtgaccctgactcagaagctggactctcagagcgatctcgccagagacttttcaagtctgcgaacttctgacagctaccgaattgacccaagaaacctggggagatctccaatgttagccagaacccgaaaagagctttgcaccctccaaggcctgtaccagacagccagctgccctgagtatctggtggactatcttgagaactacgggcgtaaggggtctgcctcacaagtcccaagccaggcaccacctagtagagtaccggagattatcagccccacataccggcctatagggaggtacaccctgtgggaaaccggtaaaggccaggctcccggacctagcagatcctcaagccccggtagagatgggatgaattccaaatctgctcaaggcctcgctggtctgagaaatttggggaacacttgctttatgaattcaatcttgcagtgcctgtctaatacgagagagctgagggattattgtctacaacgcctgtacatgcgggacctccatcacggttcaaacgctcataccgctctagtggaggaatttgcaaagctcatccagacaatctggacaagcagcccaaacgatgtggtgagtccttccgagttcaagacccaaattcagaggtatgcacctaggtttgtgggctacaatcaacaggatgctcaggagtttcttaggttcctgcttgatggcctgcacaacgaggtgaacagggttaccttgaggcctaagagcaatcctgaaaatcttgaccacctcccggacgatgaaaaggggagacagatgtggcgcaagtacctggagcgggaggattcaagaatcggggatctgtttgtcggacaattaaagagctcacttacttgcacagactgcggatactgtagcaccgtgttcgaccctttttgggacctgtcactgcccattgcgaaacggggatatccagaggtcacattgatggattgcatgagattgtttactaaggaagatgtgttggacggggatgagaagcctacatgctgcagatgccgagggagaaagcgctgtataaagaagtttagcatacagcgttttcccaaaattttggtcctccacctgaagcgctttagtgagagtcgcatacgtacaagcaaattgacaaccttcgtgaacttcccactgcgtgatctggacttgcgagaattcgccagcgagaatactaatcacgcggtttacaatctgtacgcggtgtcgaaccactccgggacaaccatgggaggtcactacaccgcttactgtcgatctccagggaccggagagtggcataccttcaatgactcatctgtcacacccatgtccagctcccaagtcagaacctccgacgcttacttgttgttttacgagctcgccagccccccttctcgaatgtag

SEQ ID NO: 27457 - DNA, 1353 bp, Artificial Sequence
  Description of Artificial Sequence: Synthetic coding sequence
atggttccgttggtcgccgtggtcagtggccctcgtgcacagctgtttgcgtgtctactccggctgggtacccaacaggtgggtcctctgcagcttcacactggagccagccatgccgctcgaaaccattatgaagtcctcgtactgggcggtggatctggcggaatcaccatggccgcacgcatgaagagaaaggtgggggctgagaatgtagccattgtagagccatccgagagacacttctatcaacctatttggactctggtcggcgcaggcgctaagcagctgtcatcctctggccgaccgaccgcatcggtaatcccctccggagtggagtggataaaggctagggtgacagaactcaatccagataagaactgcatccacacggatgacgatgagaagatctcgtacaggtacctgataattgcactgggaatccagttggattacgaaaagatcaaggggctccccgaaggctttgcccacccaaagattggaagcaattactcagtaaaaactgtggaaaagacctggaaagctctccaagacttcaaagagggcaacgctattttcactttcccaaacacccccgtgaaatgtgccggtgccccacagaagattatgtatttgtccgaagcatatttccgcaaaacgggtaaacggagtaaagccaatatcatcttcaacacgagcctgggtgcaatctttggtgtaaagaaatacgctgacgccctgcaggagatcatccaggaaaggaacctcaccgtgaattacaagaagaacctgatcgaagtgagagcagacaaacaggaggccgtgttcgaaaacttagacaaaccaggcgagacacaagtaataagctacgagatgctgcacgtgacccccccaatgagtccacccgacgtcctcaaaacaagcccagtggctgacgccgcaggttgggtggacgtcgacaaagaaactctccagcacagacggtacccaaacgtgtttggaatcggcgattgtacaaacctgcccacttccaagacggctgcggcagtggccgctcagagcggtatccttgatcggacgatttctgttattatgaagaaccagacccctactaagaagtatgacgggtatacaagctgtccgctcgtgacagggtataacagggtgatacttgccgagtttgattataaggccgaaccactggagacttttccgttcgaccagagcaaagagcggttaagtatgtatctgatgaaggcggatcttatgcctttcctttactggaatatgatgctgaggggatattgggggggacccgcattcctacggaagctgttccacttaggaatgagctag

SEQ ID NO: 27458 - DNA, 5243 bp, Artificial Sequence
  Description of Artificial Sequence: Synthetic coding sequence
atggacggggtctcaagcgaggccaacgaggagaacgataacatcgaacggcctgttcgtcggcgacattcttcaatcctaaaacctcctcgcagcccacttcaggacttgcgcggtggaaatgagcgggtgcaggagtctaatgctctgcgaaataaaaagaattccaggcgggtgtcattcgccgacactatcaaggtgtttcaaacagaaagtcatatgaaaattgtgaggaaatcggaaatggaggaaacagagacaggggagaacttgctgttgattcagaacaaaaagttagaagataactactgtgaaataacagggatgaacacactgctatccgctcccatccatacgcaaatgcaacaaaaagagttcagcatcatcgaacacacccgcgagaggaagcatgcaaatgaccagacagtaatcttctctgatgaaaaccagatggatctcacaagcagccacacagtcatgatcactaaagggctgctcgacaatcctatcagcgagaaatccaccaaaatcgacacgacaagttttctagcaaatctgaagctccatactgaagacagccgaatgaagaaagaagtgaacttcagcgtggatcagaacacaagctctgagaacaaaatcgactttaatgacttcattaaacgactgaaaaccggaaaatgttcagctttccccgatgtgcccgataaggaaaactttgagataccaatctattccaaagagcctaatagtgccagctctactcaccagatgcatgtgagtctgaaagaagatgaaaacaatagtaacataaccaggttatttagagaaaaggacgatggcatgaactttactcaatgccacacggccaacatccagacactgattcccactagctctgaaacaaactcacgcgagagtaagggcaatgatattactatttatggaaacgactttatggacctgacctttaatcacacactccagatcctcccagcgacaggaaatttttccgaaattgagaatcaaacccagaatgcaatggacgtgactaccggttacggaacaaaagccagcggcaacaaaactgtgtttaaatcaaagcagaatacagcctttcaagacctctccattaactcagctgacaagatacacattactaggagccacatcatgggtgctgaaacacatattgtctcccagacctgtaatcaggacgcgagaatactggctatgacacctgaatctatctactcaaatccctccatccagggctgcaagaccgtgttttactcctcttgtaacgacgcaatggagatgactaaatgcctgtccaatatgcgggaagagaagaaccttttaaaacacgattccaactatgctaaaatgtactgtaacccagatgccatgtctagcctgaccgaaaagactatatacagcggtgaagaaaatatggacatcactaaatcccatacggtcgccatcgataatcagatcttcaagcaagaccagtccaatgtgcagattgctgcggcacccacccccgaaaaggaaatgatgcttcagaaccttatgacaactagtgaggacggaaaaatgaacgtgaactgtaacagtgtgccacatgtttctaaggagcgcatacagcagagcctctccaaccccctgtctatctcactgacagaccggaaaactgagctgctctctggcgagaatatggatctgactgaatcacacaccagcaatttgggatcacaggtgcctctggctgcttacaacttagccccagaatctaccagcgagtcccactcccagtctaaatcgtccagcgatgaatgtgaggaaataacgaagagcaggaacgagccttttcagcgcagcgacatcatcgctaagaactccctcacagacacgtggaacaaagataaggactgggtgctgaagatacttccataccttgataaagattcaccgcagagcgctgactgcaaccaggaaatcgccactagccacaacattgtctattgcggaggagtgttggacaaacagattacaaatcggaacacagtgtcctgggagcagtcactgttctctacaactaagcctttgttctcatcaggccagttttcaatgaagaaccacgatacagcaatttctagccatactgtgaagtccgttttaggccagaacagcaagttggcagagcctctccgcaagtccctttcaaacccaactcccgattactgccatgataagatgatcatctgttcggaggaggagcagaatatggacctaacaaaatcgcataccgtggttattgggtttgggcctagtgagctgcaggagctgggtaaaaccaatctcgagcacaccaccggacagctgacaaccatgaaccgccagatcgccgtcaaggtggaaaagtgtggcaaatcccccatcgagaagtcgggcgtccttaaatccaactgcatcatggatgtgcttgaggatgaatctgtgcagaaacctaagttccccaaggaaaaacagaacgtaaaaatttggggaaggaaatctgtcggcggaccaaagatcgataagacaattgtcttctccgaggatgacaagaacgatatggacatcaccaaatcctatacaattgaaattaaccatcgccctttgctggagaaaagggactgtcacctggtccctctagcaggaacatccgagaccattttgtatacttgccgccaggatgacatggagataacgcgctcacacacaacagctctagagtgtaaaacggtcagtcccgacgagatcaccacccggcctatggacaaaacagtggtattcgttgacaatcatgtcgagctggaaatgacagaatcccacaccgtgtttatcgattatcaggagaaagaacggactgatcgcccaaatttcgagctcagccaaagaaaaagtctaggaactccaacagtgatttgcacaccaactgaagaaagcgtcttttttcccggaaacggcgagagcgatcggttggtggccaatgacagtcagctcacaccattggaagaatggtccaacaacaggggccctgtcgaggtggcagacaatatggagctctccaagtccgctacttgtaagaatatcaaagatgtgcagagcccgggtttccttaacgagcccctgtctagcaagagtcaacgtagaaagagcctgaagctaaaaaacgacaaaacgattgtattcagcgaaaatcacaagaacgatatggatattactcagagctgtatggtggagattgataacgaatcggcgctcgaggacaaagaggacttccacctggcaggggctagcaagactattctgtattcctgtggccaagatgatatggaaatcacccgctcacatactaccgctctggagtgcaagaccttgctgcctaacgaaattgccatccgccctatggacaagaccgtcctgttcaccgataactactctgaccttgaggtaactgactctcacacggtgtttatagattgtcaggctacggaaaagatcctggaagaaaaccctaagttcggaatcggtaagggaaaaaacctgggcgtcagttttccaaaggataactcttgtgtacaggaaatcgccgaaaaacaggccctagctgtaggcaataaaattgtgctgcataccgagcaaaagcagcagttattcgctgcaaccaaccgaaccactaacgagattattaagttccactccgcggcaatggatgagaaggttatcgggaaagtcgttgaccaggcctgtacgctggaaaaagctcaagttgagtcatgtcaactgaataatcgggatcgcagaaatgtggacttcacctccagtcacgccactgccgtgtgcgggtctagtgacaattactcttgtctgccaaatgtgatctcgtgcacggacaatttggagggcagcgccatgctgctgtgcgacaaggacgaagaaaaagcaaattactgtccggtgcagaatgatctcgcttacgccaacgacttcgcttcagaatactatctggagtcagaaggacaaccactctccgctccgtgtccactgctggaaaaggaggaggtgattcagacgagcacaaaagggcaattggactgcgtcatcaccctccacaaagatcaggatctgatcaaggatccacggaacctactggctaaccagaccttagtatattctcaagatctgggagaaatgaccaaattgaactctaaacgcgtatccttcaagctccctaaagaccagatgaaggtttacgttgacgacatatatgtgatccctcagccccattttagtactgatcagcctcccttacctaaaaaaggccagtcaagcattaacaaggaggaagtcattttgagcaaggcaggcaacaaaagcctaaacatcatcgagaacagctccgccccaatttgcgagaataaacccaaaatcttaaatagtgaagaatggttcgcagccgcatgcaaaaaagagctaaaagaaaacatccaaactactaattacaatactgcactcgacttccacagcaacagtgacgtgactaagcaggtgatccagacacacgtcaacgctggggaagctcctgatcctgttatcactagcaacgtcccctgcttccatagtatcaaacctaacctgaataatctgaacggcaaaaccggagagttcctggcctttcagactgtacacctgccaccactacctgaacagttactcgagttgggaaacaaggctcataacgacatgcacatcgtacaggcaacagagattcataatattaatatcattagtagcaatgccaaagattccagagacgaagaaaataaaaaatcccataatggagctgagacaacctcactgccccctaaaaccgtgttcaaggataaggtgcggaggtgttctctcggtatcttcttacccagactccctaacaaacggaactgttccgtgactggtattgacgatttagagcaaatacccgcagacacgacggatatcaatcacttggagacgcaacctgtatccagtaaggattctggtattgggagcgtggcgggaaagctgaacttgtccccaagccagtacattaacgaagagaacctccctgtgtacccagacgagattaattcctctgactccattaatatcgaaactgagccgaagaaaaacgtgggaacacgtagaaggaggtatagcta

SEQ ID NO: 27459 - DNA, 2061 bp, Artificial Sequence
  Description of Artificial Sequence: Synthetic coding sequence
atgattcctggaaagtatcgcagcgtgagcgggagggccgctaacaatgttaattgcggattacacttggtgatccagacctcctccttgcccgagaaaaacaaggtagaattcaaactgaataaagatacaagcagcttccccggacgactcctgcaacacgatctcgagcgcaactattccagcaggcagggggaccacataaacctggtttcgtcatctctctcttcctttccgatactgcagcgatctagcgaggaaaaaatcctttactccgatcggctcagcctggagcgccaaaagctgacagtttgccctatcattaatggcgaagaccatttgaggcttctgaattttcaacacaactttattacccgaatccagaacatttctaacctccagaaactcatttcacttgatctttatgacaaccagattgaagagataagcggcctgtctaccttgcgatgcttacgagttctcctgttaggcaagaaccggattaaaaaaatctccaacctggagaatctgaaatcattggacgtgctcgatcttcacggcaatcaaatcaccaagatcgagaacatcaatcacctgtgtgagctccgagtgctgaatttagccaggaacttcctgtcgcacgtggataatctgaatggcctggatagtctgaccgagctgaacctgagacacaatcagatcacctttgtccgagatgtcgataacttgccctgtttacagcatctgtttctctcattcaacaatatcagtagtttcgacagtgtcagctgccttgcagattcctcaagcttgagtgatatcaccttcgacgggaacccaatcgcccaggaaagttggtacaagcataccgtcctacagaacatgatgcaattgaggcagctagacatgaaacgaattaccgaggaagagcgcagaatggcatcagtactggctaaaaaagaggaggaaaagaaacgtgaaagccacaagcagtctctactcaaggaaaagaagagacttaccataaataatgtggccaggcagtgggacctgcagcaacagcgggtggcaaacatcgccacaaatgaggataggaaagattctgactctccacaggatccctgtcagatcgacggaagcaccctgtccgcattcccagaggaaaccggccctctggatagtgggctgaataacgctttacaggggctctctgttattgacacctatcttgtggaagttgatggcgataccctgtccttatatggatccggagccctcgagtctctggataggaactggagcgtccagacagccggtatgatcacaactgtgtcgtttacattcatagaattcgatgaaattgtgcaggtgttgccaaaactaaagatcaaattccccaactctcttcacctaaagtttaaggaaactaatctggtgatgctccagcagttcaacgctttagcccaactccgtcgcatcgaccaactaactattgatccacagggcaatcccgtggtgaatttcactctctggaaatactacgtgctgtttcggttatctcatttcagcatgcagaagattaacggtaccgaggtcacccagaatgacatgatcatggccgagcgcctcttcggcattttagcccacgttgcctcaagcgagctgcctcagtacagactaatcagcattctgggcgatgcaagaaaaaaacagttccgatacctccttgagtccaaggggaagaaaccagggattattaacgaggagaacaacgattctaaaagactagttggcgaaaacaccaatcgggctaccctcaattacacaacaagggatttttacaacgagaagttggaagaaatcaaagagaagaaaaagttttgcaagacttatatcgaggacctcgtgaaggaggctaccgaaatcaacatgaaaaacgaggctctacagaagctttggcctcagatgttcatcgagctggtccgcgatgctgtgattgagattaggaacaaaaacagctatatgaagctttgcctccagcaaatcaccgaccagaagtag

SEQ ID NO: 27460 - DNA, 255 bp, Artificial Sequence
  Description of Artificial Sequence: Synthetic coding sequence
atgccgtatctgctgatcagcactcagattaggatggaggtggggcctactatggtcggggacgagcagtcagatcccgaactaatgcaacatctgggggctagtaagcgcagggcgctgggcaacaacttttatgagtactatgtggacgacccaccaagaattgtacttgataagctggaaaggcgcggatttcgcgtgctatcaatgacgggcgtgggacagaccttagtgtggtgtctgcacaaagaatag

SEQ ID NO: 27461 - DNA, 2664 bp, Artificial Sequence
  Description of Artificial Sequence: Synthetic coding sequence
atgccaagcttgcctcaggagggggtgattcaggggccttcacccctggatctgaacaccgaactcccttaccagtcgactatgaagagaaaagtaagaaagaagaagaaaaaaggcacaataacggcgaatgtggccggaactaaattcgaaatagttcggcttgtgatagatgaaatggggttcatgaagactcccgacgaggacgaaacgagtaacctaatttggtgtgatagtgcggtccaacaggaaaaaatcagcgagcttcagaattaccagcgcatcaatcactttcctgggatgggtgaaatctgtcgcaaggattttttggcaagaaatatgaccaagatgattaagagccgacctctggattacacatttgtcccccgaacttggattttccccgctgaatacacccaattccagaactatgtgaaagagctgaagaagaagcgtaaacagaagacattcattgtgaaaccggctaacggagcaatgggacacgggattagtctcatacgcaacggcgataagctgccttcgcaggaccaccttatcgtccaggagtacattgagaaaccgttcttgatggaggggtataaattcgatctgagaatctatattttagtgacgtcatgtgatccactaaagatcttcctgtaccacgacggtttggttcgcatggggacagaaaagtatattccaccaaacgagtctaacttgactcagctctacatgcacctgaccaattactcagtgaacaagcataatgaacattttgagagggatgaaacagagaacaaggggagtaaacgctcgattaagtggtttaccgagttcctacaggcaaatcaacacgacgtggctaagttttggagcgacatatcggagctggtggtgaagaccctgatcgtcgccgagccgcacgtactgcatgcataccgaatgtgccgcccagggcaacctcctgggagcgagtctgtatgctttgaggtgttaggattcgatatcctgttggatcgcaagcttaaaccctggttgcttgaaattaatcgggcaccctcatttgggaccgatcaaaagatcgactatgatgtgaagagaggggtactcctcaacgccctgaaactactcaacatccgcactagcgacaaaagacggaacctggcaaaacagaaggctgaggcacagcggaggctttatggacagaatagcattaagaggttgctgccgggatctagcgattgggaacagcaacgccaccagttggaacggcgtaaggaggaactgaaggaaagactggcccaggtgcgcaaacagatctctcgggaagagcatgagaatcgccacatgggcaactacaggaggatctacccaccggaggacaaagcgctgctggagaaatacgaaaatctgcttgcagtggcattccaaaccttcctgtcaggcagagcagctagttttcaacgtgagctgaacaatcctcttaaaagaatgaaagaggaagatatcctggatctgctggaacagtgcgagatagacgacgaaaaactcatgggcaaaaccacaaaaacaagaggtccaaagcccctctgcagcatgccagaatcaacggagatcatgaagcgcccaaaatactgcagcagcgactcctcatatgacagcagtagttcaagttcagagtctgatgagaatgaaaaggaagaataccagaataaaaagcgcgagaagcaggtgacttataacctcaagccctcaaatcattataaactgattcagcaaccgagtagcatcaggcggagcgtctcttgtccacggtcgatctccgcccaatccccgtcttcaggcgacactcgtccttttagtgcccaacagatgatttctgtttctaggcctacgtcagcctcccgttcacactcactgaatcgcgctagttcatacatgagacacctgccccatagcaatgacgcatgtagcactaacagccaagtgtccgagtctctgagacaattaaagacaaaggagcaggaggatgatctcaccagccaaaccctcttcgtgcttaaggacatgaagataagattcccaggcaagtctgacgcagagtcagaactgctaatcgaggacatcattgataactggaaataccataagacaaaggttgcctcatattggttgattaaactagactctgttaagcagcgtaaggtcctggatatcgttaagacaagcatccgaactgtgctgccaaggatctggaaggtgccggatgtggaagaagtaaatctctacagaatcttcaatcgcgtttttaatagactgctgtggtctcgtggacagggtttatggaattgcttctgcgactcagggagcagctgggaatcaatattcaacaagagtcccgaagtggttactccactgcagctacagtgctgtcagaggcttgttgagctgtgtaaacagtgtctacttgttgtgtacaaatatgccactgacaaacgtggaagtttaagcggaattggtcctgactggggtaattccagatacttgcttccagggagcactcaattcttcctgcggaccccgacctataacctaaaatacaattccccgggaatgactagatctaacgtgctgtttacttcccgctacggtcacctgtag

SEQ ID NO: 27462 - DNA, 1140 bp, Artificial Sequence
  Description of Artificial Sequence: Synthetic coding sequence
atggccggacctcgcgtagaagttgatggttctatcatggagggtgggggacaaatcctgcgagtgagcaccgctctaagttgtctgttgggtctgccccttagggtacagaagatccgcgctgggaggtcaactcccggtcttagttcggggggatggaaaagcaaaattaaagtgctaacaaggccacagcatttaagtgggttagagatgattagagatctgtgcgatggacagcttgagggcgcagaaatcggatctaccgaaattacatttaccccggagaagatcaaaggcggaatccacactgcagacaccaaaacagccggtagtgtctgcctgctgatgcaagtcagcatgccatgtgtccttttcgccgcttctccaagcgagctgcacctgaagggcggtactaatgcagaaatggcccctcaaatcgattacactgtgatggtgttcaagcctatagtcgagaaatttggcttcatcttcaactgcgatattaagacccgtggctactaccctaagggcggtggggaggtgatagtccgcatgtccccagttaagcaactcaatcccatcaacctgaccgaacggggatgcgtgactaaaatctacgggcgtgcgtttgtcgccggtgttttgcctttcaaagtggccaaggatatggcagcagctgcagtccgctgtatccggaaagagatccgagacctgtacgtgaatatccagccagtgcaagagcctaaggatcaggcgttcggaaatggaaacggcattatcatcatcgccgaaacctccacaggctgtctgttcgcagggtccagcctggggaaaagaggcgtgaatgcggataaagtcgggatagaggctgcggagatgctgctggccaatctgaggcatggtggaaccgtggatgagtatttacaggaccagcttatcgtattcatggctctggcgaacggcgtcagcaggatcaaaacaggtcctgtgactctgcatacccagaccgcaattcactttgcggagcagattgcgaaggcaaaattcattgtcaagaaatcagaggacgaggaggacgcagctaaggatacttatattatagagtgccaggggatcgggatgacaaaccccaacctctag

SEQ ID NO: 27463 - DNA, 1056 bp, Artificial Sequence
  Description of Artificial Sequence: Synthetic coding sequence
atgccaagtgagactttatgggagatcgctaaggctgaggtggaaaaacgcggaatcaacgggtcagaaggcgatggcgctgagatcgctgaaaagttcgtattttttatcggcagcaaaaacggcggtaagactacaattattctcaggtgtctggaccgggatgaacccccaaagcctacactggctctggaatacacctatggcagacgcgctaaaggacataacacacctaaggatattgcccacttctgggagcttggcggaggcacaagcctgttagacctcatctctatccccatcactggagataccctgcggaccttctcactggtgctcgtactggatctgagcaagccgaacgatttgtggcctactatggagaatttgctgcaggccactaagtcacacgtggacaaagtcataatgaagttaggtaagacgaatgcgaaggctgttagcgaaatgagacagaagatctggaacaacatgcccaaagatcaccctgaccacgaattgatcgaccccttccccgtcccactggtaatcattggatccaagtacgatgtgttccaggacttcgagagcgaaaagaggaaagtcatttgtaagacactgcgatttgttgcacattattatggagctagcctgatgttcacttcgaagtccgaagctctgctcctgaagattcgaggtgtgatcaaccagcttgcattcggtatcgataagtctaagtccatatgtgttgaccaaaacaaaccactgttcattaccgcaggtctggactccttcggacagatagggtccccacctgttcctgagaacgatatcggaaaactgcacgcccacagccccatggagctgtggaagaaagtgtacgaaaagctgttcccacccaaatccattaacactcttaaggatataaaagatccagctagagacccccagtacgccgagaatgaggttgacgagatgcgaattcaaaaggatctagaacttgagcagtacaagaggagctcatcaaaatcctggaagcagatcgagcttgattcatag

SEQ ID NO: 27464 - DNA, 798 bp, Artificial Sequence
  Description of Artificial Sequence: Synthetic coding sequence
atgtgtacatccgagacctttcaggccctcgacacgtttgaggctcgtcatgacgatatcgtgctggcttcttacccaaagtgcggatcgaactggattctgcacattgtcagtgaactgatctatgctgtgagcaaaaaaaagtataagtaccccgagttcccggtcctagagtgtggtgattccgagaagtaccagagaatgaagggatttccatcaccgagaattctggccacccatctgcattacgataaactccccggttccatttttgagaataaggccaaaatcttggtgatttttagaaaccctaaagacacagcagtgagcttccttcatttccataacgatgtccctgatatcccgtcctacggcagctgggatgagttcttcagacagttcatgaaggggcaagtgagctggggcaggtacttcgacttcgcaatcaactggaacaaacacctagacggtgacaacgtgaaattcatcctgtatgaagaccttaaagagaaccttgcagcaggaattaagcagatagccgaatttctggggttctttctgacaggcgaacagatccagactattagcgtccagagcacattccaagctatgcgagctaaatcacaggatactcatggcgcagtgggacccttcttgttccgcaagggcgaagtgggggattggaaaaacctttttagtgagatccagaaccaggagatggatgaaaagttcaaagagtgcctagcaggcacttcacttggcgcaaaattaaagtacgagtcctactgtcagggctag

SEQ ID NO: 27465 - DNA, 5343 bp, Artificial Sequence
  Description of Artificial Sequence: Synthetic coding sequence
atggaatctaattttaaccaggagggagtgcccaggccttcgtatgtctttagcgccgacccaatagcccgaccttctgagatcaattttgacggcattaagctcgatctgagccacgagttttccttggtggcaccgaatacagaggcgaactctttcgagtccaaagactatctccaagtctgcctgaggataagaccattcactcagtctgagaaggagcttgaaagcgagggatgtgtgcatattctggactctcagacggtcgtgctgaaggaacctcaatgcatactaggacgcctgagtgagaagagcagcgggcagatggcccagaagttctcctttagcaaagtgttcggccctgccacaacccagaaagaattttttcaaggctgtatcatgcagccagtgaaggatctcctgaagggtcagtcaagattaattttcacatacggtcttaccaacagtggcaagacctataccttccagggtactgaggaaaacatcggcatcctgcccagaaccctgaatgtattgttcgatagtctgcaagaacgtctttacaccaagatgaaccttaaaccacacagaagtagggaatacctcagactctcttcagaacaagagaaggaggaaattgcaagcaagtccgcactcctccggcagatcaaggaggtcaccgttcacaacgactcggatgacacactgtacggctcgctgactaactctctgaacattagtgaattcgaagaatctatcaaggactacgaacaagcaaacctgaacatggcaaactcaatcaagttttccgtgtgggtgtccttcttcgagatatataatgaatacatctatgatctatttgtgcccgtttcatcgaagttccaaaaacgcaaaatgctgaggttgagccaggatgttaaagggtactcctttataaaggacctgcagtggattcaggtgtcagacagtaaagaggcgtatcgcttgctgaaactcgggatcaaacaccagtcagtggcattcacaaaactgaacaacgcatcttctaggagccacagtatttttacagttaaaatcctacagatagaggacagcgagatgagcagagttatccgagttagtgaactcagcctgtgtgatctggcgggaagcgaacgaaccatgaaaacccaaaatgaaggagagcgtctgcgcgagacgggtaacattaacacttccctcctgacactgggaaagtgcattaacgtgcttaagaacagtgagaaatctaagttccagcagcatgtacccttcagggaatccaagctcacccattacttccagagcttctttaatgggaaaggtaaaatctgtatgattgtgaacatttctcagtgctatctcgcatacgatgagactttgaacgttttaaaattctccgcgatcgctcagaaggtctgcgtgccggataccttgaacagttctcaggaaaaactgttcggcccagtcaagtcatctcaggacgtcagcctggattcaaatagtaacagtaagatccttaacgtaaagcgtgccaccatttcatgggagaatagcctggaggatctgatggaagacgaagacctggtcgaggagctggaaaacgccgaggaaacccagaacgttgagactaaactgctagacgaagacctggacaaaacactggaggaaaataaggcctttatttcccacgaggagaaacgaaagttgctggacttgatcgaggaccttaaaaagaaactaattaatgaaaagaaggaaaaactgacgctggagtttaagatccgtgaggaggttacccaggagtttacacagtattgggcacagagagaggctgacttcaaggagactcttttacaagagagagagatcctcgaagagaatgccgagcggagactggctatcttcaaagatttggttggtaagtgcgatactcgagaagaggctgctaaggacatttgcgccaccaaagtggaaaccgaagaagctaccgcctgcttggaactgaagttcaatcagatcaaagccgagttagcaaaaaccaagggagaactgatcaaaaccaaagaggaactgaaaaaacgagagaacgagtccgacagtctgattcaggaattagagacctccaataagaagatcatcacccagaatcagagaattaaggaacttattaatatcatagatcagaaggaggacacaatcaatgaattccaaaacctgaagtcacacatggaaaatactttcaagtgcaacgacaaagccgacacaagctccctgataatcaataataaactcatctgcaatgaaacggtggaagtgccaaaggattccaaaagtaaaatctgtagcgagagaaagagggttaatgaaaacgaattgcaacaggatgagccacccgcaaaaaagggaagtattcatgttagttcggccatcacagaggatcagaaaaaatccgaggaggtccggcctaatatcgccgaaatcgaagatatccgggtcttacaggagaacaacgagggtttgagagccttcttgttaacaatagaaaatgagcttaaaaacgaaaaggaagagaaggccgagcttaacaagcagattgttcactttcagcaggagctctccctctcagaaaaaaaaaatctgacccttagtaaggaggtgcaacagatccaatctaactatgacattgctatagcggagctgcacgttcagaagtcaaagaaccaggagcaggaggaaaaaatcatgaagctctccaacgaaattgagactgcaacacgctcaataaccaataatgtctcccagattaagctgatgcataccaagatagacgagctcaggacactggatagcgtgagtcaaattagtaatatcgacctgttgaatctccgcgatttatctaacggttctgaagaggacaacctgcctaatacccaacttgatttgctcggcaacgactatctagtgtcaaagcaagtaaaggagtaccgcatccaggagcctaatcgtgaaaatagctttcactcctctatcgaggctatctgggaggaatgcaaagagatagtgaaagcatcatccaagaagagtcaccagattgaggaactagaacagcagattgagaagctgcaggccgaggttaagggctacaaggacgagaataaccggctgaaggaaaaagagcacaagaaccaagatgacctgctcaaggaaaaagagacattaatccaacaactcaaggaggaattgcaggaaaaaaatgttactctcgacgtccagattcagcacgttgtggaagggaagcgagccttgagtgagctaactcagggagtcacctgctacaaggcgaagatcaaagagctggaaacgattctggagacgcaaaaagtcgagtgttcacatagtgctaaattggagcaagacattctggagaaggaaagcattatcctaaagctcgagcgtaacctaaaggaatttcaagagcatctgcaggactctgttaagaacacgaaggaccttaatgtaaaagagctcaagctgaaggaggagatcacacagctcacaaataatctgcaagacatgaagcacctcttacaattaaaagaagaggaagaagaaacaaacagacaagaaaccgagaaattgaaagaggaactgtcggcctcatctgctagaacgcaaaatctgaaagccgatctgcagcggaaagaagaggactacgctgacctcaaggagaaactcacggacgccaagaaacaaatcaagcaggtgcagaaagaggtgagcgtcatgcgggacgaggacaagttgctcagaatcaaaatcaatgagttggaaaaaaaaaaaaatcaatgttcacaggaacttgacatgaaacaacggacaattcagcaactgaaggaacaattgaataaccaaaaggtggaagaggcaatccagcagtacgagagggcctgtaaagatctcaatgtgaaagaaaaaatcatcgaagatatgcgcatgactctggaagagcaagaacagacccaagtcgagcaagatcaagtacttgaggcaaaacttgaggaggtggagcggctggccaccgagcttgagaaatggaaggagaaatgcaacgacctggagaccaaaaataaccagcgttctaataaggagcacgaaaacaataccgatgtgctaggcaagttgacgaacttgcaagacgaactgcaggaatctgaacaaaagtataatgccgatcggaaaaagtggttggaagagaaaatgatgctcattacgcaggcgaaagaagcggaaaacatccgcaacaaagaaatgaaaaaatatgccgaggacagggagcgtttctttaagcagcagaacgagatggagattctcactgcacagctgactgagaaggacagcgatctgcagaagtggagagaagagcgagaccaattagtcgcagctttggagattcagctgaaggcactaatatcttccaacgtgcagaaagataacgaaattgagcagttaaagcggataatctccgagactagcaaaattgaaacacagatcatggacatcaagcctaagcgaatcagctcagccgacccagacaaattgcagacagagccgctgagtacatcatttgaaatttcccgcaacaaaatcgaggatggttccgtggtgttagactcctgtgaggtcagcaccgaaaacgaccaatctactcggttcccaaagcccgaactggagatccagtttacgccgctccagccaaacaaaatggccgtgaaacacccaggatgcaccaccccggtgactgtgaaaataccaaaggccagaaagcggaaatccaacgaaatggaggaagatctggtcaaatgtgaaaataaaaaaaacgccactccacgtacaaacctgaagttccccatcagtgatgacagaaacagttccgtgaaaaaggaacagaaggtggccattcgcccttcctctaagaaaacctatagtctcagaagccaagcaagcatcattggcgtaaacctggctaccaaaaagaaggagggcaccctccagaagttcggcgactttctgcagcattcaccctcaattctgcagtctaaagcgaaaaagatcatcgagacgatgtcctcctccaagctaagcaatgtagaagcatctaaagaaaacgtctcacagcccaagagggcgaaacgaaagttatatacgtccgaaatttcatccccaatcgacatcagtggccaagtgatcctgatggatcagaaaatgaaggagtcggatcatcaaatcataaaacgcaggttaagaactaagaccgctaaatat

SEQ ID NO: 27466 - DNA, 1371 bp, Artificial Sequence
  Description of Artificial Sequence: Synthetic coding sequence
atgaattctagcgatgaagaaaagcagctccagctgattacaagcctcaaggagcaggcaattggtgagtacgaagacctaagggctgagaatcagaaaacaaaagaaaagtgcgacaagataagacaagaacgcgacgaggccgtcaaaaagctcgaggagttccagaagatatcacacatggtgattgaagaagtgaattttatgcagaaccacctggaaattgaaaagacttgcagggagtcagctgaagcccttgcaactaagcttaacaaagagaacaagacccttaagcgaatctctatgttgtacatggccaaactggggcctgacgtgattacagaagaaattaacatcgacgatgaggactcaacaaccgatacggacggcgctgcggagacttgcgtatcagtccaatgccagaagcagatcaaagagcttcgggaccagattgtcagcgtgcaagaagagaaaaaaattttagccatcgagttggagaacttgaaatctaagctagtagaggtgatcgaggaggtaaataaggtgaaacaggagaaaaccgtgctgaattccgaagtgctcgaacagcgcaaagtgttggaaaaatgtaatagggtcagtatgttagctgttgaagaatatgaagaaatgcaggtcaaccttgaactggaaaaggaccttaggaaaaaggctgaaagctttgcccaagaaatgttcatcgagcagaataaactaaaacggcagagtcatctcctgttacagagcagcattcctgaccagcaactattgaaagcccttgacgaaaacgctaagcttactcagcaactggaagaggaacgcatccagcatcagcagaaggtaaaagaactggaagaacagctggagaatgagaccttgcacaaggagattcacaatcttaaacagcagctggagcttctggaggaggacaagaaggaactggagctgaagtaccaaaactcagaggagaaggccagaaatctcaaacactccgtcgatgaactccagaagagggttaatcaatcagaaaattccgtgcccccaccgccaccccctcccccacctctgccacctccacctcctaacccgattcggagccttatgtcgatgatccgtaagagaagtcatccctcaggatccggtgcgaagaaggagaaggccactcaaccggagacaaccgaagaagtcactgatcttaaaaggcaagctgtggaggagatgatggatcgcatcaaaaagggtgtgcacctgagacccgttaaccagacagcacgaccgaagactaaacccgaatccagtaaaggttgcgagagcgccgtcgacgaactgaagggcattttagcctcccaatag

SEQ ID NO: 27467 - DNA, 630 bp, Artificial Sequence
  Description of Artificial Sequence: Synthetic coding sequence
atgaaaaaagtacgcctcaaagaactggagtcccgcctgcagcaagtcgatggctttgaaaagcctaaactgttactcgaacagtaccccacacggccacatatcgcagcttgcatgctgtacaccatacataacacatatgatgacatagaaaacaaagtggttgctgatctggggtgtggctgcggcgtgctgagcattggaacggcaatgctgggggctggcttgtgcgtcggattcgatatcgacgaggacgccctggagatctttaaccgaaacgcagaggaattcgagctgacaaatatcgatatggtgcagtgtgatgtttgtcttctgagcaacaggatgtctaaaagcttcgatacggttatcatgaaccccccatttggcacgaaaaacaataagggcactgacatggctttcttaaaaaccgccctagaaatggcccgaacagctgtgtattctctccacaagtcatccacgagggagcacgtgcagaaaaaggctgctgagtggaagatcaaaatcgacattatcgcagaactgagatatgacttgcctgcctcctacaaatttcataagaaaaagagtgtggacatcgaagtggatctgattcggttctccttttag

SEQ ID NO: 27468 - DNA, 4719 bp, Artificial Sequence
  Description of Artificial Sequence: Synthetic coding sequence
atggcctcatccgctcgtgagcacttactattcgttcgcaggaggaatccacagatgagatatactctctctccggaaaacttacaatctctggccgctcaaagctccatgcccgaaaacatgacattacaacgcgcaaattcggacactgacctggtcacttcggagagtagatctagcctgactgccagtatgtatgagtacaccttgggacaagcacagaaccttattattttctgggacatcaaagaagaggtagatcccagtgactggatcggtctgtatcacattgatgagaattctccggctaatttttgggacagcaagaatagaggggtcaccggtactcagaaagggcagatcgtgtggcggatcgagccaggcccttacttcatggagccggaaatcaaaatctgctttaaatactatcacggaatctccggagccctcagggctactaccccctgcattaccgtaaaaaatccagctgtgatgatgggcgcagaggggatggagggtggagcctccggaaacctccacagtcgtaaactggtgtctttcactctaagcgatctgagggccgtaggcctaaaaaagggtatgtttttcaaccctgacccctatttaaaaatgagcatccagcccggtaagaaaagcagctttcccacttgcgcccaccacggccaggaaaggagaagtactataatttccaacaccaccaaccctatatggcaccgggaaaagtactcttttttcgcattactcaccgacgtcctcgaaatagagattaaggataagtttgccaaaagcagacctattattaaacgcttcctgggaaaactgactattccagtgcagaggcttttggaacgtcaggccatcggtgatcaaatgttgtcatataatcttggtcggcgattacccgcagatcatgtttctgggtaccttcagtttaaggtcgaagtcacctcgtctgtccacgaggacgcatcacccgaagccgtgggaactattctcggtgtgaatagtgtgaatggagatttgggctcccccagtgacgatgaagacatgcccggtagccatcatgactctcaggtgtgcagtaatggacccgtgagtgaggacagtgccgcagacggtacaccgaagcactccttccgcacaagtagcaccctggagattgacaccgaagagctgacctcgaccagcagcaggacatcgcctcctcggggacgacaggattctttgaatgactatctggatgctattgagcacaacggtcactctagaccaggtaccgccacctgttctgaacgctctatgggcgcatcccctaaacttcgctcaagctttccgactgacaccaggctcaatgcaatgcttcacatagatagcgacgaggaggaccatgagttccaacaggatctcggctatcctagctctcttgaggaagagggaggactgatcatgttttcacgggcatcaagggctgacgacggttctctcacgtcgcagaccaaattggaggacaatccggtggagaatgaagaagctagcacacacgaagccgctagcttcgaggataaacctgagaacctgccagagttggccgagtcatctctgcctgctggaccggctcccgaggagggagaaggtgggcctgagccgcaaccctcagctgatcagggtagtgccgagctgtgtggcagccaagaggtggaccaacctaccagcggtgctgatactgggaccagcgatgcatcagggggttctcgcagagcagtttcagagacggagtcgctggaccagggttctgaaccctctcaggtgtcatctgagactgaaccttccgatccagcaagaacggagtctgtgtcagaagcgtccacccgacccgaaggtgagtcagatctcgagtgtgcagactccagctgtaacgaaagtgttacaacccaactcagttctgtggacacaaggtgtagtagcttggagagtgctcgattccccgagacacccgcattttcttctcaagaggaggaagatggcgcttgtgcagccgaaccgacctcttctggccctgcagaaggatctcaggaatctgtgtgtacagcaggttccttgcctgttgtgcaagtcccatctggggaggatgaaggccctggcgcagagtctgcaacagtgccagatcaggaagaactgggcgaagtctggcagcgccgaggcagcctcgagggtgctgctgccgcagctgaaagcccaccgcaggaggaggggagcgccggtgaggcccagggaacatgcgagggggctaccgcacaggaggagggcgcaaccggagggagtcaggctaatgggcaccaacccctgcgcagcctccccagtgtgaggcaagacgtgagccgctaccagcgagtggacgaagcactgccccctaattgggaagcacgcattgactctcatggaagaatcttctatgtcgatcatgttaacagaaccactacttggcaacggccaactgctccaccagccccacaggtcttgcaaaggtctaactctatccagcaaatggaacagcttaatcggaggtatcagagcatccggaggactatgactaacgaacgccctgaggaaaataccaacgccattgacggcgctggcgaggaagcagactttcatcaggcctctgcagacttccgccgtgagaacatactgcctcacagcaccagtaggtcaagaatcacactgctgctgcagtcccccccagtgaagttcttgatcagtcctgaattttttaccgttctgcactccaatccctcagcttatcgcatgttcacgaataacacttgcctcaagcatatgataactaaagtgcgtcgcgatactcaccatttcgaaaggtaccagcacaatcgagacctagtgggtttcctcaatatgtttgctaataagcaactcgaactccccaggggctgggaaatgaaacatgaccaccaagggaaagccttcttcgtggaccataacagtaggacaacaaccttcatcgatccacgactgccattgcagtcgtctcgacctacgtcggccctggtgcatagacagcatctgacaaggcagagatcccactcagctggagaggtgggagaggattcccgtcatgcgggaccgccagttctgccacgcccaagcagcacgtttaacacagtctcaaggcctcagtatcaggacatggttccagtagcctacaacgacaaaatagtcgctttcctacgacagcccaatatcttcgaaattctacaagagcgacagcccgatctcacccgcaatcactcactgcgggaaaagatccagttcatccggaccgaaggaacacccggtctcgtgcggctctcatctgacgccgatctggtcatgctgctgtcactttttgaggaagagattatgagttacgtgcctccccatgcacttctgcatccctcctattgtcaatcccccagaggctcccctgtctcaagtccccagaattctccaggtacccagagagccaacgccagagcacctgccccttacaaacgcgatttcgaagcgaagctgcggaatttttataggaagctggagaccaagggctacggtcagggtcccggaaagctgaagcttattataagacgagaccatttgctcgaagatgcctttaatcagataatgggttactctcgtaaggacctacagaggaataagctctacgtcacttttgtaggcgaagagggcctcgattacagcggacctagtcgcgaattctttttccttgtgagccgcgagctgtttaacccctattatggtcttttcgagtattccgctaatgacacttacactgtgcaaatctcaccaatgtcagcctttgttgacaaccaccatgaatggttccgcttctccggacgtatcctaggtctcgcactgatccatcagtacttgctagatgccttcttcacgcggcctttttacaaggcactcttaaggattctgtgcgatctgtccgatttggagtaccttgatgaagagttccatcagtcactccaatggatgaaagacaatgacatccacgacatactagacctcactttcaccgtgaacgaggaggtttttggccagatcactgaacgagaactgaaacctgggggtgcaaatatccccgtcactgagaaaaacaaaaaggagtacattgaaaggatggtgaagtggaggatcgagagaggggtggtgcagcagaccgagagtctggtaaggggtttttatgaggttgtggatgcgagactggtgtctgtcttcgacgccagggaactagaactggtaattgcaggaacagctgaaatagacctcagcgactggcggaacaataccgaataccgtggaggctaccacgataaccacattgtcattcgatggttctgggccgcagtagaaaggttcaacaatgagcagcgactgagattgctgcaatttgttacgggtacctcatccatcccctatgagggcttcgcctccttgaggggcagtaatggtccaagaaggttctgtgtcgagaagtggggcaagatcaccgcccttcctcgcgctcatacctgctttaaccgattagatctcccaccctatcctagttttagcatgctctatgaaaagctactgactgctgtggaggaaacctccacattcggactcgagtag

SEQ ID NO: 27469 - DNA, 1206 bp, Artificial Sequence
  Description of Artificial Sequence: Synthetic coding sequence
atgtcatgcaggtgttggatcagcagacatccatcgtatgaagggtggaacttgcagtcaatcatttttcacaagcagattagaggcgtggatcttgagagcacatttgtcaccaagttcgggaacaactgttcactacgcctgaatgaaacagtggacatacacaaggagaaagtggccagaagagaaattggaatcctcaccacaaacaaaaataccagtagaacacataaaattatcgcacctgccaatctggagcgaccagtacgttacatcaggaaacctattgactacactatactagacgacatcggacacggggtaaaggtatcgacccagaacatgaaaatgggcggtctgcccaggactacacccccaacccagaaacctccttcgccccctatgagcggtaaaggcactctcggcagacactccccgtatcgcacacttgagcctgtcagaccccctgtggttccaaacgattatgtgccgagccccaccaggaatatggcacctagccagcagtccccagtgaggaccgcaagcgtgaaccaaaggaaccgtacatacagctcttctggatccagcggtggctcccacccttctagtcggtctagtagcagagagaatagtggttccggctctgtaggcgtccctatcgcggtcccgacgcctagtcccccttccgtcttccctggacacccagttcaattttatagcatgaacagaccagcttcacggcacaccccccctacaatcggaggttctctgccttacaggcgcccacctagcatcacgtcccaaacctccctgcaaaaccaaatgaatgggggaccattttattcacaaaaccctgtgtcagacacgcccccacctcctccacccgtggaagaacccgtcttcgacgaatcaccaccgcctccgccacctccagaggactacgaggaagaggaagctgccgtggttgaatactccgatccctatgctgaagaggatccgccatgggccccaagaagctacctggagaaggtggtggccatctatgattatacaaaagataaggaagacgaactctctttccaggagggggctatcatctacgtcatcaagaagaacgacgacggatggtacgaaggtgtgatgaacggggtcactgggctctttccaggaaactatgtcgaaagtatcatgcactactccgagtag

SEQ ID NO: 27470 - DNA, 1428 bp, Artificial Sequence
  Description of Artificial Sequence: Synthetic coding sequence
atggccgaactgcaaatgctgttggaggaagagatccccggaggtcggagagccctattcgattcctacactaatctcgaacgggtggccgactactgtgagaacaactacatccagtctgctgacaaacagcgagccctcgaagagaccaaagcatacactacccagagtctcgcttcagttgcctacctgatcaatactctcgccaataatgtcttgcaaatgttagatatccaggcctcacagttacggagaatggagtcaagcataaatcatatctctcagaccgtggacatccataaagagaaagtggctaggagggagattgggatcctgacaactaacaagaacacttctaggacccacaagattatcgccccagccaatcttgaacggcctgtgcggtatataaggaaacctatcgattatacaatcctggatgatattggccacggtgttaaggtatccacgcaaaatatgaaaatgggtggcctcccaagaacaacgccccctactcagaaaccgcctagccctccaatgagcgggaagggcactctcggacggcattcaccttatcgcaccctggaacccgtgcgtccaccagtcgtgcctaacgactatgtgccttcgcccacccggaacatggcaccttcgcagcaatcgccagtccgcaccgcctctgtgaaccaaaggaatcggacttattcaagcagtggatcaagtggcggatctcaccccagttctcgtagctcgagccgagagaattctggctcggggagtgtgggagtaccaatcgcagtgcccacgccgtctcctccgtcagtgtttcctggacatcctgtgcaattttacagtatgaaccggccagcttctcgacacacaccgcctactatcgggggatccctgccatataggaggccaccctccatcacttcccaaacctccttgcaaaaccagatgaatggcggacccttctattcccaaaaccctgtgtcccttgcaccaccaccaccatccatactacaggtgactccccagctgccgctaatggggttcgttgcacgtgtacaggaaaatatttcggatactcctccgccaccacctccggtggaggagcctgtcttcgacgagtctccccctccccctcctcccccagaagattatgaagaagaagaagcagccgtggtggagtattctgatccttacgctgaggaggaccccccttgggccccacgcagttacctcgagaaggtagtcgccatttatgactacaccaaggataaggaggatgagctgagcttccaggaaggagccattatatatgtgattaagaagaacgatgacggatggtacgagggtgtcatgaacggggtgacggggttattcccaggcaactacgtggagagtatcatgcactactccgagtag

SEQ ID NO: 27471 - DNA, 900 bp, Artificial Sequence
  Description of Artificial Sequence: Synthetic coding sequence
atgaaaatgggaggtctgccacgaactaccccaccaacccagaagcccccttcgcctcccatgtccggaaagggtacacttggatcaagcggctccagcggaggatctcacccttctagtcgatcctcctctcgagaaaacagcggtagtggctctgtgggtgtgcccatcgccgtccctacaccatccccaccttctgtcttccccgcacctgcgggaagtgccggtacacctccactgccagcaacatccgcctccgcccctgctccactcgtgcccgcaactgttccatcatccaccgccccagacgcagcagccggaggagctcaaacgttagccgatggcttcacctctccaaccccaccagttgtcagctcaactcctcctaccggacatcctgtgcaattttattcgatgaataggcccgcttccaggcatacgccgcctacaatcggtggcagcttgccatatagacgtccaccctctatcacgtctcagacatcactgcagaatcaaatgaatgggggtcccttctatagccaaaatcctgtgtcagatactcctcccccaccccctccagttgaggagccagtgttcgatgagtctccaccaccaccacccccaccggaagactatgaggaggaggaagctgctgtggtggagtactccgatccttacgctgaggaggacccaccctgggcgccacgctcataccttgagaaggtcgtcgccatctacgactacacgaaggacaaggaggacgagctgtcattccaggaaggcgcaataatctatgtaattaaaaaaaacgatgacggctggtacgaaggagtaatgaacggggtgaccggcttgttccccggtaactatgtggaatccatcatgcactatagcgaatag

SEQ ID NO: 27472 - DNA, 1926 bp, Artificial Sequence
  Description of Artificial Sequence: Synthetic coding sequence
atggggagaaggtccacatccagtaccaagtctggcaagttcatgaatcccaccgatcaagctcggaaagaggccaggaaacgagagctgaaaaaaaacaagaagcaaaggatgatggtgcgggcagcagtgcttaagatgaaagatcctaagcagattatcagagacatggaaaaacttgacgagatggaattcaatcctgttcaacagccacaattaaatgaaaaggtcttaaaagataaacggaaaaagcttcgggaaacctttgaacgcattctgaggctgtatgaaaaggagaacccagacatctataaagaactgaggaagttagaagtagagtatgagcagaaaagggcccagctctcccagtactttgacgctgtaaaaaatgcacagcacgtcgaagttgagagcattcccctacccgacatgcctcacgctcccagcaacattctgatacaagatatacccctgccaggagcacagcccccttcgatactaaagaagacgtctgcctatggcccacctactcgtgcagttagcatcctccctttgcttggacatggtgttccccgactgcctcccggaaggaagcccccaggcccacctccgggacccccaccccctcaggtcgtgcagatgtacgggaggaaagtaggattcgcactagacttgccccctcgacggcgagacgaagatatgctgtactcccccgagctcgcacagcgcggacatgatgacgacgtatcaagcacaagcgaggacgatggatatccggaggacatggatcaagacaagcacgacgattccactgacgattccgacacggataagtccgacggggaaagtgacggagacgagttcgtgcatcgcgacaacggcgaacgagacaacaatgaggagaaaaaaagtggactgtcagttcggtttgctgatatgcccggaaaatctaggaagaaaaagaagaacatgaaagagttgacacctctgcaggccatgatgctgaggatggcaggccaagagataccagaagagggcagggaggtcgaggaattctccgaggacgacgatgaggatgactctgacgactctgaagctgaaaagcagagtcagaaacaacataaagaggaaagccactctgacggcaccagcaccgcctcatctcagcagcaggcccctccgcagagcgttccaccaagccagattcaggcgcctcctatgccaggcccacccccattggggcctcccccagctcctcctctgaggccccctggccctcccaccggcctgccacctggtcccccacctggcgcacccccatttctacgcccacctggaatgccaggcctccgcggacccttgccaaggctactccccccagggcctcctccagggagaccgccaggaccccctcctggtcccccacccggactcccccctggaccacctccaagaggcccaccaccaagactgcctccaccggctccaccaggcattcccccacccaggcctggaatgatgcgtccgccattagtcccacctttaggtcctgcgcctccaggacttttccccccagccccactgcctaacccaggagtgctgtccgcaccacccaacctgatccagaggcctaaggccgacgatacttccgctgccaccatcgagaagaaggccactgccacgatcagtgcaaaaccacagattacaaatcctaaggctgaaataactagatttgtgcccacagccctgcgagtgcgtcgagaaaacaagggagccacggctgccccacagagaaagtcggaagacgattccgccgtcccactagccaaggccgcacccaaatccggccctagtgttcctgtgtcagtgcagaccaaggacgacgtctatgaggcgttcatgaaagaaatggagggcctcctttag

SEQ ID NO: 27473 - DNA, 4419 bp, Artificial Sequence
  Description of Artificial Sequence: Synthetic coding sequence
atgaaaggaagcgaggtgagcttggagaaaaaaaaaaagatcaaaatgcccgtcaagcgcctccgagaagtagtgtcacagaatcatggcgatcatctcgtgctgctgaaagacgaattaccctgcgttcctcccgcacttagcgccaataaaaggttgcctgttgggaccggaactagccttaatggtacctccaggggttcttctgacctcacatctgccagaaattgctatcagcccttactcgagaatccaatggtcagtgagtcagattttagtaaggacgtggccgttcaggttctgccgctggataaaattgaagagaacaacaagcagaaggctaacgatatttttatatcacagtatacgatgggccagaaggatgcattgcgaacggttttaaagcagaaagctcaatccatgccagtgttcaaagaagtcaaggtgcatcttttagaagatgctggcattgaaaaggacgcggtgacgcaagagacgcgcatttctccctccggcatcgacagcgccaccacagtggcggctgccactgctgcggctatcgctactgccgctccacttataaaggtacagtctgatttagaagctaaagtgaactcagtgaccgagctcctcagtaaactccaggaaacggacaagcacctacaaagagtcacggaacaacagacatctatccaacgtaaacaagagaagcttcactgccacgaccatgaaaagcagatgaacgtctttatggaacagcatatacggcatttggagaagctccaacagcagcagatagacatccagacgcatttcatcagcgccgcactgaagacttcgtcgttccagccggtgagtatgccgagctctcgtgccgtggaaaaatactcagttaagccagaacacccaaacttaggatcatgtaacccgtcactgtacaatacgttcgctagtaagcaggcgccattaaaggaggtggaagatacatcctttgataaacagaaaagcccgctggaaacacctgctccacgaaggtttgcgccagtccctgtctcacgggacgacgaattaagcaaacgcgagaacctactggaagaaaaggagaacatggaggtctcgtgccatagaggcaatgtaagactgctggaacagattttgaataacaatgactccttgactcggaagagcgaatcgtcgaatactacgagcctcacaaggtccaagatcggttggactcctgagaagacgaatcgtttcccaagctgtgaggaattagaaaccacaaaagtgacgatgcagaagagcgatgacgtgctgcacgatctcggacagaaagagaaagagacaaactcaatggtgcagcccaaggaatcactgtcgatgctcaagctgcccgatcttccacaaaacagtgttaagctccagaccactaatacgacaagaagcgtactgaaagacgcagagaaaattttgaggggtgttcagaacaacaaaaaagtgctggaggaaaacctggaggccatcatacgcgctaaggacggggcagctatgtatagtctgatcaacgctctgtctacgaacagagaaatgtctgagaaaatccggatccgaaaaaccgtggatgagtggataaagacaatcagcgcggagattcaggggctgctaaaggcgactacagtcatccaggacgaagattacatgctgcaggtctatggaaagcctgtgtaccagggtcaccgatcaactctgaagaagggaccatacctgcgatttaattccccaagtccaaaaagcaggccccagcgcccaaaggtgattgaacgagttaagggaacaaaggtgaagagtattcggacgcagactgacttctacgcaaccaagcctaaaaaaatggacagtaaaatgaaacactcggtgccagttctgccacacggagatcaacaatatttattctctccttcccgcgagatgcccacatttagtggtaccctcgaagggcacctgattccaatggccatcctccttggccagacccagtccaacagcgacaccatgccaccagctggcgttattgtttccaaaccgcacccggtcactgttaccacctcaatcccaccgtcctccagaaaggtagagaccggcgtgaaaaagcccaacatcgccattgtcgagatgaagtcggaaaagaaggacccgccacagctgactgtgcaggtcttgcctagcgtagatatcgatagtatctcaaattcatccgctgatgtacttagccctctgtccagtccaaaagaagcttcgcttcccccagtgcaaacatggattaaaacccctgagattatgaaggttgatgaggaagaggtcaaatttcccggtacaaatttcgacgagatcatcgatgtgatacaagaagaggaaaagtgcgacgaaatccccgactccgagccaattttggagttcaaccggtctgtgaaggcggattcaactaagtataacggaccccctttccccccagtggcctccaccttccaaccaactgctgatattctcgacaaggtgatcgagagaaaggaaaccctggagaactctctgatccaatgggtcgaacaggagatcatgagtcggataatttccggactgttccccgtgcagcaacagattgcccctagtattagcgtgtccgtatccgagacatcggaaccacttactagcgatatagtcgaaggaacctcaagtggcgcactgcaattattcgtggatgctggggtcccagtgaactctaacgtcattaaacatttcgtgaatgaggcactcgcagaaacgatcgcagtgatgctcggggatcgtgaggctaagaagcagggcccagtggctacgggggttagcggcgacgccagcaccaacgaaacctacctaccagcaagagtctgcacccccttgcccacgccccagcctactccgccatgttctccttcctcacctgcaaaagagtgtgtgcttgtgaagactcccgacagctccccctgcgattcagaccacgacatggcgtttcctgtgaaggagatatgcgcggaaaaaggggacgatatgccggcaatcatgctagtgaacaccccaaccgtgacccccaccacaacgccccctcccgcagctgccgtgtttacacccacgctgtcagacatatcaatcgataaactgaaggtctcctcccccgagctgccaaaaccatggggcgacggtgaccttcctctggaagaggagaaccctaatagcccccaggaggaactgcacccaagggcaatagtgatgtcagtggcgaaggatgaggagccagaatccatggatttccctgcacagccaccacctcctgagccagtccccttcatgcccttccccgctggcactaaagctccgagcccctcacaaatgcccggttcagatagctctaccctcgagtcaactctgagtgtaacagtgaccgagaccgagaccctggacaaaccaatctcggagggagaaatcctgttctcctgcgggcaaaagctggctcccaaaatattggaagatatcggtctttacctgactaacctgaatgactctttgtcctccactctgcacgacgcagtcgagatggaagatgaccccccatcagaagggcaggtgataagaatgtcgcacaaaaagtttcacgccgacgcaatcctctctttcgccaaacagaatcaggagtcagctgtttcacagcaagcagtataccattcagaggacctggaaaattccgtgggagaactgtccgaaggacaaaggccgcagttgaccgcagctgccgagaacattctaatggggcacagcctatatatgcagccccctgtcactaatacacaaagccttgaccagcagtgtgacccaaagccactaagcagacaattcgatactgtctcaggttctatatatgaggattcctgtgcgtcccatggacctatgtccctaggcgaactggagttggagcctaatagtaagcttgttcttcccaccacgctcctgaccgctcaggagaacgacgtgaatctgccagttgctgctgaggatttttctcagtaccagctgaagcagaatcaagacgtcaagcaggtggaacacaaaccatcccagtcttacctgagggtcaggaacaagtctgacattgccccatcacagcagcaggtgtcccccggtgacatggatcggacccaaattgagctaaacccatatctgacctgcgtttttagtggaggaaaggcagtccccttatcggctagtcagatgcccccagctaaaatgagtgtcatgctcccttccgtgaacctagaagactgtagccagtcactgagcctttccacaatgcaagaagatatggagtccagtggagccgataccttctag

SEQ ID NO: 27474 - DNA, 1986 bp, Artificial Sequence
  Description of Artificial Sequence: Synthetic coding sequence
atggaaggagccgctgccccagtagcgggagaccgacctgacctaggactcggcgcacccggatccccaagagaggcagtggcaggggcaaccgccgctctcgagcccaggaaaccccatggcgtgaagagacatcatcacaaacacaacctgaagcaccggtatgaactgcaagaaactcttggcaaaggtacgtatggcaaagttaagcgtgccacggaaagattctctggcagagtggttgctattaaatcaatacgtaaagacaagatcaaagacgagcaggatatggtgcacatcaggcgagagatagagataatgtcaagtctgaaccaccctcacattatttccatatacgaggttttcgagaataaagacaaaattgtgatcataatggaatatgcaagcaagggggagctgtacgactacatatcagaacgtcgtaggctctctgagcgggagactaggcatttctttcgccaaatcgtatcagctgttcactattgtcataagaatggtgtggtgcaccgtgacctgaagcttgagaatatcctgctcgatgataactgtaatataaagattgccgatttcggcctatccaatctgtatcagaaggacaagttcctgcagactttttgtggatctccgctttatgcctcacctgagatcgtgaacggacggccttacagaggccctgaagtggactcgtgggcactgggggtgttgctctatactctggtttacggtacaatgcccttcgatgggtttgatcacaaaaacctcataaggcagatcagttccggggagtaccgggagcccacacagccatcagatgcgcgtggcctaattcgatggatgttaatggttaatcccgaccggagggctacgatagaggatattgcaaaccactggtgggtcaactggggctacaagtcctccgtatgtgactgcgatgccctgcacgattccgaatcccctctactcgccaggattattgactggcaccatcggagcaccggcttacaggccgacacagaggccaagatgaaagggctggcgaaaccgacaacgtccgaagtgatgctggaacggcagagaagtctcaagaaatcgaaaaaagagaacgactttgcacagtccggccaggatgctgtccccgagagcccatctaagctgtcttcgaaacggccaaagggcattctgaaaaagagatccaattcagagcaccggagccattctactggattcatcgaaggcgtcgtgggcccagctttgccatctacattcaagatggaacaggatctctgtaggaccggggtcctcctcccctcctctcccgaagcagaagtgcctgggaaactttccccaaagcagagtgccactatgccgaagaagggaattctgaagaaaacccaacaacgggagagcgggtactattcttcacctgagcggtccgagtccagtgagttgctggactcaaacgacgtgatgggaagttccattccaagtccttcaccacctgaccccgctagggttacatcacatagcttatcctgtcgcaggaagggaatcctaaagcactcctccaagtactctgctggaaccatggatccggctttggtgtctccagagatgccgaccctagagtctctctccgaacctggcgtgcctgccgaaggcctgtctcggagttacagccggccatcatctgtgatctctgacgacagcgtgctctctagtgactctttcgacctcctcgatttgcaggagaatagaccagcccgacagcggatccgatcctgcgtctcagccgaaaattttttacaaatccaggacttcgaagggcttcagaatcgccctcggccacagtacttaaagcgttatcgcaaccgcctggccgactcatccttctctctgctgacagacatggatgacgtaacccaagtttataagcaggccctcgagatctgcagcaagttaaactag

SEQ ID NO: 27475 - DNA, 603 bp, Artificial Sequence
  Description of Artificial Sequence: Synthetic coding sequence
atggcaaatatagcggtgcagcgtatcaagcgtgagtttaaagaggtattgaaatctgaggaaaccagtaagaaccagattaaggtggatctggtggatgagaactttacggaactgcgcggagaaattgctggcccacctgacaccccatacgaggggggtcgataccagctggaaattaaaatccccgagacctaccctttcaatccacccaaagtccgctttattaccaagatctggcatcctaacatctctagcgtcaccggcgctatatgtctcgacattttgaaagaccagtgggccgctgctatgactttaagaaccgtgttgctgtcactccaagccctgctggccgctgcggaacccgacgaccctcaggacgccgtagttgcaaatcagtacaaacagaacccagaaatgttcaaacagacagccaggctctgggctcacgtttacgctggcgcacccgtgtcctcccccgaatatactaaaaagattgaaaatctctgcgctatgggattcgatcggaacgccgtcatagtagcgcttagcagtaagtcgtgggacgtcgaaactgcaactgagctgctgctctccaactag

SEQ ID NO: 27476 - DNA, 5313 bp, Artificial Sequence
  Description of Artificial Sequence: Synthetic coding sequence
atgcctcgcagacggaagaacctgggtggcaacccttttagaaaaaccgctaatcccaaggaagttgtcgtctctagcgtcgccagtagagaagaacctaccaccactctgccttctatgggggagacaaaggttgatcaggaggagctctttaccagcattagtgagatcttttcggatctggatccggacgttgtctaccttatgctcagtgagtgtgactttaaagtggagaacgctatggattgcctcctggagctgagcgccaccgacactaagattgaggagtcaagctcacagagctttgttgccagtgagaaccaggtgggtgccgctgaaagcaaaatcatggagaaacgcccagaggaagagagcgaggatagtaaaatggactcattcctggacatgcagcttaccgaggatttggattccctgatccagaatgcttttgagaagctcaatagctctccagatgatcaagtatatagcttcctgccttctcaggacgtcaatagttttaatgattccagtgaattcattaatcccgactcatccaacatgacacctatcttcagtacccagaatatgaacctcaacggggagaacctggaaaatagcgggtcaacgctgtctttgaaccccctgccaagccattcagttttgaatgagagtaagtgcttcattaaggataacactctcgctttagaatcaaattaccccgaggatagcctcctgtcatcaagtttaaacgtggcgagcgattcgattgccggttgcagtagcttgaaccagaagcagaaagaactccttgagtccgaatgcgtggaggcacagttctcagaggcccctgttgacctagatgcatcagagccccaggcgtgtctcaacctgcccggacttgatttacccggtacaggcggtgatcagaaatcaactagagtatctgacgtgtttctgccttccgagggatttaacttcaaaccacataagcaccctgagctcccgaccaaaggcaaggacgtctcctactgcccggtcttagcaccactcccgctgctactcccacctccaccccctccacccatgtggaacccgatgataccagccttcgacctgttccaaggaaaccacgggttcgtggcacctgtggtgacaaccgcagctcattggcggagtgtgaactatactttcccaccctcggtcatctcccacacaagtccaactaaggtgtggcgcaacaaggacggcaccagcgcctaccaggtgcaggagacgcctgtctcccaggtcgtgcgaaagaaaacatcttatgtgggcttggtcctcgtgctgctgagagggttgccaggcagtgggaaatcttttctggcacgtacccttcaggaggacaatccctccggggtgatcctgagtaccgatgattatttctacataaacggtcagtaccaatttgacgtcaaatacctaggagaggcccatgaatggaaccaaaatcgagccaaggaggcttttgagaagaagatttccccaatcattattgacaatactaatttgcaggcctgggagatgaagccttacgtagcactgtcccagaaacacaaatacaaggtcctgtttagggaaccggacacatggtggaagttcaaaccgaaggaactggctcgacgtaatatccacggggtatctaaggaaaaaatcacccgtatgctggagcactatcagagattcgtttctgttcccattatcatgagttctagcgtgcccgagaagatagagcggattgaactgtgtgcctatagctgtgaggacaggagcacatctccacgggatgatgaagacatcataagtgaaaaagaggagaatatcctgtccttaagtctgaagcacctggaatttactgaagaaaaaaatctggatgtcacaaaagagacaatgctgcccgagaacgttgcatatttgtctaacgctgatctgaacaagagacgtaaggagatctcagacatgaatccatccatccagagcgccctgattttagagaccccacacatgtacttcagcgacagcgagtcaaagctccaagccactgataaaagcgaaaacgagcagatcgagatggtggcagtgaaaggttactccaagaccgacaccgattctagcatggagagggtgagcccctctacatgttgcagcgaaaataaccaggaggattgcgatctcgccaattccggcccactgcagaacgaaaagagcagccctggcgaaattgtggaggagcgagctactgtgactaagaaagccttcggcaagcagaaaagcaagtccaccctcgagaaattcccaaggcacgagctcagcaattttgtgggagactggcccgtagacaagaccatcggtcagcgtaccaagcgcaaccgcaaaaccgagaaaacctcttctgttcaatccgataagaaatataattacccacaatcgcacaaactcgtgaactcagtgagcgtgaataccgattgtgtgcagcagagaggcagtccccacgagtcagtggaagatggtcgaaaaagtcagtgcgatgacgctagcgaacccctgaattcctataaatatgatgcctataaaaatattgacaaaaatagctttaacatcatgggggattggccttcatctgactctctggcccagagggaacataggtctaggatgcctaagaccggcctctccgaaccgaacttggaaatcggtacaaatgacaaaatgaacgagatcagtctctcaactgctcacgaagcctgctggggcaccagttcgcagaaactgaagaccctgggaagctccaacctgggcagttctgagatgttattgtctgagatgacctgcgagtcccagacatgtttatctaagaagtcacacggccagcacacaagtttgccgttgacatttacgaatagtgctcccacggtttctggagttgttgagccccaaacgctcgcagagtgccaagagcaaatgcccaaacgcgatccagggaaggaggtcggaatgtgtacccagactgagccacaggatttcgcattactctggaagattgagaagaacaaaatcagtattagtgactcaattaaagtgctcaccgggaggctagacgggtttaaaccaaaggtgttcaacattaacaccaagagtgatgtccaggaagctattccctatcgggttatgtacgacaaatctacatttgtcgaagagagcgagctcacgtcagcagatgagtcagagaacttaaatatcctctgcaagctgtttgggtcattttcgttagaagccctgaaagatctgtacgaacgatgtaacaaggacattatttgggccacctctctcctgctggatagcgaaactaagctgtgcgaggataccgaatttgagaacttccaaaagtcttgcgacgggagtcagatcgggcctttctccctggggttgaatttaaaggagattatcagtcagaggggaacactcgaaaatagcaattctcctgttccagagttctctcacggcattggaatctcgaatgctgattcacaatccacttgtgatgctgagcggggaaattctgagcaggcagaaatgcgcgctgtcacgcccgaaaaccatgagtctatgacctccatattcccaagtgcggcagttgggctgaagaacaataacgacatcctccccaattcccaggaagaactcttatactcctccaagcagtcgttccctggcatacttaaggctaccacaccaaaggacatgtcagaaacagagaagaacctggtggttacagagactggtgataatatccactctccgtctcattttagtgatattttcaattttgtatctagcacatcaaatttggaactgaacgaggaaatctactttaccgactcgctggaaataaagagaaatgagaactttcccaaagactatgtgaaattttctgacgaagaggagttcatgaacgaggacgagaaggagatgaaggaaatccttatggcgggtagcagcctttctgcaggcgtgtcaggagaggataagactgaaatcctcaacccaaccccagctatggccaagagtctgaccattgactgtttagagctggctctcccaccagagctagccttccaactgaacgaattgttcgggcctgtgggtatcgactccggatcactgacagtcgaagactgtgtagtacatattgatctaaatctggccaaggttatccacgaaaagtggaaagaatccgtcatggaaagacagagacaggaggaagtaagttgcggcaagttcatgcaagatcccagcctagttggtcatacaggcctggataaccctgaacagaagagctctcagcgaaccggaaaaaagttactgaagaccctgaccgctagcgagatgttgccattgctagatcattggaatacccagaccaagaaagtttctctaagagagataatgtccgaagagattgctctgcaagagaaacataatcttaagagggagaccctaatgtttgaaaaagattgcgcgactaagttgaaagaaaagcagctgttcaaaatttttccggcaattaaccagaacttcctggtcgacatctttaaggaccataactactctctcgagcacaccgtgcagttccttaattgtgtcttagaaggtgatcctgtaaagactgtggtcgcccaagaattcgtgcatcaaaatgagaacgtaactagccatacaggccagaagagcaaggagaagaagcccaagaaactgaaggagacggaagaaactccatccgagctgtcttttcaagactttgaataccccgactatgatgattatcgggcagaggcttttctgcatcagcagaagcgcatggagtgctactccaaggcgaaggaagcttaccgtattggcaagaaaaatgtagcaactttttatgctcagcaaggtaccttacatgaacagaaaatgaaggaagcaaatcaccttgcagcaatcgagatttttgaaaaggtgaatgcctctctgctgccgcagaatgtgctcgatttacacgggttgcatgttgatgaggcacttgagcatctgatgagggtcctcgaaaaaaagaccgaggaattcaagcagaatggcggtaagccttacctctcagttataaccgggagaggtaaccacagccaggggggtgttgcccgaattaagcccgctgtgatcaagtacctgatcagtcacagtttcagattttctgaaatcaagccaggctgtctcaaagtaatgctcaagtag

SEQ ID NO: 27477 - DNA, 1362 bp, Artificial Sequence
  Description of Artificial Sequence: Synthetic coding sequence
atggactggaaggaggtgctgcggaggcgtcttgctacacccaatacgtgccccaataagaaaaaatccgaacaggaactcaaggacgaggaaatggacctgttcacaaaatactactccgagtggaagggcggtaggaaaaatacgaacgagttttataagacaattcctcgcttttattaccggcttcccgcagaagacgaagtgctgctgcagaaactgagggaggaaagccgagccgtgttcctgcaacgcaaatcccgggaactgctggataatgaagaactacaaaacttgtggttcctgctggacaagcaccagactcccccaatgattggtgaagaggccatgatcaattatgaaaactttctgaaggtgggagaaaaggctggcgctaaatgtaagcagttctttacagctaaggtctttgctaagctactgcacacagattcgtatggccgtatttctatcatgcaattctttaactacgttatgcgcaaggtctggttgcaccaaacccgaattgggctgtcactctacgacgtcgctggacagggctatcttcgcgagtccgacttggaaaactatatccttgaactgatccctacattgccccagcttgatggcctggagaaatccttttattcgttctacgtctgcacggcggttcgcaagttcttttttttcctcgacccactacggaccggaaagattaagatacaggacatcttagcctgctcgtttcttgacgacctgctcgaactgagagacgaagaactttctaaagaaagccaggaaactaattggtttagcgcccctagtgccctgagagtctatggacagtatctgaatttggacaaagaccataacggcatgctgagtaaagaggaactcagccgatatggcacagcaactatgactaatgtgttcctggaccgggtctttcaggagtgtcttacctacgacggagagatggattacaagacctaccttgacttcgtcctggctctggagaaccggaaagagcccgcagctttacagtatatcttcaaactgctggatatagaaaacaaaggttacctcaacgtcttcagccttaactacttttttagagctatccaggagttaatgaagattcacggccaagaccccgtaagctttcaggacgtcaaggatgagatattcgacatggtcaagccgaaagaccccctgaagatctcattgcaggacttgatcaactcaaaccaaggggacacagtaacaacgatcctgattgacctgaacggcttttggacatatgagaaccgagaggccctggttgctaacgatagtgagaattcagccgatcttgatgacacatag

SEQ ID NO: 27478 - DNA, 3348 bp, Artificial Sequence
  Description of Artificial Sequence: Synthetic coding sequence
atgcctgaagatcaggtcggtaaactggaagctacggagaatactatctcggccatggcagctgctgcagctgagcagcaacagttttacctacttctcgggaatctgctgtcccctgacaacgtggtccgaaagcaagcggaagagacctacgaaaacattccaggtcagagcaagattacctttctgcttcaagccattaggaacaccaccgctgccgaggaagctaggcagatggctgccgtcttgctgcgcaggctgctcagttctgcatttgatgaagtgtatccagctctgccctccgatgtccagacagctatcaagtccgaactgttgatgattatccagatggagacacagtcaagtatgcgaaagaaggtctgtgacatagcagccgaactcgccagaaaccttattgacgaagatggcaacaaccagtggcctgaaggactgaaattcctttttgattcggtctccagccagaacgtggggctgcgcgaagccgcactgcatattttttggaactttcccggaatcttcggcaatcagcagcagcactacctggatgtgatcaaaaggatgctcgtgcagtgtatgcaagaccaagagcaccccagtattcgtaccctgagcgctagagccaccgccgcattcattttggcaaatgagcataatgtagccctgttcaagcactttgccgacctgctaccgggatttctacaggccgtgaatgacagctgttaccaaaacgatgatagcgtgcttaagagccttgtggagatcgctgacacggtaccgaaatacttgagaccacatttggaagctaccctgcagctgtctctgaaactgtgtggggatacatcattaaacaacatgcaacgacaacttgcattggaagtaatcgtgaccctgtccgaaactgccgcagctatgctcagaaagcacacaaatatcgtggctcaaactatacctcaaatgctggccatgatggtggacttggaggaagacgaagactgggctaatgcggacgaactggaagatgacgattttgactccaacgctgtcgccggtgaaagtgccttggatcgcatggcctgtggcctgggtgggaaattggtgctgcccatgataaaggagcatataatgcagatgcttcaaaacccggattggaagtacaggcatgccggtctcatggctctttctgcaattggcgagggctgccaccaacaaatggagggcatcctgaatgagatcgtgaacttcgtgctgctgttcctgcaggatccccatcccagagttcgttacgctgcttgcaatgcagtggggcaaatggccactgacttcgctcctgggtttcagaaaaaattccatgagaaagtgattgccgctctcctgcagaccatggaagaccaggggaatcagcgcgtgcaggctcatgctgctgctgccctgattaactttaccgaagactgccctaaatcactgctgattccttacttggataatcttgtcaagcatttgcattcaattatggtgttgaaactgcaagagctcatccagaagggaactaagctcgtcttggaacaagtggtgaccagtatcgcatctgtggcagataccgccgaagagaaatttgttccatattacgacctgttcatgcccagtctgaagcacatcgtcgaaaatgcagtgcaaaaggagctgaggctcctgcgcggtaagactatcgagtgtatttcgctgataggccttgccgtgggcaaggagaagtttatgcaggacgcctcagacgtgatgcagctgctgctcaaaacccagaccgatttcaacgacatggaagatgacgatcctcagatcagctatatgatatcagcatgggccagaatgtgtaagattctcgggaaggagttccagcagtatctgccggtggttatgggaccgctgatgaaaaccgcttctatcaaaccggaagtggccttgttggacacccaggatatggagaatatgtctgacgatgacgggtgggagttcgtgaatctgggcgaccagcagtccttcggtatcaagactgccggactggaggaaaaatctacagcctgccaaatgctcgtttgttacgctaaagaactgaaggagggatttgtagagtacactgaacaggtggttaagctgatggttccactgcttaagttttactttcacgatggggttagggtggctgctgccgagtctatgcccctgttgctggaatgcgctcgggtccgtggccctgagtacttgacccagatgtggcactttatgtgcgacgctctcattaaagctatcggcaccgagccagattctgacgtgctttcagagatcatgcactcgtttgccaaatgtattgaggtcatgggagatgggtgcctcaataacgagcattttgaggagttaggcggaattctgaaagcaaaattggaagagcacttcaaaaatcaggaactcaggcaggtaaagagacaagatgaggattatgatgaacaggttgaagagagtctacaggacgaggacgataatgacgtttacattttgacaaaagtgtctgacatcctgcacagcatctttagcagttacaaggagaaggttctgccatggttcgagcaactgttgcccctgattgtgaacctgatctgccctcaccgcccttggcctgacaggcagtggggcctatgcatcttcgacgatgtgattgaacactgctcgcctgcttcattcaaatacgcagaatattttttgcgccctatgctgcagtacgtgtgtgacaactcgccagaggtaaggcaggccgcagcatacggcctgggagtgatggcacaatatgggggtgacaattatagacccttttgtacagaagccttgccactgcttgttagagtcatacagtctgccgactccaaaacgaaggaaaacgtcaacgcaacagaaaactgtatcagtgcagtcggaaagatcatgaagtttaaacctgattgcgtgaacgttgaggaggtcttgccccattggctgagttggctgcccctacacgaggataaagaagaggccgtccagaccttcaattacctgtgtgacctaattgagagcaatcaccctatcgtcctggggcctaataatactaacttaccaaaaatctttagcatcatcgccgagggtgagatgcatgaagccataaagcatgaagacccttgtgccaaaaggctcgctaatgtggtgcggcaggtccagacctcggggggactgtggactgagtgcatcgcccagctgtcccctgaacagcaagcagcgatccaggagctgctgaacagcgcctag

SEQ ID NO: 27479 - DNA, 1929 bp, Artificial Sequence
  Description of Artificial Sequence: Synthetic coding sequence
atgaagaggtcgagtgtgagcagtggaggagccggaagactgtcaatgcaggagctgcggtctcaggacgtgaacaaacagggcttgtataccccacaaaccaaggagaagccaactttcggtaaattatctatcaacaagccaaccagtgaaaggaaggtgagtctgttcggaaagcgtacctctgggcatgggagcaggaacagccagcttggaattttctccagctctgagaagatcaaggaccccaggcctctgaacgataaggcatttattcagcagtgtatcaggcagctgtgtgaattccttactgaaaatggttatgctcataatgtgagtatgaaatcgttgcaggccccatcagtcaaagatttcctcaaaatattcacttttctttacggttttctgtgcccttcatatgagctgcctgacacaaaatttgaagaggaagtgcctcggatttttaaggacctgggatacccatttgccctttcgaagagtagcatgtatacggtgggcgctccccacacttggccacacatagtagccgctttggtgtggctcatcgactgcattaaaattcacacagccatgaaggaatcaagtccgctgtttgacgacggacagccatggggggaagagaccgaggacggcatcatgcataataagctgtttttggactacactattaaatgctacgaatccttcatgagtggcgctgatagtttcgacgagatgaacgccgaactccagagcaagctgaaagatttgttcaacgtcgatgcatttaagcttgagtcgctcgaagcaaagaatcgtgccttgaacgagcagatcgcaagactggaacaagagagagagaaggaaccaaaccggctggaaagtctgcgaaaactaaaggcctctctccagggcgacgtccaaaagtatcaagcctacatgtctaacctggaatcccattccgccatcctcgatcaaaaactcaacggcctgaacgaagaaatagctagagttgagctcgaatgtgagacaatcaaacaagagaatacgagactacagaacattatcgataatcagaaatatagcgtcgccgacattgaacggattaaccatgagcggaatgagttgcagcagacaatcaataagctgactaaggacctggaagctgagcagcagaagttgtggaatgaagaactcaaatatgcgaggggtaaagaagcaattgagacgcagctcgccgagtatcataagctcgcacggaagttgaaactcatccctaagggagcagagaattccaagggatacgatttcgagataaaatttaatccagaagcaggggctaattgcctggtgaaatatcgagcccaggtgtacgtacctctcaaggaattgctgaacgaaaccgaagaggaaataaataaagcactcaataagaaaatgggattagaagatactctggagcagttgaacgcaatgatcactgaatccaaacgctctgtgcgaacactgaaagaggaggttcagaaactcgacgatctgtatcagcaaaaaatcaaggaggccgaggaggaggacgaaaaatgcgcaagcgagctggaatccctcgagaaacacaagcacctactggaaagcacggttaaccagggtctttcggaagctatgaacgagctggatgcggtacagcgggaataccagcttgtcgtccaaacaaccacggaggaacgtagaaaagttgggaacaatctccagcggctgctggaaatggtggcaacgcacgttggatcagtcgaaaagcatctggaggaacaaatcgcgaaggtggaccgagagtacgaagagtgtatgtccgaggatttgagcgagaatatcaaagaaatccgggataagtacgaaaagaaggcaacattaattaagagctccgaagaatag

SEQ ID NO: 27480 - DNA, 4770 bp, Artificial Sequence
  Description of Artificial Sequence: Synthetic coding sequence
atgagccttccattctaccagaggtgccatcaacactacgatctttcatacaggaacaaagatgtccgatctaccgtgtctcattaccaacgagagaaaaaacggtccgctgtgtacacccagggatccacagcttatagctcccgttcctccgctgctcaccggagggagtccgaggcatttaggagagccagtgcctccagttcacagcagcaggcatcccagcacgcgttgagtagcgaagtttcccggaaggccgcatccgcatatgattatgggagctctcacgggctcacagattcatctctgttgctcgacgactacagctccaaactgagcccgaaacccaaacgcgcaaagcatagtctcctgtccggtgaggaaaaggagaacctcccaagcgattacatggtgcccattttcagcggccgacaaaagcacgtttctgggatcactgatacggaggaagagaggatcaaggaagctgccgcttacatcgcacagcgcaatcttcttgcatcagaggaaggcatcactacctccaaacagtcgacggcatccaaacaaaccactgctagcaagcagtctactgcgagtaaacagagcaccgcatccaaacaatccaccgcttcgcgtcagtctaccgcatctcggcaatctgttgtatctaagcaggcgacatcagccttgcaacaggaagagactagcgagaaaaagtcccgcaaagtcgtgattcgtgaaaaagccgaaaggctgagtttgcggaaaaccttggaggagaccgagacctatcacgcaaagctgaatgaggatcatctcctgcatgcccctgagtttatcattaagccgcgttcgcacaccgtgtgggagaaagagaacgtgaagctgcattgttccatcgcgggatggccagaacctagggtgacctggtataagaaccaggtacctatcaatgtgcacgcaaaccccggtaaatatataatcgaaagtaggtacggcatgcacactctcgaaataaatggatgtgattttgaggatacagcccaataccgggctagtgctatgaacgtaaagggtgaactgagtgcttatgcttctgtggtggtgaaacgatataagggcgagtttgatgagaccaggtttcacgcgggtgcttcgaccatgccgctctcgtttggcgtgacaccatacggctatgcttcacggttcgagatccatttcgacgataagtttgatgtatctttcggcagagagggcgaaaccatgtcactcggctgcagggtggtgattacgccggagatcaaacactttcagcccgagatccagtggtacaggaatggggtcccattgtctccgtccaagtgggtgcagactctctggagcggagagagagcaaccctgacgtttagccacctgaataaggaggacgagggtctctacacaatcagggttagaatgggcgagtattacgagcagtacagcgcttacgtgtttgtgcgggacgccgatgctgagatcgagggggctcctgcagccccattggacgtcaagtgtttggaggccaacaaagactatattatcatttcctggaagcagccggcagtggacggcggaagcccgatccttggctattttatcgacaaatgtgaggtcgggactgacagctggtcccagtgtaatgacacccctgttaaattcgccagattccctgtgaccggcctgattgagggccgatcctatatctttagagtaagagccgtaaataagatgggcatcggattcccatctagagtctcagaaccagtcgccgcactggatcctgccgagaaggctcgtctcaaatcaaggcctagcgctccttggacagggcagatcatcgtgacagaggaggaaccaagcgaaggaattgtgcctgggcctccaactgacttgtctgtgacagaagccactcgttcttacgtggtgctgagctggaagcctcccggacagaggggtcacgaaggaatcatgtatttcgtggagaagtgcgaggcagggaccgagaactggcaacgagtgaatactgagttgccagtcaagtcccctcgattcgctctgtttgacctcgcagaaggcaaaagttattgctttcgcgttcggtgttccaactccgctggcgtaggcgaacctagcgaagcaactgaggtgacagtcgtgggtgacaaattggacataccaaaagcgccagggaaaatcatcccgtctcgcaataccgataccagtgtcgtggtctcatgggaagagtccaaggacgctaaggaactggtgggatactacatagaagcttctgtggccggatccggcaaatgggagccgtgtaataataacccagtcaagggcagtcgttttacctgccacggcttggtgacgggccagtcatatatattccgagtgcgggctgtgaatgccgcaggattaagcgagtattcccaggactccgaagccatagaagtcaaagccgctatcgctcctccgagtcctccttgtgatatcacgtgcctggagtctttccgggactctatggtccttggctggaaacagcctgataagatcggcggagcagagattactggctattacgtgaactaccgggaggtcattgacggagtacctggtaagtggagggaggcgaatgtgaaggctgtcagcgaggaggcctataaaatcagtaacctgaaggagaatatggtctatcagtttcaagttgccgctatgaacatggctggtttgggtgcccctagcgctgtgagcgagtgtttcaaatgcgaggagtggactatagccgtacccggacccccacactccttaaaatgttccgaggtgagaaaagattcgctcgtcttgcagtggaaaccaccagtgcactcaggcagaactcctgtgacaggatactttgttgatttaaaagaagccaaagctaaggaagaccagtggcgaggactgaacgaagcagcaatcaaaaatgtctacctgaaggtcagaggcctaaaagaaggtgtctcatatgtctttcgtgtgagagccataaaccaggctggagtaggaaaaccgagcgatttggcaggccctgtagttgccgagacccggcctggaactaaggaggtcgttgtgaacgtcgatgacgacggagtgatctcactcaactttgaatgtgacaaaatgactcctaaatctgagttttcctggtcaaaagactacgtctctaccgaggactctccacggctggaagtggagtctaagggtaataagaccaagatgacttttaaagacctcggcatggacgatttgggcatttactcctgtgacgtaactgataccgatgggatcgcctcatcctatctcatcgatgaggaggagctgaagagattgctggccttgagccatgagcataaatttccgacagttccagtaaagtcagaattagctgtggagattttagagaaaggtcaagtgaggttctggatgcaggccgaaaagttgagtggcaacgcgaaggtgaattacatattcaatgagaaggaaattttcgaggggcctaagtataagatgcacatagatcgcaatactggaatcatcgaaatgttcatggaaaaattacaggacgaggacgaaggaacctatacttttcagctgcaggacggaaaggctacgaaccactctaccgtagttttagttggggacgtctttaagaaacttcagaaagaggccgagttccagcgccaggaatggatccgtaagcagggtccgcattttgtagaatacctatcctgggaagttacgggagagtgtaatgtgctgctcaaatgcaaagtcgccaatataaaaaaggagacccatatagtctggtacaaggatgagcgggaaattagcgtggacgagaagcatgacttcaaagacgggatctgcacgcttttaataactgagtttagcaaaaaggatgccggaatctatgaagtgattctgaaagatgaccgaggaaaggacaagtctcggctgaagctggtggacgaggcctttaaggaactgatgatggaggtgtgcaagaagattgccttgagcgccaccgatctgaagatccaatctaccgctgagggcattcagttatacagctttgtaacctactatgtggaggacttaaaggtgaattggtcacacaatgggtcagctatccggtacagcgatcgcgtgaaaacaggagtcaccggcgagcagatctggctgcaaataaacgaacccacaccaaatgacaagggtaaatacgtgatggagctgttcgacggtaaaacgggtcatcaaaagactgtagatcttagcggccaagcatacgacgaggcttatgctgagtttcagaggttgaaacaggcggctatcgccgaaaagaacagggccagagtcctgggaggactccccgatgtggtgacgatccaagaagggaaagctctgaatctcacatgcaatgtttggggcgatccccctcctgaagtatcatggttgaagaatgagaaagctctggcgtctgacgaccactgtaacctgaaattcgaggccggtagaaccgcctactttactatcaatggggtgtctaccgcagacagcgggaagtacgggttggtcgttaaaaataaatacgggtcagagacctcggactttacagtctctgttttcatccctgaagaagaggcaaggatggcggctcttgaaagtctgaaggggggaaagaaggctaagtag

SEQ ID NO: 27481 - DNA, 546 bp, Artificial Sequence
  Description of Artificial Sequence: Synthetic coding sequence
atggggggatttttctcatcgattttttccagcctgttcggcacgagggagatgagaattctgattttaggactcgatggcgcaggtaagaccaccattctctaccgactccaggtgggggaggtcgtgactactatacccacgattggtttcaatgttgagacagtcacgtataaaaatctgaagttccaggtttgggatctgggcggacagactagcatacgaccatattggagatgttactacagtaatactgacgccgtgatatacgtggtggactcctgcgacagagatagaatcgggatatcaaaatccgagctggttgccatgctggaggaggaagagctgagaaaggccatcctggtcgtgtttgccaataagcaggacatggagcaggccatgaccagcagcgagatggccaacagcttaggcctgcctgcactcaaggacaggaaatggcagatttttaaaacttcggccacaaaggggacaggattagacgaggcaatggagtggctcgtcgaaactctgaaatcaagacagtag

SEQ ID NO: 27482 - DNA, 1269 bp, Artificial Sequence
  Description of Artificial Sequence: Synthetic coding sequence
atggccgctgccgctgttgtagagtttcaaagggcccagagcctcttatccacggatcgagaagcatccattgatattctgcacagcatagtaaagcgggacattcaggaaaacgacgaggaagctgtgcaggttaaagagcagtccattcttgagctcggaagcctactggccaaaaccgggcaggccgcagagcttggtggactcctgaagtacgtcaggcccttcttaaatagcatatcgaaggcaaaagcagctcgccttgtaagatcattgctggacctcttcctggacatggaggccgcaaccgggcaagaggttgagttatgcctggagtgcatcgaatgggccaagagcgaaaagagaacgtttctgaggcaggccttggaagcccgactggtgtccctatactttgacactaagaggtaccaggaagccttacatttaggcagccaactgctcagggaacttaaaaagatggatgataaggcattgctggtcgaggtgcaattacttgagtcaaagacttaccatgccctttctaacctgcctaaggctcgagccgctctgacttctgctaggaccaccgctaatgctatctattgcccgcctaagctccaagcaacgctcgacatgcaatcaggcatcatccacgctgccgaagagaaggactggaaaacagcttacagctatttttacgaggctttcgaaggatatgactccattgactcccccaaggcaatcacaagccttaagtacatgttgctatgcaagatcatgctgaacacccctgaggacgtgcaggcactagtatccggcaagttagccctgcgctacgcgggacggcagacagaggctcttaaatgtgtggcccaagcttctaaaaaccgctccttggcagacttcgaaaaggccttaacagactatagggccgaattaagagacgatcccataatctccactcatctcgccaagttgtatgacaatctgctggaacagaacctgattcgggtgattgagccgttctccagagtccagatcgaacacatatcaagcctgatcaagctgagtaaggccgacgtggagcgaaagctgagccagatgatcctggacaaaaagttccatgggatcttggatcaaggcgagggggttttgatcattttcgacgaaccccctgtggacaagacctacgaggctgcgctggaaaccatccaaaatatgagcaaggtggtcgactcactctataacaaagctaaaaagctgacatag

SEQ ID NO: 27483 - DNA, 1449 bp, Artificial Sequence
  Description of Artificial Sequence: Synthetic coding sequence
atggccagcctgggacccgcagctgccggagagcaagcaagcggtgcggaggcagagcccggaccagctggcccaccacctccaccaagtccgagctcgctaggacccttgctgcccctgcagcgcgagcccctctataactggcaggccaccaaggcctcactcaaggagagatttgcattcttattcaacagtgagctcttgtccgatgtgcgctttgtgctgggaaaaggcagaggcgctgccgcagccggtggtcctcagcgaattccggctcacaggtttgtgttagctgcgggatccgccgtttttgacgctatgtttaatgggggaatggcgaccacctcagcagagatagaattgccggacgtggaaccggcagccttcctcgcactcctgcgttttttatactctgacgaggtgcagattgggcctgaaaccgttatgaccacactctacacagccaagaaatacgccgtcccggctctcgaagcacactgtgtggaattcctcactaagcacctcagggcagacaatgcatttatgctgttaacccaagccaggctatttgatgagcctcagctggcttctttgtgtctagatacgattgataagtcaactatggatgctatttccgcagagggcttcactgacatagacatcgatacactatgtgcagttctggagcgcgataccttgagcattcgagagtccagactcttcggcgcagtcgtcaggtgggccgaagccgagtgccagaggcagcagttgcccgtaacattcggtaataagcagaaagtgttgggaaaggcgctctccctgatccggtttcctctgatgacaattgaggagtttgccgctggtcccgctcaaagcggcattctgtcagaccgtgaggttgtaaatttgttcttgcattttaccgtgaatccgaagcctcgggtggagtatatagaccgtccacgctgctgcttaagagggaaggaatgttgcattaaccgcttccagcaagtggagagcagatgggggtatagcggcacttcggatcgaatcaggttcaccgtcaataggagaatctccattgtggggtttggcctgtacggttcgattcacgggcctaccgattaccaggtgaacatccagattattgaatatgagaagaaacagaccctagggcaaaatgatacaggcttctcctgcgacggtaccgccaacaccttccgcgtaatgtttaaagagcccatcgagatcctgcccaatgtttgctacactgcttgcgctacgctgaagggtcccgacagccactatggcaccaagggactgaagaaggttgttcacgaaaccccagcggcaagcaaaactgtattcttctttttctcttccccgggtaacaataacgggacatccattgaggacggccagattcctgagataattttttacacttag

SEQ ID NO: 27484 - DNA, 2883 bp, Artificial Sequence
  Description of Artificial Sequence: Synthetic coding sequence
atgtcccggttgatcgttaagaatcttcccaacggaatgaaagaagaacgcttcaggcagttattcgcagcctttggaacactcactgattgttcactcaagtttactaaggatggcaagttccgcaaattcgggttcatcgggttcaagtctgaggaggaggcccagaaagcccaaaagcattttaacaagtcttttatagacacttcaaggataactgttgaattctgtaagagtttcggggaccccgcaaagccaagagcctggtctaaacacgcccagaaacctagccagcccaaacagccaccaaaggactccacgaccccagaaatcaaaaaagacgaaaagaaaaaaaaggtagcgggtcagcttgagaaactgaaggaggacacagaattccaggaatttttatcagtccatcagcggcgtgcgcaggccgctacctgggctaatgatggcctcgacgcagaaccaagcaagggcaagtcgaaacccgcttccgattacctgaatttcgattccgacagtggacaggagtccgaagaggagggagccggagaggatctggaggaagaagcctcgctcgagcctaaagcagcggtgcagaaggaactctctgacatggactacctcaaatccaagatggttaaggccggaagctctagctctagtgaggaggaagaatctgaggacgaagccgtgcattgcgacgagggttccgaagccgaggaggaggatagtagtgccactcccgttcttcaagaacgagattccaaaggagctggtcaggagcagggaatgccagctgggaagaaacgacctcctgaggcccgagccgaaaccgagaagcctgccaatcagaaggagccaaccacttgtcatacagttaagctgcggggtgccccattcaacgtgacagaaaagaatgtgatggagttcctcgctcccttgaaacccgtcgccataagaattgtcagaaatgcccacggcaataaaaccgggtacatctttgtagacttctccaatgaggaggaagtgaaacaagccctgaagtgcaatagggaatatatgggtggtcgctacattgaggtctttcgcgagaagaacgtgcctacaaccaagggtgccccaaagaacaccactaagagctggcagggaaggatcctaggagaaaatgaggaggaggaggacttggctgagtctgggaggctgttcgtcagaaacttgccttatactagtacagaagaggatcttgagaagctattttcaaagtacggacccctgagtgagcttcattatccaatcgactctctgacgaagaaacccaaaggattcgccttcatcactttcatgtttccagagcacgccgtgaaggcttattccgaggtagacgggcaggttttccagggcaggatgctgcatgtccttccgagcactatcaaaaaggaggcttcagaggatgcttcagccctgggctcctcctcttacaaaaaaaagaaagaggcacaagataaggccaatagcgcttcttctcacaattggaatacgctgttcatgggcccaaatgctgtggccgatgcgatagcgcagaagtacaatgcaactaagagtcaggtgttcgaccatgaaactaagggctcagtggccgtaagagtagccctaggggaaacccagctcgtccaggaagtcagacgattcctcatcgataatggggtgagcttagattcttttagtcaggccgcagccgagcgctcaaagacagtgatcctggtgaaaaatttgcccgctggcaccctggctgcccagctgcaagaaaccttcggtcacttcggatcactgggaagagtactgctgcccgaaggtggaatcactgctattgttgagtttctggagcctctcgaagcacggaaggcatttaggcacctcgcatatagcaagtttcatcatgtccccttgtacctagaatgggccccagtcggagttttttccagtactgctccgcagaagaagaaactgcaggacaccccatcagagcctatggagaaagatcccgcagagcctgagactgtgcccgacggtgagacgccggaagacgagaacccgacagaagagggcgctgacaactcatctgccaaaatggaggaagaggaggaggaagaggaggaagaagaagagtctctccctgggtgtactctgtttatcaagaacctgaattttgatacgactgaggaaaagctcaaggaagtctttagcaaagtgggcaccgttaaaagttgctcgatctcgaagaagaaaaacaaggccggagtactcctgtcgatgggatttggctttgttgagtacaggaaaccagaacaagcacagaaagccctcaagcagctgcagggacacgtagttgacggccacaagctcgaagtcagaatctcagaaagggctacaaagcctgcagttacgctagccaggaagaagcaggttcctagaaagcagacaacttccaagatcctggtccgtaatatcccatttcaggctcattcccgggaaattcgtgagctgttttccaccttcggtgagcttaaaactgtccggctgcctaagaaaatgactggtacgggcacacatcgcggatttggcttcgtggatttcttgactaaacaggacgcaaaacgcgcatttaacgcgctatgccatagcacccacctttatggtcgcaggttggtgcttgagtgggctgattccgaggtgaccctccaagccctcagacggaaaaccgccgctcatttccacgaaccccctaagaaaaagcgaagtgtagtgctagacgaaatcttggagcagctagagggctccgactccgattccgaggaacagactctgcagctgtag

SEQ ID NO: 27485 - DNA, 2919 bp, Artificial Sequence
  Description of Artificial Sequence: Synthetic coding sequence
atggccacgagggggcatgttcaggaccctaatgaccgcaggctgagacccatctacgactatcttgataatggcaacaacaagatggccatacaacaagctgacaagttgttaaagaagcataaagatcttcactgcgccaaggtgcttaaagcgataggcctgcaacgtaccggcaagcaggaagaagcattcaccctggcccaagaggtagccgctcttgaaccaaccgacgacaattcccttcaagcgctcacaatcctctatcgcgagatgcaccgaccagagctggtgaccaagctctacgaagctgcagtcaagaaagtgccaaattcagaggaataccattctcatctcttcatggcctacgccagggtcggagagtataagaagatgcaacaggccggtatggccctctacaagatcgtgcccaaaaatccttactacttctggtcagtgatgtcgctgattatgcagtcaatttccgcccaagacgaaaatctgtctaaaacaatgtttttgccattagccgagagaatggtggaaaagatggtgaaagaagataaaatagaagcagaggccgaggtggaactctattatatgatcctggagcgtctcggcaagtatcaggaggccctggacgtgatccgtggcaagctgggtgaaaagctgacatccgagattcaatcgagggagaacaagtgcatggccatgtataagaaacttagtaggtggcccgagtgcaatgccttgagcagaagactcctcttgaaaaactcagacgactggcaattctatctaacatattttgacagtgtgttcaggctgatcgaggaggcatggtctccacctgcagagggtgagcatagcttagagggcgaagtccactatagtgctgaaaaagctgtgaaatttatcgaagatcgcataacagaggaaagtaagtcttcacgtcacttacgtggcccacacctggctaaactggaactcattagaaggttgcgttcccagggctgcaacgatgagtacaagctgggtgacccagaggaactcatgtttcaatactttaagaagttcggcgacaagccctgttgcttcaccgatctcaaggtttttgtggatctcttgccagctactcagtgcacaaaattcattaaccaattgctaggcgtcgtgcccctcagtacacccactgaagacaaactggcccttcctgcggatataagggccctacagcagcatctgtgcgttgtacagttgactaggctgctgggactatatcacacaatggacaagaatcagaagttgtccgtggtgagagagttgatgttgaggtatcagcacggacttgagttcggcaagacttgccttaagacagagctccagttttccgactactattgcctactggctgtgcacgctttgatagatgtatggagagagaccggcgatgaaactactgtgtggcaggctctcacactcctggaagaaggcttgacacactcacctagcaacgcccagttcaagctgctgcttgtccgaatctattgtatgctgggcgctttcgagcctgtcgtcgacctgtacagcagcctggacgctaagcacatccagcacgacaccatagggtatcttctgacacgatacgctgagagccttggccagtacgctgccgctagtcagtcctgtaactttgcattaagattttttcacagcaaccagaaggacacatcggagtacataatccaggcttacaagtatggtgcgttcgaaaagattccggagttcatcgcctttaggaatcggttaaataacagtttgcacttcgcacaggtgaggaccgagcggatgctcctagatttacttctcgaggccaatatatctacgtcccttgctgagtctatcaagtccatgaacctgaggccagaagaagacgacatcccctgggaggatttgcgcgacaacagggacctcaacgtatttttctcatgggaccctaaggaccgagatgtgagtgaagagcacaaaaaactcagcttagaggaagagacactctggctaagaatcagatctctgactctaaggctgatttccggactgccctcactgaatcaccccgttgagccaaagaactccgaaaaaaccgctgagaatggtgttagctccaggattgacatcttgcggctgctgctgcaacagctcgaagccaccctggagaccggaaaacgcttcatcgagaaggacatacaatacccgttcttggggccagtgcctaccagaatgggaggcttttttaattccggctgcagtcagtgccagattagcagtttttacctcgtaaatgacatatacgaactagacacttccggcctcgaagatactatggagatacaggaaagaattgagaactccttcaagtctttgctggatcaactgaaagatgtattctctaaatgcaagggcgatttactggaagtcaaggatgggaatcttaaaactcacccaactctcctggaaaacctcgtgttctttgtcgagactatttccgtaattctctgggtgtcgagctattgcgagtccgttctgcgcccttataaattgaaccttcagaaaaaaaagaagaagaaaaaagaaacttctatcattatgccccctgtgtttacttcctttcaggactacgtcaccgggctgcaaacactgatctcaaatgtggttgatcacattaaggggctggagacgcatttgattgctctgaagctggaagagctgattctagaggacacttcgctctccccggaggagagaaaattcagcaaaactgtgcagggcaaagtgcaaagctcttacctccattctttactggagatgggagaactcctgaaaaagcgcctggaaacaacaaagaaacttaagatttag

SEQ ID NO: 27486 - DNA, 2166 bp, Artificial Sequence
  Description of Artificial Sequence: Synthetic coding sequence
atggcagaaaaattcgagagtctgatgaacattcatggtttcgacctgggcagccgctatatggacctgaaaccgctgggctgcgggggaaatggccttgttttttccgctgtggacaacgactgtgataaaagagtggctattaagaagatcgtcctgaccgaccctcagtcggtgaaacacgccttgcgcgaaataaaaattatcaggcggctggaccacgataatatcgtcaaggtgtttgaaattctgggtccttccgggagccaattgacagacgacgtgggctctttaaccgagctaaattccgtgtacatcgtgcaggaatacatggagaccgacctcgcgaatgttctggagcagggtcccttgctcgaggaacatgccaggttatttatgtatcagttgttgaggggcctcaaatacatccatagcgcaaacgtcctccacagagaccttaagccagctaacctttttatcaacacagaggatctggttctgaagatcggtgactttggtctggccagaattatggaccctcactatagccataagggccatttatccgaaggcctggttaccaagtggtaccggagccccagactgctgctgtctcctaataactatacgaaggctatagacatgtgggcagccggttgtattttcgccgaaatgctgacaggtaaaactctgtttgcgggagcccatgagctcgagcagatgcagttaatcttggaatcaataccagtagtccacgaagaagaccgacaggagctcctgtccgtgatccccgtctatattaggaacgacatgacggagccacataaaccgctgacccagctgctgcctggaatctctcgcgaagctttagatttcctggagcagattttgacatttagtcctatggaccgcctgactgcagaggaggccttgagtcacccatacatgagcatatacagctttccgatggacgagcccatatcgtcccatcccttccacattgaagacgaggtcgacgacatccttcttatggatgagacgcacagccatatatataattgggaacgctaccacgactgtcagttttctgagcacgattggcccgtgcataataattttgacatcgatgaagtgcagctggatcctcgcgcactatcagatgtgacggacgaagaagaagtgcaggttgaccctcgcaaatacctggacggagatcgggagaaatatctggaggacccagctttcgataccaattactccactgagccctgttggcagtactctgaccaccacgagaataaatactgtgacctagagtgtagccatacctgcaattacaagacaagaagttccagttatctggacaacctcgtttggcgcgagagtgaggtgaaccactactatgagcctaaactcataattgacctgagtaactggaaggagcaaagcaaggagaagagcgacaaaaaagggaagtcgaaatgtgagaggaatggacttgtaaaagcccagatcgccctagaagaggcgagtcagcagctggcagggaaggagcgggaaaagaatcaggggttcgatttcgatagctttattgcgggtaccatccagctgtcctcacagcacgaacccaccgatgtggtagacaaactgaacgatttaaattccagtgttagccagttggaactcaaaagccttatctcaaagtcagtttcacaggagaagcaggaaaaaggaatggccaatctagcccagttggaggccttgtaccagtcatcctgggactcacagtttgttagtggaggcgaggattgctttttcatcaatcaattctgtgaggtaaggaaggacgagcaggttgaaaaagagaacacctatacgagttacctagacaagttcttctcacgaaaagaggacacggaaatgctggaaacggaacctgtggaagatggaaagctaggagagcgcggtcatgaggagggatttctcaataactccggcgaattcctgttcaataagcaactcgagtccatcgggattccacaattccactcgcccgtggggagtcccctaaagagtattcaggcaacccttaccccttccgccatgaagagctcaccacagatacctcatcagacctactcaagtattctgaaacacttgaactag

SEQ ID NO: 27487 - DNA, 948 bp, Artificial Sequence
  Description of Artificial Sequence: Synthetic coding sequence
atggccgctggcgtgccatgtgcgctcgtaacgagttgctcttccgtatttagcggggaccagctcgtgcagcacattctggggacagaagaccttattgtggaggtcacgtctaacgatgccgttaggttttacccctggaccattgacaacaagtattactccgccgatattaacctgtgcgtcgtgcccaataaattcctcgtaacagctgaaatagctgagagcgtccaggcattcgttgtgtacttcgacagcacacaaaagagcgggttagactcagtgagctcatggctgccactagctaaggcctggctgccagaagttatgatcctggtttgcgatcgcgtctctgaggatggcataaatcggcagaaagctcaggagtggtgtatcaagcatggattcgaactggtcgaactgtcccccgaggagcttcccgaggaagacgatgattttcccgagtccacgggagtgaagcggatcgttcaggccctcaacgccaacgtgtggtccaacgtcgtgatgaagaatgataggaaccaaggtttctctctcctgaactccctcacgggcacgaatcattccatcggcagcgccgatccgtgccaccctgaacagccgcacttgccagccgcagacagtactgagagtctgtctgatcaccggggtggggcaagcaacacaaccgatgctcaggtggattcgatcgtcgaccccatgttggatctcgatatccaggagttagctagtctgacaacaggcggaggggacgtcgagaatttcgagagattgttttctaagctgaaagagatgaaggataaggccgctactctgccccatgaacagcgtaaggttcatgcggaaaaagttgccaaggctttttggatggccattgggggagatagggacgaaattgagggactgagctctgatgaggagcattag

SEQ ID NO: 27488 - DNA, 1338 bp, Artificial Sequence
  Description of Artificial Sequence: Synthetic coding sequence
atggccgcacccgaggagcgggatctcacacaggaacagacagagaagctcctgcagtttcaggacctgactggaattgagtcaatggaccagtgccgtcacacgctggagcagcataactggaacatagaagccgcagtgcaggaccggctcaatgagcaagagggcgttcccagtgtgttcaacccccctccttctagacccttgcaggtcaatacagctgatcacaggatctatagctatgtggtctccaggcctcagcctagagggttgctcggatggggttattatttgatcatgcttcccttccggtttacttattataccattttggatatattcagattcgcactgaggttcatacgcccagatcctaggtcaagagtgaccgatcctgttggagacatcgtttccttcatgcatagcttcgaggagaagtatggcagggcacatcctgtgttctatcaagggacttactcccaagcgctcaatgatgccaagcgggagctgaggtttcttctggtgtatctgcacggggacgaccaccaggactctgatgaattctgccggaatacactgtgcgccccagaggtcatcagcctcatcaacacccgaatgctgttctgggcgtgctccacaaacaaacccgagggctaccgggtgagccaggcccttagggagaacacctatccttttttggctatgattatgctcaaggaccgcagaatgactgtggtggggaggctggaggggctcattcagcctgatgacctcattaaccagttgactttcattatggacgcaaatcagacctatttggtcagcgagaggctggagagagaggagagaaatcagacgcaggtactgagacaacaacaagacgaagcctacctggcatcactccgggctgaccaggaaaaagaacggaagaaacgcgaggaaagggaacggaagcgacgaaaggaagaggaggtgcagcaacagaagctggctgaagagaggcggagacagaacctgcaggaggagaaggaacgcaaacttgaatgtctgccacctgaaccttcccccgatgatccagagagtgtaaagatcattttcaaattgccaaacgatagccgggtggagcggagatttcatttctctcagtccctcacggtcatccacgattttctattctctttaaaggaaagtccagaaaaattccagatcgaagccaattttcctcgacgtgtcctcccctgcatcccctcagaagagtggcccaatcccccaaccctccaggaagcgggtctgtcccacacagaggtcttgtttgtacaggatctgacagacgagtag

SEQ ID NO: 27489 - DNA, 2724 bp, Artificial Sequence
  Description of Artificial Sequence: Synthetic coding sequence
atggccaccccagatcaaaagtcccctaatgttttgctccagaacttgtgctgccggatactcgggaggagtgaggccgatgtcgcacagcagttccagtatgcagttagggtcattggatctaacttcgcacccaccgtggaacgtgatgagtttctggtggctgaaaaaatcaaaaaagagctcattagacagcgaagggaggcagacgcagctctcttcagtgaactgcatcggaaattgcactcccaaggggtcttgaagaacaaatggtccattctgtacctgcttttaagcctcagcgaagatccaaggcgacaacctagtaaagtatcctcctacgcaacgctgttcgcccaggcactgccccgtgatgcacacagtactccgtactactacgctaggcctcagacactgccactgtcataccaggaccgtagcgcacagagcgcccagtcttcaggatccgtgggttcttccgggatttccagtattggactatgtgccctctccggacccgcaccagcaccccagagtttattgcctgggcagtctaaccaggcccctggagtcggcgactgcctgagacagcagctgggcagtcgccttgcttggacactcacggcgaatcaacctagttcacaggctacaacaagcaaaggcgttccctctgcagtatcacggaacatgacccgttcgcggagggagggggatactggcggaaccatggaaattaccgaggccgcactggtcagggacattctgtatgtatttcagggcatagatggcaagaatatcaagatgaataatactgagaattgctacaaagtcgagggcaaggccaatctttccagatccttgagagatacagcagtgagactgagcgagctggggtggctgcacaataagattcggcgttatactgatcagcgcagtctggatagaagctttgggctggtgggtcagagtttctgcgccgctttacatcaggagcttcgtgagtactatagattactgtccgtcctgcattctcagctgcagctcgaagacgaccagggcgtcaatctgggcctcgaaagttctctgacactgcgaaggctccttgtctggacatacgacccgaagatcagactgaaaactctagcggctctggtggaccactgccagggtaggaaaggtggagaacttgcttcggctgtacacgcttatacaaagactggggacccatacatgcggtcactggtacaacacatcctgtccttggtgagtcacccagtcctgtcctttctctacaggtggatctacgacggagagttggaagacacttatcacgagttcttcgtggcctcggatccgaccgtcaaaacagatcggctatggcacgataagtacacccttaggaaaagtatgatcccctcctttatgacgatggatcagtcacgaaaagtgctactgattggtaagtccataaactttctgcaccaagtgtgccatgatcaaacccctaccacgaaaatgatcgctgtgaccaaaagtgcggaaagtcctcaggacgcagctgatttatttacagacctggagaacgccttccagggcaagatcgacgccgcatacttcgaaacgagcaaatatctccttgacgtgctgaataagaaatacagcttgctggaccacatgcaggctatgcgacgttacctactgctggggcagggtgactttattcgccatcttatggacttactcaagcctgagcttgttcggcctgccacgacactgtaccagcacaatctaaccggcatcctggaaacagccgtgagagctactaatgcccagttcgatagcccagaaatcttgcggcgattggacgtgcgtctgcttgaggtgtcccccggagatacaggctgggatgtcttcagtctggactaccacgtcgacggccctatcgccacggtttttaccagggagtgcatgtctcactacctgagagtcttcaacttcttgtggagagcgaagaggatggagtacattctgacagacatccgaaaggggcatatgtgtaatgccaagctactgcggaatatgcccgagttctcaggcgtgctgcaccagtgccacattctagcctcggaaatggttcattttatccaccaaatgcagtactacattaccttcgaagtgctggaatgctcatgggacgaactttggaacaaagtccagcaggcacaggacctggatcatataatcgccgcacatgaggtcttcctggacaccattatcagcaggtgcctgttggatagtgacagtcgggctctgctgaatcagcttcgcgctgtgttcgaccagatcatcgagcttcagaacgctcaggacgcaatataccgcgcagccttggaagagcttcagaggcgattgcagtttgaggaaaagaaaaagcaacgcgagatcgagggccagtggggggtgactgcggctgaggaggaagaagaaaataagcggattggtgagtttaaggaatcaatccctaaaatgtgcagtcagcttagaatcctgacacacttctaccagggaatagtgcaacagttcttggtgctcttaacaacgtcatctgacgagtctctacgcttcctcagcttccggttggactttaatgagcattacaaagccagagagcccagactgagagtctccctgggaactcgaggacggagaagctcacacacttag

SEQ ID NO: 27490 - DNA, 1086 bp, Artificial Sequence
  Description of Artificial Sequence: Synthetic coding sequence
atgacaggcaaggcaggagaggccctatccaagcctaaaagcgaaactgtcgcaaaaagtacctcaggtggggcacccgctaggtgtaccggcttcgggattcaggagattctcggactcaacaaagaacctccctcttctcaccccagggctgcactggacggtctggctccaggccatcttctggcagcaaggtctgtgctttctccggctggtgtaggaggaatggggttgcttggccctgggggattgccaggtttctacacccagcccacatttctggaagtcctgagcgatccccagtcagttcaccttcagccacttgggagagcttccggtcctctggacactagccagaccgcgtcgagtgatagtgaggacgtgagttccagtgacagaaagatgtccaagtcagctttgaaccagacaaagaaacgcaagaaaaggcggcaccgaaccatatttacatcctaccaactagaggaactggagaaggccttcaatgaagcccattatcctgacgtatacgcgcgtgagatgttagctatgaagactgagctacccgaggaccggatacaggtatggttccaaaatagaagagctaagtggagaaaacgtgaaaaatgttggggcagaagcagtgtgatggccgaatacgggctgtacggggctatggtacggcactccatcccattgcctgaaagtattctgaagtctgccaaagacggaatcatggactcttgcgctccatggctcctggggatgcacaagaaatccttggaagctgctgccgagtccgggaggaaaccagaaggggagcgacaagccctccctaagctcgataaaatggaacaggacgagcgagggccagacgcccaggcagccatcagccaggaggaattgagagaaaactcaatagcagtactgcgcgctaaggcacaagagcatagcactaaagtactcggtaccgtatctggaccagacagcttggcccgatccacggagaaacccgaggaggaagaggccatggatgaagatagacctgcggagaggttgtctccgcctcagcttgaagatatggcatag

SEQ ID NO: 27491 - DNA, 2073 bp, Artificial Sequence
  Description of Artificial Sequence: Synthetic coding sequence
atggaagaatcaccactgtcgagagctccatcgaggggaggggtcaacttcttgaacgtggcacgaacttatatacccaacacgaaagtggagtgtcattatacacttcccccaggcaccatgccttccgcttcagactggattggcattttcaaggtcgaggccgcatgcgttagggactatcatacctttgtctggagttcagtgccagagagcacaacagacggcagcccaatccacaccagcgtccagttccaagcatcctatctccctaagcccggagcacagctttatcagttcaggtacgtcaacagacagggtcaggtttgcggtcagagcccaccgttccagtttagggagcctcggccaatggacgagctagttaccctggaagaggcagacggaggcagtgacatactgttggtcgtgcctaaggccaccgtgttgcagaaccagctggatgagtcccagcaggagcgtaacgacttgatgcagctgaaacttcaactggaagggcaggtgacagagctcagatcacgcgtgcaagaactggagagagcactggcgactgccaggcaggagcataccgaactgatggagcagtacaagggtattagtaggagccatggcgagattacggaagagcgcgatattttatctcgacagcagggggaccatgttgcacgcattttggaacttgaggacgacattcagacgattagtgagaaagtacttaccaaggaggtagagctggatcgacttcgtgataccgtaaaggcactcacacgggagcaggagaagttgttggggcagctcaaggaggtacaagcggataaagaacaaagcgaggcagaactgcaggtggcacaacaggagaatcaccacttgaacctggatctcaaagaggccaaatcatggcaggaggagcagtccgctcaagctcagcggctgaaggataaggtggcccaaatgaaggacaccttgggccaagctcaacagagggtggctgaactagagccactgaaagaacagctcaggggagctcaggaactcgccgcttcatcccagcagaaggcaacactattaggggaggagctggcgtctgctgcagctgccagagataggacaatcgccgaactccacagaagtaggttggaggtcgccgaagtaaacgggaggttggccgagctcggcttgcatttaaaggaagagaagtgtcaatggtccaaagaacgggcagggctgctccaaagcgtggaagccgagaaggacaaaattctgaagttgagcgctgagatactgcgactcgagaaggctgttcaggaggaaagaacccagaaccaggtgtttaaaaccgagctcgctcgggagaaggatagctctctggttcagctctcagagtccaaaagagaactcaccgagttgcgcagtgcgctccgggtgttgcagaaagagaaggagcaactccaggaggagaagcaggagctgttagagtacatgagaaaacttgaggctcgcctggaaaaagtcgctgatgagaaatggaatgaagatgccacaaccgaggatgaagaggcagccgtagggctgtcgtgccccgcagcgctgaccgacagcgaggacgaaagtccagaagatatgagactgcctccttacgggctgtgcgagcggggagatcccggatcctccccggctggaccccgagaagcttccccactggttgtgattagtcagccagctccgatctctcctcatctgagtggccctgctgaggattcttcaagtgactccgccgaggatgaaaagagcgtgttaatggccgctgttcagagtggaggcgaggaggccaacctgttgctccccgaactaggaagcgccttctacgatatggccagtggcttcactgtcggtactttgtccgagacgtctaccggcggacccgctacaccaacttggaaggagtgccccatttgcaaagaaagatttccagcagaaagcgacaaggatgccctcgaggaccatatggacggccactttttcttctccacacaggacccttttaccttcgaatag

SEQ ID NO: 27492 - DNA, 1980 bp, Artificial Sequence
  Description of Artificial Sequence: Synthetic coding sequence
atgtcactgcctcctgaaaaggcatctgagctgaagcagcttatccatcagcaattaagcaagatggatgttcacggaaggattcgcgaaatcctggccgaaacaatccgagaggaacttgcaccagatcaacagcacctgtccaccgaggaccttattaaggctctccgtcggagagggataatagatgacgtgatgaaagagctcaactttgttacggatagtgtggagcaggaattaccttcgtcacctaaacagccaatttgtttcgaccggcagagcacactgaagaagaccaacatagaccccacccggcgatatctgtatttacaggtgctaggaggcaaggcatttttggaacacctgcaggaacctgaacccctccccggacaggtttgcagcacctttaccctctgcttacattataggaatcagcggtttcgctctaagcccgtgccttgtgcctgtgagcctgactttcatgacggttttctgctggaagtgcatcgtgagtcactgggggacgggacccgcatggccgactctactaccatgctgtccatttccgaccctatacacatggtgctgatcaagacagatatttttggtgagaccacccttgtcgcaagttatttcctggaatggcggtctgtgctgggcagtgaaaatggggtcactagcctgacggtggaactgatgggcgtagggactgaatccaaagtgagcgtcgggatcctgaacattaagctggagatgtacccaccgctgaatcaaactctgtcgcaggaggtcgtcaatacccagctcgcccttgagagacaaaaaactgccgagaaggagcgcctgttccttgtgtatgccaaacaatggtggagagagtacctgcagattagaccgtcacataacagccgcctggtgaaaatcttcgcgcaggacgagaatggcatcaacaggcccgtttgcagctacgttaaacccctcagggcaggacgcttgctggatacacctcgtcaggctgcacggttcgtgaatgtccttggctatgagcgagcaccggttataggtggtggaggcaaacaggagcagtggtgtactctgctggcatttctgtgccggaacaagggggattgcgaagatcacgcaaatctgttgtgttcccttctcctaggatacgggttggaagcgtttgtatgcgtcggtacaaaagctaagggggtgccgcatgcatgggtgatgacctgcgggactgatggcgctattaccttttgggagtctctgaccgggcaccgttacatccacaagcctacaaatccagatgaaccgcctgtggcagaacagcctaaacccctctacccctacagaactatcggatgtgtcttcaaccaccagatgttcctcgggaactgtcagccttcggatgccgtagagacatgcgtctttgacttgaacgacgaatctaaatggaagccgatgtctgaggaggcaattaaatctgtgtgtgctcccggtgcgacgacatcattgcctcctttccctccattgtgtgccagcaccattgacgcaagtgtgacctccaatgaaatagagatgcagctgagactcctggtttcggaacaccgtaaggaccttgggctgacgaccgtttgggaggaccaattgtcttacctactttcacccgcactggcctcttacgaatttgagcgcaccacctctatcagcgccggaaatgaggagtttcaagacgccattaggcgggctgtgcccgacggccataccttcaagggattccctatccactttgtttatcggaacgctagacgcgctttcgcaacttgtcttcgttcccctttttgtgaggagatcatctgctgtaggggagaccaggtgaggctcgcggtaagggtgcgtgtctttacataccccgaatcggcgtgtgcggtgtggattatgtttgcctgcaagtataggtccgtgctgtag

SEQ ID NO: 27493 - DNA, 1500 bp, Artificial Sequence
  Description of Artificial Sequence: Synthetic coding sequence
atgctggagaggccgccagccctcgctatgcccatgcctactgaggggacacccccacctttgtcaggtacaccaatcccagtgcccgcatatttccgccatgcggagccaggtttcagcttaaagagaccacggggtctctctcgctctctgccccctccacccccagcaaaaggaagcattccaatcagtagactcttccctccacggacccccggttggcatcaactgcagcccaggagagtgtcctttaggggggaggcttccgagacccttcagagtcccggttatgacccatcccgccctgaaagctttttccagcaatcctttcagaggttatctcggctgggacatgggagctacggcgaggtgttcaaggtccgaagtaaggaggatggtcgcctgtacgctgtgaagcggtctatgagcccatttagaggcccaaaagaccgagcgaggaaactagccgaagttggcagccacgaaaaagtggggcagcacccttgttgtgttaggttagaacaggcctgggaagaaggtgggatactgtacttgcagacggagctctgtggaccctcactccagcagcactgtgaagcatggggggcttctctgccagaggcacaagtgtggggttacctgcgggacaccctcctggcccttgcccacctgcacagtcagggtctcgtgcaccttgatgtgaagcctgcgaatatctttttgggtcctcgcggaagatgcaaattaggggactttggcctcctggtggaattgggcacagccggtgccggagaggtgcaagagggagaccctagatacatggcaccggaattgctgcagggcagttatggaactgccgctgacgtgttctctctgggactgacgattttggaggttgcgtgcaatatggaattacctcacggaggagagggctggcagcaactacggcaaggataccttcccccagaatttacggcaggcctcagcagcgagctaaggtcagtgttggtaatgatgttggaacctgacccaaaactgcgcgctacagcagaggctctgctagccctccctgtcctgcgtcaacctagggcctggggtgtgctgtggtgcatggccgcagaggcactaagtcggggttgggcactgtggcaggcgcttctcgcactactgtgttggctgtggcacggactcgctcatcctgcctcctggcttcagcctcttggacctcccgcaacaccgccagggagcccgccttgctccctcctgcttgactctagtctatcgagcaattgggacgacgattctcttggccctagtttgtccccagaagctgtgttggccaggacggttggttccactagtactcctagaagccgatgcacacctagggatgcgctcgatctctccgacatcaacagcgaacctcccagaggatctttcccgtcttttgagcccagaaacctcctgagcctgttcgaggataccctagatcccacctag

SEQ ID NO: 27494 - DNA, 486 bp, Artificial Sequence
  Description of Artificial Sequence: Synthetic coding sequence
atggatgtcttcctcatgataagacggcacaagacaactatattcaccgacgctaaggaatcttcaactgtctttgaattaaaaaggatcgtggagggtatcctgaaacggcctcctgatgagcaacggctttacaaggacgatcaacttctggatgacggcaaaacactgggcgaatgtggttttactagtcagaccgccagacctcaggcccctgctacagtaggtctcgcctttagggccgatgacaccttcgaggccctctgtatagagccgttcagctcgcctcccgaactcccggacgtaatgaaacctcaggattctgggagctccgccaacgaacaggccgtccatctccatgtgcactcacagaccatggcaaagtcacggaacacgtcatggtcacagtgccctggccttactgcttgcagcacacgggagccccaggatggacccacacaggtgcatccaagatgggggctgtag

SEQ ID NO: 27495 - DNA, 1521 bp, Artificial Sequence
  Description of Artificial Sequence: Synthetic coding sequence
atgacaggggagaagataaggtccttgcgacgtgatcataagccttcgaaagaggaaggtgatctgctcgaaccgggtgatgaggaggcggcagctgccttaggcggaacttttacgagaagccgtatcggcaaaggtgggaaggcttgccacaaaatctttagcaaccaccaccatagactgcagttgaaagccgcaccagcctcatctaaccctcctggagcgcctgccctgccactgcacaatagcagtgtgacagctaattcacagtcaccagcactcctggccggtaccaatccagttgctgttgtggccgatgggggatcctgtcctgcacattaccccgtccatgagtgcgtatttaaaggagatgtccgtcgactgtcatccctgatccgaacccacaacatcggtcagaaagacaatcacggaaataccccccttcacctcgctgtaatgctggggaataaggtcactgcgctgctacggaagcttaagcaacaatctagggaaagtgtagaggagaaacgtccgcgattgttgaaagctcttaaagaactcggcgacttctacttggagttacactgggactttcagtcctgggtacccctgttgtcaaggattctgcccagcgatgcgtgcaagatttataagcaagggatcaatatacgccttgatacaactttgatcgatttcacagacatgaagtgccagcgcggagatctttctttcatcttcaacggtgacgccgctccatctgagtctttcgtggtcttagataacgagcagaaagtataccagagaatccaccatgaggagagtgagatggagacagaagaggaagtggacattctcatgtcatccgatatctattccgctacactgtcaacaaagagcatatcatttactcgagctcaaaccggttggctgttccgggaagacaaaaccgagcgcgtgggtaactttttggccgatttttatctggtgaatgggttggttttagaaagcaggaagcggagagaacacttgagcgaggaagacatcctccgcaataaggctatcatggaatccctgtctaaggggggaaatatcatggaacagaattttgagcccattcgcaggcagagcttgactcctcccccacaaaacacgatcacatgggaggagtacatctcagcagaaaatggtaaggctccacaccttggcagagagctagtctgcaaagaatctaagaagactttcaaggcaacaattgccatgagccaggagtttccactgggcatcgaactcctgcttaatgtgctggaggttgtcgccccatttaagcacttcaataaacttagagagttcgtccagatgaaactgcccccaggcttcccagtcaaactggatattccagtgttcccaacaatcacagcgacagtaactttccaggaattccgttatgatgagtttgacggcagtatcttcaccatccccgatgattataaagaagatccaagccgcttccccgatctgtag

SEQ ID NO: 27496 - DNA, 699 bp, Artificial Sequence
  Description of Artificial Sequence: Synthetic coding sequence
atgcaaccaccggcacctcctgccgaactggcagccccacttccaagcccactgccggagcagcccttggactccccagcagcgcctgcgttgtcaccatccggcttggggctgcagcccggtcctgagcgtacctcaaccaccaaaagcaaggagctgtccccaggttctgcccagaagggcagtcccggttccagccagggcactgcctgtgccggtacgcaacctggggcacagcctggtgcccagcctggagcttcgcccagccctagtcaacccccagcggaccaaagtccacataccctgcgcaaggtcagtaagaaactcgccccaattccacctaaagttccctttgggcagccaggagccatggctgaccagtcagccggacaaccgtccccggtgagtctgtcccctacacctccttccactccgtcaccttacgggctctcatatcctcagggatattctctagcctctgggcaactatcccccgctgccgctccacctctggcctcgccctctgtgttcacttccactttgagtaaatcccggcctacccctaagccgagacagagacctacgctcccaccaccccagcccccaactgttaatctgagcgcatcaagtccccagagcactgaggccccaatgctggatgggatgtcacctggagaaagtatgtcaacagcagtatag

SEQ ID NO: 27497 - DNA, 1221 bp, Artificial Sequence
  Description of Artificial Sequence: Synthetic coding sequence
atgcatccagccgtgttcctgtccttgcctgatctgcgttgcagtttgctactactggtgacatgggttttcactcccgtgacaactgagattacttcgcttgacacagagaatatcgatgaaattctgaacaacgccgacgtcgccctggtgaacttctatgctgactggtgtcgattctcgcaaatgctccatccaatcttcgaggaggcttcagacgtaataaaggaagagttccccaacgagaatcaggtagtattcgccagagtggattgcgaccagcattccgacatcgctcagaggtatcgcatcagcaagtatcccaccttgaagctgttccggaacggaatgatgatgaaaagagaatatcgcggacagagatcagtaaaggcactggccgattacataagacagcagaaaagcgacccgatccaagagataagagatctggccgagattacaacactagatcggtctaaaaggaacatcatcgggtacttcgagcagaaagattcggataactatcgcgtttttgagcgggttgccaacatcctccatgatgattgtgcgttcctgtcggccttcggcgacgttagtaagcctgaacgttacagcggtgacaacataatatataagccccctggacactccgcacccgatatggtctatctcggggctatgactaactttgatgtgacttacaactggatccaggacaagtgcgtgccactggtgcgcgagatcactttcgagaacggagaagagctgacagaagaaggcttaccttttttaattttgtttcacatgaaggaggacacggaaagccttgaaatttttcaaaacgaggttgctcgacagctgattagcgagaaggggaccatcaattttttgcacgcagactgtgacaagtttcgtcaccccctgctgcacatccagaaaacacctgccgattgcccggtcattgctattgattcctttcgccatatgtacgtctttggcgattttaaggatgtgctcatccccggtaagcttaaacagtttgtcttcgacctacattctgggaagttgcacagggagttccaccacggacctgacccaacagacactgcccctggcgagcaagcacaggatgtagcctcctctcccccagaaagctctttccagaagcttgcaccgtcagaatatcgatataccctgctgagggatcgtgacgaactctag

SEQ ID NO: 27498 - DNA, 5601 bp, Artificial Sequence
  Description of Artificial Sequence: Synthetic coding sequence
atggatcctgttggactgcagctgggaaataagaatttgtggagctgcctcgtgcgcttactgactaaagacccagaatggctgaacgctaagatgaagtttttcctgcccaacactgacctagactccaggaacgagactctggatccagaacaaagggtaattctgcagctgaacaaactccacgtacagggctccgacacctggcagtcttttattcattgcgtgtgtatgcagctcgaagtccctttagacctcgaggtcttgttgctcagcactttcggttacgatgacggcttcacaagccaactaggagccgaaggcaaaagtcaaccagaatcacaactccaccatggcctgaagaggccacatcagagttgtggctctagtccaaggaggaaacaatgcaagaagcaacagctggaattggcaaaaaaatatctgcaactgctgcggacatccgcgcagcagcggtacaggagccaaattccaggatctggtcagccccatgcctttcaccaagtgtacgttccccctattctgagaagggcaaccgcctctcttgataccccggaaggagccatcatgggggacgtgaaggtcgaagacggagccgatgtgagcatttcagatttattcaatactagagtgaacaaggggcctcgagttaccgtgctattgggcaaagctggaatgggcaagacaaccctggctcacaggttatgtcaaaagtgggctgaagggcatttaaattgttttcaagctctgtttctgtttgaattcagacagcttaacctgattacccgctttctaaccccatctgagcttcttttcgatttatatctgagtcctgagtctgatcatgacaccgtgttccagtacctggagaagaacgccgatcaggtcctcctgatcttcgacggtcttgatgaggctctgcagcccatgggacccgacgggccaggacccgtgttgaccttgttctctcacttgtgcaatgggacactgttgccagggtgtcgcgtgatggctacttccaggcccggtaagctgcctgcctgtctgcccgctgaagcggctatggtgcacatgttaggattcgacggaccgcgagtcgaagagtacgtgaatcatttctttagcgcccaaccttccagggagggagcgctggtggagctccagaccaacggacggcttcgttctttgtgcgctgtccctgcattgtgtcaagttgcttgcctctgcctgcatcacttgctgccagaccatgcccctggacagtcagtggccctgctgcccaatatgactcagctttacatgcagatggtgttggcgctgtcccccccaggccacctgccaactagctccctgctggacctcggggaagttgctctcaggggcctggaaaccgggaaggtgattttttatgccaaagacattgctccgcctctcattgcgtttggtgccactcacagcctgctgacttccttttgtgtatgcaccgggcctggccaccagcagacaggatatgctttcacacatttatccttgcaggagttccttgcagcactccacctcatggcatcacccaaagtgaacaaagacacactgacccagtacgtgacactacacagcaggtgggtgcagagaaccaaagcacggttgggactgagtgatcatctcccgacgttccttgcaggcctggccagctgtacatgcaggccctttttgagccatctggctcaaggcaatgaggattgtgtaggcgctaagcaagccgctgtcgtgcaggtactcaagaagttggccactcggaaactgacaggaccaaaggtcgtggagctctgtcattgcgtggacgagacacaggaaccagagttagccagcctgaccgctcaaagtctcccctaccaacttccatttcataatttcccattgacatgtacagatctggctacactgaccaatattttagagcatcgagaggcgccaattcatttggatttcgatgggtgcccccttgaacctcattgtccagaagcactggtgggatgtggtcagattgaaaacctctcatttaaatccagaaaatgtggtgacgcctttgcggaggccctctccagaagccttcctacaatgggcaggttgcagatgttaggactagctggcagcaagattactgctcgcggaatctcccacctggtgaaagcactgcctctttgccctcagttaaaggaggttagcttccgtgataatcagctgtcagatcaggtggttctcaatatcgtggaggtcttgcctcacttgcccagactgcgaaagctcgacctgtccagcaacagtatatgtgtcagtacactgctctgtctggccagggtagctgtgacatgtcctacagtgcgcatgctccaggcacgagaagctgatttgatctttctgctgagccctccaaccgagacaaccgcagaactccagcgtgctcctgatttacaggagtctgatggccaaagaaagggagcacaaagccgttctctgactcttaggctgcagaaatgccagttgcaggtgcacgatgcggaggcgttaatagccctactccaggaagggccacacctggaagaggtggatctcagcggtaaccaactggaagacgagggatgcagactgatggccgaggctgcgagccagctgcacatagccagaaagttagatctttcaaacaacggactttctgtggccggagtccactgtgtcttgcgcgcagttagtgcctgctggactctggcagaacttcacatttccctccagcacaagaccgtcatctttatgtttgcccaagagccggaggagcaaaagggtccccaggaaagagccgcttttctcgacagtcttatgcttcagatgcctagtgagctccccctatcctctcgcaggatgaggctcacacattgcggtctgcaagaaaagcacctggaacagctttgcaaggccctgggagggtcatgccacctgggtcatctccacctggactttagcgggaatgcactgggcgatgagggcgcagcccgattggcgcaactgctgcccggattgggcgcactccagagcctgaatttgtcagaaaatggactgagcctcgacgccgttctgggcctggtgaggtgtttctcaaccctacagtggctttttcgtcttgatattagctttgaatcccagcatattcttttaaggggggataagacctctcgggatatgtgggctacaggctctctgcctgatttcccagcggcagccaagtttctgggcttccgtcagagatgcatccccaggagtttgtgcctgagcgaatgcccactggagccgccatcactgacacggctgtgcgctaccctgaaggattgccccggaccactcgagctgcaactcagctgtgagttcctttcagatcaatctctcgagaccctgttggattgcttaccacaactcccacagctctccttactacagttgtcccaaaccgggctgagtccaaaaagtccattcctcttagctaatacactgtccctttgcccacgggtcaagaaggtggatctccggtctttacaccatgccacgctgcacttccggtccaatgaagaggaggaaggtgtgtgttgcggacgcttcacaggttgctccctgagccaggagcatgtggagagcttatgctggctgcttagcaaatgcaaggatttgtcacaagtggacctgtccgcaaacctgctcggtgactccggactgcgctgtcttttagaatgtctgccacaggtccctatctccgggttgctcgacctaagccacaattcgatttcccaagagagcgcactctacctgcttgagaccctgccctcgtgccccagggtgcgagaagcgtctgttaacttgggttccgagcaatccttcagaatccatttctctcgggaagatcaggcgggtaagacgctgcggctgtctgaatgctcatttagacctgagcacgtctcgagacttgccaccggactgtccaaatcgctccaactcaccgaattaaccctcactcagtgctgtttgggtcagaagcaactggcgatactactgagtctggtgggccgtcctgcaggcttgttttcgcttcgggtccaggaaccatgggctgatagagctcgcgtgctgagtttgctggaagtgtgtgcccaggcatccggctcggtcacggaaatttcaatctccgaaactcagcagcagctgtgcgtccaacttgaatttcccaggcaggaggagaaccctgaggccgttgcgctccgcctcgcccactgcgacctgggtgcccaccattcactgctagtgggccaactgatggaaacttgcgcccgtctccaacagttgtctctgtcacaggtgaacctgtgtgaggacgacgacgctagcagtctgctgctccagtcattgctgttgagcctttcagagctaaagacattcaggcttacgagctcctgtgtgtccactgaaggcctggctcacctggcttcagggcttggtcattgccatcacctggaggaattggacctctctaataaccagttcgacgaggaggggactaaggccctgatgagggctctagagggtaaatggatgcttaaacggttggaccttagccatctcttactgaattcatccacgctggcacttctgacacacaggttgagtcagatgacatgccttcagtccctaagattgaacaggaactctattggagatgttggttgttgtcacctgtccgaagccctacgtgctgccacgtcccttgaagaactcgatttgtctcacaatcagattggggacgccggtgttcagcatctggcgaccatcctcccgggtctacctgagctgaggaaaatcgatctgtctggcaactccatatcctccgccggtggcgtgcagctcgccgagtccttggtcctgtgccggagactagaagagctgatgctgggctgtaatgcactgggggaccccaccgctctgggcctggcacaggagttaccccagcatttacgcgttctgcacttgcccttcagtcacctgggacctgggggtgccctcagtctggctcaagccctcgatggttctccccacctcgaggaaatatctttggccgaaaataaccttgctggcggagtcttgaggttctgcatggaactgccactattgcgccagattgacctggtgagctgtaaaatagataaccaaactgcgaaattactgacttcctccttcacatcttgtcccgctcttgaggtaatactcttgagttggaatctcctgggcgatgaagcagccgcagagctagcccaagtcctgcctcagatggggaggttgaagcgggtggatctcgagaagaaccagattacagcgctgggcgcatggcttctggcagaaggtctggcccagggtagctctattcaagtgatacgcctctggaataaccctattccatgtgacatggcccaacatctgaagtctcaagaacccaggcttgatttcgcctttttcgataatcaaccccaagctccttgggggacataa

SEQ ID NO: 27499 - DNA, 897 bp, Artificial Sequence
  Description of Artificial Sequence: Synthetic coding sequence
atgatgaatgtgaacacaaggggtacttatctagcaagcaaggcctgcattccatacctgaagaagagcaaagtggctcatattcttaatatcagccctcctctgaacttaaacccagtgtggtttaagcaacactgcgcttataccattgctaagtatggtatgtctatgtacgtgctcgggatggcagaggaattcaaaggggaaatcgctgtgaacgcgctatggccaaaaacggccatacacacagccgcaatggacatgctgggcggacccggaatcgaatctcaatgcagaaaggtcgatattatcgcggacgctgcttatagcatctttcaaaagccaaaatcgttcactgggaactttgtgatcgatgagaatatactgaaagaggagggcattgaaaattttgatgtctatgccattaagcctgggcatccgctgcagcctgatttcttcttggacgaataccctgaagcggtttccaaaaaggtggagtctacaggcgcagtgcccgagttcaaggaggagaagttgcagttgcaaccaaagcctcggagtggcgcagttgaagagacatttcggatcgtgaaagatagtctgagcgatgacgtggttaaagcaacccaggccatttacttatttgaactgtccggagaagatggtgggacctggtttcttgacctcaagagcaaggggggaaatgtcggctacggagagccaagtgaccaggccgatgtggttatgtcaatgacaaccgacgatttcgtcaagatgtttagcggcaaactcaagcctaccatggccttcatgagcgggaagctgaaaatcaagggtaacatggcattagctattaaattagagaagctcatgaatcagatgaacgcgagactgtag

SEQ ID NO: 27500 - DNA, 4026 bp, Artificial Sequence
  Description of Artificial Sequence: Synthetic coding sequence
atgtggagacgaaaacaccccagaacatcaggtggtactcgcggtgtcctaagtgggaatcgaggcgtggagtacggcagcggtcgcggacacttggggacattcgagggacggtggcgtaagcttccaaagatgcccgaagccgtgggcacagacccgtccacgtctaggaaaatggccgagctggaagaggttacactcgacggcaaacctctgcaggccttgagggtcacagatctaaaggctgctctggagcagcggggtctggcgaaaagcggtcaaaaaagcgccctggttaagcgcttgaaaggggctctaatgctcgagaatctgcagaagcattctacgccccatgctgcgtttcaacctaattcccagataggcgaggagatgtcccaaaattctttcataaaacaatacctggagaagcaacaggagctgttaaggcagcgcctcgagcgcgaagctcgtgaagccgcagagctcgaggaggcttcggcagaatctgaggacgaaatgatccaccctgagggggtcgccagcctgctgccgccagactttcagtcaagcctcgagagaccagagctagagctctcccgtcacagtccccgaaaaagcagtagcatatctgaggagaagggtgactccgatgacgagaagccccgaaagggggaaagacgctcgtcaagggtcagacaagcccgagccgcaaaattgagcgaaggcagccagcctgctgaagaagaggaggaccaggagaccccttcccgcaacctgcgggtaagggcagacagaaacctgaaaaccgaggaagaagaagaggaagaagaggaagaggaggaggacgatgaggaagaggagggggatgacgagggccagaagtcaagggaggctccaattctgaaagaatttaaggaagagggggaggagataccccgagttaaacccgaagagatgatggatgagcgccctaaaacccgttcccaggagcaggaagttctggaaaggggaggccgttttacgaggtcccaggaggaggcccgaaaatcacacctggcacggcagcagcaagagaaggagatgaagacaactagtccgttggaggaggaagagagagaaatcaagtcctcccaggggttgaaggagaagtctaagtcccccagcccaccacgcctaaccgaggaccgcaaaaaggccagtctggtggcactgccagaacagactgcctctgaagaggagacaccgccaccactgttaaccaaagaagctagctccccccctcctcacccacagttgcatagcgaggaggagatcgaaccaatggaaggacccgcaccagccgttttgatccaactcagccctcctaacaccgatgccgacacccgggagttgttagtcagccaacacactgtgcagctagtcggagggctgtccccactctcttctccgtctgacacaaaagctgaatccccagccgagaaggtccctgaagagtccgtgttgcccctcgttcagaagagtaccttagctgactattctgcccagaaagacctcgaacccgaaagcgataggagcgcacagccgctccctctgaaaatagaagagctagctttggcaaagggcatcacagaggaatgcttgaaacaacccagtctggagcagaaagaggggaggagggcatctcacactctgttgcctagccatcggttgaaacaatccgcggatagttcgtcctccaggtcttcttccagctcttctagttcttccaggagtcgctcaagatccccggatagttctggctcccgctcacacagtccccttcgaagtaaacagcgggatgtggcccaagctcgcactcatgctaatcccagagggagacccaaaatggggtcacggagcacaagtgaatcaaggagcagatccaggtctcgatcccggagcgcctcaagtaactcacgcaaatccctgtctcctggcgtgagtcgagactcatcaactagctacaccgaaactaaagacccaagtagtggacaggaggtagccaccccccctgtacctcaattacaggtgtgtgagcctaaggagcggacctcaacctccagtagcagtgtgcaggcgcgacgcttaagtcagccagagtccgccgaaaagcacgttacacagcggctgcagcccgaacggggttctcccaagaaatgtgaagccgaagaagccgagcctcccgcagccacccagccccagacttcagaaactcagacatcacatctcccagaatctgagcgcatacatcacaccgtggaggaaaaggaagaagttactatggacacctccgaaaaccggccagaaaacgatgtaccagagcctccaatgcccatagctgaccaagtgtcaaatgatgatcgccctgagggttccgttgaagacgaagagaagaaggagtctagcctgcccaagtccttcaaaagaaaaatcagcgtggtgtcagccaccaagggagtcccagcagggaacagcgatactgaaggcggacagcccggaaggaaaagaagatggggggcaagcacggccaccacacagaagaagccatccatctcaataaccaccgaaagcctcaagtctttaataccagatatcaagcccctagcaggccaggaggctgtggtggacctgcacgccgatgactccagaatatcagaggacgagaccgagaggaatggggacgatggcacacacgataaaggtctcaaaatctgtcggaccgtcacccaagtggtgcccgctgagggacaggaaaacggtcaacgagaggaagaggaggaggagaaggagccggaagcggaacccccagtgcccccacaagtctcagtggaggtggccctacctccgccagccgaacatgaggtgaagaaagtgacactgggggataccttaactaggaggtctatcagtcagcagaaatctggtgtctccattactatcgacgatcccgtcagaaccgcacaggttcccagtcctccacggggaaagattagcaatattgtccacataagcaatctggtgcggccttttaccctgggccaactaaaagagctcctgggaagaacaggcactctggtggaagaggccttctggatcgataagattaaatctcactgttttgtgacgtactcgaccgtcgaagaagccgtggcaaccagaaccgccttacacggcgtgaagtggccacagagtaatccgaaatttctctgtgcagattatgcagagcaagacgagctggactatcacagagggctgctggtcgaccgcccaagcgaaaccaaaactgaggagcagggtatcccccgacctttgcacccgccaccgcctccgcctgtccagcccccacagcacccgagggcagaacagcgggagcaagagcgagctgtccgggaacagtgggctgagagggagcgcgaaatggaaaggagagagaggaccaggtccgagagagagtgggacagggacaaagtgagggaagggccaagatctcggagtaggtcgagagaccgcaggcggaaagagagagccaagagcaaggaaaagaagtccgaaaaaaaagaaaaggcacaggaagagcccccagctaagttactggatgacttatttcggaagaccaaagccgctccgtgcatatactggctgccactgaccgatagtcagatcgttcagaaagaggctgaacgcgcagagagagccaaagagagggagaaacgacggaaggagcaggaggaagaggaacagaaagagagggagaaggaagctgagagagagcggaacagacagctggagagagaaaaaagaagagagcattctcgtgagcgggatcgcgagagagagcgggagcgggaacgcgacagaggagaccgggatcgtgacagagaaagagatcgcgagaggggacgcgagcgtgataggagggataccaagcggcattcccgatctcgatccagatctacaccagtgagagaccgcggtgggcgaaggtag

SEQ ID NO: 27501 - DNA, 600 bp, Artificial Sequence
  Description of Artificial Sequence: Synthetic coding sequence
atgtcttctggtaacgctaaaatcgggcacccggctcctaacttcaaggcaacggctgttatgcctgatggtcagttcaaagatatcagcctttcagattacaaaggcaagtacgtggtctttttcttctatccccttgatttcaccttcgtctgcccgaccgagatcatcgctttctctgaccgggctgaagagtttaagaaactcaactgtcaggtgatcggggcttcggtcgacagtcacttttgccatctggcctgggtcaacactccgaaaaagcaagggggtttgggcccaatgaatattcctctggtctccgatccgaagagaaccattgcccaggattatggcgttttgaaagccgatgaggggatctcttttcgagggctattcattatcgatgacaaaggcattctccgtcagatcacggtcaacgacctccccgtgggtcggagcgtcgacgaaacactgcggctggtccaggctttccagttcaccgataagcatggtgaagtttgccctgctggatggaagccaggcagcgatacaataaagcctgatgtccagaaatccaaggaatacttctccaagcaaaaatag

SEQ ID NO: 27502 - DNA, 1077 bp, Artificial Sequence
  Description of Artificial Sequence: Synthetic coding sequence
atggaaaagaagaagatggtcacacaagggaaccaagagccaacaacgacaccagacgcaatggtgcagcccttcactaccatcccgttccccccacccccacagaatgggattcccaccgaatatggtgtcccccacacccaggattatgccggacagaccggagagcataacttgaccctatacggctctacccaggcgcacggcgagcagagtagtaacagccctagtacccaaaatggctctctcaccaccgaagggggagcccagactgacggacaacagtcgcaaacacagagcagcgagaactcggagtctaagtcaacacccaagcggctgcatgtctcaaacattcctttccgtttccgggacccagatctgcgccagatgtttgggggattcggctttgtcacgtttgaaaactctgcggatgctgacagggccagagagaagctgcatggcacagtggtggaagggaggaaaattgaggtgaataacgccaccgcccgtgtgatgactaataaaaagatggtgacgccctacgctaatggctggaagctgagtcccgtggtgggtgctgtatatggtccagaactgtacgctgcaagttcatttcaagccgatgtctcactagggaatgatgcagcggttcccctatcggggaggggaggcattaatacctatatccccttgataatcccgggatttccgtatccaactgcagccacgactgccgcagcgtttcggggtgcccaccttaggggtagaggacggacagtgtacggtgccgtgcgggctgtcccccctacagcaatccccgcatacccgggagtcgtgtaccaagatgggttctacggtgccgatctctatggaggctatgctgcatataggtacgcacagcctgccaccgccaccgccgctacagcagctgcagctgccgctgccgcttattcagacggctatgggagagtgtacacagctgatccttaccacgccttggcaccggctgcgtcatacggtgtaggggctgtggcatcactgtacaggggcggatatagcaggttcgctccctattag

SEQ ID NO: 27503 - DNA, 1596 bp, Artificial Sequence
  Description of Artificial Sequence: Synthetic coding sequence
atgagctatccagccgatgattatgaatctgaggccgcatatgacccgtacgcatacccctcagattacgatatgcatactggtgacccaaagcaggacttggcctatgagagacagtatgagcagcaaacataccaggtgatccctgaggtgattaagaacttcattcagtattttcacaaaaccgtgtccgacctcattgatcagaaggtttatgagctccaggcctcgagggtcagcagtgatgtgattgatcagaaggtatacgagatccaagacatttatgaaaattcttggacgaagctgacagaaaggttttttaagaacactccatggccagaggccgaggctatcgctccccaagtagggaacgatgctgtgttcctgatcctgtacaagattcttcaggcccacggacccgcaccgttggaacttcctaatcaatggctgtgggatataatcgacgaattcatctatcaattccagtcgttctcccagtaccgctgcaaaaccgcgaaaaagtcagaggaggaaatcgatttcctaaggagtaatccaaagatctggaacgttcattccgtgctgaatgttctacacagtctagtggacaagagtaacattaaccgccaactggaagtgtatactagtgggggagatcctgagtccgttgcaggagagtacggccgacattcgctctacaagatgttaggctatttctcgctcgtggggctgctgcggctgcattcactgctgggtgactactaccaggccatcaaggttttggagaatatcgaacttaataaaaagagcatgtactcccgcgttcctgagtgtcaagttactacctactactatgtcggttttgcttacctgatgatgagacgctaccaggacgctattagggtcttcgccaacatactcttatacattcagcggacaaaaagcatgtttcagaggactacctacaaatacgagatgatcaacaaacagaacgagcagatgcacgctttgcttgctatagccctaactatgtatcccatgcgtattgatgagagcatccacctccagctgcgggagaaatatggggataaaatgctgcggatgcagaaaggtgacccacaggtctacgaggaacttttcagttattcttgcccgaaatttctcagccccgtcgtcccaaactacgataacgtccacccgaattaccataaggaacccttcctacaacaactaaaagtgttcagtgatgaagtgcaacagcaggcacagctcagtaccataaggagcttcttaaagctgtataccactatgcctgtcgccaaactggccggttttcttgatctgacagaacaggagtttcgcatccagctgctggttttcaagcacaagatgaaaaaccttgtgtggacctccggcatctctgctctcgatggggaatttcagagcgctagcgaggttgatttttatatagataaggacatgatacacattgccgacactaaggtcgcccgaagatatggcgattttttcatacggcagatccacaaatttgaggaactgaatcggacgctcaaaaagatgggccagcggccatag

SEQ ID NO: 27504 - DNA, 5952 bp, Artificial Sequence
  Description of Artificial Sequence: Synthetic coding sequence
atgagtgggaataaacgagggtctagagcatcttgtcctcaccggggagctgagtgtctgctgccatgggccgctttaaaccttcaggggttccagttgctattacttcaccccagcgcaacagccatgatggacgtgtccgaactgggagagagcgcaagatatttacggcagggctaccaagagatgactaaggtgcacacaatcccatgggatggaaaaaagcgcgtgtgggtcccggacgagcaggacgcctacgtagaggcggaggtgaaatcagaagccacagggggacgcgtgaccgtggaaacaaaggatcagaaggttctgatggttcgggaggctgagcttcagcccatgaatccaccacgattcgacctgcttgaagatatggcaatgatgactcacttgaacgaggcctccgtgctgcataatttgagacagcgctacgcaagatggatgatctatacatatagcggtcttttctgcgtcaccatcaacccctataaatggttacccgtctacaccgcctcagtcgtggcagcatataaggggaagcgtaggtcggactcaccccctcatatttacgcagtggccgataacgcctacaacgatatgcttcgcaatagggataatcagagcatgcttataactggcgaaagtggcgctggtaaaaccgttaacactaaacgggtcatccagtactttgcaatagtggctgccctgggggacggccctggcaagaaagctcaattcctcgccaccaaaaccggcggtacccttgaagaccagataatcgaggcaaacccagctatggaagcctttggcaacgctaaaaccctccgaaatgataacagcagtcgcttcggaaaattcatccggatacattttggccctagtgggaagctggcctctgctgacatcgattcctatttgttggagaagtcccgagtgattttccaattacctggcgagcggtcatatcatgtgtactatcaaatactgtctgggagaaagccggagctacaggatatgttgctgctgtctatgaacccctacgactaccatttttgtagtcaaggagtgattaccgttgacaacatgaacgatggcgaggagctcatagccacagaccacgccatggatatactcggcttcagtgtggatgagaaatgcgcctgttacaaaattgtcggtgctcttctacatttcggaaatatgaaatttaaacaaaaacagagggaagaacaggccgaggccgatgggaccgaaagtgctgacaaggccgcatacctcatgggagtgtccagcggtgatttgttaaagggactgctgcatccgagagtgagggtcggtaacgagtacgtcaccaagggacagtctgtcgagcaggtggttttcgcagtcggagccctggcaaaggctacctatgataggctctttcggtggctagtgagccgaattaatcaaaccctggacacaaaattaccgagacaattctttattggcgtgttggatatcgcagggttcgagatcttcgaattcaatagctttgaacaactgtgcattaatttcaccaacgagaagttgcagcagttttttaatcagcacatgtttgttctagaacaagaggagtataagagggagggaatagactgggtttttatcgacttcggattggatttgcaaccatgcattgacttaattgagaaacccctgggcatcctcagcatccttgaagaggagtgtatgtttccaaaagcgtcagacgccagctttcgagcaaaactgtatgacaatcacgcaggcaagtcgcctaactttcagcaacccaggccggataaaaaaagaaaataccaggcccatttcgaagttgtgcactatgccggtgtggtgccttactcaatcgttggatggttggagaagaacaaagatcctctgaatgagactgtggtgcccatctttcagaaatcgcagaatcgcctgttagcaactctatacgaaaactatgcaggttcatgtagcactgagccccctaaaagcggggtgaaagagaagaggaagaaagccgcaagctttcagacagtcagtcaactccataaagaaaatctcaataaactgatgactaatttacgtgcaacccagccacacttcgtgagatgtattgttccaaacgagaacaagactccaggcgttatggatgcctttctagtcctccaccagctgagatgcaatggtgtgttggaaggcatacgaatctgcaggcagggctttccaaataggctactgtataccgacttccgacagagatatagaattctgaatccctccgccatcccggatgatacgttcatggactcccgcaaagcaacagagaagctgcttggttcattagacttggatcacacccaatatcaattcgggcacaccaaggtttttttcaaggccggactgctaggcgttctagaagaattaagagaccagcgcctggcgaaggtactgaccctcttgcaggcgaggtccaggggacgcctgatgcggctggagtaccagagactcttgggagggagggacgctctcttcaccatccaatggaacattagggccttcaacgccgttaaaaattggtcttggatgaaactgtttttcaaaatgaagcccttactaaggagcgcccaagctgaggaggaactcgcagctctgagagccgaactgagaggcttacgaggtgcgctcgccgcagctgaggccaaacgccaggagctggaggagacacatgtgtccataacccaggagaaaaacgatctggctcttcaattgcaggccgagcaggataatctggctgacgctgaggaacgttgccacctcctgattaagagcaaggtccaactggagggtaaggtgaaagagctgagcgagagattggaggacgaggaggaggtgaatgcggacctggccgctcgtagaagaaagctggaagatgagtgtacagaacttaagaaggatatcgatgacctaaaactgacacttgccaaagccgaaaaggagaaacaggcaacggaaaataaggtaaaaaatctgacggaggaaatggccgcactggacgagagcgttgctagactgacaaaggagaagaaagcactgcaagaggcacaccaacaggcactcggcgacctgcaggccgaagaggatcgcgtgtctgcgctcacaaaggccaagcttcgtctggagcagcaggtggaggatcttgagtgttcactcgaacaggagaagaagctgaggatggacaccgagagggcaaaaagaaaattggagggcgatctgaagttgacccaagagagtgtggctgatgccgcacaggataaacaacagttagaagagaagctgaagaaaaaagattcagagctgtcccagctctccctcagggtggaagacgaacaactgctaggagcccagatgcaaaagaagattaaggaactgcaggctcgagccgaggaactggaggaagagctcgaggcagagagggctgctcgtgccagagtggagaaacagcgcgctgaggccgcacgagaactcgaggaactgtccgaacgcctggaggaagcagggggagccagtgcagggcaacgcgagggatgcagaaaacgcgaagccgaacttggcaggctgaggcgcgagttagaggaagctgcactaagacacgaagcaacggtggcagccttgaggcggaagcaagctgagggggctgccgagctgggcgagcaggtcgattccttgcagcgggttcgccagaagttagaaaaagaaaagagcgaacttcgcatggaggtcgatgacttggctgcgaatgtcgaaactctcacccgtgcgaaagccagcgcagagaaactgtgtcgaacatacgaagaccagctcagtgaagccaaaatcaaagtagaggagcttcagcgacagttggccgacgcgtcgacccagagagggagattgcagactgagtctggagaactctcccgcctcctggaagagaaagaatgtctcatttcgcagctgtcgcggggtaaggctctggctgcccagtccctcgaggagctgaggaggcagttggaagaggagtccaaagccaagagcgctctcgcacacgccgttcaggcactgaggcacgactgcgacctcctgcgcgaacagcacgaggaggaggccgaggcccaggcagagctgcagagactgctcagcaaggccaatgccgaagtcgcacagtggaggtctaagtatgaagccgatgcaattcagcgaacagaggaactggaggaggccaaaaagaagttagctctgaggctgcaggaggctgaggaaggtgtggaagccgcaaatgccaagtgcagtagtcttgagaaagccaagctacgcttgcagacagagtctgaggatgtgaccttggagcttgagcgggctacaagcgctgccgcagccttagataagaaacaacgacatctcgagagagcgctggaagaacgacggcgacaggaggaggagatgcagcgcgagctggaagctgcacagcgggagtccagaggactgggaacagaactattccgcctgaggcacggacacgaggaggccctggaagccctcgagaccctgaagcgagagaacaagaatctgcaggaagagatctcagacctgactgaccaagtctctctttccggcaaatcaatccaggaacttgaaaagactaaaaaagcactcgaaggggagaagagcgagatacaggccgctctggaggaagcggaaggcgctctggagctcgaggagaccaagaccctgcgaatccaactggaactctcccaggtaaaagccgaggtggatcggaagcttgctgaaaaggacgaggaatgtgccaacctgagaaggaaccatcaacgtgccgttgagtcccttcaggcatcactggacgccgagacaagagcccgaaacgaggccctaaggctgaagaagaaaatggagggcgatcttaatgaccttgaattgcaactgggacatgccacacggcaggctacagaggcgcaggccgctactaggctcatgcaagcacaactgaaagaagagcaggccggtcgcgacgaagagcagcgcctggctgcagagcttcatgaacaggctcaggctctggagcggagagccagtttgctggccgcagaactagaggaattaagggccgctctcgaacagggagagagatcacgcagattagcagaacaggagctgctggaagccaccgaacggttgaacctcctgcacagccagaataccgggctgctgaaccaaaaaaaaaaattagaggccgatctggcgcagctcagcggagaggtggaagaagccgcacaggaacgacgcgaagcggaagagaaagctaaaaaggccatcactgacgccgctatgatggccgaggagctgaaaaaggaacaggatacgagtgcacatctagagcgtatgaaaaagacactcgaacagaccgtcagggagttacaagcacggctggaagaggccgagcaagccgcactgcgcggaggcaaaaagcaggtccagaaacttgaagctaaagttcgcgaactcgaggctgagctcgatgccgagcagaagaaacatgccgaggctctgaagggcgtccgcaaacacgaacgaagggtgaaagagctggcctaccaggccgaggaggatcgcaagaacctcgcacggatgcaagatctggtcgataagctccagtcaaaggtgaaatcatataaacgtcagtttgaagaggcggagcagcaagctaatacaaacttggcaaaataccggaaggctcagcacgagctcgacgatgctgaggagagggccgacatggcagagacccaagcaaataagctgcgggctagaactcgggatgccttaggtcctaagcataaagagtaa

SEQ ID NO: 27505 - DNA, 2730 bp, Artificial Sequence
  Description of Artificial Sequence: Synthetic coding sequence
atggaaagagccatggagcagctgaatcggttgactcgctccctgaggagggcacgcacagtggagctccctgaggataacgaaacagctgtttacactctcatgccaatggttatggcagatcagcaccggtcggtcagcgaactactctcaaatagtaagtttgatgtcaactacgcgtttgggcgtgtgaaaaggtccttgctacatattgcagccaattgtggcagtgtggaatgccttgtgctgctacttaagaaaggagcaaaccctaactaccaggatatttctggctgcactcctctccacctcgccgctagaaatggtcaaaaaaaatgtatgtccaaactgcttgagtattccgctgacgtgaacatatgcaacaatgagggacttacggcaatacattggttggccgtcaacggaagaacagagctgctgcacgacctcgtgcagcacgtgagcgatgttgatgttgaagacgccatggggcagactgctctccacgtggcatgccagaacggacataagacgacagtgcagtgcttgttggacagcggggcagacattaaccgtccgaatgtctcaggggcaacacctctgtattttgcatgtagtcacggtcaacgcgatacagctcaaatcttactgctgcgtggggctaagtatctgcctgacaaaaatggtgttacgcctctagatctgtgtgtgcagggcggttacggtgaaacttgcgaggtgttgatccagtaccacccacggttgttccagacaatcatccagatgacgcagaacgaggatctaagggaaaacatgctgcgacaggttcttgaacacttgagtcaacagtcagaaagccaatacttgaagatccttacctcactggcggaggttgccaccactaatgggcataagttgctgtcactgagtagcaattacgatgcgcagatgaaatccctgctgcgcattgttcggatgttctgccacgtgtttaggatcggaccttcctccccctccaatggtatagatatgggttataacgggaacaagacccctcgatcccaggtgtttaaacccctggagctcttatggcactcccttgacgagtggctggtgctcatagccacggagctgatgaaaaataagagggactccaccgagataacttctatcctcctgaagcagaaaggacaggaccaggatgcagcaagcatcccacctttcgaaccacccggacccggatcttatgagaatctgtccacaggaaccagggagtcgaagcctgatgcattagctgggcgtcaggaggcaagcgcagactgtcaagacgtgatatctatgacggctaacagactgtcagcagtcatacaggccttctatatgtgttgtagttgtcagatgccccctgggatgacgtctccacgcttcattgaatttgtgtgtaagcacgatgaggtcctgaaatgtttcgtaaatcgcaatccaaaaatcattttcgaccattttcactttctgctggagtgtcctgagctgatgtcccggttcatgcatattatcaaggcccagccctttaaggatcgctgtgagtggttttacgagcatctgcatagtgggcagcccgattcggacatggtacatcgaccagtgaacgagaatgacatcctgctggtgcatagggatagtattttcagaagttcatgtgaggtggtgtcaaaggctaactgtgcgaaacttaaacagggtatcgcagtgcggtttcacggcgaggagggcatgggacaaggagtggttagggagtggttcgacattttgagcaatgagatcgtgaaccctgactacgcactcttcacccaatccgccgatggaacaacatttcagccaaactctaattcttatgtaaatcctgaccacctcaattacttcaggtttgccggtcagattctgggcttggccttgaaccatcgacaacttgtgaatatctacttcactcggtccttctacaagcacatactcggtatccccgttaattaccaagacgtggcttctattgaccctgagtatgctaaaaatctgcagtggattctcgataacgatatcagcgacctgggcctggaattgacgttctccgtggagaccgatgtgtttggagcgatggaagaggtccccctgaagcccggagggggatcaattctcgtgactcaaaacaacaaagccgaatacgtgcagttggtcactgaattaagaatgaccagagcgatccagcctcagataaacgctttcctccagggattccacatgttcatcccaccatctctcatccagttgttcgatgaatacgaattagagctcctgttgagtggaatgcctgagattgatgtttccgattggataaagaacaccgagtatacatcaggatatgagcgtgaagatcccgttatccagtggttctgggaggtcgttgaggatatcacccaggaagagcgcgtcctactccttcagttcgtgactggcagctctcgtgttcctcatggtgggtttgctaacataatgggtggcagtgggctgcagaactttaccattgccgctgttccatatacccctaacttgctgcccacctcctccacttgtatcaacatgctgaaattgcccgaatatccctccaaagagatactgaaagataggctcctagttgcacttcactgcgggagctacgggtacactatggcctag

SEQ ID NO: 27506 - DNA, 2679 bp, Artificial Sequence
  Description of Artificial Sequence: Synthetic coding sequence
atgcgaaaggtgaagaaactgcgcctcgataaagaaaatactggatcctggcggtcgttttctctgaattccgagggggctgagcgcatggccacaactggcacacccaccgctgatagaggggatgcagccgctacggatgaccccgcagcaaggttccaagtgcagaagcatagctgggatggactacgttcaatcattcacggttcccgaaaatattctgggctcatcgtgaacaaggctcctcatgactttcaattcgttcagaagactgacgaaagtggaccacacagtcacaggttgtactaccttggaatgccgtatggctctcgagagaattctttactctacagtgagattcctaagaaggtgcgcaaggaggcactcctgctactatcctggaagcagatgttagatcactttcaagccacaccgcaccatggagtgtattcccgggaagaggagctgctccgcgagagaaagcgcctgggcgtgttcggcattacatcatacgattttcactctgagtcgggactgttcctcttccaggcctcgaatagcctgtttcattgtcgagacgggggaaaaaatggatttatggtaagtcccatgaaacccttggaaatcaaaacccagtgctcgggtcctcgcatggacccgaagatttgccccgcagacccagctttcttcagttttattaataactcagacctgtgggtcgctaatatagagacaggagaggagcgcaggctaaccttctgccaccaaggactgtcgaatgtcctggatgatcccaagtcagccggagtggcgactttcgtgatccaggaagagttcgatcgattcaccggatattggtggtgcccaaccgcctcatgggaaggtagtgaaggcctgaaaacactcagaatcctgtacgaggaagtggacgaaagcgaggtcgaagtcatccatgtccccagtcctgcgcttgaggagcgaaaaacagactcataccgttatcctaggactggatccaagaatcccaaaatcgcccttaaactcgctgaattccagactgattcacaaggtaagatcgtctctacgcaggaaaaagaactggtgcagcctttcagttccctattcccgaaagttgagtacatcgccagagccggatggacacgcgacggcaaatacgcatgggcgatgttcctcgaccgaccacagcagtggttacagttggtgttactgcctcctgctctgttcatcccgagcaccgagaatgaggagcagcgtctcgctagtgccagggcggtccctcgcaacgtccagccatacgtcgtgtatgaggaggtgacgaacgtttggatcaatgttcacgatatcttctatcctttcccacagtccgaaggcgaggacgagctatgctttttgcgtgcaaatgagtgtaaaaccggattttgtcacctctataaggttaccgccgtccttaaatctcagggttatgactggtcagaacccttttcccccggtgaagacgaatttaaatgtcctattaaggaggaaatcgccttaacatcaggagaatgggaggttctcgcccgacacggttccaagatatgggtcaatgaggaaacgaagttggtgtattttcagggcacaaaagacacaccactagaacaccacttgtatgtggtgagctacgaggcggcaggcgagatcgtgcgcctgacgactccaggatttagccactcctgtagcatgtcacagaactttgacatgttcgtatcccactatagtagtgtgtcaacccccccatgcgtacatgtctataagctctcgggcccagacgatgacccactccacaagcagcccagattctgggcctccatgatggaggctgcttcatgtccccctgattatgtgccgcctgaaatcttccactttcacacgaggtctgatgtcagactgtatggcatgatttacaagccacacgctctgcaaccaggaaagaaacatccgaccgtcctgttcgtctatggtggaccacaggtgcagcttgttaataacagttttaaggggataaagtacctgagactgaacacgctcgcctcattgggatatgcagtggtggtgattgatgggagaggaagttgccagcgtggcctcaggtttgagggtgctctcaagaatcagatgggccaagtcgagattgaggaccaggtggaaggcttgcagtttgtagcggagaaatacgggtttatcgatctttcccgggtggcgatccatggctggtcatatggtggctttctctcactcatgggtctcatccataaaccccaagtatttaaagtcgctatcgcgggagcccctgtgacggtttggatggcctacgatacgggatatactgagcgttacatggacgtgcccgagaataaccagcacgggtacgaagccggaagtgtagccctccatgttgaaaaactgcctaacgaacctaacaggctccttatcctgcacggtttcctggatgagaacgtacattttttccacactaactttctcgtgtcgcagcttatcagagccggaaaaccttatcaactgcaaatctacccgaacgagcgtcattctattcggtgtccggaaagcggagagcattatgaagtgacactgctgcactttctacaagaatacctctag

SEQ ID NO: 27507 - DNA, 1533 bp, Artificial Sequence
  Description of Artificial Sequence: Synthetic coding sequence
atggctgccgaactggtagaggccaaaaacatggtcatgagctttcgggtgtcggacctgcaaatgctactcgggtttgtcgggcgatcaaagagcggcctgaagcacgaactggttactagggcccttcagctcgttcagttcgactgttctcccgaacttttcaagaaaatcaaggaattatacgagacccgttacgctaagaaaaattccgaacctgctccccagccccacagacccctggatcctctgaccatgcattccacctacgatcgcgcaggggctgtgccacgaacgccgctcgctggccctaatattgattaccccgtgctgtacggtaagtacctcaacggactgggacggcttcctgctaagaccctgaagcccgaagtccgcctcgtcaaactgccgttcttcaatatgctggacgaactcctgaagccgacagagctagttcctcaaaacaacgagaaacttcaagaaagcccatgtatattcgcactaacacccaggcaggtggaacttatcaggaatagccgagagctgcaaccgggtgttaaggcggtgcaggtggtgcttcgaatatgttacagtgacaccagttgcccacaagaggaccagtatccaccaaacattgctgtgaaagtgaaccactcctattgctccgttccaggctattacccatctaacaagcctggtgtggagcccaaacgcccatgtaggcccattaacctgacacacttgatgtacctctctagtgccacaaacagaatcacagtcacatggggtaactacggaaagagctacagtgtggcattgtatttggttcggcaactgacgagctccgagctcctgcagaggctaaaaaccatcggagtgaaacaccctgagctgtgtaaggcccttgtaaaggagaagctgagactagaccctgactcagaaatagcaacaacaggagttagagtgagcttgatatgtcccctggtgaagatgcgcctgtcagtcccctgccgggcagaaacttgcgcccaccttcagtgctttgatgctgttttctacctgcaaatgaacgaaaagaagcccacctggatgtgccctgtatgtgacaagcctgccccttacgaccaactgataattgatggtctgctttccaagattctgtctgagtgcgaagacgcagatgagattgagtatttggtggacggcagctggtgtcctattcgtgcagaaaaggaaaggtcatgttctccccagggggctattctggtgctgggcccatctgatgcaaatgggctgttgcccgctccttcagtaaatgggtctggagccctgggatcaactggaggaggaggccctgtgggcagcatggaaaatggcaagccaggcgctgatgttgtggacctcactctggactcttcaagttccagcgaagatgaggaggaagaggaagaggaggaggaagacgaggacgaggaggggcctcgacctaaaaggaggtgcccatttcagaagggcctggtgcccgcttgttag

SEQ ID NO: 27508 - DNA, 684 bp, Artificial Sequence
  Description of Artificial Sequence: Synthetic coding sequence
atggcagcccagcggcctttgagagtgctgtgcttggcgggattccgccagtccgagcgcggtttcagggagaagacgggggctctgcgcaaggccttgcggggtagggccgaattagtttgtctgtctgggccacacccagtaccagatcctcccggtcccgagggggcacgctccgacttcggaagctgtcctccagaagagcaacctagaggctggtggttttctgaacaagaggctgacgtcttcagtgccttggaggagccagccgtctgcagaggtctggaagagtcgttaggcatggtggctcaggcactgaacaggctaggtccgttcgatggactgcttggtttctctcagggcgctgctctggctgccctggtctgtgccctaggtcaggctggggacccccgatttcccctgccacgcttcatcctcctggtgtccggcttctgtcctaggggtatcggctttaaggaatccattctgcaaaggcctttgagccttcctagcctgcacgtatttggcgatacagacaaagttatccccagccaggagtcagtccagctcgccagccagttccctggggctattaccctgactcacagtggaggacatttcattccagcagctgcccctcagcggcaggcttatctcaagttcctggatcagttcgccgagtag

SEQ ID NO: 27509 - DNA, 1656 bp, Artificial Sequence
  Description of Artificial Sequence: Synthetic coding sequence
atggaagaagctgagcttgtgaaaggtcgcctgcaggccatcaccgacaagcggaaaatccaggaggaaatcagtcagaagcgtcttaagatcgaggaagataagctgaagcatcagcatctaaagaagaaggcgcttcgtgaaaagtggcttctggacgggatttcaagtggtaaggaacaggaagagatgaagaagcaaaatcagcaagatcagcaccagatccaggtactggaacagagcatattgagactcgaaaaggaaatacaggatttagagaaggccgagctgcagatctccactaaggaagaggctattctcaagaaactgaaatctatcgagaggactactgaggatataatccggagtgtgaaggttgaaagagaggagagggccgaggagtccatagaagacatctacgcgaacattccagacctgcctaagtcctacatccctagccgcttgcgaaaggagatcaatgaggaaaaagaggacgacgaacagaaccgcaaggctctgtacgccatggagatcaaagtagaaaaagaccttaaaactggtgaatccacggttctgtcaagcatccctctgcccagtgatgattttaaggggactgggataaaggtctatgacgatgggcaaaagagcgtttacgctgtgtctagcaaccactcagccgcttataatggtactgatgggctggcaccagtggaggtcgaagagctgcttcgacaggcctctgagcgtaatagcaagagtcccacagagtatcacgagcccgtctatgccaatccattttaccggcctactactccccaaagagaaaccgtgacgccgggtcctaattttcaggagaggattaagatcaagaccaatggtttaggaatcggagtcaatgaatccatccacaatatgggcaatggtctttcggaggagcgagggaataatttcaaccatattagccctattcctcccgtgcctcacccacggagcgtaatacagcaggccgaagagaagctgcacactccgcagaagaggctgatgaccccctgggaggaatccaacgtgatgcaggacaaagacgccccatcacctaaacctaggttgagccccagggaaacgatttttggtaagagtgagcaccagaatagttctcctacctgccaggaggacgaagaggatgtcaggtacaatatcgtgcatagtctgcctcccgacataaacgataccgagccagttactatgatatttatgggataccagcaggcggaggactcagaagaagataagaaatttttgaccgggtatgatgggatcattcacgccgagctggtggtcattgatgacgaagaagaggaggacgaaggagaagccgagaaaccatcataccacccaatcgctccacacagtcaggtgtatcagcctgcaaaaccaacacctcttcctcgtaagcgcagtgaagccagtccacatgagaacaccaatcacaagagcccccataaaaacagcatctcattaaaagaacaggaggagtcattaggctcacctgtgcaccactcgccgtttgatgcccagacaaccggtgacggcacagaagacccatccctcaccgctttgcggatgcgcatggccaagcttggcaagaaggtgatatag

SEQ ID NO: 27510 - DNA, 1701 bp, Artificial Sequence
  Description of Artificial Sequence: Synthetic coding sequence
atgttcgtctctgatttccgcaaggaattctatgaggtggttcagtctcagcgtgtactgctctttgtcgcttcagatgtggatgccctgtgtgcttgcaagatcttacaggctctgtttcagtgtgaccacgtgcagtatacactggtgcctgtgtcagggtggcaggagctggagacggccttcctggagcataaagaacagttccattattttattctaataaactgtggcgcaaacgtggacctcctggatatcctgcagcctgatgaggataccatcttctttgtatgcgatactcaccggcctgtcaatgtggtcaacgtctacaacgacacccagattaagctcctgataaaacaggacgatgatctcgaggtgcccgcatacgaggacatcttccgcgatgaagaggaggacgaggaacattctggtaacgatagcgacggttcggaaccctcagaaaagagaacccgtctggaggaggaaattgtggaacagacgatgaggcggcgtcagcggcgagagtgggaggccaggaggcgcgacatcctctttgactacgaacagtatgaataccacggcacttcctccgcaatggtgatgtttgagctcgcttggatgctctctaaggacctcaacgacatgctgtggtgggcaattgtgggcttgacagatcaatgggtccaggacaaaattacacaaatgaaatatgtcacggatgtcggagtgttgcagcggcatgttagtcggcataaccaccgcaatgaggacgaggaaaacaccctatcagttgattgtacacggatcagtttcgaatacgatttgcgtcttgtcctgtaccaacactggagcctccacgactcgctgtgcaatactagctatacagctgcacggttcaaactgtggtccgtacacgggcagaagagactgcaggagtttctggccgacatgggactgcccctgaaacaggtgaagcagaaatttcaggctatggacatctctcttaaagagaatcttcgcgagatgattgaggaatctgccaataaattcggaatgaaggatatgagagttcaaaccttcagtatccacttcgggttcaagcacaaatttcttgccagcgacgtggtgttcgccaccatgagcctgatggagagccctgaaaaggacggttccgggacagatcattttatccaagcgctagattctctgagtcgctctaatctagataagttataccacggactggaactcgcgaagaaacagctccgagctacgcaacaaacaattgcgtcgtgtttatgcaccaacctggtaatttcccaagggccatttttgtattgtagtcttatggaggggactcctgacgtgatgctgttcagccgtccagcaagtctctctctgctgagcaagcacctgcttaagtcattcgtgtgcagcactaaaaatcggaggtgcaagctgttgccactagtcatggccgctcctctttcaatggagcacggtactgtaaccgtcgttggaatcccaccagagaccgactcttccgatcgcaagaacttttttggacgagcgttcgaaaaagccgctgagtctacatcaagccggatgttacacaaccacttcgaccttagcgtgatcgaattgaaggctgaggacagatctaaattccttgatgctttgatctccttgctgagttag

SEQ ID NO: 27511 - DNA, 1461 bp, Artificial Sequence
  Description of Artificial Sequence: Synthetic coding sequence
atgtccgttacctatgacgactccgtgggagttgaagtctcttccgatagtttttgggaggttggaaactacaagcggactgttaaaaggatcgatgatggacaccgtctgtgtagcgatctgatgaattgcctccacgaaagagcacggatcgagaaggcatacgctcagcagctaaccgagtgggcgagacggtggaggcagctggtggagaaagggcctcaatacggcacagtggagaaggcttggatggcctttatgtctgaggctgagagagttagcgagctacatctggaagtcaaggcatctttgatgaacgatgatttcgagaaaattaaaaactggcaaaaggaggcattccataagcagatgatggggggattcaaagagacaaaggaggccgaggacgggtttcgaaaggcacagaagccatgggccaaaaaattgaaggaagtcgaagccgctaaaaaagctcatcacgcagcatgcaaggaagaaaagttagccatctcccgcgaagcgaacagtaaggccgatccgtctctgaacccagaacagttaaagaaactgcaggataaaatcgagaaatgtaagcaagacgtgctgaaaaccaaggagaaatacgagaagtcacttaaggagctagatcaaggaacacctcaatatatggaaaatatggagcaggtcttcgaacagtgtcagcagtttgaggagaagcggctccggtttttcagggaggttttgctcgaagtgcagaaacatctggaccttagcaatgttgctggctacaaggccatctaccacgacctggagcagagtatcagagctgctgatgcggtggaggatttgaggtggttccgcgctaaccacggcccaggaatggcaatgaactggccacagtttgaggagtggtccgcagacctcaaccggactctgtcccgaagagagaaaaagaaagccactgacggcgttacccttacagggattaaccagactggcgaccagagcttaccaagcaaaccgtcctctactcttaacgtacctagtaaccccgctcagagtgctcagagccagagtagctataatccctttgaagacgaagatgacaccggcagtacggtgagtgaaaaggatgatactaaggccaagaatgtgtccagttacgagaaaacacagtcttatcctacagattggtcggatgacgagagcaacaatccattcagtagcaccgatgcaaacggcgattccaatccttttgatgacgacgcaacgagtggtactgaggtcagagtccgggcactttacgactatgaaggccaggaacatgatgaactgtcctttaaagcaggtgatgaactaacgaagatggaggacgaggacgagcaagggtggtgcaagggcagactagataacggacaggtgggcctgtacccagctaactacgtagaagcgatccagtag

SEQ ID NO: 27512 - DNA, 2262 bp, Artificial Sequence
  Description of Artificial Sequence: Synthetic coding sequence
atgatggaggaaagagcggctgcagcagtggctgccgctgcctcttcttgtcggccattaggatctggagccggtcccggaccgaccggcgctgccccagtctccgcacccgctcccggacctggtcctgccggaaagggaggagggggagggggtagcccaggaccgaccgcgggacctgaacccctgtcactgccaggaatcctgcattttatacagcatgaatgggcccgatttgaggcagaaaaagcaagatgggaggctgagcgcgctgaattgcaggcccaagttgcattcctgcagggcgagcgtaagggacaggagaacctcaaaaccgatctggtccggaggattaaaatgttggagtatgccttaaaacaggaaagagcgaagtaccacaaactgaagttcggcaccgacctcaatcagggtgagaaaaaagccgacgtatccgagcaggtttccaatggtcctgtggagagtgtgaccctcgagaactcccccctcgtgtggaaagaggggaggcagctccttcgccagtatttagaggaagtgggctataccgatacaattctcgacatgcggagcaagcgagtcaggagtctgctgggtcgaagcttggagctgaatggagcagtcgagccctccgaaggagctccccgtgcccctcccggtcccgcaggcctctctggaggcgaaagcctacttgtgaaacaaatcgaggagcagataaaacggaatgccgctgggaaagacggaaaggaacgattaggtggttcagtgctggggcagattccatttctgcagaattgcgaagacgaggacagcgacgaagacgacgagctggacagtgtgcagcataagaaacagagagtgaaactgcctagtaaggctctggtaccagagatggaggacgaagatgaagaggatgacagcgaggacgcgatcaacgaatttgactttttagggtctggggaagatggagaaggagcacccgatccgagaaggtgtacagtggatggtagcccacatgagctggagagccgcagagtcaaactccagggcatcctcgccgacctgcgggacgtggatggtctcccaccaaaagtcacaggcccacccccaggaacgcctcagcctcgtccacacgaagacgtctttattatggacaccatcggaggtggcgaagtgtctctgggggacctcgcagatctcaccgtaaccaatgataacgacttgtcttgtgacctgtctgactccaaggacgcctttaaaaagacatggaaccctaagtttaccctgcgttcccactacgacggtattcgctctttagcctttcatcattcacaatccgcacttctgaccgcgtccgaggacgggaccctgaagctctggaatcttcagaaagccgtaaccgcaaaaaagaacgccgctctagatgttgagcccatccacgcattcagagctcacaggggccctgtgctggcagtggctatgggctcaaacagcgaatactgttattctggcggagcagatgcctgtatccatagctggaaaatcccagatctgagtatggatccttacgacggatacgacccctccgtgctgtcacatgtgctggaaggtcatggagacgccgtatggggtctggcattttctcccacaagtcagcgcctggccagttgttccgcagacggaaccgtgcggatctgggacccctcttcttccagcccagcttgtttgtgtactttcccgactgcttcagaacacggagtgccgacctcagtagccttcacctccaccgaaccggctcacattgtagcttccttccgttctggggatactgtgctgtatgatatggaggttgggagtgccttgctcactcttgagtccagagggagcagtgggcctactcagattaatcaagtcgtttcacacccaaatcaaccactcaccatcacagctcacgacgatcgcggaataagatttctggataaccgtaccggcaagcctgtgcattcgatggtcgctcacctggatgcggtgacttgcctcgctgtagatcctaacggggcatttctgatgagcggaagccatgactgctccttgcgcctctggagtctcgacaataagacctgcgtgcaagagataacagcgcacagaaaaaaacatgaggaagctatccacgccgtggcctgccaccccagcaaggccctgatagcaagtgccggtgctgacgccctggctaaggttttcgtttag

SEQ ID NO: 27513 - DNA, 1596 bp, Artificial Sequence
  Description of Artificial Sequence: Synthetic coding sequence
atgaggatgcatacgcgcctgagcctgccgggacctcctcaccatgttggtgcggcataccctcccgctgggggaaacagatccgagaatgctggcagttggggcggtgcgggagcttcttccgtcgagccattagccagaagggtcgcctccggggaagctaccctggccatggaccagccagccggactccaggtggattacgttttcaggggcgttgaacacgcagttagagtgatggtgagcggccaggtgctcgagctggaagtggaagaccgcatgacagcggaccagtggaggggagagtttgacgcagggtttattgaggatttaacacataaaaccggcaatttcaagcagtttaatatcttctgtcacatgctcgagagcgctcttacgcagtcgtccgagagcgtcacactggaccttttgacttataccgatttggagtcactccggaatcggaaaatggggggtcggccaggctctctagcccctcgatccgcccaactcaattccaaacggtaccttattctcatttatagcgtggagtttgatcggattcactaccctctcccccttccctatcaaggcaaacccgaccctgtagtgctgcaaggcataattcgcagcctcaaagaggagttgggcagactccagggactagatggccagaacactagagacacccgggaaaatgagatctggcacttgagggaacaggtttccagattggcttccgagaaaagagaactcgaggcacaactcggtcgctcccgcgaggaggcactagcagggcgagcagcccgacaggaggcagaggcactcagaggacttgttcgcggactcgagttggagctccgtcaggaaagaggattgggacaccgcgtggccggacgtcggggtcaggattgtcggagactggctaaagagctggaggaagccaaggcctctgaacgatctctaagagccaggttaaagactctcaccagcgaactggccctttacaagcgaggcggaagggggtccagagggagaggacgacccgctcgtcctagcccatcacctacaggcggacgcgcactgagattcgatcctactgccttcgtcaaggcaaaggagcgtaagcagcgggagatacaaatgaaacagcagcagaggaaccgcttggggtccggcggaagcggcgatggcccaagcgtctcatggagtcgccagacacagcctccagccgctttgactggacgaggggacgcacccaacagaagcaggaaccggtcgagttccgtggattccttcagaagtagatgtagctcggctagttcctgcagtgatctggaggactttagtgaaagcctaagtcggggaggtcataggcgcaggggaaaaccaccctcaccgacgccctggtctggttccaatatgaagagtcctcctgttgaacgatcgcaccaccagaaaagtttagcaaatagcggcggttgggtgcctatcaaggagtacagtagcgagcatcaggcggctgatatggccgagatcgacgctagactaaaagccctccaggagtatatgaatcgactggatatgcgtagctag

SEQ ID NO: 27514 - DNA, 1452 bp, Artificial Sequence
  Description of Artificial Sequence: Synthetic coding sequence
atggcgtccttgctctggggcggagacgcaggtgcagcagagtccgagcgactcaacagtcatttctcaaacctctctcaacctaggaaaaacctttgggggatcaagtctactgccgtgcgtaacattgatggcagtattaataacattaacgaggatgacgaggaagatgttgtcgatctggccgctaatagtctcctgaacaagctgattcatcagtctctcgtggagtcgagtcaccgcgtggaagtgttacaaaaagatccatcatcgccgctctactccgtgaaaacctttgaggagctgaggctgaaagaggagctgctcaaaggcatctacgctatgggatttaatcgcccaagcaaaatccaggaaatggctctgcccatgatgctggctcacccccctcagaatctgattgcacaatctcagtctgggaccgggaagaccgctgccttcgtgttggcgatgctttcccgggtgaacgcccttgaactttttccccagtgcctgtgccttgcccctacatacgagttggcattgcaaactggacgggtggtcgagcagatgggaaagttttgtgtggatgtccaggtaatgtacgccatcagaggcaacagaatcccgagagggacagacatcactaaacagatcattattgggactccaggcaccgtgttggactggtgttttaaactgaaactgatcgatctgacgaagatccgcgtttttgtcctggacgaggccgacgtgatgattgatacccaaggattcagtgatcacagtattcggatacagagggctctgccatcagagtgtcagatgctcctgttctcggccaccttcgaggacagcgtctggcacttcgcagagaggatcatccctgaccctaacgtgattaagttacgaaaggaggaacttaccttgaataatatacgccagtattatgtgttgtgcgagcaccggaaggataaataccaggccctgtgtaacatctatggctcgatcacaatcggccaggctatcatattctgccagaccaggcgcaacgcgaagtggctcactgtcgagatgattcaggacggccatcaggtgtctctgctgtctggagagttgactgtggagcaaagagcgagtatcattcagaggttccgagacgggaaggaaaaggtcctcatcaccaccaacgtatgcgctagaggtatcgatgtcaagcaagtcacaatagtcgtgaatttcgatcttccggtgaagcagggcgaggagcccgactatgagacatatctccatcgaattggacggacaggtcgttttggaaagaagggtctggccttcaatatgatcgaggttgacgaattgccatccttgatgaaaattcaggatcattttaacagcagcattaaacaactcaatgcagaagacatggacgaaatcgaaaagatagactattag

SEQ ID NO: 27515 - DNA, 1014 bp, Artificial Sequence
  Description of Artificial Sequence: Synthetic coding sequence
atggctgatgccgctcctcagttgggcaaacgcaaacgcgaactggatgtcgaagaggctcatgcagcttccacagaagaaaaggaggcgggagtgggtaatgggacctgtgcacccgtgagactgcccttctctggcttccgtcttcagaaggtactgagggagagcgctcgtgataaaatcatatttctgcacggtaaagtcaacgaggcctctggggacggcgacggcgaagatgccgtggtgattctagagaaaactcctttccaggtggagcaagtggcccagttgctgaccggcagtcctgaactgcaactgcagtttagtaacgacatctactctacgtaccacctgttccctcccagacagctgaacgacgtgaaaacaaccgtggtctatcctgctacagagaagcacctgcagaagtatcttagacaggatctgaggttgattcgggaaacgggggacgactacaggaacattaccttgccgcatctggagtctcagtcactatcgatccagtgggtgtacaatatactcgacaaaaaagctgaggctgacaggattgtgtttgaaaaccctgaccctagtgatgggtttgtattgattcctgatctgaagtggaatcaacagcagttggatgatctgtatctgatcgcgatctgtcataggcgcggtattcggtctctgagagatcttacacctgagcatctgccactgttgcgcaacattttacaccagggacaggaggccattttacagcgctaccggatgaagggggatcacctcagagtgtaccttcactacctgccttcctactaccatctgcacgtgcatttcaccgcactgggcttcgaagcgcctggtagcggcgtcgagagggctcatctacttgccgaggttatcgagaacctggaatgcgaccctcgccattaccaacagagaacactcacctttgcactgcgggcagatgatcctctgctgaagttacttcaggaagcacaacagagctag

SEQ ID NO: 27516 - DNA, 1782 bp, Artificial Sequence
  Description of Artificial Sequence: Synthetic coding sequence
atgaagctccaagccgtgatggagacactcctgcaacgccaacaaagggcaaggcaggaattagaggctaggcaacagttaccacccgaccctcccgctgcgcctcctggccgagccagggcagcccctgatgaggaccgagagcccgaatccgcacggatgcagagagcacaaatggctgcattggccgctatgcgggcagcggctgctggactcggccatccggctagcccaggaggttccgaggacggccctccgggttctgaagaggaggacgccgcaagagaggggacccctggatcgccagggagggggcgagaagggcctggtgaagaacacttcgaggacatggcgagcgatgaggacatgaaacccaaatgggaagaggaggagatggaagaagacctcggagaggacgaagaagaagaggaggaagactacgaggatgaggaggaggaggaggatgaagagggacttggtccaccaggcccagcctctcttggaaccactgccctatttccaaggaaagcacaaccaccccaagctttccgcggtgacggggtgcctagagtgctgggcggacaggagcggccaggccctggtcccgctcaccccggaggcgcagcgcacgttgcaccccaactacaacccccagatcatggagattggacttatgaagagcagttcaaacaactctatgaactggacggcgaccccaagcgcaaggaattcctcgatgatcttttctctttcatgcagaaacgtggaactcctgttaatcgtatcccaattatggccaagcaggtcctcgatctgttcatgctgtatgtgctcgtgaccgaaaagggtggcttggtagaggttataaataagaagctgtggagggagataaccaagggcttgaacttacccacgagcatcacgagtgcagccttcacactgcgaacacaatacatgaagtatttatacccatatgagtgcgagaagagaggcctgtcgaatcccaatgaattgcaggcagccatcgactctaacagacgagaaggacggagacagagttttggagggtctctattcgcgtactccccagggggtgcacatgggatgttgagctcccctaagctccccgtgtctagcctgggtctggccgcttcaaccaatggatcaagcatcactcccgctcctaagattaagaaagaggaagactcagccattccaatcactgtgcctggcagactgcctgttagtctcgcaggccatcccgttgtcgccgcacaggcagctgcagtgcaagcggctgcagcccaggccgctgtagcggcacaggccgctgctctcgagcagcttagagaaaaattggagtccgctgagcctcccgaaaaaaagatggcactggtcgccgacgagcaacaaagactgatgcagcgcgcactccagcagaacttcctggctatggccgctcagcttcccatgtcgattcgcattaattctcaggcatctgagagtagacaggacagcgcagtgaacctcacaggtaccaacggctccaacagtatctccatgtccgtcgaaattaacggaattatgtatactggagtgctcttcgcccagcctccagcaccaacacctaccagtgcacccaataagggagggggtggcggaggagggagttctagcaatgccggtgggaggggaggtaatacggggactagcgggggacaagcaggtccagctggcctttctaccccatctacctctacctccaataactcattaccttag

SEQ ID NO: 27517 - DNA, 6192 bp, Artificial Sequence
  Description of Artificial Sequence: Synthetic coding sequence
atggctgatggcgcaccaagacctcagttgtaccgcagtgtgagcttcaaactgctcgagcgatggagcggaggccctggactgcgcgaagaagatactgatacccccggtttaaggcggcgagcgtcctgccggcctacaactgccgctcggggacagcccagcaggagagtgagtaagttagcatcgggtccactagcagcgcctgctcaacctcggccattgaggagcctcagcccaagcgttagacagttgtccagacggtttgatgctccaaggctggacgacggctctgcgggaaccagggacgggggagttctgcctgcagccgcagaagaggcggctgagggcccagccagaggagcatggccctccgtaaccgagatgcgtaaactgtttgggggacctggttccagaagaccaagcgcagactccgagagccccggtacaccatccccggacggtgctgcctgggagccccctgcccgagaatcccgccagccccctacacctcccccacggacttgttttcctctcgccggactacggtctgcgagacccctgaccggaccagagaccgagggtcgtcttcgcaggccacaacaacaacaagaacgagcacagaggccagctgacgggctgcattcatggcatattttctcccagccgcaagcgggagctcgcgctagctgctcatcatcttcgatcgcagcatcatatcccgtgtcaaggtctcgagcagcttcttcaagcgaagaggaggaggaaggtccccctcagctccctggggcacagagtccagcgtaccacggcggtcactccagcggatccgacgacgaccgagatggcgagggaggccaccggtggggtgggcgaccaggtcttagacctgggtcttctctgcttgaccaggattgccggcctgattccgacggcctgaacctgtccagcatgaactcagccggagtgtccggttcaccggaaccgcctacatccccaagggcaccacgggaagaagggctccgagaatggggctcaggctcgcctccatgcgtccctggccctcaggagggactccggccaatgagcgattcagtcgggggagcctttagagtggccaaagttagcttcccctcataccttgcatcacctgcaggttcacgtggctctagcaggtacagttccactgagactttaaaggatgatgacttgtggtctagccgcggatctggcggatggggcgtctaccgaagccccagcttcggcgcaggtgagggtttgctgagaagccaggcacgcacgagagctaagggaccagggggaacatccagggctctgcgagacggagggttcgagcccgagaagtctcggcagcgcaaaagcttatccaatccggatattgcctcagaaacgttaaccctactcagttttctgcgcagcgacctgagcgagctgcgggtgcgcaaacctggcggaagttctggcgataggggatcgaaccccttagatggccgagattcaccttccgcaggaggacccgtggggcagctcgagcctatcccgattccagcccctgcgagcccaggaaccaggcctacactcaaggatctgactgctaccctacgacgcgctaaaagctttacctgttctgagaaaccaatggccagacgactgcctcgaactagcgcactgaaatcatccagcagcgaactactgctgactggcccaggtgcagaggaagatccactcccgttgatcgtgcaagatcaatacgtgcaggaagctcggcaggtgttcgaaaagatccagagaatgggggcacaacaagacgatggatcagatgcccctccgggatctccagactgggccggagacgtcactcgaggccagcggtcccaggaggaactctccggcccagagtcttctttaacagacgagggcattggtgccgatccggaaccccctgttgctgcattctgtgggctgggcacgaccggtatgtggcgacccttgtcgagctccagtgcccagaccaaccaccatggccctgggacagaagattcactgggaggatgggctttggtctctcctgagacccccccaacgccgggtgccctgaggcggaggcggaaggttccaccttcaggatctgggggatctgaactctccaacggcgaagcaggcgaggcttatcggagcctgtctgatccgattccgcagcgacatagagcagccacttcggaggagcccaccggatttagtgtcgattcaaatctgcttgggtcactgagcccaaagaccggtctcccagccactagcgctatggacgaaggtctcacctcaggccattctgactggtcagttgggagtgaggagtcgaaaggctaccaggaggtgattcaaagtattgtgcagggcccaggaacactcggcagggtggttgatgatagaatcgctgggaaagcccctaagaagaaaagcctgtccgacccgagcagaaggggtgagcttgccggtcccggatttgaggggcctggtggggaacctataagggaagttgagcccatgctccccccttcttcatctgaaccaatcctcgttgaacagagggcagagccggaggagcctggtgctactcgaagtagagcacagagtgagagagctctgcctgaagctctccctcctcctgcgaccgcgcataggaactttcatttggatcctaaattggcggatatactttccccgcgactcatacgtaggggtagcaagaagagacccgctcgctcctcccaccaggagctccgcagagacgagggctcccaggaccagacggggagtctgtccagagccagaccatcctccagacacgtacggcatgcgagcgtgccagctacatttatgcccatcgtggtgccagaacccccaacttcggtcggcccacccgtggccgtcccagaaccaattggtttccccaccagagcccatcctactctgcaggcgccaagcttagaagacgtgaccaagcagtacatgctcaatttgcattctggtgaggtgccagcacctgtcccagtcgatatgccttgcttaccgttggccgctccacccagcgccgaagccaaacctcctgaagccgctcgtcctgcagatgagcccacacccgcttccaaatgctgttctaaaccacaggtcgacatgagaaagcacgtcgcaatgacactcctggacacagaacagtcctatgtggagagtctccggactctgatgcaggggtacatgcagccactcaagcagcccgaaaactcagtgctgtgcgatccgagccttgtcgacgagatctttgaccagatacctgagctgctggagcatcacgagcaatttctggaacaagtccgccattgtatgcaaacttggcatgcacaacagaaggttggagcattacttgttcagtcgttttcaaaggacgtcctcgtgaacatctacagcgcatacatcgacaactttcttaatgccaaggatgccgtccgcgtcgcaaaggaggcccgaccagcattcctgaaattcctggaacaatctatgagagagaataaagagaaacaggcactatctgatttaatgattaagcctgtgcagaggatacccaggtacgaactattggtcaaggatctgctcaaacacacacccgaggatcaccccgatcatccccttcttctggaggcgcagcgtaatataaaacaggttgctgagaggattaataagggcgtacgatcagccgaagaggcagaaaggcatgcccgagtgttgcaggagatcgaggcccatatcgaggggatggaggaccttcaggccccactccgaaggttcttgagacaagagatggtcatcgaagtgaaggctattggcggaaaaaaggacagaagcctgtttctgttcactgatctgattgtgtgcacaacattgaagcgcaagagtggttccctccgcagatccagcatgtccttgtatacagcagccagcgtgatcgacaccgcctcgaaatacaaaatgctgtggaaactgcctctggaggatgcagacattataaagggagcttcccaggcaacaaatagagagaacatccagaaagcaatctcaagattggacgaagacctcaccacattgggacaaatgtctaagctgagtgaatccctgggttttccacatcagtccctggacgatgcgttacgcgatctcagtgccgcaatgcaccgtgacctctctgaaaagcaagcactctgctatgccctctccttcccacccaccaagctggaattgtgcgcgaccagacccgaagggacagattcctacatttttgaatttccccacccagatgcacggttgggtttcgaacaggcttttgatgaggccaagaggaagctggcctcctcgaaatcttgtcttgaccccgagttcttgaaggcaatcccaattatgaaaacacgatccgggatgcagtttagctgcgctgccccaacacttaatagttgccccgagcctagtcctgaagtatgggtttgtaattcagatggctacgtcggccaagtgtgcctcctttccctcagggccgagccagacgtggaggcatgcatagccgtctgctcggcccgaatcctgtgcatcggggctgtgccgggtctccagcccaggtgtcaccgcgagcctccaccatcgctccgatccccaccagaaaccgctcccgaacccgctggccctgaactagacgtggaagcggctgcagatgaagaagccgctacactggcagagcctgggcctcagccctgtttgcacattagcatcgctgggagcggcttggaaatgacgccaggcctgggcgaaggcgatccaaggcccgaacttgtgccttttgactcagatagcgatgacgagtcgtccccctcccctagtggcacccttcaaagtcaggcctcaagatccactatcagtagctcttttggtaatgaagagaccccctcaagcaaagaggccacagcggaaactacctctagtgaagaggaacaggagcccggattcttgcccctgagcggcagcttcggtcctggtgggccatgtggaacttccccaatggacggacgggctcttcggagatcaagccatggcagtttcactcgaggcagcctggaggatctcctcagtgttgaccccgaggcttaccagagtagcgtctggctaggtactgaggacggctgcgtgcatgtctaccaatcatctgactcaattcgggatcgccgaaattccatgaagctgcagcatgcagccagtgtgacgtgtatactttatctcaacaaccaggtcttcgtctccctcgctaatggggagttggtggtataccaacgggaagccggacacttctgggacccccaaaactttaagtccgtgaccctggggacacagggttccccaataacaaagatggtctctgtgggaggcaggctttggtgcggctgccagaatcgggtactcgtgctctcccccgataccctgcagctcgagcatatgttctatgtgggtcaggattcaagtcggtgcgtggcctgtatggtggattcatctcttggggtctgggtcaccctcaaaggaagcgcccacgtctgcctctatcaccccgatacgttcgagcagctcgctgaggtggatgtgaccccccctgttcacaggatgcttgccggatctgacgccattattaggcaacacaaagctgcgtgtctaagaataacagccttgctggtctgcgaggaactcctatgggtcggtactagcgctggtgtcgtattgaccatgcctacctcccccggtacggtctcttgccccagggctcctctctcaccaacagggcttggacagggccacactggtcatgtgcgtttcttagctgccgtgcagctgcctgatggtttcaacctactttgcccaaccccaccccctcctcccgatacgggaccggaaaaacttccgagtctggaacatcgcgactccccctggcatcgaggcccagcaccagctcgtcctaaaatgctcgtgatcagtggtggcgatggttacgaggacttccgcctcagttccggaggtggttcaagctctgaaaccgtgggcagggatgacagtacgaatcatctactgttatggagggtgtag

SEQ ID NO: 27518 - DNA, 2499 bp, Artificial Sequence
  Description of Artificial Sequence: Synthetic coding sequence
atgtctgaagcagggggagcagggccaggtggatgtggtgcaggggcaggtgcaggggcagggcctggagctctgccccctcaacctgcagctcttcctccagccccacctcaaggctccccatgtgcagctgcggcaggcggttcgggtgcctgcggccctgcaacagcagtggccgcagcaggtactgccgagggccctggagggggaggcagtgcacggatagccgtgaagaaggcccagttgaggagcgcaccccgtgctaagaagctggagaagctcggtgtgtacagtgcttgtaaggcagaggagtcctgtaagtgcaatggttggaagaatccaaacccatcccctactcccccacgggcagatctgcagcagatcattgtgagcttaactgagtcatgccgctcatgctcccacgccttagccgctcacgtgtctcatctcgagaatgtttctgaggaggaaatgaacagactattggggattgttctggacgtcgagtacctctttacctgtgttcacaaggaggaggatgccgatactaaacaggtgtatttttacctctttaagctgctgaggaaatccattttgcaaaggggaaagcccgtcgtcgaaggtagcctggagaaaaagccaccttttgagaagccctccatcgagcaaggggtgaataacttcgttcagtacaagtttagccacttgccagctaaagaaaggcaaacaatagtcgagctcgctaagatgttcttaaatcgcattaactattggcatctggaagctccttcacaacgcaggctacgaagtccaaatgatgacattagtggatacaaggagaattatactcgctggttgtgctactgcaacgtgccacagttctgtgactccctgcctaggtatgagacaacccaagtgttcggcaggaccttgctcagatccgtgtttacggtaatgcgacggcagctccttgagcaggccaggcaggagaaggataaactgccattagaaaagcggacgcttatccttacacacttccctaagttcctatccatgctggaagaggaggtctactcccagaatagccctatttgggatcaagacttcctgagcgcctcttctagaactagccagctcgggatccagacagtgattaatccaccgccagtagctggcactatctcctacaacagcacgtcttcatctctggagcagcctaacgctggatcatcaagtcctgcttgcaaggcaagctctggtctagaggcaaacccaggcgaaaagcgcaagatgacagactcacacgtgctggaggaggccaagaagcccagagttatgggggacattccgatggagctaataaacgaggttatgtccaccatcacagacccggcagctatgctgggcccagaaaccaatttcctctctgctcatagcgcgcgtgacgaggccgcaagactggaggagagaaggggggtgatagagtttcatgtggtgggcaactcgctcaaccagaagccaaataagaaaatcctgatgtggctcgtcggactgcagaatgtcttttcccatcaactgcctcgcatgcccaaagaatacatcacccggcttgtcttcgaccctaagcataagactctcgcgcttatcaaggatgggagagtgatcgggggaatttgttttcgaatgtttccttcacagggattcacagaaattgtgttctgcgccgtgacttccaacgagcaggtgaagggttatggaacgcacctaatgaaccatctaaaggagtaccatattaagcacgatatcctgaactttcttacatacgccgacgaatacgctataggatactttaaaaaacagggcttcagcaaggaaattaagattcccaagactaagtatgtcgggtatatcaaggactacgagggtgcaactctgatgggctgcgaattgaatccaagaattccttacacggagttctctgtgataatcaagaagcagaaggagatcattaagaaactaatagaacggaagcaggcccagatcaggaaggtgtatccaggactgagctgtttcaaggatggcgttcggcaaatccctatcgagtccatccctggcatcagggaaaccggctggaagccctcaggaaaggagaagagcaaggagcccagggatcccgaccagctctattccacactgaagagcattctgcagcaggtgaaatcccaccaaagtgcatggccattcatggaacctgtgaagcgaaccgaagcccctggatactacgaggttatacgatttccaatggacctgaagaccatgtctgagagactgaaaaacagatactatgtcagcaaaaagcttttcatggctgacttgcagagggtgtttaccaactgtaaggagtataaccctcccgaaagtgaatattacaagtgcgctaatatccttgaaaagttcttcttttcaaaaattaaagaagccggacttattgacaagtag

SEQ ID NO: 27519 - DNA, 4950 bp, Artificial Sequence
  Description of Artificial Sequence: Synthetic coding sequence
atggctgggggtaggggcgctcccggaaggggtcgcgacgagcctcccgaaagttatccccagcgccaggatcacgaacttcaagcactggaagctatttatggtgcagactttcaggacttacgcccagatgcgtgtggccctgtgaaagagccgcctgagattaatctggtcctctatcctcagggcctgacgggagaagaggtgtacgtaaaggttgatctgcgggtgaaatgccccccaacttaccccgatgtggttcccgagattgaactgaagaatgccaagggactctcaaacgagagcgtcaacctgctgaagagtcgactggaagaattagctaagaagcattgtggtgaggtgatgatctttgaactggcctatcacgttcaatctttcctctcagaacataacaagccccctccaaagagctttcatgaagaaatgctagagcgcagagcacaggaagagcagcaacgcctgcttgaggcaaagaggaaggaggagcaggaacagcgggaaattctgcacgaaattcagcggaggaaagaagaaatcaaagaagagaagaagcgaaaggagatggcgaaacaagaaagacttgaaattgctagtctgtccaaccaggaccacacaagcaagaaagatcccggaggccaccgaaccgcagcaatcttgcatggcggttcacccgatttcgttgggaacgggaagcatcgcgctaacagctctgggagaagtaggcgcgagcgccagtacagcgtgtgcaacagtgaagacagtcccggatcctgcgagattttatattttaatatgggctctcccgaccagctgatggtgcataagggaaagtgcattggaagtgatgaacagctgggaaaattggtgtataatgctctggagacagcgacagggggattcgttttgctttacgagtgggttctacaatggcagaagaaaatgggacccttcctaactagccaggaaaaagagaaaatcgataaatgcaaaaaacagattcaaggtacagagacagaatttaattccctggtcaagctatcccacccaaacgtcgtgcgctatttggcaatgaatcttaaggagcaggatgattctatagttgtggatatcctcgtggagcacatttctggcgtctcgctggccgcacacctgtcacactccgggcctataccagtgcaccaactgagacggtatactgctcaactgctgagcgggctggattatctccatagcaatagtgttgttcataaggtgctctctgcttctaatgtgctcgtggacgccgaaggtaccgtaaaaattactgactacagcatctccaaaaggcttgccgacatttgcaaggaggacgtttttgaacagacaagggtcaggttttccgacaacgccctcccatataagacgggtaagaagggcgatgtgtggcggttgggcctgcttctgctttcgctgtctcagggacaggagtgcggggagtacccagtgacgattccttccgatctgcccgcagatttccaggacttcttgaaaaagtgtgtgtgcctggacgacaaggagcgatggagtccacagcagctgcttaaacactcttttataaacccccaaccgaaaatgcccttagtcgagcagtctccggaagactccgaggggcaggattatgtggaaactgtgatcccaagcaatcggctgcccagcgctgcttttttcagcgagacacagaggcagtttagccggtattttattgagtttgaggagttgcagctgctgggaaagggcgcttttggagctgtgatcaaagtgcagaataaacttgacggatgctgctatgccgtgaagaggattccaattaatccagccagcagacagttcagaaggatcaagggggaggtgacgcttctgagccgactccatcacgagaatatcgttcgttactacaacgcatggatcgaacgacacgaaaggccagcagggcctggcaccccaccgcctgatagtgggccactggcaaaggatgatcgagctgcgaggggtcagcctgcatccgacaccgacggcctcgattcagttgaggcagccgcaccccctcctattctttcgtcgagtgtcgaatggagcaccagtggcgaaaggtccgcctccgcccgatttcccgcaacagggccagggtcctcagacgatgaagacgacgacgaagacgaacatggtggcgtgttcagccagagctttttgcccgcatccgactcagaatcagatatcatcttcgataacgaggacgagaactcaaagagtcagaatcaggacgaggattgcaacgaaaagaatgggtgccatgaaagtgagcctagtgtgacgacggaggcagtgcactacctgtacatccagatggagtattgcgaaaagtccactctgagggacacaattgaccagggtctgtaccgtgataccgttcgcctgtggcggcttttcagagaaattctggacggtctggcctatatccacgaaaaagggatgatccatcgagatctgaaacccgtgaacatcttcttagactctgacgatcatgttaaaatcggcgacttcgggctggccacagatcacctggccttttccgctgacagcaaacaagatgaccagaccggagacctcataaaatcagatccgtctgggcacctgaccgggatggtgggtaccgcactgtacgtttccccagaagtgcagggatcaaccaaatccgcctataatcaaaaggtggacctgtttagtctcgggattatattcttcgagatgtcttatcacccgatggtgaccgcctcagaaagaatttttgtattgaaccaactgagggaccctactagtccaaaattcccagaggatttcgatgacggggaacatgccaaacagaagtctgtcatcagctggctgctaaatcatgacccagccaagcgacctacagccaccgaacttttgaagtccgagctgctccctcccccacagatggaggagtcagagcttcatgaggtgctgcaccacacattgaccaatgttgacgggaaggcttaccgtacaatgatggctcagattttttctcaaaggataagccctgccatagattatacttacgactctgacatcttaaaaggaaacttctcaatccggaccgccaagatgcagcagcacgtctgcgaaacgatcatccggatttttaagagacacggggctgttcagctttgcactcctctgctgttgcctcgaaaccgccagatctacgagcataacgaggctgccctgttcatggatcacagcggcatgctcgtgatgctccccttcgatctgcgaatcccgttcgccagatatgtggcaagaaacaatatcctgaacctaaaacgctactgtatagagcgtgtgttccgtccaaggaaattagatagatttcacccaaaagagctcctcgaatgcgcgttcgatatcgttacatcgaccacaaacagcttcttaccgacagcagagatcatctacactatctacgaaatcatccaggagtttccagcactgcaggaaaggaattacagtatttacctgaatcacacaatgttgctgaaagccatacttttacattgcggcatcccagaagacaagctgagtcaggtttatataatcctgtacgacgcagtaaccgaaaagctcaccagacgcgaagtggaggcaaaattctgtaatttgtcattaagcagtaattcgctgtgccgcctgtacaaatttatcgagcagaaaggagatcttcaggacttgatgccgacaataaatagcctgataaagcaaaagaccggaatcgcacagctggttaagtacggactgaaggatcttgaagaggtggtcggattactgaagaaactaggaattaagctgcaggtactcatcaacctgggtcttgtgtataaagtccagcaacataacggaattatctttcagtttgtagccttcattaaacggcgacagagggccgtgcccgaaatcttagcagcagggggaagatatgaccttctgatcccacagttccggggtccccaggctcttggccctgtccctacagcaatcggcgtgtctatagccattgataagatctctgccgcagttctcaacatggaggagtccgtgaccattagttcttgtgatcttctggtcgtgagtgttggccagatgtccatgagccgcgctattaatttgacccaaaagctgtggacagccggaattaccgccgagataatgtacgattggtcgcagtcacaggaggaactgcaggagtattgtcgacatcacgagatcacatacgtggctcttgtgtctgataaagagggaagccatgtgaaggtaaagagttttgagaaggagcgacagacggaaaaacgcgtccttgaaactgagttggttgaccacgtgctccaaaaactccggactaaagttacggatgagcggaatggtcgagaggcatcagataacctcgcagtacagaatctaaagggtagctttagtaacgcttctggactgttcgaaatccacggtgcgactgtggtgccaattgtgtctgtgttagctcccgagaaactgagtgccagtacccgcagaagatacgaaacccaggtgcagactaggctccagacttctctagctaacttacaccagaagtcctccgaaattgagatcctggctgttgacttgccaaaggagaccattctgcagttcctctcgcttgagtgggatgctgatgaacaggcattcaataccactgtgaaacagcttctgtcccggttgcctaaacagcgttacctcaagttggtctgtgatgaaatatataatatcaaggtggagaaaaaggtcagtgttttatttctctacagctaccgcgatgattactaccgaatccttttctag

SEQ ID NO: 27520 - DNA, 5652 bp, Artificial Sequence
  Description of Artificial Sequence: Synthetic coding sequence
atgcctgtgggccgtattgagtgccctagttcacctagtttccctcgtgacattagtcacgaatgcagggtctgcggtgtaactgaggttggactgtctgcctatgcgaagcacatctccgggcaactccataaggataatgtggacgctcaggaacgggaagatgacggcaagggcgaggaggaggaggaggattattttgacaaggagctgatccaattaatcaagcaacgtaaagaacagagtcgccaggacgaacctagtaatagtaaccaggagataaacagtgacgatcgaagaccgcagtggaggcgggaggaccgcattccttatcaagaccgagagtcttatagtcagccagcctggcatcaccgcggaccaccccagcgcgactggaagtgggaaaaggatggatttaacaacaccaggaaaaattcattcccccacagcctcagaaatggcggaggtccacgtggccgatccggctggcacaagggcgttgcaggtggtagttctacatggtttcacaatcattctaacagtggtgggggatggctgagtaattctggtgccgtggattggaatcataacggcacaggcaggaacagcagctggctttcagagggaacgggaggcttttcttcttggcacatgaataactcaaacggcaattggaaatccagcgtcaggagcactaacaactggaattacagcgggcctggggacaagtttcagcccggtcgaaaccgtaattcgaactgccagatggaggatatgactatgttatggaacaaaaaaagtaataaaagcaataaatactcccacgacagatacaattggcagagacaggaaaatgataagctcggaacggttgctacttaccgcggtccctctgaagggtttacatcagataaatttcccagcgaagggctgctggacttcaacttcgagcagctcgaatcgcaaacgactaagcaggccgatacagccacctcaaaggtgtcaggcaaaaacgggagcgccgctcgcgaaaaacctcgcaggtggacaccttacccctcccagaagacacttgacctgcaatccgggcttaaagacattaccggaaataagagtgagatgattgaaaaacctctgttcgatttctctctaatcacaaccgggatccaagagccccagactgacgagacgcggaactcgccgacgcagaagacccagaaagagatccataccggatctctcaatcataaagcatcttccgacagcgccgcaagttttgaagtcgtccggcagtgtccaactgcggaaaagccagagcaggaacatactccaaataagatgccctctcttaagtctcctctgctaccatgtccggcaacgaagagcctgtcgcaaaagcaagatccgaagaatatttcgaaaaataccaagacaaacttttttagcccaggcgagcactctaacccatctaacaagcctaccgtggaagacaaccatgggccatacatctcaaagctgcgttcttcttgtccacacgtgttgaagggtaacaaaagcacctttgggagccagaaacagtccggagacaacttaaatgacacgcttcgcaaggcgaaagaagtcctgcagtgccatgaaagcctgcagaatcccctgttaagcacatccaagagcacacgaaattacgccaaggcatccaggaacgtggaggaatctgaaaagggtagcctgaaaattgagtttcaggtccacgccctggaggacgagtcagacggcgagacgtcagacactgagaagcacggcaccaaaattggaactttagggtccgccaccacagaactcctgtctggatctactcgaacagccgatgagaaggaagaggacgatcgcatcctgaagactagtcgcgagctaagcacaagcccctgtaatcctattgtgaggcagaaagagagtgagctgcaaatgacaagcgcagccagtccccatcccggactcctactggacttgaagacctcactggaggatgctcaggttgatgacagcattaagtcccatgtgtcttatgagactgagggtttcgagtcggcctcactggacgcggagctgcaaaaaagcgatattagtcagcccagcgggcctctactcccggagttatccaaactgggattcccagcgtcccttcaaagggatcttactcgccacataagtcttaaaagtaaaaccggagttcatctccctgagccaaacttgaactccgcccgaagaatcagaaatatcagtggccatcggaaaagtgagaccgaaaaggagagcggactcaaaccaactctacggcagatactgaacgcatccagacgcaatgttaattgggaacaggttatccagcaagtcacaaagaaaaagcaggagctgggcaaaggactcccacggttcgggatcgagatggtgcctctagtgcagaatgagcaggaggccctcgacctcgacggcgagcctgatctgtctagtttagaagggttccagtgggaaggggtgagtataagtagctcacccggattggccaggaaaagatctctgtcagaaagttcagtcatcatggatcgcgctcccagcgtatactctttcttttccgaagaaggcaccggaaaggagaatgaaccacagcaaatggtgtctccttccaattctctcagggctggacagtcccaaaaggccacgatgcacctaaagcaggaagttacaccgcgagccgcttctctaagaaccggcgaacgggctgagaacgttgcaactcagaggcgccatagtgcccagctcagcagcgatcatattatacctttaatgcacctggctaaggaccttaacagtcaagaacgcagcattccccctagcgagaatcagaatagccaggaatctaatggcgaaggaaactgcctgtccagctccgctagttcggccctggccatcagtagccttgcagacgccgcaaccgacagctcttgtactagcggtgcagagcaaaatgacggacagtccattaggaaaaagcggcgagccaccggagatggaagtagccctgagctgccaagtctggagcgcaagaacaagagaaggaagattaaaggaaaaaaagaaagatctcaggtagaccaactgctgaacataagcttgagagaggaagagctcagtaaatccttacaatgtatggacaataatttgctgcaggctagagccgcattacaaacagcatatgtggaggttcagcggctgttgatgctaaaacagcagatcacgatggaaatgagcgccctaaggactcaccgtatccagatcttgcagggcctccaggagacgtacgagcctagcgaacacccagaccaggttccatgttctctgacacgggagcggaggaatagccgatctcagacaagtatcgatgctgctctactacccactcctttttttccgcttttcctggaacccccttcatcacacgtcagtccttcacccacaggtgctagcctccagatcaccacgagtcctactttccagacccatggctcagtgcctgcccctgatagcagtgtacagatcaagcaggagcctatgtccccggaacaggatgagaacgtcaatgctgtgcctcccagcagcgcctgcaatgtctccaaagagctgctggaggctaatcgggaaatctcggattcttgccctgtttatccggtgattacggctcggttgtccttgcccgaatctacagagtcattccacgagccctcccaagagctaaagttctccgtggagcagcggaatacccgtaaccgtgaaaactcgcctagctctcagagcgccggtttgtcatccatcaacaaggagggggaggaacccactaagggtaattccggcagcgaagcatgtacgagctcttttttaagattgtctttcgccagtgagacacctctggaaaaagagccacactcacccgctgaccaaccggagcagcaggcggagtctacactcactagtgctgaaacacgcggatccaagaagaagaaaaaactcagaaagaagaagagcttgcgggctgcacatgtccctgagaattcggatactgaacaggatgtgctcacagttaaaccggtgcgcaaagttaaagctggaaaactgatcaagggaggaaaggtaactacctctacttgggaagatagccgtaccgggagagaacaggaatcggtgagggacgaaccggactccgattccagcttggaggtgctcgaaatccctaatccgcagcttgaggtggtggctattgactcttccgagagcggagaggagaaaccggacagtcctagcaagaaggatatttggaatagcaccgagcagaaccctctggagaccagcagaagcggctgcgacgaagtgtcgagcacgtcagaaattgggactagatacaaggacgggatacccgtgagcgtcgccgaaacacagacggtgatttcgagcataaaaggatccaaaaacagcagcgagatctcttccgaacctggagacgacgacgaacccaccgagggcagctttgagggtcaccaggccgcagttaacgcgatccagatcttcgggaacttactgtatacttgttctgccgataagacagttcgggtgtacaatcttgtgtcacgaaaatgcattggcgtcttcgagggacatacatcaaaagtaaattgccttctggtgactcagacttccggtaaaaacgccgctctgtacacgggatcttcagatcacacgattaggtgttacaacgtgaaatcgcgggaatgtgtggagcagctgcaattagaggatcgcgtgctttgtctgcattccaggtggcgaattctgtatgcagggttggccaacggcactgtggtaacgtttaacatcaagaacaacaaaagattggagatattcgagtgtcatgggcctcgcgctgtcagctgcctggctaccgcccaggaaggtgctagaaaattactggtggtaggatcttatgactgcaccatcagcgttagggacgcaagaaatggcctgctgttgagaaccttagagggacattcaaagaccattctgtgcatgaaagttgtgaacgatctcgtcttctctggttcctccgaccaatccgtccacgcacacaacatacacaccggagaactggtaaggatctataaaggccacaaccacgcagtgaccgtggttaacattctaggtaaggtgatggtaaccgcatgccttgacaaattcgtccgggtctacgagctgcagtcccacgatagactacaggtctacggtgggcataaagacatgattatgtgcatgactattcacaagtcaatgatatatactgggtgctacgacggaagtatccaagctgtgcggttgaacctgatgcaaaactatcgctgctggtggcacgggtgcagcctgatttttggcgtggtggatcatctcaaacagcacctgttgactgatcacactaaccctaactttcaaaccttgaagtgcagatggaagaactgcgatgcgtttttcaccgcgagaaagggttccaaacaggatgcagcaggccatattgagagacatgccgaagatgacagtaagatcgatagttaa

SEQ ID NO: 27521 - DNA, 588 bp, Artificial Sequence
  Description of Artificial Sequence: Synthetic coding sequence
atggccgaaccagtgcaggaggagctgtccgtactcgcggcaatattttgccgccctcacgagtgggaagttctgtctcggtccgagacagacggcaccgtatttagaatccatactaaagccgagggattcatggacgttgacatccctctggagttagtgttccacttgcccgtgaactacccctcttgtctccccggtatctctatcaatagcgaacagctcacaagagcccagtgcgtgacggttaaggagaatctgctagaacaggccgaatccctgctctcagaaccaatggttcatgagctagtactctggatacagcagaaccttcgccatatcttgtctcagcctgagaccggaagcggttcagaaaagtgcactttctccaccagtacaaccatggacgacgggctctggatcaccctgctgcatctggaccatatgagggctaagaccaaatacgtgaaaattgttgaaaagtgggcttcagacctccggctcacaggccgactgatgtttatgggcaaaatcatcctgatactgctccagggtgatcgaaacaacctgaaagttccaaaaagttag

SEQ ID NO: 27522 - DNA, 1119 bp, Artificial Sequence
  Description of Artificial Sequence: Synthetic coding sequence
atgagccgcaggcggtttgattgtcggagcatctcaggactactcacaacaacccctcagattcctataaagatggagaattttaacaacttctacattctgacctctaaagagctaggacggggaaaatttgccgttgtgcgtcagtgtatcagcaaaagtacaggtcaggagtatgcggcaaagtttctgaaaaagcggaggcgcggacaagactgccgagctgagatcctccacgaaatcgctgtcttggagttggcaaagagttgtccccgtgttattaacctccatgaagtctacgaaaatacctccgaaattattctcatcttggagtatgccgcagggggagagatattctccctatgcctgccggagttggccgagatggtgtcagaaaacgatgtaatccgcctcattaagcagattctggagggtgtgtattatttgcatcagaataacattgtgcacctggacctaaagccacaaaacatcctgctgagctccatttatccactgggtgacatcaagatcgtggacttcggtatgtctcgtaagatcggtcacgcttgcgagctgcgagaaatcatgggcacccctgagtacttggcccctgaaatcttgaattacgatccgatcactactgcaacagatatgtggaatattgggatcatagcatatatgctactcacccacacctcccctttcgttggagaagacaaccaggagacctatctgaatatctcgcaggttaatgtggattactccgaagaaacattctcgtcagtgtcccagctcgcgaccgattttatacagagtctgcttgtgaagaacccggaaaagcgcccaaccgccgaaatctgtctctcccactcatggttgcaacagtgggactttgagaatctgttccaccccgaagagacctcttcttcttcccaaacccaggatcacagcgtgcggtcctcagaggataagactagcaagagcagctgtaacgggacatgtggtgatagagaggacaaagagaacataccagaagattcaagcatggtgagcaaaagattccgctttgatgatagcctgccaaacccccacgaattggtttctgatctactgtgctag

SEQ ID NO: 27523 - DNA, 930 bp, Artificial Sequence
  Description of Artificial Sequence: Synthetic coding sequence
atggaggccgcacggacagctgtattgagggtcaagcgcaagagaagcgcagagcctgcggaagcccttgttctggcgtgcaagagactgcgttccgatgctgtggagagtgctgcccagaagacatcagaggggctggaacgggctgccgaaaacaacgtattccacctagtagcaacggtgtgctcccaggaagagcccgtccaaccgctcctgcgggaagtgctgcgtcccagccgggactcgcagcagcgtgtccgcaggaacctgcgggcatccgcacgcgaggtgaggcaagaggggcgttacagggtgctgagctctaggcgatcactggggactacaagctccggtcaggagagtgaatacacccctggaaacccggaggccgctgggaacagtggtttccaactgctggacctggtgcacgaagagggagaacctgaggccgcttctgcaggttcctgtaaaactagcgaccctgatgtaatcctctgcaactccgtggagctcatcagagagcgcctgacggtgtcagaggatggccctggcgtgcgcaggcaggaggagcagaagcatgacgactacgtgtatgacatttactacctggagaccgcaactcccggatggattgaaaacatcttatctgtgcaaccatatagccaggaatgggagcttgttaacgacgaccaggaacctgaggacatttatgatgatgaagacgacgaaaactcggagaacaattggaggaatgaatatcccgaggaagagtcatctgatggagacgaagattctcgaggttcggcagactataatagcttatctgaggaagaacgagggtcctctcgacagaggatgtggagcaaatacccgctcgacgttcagaaggagtttggctatgactctcctcacgatttggactcagactag

SEQ ID NO: 27524 - DNA, 1068 bp, Artificial Sequence
  Description of Artificial Sequence: Synthetic coding sequence
atggccgacaattccagtgatgagtgcgaggaggagaacaataaagtgctgcgcgagggcatgccccaagccccaggccatagggggaaagacatggaccctgtgcccccagctcccgcaagcttgaaatgccaccagactccgagtcatgtgctggagcgtgtcgggtggtaccgagagagtcagaaacatcgcaaggaaaaaaagaaaacttctcaactaacgcctcagcggggattttccgagaacgaggacgacgatgacgacgatgatgattcctctgagactgactctgatagcgacgatgacgatgaagagcacggagctcccctcgaaggagcttatgacccagccgattacgagcacttgcccgtgagcgccgagattaaagaactgtttcagtacatatcgagatacaccccccagctgatcgacttggaccataaattaaaaccttttattcctgattttattccagcggtgggggatatagacgcttttcttaaagtcccgagacccgacggcaaaccagacaacctgggtctgcttgtcttggatgagccctccaccaagcagtcagatccgacagtcctgtcactgtggctgaccgaaaactcaaaacaacacaatatcacccagcatatgaaagttaaatccttggaggacgcagaaaagaatcctaaagccattgatacctggattgagagtatctcagagctacataggtctaagccaccagcgacagttcattacactagaccaatgccggatatcgatactctaatgcaggaatggagccccgagttcgaagagttacttggcaaggttagcctgccaaccgccgagatcgattgctcgctagccgagtacattgacatgatttgcgccatactggacatccccgtctacaagtcccgaattcagtcattgcatctgctgtttagcctgtactcagaatttaaaaactcccagcactttaaagcactggctgaaggaaagaaagcatttacaccatcaagtaactccaccagtcaggctggagacatggagaccctgaccttctcctag

SEQ ID NO: 27525 - DNA, 915 bp, Artificial Sequence
  Description of Artificial Sequence: Synthetic coding sequence
atggcggacaatagttcagacgaatgtgaagaggaaaataataaagagaaaaagaagacctctcagctcacacctcagcgcggattctctgaaaacgaagatgacgatgacgatgatgacgacagctccgaaactgacagtgactctgacgacgacgacgaggagcatggagctcctctcgaaggggcttatgatcccgctgactatgagcacctcccagtaagcgcggaaattaaggagctctttcagtacataagccgatacacacctcaactgatcgatctggatcataagttgaagcctttcatcccagacttcatcccagccgtaggggacattgacgccttccttaaggtgccccgaccagatgggaagcccgataacctcgggctgttagttcttgacgaaccaagcacaaagcagagcgatcccaccgtattgtccctgtggctgaccgaaaactccaaacaacacaacataacacagcacatgaaagttaaaagtttggaggacgcagaaaaaaacccgaaggcaatcgacacatggatagaaagtattagtgagctccacaggtctaaacccccagctacagtgcattacacacggcctatgccagacattgatacacttatgcaggaatggtcccccgaattcgaagaattgctcggaaaggtgtcactgcccactgcagagatcgattgctccttggctgagtacattgacatgatctgtgcaatcctggacattccagtctataaatcaagaatacaatctctgcacctgctcttcagcctgtactcagagtttaagaattcacagcatttcaaagccctcgccgaaggaaaaaaggcctttacgcctagttcaaatagtacttcacaggctggtgacatggagaccttgaccttctcatag

SEQ ID NO: 27526 - DNA, 1335 bp, Artificial Sequence
  Description of Artificial Sequence: Synthetic coding sequence
atgagggaaatcgtccacctgcaggccggacagtgtgggaaccaaatcggcgctaagttttgggaggtcatcagcgacgaacacggaattgaccccacaggaacttaccatggagatagcgatttacagcttgaacgcataaatgtctactacaatgaagcgaccggcggaaactacgttccacgagccgtcctggtagacctcgaacctggcaccatggatagcgtgcgctctgggccatttggacagatattccgcccagacaactttgtcttcggccagagtggtgcaggcaacaattgggccaagggccactacaccgagggagcagagctcgtcgatgccgtgctggatgtggtacgcaaagaggctgaatcatgtgactgtttgcaggggtttcaacttacacactcactgggcggaggcaccggcagcggcatggggactctcctcatcagtaaaatccgagaggaattcccagacagaattatgaacacattttccgtggtgcccagccctaaggtctccgataccgttgtcgaaccttacaacgccacactctctgtgcaccagctcgttgagaacactgacgaaacatattgtatcgataacgaagcattgtacgatatctgctttcgcactcttaaactgacaaccccgacctatggcgatctcaatcacctggtcagcgccaccatgtccggcgttacaacctgtctgcgctttcccggtcagctgaatgctgacctcagaaaactcgctgtgaatatggtgcctttccctagacttcatttctttatgccaggctttgcacccttgacctcgcggggttcccagcagtaccgagccctgactgtgccggagctgacccaacagatgttcgatgccaagaacatgatggccgcttgtgaccctcgacatggcagatatctgaccgttgcagcagtcttccgcggacgtatgtctatgaaggaagtggacgaacagatgctttccgtgcagtctaagaactcaagttatttcgtagaatggattcccaataatgtgaaaacagccgtctgtgatatccctcccaggggattgaaaatggcagctacattcattggcaactccactgctatacaggagttgttcaagcgtatttctgaacagtttaccgcaatgttccgtcgcaaagcgttcctacactggtacacaggggaaggcatggatgaaatggagtttactgaggcggagtccaatatgaacgacctggtctcagaatatcaacagtaccaggacgcaacggccgaagaaggagaatttgaggaagaagctgaggaggaagtagcctag

SEQ ID NO: 27527 - DNA, 1398 bp, Artificial Sequence
  Description of Artificial Sequence: Synthetic coding sequence
atggaaccctcatccctcgagttacctgcagatacggtccagcgcattgcagcagagctcaagtgccaccctacagatgagagggtagccctgcacctggatgaggaagataagctccggcatttccgcgaatgcttctatatacctaaaattcaggacctgcccccagtggacctctcactggtgaataaagacgagaacgccatctacttcctaggcaactcccttggcctgcaaccgaagatggtgaaaacctacctggaagaggaacttgataaatgggccaagatcgccgcatacggtcacgaggttggcaaaagaccttggattaccggcgatgagtcgattgtaggactgatgaaggatatagtcggggcaaatgagaaggagatagcgcttatgaacgctctgactgtcaatctgcacttactgatgctctccttttttaaacccactccgaagcgttataagatcctcctggaagcgaaagccttcccctctgaccactatgccatagagagtcagctgcagctccatggtctgaatattgaagaaagcatgcggatgatcaagcccagggagggagaggagactcttcggattgaggatatccttgaagtcattgaaaaagagggggatagcatagccgtaatactttttagcggtgttcacttctataccggtcagcacttcaatattccagctataacaaaagccggacaagccaaaggatgctatgtggggtttgatcttgcgcacgctgtgggcaatgtcgaactgtacctgcatgattggggtgtcgattttgcctgttggtgtagttataagtatttgaacgccggagccggtggaattgctggggctttcatccatgagaaacatgctcacacgattaagccagccctggttggctggttcggccatgaactgtccacccgttttaaaatggacaataagctccagctaattcccggtgtctgcggctttcgtatttctaatccgcctattttgctggtgtgtagcctgcacgcgagtctagagatctttaagcaggccactatgaaggcgctgaggaagaaaagcgtactgttaaccggctaccttgaatatctgattaaacataattatggcaaggacaaagctgcaactaagaagcccgttgttaatatcataacacctagtcacgtagaagagagaggctgccagctgacaatcactttctcagtgccaaataaggacgttttccaagagctggaaaaacggggtgtggtgtgcgataaacgcaaccccaatggcattcgcgtcgctcccgtccccctgtacaattccttccacgacgtttataaattcaccaatctcttaacttcgattctggactctgcagaaacgaagaactag

SEQ ID NO: 27528 - DNA, 4758 bp, Artificial Sequence
  Description of Artificial Sequence: Synthetic coding sequence
atgaattctcagcctcagacaagaagccccttcttccagcggccacaaatccagccccctcgcgcaaccatccccaattcctctccatcaattaggcccggtgcgcaaactccgacggctgtctatcaagccaaccagcacatcatgatggtgaaccatctgccaatgccttaccccgtgccgcaggggccacagtactgtatccctcagtatagacactccggccctccatacgtgggcccaccccagcagtatccggtccagccacctggcccagggcctttctatcccggacccggtccgggtgattttccaaacgcttacgggacacctttttaccccagtcagcccgtgtaccagagcgcccctattatcgtacccactcagcaacagccaccaccggctaagagggagaagaaaactatccgaatcagagatccaaatcagggaggcaaagacatcacagaggagattatgagtggcggaggaagtcgtaaccccaccccacccatcggccgtcctacaagcacacccacccctcctcagcagctcccaagtcaagtgcccgaacatagtccggttgtgtacggcactgtggagtccgcgcatctggctgcatctacccctgttactgctgcaagcgatcagaagcaagaagaaaagccaaaacccgatcctgtgctgaagagccctagtcccgtactgcgtctggtattgagtggggagaagaaggaacaggagggccagacatccgagaccaccgcaattgtttccattgcagagctccccctgccgccttcgccaactaccgtgtctagtgtagcaaggtctaccatagccgcacccacatccagcgcacttagttcgcagccgatcttcacaacagcaattgatgataggtgtgaactgtcatcaccaagagaagacactattccgataccatctctcaccagctgcactgagaccagtgatcctctgcccactaatgaaaacgatgacgatatctgcaaaaagccgtgtagtgtggcaccgaacgacattcccctcgtctcatccaccaacttgatcaatgagatcaatggagtttccgaaaagctttccgcaacagaaagtatcgtggaaattgtgaagcaggaggtgttgcccctgacactagaattggagatcctcgaaaaccctccagaggagatgaaactcgaatgtatccctgcccctatcacccccagcactgtaccctcatttccccctactcccccaacacccccagcctccccccctcacaccccagtgattgtccccgctgccgcaacgaccgtatcatcaccttctgcagcaattacagttcagcgagtgctggaagaagacgaatccatccggacatgcctatccgaagatgcgaaggaaatccagaacaagatcgaggtggaggctgacgggcagaccgaagaaattctggactcccaaaatctgaactcacgtcggtctcccgttcctgcccagatcgccattacggtgcctaagacctggaaaaagcccaaagatcgaacccgaacaacagaagaaatgctggaagccgagctagagctgaaggcagaagaggaactgtccattgacaaagttctggagagtgaacaagacaagatgtcccaagggtttcatccagagcgggacccctcggatctcaagaaggtgaaggcagtggaagagaacggcgaagaggctgagcccgtgaggaatggagccgagtcggtatcagagggagagggcatagacgcaaattcgggttccacagattcctctggtgatggagtgacctttccattcaagcctgaaagctggaaaccaaccgacaccgagggcaaaaaacagtatgatcgggaatttctgctggatttccagtttatgcctgcttgtatacagaagccggaaggcctgccccctatctcggatgtggtcctggacaagataaaccagcccaaacttccaatgcggacgctcgatcctcgaatcctcccaagagggccagacttcactccggctttcgctgatttcggtcgtcagactcccggtggccgaggtgtaccgctgcttaacgtgggcagccgcagatcacagcctggccagagacgcgagcctaggaaaatcattacagtttctgtgaaagaagacgtccaccttaagaaagcggagaacgcctggaaaccatcccagaaacgggacagccaggcagacgacccagaaaacatcaagacccaagagctctttcggaaggtccgctccatcctgaataaactgactccacagatgttcaaccaattaatgaagcaagtctctggactcaccgtggacactgaggaacgcttaaagggcgtaatcgacctggtcttcgagaaagcgatcgacgaaccaagcttcagtgtggcctacgccaatatgtgtcgttgcctcgtcacacttaaggttccaatggccgataagcctggcaatactgtgaatttccgtaagctactgttaaacaggtgtcaaaaggaatttgagaaggacaaggcagatgatgacgttttcgaaaagaaacagaaggagttggaggcggctagcgctccagaggagcggactcggttacatgatgaactggaagaagcaaaggacaaagcccgacgccgaagcataggtaacattaagttcatcggcgaattatttaagttgaaaatgttaacggaagctattatgcatgactgcgtggtgaaactgctgaagaaccacgacgaagagtccttagaatgtctctgtcgattgctaaccaccattgggaaggacctggactttgagaaggccaagcccagaatggaccagtacttcaaccagatggagaagatcgtgaaggagcggaagacttctagcagaatcaggttcatgctgcaggatgtgatagatctgaggctgtgcaattgggtgagtcggagagccgaccaagggcctaagacgatcgagcagatccataaggaagcaaaaattgaagaacaagaggagcagcgaaaggttcagcagttgatgactaaggagaagaggcgccctggcgtacagagggtcgacgagggtggttggaacacagtgcaaggcgctaagaattcccgagtgctggatccatcaaagtttcttaaaatcacgaagcccaccatcgacgaaaagatacagctagtgccgaaagcacaactgggttcttggggcaagggctcatccggcggtgcaaaggcatctgagaccgatgcacttcggtccagtgcctcctccctcaataggttcagcgcgttgcagccaccagccccttccgggagtacccctagtacacctgtagagtttgatagccgccgtactctgacgtccaggggatccatggggagagagaagaatgataagcctcttccttccgcgacggctaggccaaacacgtttatgagaggaggaagcagcaaagaccttttggacaaccagtcccaagaagaacaacgccgtgaaatgttggagaccgtcaaacagcttacaggaggcgtagacgtcgagagaaatagcacagaggctgaaagaaacaaaactagagagtcagctaagccagagattagcgcaatgagcgcgcacgataaggctgccttgtcagaagaggaactggagcgaaaaagcaaaagtattatagacgagtttcttcatattaatgactttaaagaggctatgcagtgtgtggaagagctaaacgcacaggggttgctgcatgtattcgtcagagtgggtgtggagtcaactctggagagaagccagatcacgcgcgaccacatggggcagttactgtatcagctggtgcagtccgaaaagctgagcaagcaggacttcttcaagggattcagcgaaacattagaactggcagatgatatggctatagacattccacacatttggctgtacttggctgagctggtgacccctatgctaaaagagggcggaatatccatgagagagctaaccattgagttcagcaaaccgctcctgcccgtgggccgagcaggcgtgcttctgtcggaaatattgcacctcctttgtaagcagatgagccataagaaagtgggggcactctggagggaagccgatttaagttggaaggacttcctgccagaaggagaagatgtgcataacttccttttggagcagaagctggatttcatcgaatctgattctccatgcagttctgaggccctcagtaagaaggaattgagcgccgaagagctgtataagcgtctcgagaagctgatcattgaggataaagccaacgacgagcagatcttcgattgggtcgaggcgaatctggatgaaattcaaatgtccagtcctaccttcctgagagcgttgatgactgctgtctgcaaggcagcaattattgccgacagctcaaccttcagggtggataccgccgtgatcaagcagcgcgtcccaatattgctgaaatacctggattccgatacagaaaaggagctacaggccttgtatgcactccaggcgagtattgttaagctggatcagccagccaatttactgaggatgtttttcgactgcctatatgatgaagaggtaatctcagaagacgccttttacaagtgggagagctcgaaggacccagccgagcagaatggcaaaggcgttgcactcaagtcagtgacagcctttttcacctggttgagagaagccgaagaagagtcagaggacaattag

SEQ ID NO: 27529 - DNA, 378 bp, Artificial Sequence
  Description of Artificial Sequence: Synthetic coding sequence
atggcccctgcaaaaaagggaggagagaaaaaaaaaggcagatctgcaatcaatgaggttgtgactagagaatatacaatcaatatccacaagagaattcacggagtcgggttcaagaaacgcgcaccgagagcgttgaaggagatccgtaaatttgctatgaaagagatgggaacccctgacgtgcgaatcgacacacggttgaacaaggcagtgtgggcgaagggtatccggaatgtgccttaccgcattcgtgtacggctgagtaggaaaagaaacgaggatgaagattcaccaaacaagctgtataccctcgtgacctacgttcccgtgaccacattcaaaaatctgcagacggtaaatgtcgacgagaattag

SEQ ID NO: 27530 - DNA, 1590 bp, Artificial Sequence
  Description of Artificial Sequence: Synthetic coding sequence
atgctagtgctgttcgagaccagcgttggatacgctatttttaaggtcctaaacgaaaaaaaacttcaggaggtggactccctgtggaaagagtttgagacccccgagaaggccaataaaattgttaaactgaagcattttgaaaaatttcaggacaccgcagaggcgctcgcagcctttacggctcttatggagggcaagatcaataaacagctgaaaaaagtcctcaagaagatcgtgaaagaggcccatgaaccgctggctgtagcggatgctaagctagggggtgtaatcaaagaaaaactgaacttgagctgcattcactccccagttgtcaacgaactaatgcgtgggatccgcagtcaaatggacgggctgatccccggtgtcgaacccagggagatggccgctatgtgcctgggtctcgcacatagcctgtcacgctacagactaaagttttccgcggataaagtggataccatgatcgtccaggctatttcactgctggatgatcttgacaaagagctgaacaactacattatgcgctgccgagagtggtatgggtggcacttcccagagctggggaagataatctcagacaacttaacttattgtaaatgcctgcagaaggttggagatcgcaagaattatgcttccgccaagctctctgaactcctcccagaggaggtcgaagcagaagtaaaagccgcagccgaaatatccatgggcacagaagtgtcagaagaagacatatgcaatatcctccatctgtgtacacaggtgattgaaatttctgaatataggacccagttgtatgaatacctgcagaaccggatgatggcaattgcccctaacgtcaccgtaatggtgggagagttagttggcgcaaggctcattgcccacgcaggctctcttttgaacttggctaaacacgcagcctctactgtgcagatcctaggggctgagaaagccctattcagagcgctgaagtctcgcagagatactcctaagtatggcctgatctaccatgcttctttagtgggacagacttctccaaaacacaagggaaagatttcccgaatgctcgccgctaagacagttttagccatccggtatgacgccttcggcgaggattctagctcagccatgggggttgagaacagagctaagttggaggccaggcttcggaccctggaggacagagggatcaggaagatctcaggcactgggaaggcattggcaaaaaccgagaagtacgagcataaatcagaagtcaagacctatgatccgtctggggactccacacttcctacctgtagtaaaaagaggaaaatcgagcaggtggacaaggaggatgagattacagaaaaaaaagcgaaaaaggccaagatcaaagtaaaagtggaagaggaagaagaagagaaagtagctgaggaagaggagacgtcagtgaagaagaaaaagaaacgcggaaagaagaagcacatcaaggaagaaccgctgagtgaggaggagccttgcacttccaccgcgattgccagtcctgaaaagaagaaaaagaagaaaaagaagcgcgagaacgaagattag

SEQ ID NO: 27531 - DNA, 738 bp, Artificial Sequence
  Description of Artificial Sequence: Synthetic coding sequence
atgaacgggagagctgattttcgcgagccaaatgctgaagtcccaagacccatcccccatattggtcccgactacatccccaccgaagaggaaaggagggtttttgcggaatgcaacgacgagtcattctggttcaggagtgttcctctggccgcaacatcgatgctcattacccagggcttaatatccaagggcatacttagttctcacccaaagtatggaagcatacctaagttgattctggcatgtatcatggggtactttgcaggaaagctttcatacgtcaaaacctgccaagaaaagtttaaaaagctggagaatagtcccctgggtgaagccctcagaagcggccaagcaagaaggtcttcccccccaggtcattactaccagaaatcaaagtatgacagctctgtctccggacaatctagcttcgtcacatctccagctgccgacaatatcgagatgctaccacactatgagcctattcccttttctagttccatgaatgaatctgcccctaccggcataacagatcatatcgtgcagggcccagacccgaatttggaggaaagcccgaaaaggaagaatataacttacgaagaactgaggaataagaatcgggagagttatgaagtgtcactgactcagaagactgatccaagcgtgcgccctatgcacgagagggtacctaagaaggaagtgaaggtcaacaagtacggcgacacttgggacgaatag

SEQ ID NO: 27532 - DNA, 1746 bp, Artificial Sequence
  Description of Artificial Sequence: Synthetic coding sequence
atggaggatgtcaattcaaatgtgaatgcagatcaagaggtccgaaagctccaggaattagtgaaaaagctggagaagcagaatgagcagctccggtcccgaagcggtgccgttcagggagctgggagcctgggcccaggttcacccgtgcgcgctggggctagcataccgagctctggtgcggcttcaccgcgtgggtttcccctaggcttgtctgctaaatctggcggaggccctgggtctggaccaaggcgaacttcctctgaggagttgcgagacgcaaccagtctcctggctgccggagaggggggactgctggacgaagtggaaccgttgaggccagatgaactcgaacggctgtcaggttgggaggaggaggaggagtcctggctgtattccagtcccaagaaaaagctcactcccatgcagaagtcagtctccccactcgtgtggtgcaggcaggtactcgactaccctagtcccgatgttgagtgcgccaaaaagtctttgattcacaagctggatcagacgatgagcgctttaaaacgccagaacctctacaacaaccccttcaactctatgtcctatactagcccctactcaccaaacgcatcttccccctacagcagcgggttcaactccccctctagcaccccagtaagacccccaatagtgaagcagcttatcctgcctggcaactccggaaatctcaaatcctccgataggaaccccccactcagtcctcaaagctcgatagactccgagttgagcgccagtgagttagatgaagatagcatcgggtcaaactataagcttaatgatgttacggacgtgcagattctggcacgcatgcaagaggagagtctacgtcaagaatatgccgctaccacttccagacgcagcagtgggtcaagttgcaactccaccagacggggtacattctctgaccaagagctggacgcccagagcctcgatgacgaggacgataatatgcatcatgccgtctacccagctgttaaccgcttttctccatctccaagaaactctcccaggccgagtccaaagcaatcaccccgaaactcgcccagaagtcggagtcctgcacgtgggattgaatactcccgggtgtcacctcagcccatgatctctcggctgcagcagccgagactctccctgcagggacaccccaccgacctgcagacgagtaatgtgaaaaacgaggagaagctgagaaggagcctgcctaacttatcgcggacatcgaacacgcaggtcgactcagttaagtcctcacgctccgatagtaatttccaggtccctaacggcggtatacctagaatgcagccacaagcatctgcaatcccttctcccggtaaatttcggagcccggctgctccctcgccactggcgttgcgccagcccgtgaaagccttttctaaccacggcagtggttcccccggtagtcaggagattactcagttaacccagactacaagctctcctggtccccctatggtgcagtctacagtgtcagcgaatcctccctccaacatcaattctgctacgctgactagacctgctggtaccaccgccatgagatccggcttgccaagacccagcgccccttcggcagggggtatacccgtgcctcgctcaaaacttgcccaacccgtgcgcaggtccctgccagcaccgaagacctacggttcaatgaaagatgatagctggaaggacgggtgctactag

SEQ ID NO: 27533 - DNA, 3153 bp, Artificial Sequence
  Description of Artificial Sequence: Synthetic coding sequence
atgctttgctggggctattggtcactgggacaaccaggtatctccaccaaccttcaggggatcgtcgctgaacctcaggtgtgcggctttatctccgaccggtccgtcaaggaggtggcgtgcgggggaaaccactctgtatttctgctggaggacggcgaggtgtatacctgtggacttaatactaagggacagctgggacacgaacgcgagggaaacaagccagaacagattggtgccctggccgatcagcatataatacacgtcgcttgcggcgagagccattcactggctctttctgacagaggccagctcttcagctggggagcaggatcagacggacagctgggtctgatgacaacggaagattcagtggctgtgcctcggttaatccagaagcttaaccagcagacgattcttcaggtatcttgtgggaattggcactgcttagccctggccgctgatggccagttttttacctggggaaaaaattcccatggtcagctaggactgggaaaggaatttcccagtcaggcttcaccccagcgcgttagatccctggagggaattcccctggcacaggtggctgcgggtggcgcacattcgttcgctctctcacttagtggagcggtcttcgggtggggcatgaataatgccggtcaactcggcttaagtgacgaaaaggatcgcgagagcccttgccacgttaaactgcttagaactcagaaagttgtttacattagctgtggtgaggagcatacagcggtgctcaccaagtcaggcggtgttttcacgttcggagcaggaagttgcggccagctcggtcatgattctatgaacgatgaggtcaatcctcggagagtattggagctaatgggcagtgaagtcacccagatcgcctgtggcagacagcataccctggctttcgtgccctccagcggtcttatatacgccttcggttgtggcgcaagggggcagcttggcaccggccatacatgcaacgtgaagtgccctagtcccgtcaagggttactgggccgcacactctggacagctgagcgccagagcagaccggtttaagtaccatatagtgaagcagatattctctggcggtgatcagacctttgtgctgtgcagtaagtatgagaactattctcctgcagtcgactttcggaccatgaatcaggcccattacacatccctcataaatgatgaaacaatcgccgtttggaggcagaagctaagtgagcacaacaacgccaacacgatcaatggagtggttcaaattctgtctagcgcggcttgttggaacggaagttttctggagaagaagatcgacgaacattttaagacaagtcccaagattccagggattgacctgaattcgactcgggtcctctttgaaaagctgatgaattcacagcactctatgatcctggagcaaatcctgaactcatttgagagctgtctgattccacaattgagctccagtcctccagatgtggaagcaatgcgaatctatctgatcctcccagaatttccactgctgcaggattccaagtattacatcacactgacaatccctttagcaatggctatcctgagactggacaccaatccttccaaggtgctcgacaactggtggtcacaggtttgtccaaagtactttatgaaactggtgaacctgtataagggcgctgtgctttatctactcagaggccgtaagacatttcttattcctgtcctcttcaataattatatcactgcagccctgaagttgctcgagaaactatacaaggtcaacctgaaagttaagcatgtggaatacgacactttttatatacctgagatctccaacctcgtggatattcaggaagattacctgatgtggttcctacatcaagctgggatgaaagccaggccaagtataatccaggataccgtgaccctgtgcagttatcctttcatatttgacgcacaggctaaaactaagatgctgcagacagatgctgagttacagatgcaggtggctgtcaatggagcgaacctccagaatgtgtttatgcttctaaccctggagccactgctcgctagaagcccctttcttgttctgcacgtgcgcaggaataacttagtgggggatgccctgagagagctgtccattcactccgatattgatctgaaaaagccgcttaaagtgatcttcgatggggaggaagccgtggacgccggaggcgtgacaaaggagtttttcttgctactgctgaaggaactgttaaatcctatatacggaatgtttacttactatcaggattccaatttactctggttctccgatacatgctttgtggagcataactggtttcatctgattgggattacctgcggcctggctatctacaactccacagtcgtcgacctccatttcccactcgctctttacaagaaacttctgaatgtgaagccagggctggaagatttgaaagagctctcacctactgaggggagatccctgcaggaactgcttgactacccgggagaggacgtggaggagaccttctgcctgaacttcacaatctgtcgggagtcttacggtgttatagaacagaagaagctaatccccggtggagacaatgtgactgtgtgtaaggataacagacaagaattcgtggacgcctatgtaaattacgtattccagatatctgtgcatgaatggtatacagcttttagcagtgggtttctgaaggtgtgcggcggaaaggtcctggaactgttccagccctcggagctgagagctatgatggttggaaatagtaactataactgggaagaactggaagagacggcgatctacaaaggagattatagtgccacccacccgaccgtcaagttgttttgggaaacttttcacgaattcccattggaaaagaagaaaaagttcctactgttcctgaccggctctgaccggattcctatttatggtatggcctctttgcagatcgtcattcaatctaccgcctctggtgaagagtatctgccagttgctcacacctgctataacttgcttgacttgcctaagtactcatccaaagaaattctgtccgctcggttaacgcaggccctcgacaactatgaaggttttagtctggcttag

SEQ ID NO: 27534 - DNA, 3069 bp, Artificial Sequence
  Description of Artificial Sequence: Synthetic coding sequence
atgtacttctgttggggcgctgatagcagggagttgcagcgcagacggacagctggatcaccgggagctgagctgctccaggccgcttcaggagaaaggcacagcttgctgctattgaccaatcaccgtgttctttcatgtggtgacaacagtcgcggtcagctcggacggaggggcgctcaacgcggagagctacctgagcccatccaggccctggaaaccctgatcgtagacttagtgtcatgcggcaaggaacattctttggcggtgtgtcacaaagggcgagtttttgcctggggggcagggagcgaagggcagcttggcattggtgagttcaaggaaattagctttactcccaagaagatcatgaccctgaatgatatcaagatcattcaggtgtcctgtggccattaccattcgctcgccttaagcaaggattctcaggtcttctcttgggggaagaattcgcacggacagctgggtttgggcaaggaatttccctcccaagcgagcccacagcgggtacggtcactggaggggatccccctggcccaggtggctgctggaggcgctcattcctttgccctgagcctgtgtggaacatccttcggatggggctcaaattcggcaggtcaactggctctgagcgggagaaacgtacctgtacagtccaacaagccactttccgttggtgcactaaaaaatttaggcgtcgtctacatcagttgtggcgacgctcatacagctgtcttgacacaggacgggaaagtgtttacattcggggataatcgctccgggcagttggggtacagccctaccccagaaaaacgcggtcctcaactcgtggaacggatcgatggactggtgtcacagatcgactgtggtagttatcatacactggcctacgtgcataccaccggccaggtggtctctttcggacatggtccctctgacacatccaagcctacgcaccccgaagctcttactgaaaactttgatatatcctgtctgatcagcgctgaggacttcgtggacgtgcaggtcaagcatattttcgccggaacatacgcgaattttgtcacgactcaccaagatacctccagcactcgtgccccaggtaagaccctgccagaaatttcgagaataagccagtcaatggcagaaaaatggattgctgtgaagcggaggtcaaccgagcatgagatggccaagagcgagatccggatgatcttttcttcccctgcttgtctgactgctagcttcctaaagaaaaggggtacaggcgaaaccacatctatcgatgtggacctggaaatggcacgcgacacttttaagaaacttaccaagaaggaatggatttcctcaatgatcactacatgtctggaggatgacctgttgcgggcactcccatgtcattctccacatcaggaggccctcagcgtgtttctcttactgccagaatgtccagtgatgcacgatagtaaaaactggaagaacctggtcgtccctttcgcaaaggccgtgtgtgagatgtcaaagcagagcctgcaagtgctcaaaaagtgctgggctttcctgcaggagtcctctttgaaccccttaatccaaatgctgaaggcagccatcattagtcagttgctccaccagaccaaaacagaacaggatcactgcaacgttaaggcgctgttgggcatgatgaaagagttgcataaggtgaataaagcaaattgcaggctgccggaaaacacgtttaacatcaatgagctcagcaacctgctgaacttttatattgacagagggaggcagctgttccgcgacaatcatctgatccctgctgagacgcctagccctgtgattttcagtgactttcccttcatcttcaactcactgtctaaaatcaaactcctccaggccgactctcatattaaaatgcaaatgtccgagaagaaagcctacatgcttatgcatgaaaccatcctgcagaaaaaggacgagttcccccctagccccagatttatcctgcgcgtacgtcgctcacgcctggtaaaggatgccctgagacagctgagccaggcagaggctaccgacttctgcaaggtcctcgttgtggaatttattaatgaaatttgcccggagtccggaggcgtgagctccgaattcttccattgcatgtttgaggagatgactaaaccagagtatggaatgtttatgtatcctgaaatggggtcatgtatgtggttcccagcaaagccaaaaccagaaaagaagcgttatttcctgtttggaatgctgtgtggcctgagcctgtttaacctcaatgtcgctaatttgccattccctctggccctgtacaaaaaacttctcgatcagaagcccagcctggaagatctcaaggagctatctcctagactcgggaaatctctccaggaggttctggatgatgcagctgacgacatcggcgatgcactttgcatcaggttctcaatccactgggatcagaacgacgttgacctaatccccaacggaatctctatcccagtagatcagaccaacaagcgggactatgtatcgaagtatatcgattacattttcaacgtttccgtgaaggccgtatatgaggaatttcagcggggattctatagagtgtgcgagaaggagattctgcgacatttctatccagaggaacttatgactgccattatcggcaacaccgactacgattggaagcagtttgagcagaatagcaagtacgagcaaggttaccagaagagtcaccctaccattcaactgttctggaaagctttccataagttgaccctggacgaaaaaaagaaattcttattcttcttgacaggaagagatagactgcatgccaggggcatccaaaaaatggagatagtgtttcggtgtcctgaaacatttagtgagcgtgaccaccccacatctatcacatgccacaacattctcagcctcccaaagtattctaccatggaacgaatggaagaagccctgcaggtggcaatcaacaacaacaggggctttgtgtctccgatgttgacacaatcatag

SEQ ID NO: 27535 - DNA, 1221 bp, Artificial Sequence
  Description of Artificial Sequence: Synthetic coding sequence
atggcggcagctgttcggcaggatctggcacaactgatgaactcatcagggagccataaggatctggcgggtaagtaccggcagatacttgaaaaagccatccagcttagcggagcagaacagctggaggctctgaaggcgttcgtcgaggcgatggtgaacgagaatgtctcccttgtgatctcacggcagctgctgaccgacttttgcacccacttacccaacctgcccgattcgacagccaaggaaatttaccattttacgctcgagaagatccagccgcgagtcatcagcttcgaggagcaggtggcttccatccgccagcatttggcttccatctatgagaaggaggaggactggagaaatgctgcacaagtactcgtcggcatccccttagagacagggcaaaagcaatacaatgttgactacaagctggagacatacctcaagatagcacggctctatctcgaggatgacgatccggtccaggccgaagcttacattaaccgcgctagtttactgcagaacgaatctacaaatgagcagttgcagattcattacaaagtgtgctatgcccgagtactagactatcgacgaaagttcatcgaagccgctcagagatacaatgagctgagctacaaaacaattgtgcacgagagtgaaagactggaggccttaaagcacgcactgcactgtacaatcctcgccagtgcaggacagcagaggtcccggatgctggccacccttttcaaggatgagaggtgccagcaactcgccgcttacgggattctggagaagatgtatctcgaccgaatcatacgtggcaatcaactgcaggagttcgcagctatgctgatgccacaccagaaggctacaactgccgacggctcctccatactggaccgggctgtaattgaacataacctgctcagcgccagcaaactttacaacaacatcacgtttgaggagttgggcgcactgctagaaatcccggcagcaaaggctgagaagatagctagccagatgataacagagggcagaatgaatggctttatagaccagatcgacggaattgtgcattttgaaaccagggaggccttacctacgtgggataaacagatccaatctttatgcttccaggtgaacaatttattggaaaagattagccagactgcgcctgaatggacagctcaggccatggaagctcagatggcccagtag

SEQ ID NO: 27536 - DNA, 1578 bp, Artificial Sequence
  Description of Artificial Sequence: Synthetic coding sequence
atggcagccggactgctaggctccgaagatcctccgtggtcctggaatctgacctgtagggccctccgaacgtgccaagtgagaaacatacgagtcttacagttgctactgaaaccatggtgcatctcaagggccgtgtaccagatgaccgaaggaaggagatgtcaggtacatctcttggatgatcgaaagttagaacttcttgtgcagccaaagctcctggctaaagagctgcttgacctcgtggcctctcattttaatcttaaagagaaagagtattttgggatcgcctttaccgatgagaccgggcacctgaactggctgcaattggatcggagagtcctcgaacacgattttcccaagaaaagcgggccagtggttctctatttttgcgtgcggttctacattgaaagtatctcatatttgaaagacaacgccacgattgagctgttttttctgaacgccaagtcctgcatctataaggaactcatcgatgtggactccgaagtggtgttcgagctggcgagctacattttgcaggaagctaaaggggatttttccagtaatgaagtagtccgaagcgatctcaaaaaacttcctgccttgcctactcaagcgctgaaggaacatccatccctcgcatactgcgaagacagagttatcgaacattacaaaaagctgaacggacagactcgaggacaggcaatagtgaactacatgtctattgtggagagcctccctacatatggtgtacactattatgctgtaaaggataaacagggaatcccgtggtggctagggctcagctataagggcatcttccagtacgattaccacgataaagtgaaacctcgaaaaatatttcagtggcgccagctcgaaaacctgtactttcgagaaaaaaaattcagcgtcgaagtccacgacccaagacgcgctagcgtcacccggagaacattcggccactccggcattgcagtgcatacttggtatgcctgcccagctctcataaaatccatttgggcgatggccatcagccaacatcagttttatcttgatcggaaacaatctaagagcaagatccatgccgcacgatccctgagcgagatcgctattgatctgacagagactggcacactgaaaacatcaaagctggctaatatgggctccaaaggaaagatcatttccggcagctctgggtctctgttaagttcaggatcacaagagtccgatagcagtcagtcggccaaaaaagatatgctcgccgctctaaagtctagacaagaggccctcgaagagacgttacgccaacggttggaagagttgaagaaactctgtctccgcgaagccgaactaacaggcaaactccccgtggaataccccctggaccctggagaggaacccccaatagtgcgtcgcaggatcggtactgcgttcaagctggacgaacaaaagatactgcccaagggcgaggaagccgaactcgaaagactggagcgggagttcgcaatacagtcccagataactgaggccgctaggcgcttggcctcagacccgaacgtctctaagaagctgtag

SEQ ID NO: 27537 - DNA, 1605 bp, Artificial Sequence
  Description of Artificial Sequence: Synthetic coding sequence
atgaagcaggaaggatccgctcgcagaagaggggctgacaaagccaagccacccccaggcggaggtgaacaggagccaccaccccctcccgctccccaggacgtcgaaatgaaggaggaggccgctaccggcggagggagcacaggcgaggccgatggaaaaacagctgcagccgctgccgagcattctcagagagagctcgatactgtcacactggaggatatcaaggaacatgtcaagcagctggaaaaggccgtgagcgggaaagagcctagatttgttctccgggcattgagaatgctgccctcaacttcacgacggctgaaccactatgtgctgtataaagccgtgcagggattcttcacctctaacaatgctacgcgcgatttcctgttacctttcttagaggagcctatggacactgaagccgacctgcagtttcgaccacgaacaggtaaagcagcatcaacacccctactgcccgaagtggaggcatacctgcagctcctggttgtgatttttatgatgaatagcaaaagatataaagaggcacagaagatttctgatgatctgatgcaaaaaataagcacccagaatcggcgagcgttagatctggtggcagctaagtgttactattaccatgccagggtctatgagttcctcgataagttagacgtcgtgaggtccttcctgcatgcccgtctgagaacggcgaccctccggcatgacgctgacggccaagccaccctcctgaatttgttattgaggaactaccttcattattccctatatgaccaagcagagaaactggtgtcaaaatcagttttcccagagcaagccaacaacaacgagtgggccaggtacttgtattacaccggtcggattaaagccattcagctggagtactccgaggctaggagaaccatgacgaacgcgctacgcaaggcaccacagcacaccgcagtcgggttcaaacagaccgtccacaaactgttgatcgttgtggagctactgctcggggagattcctgaccgcttgcagttccggcaacctagtctaaagaggtcactcatgccttacttcctgcttacgcaggccgtgagaacaggtaacttggcaaaatttaaccaggtgttggatcagttcggtgagaaatttcaggccgacggcacctatacgcttattatacgactcaggcataacgtgatcaagaccggggtgcggatgatctcccttagctactcccgcatcagcctggcggacattgcgcagaagcttcagttggattcaccagaggacgcagagtttatcgtggcaaaggcaatccgcgatggcgtcatagaggcttcgattaaccatgaaaagggctatgttcagtcaaaagagatgatcgacatttattcaacccgagaaccacagctggcatttcaccaaagaatcagcttttgcctggacatacacaacatgtcggtgaaagctatgcgcttccccccaaagagctataacaaggacctcgagagtgcagaggagcgcagagagagagagcagcaagacttggagtttgctaaggagatggctgaagatgacgacgactcatttccatag

SEQ ID NO: 27538 - DNA, 1311 bp, Artificial Sequence
  Description of Artificial Sequence: Synthetic coding sequence
atgagaagagatgtgaatggagtgactaagagccgttttgagatgttcagtaactcagacgaggcggtgatcaacaagaagcttccgaaagagcttctgctgagaatcttctcttttctcgacgtggtcacgctgtgtcggtgtgctcaggtctcccgcgcatggaatgtcttggctctggacggaagtaactggcagagaatcgacttgtttgacttccaaagagacatagaaggacgagtggttgagaatataagcaagaggtgtggaggatttcttcgcaagctgtcacttcgcggatgtctgggggtgggggacaatgcactcagaactttcgcacaaaattgtaggaatatcgaggtattgaacctcaatggctgcactaaaacgaccgacgccacatgtacgtctctgtccaagttttgctctaagttgcggcacttggacctggcaagctgtacctcaatcactaacatgagcctgaaagccttatccgagggctgcccccttttagaacagctgaatatttcttggtgcgaccaggtgaccaaggacggcatccaggccttagtgaggggctgcgggggactcaaagccttatttctgaaaggctgcactcaactggaggacgaggctttaaagtatatcggtgcacactgccccgagctcgtaactctcaatttgcagacctgccttcaaatcaccgacgaggggttgataaccatctgcagagggtgtcacaagcttcagagcctctgtgccagcggctgttccaatataacagatgccatcctgaacgctctggggcagaattgccccaggctccgtatcctggaagttgcccgatgctcccagctgaccgatgtagggtttacaacgctggcccgaaattgccatgagttggagaagatggacctggaggagtgcgtccaaatcactgacagcacattgatccaactcagtatccactgcccacgactccaggtgctgagtctgtcccattgtgaactgatcacggacgacggcatccggcacctgggcaacggtgcttgtgcccacgatcagctggaggtgatcgaattggacaactgtccactgataaccgacgcgtccctggagcatctgaagagctgccatagccttgaaaggatcgaactgtacgattgccaacaaatcacaagggccggtattaagcggcttaggacccatctaccgaatatcaaagttcacgcatacttcgctcccgtgacacctccgccaagcgtcgggggatctcgccaacggttttgccgctgttgcatcattctttag

SEQ ID NO: 27539 - DNA, 1167 bp, Artificial Sequence
  Description of Artificial Sequence: Synthetic coding sequence
atgcgatgtctgtacggcagagtcgggggtgccagaagaaaaatggctgccagtgctgctgctgccgaattacaggccagcgggggacccaggcatcctgtttgcctccttgtcctggggatggctggctcgggcaaaacaacattcgtgcagagactgacaggccacctgcatgcccagggcaccccaccctatgtgatcaatctggatcctgccgtgcacgaagtgccattccccgcaaatatcgacattagggacaccgtgaaatataaggaggtgatgaagcagtacggactgggccctaacgggggaatcgtaacatccctgaacctcttcgccactagatttgatcaagtgatgaaattcattgaaaaggcgcagaatatgtcaaaatatgtgctgatcgatacccctggccaaatagaggtgtttacatggtcagcaagtgggaccattatcacagaggccctcgctagttccttcccaacggttgtgatctacgtgatggatacaagtaggagcacaaacccagttacatttatgtccaacatgctgtatgcttgttctatcctgtataagaccaagctcccctttatcgtcgtgatgaacaagacggacattattgatcacagctttgccgttgagtggatgcaggatttcgaggccttccaagatgccctgaaccaggaaaccacatatgtttctaaccttacccgaagcatgtcccttgtattagacgagttctacagcagcctgagagtggtgggggtttccgctgtgttgggaaccggtttggacgaactctttgtccaggtgaccagtgctgctgaagagtatgagagggaatataggcctgaatatgaacgccttaagaaatccctcgccaatgccgaatcccagcagcaaagggaacagctggagcgcctccgcaaagatatgggatctgtggcactcgatgccggaactgccaaggattcactttcccctgtcctacacccttcagacctgatcctgacgcgagggactctagatgaggaagacgaagaggcagactcagatactgatgacatcgaccatcgcgtaacagaggaatcacacgaggaacccgcattccagaatttcatgcaggaaagcatggctcaatactggaaaagaaacaataagtag

SEQ ID NO: 27540 - DNA, 1668 bp, Artificial Sequence
  Description of Artificial Sequence: Synthetic coding sequence
atgcggctgatcggaatgccgaaagagaagtatgatccgccagaccccagacgaatttatactatcatgagcgcggaagaagtggcaaacgggaaaaagagtcactgggcggaactggaaatcagtggaagagtccggtccctctccacctcgctctggtcactgactcatctgactgcactacacctgaacgataattacctgtctcggattccccctgacattgcgaagttacacaaccttgtctaccttgacctgtcttccaataaattgcgcagcctccccgctgaactcggtaatatggtgagtctgagggaactcttactgaacaataacctgttgcgcgtgttaccctacgagcttggaagactgttccagctgcagacactgggccttaagggaaatccgctgtcacaggacatactaaatctgtatcaggatccggacgggacacgcaagctcctgaattttatgctggataacctggccgtgcaccccgagcagctgccaccacgaccttggattaccttgaaggagcgtgaccagatccttccatctgccagttttaccgtgatgtgttataacgtgttgtgcgataagtacgctacacgacagctgtatggctactgcccttcctgggctctgaattgggaatatcgcaagaagggaattatggaggagatcgttaattgtgatgccgatattattagcctgcaagaagtcgaaacagagcagtacttcacccttttcctccccgcactgaaagagaggggctacgatggcttcttctccccaaagtctagagccaaaatcatgtctgagcaagagaggaagcacgtggacggctgtgcaatttttttcaaaaccgaaaaatttaccctggtccagaagcataccgtggagttcaaccaggtagctatggccaattctgacggttcagaagctatgcttaacagagtgatgaccaaagacaacatcggagtcgccgttgtcttagaggtccacaaagaactgttcggtgccggtatgaagccaatccatgctgcagacaagcagctcttgatagttgcgaacgcacacatgcactgggaccctgaatactcggatgtaaagctgatccagactatgatgttcgtgagtgaggtgaagaatatacttgaaaaagcctctagtagacccggaagccccaccgcggatccaaatagtatcccccttgtgctgtgtgccgacctcaatagcttacccgattccggcgtggtggaatatctcagcaatggcggagtcgccgacaaccacaaggactttaaagaactcaggtataacgaatgtctcatgaatttttcatgcaacggaaagaacggaagctccgaggggagaatcacccacggttttcagctgaagtccgcttacgagaataacctgatgccgtataccaattacaccttcgactttaagggagtgatcgactatatcttctactctaagacccacatgaatgtcctgggagtgttgggcccactggatcctcagtggctggtggaaaataatatcaccgggtgtccccacccacacatcccatcggatcacttcagcctcctgacccagttagagctgcacccccctctgctgcctcttgtgaatggagttcatctgccgaatagacgctag

SEQ ID NO: 27541 - DNA, 2673 bp, Artificial Sequence
  Description of Artificial Sequence: Synthetic coding sequence
tctagtgacagcgagattataggctatgctctcgatacgttgtacaatataatttcaaacgaggaggaggaagaggtcgaggagaattccacccggcagtccgaggacttaggtagccagttcacagagattttcattaaacaacaggaaaacgtgacattgctcctgtccctgttggaggaatttgacttccatgttcggtggcctggcgtcaagctcctgacatctttactcaaacaactaggcccacaagtgcaacaaatcattttggtaagcccaatgggcgtatctcgtctgatggacctcctggcagattccagggaagttattaggaatgatggggttcttctactccaagcactcacaagatcgaatggtgccatacagaagatcgtggcatttgagaacgcgttcgaacgccttctggatattattagcgaagaggggaattcggatggaggaattgtggttgaagactgtctcatcttgttgcagaacctcttgaaaaataacaacagcaatcagaacttcttcaaagaggggtcatatatccagagaatgaagccctggtttgaagtgggggacgagaattcgggttggtctgctcagaaggttacaaacttgcacctaatgctccagctggttagggtgctggtgagcccaactaacccacctggagccacttcgtcctgtcagaaagccatgttccagtgcggactgctccagcagctctgtacaatcctgatggctacgggtgtgccggcagacattttgaccgaaactattaacacagttagtgaagtcatccgagggtgccaagtgaaccaggactactttgcctcggttaatgcaccttccaacccccctcgacctgcgatcgtggtactgcttatgtctatggtcaacgagcggcagcccttcgtgctgaggtgtgccgtcctgtattgctttcaatgttttctgtataaaaaccagaagggacagggggagatagtcagcaccctgctgccgagcacgattgacgcgacgggcaactccgtttcagccggacagcttttgtgcggcggattattttcaacagactcgctctccaattggtgtgcggctgtcgccctggcacatgccctgcaagaaaatgctacccagaaagaacagcttctacgggtccagctagccactagtatcgggaaccctcccgtctctctcctccagcagtgtaccaatatactgagccagggcagcaagatccaaaccagagtcggtctgttgatgctactgtgtacctggctatccaactgccccattgcagtcacccactttctccacaactctgcaaacgtaccttttctcaccggccaaattgcggagaacttgggcgaggaggaacaactcgttcagggcctgtgcgccctacttctgggaatctccatttactttaacgataatagcctggagagttatatgaaagaaaaattgaagcagctgattgagaagcgaatagggaaggaaaatttcatcgaaaagcttggcttcatttccaagcacgaactgtactcaagggcatctcagaagccgcaaccaaattttccaagccccgaatacatgattttcgatcacgagttcacaaaactggtgaaagagcttgaaggcgtgataaccaaggctatctacaagagcagcgaggaggataagaaggaggaagaagtgaagaagaccttggagcagcatgacaatatagtgactcactataagaatatgattcgtgagcaggatttacagctggaagaattaagacagcaggtaagtactctgaagtgtcaaaacgagcagctgcaaactgccgtgacacagcaggtgtcccagattcagcagcataaagatcaatataacctcctaaaaatccagctgggcaaagacaaccagcaccaggggtcgtattcagaaggcgctcagatgaatggcattcaaccggaggaaattgggaggcttagggaggagatcgaagaactgaaacgaaatcaggagttgctccagagtcagctcacagaaaaggactctatgattgagaatatgaagtcctcccagacgagcggcactaacgagcagagctctgccatagtgtcggccagggatagtgagcaggtcgcagagctgaagcaggagctggccactctgaaatcccaattgaacagccagagcgtcgagatcacaaagctccagacagagaaacaggagctgctgcagaagactgaagcatttgctaaatcggtcgaggttcagggagagactgagaccatcatagctaccaagactactgatgtggaagggagactaagcgctttgctgcaggagactaaagagttgaaaaatgaaatcaaggccctctccgaagagaggacagccattaaagagcaactggattcctcaaactccaccatcgcaatactacaaactgaaaaggataagcttgaactggaaatcacggattctaagaaggagcaggatgatctgctggtgctgctcgccgatcaggatcagaagatcctttctctcaagaacaagttgaaagatcttggccatccagtagaggaagaagatgagctagagagtggggatcaagaggacgaggacgacgagtccgaggaccctggcaaggacctggaccacatctag

SEQ ID NO: 27542 - DNA, 1944 bp, Artificial Sequence
  Description of Artificial Sequence: Synthetic coding sequence
atggccagggccggacccaggctcgtgctctccgaggaagcagtcagggccaagagtggcctgggaccccatcgggatctggctgaactgcagagcctgtccatccccggaacctatcaggaaaagattacacatctggggcacagcctcatgagcctaacgggactcaaaagcctggatttatctcggaactctctggtctccctggagggaatccagtatcttactgcgctggagagtttgaacctttactacaactgcatttcctcactggcggaagtctttagactccacgctctgactgagctcgtggatgtagacttcagacttaacccggtggtgaaagtggagccagactaccggttatttgtcgtgcacttgctgcccaagctgcagcagctcgatgaccgacctgtgagggcctctgaacggaaggcatctagactacacttcgccagcgaggattcactcgacagcaaagagtctgtccccgctagcttaaaagaaggacgaccccaccatcccagggccaagtgtactgaagcattggcaaagcagtccttggtgatggatgctgacgatgaagccgtgctaaatctgatagcggaatgtgaatgggacctcggtcggccacccggttctacttccttcagtcagaagggacgggaggctgactccagaggtagccaagaatcacgacaccttctgagtccccagttagtgcagtatcaatgtggagacagcgggaagcaagggagggagacccggagatcgtcctgccgaggatgctgcttagaaaagatgccgtggtcccaactctgcggagagcttccaccactatatggagcagagcccgaggcttcacgagctcctcgaccacatacttattttacgccccacccagatagtatggatacagaggattcagcctctagtcagaaattggatctgtcaggcgaaatggtccccggtcccctgcccgctccagggaagtgccgcaagcgacggatgcctgtcgggaggttccagacattctcagatcaggagggcttgggctgccctgaacggacacacggtagctccgttcccaaggaatccctcagtagacaagattcgagtgaatcacggaatgggaggactctgtctcagccggaagcatctgagaccgaagaacagcggtcccgaggggtgaccgacacccgcgagccgagtcctggatcccatagcgccctgcccggaaagaagaccgcgctgcaggctgcactcctcgagaccctactcgacctggtggatcgctcatggggtggatgtcgttctctgcatagtaacgaagctttccttgcacaagccaggcacatcctctctagcgttgaggagtttacagccgcacaggactcatccgcaatggtcggggaggatgtgggctcactagctctggagtccaagagcctccagtctcgcctggctgagcaacagcagcagcacgcaagggagatgtcagaggttacagctgagcttcaccatactcacaaagagctcgacgaccttaggcagcacctggacaagtcgctagaggaaaacagtcggctaaaaagtctgcttttgagtatgaaaaaggaagtgaagtctgcagacaccgctgccacgctgaacttacagatagcaggcttgcaaaccagtgtgaagagactgtgtggagagatcgtggagcttaagcagcacctggaacactatgacaagatccaggagctaacgcagatgctccaggagtctcattcatcccttgtttcaaccaacgaacacttactgcaagagctcagccaggtgagggctcagcatagggcagaggtggagcagatgcattggagttatcaggaattgaagaagaccatggctctttttccacattccagcgccagccacggcggatgccaggcatgttag

SEQ ID NO: 27543 - DNA, 777 bp, Artificial Sequence
  Description of Artificial Sequence: Synthetic coding sequence
atggctgagacagaggagcggtctctggacaatttctttgctaagagagataagaagaagaagaaggagcgctcaaatcgggctgccagtgcggctggcgcagcaggatccgccggaggtagttccggcgcagccggtgccgcaggtggcggagcaggcgctggcacccgtcctggagatggaggaacggctagtgctggcgcagccggacccggagccgctaccaaagctgtgactaaagatgaagacgagtggaaggaactggaacagaaggaagtcgattacagcgggttaagagtgcaagctatgcagatatctagcgagaaggaggaagatgacaacgagaaacgccaggatcccggtgacaattgggaggagggcggtgggggtgggggaggcatggaaaagagtagtggcccttggaacaagactgcccctgttcaagcccctcctgcgcctgtgatcgtgactgagacacctgaaccagccatgacaagcggtgtgtatcggcctcccggtgctaggctcacgacaacaaggaaaacaccacaggggccacctgagatttattccgatacacagttcccatcccttcagagtacggctaagcacgtggagtcccggaaagacaaagagatggaaaagtccttcgaagtcgtgaggcacaagaatcgcggacgagatgaggtctctaaaaaccaggccctcaaattgcagctcgacaatcagtacgccgtgctggagaatcagaaaagttcacactcccaatacaactag

SEQ ID NO: 27544 - DNA, 1077 bp, Artificial Sequence
  Description of Artificial Sequence: Synthetic coding sequence
atggcccctcagaacttgtctacgttctgtttgctgctactttacttaatcggcgctgtgattgccggaagggatttttacaaaattctgggtgtgccaagaagtgcaagtatcaaagatatcaaaaaggcttataggaagcttgctctgcaattgcaccctgacagaaatccagatgatcctcaagcccaggagaaattccaggatctcggcgcagcctacgaagtgctttctgacagcgaaaagagaaagcagtacgacacctacggcgaagagggtctgaaggatggccaccagtcatctcacggggatatcttcagccacttttttggcgattttgggtttatgttcggcggaacaccccgtcagcaggatagaaatatacccagagggtcggacatcatagtcgaccttgaagtgaccttagaggaggtatacgcaggcaattttgtcgaggtcgtcaggaataaaccagtggcccgtcaggctcctgggaagaggaaatgtaactgtaggcaagagatgcgcaccacccagttaggacccggaaggttccagatgacccaggaggtagtatgtgatgagtgtcccaacgtgaagctggttaacgaagagaggacactggaggtggagatagagcccggagtgcgagacgggatggaatacccattcatcggcgaaggagaaccacatgtggacggcgagcccggtgacctgaggttccggatcaaagtcgtcaagcacccaatttttgagagaaggggcgatgacctttacacaaacgtgaccattagcctggtggagagccttgtcggattcgaaatggatataacccacttagacggtcataaggttcatatcagcagagacaagattactcgccctggagctaagttatggaagaaaggtgagggcctgcccaacttcgacaacaataatattaagggcagtctgatcataacgttcgacgtagattttcctaaagaacagctgaccgaagaagccagggaggggattaagcagcttcttaaacaggggtccgtgcagaaagtttataacggactacaaggttactag

SEQ ID NO: 27545 - DNA, 624 bp, Artificial Sequence
  Description of Artificial Sequence: Synthetic coding sequence
atgacttcccgcaagaaggtccttctgaaggtgattatcttgggagatagcggtgtgggtaagacctcccttatgaaccaatatgtcaacaaaaagttttcgaaccaatataaagcaaccataggggcagactttctgaccaaggaagtcatggtggacgacagattagtcaccatgcagatttgggacactgccggacaggaacgtttccagtctctcggcgttgccttttatagaggagctgactgttgcgtgttggtttttgacgtgacagcgcctaacactttcaagaccctcgattcttggagagatgagtttttgatccaggcctcccccagggaccctgagaatttccccttcgtagttttgggtaataagatcgatctagaaaaccgtcaggttgccacaaaacgagcccaagcctggtgttacagcaaaaataacattccttattttgaaacgtcagcaaaagaagctattaatgtggagcaggcctttcagaccatagctcgaaatgccctcaaacaggagacagaggtggaactttacaacgaatttcctgaacccatcaaactcgacaagaacgaccgggcaaaggcctctgctgaatcttgttcttgctag

SEQ ID NO: 27546 - DNA, 3225 bp, Artificial Sequence
  Description of Artificial Sequence: Synthetic coding sequence
atgattccgatctgcccagtcgtgagtttcacttacgtcccgtctaggcttggcgaagacgctaaaatggctacaggcaactacttcggttttacacattccggagccgctgcagccgctgctgcagcacagtactcacagcagcccgcttccggtgtggcctacagccaccccacaactgtagcatcttataccgtccatcaggctcccgtggccgcacacaccgtgacagccgcatacgctcccgctgccgctactgtcgcagtcgcccgaccagccccagtggcagtcgccgcagcagctacagccgctgcatacggtggttacccaactgcacacaccgctacagactacgggtacactcaaagacaacaggaagcgcctcccccacctcctccagcgacgacccaaaattatcaggactcttactcatatgtccgaagcacggcccctgctgtggcatatgactccaagcagtactaccagcagccaaccgccacagccgctgccgtcgctgcagctgctcagccacagccctcagtcgcggagacgtactatcagaccgcacctaaggccggatacagccaaggcgctacccagtatacccaagctcaacagacacgccaggtgactgccatcaaacccgcaacccccagccctgcaacaactacattttccatctaccctgtgtcgagcacagtgcagccagtcgccgctgctgccaccgtcgtaccgagctacacccagagtgctacctacagcacaaccgccgtcacgtattcagggacaagctattcaggatatgaggccgcagtgtacagcgcagcttcatcctattatcagcagcagcagcaacaacagaagcaggctgctgccgcagctgccgctgctgctgctactgctgcctggacgggcacgacgtttactaaaaaagctccttttcaaaataagcagttaaagcctaagcaaccacccaagcctccccagatccattactgtgatgtttgtaaaatttcctgcgcaggaccccagacgtataaagaacacctagaaggacagaaacacaagaagaaggaggctgcacttaaggcgtctcagaatacgtctagctctaattcctccacacggggtactcagaatcagctgcggtgcgaattgtgtgacgttagctgcaccggagctgacgcctatgccgctcatatcagaggggctaagcaccagaaagttgttaagcttcataccaagctggggaagcccattccttccactgaaccgaacgttgtctcacaggcaacatcgtcgaccgctgtgagcgcgtctaagccaacagcatccccatctagtattgccgctaataactgtacagtgaatactagtagcgtggctacttcctcaatgaagggcctgacaaccacaggcaactctagcctaaatagcacgtctaacaccaaggtgtctgctgtccccacgaacatggccgcaaaaaagacaagcacccccaaaattaacttcgtgggcggaaataagttgcagtcaactggaaataaggccgaagatattaagggcacagagtgtgtcaaatccacccccgtcactagtgccgtgcagatccctgaggtgaagcaggacaccgttagcgaacctgtgacgccagccagcttggctgctctccaaagcgatgtgcagccagtgggccacgactacgtcgaggaagtacgaaatgatgaaggcaaggtcatacgctttcactgcaagctatgcgagtgcagcttcaatgacccaaacgccaaagaaatgcatttgaaagggaggaggcacaggttgcagtacaagaaaaaagtcaaccctgacctgcaggtggaagtcaagcccagcatcagggccaggaagatccaagaggaaaagatgcgaaaacagatgcagaaggaggagtactggcgacgcagggaggaagaggagcgttggagaatggaaatgaggagatacgaggaggatatgtattggcggcgaatggaagaggaacaacaccattgggacgacaggcggagaatgcctgacggcggatatcctcacggaccccctgggcctcttgggctgctgggtgttcggccaggaatgcctccacagccccagggacctgcccctctgaggcgccctgatagctctgatgatagatacgttatgaccaagcatgccactatttacccaactgaagaggagttgcaggccgtgcagaagatcgtgagtatcaccgaacgtgctttaaagctggtgtccgactctctcagcgagcatgaaaagaataagaacaaggagggcgatgacaagaaggaggggggaaaagatcgggctctaaagggagtgctgcgggtcggcgtccttgcaaaagggctgttgctgagaggcgacaggaacgtcaatttagttttattatgcagcgagaagccttcaaagactctattgtctagaatagccgaaaatctccccaaacaattggcagtcatcagcccggaaaagtatgatattaaatgcgccgtgagtgaggcagctatcatcctgaacagttgcgtcgagcccaagatgcaggtgaccattaccctgacatcccctatcattagggaggaaaacatgcgggaaggtgatgttacgagcggcatggtcaaagaccctcctgacgtgctggacaggcaaaagtgtctggatgcactggccgctttgcgacacgccaaatggttccaggctcgcgctaatggactccagagctgcgtgatcattatcagaattctccgcgatttatgccagcgcgtgccgacttggtccgacttcccaagctgggccatggagttgctggtagaaaaggccatttcaagcgcatcctcaccccagagccctggcgatgcccttcgccgagtcttcgagtgcatctcttcaggcataattctcaaaggcagccctggcctgttggacccttgtgaaaaagatcctttcgatactctcgcaacaatgactgaccagcagagagaagacataaccagtagcgctcagttcgccctgcgattgctggcctttaggcaaatccacaaagtgctggggatggatcccctccctcagatgtctcaaagatttaacatccataacaaccgtaagagacggcgagacagtgatggtgttgacggttttgaggcggaaggcaaaaaagataaaaaagactatgacaatttttag

SEQ ID NO: 27547 - DNA, 438 bp, Artificial Sequence
  Description of Artificial Sequence: Synthetic coding sequence
atgaagtttaatccttttgtgacctcagatcgcagcaaaaaccgaaagcgccacttcaatgcccctagccatgtgagacgtaagataatgtcaagccccctttccaaggagttgcgccagaaatacaatgtgcgatccatgccgatcagaaaagatgatgaagtccaggtggtaagaggccactacaagggacagcagatcgggaaagtcgtccaagtctacagaaagaaatatgtcatctatatcgagagggtccaaagggaaaaggccaatggcacaactgtccacgtaggaatacacccttcgaaggtggtgattacccgactgaaactggacaaagatagaaaaaagatcttggaacggaaagccaaaagtagacaggtgggcaaggagaaaggaaagtacaaggaagagctcattgagaagatgcaggagtag

SEQ ID NO: 27548 - DNA, 3177 bp, Artificial Sequence
  Description of Artificial Sequence: Synthetic coding sequence
atggaggacgggacacccaagcacatcattcagatgactggtttcaagatggaggaaaaagaggctcttgtaaagctcctcctgaagctggattgtaccttcatcaagagcgagaagtacaagaactgcactcacctgattgcagagcggttgtgcaagagcgagaagttcttagccgcttgtgcagccggaaaatggattttgactaaagactacatcattcattctgcaaagtcaggcagatggctggatgagaccacgtatgagtggggatacaagatagaaaaagactcgcgatatagtcctcagatgcagtctgcgcctaagaggtggcgggaggagctgaagcgcactggtgcccctggcgctttccacaggtggaaagttgtgcttctcgttagaaccgacaaacggtctgacagcctgatccgagttttagaggcaggcaaagctaacgtgattctgccaaaatcaagtccgagtggcattacccacgtgatcgcatcgaacgcgcgaatcaaggcggagaaagaaaaggataatttcaaggcacccttttatcctatccaatacctgggggacttcctgctggagaaggagatccagaacgatgaggattcccaaaccaattcagtctggactgaacactcaaacgaggaaacaaataaagacttccgaaaggatgccggttttctggagatgaaaggtgctctcagagaaacaatgtaccggacacagaaggagatgcaaaaccacgaagatgtgaacgtcggaagtattctcatacagcaccataaaaaggaaaagttctcaggcagcagcaaggatttaaagttcgtcaaaatgcgaaacacatttggctctcatacttatgagaaccagaaggagatcaaaaaaaaagacgaggatatccagcggagctataccctgcgacgtaaacggaagaagggcaaggagagtaattgtaaaaagggagtggaacacgagaaaatcaagtcaaccttgaggcggcacatttataaccgcgaccagaaagaaatgaaaaacagtatttttgctgagtacgccaaagagtccaaagccatggccatcaagaccgacgtggacgtcgtcgagattaaaaacacactgagaaaacacatctatagggctcaggccgttcgatataactgcatcagaattgataaacagcccgtgtacaacgtcgaggttaagaacgctgaattccctcgtggggtcttgaatttgatcgaaagcctgattgaaggccacttttttaaagaggcaatcgaggagctgtccaccctgcaggcccattatatacccccagtctgtgtgcttcatgccttgcttgagaacgtgttacaggataatatcgataccttttccggacgctactttcatattctatccgccctcctccaccttcaccccccatggaaatctcctgccatgtcgagatattatctcgaacttttccagtgtccaacatgtatgaagggcgcttggagtctggtagaggtgttgatccggagctgtttgtttaatgaatccttctgccaccaaatcagtgagaacatcggcagtaaagtgttgcacctgacactgctaaagttcttctttaacttgatagagtccgaggtccagcatctttcccagaagctgtacgattggtcagactcccagaatcttaagattaccggcaaggcaatgctcttggaaatcttctggtccgggagtgaaacgagcgggctgctcacgaagccagttaacatgctactggagtggaccatatacagccacaaggagaaatttaaatcaaatgatgtcttcaaacacgaacttgcttacctgctggctgggatcctgggcgctgccattgactactggatcttccttggcctaaagatgggcagaaatgtgatgcgccatatgtcagatgacctgggctcctatgtctccttgtcttgcgacgatttcagtagtcaggagctggagatttttatctgctccttctccagttcatggttgcagatgttcgtggcagaagccgtgttcaaaaagttatgcctccagagcagtggatctgtgagctccgagcctctgtcattgcagaagatggtttacagctacctgcccgctctcgggaaaactggcgtgttgggttccggcaaaatacaggtgtccaagaagattggtcaacgaccctgtttcgacagccagcgtactctgctaatgcttaacgggaccaaacaaaaacaggtcgagggccttcccgaattgcttgaccttaacctcgccaaatgctcctcctccctgaagaaactgaaaaaaaagtcggaaggggagctcagctgttctaaggaaaattgtcctagcgtggtgaagaagatgaactttcataaaaccaatcttaagggggaaactgctttacaccgcgcatgtattaataatcaggtggagaagcttatcctccttctgtcgttgcccggaatagacattaacgtcaaggacaatgccggttggacccccctccacgaagcctgtaactacggcaacaccgtgtgtgtgcaggagatacttcagcgctgccctgaagtagacctactgactcaggtcgacggcgttacgccgctccacgacgccttgtccaacgggcacgtggaaatcggtaagttgctattacagcacggaggccctgttcttcttcagcagagaaatgcaaaaggggagctgccactggactatgtagtctcgccccagattaaagaggaacttttcgcaatcaccaagatcgaagatactgtggaaaattttcatgcccaggccgagaagcattttcactaccagcagctggaatttgggtcattccttttgagtcggatgctgctgaacttctgctccattttcgaccttagcagcgagttcattctggcctctaaaggtctgacccatctcaatgaattgctgatggcttgcaaatcacacaaagagaccacttcagttcacaccgattggctgttggacctttatgcgggtaatatcaaaacacttcagaaattaccacacatactcaaggaactgccggaaaacctcaaggtgtgtccaggcgtccataccgaggcactcatgatcacactagaaatgatgtgcaggtctgtcatggagttttcctag

SEQ ID NO: 27549 - DNA, 660 bp, Artificial Sequence
  Description of Artificial Sequence: Synthetic coding sequence
atggaacctaaggaagcaacaggcaaagagaatatggtgactaagaagaagaacctagccttcctgcgttcacgactgtatatgcttgaaaggcgcaaaaccgataccgtcgtagaatcatcagtctccggcgatcattccggcaccttgagaaggagtcagagtgatcgcacagagtataatcagaaactacaggaaaaaatgactccacagggagaatgcagtgtggcggagactttaactccggaggaggagcatcacatgaaacgcatgatggccaaacgcgaaaaaataattaaagaactgattcagaccgagaaagactatcttaacgatctggagctctgcgtaagggaggtggtgcaaccactgaggaacaaaaaaactgatcgtcttgacgttgattcattattcagtaatatcgagtcagtgcaccaaatctcagcaaagctgctgtcactgctggaagaagccactacagatgtggagcccgctatgcaggtgatcggtgaggtgttcctgcaaatcaagggtccgcttgaggatatttacaaaatctactgttatcatcacgatgaagctcattcaatccttgagtcttacgagaaagaagaggaactaaaagaacatctatcccactgtatccagagcttgaaatag

SEQ ID NO: 27550 - DNA, 3183 bp, Artificial Sequence
  Description of Artificial Sequence: Synthetic coding sequence
atgctcatagaggatgtcgacgcactgaagtcttggcttgccaaactgctagagcccatttgcgatgccgatccgagcgcactggccaactacgttgtcgcgctggtgaagaaagataaaccagagaaggagctcaaagctttctgcgcagaccagctggatgtttttctgcagaaggagacatctgggtttgtcgacaagctttttgagagcttgtacaccaagaattatcttcctctgctggaacccgtcaagcccgagcctaaacccttagtccaggagaaagaggaaattaaggaggaagtcttccaggagccagccgaagaggagcgggacggccgaaagaaaaaatatccatctccccagaagacaagatcagagagtagcgaaagacgcacgcgtgagaagaaacgagaggatggcaagtggcgggattacgaccggtattacgaaaggaacgagctatacagggagaagtacgattggcggagaggaagatcgaaatcccgctcgaaatccaggggattgagtagaagcaggtcccgtagtcgtggcagaagcaaggaccgggacccaaatcgtaatgtggagcaccgggagcggagcaaattcaaaagcgagcgcaatgacttagagtcgtcctatgttcccgtatccgctccacctcctaacagtagtgagcaatattcaagcggagcccaatccattccatccacagtaactgtcatcgcacctgctcaccattcggagaacactacagagagctggagcaattactataataatcattcctcgtcgaatagcttcggccgaaatctgcctccaaagcgccgatgcagagattacgatgaacggggtttttgtgttcttggagatctgtgccagtttgaccacgggaacgatcccctggtcgttgatgaagtggcccttccatctatgattccatttcctcccccaccacctgggcttcccccacctccccctccaggaatgttgatgcctcccatgcccggaccaggacccggaccgggtcccggacccggacccggtccagggccaggccctggccctggtcactccatgcgcctccccgtccctcagggccatggtcaaccacctccctcagtggtgctgccgattccgaggccccctatcactcagtcctccctgatcaacagccgtgatcagcctggaaccagcgccgtgccaaacttggccagcgttggaacccgcctgcctccacctttgccgcagaaccttctttatacagtgagtgaaagacagccaatgtatagcagagaacatggggcagccgctagcgaacgtttgcagttgggtacaccacccccactactggccgctagattggtcccccctagaaaccttatgggaagctccatcggataccacaccagcgtgtctagcccaaccccactggtccctgatacatacgagcccgatgggtacaatcccgaagctccgtctattacttcgtcaggccgaagccagtaccgccagttttttagtcggacccagacccaaaggcctaaccttatcggccttactagcggtgatatggatgtcaatccacgggctgcaaatatcgtcattcaaacggaaccccctgtgcctgtatccatcaactcaaacataacccgcgtggtcctagagcctgactctagaaagcgagcaatgagtggcttagaagggcctttaaccaagaaaccttggctcggcaagcagggaaacaacaaccagaacaaacctggttttttacgcaagaatcagtacactaacaccaaactggaagtgaagaagattccccaggagctcaacaatatcacaaaacttaatgagcacttctccaagtttggtaccattgtaaatatccaggtggcctttaagggggaccctgaggctgcgcttatccaatatctcaccaacgaagaggcgaggaaagcaatctcatcaaccgaggccgtgctgaataaccgcttcatcagggtcctgtggcaccgcgagaataatgaacagcctacactccaatcgtccgcccagttactgctgcagcagcagcagacacttagccatctgagccagcagcatcatcatcttccccagcatctccaccagcaacaggtcctggtggctcagagcgctcccagcacagtccacggtggcatccagaagatgatgtccaaaccacagacttccggggcttatgtccttaacaaggtcccagtgaagcaccgtctgggtcacgctggtggcaatcagagcgacgccagccatttacttaatcagtccggaggagcaggggaggactgccagatcttcagcacgcctggccatcccaagatgatttattcaagctcaaacctgaagacacccagcaagctctgctctgggtctaaatcacacgatgtgcaagaagtgctcaagaagaagcaagaagcgatgaagctccagcaggacatgaggaagaagcgccaggaggtgctcgagaaacagatcgaatgccagaaaatgctgattagcaagcttgagaaaaacaaaaacatgaaacctgaggagcgtgctaatattatgaaaactttgaaggagctgggggaaaagatctcacagctgaaagatgagctcaaaaccagttccgccgtgtcaaccccatcaaaggttaagacaaagaccgaagcccagaaggaactgctggacaccgaactcgacttgcataagcggctctcctctggggaggatacgacggaattgagaaaaaagctcagccaactgcaagtcgaggccgctcggctcggcattctgcctgtgggccgtggcaagaccatgtcttcccaagggagaggcaggggccgtggccgaggaggacgaggcagaggctctctgaaccacatggttgtcgaccaccgtcccaaagctctcactgttggcggttttattgaagaagagaaggaagacctcctgcagcactttagcactgctaatcagggccctaagttcaaggacagacggctccagatctcttggcacaagcccaaggtcccaagtatctccacggaaactgaagaggaggaggtgaaagaagaggaaactgaaacatccgatcttttccttcccgacgacgatgatgaagatgaggacgagtatgagtcccgctcgtggcggagatag

SEQ ID NO: 27551 - DNA, 1818 bp, Artificial Sequence
  Description of Artificial Sequence: Synthetic coding sequence
atggaggcagatatcatcacaaaccttcgctgcagactcaaagaggccgaagaggaacggctcaaagccgctcagtacgggcttcagctggtcgagtctcaaaatgagctgcagaaccagctggacaaatgtcgcaacgagatgatgaccatgacagagtcctatgagcaggagaaatacacccttcaacgggaggttgagctaaaatcaagaatgctggagagccttagttgtgagtgtgaggctattaagcagcaacaaaaaatgcacctggagaagttggaggagcaactctctagatcacacgggcaggaggtgaatgaactgaaaacaaagattgaaaaattgaaggtggaactggatgaagccagattatccgagaagcagttaaaacaccaagtggatcatcaaaaagaattgctaagttgtaaatccgaagagttgcgagttatgagcgaacgggtccaggagtcaatgagctctgagatgttggcgcttcagatcgagcttacagagatggagtctatgaagactactctgaaggaggaggttaatgagctccagtatcgtcaggagcagctggaactcctaatcacaaaccttatgcgccaggtcgacagactcaaggaggagaaggaagagagggaaaaggaagccgtgagttactacaacgcgttggaaaaggccagagtggctaatcaggatctccaggtgcagctggaccaggccctgcagcaagccctagacccgaacagcaagggcaactctctctttgccgaggtggaggacaggagagcagcgatggagcgacagctgatttctatgaaggtgaaatatcagtccctgaagaagcagaacgtcttcaacagagaacagatgcagcgcatgaaattgcagatcgcgactctgctgcagatgaaaggatctcaaaccgagtttgagcaacaagagaggcttctggcaatgctcgaacaaaagaatggggagatcaaacacctgctcggcgaaatacggaatctcgaaaagtttaagaatctgtacgatagtatggagtctaagcccagtgtcgacagtgggaccttagaggacaacacatactacactgatctcctacaaatgaaattggacaatttaaacaaggaaatcgaaagtaccaaaggagaattgagtatccagcggatgaaggctttattcgaaagccaacgcgctctcgacatcgagaggaaactctttgcgaacgaacgatgcttgcaactcagcgagagcgagaatatgaagctgcgggcaaagcttgacgaactaaaacttaagtatgagcctgaggagaccgtggaagtgcctgtgttgaaaaagagaagggaggtgcttcccgttgatattaccaccgcgaaagacgcctgtgtgaacaattctgccctcgggggtgaagtgtataggcttcctccccagaaggaagaaacacagtcgtgtcccaatagtctcgaagataataatctgcagctggagaaatctgtctcaatttacacccccgtagtgagtttatccccacacaagaatttaccagtggatatgcaactgaagaaagaaaagaagtgtgtgaaattaataggagttcccgctgatgccgaggccctgtctgaaagaagtggtaacactcccaactctccaagactcgcagccgagtcaaagctgcaaacagaagttaaagagggcaaagaaaccagctcaaagctagaaaaagagacgtgtaagaagcttcatcccattctgtatgtgagttctaagagcacacccgaaacgcagtgccctcagcaatag

SEQ ID NO: 27552 - DNA, 888 bp, Artificial Sequence
  Description of Artificial Sequence: Synthetic coding sequence
atgatggcaaagaagccccctaagcctgcaccacgccgaatcttccaggagcggctcaaaattactgccttacccctctattttgaggggtttcttctgatcaaacgctctggatacagagaatatgagcattactggactgagctccgcggaactacacttttcttctacaccgacaagaagagtatcatttacgtggacaagcttgacattgtggacctcacttgccttaccgagcagaacagcaccgagaagaactgtgccaagttcacactcgtgcttccgaaggaagaggtccaactgaaaactgaaaacacagagagtggtgaagagtggaggggctttattctcacagtgaccgagctctctgtgccccagaatgtctccctcttacctggacaggtgattaagctccatgaggtgctcgagagagagaagaaacgcaggatcgagacggaacagagcacatccgtagagaaagaaaaagaacctaccgaggactacgtagacgtgctgaatccaatgcccgcttgcttctacaccgtgtcccggaaagaagcaactgaaatgctccagaaaaacccaagcttgggcaacatgatcctgaggccgggtagtgactctcggaattactcaatcaccattaggcaggagatcgacataccacggattaaacattacaaggtaatgtccgttggtcaaaactacaccatagagctggagaagcccgtgacactcccgaatctgttctctgtgatcgactacttcgtgaaggaaaccagaggcaatcttcggccattcatctgtagcaccgacgaaaacaccggccaggaaccgtccatggagggacggtctgagaaactgaaaaagaatccacacatcgcctag

SEQ ID NO: 27553 - DNA, 4821 bp, Artificial Sequence
  Description of Artificial Sequence: Synthetic coding sequence
atgttccacatctgcccagccgaaaacctgtatcaaaatagatttctcgggcttgccgcaatggcctccccttcacgaaactcccagagcagacgccgttgtaaagagcctctgcgctactcttacaatccagatcagtttcataatatggatcttcggggagggcctcacgacggcgtcacaattcctcgcagcacctcagacacagacctcgtcacatccgactcacgatctaccctcatggtgtccagctcttactacagcatcggccatagtcaggacctggttattcattgggacatcaaagaagaggtggatgccggtgattggatcggtatgtacctcattgacgaggtgctgtccgagaatttcctcgactataagaataggggcgttaacggctctcataggggccaaattatttggaagatcgacgcatcttcttatttcgtggagcccgaaacaaaaatttgttttaaatattaccatggggttagcggggctttgagggccacaactcctagtgtgacggttaaaaactccgcggcaccaattttcaagtccatcggcgcagacgagaccgtgcagggtcaaggctcacgcagactgatcagcttcagtcttagcgattttcaagctatgggtcttaaaaaggggatgttttttaaccctgatccttaccttaagatcagcatccagccagggaaacactccatcttccccgcactgcctcaccacggtcaggagaggcgaagcaaaataatcggtaatactgtgaaccccatatggcaggcagaacagttttcgtttgttagtctgcctaccgatgtcttggagatcgaggtgaaggataagtttgctaagagcaggcccattattaaacgctttttgggaaaactgtccatgcccgtccagcgactgctggaaaggcacgcgatcggggatcgggtcgtttcttacacactcgggagacgcctgcctacagatcacgtgtccggccagttacaattcaggtttgaaattacatcatctatccatccggcagacgatgaagagatttccctgagtacagagcccgagagcgcccagattcaggactcccctatgaataacctgatggaaagcggatctggagagccgaggagcgaggccccagagagttcggaatcgtggaagcctgagcagctgggcgagggtagcgtgccagacgggcctgggaatcagtctatagaactgtctagacccgctgaggaagcggcagtcattacagaggctggagaccagggtatggtgtctgtggggcctgaaggggctggagagctgttagcccaggtacagaaggacatacaacccgctcccagcgccgaggagctggcagaacaactagacttgggcgaggaggcttcggctctgttgttagaggacggagaggctccagcttctacaaaggaagaaccactggaagaagaggcgactacgcagagccgggctggccgagaggaggaggagaaagagcaggaagaagaaggagacgtttctacactggagcagggcgagggtaggctgcagctcagagcctccgtcaagaggaagtctcgcccatgcagcctgccagtaagtgagctggaaacagttatcgctagcgcatgcggggaccctgaaaccccccgaacccattacatacggattcacaccttgctgcactcaatgccctccgctcagggcggatccgccgctgaagaagaagatggcgctgaagaggagtcgacactgaaggactccagcgaaaaggatggactttccgaggtcgataccgtagctgctgacccatccgccttggaagaggatcgcgaagagcccgaaggcgctacccctggcacggctcacccgggtcactcaggaggacattttccaagtcttgccaatggagccgctcaagatggagacacccacccctccactggttctgaatcagacagctccccccgacaagggggagaccattcctgtgaggggtgcgatgcatcatgttgctcgcctagttgctattcttcctcctgttacagtacttcatgctactcgtcctcatgctacagcgccagctgctacagcccgtcctgttacaacggcaatagatttgctagccacactcgctttagtagcgtcgatagtgcaaagatcagtgagtccactgttttttctagccaagacgatgaggaggaggaaaatagtgccttcgaatctgtcccagacagcatgcaatcacccgagctcgacccagagtcaactaacggagccggtccttggcaagatgaactggccgctccttccggtcatgttgagagaagccctgaagggctggagagtcctgtagctgggccaagcaacaggagagagggagaatgcccaatcttgcataatagtcagcccgtgtcacagctccccagcctacgacctgagcatcaccactatcctacgattgacgagcccttaccgcctaattgggaggcgaggattgactcacacggaagggtattttacgtggatcacgtcaatagaacgacgacatggcaacggcctacagctgccgcaacaccagacggaatgaggcggtcgggatccatacaacagatggagcagcttaatagacggtatcagaatatccagcggaccatcgcaactgaaagaagcgaggaggacagcgggtctcagtcgtgtgagcaagcacccgctggaggaggcggagggggaggctctgattcagaagccgagagttcccaatcaagtctggacctcaggagagagggaagcctctctccagtcaatagccagaaaattaccctgctgctgcagtcacctgccgtaaaattcatcacgaatccagaatttttcacggtcctgcatgctaactacagtgcatatagggtgttcacctcttctacctgtctaaagcacatgattctgaaagtgcggagggacgctcgcaacttcgaacgatatcagcacaatagggaccttgttaacttcataaatatgtttgcggatacgaggctcgagttgccacgcggatgggaaattaaaacagaccagcaaggcaaaagtttttttgtggaccacaactccagagcaaccacattcattgaccccagaatccccctacagaacggtcgtctgcccaaccacctgacccacagacagcacctccagcgcctacgcagctactcagccggagaggcgtcagaggtgagccggaacaggggcgcaagtctgctggcacgccctggacacagcctcgtggcagcaattaggtcacaacaccagcacgagtctctccccctagcttataatgacaagatcgtggcttttctgagacagccgaacatctttgagatgcttcaggaacggcagccatcactggcgagaaaccacacgctccgagagaaaatacactatatcagaacggagggcaaccatggccttgagaaattatcatgtgatgccgatctggtgatcctgctatcgttgtttgaggaagaaatcatgagctatgtccccctgcaagccgcattccatcccggttactcgttcagtccacggtgcagcccatgctctagtccacaaaacagtcctggattacaacgggcaagcgcgagagccccatcgccgtatcgccgagacttcgaggccaaactgagaaacttctacagaaaactggaggcaaagggatttgggcaggggccagggaagatcaagctgataattagacgggaccacctgctcgaggggacttttaatcaggtgatggcttacagccgtaaggagctgcagcgtaataaactctatgttacgtttgtgggagaggagggcctggactatagcggcccttctagggaattcttcttcctgctgtcccaggaactgtttaacccttactacggcctgttcgaatacagcgcgaacgacacttatacggtccagatttcgcctatgtcagcctttgtggagaaccaccttgagtggtttcggttctccggcagaatcctggggctcgccctcattcatcagtacttacttgatgccttttttacgcgacccttctacaaggccctgctgagacttccctgtgacctgtccgatttggagtatttagatgaagaatttcatcagtctctgcagtggatgaaggacaataacattacagacattctcgatctgaccttcacggtcaacgaggaggttttcggacaagtgacagaaagggagttgaaaagcgggggtgccaacacacaggtcactgagaagaataaaaaggagtatatcgagagaatggtgaaatggagagtcgagcggggtgtggtccagcagactgaggcccttgttcggggattctatgaagtggtagactccaggctggtatctgtgttcgacgcacgggagctggaacttgtgatcgccggaacagctgaaatcgaccttaatgactggcgaaataacacagagtacagaggtgggtaccatgacggacatctcgtaatccgttggttctgggcagcggtcgagagatttaacaatgaacagcgtttgagattgctgcagtttgtgactggtacttctagcgtcccttatgagggcttcgccgctctgcgtgggtcaaatggcctcaggagattctgtatcgaaaaatggggcaagataacctcactgcctagagcacatacttgcttcaacaggttagatctgccaccttatcctagttatagcatgttgtatgaaaaactgctcaccgccgtcgaggaaacgtccacattcgggctcgagtag

SEQ ID NO: 27554 - DNA, 2373 bp, Artificial Sequence
  Description of Artificial Sequence: Synthetic coding sequence
atggggactcggaaaaaagtgcacgccttcgttagggtcaaaccaacagacgactttgcacacgagatgatccgttacggggatgacaaaagatcaatcgatattcatctcaaaaaggatattcgtcggggtgtcgtgaataatcaacagacagattggtcttttaagctggacggcgtgctgcacgacgccagtcaggacctagtctatgagacagtggcaaaggatgtggtgtctcaagctctggacgggtacaatggcactatcatgtgttatggccaaactggagccggaaaaacctataccatgatgggagcgacagagaactataaacaccggggaatcttaccgagggccttgcagcaggtgtttcggatgattgaagaacgcccaacacatgcaattacagtcagagtttcatacctggagatctacaatgaatcgctttttgaccttctctccacgctgccttatgtgggaccatctgttaccccaatgacaatagtcgaaaatcctcagggagtgtttattaaggggctctcagttcatttaacaagtcaggaagaggatgcatttagtctcctgtttgaaggcgaaaccaaccggatcatcgccagtcataccatgaacaaaaacagcagtcgtagccattgtatctttacaatctacctcgaggcgcattctaggacccttagcgaagaaaagtacattacgtccaagatcaaccttgtggatttggctggatcggagcgtctgggcaaatccggaagtgaagggcaggtgcttaaggaggctacgtacatcaataagagcttgtctttcctggaacaggccatcatcgcactgggagaccaaaaacgcgatcacatcccctttcgacagtgcaaactgacccatgcactcaaagactccctgggtgggaattgcaacatggtgttggtgacaaacatctacggtgaggcagctcagctggaggagacgctatcaagcctccgcttcgccagccgtatgaaattggtgacaaccgaacctgccataaatgaaaagtacgatgccgagaggatggtcaagaacctggagaaagagttggccctgctgaagcaagagctggctatccatgattcactcaccaatcggactttcgtcacgtatgatcctatggacgagattcagatcgcagaaatcaactctcaggtcagacgctatctcgaaggtactctggacgagatcgacatcatctcattgagacagataaaagaggtcttcaaccagtttagagtagttctgagccagcaggaacaggaggtcgaatccactctaagaaggaaatacacactgattgaccgcaacgactttgccgctatatcggctatacagaaggcgggtctggtggatgtcgatggccacctggtaggagagcctgaggggcagaattttgggctgggggtggctccatttagcactaaacctggcaagaaggccaaatcaaagaagaccttcaaagagcccctgagctcccttgccaggaaggagggagccagcagtcctgttaatggcaaggacctggactacgtctctacatctaaaacgcagttggtgccttcgagcaaggacggcgatgtgaaagacatgctgagccgcgatagagagacgagtagcattgagccccttccatcggacagtcccaaggaagaattacgacccatacggcctgatactcctcctagcaagcctgttgcctttgaggaattcaagaatgagcagggctcggagattaaccgtatatttaaggaaaataagtcgatcctgaacgaaaggcgtaagcgtgcttccgagaccactcagcacatcaacgccattaagcgtgaaattgatgtgaccaaggaggctctgaacttccagaagtctttacgggagaaacaaggaaaatatgagaataagggtttgatgattatagatgaagaggaatttctcttgatcctgaagctaaaagacctcaaaaaacagtataggtctgagtaccaggacctacgagacctaagggccgagatccagtactgtcagcacctcgttgaccagtgcagacatagactgctgatggagtttgacatctggtacaacgagagcttcgtaattcctgaagatatgcaaatggctctgaagcctggtggtagtattaggcctgggatggtaccagttaacagaatcgtgtctttgggcgaggatgatcaagacaaattcagtcagctgcagcagcgtgtcttacccgaaggacctgattctatatcgttctataacgcaaaggtgaaaatcgagcaaaagcataattacctaaaaacaatgatgggtctccaacaggctcataggaagtag

SEQ ID NO: 27555 - DNA, 876 bp, Artificial Sequence
  Description of Artificial Sequence: Synthetic coding sequence
atggcatcagtcactctttcagaagcggagaaagtatacattgttcacggcgtccaggaagacctccgtgtcgatgggagaggctgtgaagactaccgctgtgtggaggtggagaccgatgtggtgtctaacacatctggatccgctagggtgaagcttgggcacactgacattttagttggagtgaaggcagagatggggacaccaaagttagagaaacccaacgagggttacctagagttcttcgtggattgttcagcctcagccacccccgaatttgagggacggggaggggatgatctcggcaccgagattgcaaacacactgtaccggatcttcaataacaagagctcagtcgatctgaagaccctgtgtatctcccctcgcgagcactgttgggtcctgtacgtggatgtgctcttgctcgagtgcggcggtaacctcttcgatgctatttccattgcagtgaaagcagccctgtttaacactcgaattccgagggttcgagtgctcgaagacgaagagggatcgaaagacatcgagttgagcgacgatccctacgattgcattcgactttccgtcgagaatgtgccctgcattgtcactctttgtaagataggttaccgacacgtggtggatgcaactctgcaagaggaagcatgcagtctggcctcgttgctggtctccgtgactagcaagggcgtggtgacatgtatgaggaaagtagggaaaggcagccttgaccctgagagcattttcgaaatgatggagacagggaagcgcgtcggaaaagtgctgcatgcaagcctgcaatccgttgtacacaaagaagaaagcctgggcccaaagagacagaaggtgggttttctgggatag

SEQ ID NO: 27556 - DNA, 2382 bp, Artificial Sequence
  Description of Artificial Sequence: Synthetic coding sequence
atgttctggaagtttgacctgcactctagctcgcatatcgacactctcctcgaacgcgaggatgttacccttaaggaactcatggatgaggaggacgtactgcaggaatgtaaagcacaaaatcgcaagctcattgagtttctgttgaaggctgaatgcctagaggatttagtcagctttattatcgaggaacccccacaagatatggatgagaagatcaggtacaagtatcctaatattagctgtgagttgctgacgtcagacgtcagccaaatgaacgaccgcctgggggaggatgagtctctcctgatgaagctctatagcttcctgctgaacgattcacccttgaatccgcttctggccagttttttttccaaggttctctcgatcctaatctccaggaagcccgagcagattgtcgatttcctgaagaagaaacacgactttgtcgatctcataataaaacatattggcacgtccgcaattatggaccttttactgcgattgcttacatgtatcgagccaccacagccccgacaggacgtgctgaactggctcaatgaggagaaaatcatccagcgtctggtggagattgtccatccgtctcaggaggaagaccgccattcaaatgcttcgcagagtctttgtgagatcgttcgactcagtagagatcagatgttacagattcaaaactctactgagcccgatcccctgctcgcaaccctggagaagcaggaaatcattgagcaactactttcaaacatctttcacaaggagaagaatgaaagcgccatcgtgtctgctatccagattcttttgacgctcctggagactaggcgaccaacatttgaaggtcacattgaaatatgcccgccaggcatgagccactccgcctgctctgtgaacaagtcagtgcttgaagccatccgagggaggctgggcagtttccatgaactccttctggaacccccaaagaatatgttctttaaatacacatggaataatttcctccacacccaggtcgagatttgcattgcattgatactggcgagcccattcgagaacactgagaatgccacaatcactgaccaggattctacaggcgacaatttactgttaaagcatctgtttcagaaatgccagctgatcgagcggatactagaagcgtgggagatgaatgaaaagaaacaagccgaaggaggcaggagacatggctacatgggccacctcacacgaattgcaaactgcattgtccactcaacggacaagggcccaaattccgctctcgtacagcagttgattaaggacctgcctgacgaggttcgtgagaggtgggagacattctgcaccagcagtctgggggagaccaataagaggaatacagtcgatctggccttttccgattaccagatgcagcagatgacctcaaactttatcgatcaatttggatttaatgacgagaaatttgctgatcaggatgacatcggtaatgtctcattcgacagagtgtccgatatcaatttcacactcaataccaacgaatcggggaacatagctctgttcgaagcctgttgcaaagaacgaatacagcagttcgatgatggtggcagcgatgaggaggatatctgggaggaaaagcacatagcttttacacctgagagtcaaaggagatctagcagcggatctacagacagtgaggaatcgaccgattcggaggaagaagacggcgcaaagcaggacctctttgagccctccagcgctaataccgaagacaaaatggaggtggacctcagcgagccaccgaactggagtgctaactttgatgtgcccatggaaaccacgcacggagcaccactagactctgttggaagcgatgtgtggtccacagaggaacccatgcccactaaagaaactgggtgggcatcattttctgagtttaccagctctctgtcaaccaaagactccctgcgttctaatagcccagtcgaaatggagacttccactgagcctatggacccactgactccgtcagctgctgccctggccgttcagccagaggccgcaggcagcgtcgctatggaggcctcctccgacggcgaagaggatgccgaaagtactgacaaggtcaccgaaaccgtgatgaacggaggtatgaaggagacacttagtctgacggtcgatgctaaaacagaaactgctgtctttaaatcagaggagggcaaactcagcacttcgcaggatgctgcttgcaaggatgcagaggaatgcccggaaacggccgaggccaaatgtgccgctccacgcccaccctctagcagccccgaacagagaacagggcagcctagcgctccgggtgacacttctgtcaatggacccgtgtag

SEQ ID NO: 27557 - DNA, 3375 bp, Artificial Sequence
  Description of Artificial Sequence: Synthetic coding sequence
atggaccctttcacagaaaaacttctggagagaacccgtgcacgaagggaaaatctgcaaaggaaaatggccgagcggcctactgctgctccgcgaagcatgactcacgccaaaagggccagacaacctttaagcgaagcctccaatcaacagccactgagcggcggagaagaaaaaagctgtacaaaaccctccccctctaaaaaaagatgctctgacaacacagaagttgaggtttctaatctggagaataaacagccagtggaatccacttctgccaaatcgtgttcccccagccccgtgtctcctcaggttcaaccccaggccgcagatactatctctgatagtgtagcggtgccggctagcctccttgggatgcgcagaggattgaattctaggttggaagccaccgcagcaagctccgtcaagacacggatgcagaagctggctgaacaacgacgtcgctgggacaatgatgatatgaccgacgacattcctgaatccagcttattttcccctatgccatccgaagagaaggctgctagcccacctcggccactgctttccaatgcctccgctaccccagtgggacgtcgcggtaggctggccaatctggctgctaccatctgcagttgggaggacgacgtgaatcatagttttgctaagcaaaactccgtccaggagcagcctggaactgcatgcttgtcaaagtttagctcagcttcaggtgcgagcgccaggataaattctagctctgtgaagcaggaagctaccttctgcagtcagcgcgacggagacgcatcacttaataaagcactatcttcatccgccgatgacgcttcactggtgaacgccagcatcagcagttcagtgaaagctacatctccggttaaatcaaccacctccatcacagatgcgaaaagttgcgagggacagaatccagagcttctgcctaagacccccatttctcctcttaaaaccggagtgagcaaacccatcgttaaatcaaccctcagccagacggtaccctccaaaggcgagcttagcagggagatttgtcttcaatcacagagtaaagacaaatcaacgacacccggaggtactggaattaagcccttcctggagcgattcggcgaaagatgtcaggaacacagcaaagaaagcccagcacggagtacccctcatcgaacacctataattaccccaaacacaaaggccatccaggagcgcctctttaagcaagatacttcttcctcaaccactcacctggcacagcaacttaaacaagagcggcagaaagagctggcttgtctaagggggagatttgataaaggcaatatctggtccgccgagaaagggggaaacagcaaaagcaaacagctggagacgaaacaggagacccattgtcagagtacccctctaaagaaacatcagggagtctcgaaaactcagtcgctgcccgtgacagaaaaagttacagaaaaccagattcccgcaaagaatagcagcacagaacctaaaggcttcactgaatgcgaaatgactaagagctcccctctgaaaatcactctgtttcttgaagaagataaaagcctcaaagtcacttccgaccctaaggttgaacagaagatagaagtgatacgggaaatagaaatgagtgtcgatgacgacgatatcaactcaagcaaggtgattaacgacctatttagcgatgtgctcgaggaaggcgaactagatatggagaagtcacaggaggaaatggatcaggcactggctgagtcctcagaggaacaggaggatgcactgaacatctccagtatgtcgctgctagcacccttggcccagacagtcggagtcgtgtcccctgagtctctggtgtcaaccccccgattggagctgaaggacaccagcaggtcagatgagtctcccaaacctgggaaattccagcgcaccagggttccccgtgccgagagcggggactcactcggaagcgaggaccgtgacttgctatattccatcgatgcatacaggtcccagcggttcaaagagacagaacgcccaagcatcaaacaggttatcgtacgcaaggaagacgtgacgtctaagcttgacgagaaaaataatgcctttccctgccaggtcaatattaagcagaagatgcaagagctgaacaacgaaattaatatgcaacaaactgtcatctatcaggcctcccaagcattgaactgttgcgttgatgaagaacatggaaagggttcgctggaggaggcagaggcagaaaggttactgctgatagccactggaaagagaacactcttaatcgatgaactgaataagctcaaaaatgaaggccctcagaggaagaacaaagcctctccccagagcgagtttatgcctagcaaaggttccgtgacactgtcagagatcagactgccacttaaggctgatttcgtgtgctctacagtgcagaaaccagatgcagccaactactattatcttatcattttaaaggccggagccgagaacatggtagccacacctttggcaagcacaagcaattccctcaacggggatgccttgacattcaccacaacatttacccttcaggatgtttccaatgactttgaaatcaatatcgaagtatactcgctcgtgcagaaaaaggacccatccggccttgataaaaagaagaagacatctaaatctaaagccatcactcccaagcgtcttctgacatccataaccactaaatctaacattcactccagtgtgatggcaagtccaggtggtctttcagccgtgaggacatccaatttcgcactcgttggttcttataccctgtcactctcaagtgtaggcaatacgaagtttgtcttggataaggtgccttttttaagctctttggagggccatatttacctgaagatcaaatgccaggtcaactcatctgtggaggaaaggggcttcctgactatctttgaagatgtcagcggcttcggagcctggcataggaggtggtgtgtcctttccggcaactgtatttcttattggacatatcctgatgacgagaaaaggaagaatcccatcggtagaattaacctcgccaattgtacaagccggcagatcgagcccgcaaatcgcgaattctgtgcaaggaggaacacatttgagttgattacagtccgaccgcagagggaggacgaccgcgaaactctggtctcccagtgtagagatactctatgtgtgacaaaaaactggctgagtgccgacaccaaagaggagagggacctgtggatgcagaaactcaatcaggtcctcgtggatatccggctctggcaaccagacgcctgctacaaacccattgggaaaccctag

SEQ ID NO: 27558 - DNA, 1365 bp, Artificial Sequence
  Description of Artificial Sequence: Synthetic coding sequence
atgctgaaacaaatcctgagcgaaatgtacatcgatcctgatttactggcagagctgagtgaagaacaaaagcagattctcttcttcaaaatgcgagaggagcagatccggagatggaaggagcgcgaagcagcaatggagcgtaaggaaagtctccccgtgaaacctaggcctaagaaagaaaatggcaagtcggtgcattggaaactgggagcagacaaagaagtgtgggtgtgggtcatgggggaacatcatctcgacaagccatatgacgtattatgtaatgaaattatcgctgaaagggcacggctcaaagcagagcaggaagcagaggagcccaggaagacccatagtgaagagtttaccaattctttaaagacaaaatcccagtaccacgatctccaggctcctgacaaccaacaaacaaaggatatctggaaaaaagtcgccgaaaaagaggagttggagcaggggagccgtcctgctcctaccttagaagaagaaaagatcagatccctgtcctccagctctcgcaatattcaacagatgctggccgactctatcaaccggatgaaagcttatgcattccaccagaaaaaagaatccatgaaaaaaaaacaggacgaggaaataaaccagatagaggaagaacggacaaaacagatttgcaagtcctggaaggaggatagtgaatggcaggcaagcctgagaaaatccaaggctgccgatgagaagcgacgcagtctagccaagcaagcccgtgaagactataagcgactgtctctgggagcccaaaaaggtaggggaggtgaaagacttcagagcccacttcgggtccctcaaaagcctgagcgtcctcccctgccccctaagccccagttccttaactcaggcgcttacccacagaagcctctgcgaaaccagggggtcgtgagaaccctttcatcgagtgcccaggaggacatcatccgttggttcaaggaggaacagttgcctctgagggcgggataccagaagacgtctgataccatagctccttggtttcatggtattctcaccctaaagaaggccaatgaattgttgctgagcacgggaatgccgggatcttttttaatccgagtcagcgaacgcataaagggttacgcgctgagttacctgtctgaggacggatgtaaacacttcctcatagatgcctccgcagatgcctactcttttcttggcgtagaccagctgcagcacgcaaccctggctgacttagtggaataccataaagaagagccaatcacttcactggggaaggagcttttactatacccatgtggacaacaggaccagttaccagactatctggaactgtttgaatag

SEQ ID NO: 27559 - DNA, 1497 bp, Artificial Sequence
  Description of Artificial Sequence: Synthetic coding sequence
atggacgagacagagtggattcataggcatcccaaggcagaggacttgagagtcggattaattagttgggccggtacctatctgacgttcgaggcctgtaagaatactgtgacggccacggcgaaaagtctggggagacgccagacttgggagattttagtgagtaacgaacacgagacccaggctgtcgtccgcctcaagtccgtgcagggtttgtacttgctgtgtgagtgcgatggaacagtgtgctatgggaggcccagaacctcccatcatgggtgcttcctcctcagattccacagaaatagtaagtggactctgcaatgcctgatcagcgggagatatctcgagtcgaatggcaaagacgttttctgcacgtctcatgtactgtctgcttaccacatgtggacacccaggcccgcactgcatgtacatgtcatcctttactctcctattcaccgctgctacgcgagggcggatcctacaatgggcaggatctgggtcgatgctgcagtgccttgtctggaagaatgcggcttcctgcttcatttccgcgacggctgctatcatcttgaaacatccacccaccacttcctaagccatgtggataggctattctcacagccttcgtcccagaccgcattccacatgcaagtgcgtcctggcggattggtggccctgtgcgatggcgaaggaggtatgttgtaccctcagggtacccatctgttacttgggatgggctgtaatcccatgagaggagaggagtggttcatcctgcagcattgccctacctgggtgagtctgcgctccaagacaggcagatttatttcagttatctacgatggcgaagtccgagccgcttccgagcgattaaacagaatgtctttattccagtttgaatgtgacagtgaaagtccaactgtacagcttcgctctgcaaacggctactatctgtcgcaaaggcgtcatagggctgtgatggctgacggtcatccactggagtctgacacattttttagaatgcactggaattgcggcagaatcatcctgcagtcttgtcggggaaggtttctgggaatcgccccaaactccctcttgatggcaaacgtaatcctgcctggtcccaacgaagagtttggcattctcttcgccaatagaagcttcctggttctgagagggaggtacggttacgttggttcaagttctggccacgacttgattcaatgtaatcaggaccagcctgaccgcatccatctgctgccgtgtcggccaggaatataccacttccaagctcagggaggatccttttggtctatcacttcatttggcactttcagaccatggggcaagttcgctctgaatttttgtattgagctccagggatccaatctgctgaccgtgttagccccaaacggcttctacatgcgcgcagaccagtctggaacactcctagccgacagcgaagacataaccagagagtgtatctgggaattctag

SEQ ID NO: 27560 - DNA, 1377 bp, Artificial Sequence
  Description of Artificial Sequence: Synthetic coding sequence
atggagcgtgagccatcggcctctgaggcagccccagccgctgcagcgctcttcgcatggggggcaaactcttatggtcaattgggacttggtcacaaagaggatgtgttattaccacagcaactgaacgatttttgtaagcccagatctgtgagaagaatcaccggaggaggaggtcactctgctgtcgtgacagatggaggtgatttgttcgtgtgcggtcttaacaaggatggacagctggggctggggcacacggaggacatcccctattttacgccgtgtaaaagcctgttcggctgtcccattcagcaggtagcttgtgggtgggatttcaccattatgctgacggaaaatggtcaggtcctgtcctgtggctccaactccttcggacagttaggcgtgcctcacgggccacgaaggtgtgtggtcccccaagccattgagctgcataaggaaaaggtcgtatgcattgcagctggactgcggcacgctgttgcagcaactgctagtggaatcgtgtttcagtggggcaccggcctggcttcctgtggcaggaggctgtgcccaggccagaccctgcctcttttcttcactgcgaaggagccctcaagagttactggattggagaactctaaagccatgtgcgttctggccggatctgaccacagcgcttctctcacagacgctggagaggtatacgtttggggaagcaacaaacacggtcaacttgccaacgaagccgcttttttgccagtgccacagaaaattgaggctcattgctttcagaacgagaaggtaaccgctatttggtccggatggactcatctggtggcccagacagaaacaggaaaaatgttcacttggggccgtgccgattacggtcagctgggcaggaagctcgagacatatgagggatggaaacttgaaaaacaggactcttttttaccatgtagccggcctccaaacagtatgccctcctctcctcactgcttaacgggagccacggaggtcagctgcgggtctgaacataatctggctattattggaggcgtctgctactcctgggggtggaatgaacacgggatgtgtggagacggaactgaagctaatgtttgggccccaaagcctgtgcaggctttactaagcagtagtggcctgctagtgggatgcggcgctggtcacagcctggctctctgtcagctgccggctcatcctgccctggtgcaggacccaaaggtcacatacctcagtcccgacgccatcgaggatactgagtcccagaaggccatggacaaggagcgcaactggaaggaacgccaaagtgaaacgagcacccagtcccagagtgactggtcccggaatggtggactgtag

SEQ ID NO: 27561 - DNA, 2961 bp, Artificial Sequence
  Description of Artificial Sequence: Synthetic coding sequence
atggagcgcatgaattggctgagtcggctggcctcaagggggccaggtcacaggataccccaaggcgcaaatctgcagacgcctgtcatggccgacccagaaacctgtctcatggtgtttaagaaccattggtctcaggtggttcgtatcctggagaggcaaggtcccagagcagcccctggcggtgctgacgatctctcagcggttcgtaatcacacatatcagatgttgactctgctggccgaggatagagccgtgccgtcagctccaacagggcctggacctttgttagagttcgcgttgcatgaggaccttctcactcgcgtactgacatggcaactgcagtgggacgagctgggggatggtgtcgaagaaaggcgcgctgaacagctgaaactgttcgaaatgctggtgtccgaagcaaggcagccactcctgagacacgggccagtaagggaagcgctcctcacgctgttggacgcgtgtggcagacccgtgcccagtagtcccgctctggacgaaggtctggtcctgctgctgtcacagttgtgtgtgtgtgtagctcaggagccatccctgctggaattctttctgcagcctcccccagaacccggagctgccccaaggctccttctgttctcaagactggtgccattcgtgcaccgcgagggtaccctcgggcagcaagcccgtgatgctctcctcctgttgatggccctgtccgcaggaagcccaacagtggggcgttatatcgccgatcatagctatttctgcccagtgttagccactggattgtccgccctgtacagcagcctgcctcggaagatcgaggtgcccggtgatgactggcattgtctgcgcagagaagactggctgggggtgccggcactcgctctgtttatgtcaagcctggagttttgcaacgctgtgattcaggttgcgcatccgctggttcagaaacagctggtggattacattcataacggcttcctggtgccggtgatgggaccagcattgcacaagacatccgtcgaggagatgatcgcttctaccgcatacttggaactttttctcaggtctattagcgagcccgcattattacgcacgttcctccggttcttgctgctgcaccgccatgacacacacacaattttggatacactggtggcacgcattgggtccaacagtaggctgtgcatggtttctctgtctttgttccgaacgctgctgaacttatcatgcgaagatgtattgctgcagctagtcctgcggtacctggttccgtgtaatcacgtgatgctgtctcagaagcccgctgtgagggacgtagatctgtacggccgagcagccgataaattcctgtctttaatcccccgatgttgtagacatcatgcgccaagtccccctaggcccgaacacgcgagctgggcacggggtggtccctctagagagacaggaagacgagaggacattactggcccaggctccccttcagttgacagttcttcagtgactacggtccccaggccttcgaccccctctcggctggcccttttcctccgacagcagagcttaggcggaagcgaatcccccggtcccgctccttgctccccgggacttagcgcaagccccgcttccagcccgggacggaggcccaccccagccgaagaacccggtgaactggaggataattacctggagtacctgcgagaggcaaggaggggcgttgacagatgcgtccgcgcatgccggacctggagcgcaccatacgatggggagagaccaagccccgagcccagccccttcggatctcgaaccaaaaagaggtcgctgctgccggaagaggacaggaataatgttggcgaaggagaagaggaggaattggggaggcgtggtcgcgctggcggagccggtgagggacccggtcacttgccaccaccccagctgaatggggtacctggcagttggcctgagggcgcaaagaaggtacggctggtaccgaaggagggagctggggaactgttagaagggatttcagaggggatggcgggattagagggtttcgggcaggagctccgcgaactcgaggttgctctgagcaatggcggaactggctcggaatctcccctggagcctccactcccattagaggaggaagaagcatacgagtccttcacgtgccctccagagccaccaggacccttccttagttctcccttgcgtacactgaaccagctgccatcccagccctttactggcccttttatggccgtgctcttcgcaaaactcgaaaatatgttgcagaattctgtgtacgtcaattttcttctaaccggcctggtggctcaattggcttgccacccccagcccctgcttcgatctttcctgttgaacacaaatatggtgttccagcccagcgtgaagtctctcttgcaagtcttaggaagcgttaaaaacaaaattgaaaactttgcagcctcacaagaagatttccccgctcttctatcgaaagccaaaaagtatctcatcgcacgaggtaaattggactgggctgagggccctgctgctggtcccgctcccaggcgcagtgacccactggtgaaaagcaggcggccaagcttaggcgagctcttgttgaggcacgctcactcgccaactagggcaagacaggctgctcagctggtgctacagcctggaagggacggagccggactcggacttagcgggggaagcccaggcgcttccacgcctgttctgctgacccgcggtggcgcacctgaacggcaaggtgaggcgctgagagtcaaaaacgctgtgtattgcgctgtgatattccccgaatttctgaaggagttggctgcgatatcccaagcccacgccgtgacatctccctttctcctcgaaacctctgaagaggggagtggtccacttatctcaggctgtggacctcttaacccatag

SEQ ID NO: 27562 - DNA, 6723 bp, Artificial Sequence
  Description of Artificial Sequence: Synthetic coding sequence
atggatgataagggcgatccgagcaatgaagaagcaccaaaggcgatcaagcctacttccaaggagttcaggaagacatggggcttccggagaacaactatagctaagagggagggagccggagacgccgaggcagaccccctcgagcctccccctcctcagcagcagctgggcctgtccctgcgcaggtccgggagacagcccaagaggactgagagagtggaacagttcctgactattgccagacgcagggggaggcgctccatgcccgtcagcctggaagattctggtgaacccacctcgtgtcctgccacagatgcagagacagcatccgagggtagcgtcgaatctgcatctgaaacgaggagtggacctcagtctgcatctaccgcagtaaaagagaggcccgcttcctccgagaaggtgaagggcggagatgaccacgacgacacttccgattcggacagtgatggcctgacactcaaggagttacagaacaggctacgtagaaaaagagaacaggagcccactgaacgccctctaaaagggatccagtcccggctccgcaagaaacgccgagaggagggccctgcagaaactgtgggtagcgaggcaagcgatacagtcgagggggtgcttccaagtaagcaggagcctgaaaacgaccaaggtgtggtgagtcaggcaggtaaagatgatagagagagcaaacttgaagggaaggctgcacaggatattaaggatgaagaacccggtgacctgggaagaccaaagccggagtgcgaaggatatgatcctaacgccctgtactgcatctgccgccagcctcacaataaccgttttatgatatgttgcgaccggtgcgaagaatggttccatggggattgcgtaggcatcagcgaagccagagggcgtctcctcgagcgtaatggtgaggattatatctgtccaaattgcaccatccttcaggtgcaagacgaaactcactccgagacagccgaccagcaggaggctaagtggcggcctggtgatgctgacgggactgactgtacctccataggaacgattgaacagaaatcgtcggaagatcaaggaatcaaaggccgaatagagaaggcagctaatccatccggcaagaagaaacttaaaatctttcagcccgtgattgaagcgcctggtgccagtaaatgcatcggtccaggctgctgtcacgttgctcagccagactccgtgtattgttccaacgactgcattttgaagcacgccgctgccacgatgaagttcctctctagtggcaaggagcagaaaccaaaaccaaaagaaaaaatgaaaatgaaacccgaaaagccctccctgcccaaatgtggcgctcaagctggtatcaagatctcttcagtgcataaacgccctgcgccagaaaagaaggaaactaccgtcaaaaaagccgtcgttgtgcccgcaaggagcgaggctctgggaaaggaggctgcctgtgagtctagcacgccatcatgggcatctgaccataattataacgccgttaaaccagagaaaaccgcggcaccaagtccatctctcctgtacaaaagtacaaaagaagaccggaggtccgaggagaaggccgctgcgatggccgcttccaaaaagaccgcaccacctgggtcagccgttggcaagcagccggcaccacggaacctagtgccaaaaaagtcctcatttgctaacgtcgcagctgctacccccgctatcaaaaaacctccttctggctttaagggcacaatacccaagaggccatggctgtctgccaccccatcctctggagcctctgccgctaggcaggccggaccagcgcctgcagcggctaccgctgcttccaaaaagtttcccggtagcgccgcactggttggggcagtgaggaagccggttgttccttccgtacccatggcaagccccgctcctggtcgcctgggtgccatgtccgcggcaccgagccaacccaactcgcagataaggcagaacatccggagaagtctgaaggagatcctctggaaaagagtcaacgactcagatgacttaatcatgaccgaaaacgaggtagggaagatcgctctgcatatcgaaaaggagatgtttaacttatttcaggtgacagataataggtataaaagcaagtacagaagcatcatgtttaacttgaaggatccaaagaatcagggcctgtttcatagggtactgcgagaggagatctccctcgccaaactggtaaggctcaagccagaggagctggtaagcaaagagctgagcacgtggaaggagagacctgctcgctccgtgatggagagccgcactaaactacacaacgaaagcaaaaaaaccgccccacggcaggaggccattccggacctggaggattcacccccagtttctgattctgaagagcagcaggaatccgcgagagctgtgcccgaaaaatccacggcacctctgctagacgtgttcagttcaatgctcaaggatacaacgagtcagcatcgcgcacatcttttcgatctcaactgcaagatctgtaccgggcaggtgccgtcagctgaagatgaacccgcacccaagaaacaaaaactgtccgcatctgtcaaaaaggaagacttgaagagtaagcacgattcgtccgctcctgaccccgctcctgattctgccgatgaggtgatgcccgaagcggtgccagaagtagcctccgaacctggcctggagtctgcctcacatccaaacgtcgacagaacgtactttccgggaccaccaggcgatggtcatccggagccatccccgctggaagatctgtctccctgtcctgcgagctgcggatccggggtggtcacaaccgtaactgtgtccgggcgtgatccgaggaccgcccctagctcatcctgcacagccgttgctagcgccgcaagccgccctgactccacccacatggtcgaagctcgccaggacgtgccaaaacctgttctgacgtcggtaatggtgccaaagtcaattttggcaaagccgagcagttcccctgacccgcgttatctctctgtccctccatcccccaatatctcaacatctgagagcagatctcctcctgagggcgacaccactcttttcctgtctagactgtctacgatctggaaagggtttataaacatgcagtccgtcgcgaagttcgtgactaaggcttaccccgtttccggctgttttgactacctttccgaggacctcccagatacaatccacattggcggtaggattgctccaaaaacggtgtgggactatgttggaaagctgaagagctcagtgtcaaaggaactctgcttgatccggtttcacccagctacagaagaggaggaggtggcctacatctccctttattcctacttctccagcagaggacgttttggagttgtcgcaaataataatagacacgtgaaagacctctatctgatccccttgagcgcacaagaccccgtgccttcaaaactcttgccttttgaggggccagggctggaaagtcctcgacccaacatcatcctgggtttggtaatttgtcagaaaattaaacggcctgcgaacagcggcgagttggacaagatggatgagaagaggacgcgcctgcagccggaggaggccgacgttcctgcctaccccaaggtcgctaccgtgccacagtcagagaagaagccttccaaatatccgctatgctctgcggatgctgccgtgtctacaacacccccaggtagccccccacctccaccacctttgccagagccccctgtgctcaaagttctgagcagcctcaagcctgctgccccatcacccgctacggcggctacaactgcagcagctgcctcaaccgccgcttcatccacagcgtcaagcgccagtaaaaccgcctctcctctggagcacatcctccaaacactgtttggcaagaaaaagagttttgatccaagtgctcgcgaaccccctggcagcacagccggactccctcaggagcctaaaaccacagccgaggacggggtgcctgcaccacctctattggacccaatcgtgcagcagttcgggcaattcagcaaagacaaagctctggaagaggaagaggatgaccgaccttatgatccggaggaagagtatgacccagagagagcatttgacacacagctggtagagcggggaaggagacacgaggttgagcgcgcacccgaagccgcagccgcagagcgagaggaggtggcgtacgacccggaggatgagactattctggaggaagctaaagtgaccgtagacgacctgcccaatcggatgtgtgctgatgtgagacgaaacagcgtagagcgaccagcagaaccagtggccggtgcagctacacctagtctggtcgagcagcagaagatgctcgaggaactcaataagcagatagaggagcagaagcgtcagctggaagagcaggaggaagctctgagacaacaaagggcggctgtgggtgtctcgatggctcatttcagcgtgagcgatgccctgatgtcacccccaccaaagtcttcactgccaaaggcagagctctttcagcaggagcagcagagtgctgataagccagcatccctcccgccagcttcacaagccagcaaccacagagatcctagacaggcaaggcggctggctaccgagacaggtgaaggggaaggtgagcctcttagccggttgtccgccagaggcgcacagggcgcactgcccgagcgagacgcatccagaggcggactggttggccaagctccaatgcccgtccctgaagaaaaagaaccagcaagctccccgtgggcctctggcgagaagccaccagcaggaagcgagcaggacgggtggaaggccgaaccaggagaaggaacaaggcctgcaactgtgggcgattcctccgcccgacccgctcgacgggtactattgcccacacctccttgtggagcactccagcccggatttcccttacagcatgacggtgaaagggaccccttcacatgtcccggttttgccagtcaggacaaggcccttgggagtgcacagtatgaagacccgaggaacctgcattcagccggtagatcgagctcgcctgccggagagaccgagggggatcgagagcctcaggccaggcctggagaagggactgccccactgccaccccctggccaaaaagtagggggttcccagccgcctttccagggccagagggaacctggaccccatgccctaggaatgagtgggctgcacggccctaacttcccaggccctcggggacctgctccgccatttcccgaagaaaatattgcctccaatgatggtccccgtggtcctccaccagcgagattcggggctcagaaaggcccaatcccaagtctgttcagcggccagcatggaccaccaccctatggtgatagcagagggccaagcccttcctatctaggcggacctaggggggtggctccgtctcaatttgaagagagaaaagaccctcacggagaaaagagggaatttcaggatgctccctacaatgaagtgacaggggcacctgctcagttcgaaggaacagaacaagcccctttcctagggagccggggtggagctccttttcagttcggaggacaaagacgtccactgctcagccagttaaagggccctcgtggaggcccaccaccctcccagtttgggggacagaggggaccccctcctgggcactttgtaggacccaggggaccacatcccagccagttcgagactgctcgtggacctcacccaaaccagtttgagggacccagaggccaggcccctaatttcatgcccggaccacgaggaattcaacctcagcagttcgaggaccaaagagtacacagtccccctaggttcacgaaccaacgggctcctgctcccctccagttcggaggcctgaggggaagtgcaccgttctctgaaaaaaatgagcagacaccctcccggttccatttccagggacaggccccacaagtcatgaaacccggaccacgccctctcttggaactgccgtcccacccaccccagcaccgcaaagaccggtgggaagaggccggtccaccatcagctctctcttcatcggctccaggccaggggccagaggcagacggccagtgggccagcgccgattttcgagagggaaagggccatgaatatcgaaatcagactttcgaaggtcgtcagcgcgaacggtttgatgtggggcctaaggagaagcccttggaggaaccggatgcccagggcagagcctcagaagaccgaaggagagagcgcgaaaggggacgaaattggtccagagaaagagactgggatcgcccacgtgagtgggatcgccaccgagataaagactcatcccgagactgggatcgtaaccgcgaacgcagcgcgaatcgcgatagagagagggaagcagaccggggtaaagagtgggacagatctagggaacgttctcgaaaccgggaacgagaacgtgatagaaggcgcgaccgagaccgaagccgctccagagagagggatcgcgacaaggcaagggatcgagagagaggaagagataggaaggacaggtccaaatcaaaagaaagcgctagagatccaaagcctgaggctagcagggcctctgacgcaggtacggctagccaggcctac

SEQ ID NO: 27563 - DNA, 1635 bp, Artificial Sequence
  Description of Artificial Sequence: Synthetic coding sequence
atggatgacaaaggtgaccccagcaacgaggaggcgccaaaagccatcaagcctaccagcaaggagttcagaaaaacctgggggtttagacggacaacaatcgcaaaaagagaaggcgctggtgacgccgaagccgatcctctcgagccccctcctccccagcaacaattgggtttaagccttcggagaagcggcagacaaccgaagagaacggaaagagtagagcagtttctaacaatagcccgaagacgcggacggagaagcatgcctgtatccttggaggacagtggggaacctacaagctgtccagccaccgacgcagaaacagccagtgagggatcagttgaatccgcctcggagacacgttccggtccacagtccgcgtccacggcagtgaaagaacggcctgcctcctccgaaaaggtcaagggcggagacgaccacgacgacacatcggattcagacagtgatggccttactttaaaggagttgcagaaccgactcaggaggaaaagagaacaggagcccactgagagacctctgaaaggcattcagtctaggctaaggaagaaaagaagggaagagggtcctgcggaaaccgtgggctcggaggcttctgacaccgtggaaggcgttctgccctccaagcaagaacctgagaacgatcagggagtggttagtcaggctggaaaggatgacagagaaagcaaacttgaggggaaagctgcgcaggatatcaaggatgaagaaccgggagacctggggaggcctaagccagaatgtgaggggtatgaccctaatgccttatactgcatttgccggcagccacacaacaatcggttcatgatttgttgcgatcgctgtgaggagtggtttcatggtgattgcgtcggcatcagtgaagcgaggggcaggttgctggaacggaacggcgaggattacatctgtccaaactgtaccatactgcaagtgcaggatgagacacacagcgagaccgccgaccaacaggaggccaaatggagaccaggcgacgcagacggcaccgattgcacttcgatcgggactatcgagcaaaagtcttcagaagaccaggggatcaagggccgaatagaaaaggccgcaaatccctccggcaaaaagaagctgaaaatatttcagcctgtgattgaggctcctggagcatccaaatgtattggcccaggctgctgtcacgtggcccaacctgactccgtatactgcagtaatgactgcatcttgaagcatgccgctgctaccatgaaattcctctcctccggtaaagagcagaagcccaagcctaaggaaaagatgaagatgaaaccagagaagcctagcctgccaaaatgtggagctcaagcagggatcaagatttcatcagtccataagaggccagcgcctgagaagaaagagacaacagtaaagaaagcggtggtagtgccagctcgaagcgaggcactaggcaaggaagccgcatgcgagagttctaccccctcttgggcctctgaccataactataatgctgtcaagcctgagaaaacagcagccccttcaccaagcctgttgtacaaatgttcaggtaaatattcttactccttgcatccttctctgatagcctag

SEQ ID NO: 27564 - DNA, 1164 bp, Artificial Sequence
  Description of Artificial Sequence: Synthetic coding sequence
atggagaggccgccacctagagcagctggaagggaccccagtgctctgagagccgaggccccttggcttcgcgcagaaggacccggacctagagcagcacctgtaactgtacccaccccgcctcagggatcttcagtcgggggaggatttgccggactggaattcgcacgtccccaggagtccgagccccgagctagcgacctcggagctcctcgcacctggacaggagccgctgctgggcctcgcactccatctgcgcacatcccagtccccgctcaacgggctacacccggtaaagctcgtctcgacgaagtgatggccgctgctgcactgacgtcacttagcacaagtccccttctgttgggtgccccagtcgctgcgttcagtcccgagcccggacttgaaccatggaaagaagcgttagtgagacctcctggaagttattctagttcttcaaactcgggggattggggctgggacttagcctccgatcaaagctcgccaagcaccccttcgccgccactgccaccggaagccgctcatttcctgtttggtgagccaacgctgcgcaagcgtaaatccccggcacaagtaatgttccagtgtctgtggaagtcctgtggaaaagttctgtccactgcatccgccatgcagcgccatataaggctcgtgcatctgggcaggcaagctgagcccgaacaatccgatggcgaggaggacttctattacaccgaattagatgtcggcgtagatacccttacagacggcctgtcatctctgactccagtttcccctaccgcatcgatgccccctgcttttccaaggctcgagttaccggagctgctcgagccccctgcattaccatcacccctgagacctcctgccccacccctgccacccccaccggtgctgagtacggtggcaaacccccagagttgtcacagcgacagggtttaccaaggctgtcttaccccggcacgcctggaaccccagccaacagaagtgggggcatgcccacctgcgttgagctcccgaattggcgttacccttcggaagccacgcggagatgccaagaagtgtcgtaaagtgtacggcatggagagacgggacctctggtgcactgcatgccgatggaagaaagcctgccagaggtttctcgattag

SEQ ID NO: 27565 - DNA, 414 bp, Artificial Sequence
  Description of Artificial Sequence: Synthetic coding sequence
atgctcagattctgcgccggtttgtctgacttcgccccagtcgccgtccggtctctgcaagacctggcaagaattgctatcaggggcaccattaagaaaataattcatcaggagaccgtctcaaaaaacggcaatggattgaaaaacactccaaggtttaagcggaggcgtgtgagaaggagacgcatggaaaccatagtgtttctggataaggaagtgttcgccagtcggatcagtaatccgtccgatgacaattcttgcgaggatctcgaagaggagcgccgagaggaagaggagaagacccctcctgagaccaagcccgaccctccagtcaacttcctgcggcagaaggtactctccctgccacttccagatcccctgaagtattacttactttactaccgagagaagtag

SEQ ID NO: 27566 - DNA, 2505 bp, Artificial Sequence
  Description of Artificial Sequence: Synthetic coding sequence
atgaggctcctcgacggcaagcagacaagccgctacagtgagaacgcatgtgagaagaagatctttagcatctacggtcactaccctgtagtccgagccgcactccggaggaaggggtgggtggagaagaaatttcacttcctccctaaagtgatacccgatgtagaagacgaaggcgcaagagttaacgatgatacctgcgcgaaggttaaggagaaccaggagatggcactcgagaaaaccgacaatatacacgacgtgatgtctcgtcttgtaaagaatgagatgccctatctgttgtggactattaaacgggatatcattgattatcacagtctgacatatgatcaaatgttaaaccattacgccaagactgccagtttcacaactaaaataggtctctgcgtcaatatgaggagcctgccctggtacgtgccggctaatccggattcatttttcccaaggtgctactccctttgtacagagagcgaacagcaggagttcctggaggattttcggagaacgatggccagttcaatactgaagtgggtggtgagccatcaatcctgttccagatcatcccggtctaaaccgagggatcagcgagaggaggccggttcaagcgacctctcatccagacaggacgccgaaaacgccgaagcaaagcttcgcggactccctggccagcttgttgatatcgcatgtaaggtttgccaagcttacctgggtcagctggagcacgaggacatagacacatccgccgacgctgttgaagaccttaccgaggcggagtgggaagatctcacccagcaatactacagcctggtccaagttcccctcggaagctcaatcgtgctgtgtatctttaaaatccagaaggttatgatgtctttcgaaccaccaacagcacgtgataggcagtgtcaggccctcttaaaccgcatcacttcagtgaatccccagacagacattgatgggctacggaacatttggatcatcaaacctgccgctaagtctcgaggcaggggtgagtccccagacatagtgtgcatggatagagtggaagaaattctcgaattagcggcagctgatcaccccctcagtagggacaacaagtgggtggtgcagaagtatatagagacacccttgctgatctgcgatacgaagttcgatatccgccagtggttcctggtgacggattggaatccattgaccatctggttctataaggagtcatatctgaggttctccacccagcgcttctctctcgacaagctggactccgcaatccacctgtgtaacaacgcagtccagaaatatctgaagaacgacgttgggaggtcgccactattgcccgctcataatatgtggacctccacaaggttccaggagtatctgcagaggcaggggcgtggggcagtgtggggctccgttatctacccgtcaatgaaaaaggcaattgctcacgcaatgaaagtcgcccaagatcatgtggaacctagaaagaacagcttcgagctgtacggtgcggactttgttctgggtcgcgacttcagaccttggctgattgagatcaacagctcccccacaatgcatccttctacacccgtcactgctcagctgtgtgctcaagtccaggaggatacaatcaaagtggcagtagaccggtcgtgtgacataggaaatttcgagttgttgtggaggcaacctgtcgtcgagccacctccctttagtggttctgatctctgtgtggcaggagtttcggtgcggcgtgcacggagacaagtgctgccggtatgcaacctcaaggcttccgcttcccttctggatgctcagcctcttaaagcccgaggccctagcgcaatgcctgacccagcacagggtccacccagcccagcgctgcagcgagatctgggcctaaaagaggaaaaggggctgcctctggctctactggccccacttcgaggcgctgccgagagtgggggagccgctcaaccaactaggactaaagcagcagggaaagtagagttgcctgcatgtccttgtagacatgtagattcccaggctccaaatactggcgtcccagtcgctcaaccagctaaaagctgggatcccaatcaactaaatgcccaccccctggagcccgtcctacggggtctgaagacggctgaaggcgctcttcgccctcctccaggcggaaaaggagagggtaccgtgtgttccaggcttccccaccacgggcaccacgtggccgcatgtcagactacgggcaccacctgggacggagggccaggggtctgcttcctcagacagctcctggcatccgagctgcctatggggccaggcctgcccagagaccctcgtgcacccccttgccttgtgtgtagaggacttctgcctcccgcaggaccgtgcaaaaggtgccggtccttttgtgcagcagtgctgcagggtgcctcttttgtgcgtctgggcggacggtcttgctcaccacgcacaccatag

SEQ ID NO: 27567 - DNA, 759 bp, Artificial Sequence
  Description of Artificial Sequence: Synthetic coding sequence
atgtgttcaacatcaggctgcgacctggaggagattcctctcgacgatgatgatttaaacacaatcgagttcaaaatcttagcctattatacacggcaccatgtattcaaatcaactccagccttgtttagccctaagctcctgagaactcggtcattgtctcagaggggccttggcaactgtagtgccaacgagtcgtggactgaagttagctggccgtgtcgcaactcgcagtcttccgaaaaggccataaatttagggaaaaaaaaatcatcttggaaggcattctttggagtggtcgaaaaggaagactctcagtctacccccgcaaaagtcagtgcgcagggccagagaactctggagtaccaggatagccactcacagcagtggagtcggtgtctgagtaatgtcgaacaatgtctcgaacatgaggccgtggaccctaaggttatctcaatcgctaatcgggtcgctgagattgtctatagctggcctccgccacaggcaacccaggccggaggcttcaagtctaaggaaattttcgtgaccgagggcctgagctttcagttacaggggcacgtcccagtggctagcagctccaagaaagacgaagaggaacagattcttgcaaagatcgtggaactccttaaatacagtggcgatcagttggagagaaaggatacagcgtttatcccgattccactcgtggatacatctatacagggatttccacaggacggcctcatggcctgcatttag

SEQ ID NO: 27568 - DNA, 261 bp, Artificial Sequence
  Description of Artificial Sequence: Synthetic coding sequence
atgagtctaccacttaacccgaagcccttcttaaatgggctcaccggcaaaccggtgatggtgaagctcaaatggggtatggaatataaaggctatctggttagcgtcgacgggtacatgaacatgcaactggcaaacaccgaggagtacattgacggcgctttaagcggtcacctgggggaggtgctcattagatgtaataacgtgctgtacatcagaggggtggaggaagaagaggaagacggggagatgagggagtag

SEQ ID NO: 27569 - DNA, 1281 bp, Artificial Sequence
  Description of Artificial Sequence: Synthetic coding sequence
atggcctccgggcattccttgctgctcgagaacgcccaacaagtggttctcgtgtgcgcacgcggagagcgtttcctcgctagggatgctttaagaagtttggccgtgcttgaaggagccagtctcgtcgtgggtaaagatggtttcattaaggcaatagggccagcagatgtgatccagcgacagttctctggcgagacatttgaggaaatcattgattgtagtggaaaatgcatcctcccagggctggtggatgcccacacccaccccgtgtgggcaggtgaaagggtccacgaattcgccatgaagctggcgggagccacgtatatggagattcaccaggctgggggaggcatccatttcactgtggagcgcaccaggcaggcgactgaggaagagctcttcagaagcctgcagcagcgcctccagtgtatgatgagggctggcaccaccttagttgagtgcaagtctgggtacgggttggatctggaaacggagcttaaaatgcttagagtcatcgaacgcgctagaagagagctggacattggaatttccgctacatactgtggcgcacactccgtcccaaagggtaaaacagcaaccgaggccgcagatgatatcatcaacaaccacctgccgaagctcaaggaactggggcgaaatggtgagatacacgtagataacatcgatgtcttttgtgagaagggcgtatttgacctggatagcacccggcgtatactgcagcggggtaaagatataggcctgcagatcaactttcacggagatgagctccatcctatgaaggcggctgagctgggtgctgagctgggggctcaggctatctcacacctggaggaggtttctgatgagggtatcgttgccatggcgaccgccagatgttctgccattctgctcccgacgacagcctacatgctgaggctgaaacagccaagagccagaaaaatgcttgacgaaggagtaattgttgcccttggctctgatttcaaccctaacgcctattgcttttctatgccgatggttatgcacttagcatgtgtcaatatgaggatgtccatgccagaggcattagcagcagccaccataaatgcagcctacgcacttggcaaatctcatacccacgggagtcttgaagtaggcaagcagggtgacctaatcattataaacagctcccggtgggaacacctcatctatcagttcggtggccaccacgagctgattgaatatgtgatcgccaaagggaagctgatttataaaacgtag

SEQ ID NO: 27570 - DNA, 1263 bp, Artificial Sequence
  Description of Artificial Sequence: Synthetic coding sequence
atgttctcacccggtcaagaagaacactgtgccccaaataaagaaccggtgaaatatggagaactggttgttctaggctacaacggtgcccttcctaacggcgaccgagggcgtcgcaagtccagatttgccctctataagagacctaaggctaacggagtgaagccgagcactgtgcacgtcatctccacgccccaagcttcaaaagccatatcgtgtaagggtcaacattccatttcatatactctgagcaggaaccagaccgttgtggtcgagtatacacatgataaagatactgacatgtttcaagttgggaggtctaccgagagtcctatcgattttgtggtgaccgacaccattagtgggagccagaatacagacgaagcccagatcacccaaagtacgatcagtaggttcgcttgccggatcgtgtgcgaccggaatgagccctatacagccagaatttttgcagccggatttgactctagcaagaatattttcctgggcgaaaaggctgccaagtggaagaacccagacgggcacatggacggactgactacaaatggtgtgctggtcatgcacccgcgaggaggtttcaccgaggagtctcagcccggtgtttggcgggagatctccgtgtgtggtgacgtgtacacactgagagagactcgctccgctcagcagcggggaaagctggtggagtctgagaccaacgtcctacaggatggcagtttgattgatctgtgcggggcaaccctgttgtggagaactgcagacgggttgtttcataccccgactcagaaacatattgaggccttacggcaggagatcaacgcagctaggccacagtgcccggttggcttaaatacactcgccttccctagtattaaccggaaagaggtggtggaggagaagcagccatgggcatacctttcttgtggccatgttcacggctaccacaattgggggcaccgcagtgataccgaagctaatgagcgagagtgtcccatgtgccgaacagtgggcccatacgtgcctctatggctggggtgtgaggccggattttatgtggatgcagggccaccgacccatgcctttacaccttgtggtcatgtgtgtagtgaaaaaagtgccaagtattggtctcaaataccccttccgcacggcacccatgcttttcacgcagcgtgcccattttgtgcaacccaactggtgggcgagcagaattgtatcaagctgatttttcagggcccaattgactag

SEQ ID NO: 27571 - DNA, 1056 bp, Artificial Sequence
  Description of Artificial Sequence: Synthetic coding sequence
atgatcgtccagagagtggtgctgaattcgcgccctgggaaaaacggaaacccagtggccgagaacttccgcatggaggaagtgtacctccccgacaatattaatgagggtcaggtgcaagtccggacactttatttaagtgtcgacccatatatgagatgtaggatgaatgaagatacaggtaccgactatatcaccccttggcagctgtctcaggtagtggacggcggaggtatcggcatcatagaggagagtaaacacaccaacttaacaaaaggagattttgttacctccttctactggccctggcagacaaaagtaattctggacggcaactcgctcgagaaagttgaccctcagcttgtcgacggacacttgagttactttttgggggctattggcatgcccggactgactagccttattggcatccaggaaaaggggcacattacggccggatctaataagacaatggtggtttctggagccgctggcgcttgtggttcggtggcaggccagatcggacattttctgggctgtagtagagtagtgggcatatgtggcacgcacgaaaagtgcattctactgacctccgagctcggcttcgacgccgctatcaattacaagaaggacaatgtggctgagcagctgcgggagtcttgcccggctggagtggacgtgtacttcgacaacgtggggggtaacattagtgacacggtgatttcacaaatgaacgagaattctcacataatcctgtgcggccagatatcccagtacaataaagatgtcccctatcccccaccactgagtccagcaattgaggcaatccagaaggagaggaacattacacgcgaacgctttttagtgctcaattacaaggacaaatttgaaccagggatccttcagttgagccagtggttcaaggaggggaagttgaagattaaggagaccgtgataaatggcctcgagaacatgggtgcagcctttcagtcaatgatgaccggcggaaatatcggaaagcagattgtgtgcatatctgaggaaatcagcctgtag

SEQ ID NO: 27572 - DNA, 2172 bp, Artificial Sequence
  Description of Artificial Sequence: Synthetic coding sequence
atggccgaggaagaagagactgccgcactgacagagaaggtgatcagaactcagcgagtctttatcaatttgcttgacagctatagttcaggcaatatcggcaagttcctgtcaaattgtgttgttggggctagcctggaggaaattaccgaggaggaagaggaagaagatgagaacaaaagcgcaatgcttgaggctagtagcactaaagtgaaagagggaacatttcaaatcgtggggaccctctctaaaccggacagtcccagacccgattttgccgtcgaaacatattccgcaatctctagggaggacttgctcatgaggctgttagagtgcgatgtgatcatttacaatataaccgaaagtagtcaacaaatggaggaggccatttgggcagtttccgctctatcggaagaggtgagccattttgagaaacggaagctgttcatcctgctcagtacagtgatgacctgggcccgatccaaggctcttgatcctgaggactctgaggtcccctttaccgaggaggattacaggcggaggaaaagccatcccaactttctggatcatataaatgccgagaaaatggtactgaaatttggtaaaaaggctcgcaagtttgctgcctatgtggtagccgctgggttgcagtatggtgccgaggggggaatgttacacactttcttcaagatggcatggctgggcgagattccggctctgcctgtgtttggtgatggcaccaatgttatccctacgatccacgtgctggatctcgctggggtaatccagaacgttattgatcacgtgccaaagcctcactatttggtggcagtcgacgaatccgtacacaccctggaggatatcgtcaagtgtatctccaagaacaccgggccaggtaagatccagaaaatcccacgagagaatgcttacctgacgaaggacctaacccaagactgcctggatcacttgcttgtgaatctgagaatggaagcactgtttgtgaaggaaaactttaacattaggtgggcggcacagactggttttgtagagaatattaatacaatcctgaaggaatataagcaaagtcgcggtttgatgcctattaaaatctgcatcctgggacctcccgcagtcggcaagagcagtatcgccaaggaactggcaaactactacaagttacaccatattcaactgaaggatgtgattagcgaggccattgccaagctggaggccatcgttgcgcctaacgatgtcggagagggggaggaagaagtggaagaagaggaggaagaagaaaatgtggaagatgcccaggagttgctggatgggattaaagaaagcatggagcaaaacgccggacagcttgacgaccagtatatcatcagattcatgaaagagaagctgaagtccatgccttgtcgcaatcaggggtacatattggatggattcccaaagacatatgatcaggcgaaggacctctttaatcaggaagatgaggaagaggaggacgacgtgcgcggtcggatgtttcccttcgataaattgatcatcccagaatttgtgtgcgcacttgatgcatctgatgagttcctcaaagaacgggttataaacctgcccgagtctatcgttgctggcactcattacagtcaagaccggttcctcagggctctgtcaaattacagagatattaacatcgacgatgagacggtgtttaactactttgacgagctggaaattcaccccatccatatcgacgtgggaaaactggaggatgcgcaaaaccggctggccatcaaacagttgattaaagaaatcggcgagccaaggaattatggactcacagatgaggagaaagcagaggaggaaagaaaggccgctgaggagcgactggcacgggaggctgccgaagaggcagagagagaacatcaggaggccgtcgagatggcggaaaaaattgcacggtgggaggaatggaacaagcgcttggaagaggtcaagagagaggagcgcgaattactcgaagctcagagtattccgcttcggaactatcttatgacatacgtcatgccaaccctaattcaaggactgaacgaatgttgtaatgtgcgccctgaagaccccgttgacttcttagcagagtaccttttcaagaacaaccccgaagcgcagtag

SEQ ID NO: 27573 - DNA, 1245 bp, Artificial Sequence
  Description of Artificial Sequence: Synthetic coding sequence
atgcagaccttccttaagggcaagcgcgtaggctattggctcagcgagaaaaagatcaagaagttgaattttcaggcattcgcagaactgtgtagaaagcggggaatggaggtagtccagctgaacctgtcccggcctatcgaggagcaaggcccacttgatgtaattattcataagctgaccgatgtcattctggaggcggaccagaatgacagccaatcccttgagctggtccaccgattccaggaatatatagacgcccacccagaaaccatcgttttggaccctctgccggctattcgtacactgttagatagatcaaaatcttatgaactgatcagaaagattgaggcgtatatggaggacgatcgcatatgtagtcctccgttcatggagctcaccagtctctgtggcgacgacacgatgaggctcctggaaaagaatggcctgacatttccctttatctgtaagactcgggtggcccacggcacaaatagccacgagatggcaatcgtatttaatcaggaaggcctgaatgccattcagcctccatgcgtagttcaaaacttcataaatcataatgccgttttatataaggtcttcgtcgtgggagaaagctatactgtcgtccaacggccttccctaaaaaacttttcagcaggaacatctgatcgtgaaagcattttctttaacagccacaacgtgtcaaagcctgagagctcttccgtgctgactgaactggataagatcgagggcgtgtttgaaaggccttccgacgaggtgatacgagaactgtcccgcgctctacggcaagctctgggggtgagcttgtttggcattgatattattataaacaatcagacaggacagcatgccgtgattgatattaacgccttcccgggatatgaaggggtaagtgagttcttcacagacctgctcaatcacatcgcaaccgttctgcaaggccagagtacagctatggcggctaccggtgatgtagctctgctgagacactccaaacttctggcagaaccagctggcggattggtgggcgagcgcacctgctctgcttcaccaggttgctgcggatccatgatgggtcaggacgccccatggaaggccgaagccgatgccggagggaccgccaagctgcctcaccagaggctcggctgtaacgccggagtgtctccatccttccaacagcattgtgtcgcatccttggctactaaggctagttcacagtag

SEQ ID NO: 27574 - DNA, 600 bp, Artificial Sequence
  Description of Artificial Sequence: Synthetic coding sequence
atgcgctttagattctgtggcgacctggactgtcctgattgggtgctggccgagattagtactcttgccaaaatgtcatccgtcaaactgaggctcctgtgtagtcaggtgctaaaggagttactaggtcaggggatcgattatgaaaagattctgaagctgactgccgatgccaaattcgaatccggagatgttaaggcaaccgtggccgtgctgtcattcattttatcatctgctgcaaagcactccgtagatggggaatccctgtcatcagagctgcagcagcttggactgcccaaggaacacgcggcatcactctgtcggtgctatgaggagaagcaatctccactgcagaaacaccttcgagtctgcagtctcagaatgaatagactcgctggcgtcgggtggcgggtggactacaccttgtcctcgtcgttgctccaatcggtggaggagccgatggtccacctgcggctggaagtggcagcagcacctggaactcccgcacagccggtggcaatgagtctgagcgctgataagtttcaggtattgctggcagagctgaagcaggcgcaaacgctaatgtcctcactgggatag

SEQ ID NO: 27575 - DNA, 1224 bp, Artificial Sequence
  Description of Artificial Sequence: Synthetic coding sequence
atgtcgcaccggaagttttctgccccaaggcatggccatctggggtttttgccgcacaagagatcgcacagacatcggggtaaggtcaagacctggccgagagacgatcctagtcagcccgtgcacctgacagcattcttggggtacaaagcaggcatgacccacactctgagagaggtgcacagaccaggattaaagatcagcaagagagaagaggtcgaagcagttacaatcgtggaaaccccaccactcgtcgtggtgggagttgtggggtacgtggccacaccacgagggctgcgtagctttaagaccatcttcgcggaacacctctctgacgaatgcaggcggcgattctataaagattggcacaagagcaagaaaaaggcatttactaaagcgtgcaagcgctggcgcgatacagacgggaagaagcagcttcagaaagactttgccgctatgaagaaatactgtaaagtaatccgcgtgatcgtgcacacacagatgaagctgctgccatttagacaaaagaaggcccacataatggagattcaattaaatggcggtaccgttgctgaaaaggtcgcctgggctcaagcaagattggagaaacaggttccggtgcattctgtgttcagccaatctgaggtgatagatgtaattgcagtcaccaaggggcgaggagtgaaaggcgtgacttctcgatggcacactaagaagctgccgaggaagacccacaaaggcctgagaaaggtggcctgtatcggggcttggcaccctgcacgggtagggtgttctatagcgagggccggtcagaagggttatcaccaccgaaccgagctgaacaaaaagattttcaggataggccgtggcccacatatggaggatggaaagcttgtgaagaataacgcgagcaccagctacgatgtcacagccaaaagcattacgccgcttggcggatttccgcactacggggaagtgaataatgattttgtgatgctcaagggctgtatcgccggaacaaaaaagcgggtgattaccctgagaaagtcattgctcgtgcatcatagtagacaggctgtggagaatatcgagttgaaattcattgacactactagcaagttcggacacggtagattccaaacagcgcaggaaaaacgcgctttcatgggacctcaaaagaagcacctggagaaggagactcctgaaacatctggggatctgtag

SEQ ID NO: 27576 - DNA, 7322 bp, Artificial Sequence
  Description of Artificial Sequence: Synthetic coding sequence
atgagttcctccggctatcccccaaatcagggagcctttagcactgagcaaagtcgatatccgccacatagtgtgcagtatactttcccgaacaccaggcaccaacaagaatttgccgtgccagattaccgcagttcccacctcgaagtcagtcaggcctcccagctgctccagcagcagcagcagcagcaactgagacggaggcccagtttgctttcggagtttcacccagggagcgaccgcccacaggaaaggcgcacctcttacgaaccttttcacccaggtccctctcccgtggaccatgactcactggagagcaaacgaccaagattagagcaggtgtccgattcacactttcagcgtgtctcagccgctgtgcttccacttgtacaccccttgcccgaggggctgcgcgcatccgctgatgctaagaaagaccccgcattcggaggaaagcacgaagcccctagcagtcctatttctgggcagccctgtggcgacgatcaaaatgccagcccttccaagctttcaaaggaggagctcattcaatcgatggacagggtcgatcgagagatcgccaaggtcgagcagcagatactaaaactgaagaaaaagcagcagcagctggaagaggaagccgctaagccaccagaacctgagaagccagtgtccccccctccggtggaacagaagcataggtcaatcgtgcagattatatacgacgagaatcgaaagaaggctgaagaagcccataagatctttgaaggcctgggcccaaaagtggaactcccactttacaaccagcctagtgatacgaaagtttatcacgagaatattaagaccaatcaggtgatgaggaagaagctcattctcttttttaagcgccgtaaccatgcacgaaagcagcgcgagcagaagatctgtcaacgctacgaccaactgatggaagcatgggagaagaaagtcgataggattgaaaacaacccgagaagaaaggctaaggagtccaagacccgagagtattacgagaagcagtttcctgaaatccgcaagcagagggaacagcaggaacgcttccagcgtgtgggacagcgaggggctggcctaagcgctacaatagcacgcagtgagcacgaaattagcgaaataattgatgggctgagcgagcaggagaataatgagaagcagatgcgccagctcagcgtcatcccccctatgatgtttgatgctgaacagaggcgcgttaagtttatcaatatgaacggcctcatggaagatcctatgaaggtgtataaggaccggcagttcatgaacgtctggacagaccacgagaaggagatctttaaggataagttcatacagcatcctaagaacttcggcttgatcgcctcctacctggagcggaagagcgtgcccgattgcgtgttatactactatctgaccaaaaagaacgaaaactacaaggccctggtccggcgaaattacggcaagcggaggggtcggaaccaacagattgcacgcccttcccaagaagagaaggtggaagagaaggaggaggataaggccgagaagaccgaaaaaaaagaggaggaaaagaaggacgaggaggaaaaagacgagaaggaggattcgaaggagaacaccaaggaaaaggacaagatcgatgggacagctgaagagacggaggagagagaacaggccacaccaagagggaggaagactgcaaactctcaggggagaaggaaggggcgaatcacacggtcaatgacaaacgaagcagctgcggcaagcgccgcagcagcggcagccacagaggagccaccccctcctctcccaccacctcctgagccaattagcacggaacctgtggagaccagccggtggacagaagaggagatggaagtggcgaagaagggccttgttgagcacggacggaactgggccgctatagccaagatggtgggaacaaaaagcgaagctcaatgtaaaaacttttattttaattacaagcgcagacataatttagacaatctcttgcagcagcacaaacagaaaacctctagaaagccacgcgaagagagggacgtttcccaatgtgaaagcgttgcgtcaacggtgtccgctcaggaagacgaagacattgaagcctctaatgaagaggaaaatcctgaggatagcgaggtagaggctgtgaaaccttccgaagattcgcctgaaaacgcaacctcacgtggaaatactgagcctgccgttgaactggagcctactacggagacagcaccttctactagtcccagcctggctgtaccctccaccaagccggctgaggatgaatccgttgaaacacaggtcaatgactcgattagtgctgagacagctgaacaaatggatgtcgatcaacaggagcacagcgcggaagagggcagtgtgtgcgacccaccccctgccacgaaggcagactccgttgatgttgaggtgcgcgttccagagaatcacgcctctaaggtcgaaggggacaacaccaaggagagggacttggacagagcttctgagaaagtggagccgagagacgaggacttagtcgtggctcagcaaatcaatgcgcagcgtccagaaccacagtccgataacgacagttcagcaacgtgctccgcagatgaagacgtggacggagagccagagcgccagcgcatgtttcctatggactcaaagccaagtctgctgaatcccacagggtcaattctggtgagctccccgctcaagcctaatcctctagatttgccacagctgcagcacagagctgccgtcattccaccgatggttagttgcaccccatgcaacatccccattggaacaccagtaagcgggtacgctctgtatcagagacatatcaaagcaatgcacgagagcgcacttctggaagaacagcgccaacggcaggagcagatcgatctcgaatgtcgcagtagcacgagcccctgcgggactagcaaatctcccaaccgggagtgggaggtgctgcaaccagccccacaccaggtaattaccaatcttcccgaaggcgtgcgactaccaactacgcgccctacccggcctccaccccctctgattcccagcagcaagacgactgttgccagtgaaaaaccctctttcatcatgggaggctctataagccagggaactcccggaacatatcttactagccataaccaggcctcatacacacaggagacaccaaagccctctgtaggatccatctctcttggcctacctcgccagcaagagagtgctaagtctgcaacgctgccctatatcaagcaggaagagttctcaccacggagtcagaacagtcaacccgagggtctcctcgtgagggcgcagcatgagggtgtggttcgaggcacagctggtgcaattcaggagggatctattactcggggaacgcctacttctaaaataagtgtcgagagcatcccgagtctcagaggaagcatcacccagggaactccagctttacctcagacggggatacctacggaagctctagtaaagggatctatcagccgcatgcccatcgaagactcctccccagagaagggaagggaggaggccgcttcaaaggggcacgttatttacgagggtaagtcaggccatatcttgagttacgataatatcaaaaacgcccgagaagggacccggtcgcccaggaccgcccacgaaatttctctgaagcgaagctacgagagcgtcgagggcaacatcaaacaagggatgtcgatgcgcgaatcacccgtctcggcgccactggaaggtctgatctgcagagccctgcctcgcggttccccacactccgacctgaaggagcggaccgtgctctccggatctatcatgcaaggtactccacgtgccactactgagagcttcgaggacggactgaaataccccaaacagataaaaagggagtccccccctataagagcctttgaaggagcgatcactaaaggcaaaccttacgacggtattaccaccataaaggagatggggaggagcatccacgaaatccctcggcaggatattctgacgcaagagtcccggaagacccccgaggtagtccagagcacgagaccaattattgaaggcagtatcagccagggaacgcccatcaagtttgataacaattctggccagtccgcaattaaacacaatgtgaagtctcttataacaggaccatccaagttatcgcgagggatgccccctctggaaattgtgcccgagaacattaaggtggtcgaaagagggaaatacgaagacgtaaaggccggtgagactgtacgctctcgtcacaccagcgtggtttcatccggcccttctgtcctgcgctctacattgcatgaggctcctaaggcccagctttctcctggcatatatgatgacactagcgctcgacggactccagtgtcctatcagaataccatgagccgaggatcacctatgatgaacaggacaagcgacgtcaccattagctcaaacaaatctacgaatcatgaaaggaagtccacccttactcccacgcagagggagagtattcccgctaaatctccagtgcctggcgtggaccccgtcgtcagccactctccctttgacccccaccaccgcggttccaccgcaggagaagtatacagatcccatctgcctacacacttggatccggctatgccctttcaccgcgcactcgaccctgccgctgccgcttatctatttcagcggcagttgtcccccactcctggctacccaagccagtaccaactctacgccatggagaacacccggcagaccattttgaacgactatattacctcgcagcagatgcaggtcaacctgaggccagatgtggctcggggactgtcgccgagggagcagcccttaggcctgccttatcccgctaccagggggatcattgacttgactaatatgccccctacgatcctagtcccccatcccggtggtacttccactcccccaatggatcgcatcacctacattcctgggacacaaataactttcccaccccgaccctataatagtgcctcaatgagccctggccaccccacgcatctggcagccgcagctagcgctgaacgagagcgagagcgcgaacgcgagaaggagagggaaagagagagaatcgccgcagcctcttctgatctgtatcttagacctgggtcggagcagccaggacggccaggctctcatggctatgtcagaagtccatccccatctgttcgtacccaggagaccatgctacagcaacgacctagtgtatttcaggggaccaatggaactagcgtgatcacaccactcgaccccacagctcagcttagaatcatgcctttgccggctgggggtccaagtattagtcaaggactcccagcttctcgatacaatacggctgctgacgcactcgccgctcttgtcgacgccgcagcctccgctcctcagatggacgtgagtaagaccaaggaaagcaaacatgaggccgctcgcctcgaagagaacctgagaagcaggtcagccgcagtcagcgaacagcagcaactcgagcaaaaaacactggaagttgagaagcgctcagtgcagtgtttatacactagctctgctttcccgtcaggcaagccacaaccgcacagttccgtcgtttactccgaggctggaaaggataaggggccacctccgaagtctagatacgaagaagaactgcggacacggggaaagactacgatcaccgctgccaactttattgacgtcatcatcacgcggcagattgcgtccgataaggacgctagggagagaggttcgcagtccagtgattcttccagttccctttcgtcacacaggtacgagactcccagcgacgctatcgaagtgatcagcccagcatcttccccagccccaccacaggagaagcttcagacctatcagcccgaagtggtcaaggccaaccaggcagaaaacgacccgactagacagtacgagggtcccctccaccattatagacctcagcaggagtccccttccccgcagcagcagttacccccttccagccaggccgaaggcatggggcaggtgccccgtacacacaggttgatcacactcgccgatcatatctgccagatcattactcaagactttgcacgcaatcaggtgtcaagtcagacaccgcagcagcccccaacaagcacctttcaaaactccccttctgcattggtgtctactcctgtacgcaccaagacctctaatcggtattcccctgagtcacaagcgcaatccgttcaccaccagagacctgggtcgcgcgtttccccagaaaacctggttgacaaaagtagagggtctcggcctggcaaatcccctgagcgctctcatgtctccagcgaaccttatgaacccatttctcctcctcaggtgcccgttgtgcacgagaagcaagacagtctcctactgctttcccaacgtggggcagagcctgccgagcagaggaatgacgcacgctctccaggctcaatatcttatctgccatcatttttcacaaagttagagaacacctcccctatggtgaaatctaagaagcaggagatcttccgtaagttgaactcgagtggcggtggggatagcgatatggctgccgcacagcccggaaccgagatttttaacctcccagccgtgacaacttccggttcggtgagctccaggggtcatagctttgccgaccccgctagcaacttgggtctcgaggatattattagaaaagcactgatgggctcatttgacgataaagttgaagaccatggggttgtgatgagccaacccatgggcgttgttccaggaaccgcgaacacgagcgtggttacttctggagagacaagacgagaggagggggaccccagcccccactctgggggagtgtgcaaacccaaacttatctctaagtcaaattcccgcaaaagtaagtcaccaatacccggtcagggctacctcggcactgagcgacccagctctgtgtcctctgtgcattctgagggcgattaccaccgccagaccccaggttgggcttgggaggaccggcctagctcaactgggagcacacaattcccgtataaccctctcaccatgcgaatgctctcgtccacacctcccactcctatagcatgtgccccaagcgctgtgaaccaggcggcaccacatcaacagaatagaatctgggagcgggaacccgcacccctgctgtcagctcagtatgaaacccttagcgacagtgatgacta

SEQ ID NO: 27577 - DNA, 2313 bp, Artificial Sequence
  Description of Artificial Sequence: Synthetic coding sequence
atgcttcaacaggtgaacggtcataaccctggaagcgatggacaggcacgggaatatttaagagaagacttacaggagtttttgggcggtgaggtccttctatacaaactggatgacttgacgcgggttaacccggtgaccttggagacagtgttacgatgcctgcaggcccgatatatggcggacactttctatacgaacgcagggtgcaccctggtggccctcaatccattcaaacccgtgccacagctctacagccccgagctaatgagggagtatcacgccgcaccccagccacagaaactgaaaccacatgtttttaccgtgggagagcagacgtataggaatgtgaagagtctcatcgagcccgtgaaccagtcaatcgtcgtgtcaggcgaaagtggcgctgggaagacttggacgagtcgttgcctaatgaaattctatgccgtggtcgccactagtcccgctagctgggaatcgcataagattgcggagcgcatcgaacagaggatcctgaactcaaacccagtgatggaggccttcggaaatgcgtgcacactccggaacaacaattcttccaggtttgggaagttcattcaactgcaactcaaccgggcacagcagatgacaggagccgcagttcagacctatctcttggaaaagacacgcgtagcttgtcaggcatctagcgaacgcaactttcacattttctaccagatatgcaagggggcatccgaagatgaaaggctgcagtggcacctgcccgaaggcgcagccttttcctggctgccaaaccctgaaaggagtttggaagaggactgttttgaagtcactagagaggctatgctccacctgggaattgatacacccacccagaacaacatatttaaggtgctggcagggcttctacacctgggcaatatccagtttgccgcttccgaggacgaagctcagccctgtcagccaatggatgacgctaaatacagtgtacgtaccgccgcatctctgttaggcctcccagaggacgttctgctggagatggtgcagatccgtaccattcgggctggtaggcagcagcaggtcttccggaaaccatgcgctagagccgaatgtgacactaggcgagattgtctagctaagcttatttatgctcgattgtttgactggttggtgtcagtcataaattcatccatttgcgcagacactgactcttggaccacatttatcggcttgcttgacgtttacggtttcgaatcatttcctgataatagcctcgagcagctctgtataaactatgcgaatgagaagcttcagttggaagcctgcggcctcgtggagacaatacacatcagtgctgcaggatttcccattcgcgtgagccacaggaattttgtggaacgctataagctgttgcgacggctgcacccctgtacttccagcgggcctgactcaccctacccagccaagggcctaccagaatggtgcccacattctgaagaggcaactctggagcccctaatacaggatattctccacactctgcctgtactcacacaggccgctgctatcacgggcgatagcgcagaggcaatgcctgctcccatgcactgcggcaggacgaaagtcttcatgaccgactccatgttagagttgctcgaatgtggtagagcacgtgttttggagcagtgcgcaaggtgcatccagggcggatggaggaggcaccgccatagagagcaggagagacagtggagagccgtgatgctgattcaggctgcgatccgtagttggctcaccaggaagcacattcaaagacttcatgccgctgcaaccgtgattaagcgtgcatggcagaagtggcgcatccgtatggcctgtctggctgcaaaagaactggacggtgttgaagagaagcatttctcacaggcaccctgttcgttgtccacgagcccactgcagactaggttgttggaggcaattatccgactgtggccgttaggtctagtgctggccaacacagctatgggagtgggcagtttccaacggaaactggtggtatgggcttgcttacagctaccccgaggctctcccagtagctacaccgtccagacagcgcaggatcaggctggagtcacaagcatcagggccctgccgcaaggaagcataaagtttcactgtcgcaagagccccttgaggtatgcagatatctgtcctgagcctagtccatattctatcaccgggtttaaccaaattctgctcgaacggcataggttgattcacgttacgtctagcgctttcacaggtttggggtag

SEQ ID NO: 27578 - DNA, 2796 bp, Artificial Sequence
  Description of Artificial Sequence: Synthetic coding sequence
atggccgaagtggaagcagtacaacttaaagaagaaggcaacaggcacttccaattgcaggattacaaagcagccactaatagttattctcaggcactgaaattgacaaaggacaaagccctgctcgccactctttaccgtaacagagccgcatgtggtctcaagaccgaaagctacgtgcaggctgcctccgatgcgtcacgcgctattgatattaattccagtgatatcaaggccttataccgcagatgtcaagccctagaacatttgggaaagcttgatcaagcatttaaagatgtgcagagatgcgcaacgctggaaccacgaaaccagaatttccaggagatgctcaggcggcttaataccagcatccaggagaaactgcgggtgcaatttagtacagattcccgagtgcagaagatgtttgagattctgttggacgagaactccgaagcagacaagagagagaaagcagcaaataatctaattgtgctgggcagggaggaagcaggagccgaaaagattttccagaacaatggcgtggccctgctcttacagcttctggacacaaagaagcccgaactggtcctggcagccgtaagaaccctctcaggtatgtgcagcggacaccaggccagagctaccgtcattctccacgctgtgcgtatcgatcgcatctgctctttaatggcagttgagaatgaagaaatgtccttagccgtctgcaatctactacaagccatcatcgactctctttctggggaagataagagggagcatcgcggtaaagaagaggccctggtcttggacactaaaaaagacctgaaacaaataacctctcacctcctggatatgttagtgagcaagaaggttagcggacaaggtagggaccaggctctgaacctactgaataaaaatgtgcccaggaaggatttagccatccatgataactctagaaccatctacgtcgtcgataacggacttcgcaagatactgaaggtggttggacaggtgccggatttgccttcctgccttcctctcaccgacaatacccgcatgttggccagcatcctcattaataagctgtacgacgatctgcgctgtgaccccgaacgggaccactttaggaagatatgcgaagagtatataaccggcaagttcgacccccaggacatggacaaaaacttaaatgctatccaaaccgtgtcaggaatacttcagggtccctttgacctcggcaaccagctcctcggactgaagggggttatggagatgatggtggcattatgcgggtccgaacgagagacagaccaactcgttgcagtcgaagcactgattcacgcttccacgaagctcagtagagctaccttcataattaccaatggcgtctccctcttaaagcagatctacaagactacgaaaaatgaaaagattaagatcagaacccttgtaggcctgtgcaaactgggatccgccggaggcactgactacggcctcaggcagtttgccgagggttccactgaaaaactcgcaaaacagtgtcggaaatggctgtgtaacatgagtatcgacacgagaacaaggaggtgggcggtggagggcctcgcatatctgacgttagatgccgatgttaaagatgatttcgttcaggacgtgcctgccttgcaggctatgttcgagctagccaaggccggtaccagcgataaaacaatcctgtactcagtggcaactaccttagttaactgtactaatagttatgatgtgaaggaagttatccctgaactggttcagctggctaagttctctaagcagcacgtcccggaggagcatccaaaagacaagaaggatttcattgatatgcgcgtgaagcgtcttttaaaggccggtgttatctctgcactcgcatgcatggtgaaggctgatagcgcgatactcactgaccaaacaaaagaactgctggcaagagtgtttctggccctgtgtgataacccaaaagaccgtggcacaattgtcgcccagggcggaggaaaggccctcatacctcttgcgttggaaggaaccgacgtcggtaaagttaaagccgctcatgccctggctaaaattgccgctgtctccaacccagacatcgcctttccaggtgagcgcgtctacgaagttgtgcgaccgcttgtgaggctgctggacacccagagagacgggcttcagaactatgaagcgttgctggggctcactaacctctccggcaggtccgacaagctgcggcaaaaaatctttaaagagagggcccttcccgatattgagaactacatgtttgagaatcacgaccaactgagacaggccgctaccgagtgcatgtgtaacatggttctgcataaggaggtgcaggaaaggttccttgccgatggcaacgaccggctgaaactggtcgtgctgctgtgcggcgaggatgacgataaggttcagaatgcagccgcaggggctctggcgatgctgaccgccgcacacaaaaagttgtgcctgaagatgacacaggtgaccacacagtggttagaaatattacagaggctgtgtctgcacgatcagctatcggtgcagcatagaggcctggtaatagcctacaacctgttagctgccgacgccgagcttgccaagaaactcgtggagtccgagctgttggagattctgactgtggtcggaaaacaggaacctgacgaaaagaaggcggaggtggtgcaaactgccagagaatgtctgattaaatgcatggattacggtttcatcaagcccgtgtcttag

SEQ ID NO: 27579 - DNA, 2022 bp, Artificial Sequence
  Description of Artificial Sequence: Synthetic coding sequence
atggcctcccagttctgcctacctgagtctccttgcctgtcccctttaaaaccacttaagccacattttggggacatccaggagggtatttatgtagctattcagcggtctgataagaggatccatctagcggtggtgacagagattaaccgcgagaactattgggtcacggtagagtgggtggagaaggccgtgaagaaggggaaaaaaatcgacctcgagaccatcctgctcctgaaccctgccctggattccgctgaacacccaatgcccccacctccgttgtcacccctggcattggctccctccagcgctatccgagaccagcgcaccgctacaaagtgggtcgctatgattccccagaagaatcagactgcatccggagattcactggatgtgcgggttcctagcaaaccctgtctgatgaaacagaaaaaatcaccctgcctgtgggagattcagaaacttcaggaacagagagaaaaaaggagacgtctgcagcaggaaatacgggctcgtcgggcactggacgttaacactaggaacccgaattacgagatcatgcatatgattgaagagtatcgccgtcacctcgacagctctaaaatcagcgtgctcgagcctcctcaggaacatcgaatctgtgtttgcgtgagaaaacgaccattgaaccagagagagaccacactgaaagacctggacataatcactgtaccgagcgataacgtagtgatggtacatgagtccaagcagaaggtggaccttacacgctatctccaaaatcagactttctgttttgatcatgcgttcgatgataaggcaagcaatgagctcgtttaccagtttaccgctcagcctctggtggaatccatattccgtaagggaatggcaacttgcttcgcatacgggcagaccggcagtgggaagacctacaccatgggaggagatttcagcggtacggcgcaggactgctctaagggcatctatgcattggttgctcaagacgttttcctcttgttgagaaactccacatatgagaaactggacctgaaagtttatggaaccttctttgaaatttacggcggtaaggtgtatgatttactgaactggaaaaagaagctgcaggtgctcgaagatggtaaccagcagatccaggtggtgggccttcaggagaaagaggtctgttgtgtcgaggaagtgctcaacctcgtcgaaattggtaactcctgtcgaacatcgcggcagaccccagtcaacgcccattcctcccgctcacacgcggtgttccaaattatcctgaagagtgggagaatcatgcatggcaagttttcactggtggacctggctggaaatgagcgtggggctgacaccaccaaggcgtcccgcaaacgccagcttgagggggcagagataaataaatcactgctggcacttaaagaatgcatcttggccctgggtcagaacaaacctcacacacctttccgcgcttcaaaactgaccctcgtcctcagagattcctttattggtcagaactcatccacatgcatgatcgccacgatcagcccaggtatgacgtcttgtgaaaatacgctaaatacccttaggtatgcaaaccgcgtcaagaagcttaacgtggatgtccgaccttatcatcgcggtcactaccctatagggcacgaagctccgaggatgctgaaatcccacatcgggaactccgagatgtccctccagcgggatgagttcattaaaattccgtacgtccagagcgaggaacagaaagagattgaagaagtggagactctccccactcttctcggcaaggacacaaccatttcaggaaaagggtcttctcagtggttggaaaatatccaggaacgcgcaggaggtgtccatcacgacatcgatttttgcatcgcacggtctctatcgatcttggagcagaagatcgacgcactcactgaaatccaaaaaaaactgaaacttctcttggccgatctgcatgtgaaatctaaagtcgagtag

SEQ ID NO: 27580 - DNA, 1236 bp, Artificial Sequence
  Description of Artificial Sequence: Synthetic coding sequence
atggccacgacagctaccatggcaacttcagggtctgccagaaagaggctcctcaaggaagaggatatgacgaaggtggaatttgaaacaagcgaggaggtggacgtgaccccgacattcgacactatgggcctccgcgaagatttattacggggtatttatgcatacggattcgaaaaaccttctgcgatacagcagcgggctataaaacagatcatcaaaggcagagatgtgattgctcagtcacagagtggcactggaaaaaccgcaaccttctccattagtgtcctccaatgtttggacatccaggtccgcgagacccaggcactgatcctagctcccacaagggagctggcagttcagattcagaagggcttactagccctgggtgactatatgaacgttcagtgccacgcctgtatcggtggaacaaacgtcggcgaggacatccgcaagctagattatgggcagcacgttgttgcaggcacccctggccgtgtcttcgatatgatccgccgaagaagcttaagaactagggctatcaagatgttggttttggacgaggcggacgaaatgcttaacaaaggattcaaagagcaaatctacgatgtttatcgctatttgccgccagcaactcaggtggtgttgattagtgcaacccttccacatgaaatcttggaaatgaccaataagttcatgacggaccccattagaattcttgtgaaaagagatgagctcacgctcgaagggatcaagcagttctttgtagcagtggagagagaagaatggaagttcgatacactgtgcgatttgtacgacacactaaccatcacacaggcggtcattttttgcaatacgaagcggaaagtggattggctgacggagaagatgagggaagctaacttcactgtgtcatctatgcatggagatatgccacagaaggagcgagagtccatcatgaaggagttccggtctggtgcatcaagagtgctgatctcaaccgatgtttgggccagggggctggatgtaccacaagtcagtttaatcatcaattacgaccttcccaataatagggaactgtacattcatcggatcggtagatccggtaggtatggtcgcaaaggggtagccataaatttcgtgaagaacgatgacatcagaattctgagagatattgagcaatattactctacccagattgatgaaatgccaatgaacgtggctgatctcatttag

SEQ ID NO: 27581 - DNA, 1683 bp, Artificial Sequence
  Description of Artificial Sequence: Synthetic coding sequence
atggagctgcccgcagtcggcgagcatgtcttcgcggtcgagagcatcgaaaagaagaggattcggaagggccgtgtcgaatacctagtgaagtggcgtggctggtctccaaaatacaatacctgggagccggaagagaacatactggacccacgcctcctgattgcttttcaaaacagggagagacaggaacagctgatgggataccgaaaaagaggcccaaagccaaaaccactcgtggtgcaagtgcctacctttgctagacgtagcaacgtgcttactggtctgcaggactctagtacggacaacagggcaaagctggacctgggggcacagggtaaaggtcaggggcatcagtatgaactcaattctaagaaacaccaccaataccagcctcacagtaaggagcgggctggcaagccccctccacccggaaaatccggaaagtactattaccagttaaattccaagaagcaccacccctatcagcccgaccctaagatgtatgatctgcaatatcagggcggacacaaagaagctcctagccccacctgtccagacctcggggctaaaagccacccaccagacaagtgggctcagggggctggagcgaaggggtatctaggggctgtgaaaccactcgcaggcgctgccggagcgcctgggaagggtagcgagaagggcccaccaaacggtatgatgccagctccaaaggaggccgtaaccggaaatggtattggcggtaaaatgaagatcgtgaagaataagaacaagaacgggagaatcgtgatcgtgatgagcaagtatatggaaaatggcatgcaggctgtgaagattaagtctggggaagtagccgagggagaggccaggtctccttcccacaagaagcgcgctgcggatgaacgccaccctccagctgacaggacctttaagaaggccgcaggagctgaggagaagaaggtcgaagccccacccaagcgccgagaggaagaggtcagcggggtttctgacccacagccgcaggatgctgggagcaggaagctttcccctactaaggaggccttcggggaacaacccttacagctgacgacaaaacctgatctcctggcttgggacccagcgagaaacacccatcctccatctcaccatcctcacccgcacccacatcatcaccaccaccatcaccaccatcaccaccacgccgtgggattgaacttgtcccacgttcgcaaacgttgtctgtccgaaacccatggagaaagagagccttgtaaaaaacgcctcacagccaggagtatctccactcccacatgtttaggcggttcacccgctgccgaacggccagcagatctccctccggctgcagccctgccccagccagaggtgatcttacttgattcagatcttgatgagcccattgacctccgatgcgtgaaaacgcgctcagaggccggtgaaccaccatcttctctccaggtgaagccagaaactcctgcatctgccgctgtcgccgtggccgctgccgcagcccctacgacgacggcagaaaaacctccagctgaagctcaggacgaacccgctgagtctttgtccgaatttaaaccatttttcgggaacattatcattaccgatgtcaccgctaattgtctaactgtgacgttcaaagagtatgtcaccgtttag

SEQ ID NO: 27582 - DNA, 1218 bp, Artificial Sequence
  Description of Artificial Sequence: Synthetic coding sequence
atggattcactggtaaccgctaacactaaattctgcttcgatctctttcaggagattggcaaagacgatagacataagaatatctttttctcaccactgtcccttagtgcggctctcggaatggtgcgactgggcgctagatctgacagtgctcaccagatcgacgaggtgttacactttaatgagttctctcaaaatgaatccaaggaaccagacccctgtcttaagtcaaacaagcagaaggcaggttctctcaataacgaatccgggctcgtcagttgctatttcggtcagctgctgagcaagctcgatcgaattaagactgattacacattgagcatagcaaatcggctctatggcgagcaagaattccctatctgccaggagtacctggatggagtaatccagttctaccacaccacaatcgagagcgtggactttcagaagaacccagagaaatcgaggcaggagatcaacttttgggtggagtgtcagagccaggggaagataaaggaactgtttagcaaagacgctatcaacgctgagaccgtcctggtccttgtgaatgccgtctacttcaaggccaagtgggagacatacttcgatcatgagaatacggtggatgcacccttctgcctcaacgctaacgaaaacaaaagcgtgaaaatgatgacgcagaaaggcttatataggatcgggttcattgaggaagtgaaggcgcagattctcgaaatgagatatacaaaaggcaaactgagtatgtttgtcctccttccctcccactcaaaggacaatctgaaagggctcgaagagttagagagaaagataacctacgaaaagatggtggcgtggtcaagttccgagaacatgtctgaggaatccgtggtactctcttttccccgattcaccctggaggatagctatgatctgaactcaatacttcaggatatggggatcactgatatattcgatgaaactcgcgctgatctgacaggcatcagcccatctcctaatctatacctgtcaaagattattcacaaaactttcgtggaggtggatgaaaatggaacccaggcagccgcagctaccggcgcagtggtttccgagaggtcattgcggtcctgggtggagttcaacgcaaatcaccccttccttttttttatcagacataataaaactcagacgatcctcttctacggccgtgtgtgctccccctag

SEQ ID NO: 27583 - DNA, 3537 bp, Artificial Sequence
  Description of Artificial Sequence: Synthetic coding sequence
atgcttaggatgaagctgcccttaaagccgacacaccctgccgagcctccacccgaagctgaagagccagaggccgatgctcgaccgggagctaaggccccttcaaggcggagacgcgattgccgaccccctcctccgccaccaccacccgcaggcccatccagaggtccactacccccaccccctcccccacgcggtctcggaccgccagttgctggaggggctgccgcaggcgcaggcatgccgggagggggtgggggacccagtgccgctttaagggagcaggaacgggtttacgaatggtttggactggtgctagggagcgctcagcggctggagttcatgtgcggcctgctggatctgtgtaacccgctggagctgagatttctcggctcctgtctcgaagacctggccaggaaggattatcattatttgagggacagcgaggccaaagcgaacgggctttcagaccccggacccctggcggacttccgagagccagctgtgagaagtcgcctgatcgtgtatttggctcttctgggtagtgaaaacagagaggctgccggaagactgcatcggctgttaccccaggtcgatagcgtgctgaaaagcctgcgcgcagcaaggggggaaggcagccgcggaggggctgaagatgagcgtggggaagatggcgatggggaacaggacgccgagaaggacgggtcagggcctgaagggggtatcgtggagcctcgggtgggcggagggcttggcagtcgggctcaggaggagttgctactgctctttaccatggcctcattacatcccgcttttagtttccatcagcgagtgactttgagggagcacctagagcggctgcgggctgccctcagaggcggacctgaggacgcagaggtcgaggttgagccgtgcaagttcgccggtcctcgggcacagaataactctgcacatggggattacatgcaaaacaatgaaagttcactgattgagcaggccccaatcccccaggacggactgactgtggctccccaccgcgcacagcgggaggctgtgcatatcgagaagatcatgttgaaaggagtacagagaaaaagggcagacaagtactgggaatatacttttaaggtgaactggtctgatttgagcgtcaccactgtgactaaaacccaccaggagttacaggagttcctgcttaagctgccaaaggaactaagcagcgagacatttgacaagaccatcctgcgtgcacttaaccaaggctcactaaaaagggaggaacgacggcacccagaccttgagccgatactgcgacaactcttttctagtagctcccaagcatttttgcaaagccagaaggtccactcattctttcaaagtatcagttctgattctctccatagcattaacaatttacagagcagcctcaagacctccaagatcctggagcacctcaaagaagatagcagtgaggctagtagtcaagaggaagacgtgcttcagcacgccattattcacaaaaagcacaccggtaagtcaccaatcgtgaacaatattggcacgtcatgctctcccctggacggattaaccatgcagtattccgaacagaacggaatcgtcgattggaggaaacagtcttgtacaactattcaacacccggaacattgtgtcacttccgccgaccagcattctgcagagaagcgatcactgtcctcgatcaataagaaaaagggcaagccacaaaccgaaaaggagaaaatcaaaaaaactgataatcgtctgaatagccgaatcaatggaatccgattgtcgaccccacagcatgcacacgggggaaccgtgaaagacgtgaaccttgacataggatccggccatgatacatgtggggagactagctcggagagttattctagcccttccagtccacggcacgatggaagagagtctttcgagtcagaggaagagaaagatcgcgacacggacagcaacagcgaagatagcggcaatccctctacaacccgcttcactggatacggctccgtcaaccagacagtgactgtgaaaccaccggtgcagattgccagtttgggcaacgaaaacggcaatctgttggaggatcctctgaactcgcctaaataccagcacatcagcttcatgccgacactccattgtgtgatgcacaatggggcacagaaaagcgaggttgtggtgccggcacctaagcccgcagatggaaaaaccataggaatgctggttccttccccagtcgctatttcggctattagggaatccgccaattctacgccggtggggatcctcggtcctactgcctgcaccggcgaatctgagaagcatctagagctactcgccagtcctctgccaatcccaagcaccttcctccctcactcttcaacccccgcactgcatctaaccgtgcagaggctcaaactgcctcccccacagggaagctccgagtcatgcaccgttaatatccctcagcagccccctggatctctgtcaatcgccagcccaaacacagcattcatccctattcacaacccaggttcattcccaggctctccagttgccaccaccgatcctattaccaaatccgcctcccaggtcgtcggtctcaatcagatggtgccccaaatcgaagggaacacagggaccgtgccccagcccacgaacgtcaaggtagttctgccagccgctgggctgagcgccgctcagccacctgcgagctaccccctccctgggagtccccttgcggcaggagtcctcccaagccaaaacagctctgttctatccactgcagccacatcccctcagccggcaagcgccggaattagtcaagcacaggcaaccgtcccacccgctgtgccaacccatactcccggacctgctccaagcccttctcctgccctgacgcacagtacagcacagagcgatagcacctcttatattagcgccgtagggaacactaacgcaaacggtactgtcgtgccccctcagcagatgggatcagggccatgtgggagctgcgggagaagatgtagttgtggtaccaatggaaacctgcaacttaactcgtattattaccccaatccaatgccaggcccaatgtacagggttccttccttctttacgctccctagcatttgcaacggcagctatctgaatcaggctcaccaatctaatggtaaccagctgccctttttcttgccacaaaccccctacgcaaatggcctggtgcatgatcctgtgatggggagtcaggctaactacggaatgcagcagatggcaggatttggcagattttatccggtatatccagctccgaacgttgtggcaaatacatctggaagcggccctaagaagaatggtaacgttagctgctacaattgcggtgtctccggacattacgcccaggattgcaagcagagcagcatggaggccaaccagcagggaacctaccgattgaggtacgccccaccattacctccctctaacgatactctcgactccgccgattag

SEQ ID NO: 27584 - DNA, 411 bp, Artificial Sequence
  Description of Artificial Sequence: Synthetic coding sequence
atgcccggtaaaaaggctcgcaagaacgcacagccatctcctgcccgagctcctgcaggccctgctggcaccgcaggaaccgctcgcgatcaggcgggatttgccatcggcatgcagctccgctttacacggggaaaaaaactgctgtctagcagtttgagtagctctcctcttgcgctccctaggggtcatgaagagcaagttcaggttgctggatcacgcgtatgctacagtacacaggagatctggaggcagacagagctacccgctgagacgagcgagtccgatattcagacactacttctgaggaacctaaccgcatctaagacgtgcatgcgtggcttgctgcagaagagctttctgcggagatgcacattccatcaattcgaagagcgtttacattgtaattag

SEQ ID NO: 27585 - DNA, 879 bp, Artificial Sequence
  Description of Artificial Sequence: Synthetic coding sequence
atgaaagccaccgtgctcatgagacagcccggacgcgtgcaggaaatagtaggcgctctgcgcaaggggggtggcgacagattgcaggtgatcagcgatttcgatatgactttgtcacgcttcgcctacaatggaaaaagatgtccaagctcatataatatcttggacaattctaaaattatttccgaagaatgtcggaaagagctgacagcactgctgcatcattactacccaattgaaattgaccctcatcggactgtgaaggagaaacttccacacatggtcgaatggtggactaaggcccataacttgctctgtcagcagaagatacagaaattccagattgcgcaagtggtgcgagaatccaatgccatgctccgtgagggctataagacattttttaacaccctgtaccataacaacattcccctgttcatcttctccgcgggtattggagacattctggaggagattattagacagatgaaagtgtttcatccaaatatccacattgtgtcaaactacatggacttcaacgaggacgggttccttcaaggatttaaaggtcagctaatacacacctataacaagaattccagtgcttgcgaaaacagcggatacttccagcagttggaaggcaagacgaacgtcatcttactcggggatagcatcggcgatctgaccatggcagatggggtgccaggcgtccaaaacatcctaaagatcgggttccttaatgacaaagtggaagagcgacgcgaaagatacatggacagctacgacatcgtactggagaaggacgagacacttgacgtggtgaacggcctgctccagcacattctctgtcagggcgtacaattggaaatgcaggggccttag

SEQ ID NO: 27586 - DNA, 2010 bp, Artificial Sequence
  Description of Artificial Sequence: Synthetic coding sequence
atggacctgcggaccgctgtgtacaacgcagcccgagatgggaagcttcagcttctccagaagttgttgagcgggcgttcacgtgaagagcttgatgaacttaccggcgaggtcgctggagggggaactccactactcatagccgcaaggtacggccatctggatgtggtggaatacttagtggataggtgcggcgcaagcgtagaagctgggggatccgtgcacttcgacggagagacaattgagggcgctcctccactctgggctgcctccgcagcgggacacctcgatgtagtgcggtccctgctgcgccgaggggcaagcgttaatcgcaccacgcgcaccaacagcacgccactgcgcgctgcctgtttcgatgggcacctagaggtcgtgcggtatcttgtgggcgaacaccaagccgacctggaggtcgccaatcgtcatgggcacacgtgcctcatgatctcatgctacaaagggcaccgagagatcgcacgatatttattagaacaaggggcacaggttaaccgacgatccgccaaaggcaataccgccctgcacgactgcgctgaaagcggaagtcttgagatcctgcagttactgctcgggtgtaaggcgcgtatggaacgagatggctacggaatgacacctctacttgctgcctctgtcaccggccacaccaatatcgtggagtacctgatacaggaacagcccggtcaggagcaggtggctggcggagaggcgcagcctgggctgccccaggaagatccatcaacatcccagggttgcgcccagccacaaggggctccttgctgttcctcctcaccagaggagccgctgaatggagaaagttacgaatcttgttgccctacaagccgggaggcagccgttgaagcgctggaactgctcggcgcaacctacgtcgacaagaagcgggaccttctgggagcacttaagcactggcgcagagcaatggaactgcgacaccaggggggagaatatctgccgaagcctgaacctccacagctggtactagcatacgactatagcagagaagtcaataccacagaggagctagaagcactgattactgatccagatgagatgcggatgcaggcactcctcatccgagaacgaatcctgggaccttcccatcccgacacctcgtattacatccgatacaggggtgcggtttacgcagactccggaaactttgagcgctgcatccgtctgtggaagtacgccctggacatgcagcaatctaacctcgagcccttgtctccaatgacagcgtccagcttcctctcttttgctgagctgtttagctacgtgctccaggatcgcgcagccaaggggtcactcgggacccagatcggcttcgctgacctgatgggcgtcctaacaaagggagtgcgggaggttgagcgtgccctgcagctgccacgtgagccaggggacagcgcccaattcactaaagcactggccataattcttcatctgctttatctcctagagaaagttgagtgcacacctagccaagaacatttgaagcatcagacagtctacagattactcaagtgtgctcctagagggaaaaatggctttactcccctgcacatggctgtggacaaagataccactaatgtgggacggtaccctgtgggaaggtttcctagcttacatgttgtgaaggttctgctggattgtggcgctgacccggattcgagggactttgacaataacacacctttacacatcgccgctcagaacaattgtccagccataatgaacgccctaatagaggctggggcacatatggacgctactaacgcgtttaagaagacagcatatgagctgctggatgaaaagttgttggctcgaggcaccatgcagcccttcaattatgtgacgcttcagtgtttggctgctcgcgctctggataagaacaaaataccttataagggattcattcctgaggacttggaggcttttattgagctacactag

SEQ ID NO: 27587 - DNA, 720 bp, Artificial Sequence
  Description of Artificial Sequence: Synthetic coding sequence
atggccgctacgttactagcagctcgtggagccggtcccgctccagcctggggcccagaagccttcaccccggactgggaaagtagagaggtttccaccggaacgacaataatggccgtgcagtttgatggcggtgtcgtgttgggtgccgatagcaggacgactacgggtagctatatagccaaccgagtgacagataaactgacccctatccatgacaggatattctgctgtcgctctgggagcgccgcagatacccaagccgtagccgatgctgtcacataccagcttgggtttcactccatcgaactgaacgagccacccctggtacacactgccgcatccctatttaaagagatgtgttatcggtatcgggaagacctcatggcgggaatcatcatcgctgggtgggacccacaggagggagggcaggtgtacagcgtccctatgggcggaatgatggtcagacagtctttcgccattggcggaagtggttcgtcttacatctacggttacgtagacgctacttatagagaaggtatgacaaaagaggagtgcctgcagttcaccgccaatgcactagctctggcaatggaaagagatgggagcagcggaggggttatcaggctcgccgctattgccgaatccggtgtggagcggcaagtcctgctaggagaccagatccccaagttcgctgtggccaccttacccccagcttag

SEQ ID NO: 27588 - DNA, 1383 bp, Artificial Sequence
  Description of Artificial Sequence: Synthetic coding sequence
atgaacttttctgaagtatttaaacttagctctctcctgtgcaaattctccccagacggtaaatatctggcctcatgtgtacaataccgtctcgtagtccgggatgttaatacactccagatcctgcagctgtatacgtgcctcgatcagatacagcatatagaatggtcggcagactcactgttcatactctgtgctatgtataaacggggactggtgcaggtgtggtccttggagcaaccagagtggcactgtaaaatcgatgaggggtctgctggactcgtcgcatcttgctggagtcctgacggcagacatatactcaacaccaccgagtttcatcttcgtattaccgtgtggtccttgtgcacaaaatccgtttcctacatcaaatatcccaaggcatgcctgcaaggtattaccttcacacgcgatggcaggtacatggctttggccgaaagacgtgactgtaaagattatgtttctatcttcgtctgttctgactggcaactcctccggcacttcgacaccgacacgcaggacctgacggggatagaatgggcccctaatggctgtgtgctggccgtgtgggacacctgtctcgagtacaaaattttactgtattctctggatggcagacttctttctacctactcagcttatgagtggtcactcggcattaaaagtgtcgcttggtctccgagctcacagtttctagcagtcggttcctacgatgggaaggttcgaatcctcaaccatgtgacatggaagatgatcacagagtttggtcacccagcagctattaatgaccctaaaatcgtggtttataaggaggcagagaaatccccccaactcgggctcggatgcctgtcctttcctccacctcgcgctggagctgggccactgccatccagcgagagtaagtacgaaatagccagcgtaccagtctcgttgcagactctgaagcctgtgacagaccgggctaaccccaagattggcattggcatgctggccttctccccagattcttactttctggccacaaggaacgataacatccctaacgcggtgtgggtctgggatatccaaaagctgcgtctgtttgcggtgctggagcagctttccccggtgcgtgcatttcagtgggacccccagcaaccaaggcttgccatctgcacaggagggtccagactgtatctgtggagccctgccggttgtatgtctgttcaagtcccgggagagggggattttgcagtcctgtcgttatgctggcacctttctggtgattccatggcactgctctcaaaggatcacttctgtctttgcttcctcgagacagaggctgtcgttggaacagcatgtcgccagctcggcggacatacgtag

SEQ ID NO: 27589 - DNA, 282 bp, Artificial Sequence
  Description of Artificial Sequence: Synthetic coding sequence
atgagtggccttcgagtctactcaacttcagtgacaggttcccgggagatcaaatcccagcagtcggaggttacaagaatcctcgacgggaagcggatacaataccagcttgtcgacattagtcaagataatgctctccgcgacgagatgcgggctttagccggaaaccccaaggccaccccacctcagatagtgaacggagaccaatactgtggtgattatgaactgttcgtcgaagcagtggaacagaacaccctgcaggagtttctgaagctggcttag

SEQ ID NO: 27590 - DNA, 1920 bp, Artificial Sequence
  Description of Artificial Sequence: Synthetic coding sequence
atgaacctcgaaaagttgtctaagcctgagcttttgacattgtttagtatcctcgaaggcgaattggaagctagggatcttgtgattgaagcactgaaagcccagcacagagacaccttcatagaggagcggtacggaaaatataacatttctgacccgctgatggcactgcagcgagacttcgagaccctcaaagaaaaaaatgacggcgagaagcagcctgtctgtacaaaccccctgagcatactcaaggtggttatgaaacagtgcaagaacatgcaggagagaatgctttcccagctggctgcagccgaatccaggcatcgcaaagttattctagatctagaggaggagcggcaacggcacgcccaggatactgctgagggcgatgacgtgacttacatgctcgaaaaggagcgcgaacgactaacccagcagctggagtttgaaaaatcgcaggttaagaaattcgagaaagagcaaaagaagctgagctctcagttggaagaagagcggagtcggcacaagcaacttagcagcatgctcgtgctggagtgcaagaaggctactaacaaagcagccgaagagggtcagaaggccggagaactgagtttgaagctcgagaaagagaaaagtcgagtttctaagctggaggaggagctggccgcagaaaggaaaagaggtttgcagaccgaggcccaggtagagaagcagctttcagagtttgatatcgaaagagaacagcttcgggcaaagctgaatcgcgaggagaaccgcacaaaaacgttaaaggaggagatggagagtttgaaaaaaatcgtgaaggacctcgaagcttcccaccagcatagttcgcccaatgagcagctcaagaagcctgtgacagtgtctaaagggacagcaacggaacccctcatgctgatgtcagtgttttgtcaaacggagtcctttccagcagagcggacccacggcagcaacattgccaagatgaccaacacgggacttccgggtccagccaccccagcctactcctacgcaaaaactaacggccactgtgacccagaaatccagaccaccagggagctcaccgctggcaataacgtcgagaaccaggtcccacccagggagaaatccgttgcactcgcacaagagaagccagtggaaaacggcggttgccccgtgggcattgagacgcccgtccctatgccctcccctctgagttcctcaggttcttctttaagcccctcctccacagctagctcctccctcacgtcatccccttgctcttcaccagtgttgactaagcgcctgctcggtagttccgcttcctctcccggatatcagagttcttaccaggttggcatcaaccagagatttcatgcggctcggcataagtttcagagccaggccgaccaagaccagcaggcctccggtctccaatcgccaccctcccgagacttgtcccctacgctgatcgataactcagctgcaaaacagctagcaaggaacactgtgacacaggtactttcgcgttttacaagtcagcaggggcctattaagccagtgtctccgaattcgtccccatttggcaccgactaccgcaatctcgccaacaccgctaaccccagaggggacactagccactctcctaccccgggtaaagtgtcaagtccattatctcccctgtctccaggtatcaaatcacccacgatcccgagggctgaacgtggtaacccaccacccattccgcctaagaaacccggactgacccctagcccttctgccacgactcctctcacgaagactcatagtcaggccgcttctctaacgacagccgaagacctggctagttcctgttcatcaaataccgtagtagccaatggtaaagacgtcgaactgctgctgcccacgagttcatag

SEQ ID NO: 27591 - DNA, 2487 bp, Artificial Sequence
  Description of Artificial Sequence: Synthetic coding sequence
atgcgttttcttgaggcgagatccctggctgtggcaatgggtgatactgttgtggaaccagctcctctgaagcctacttctgagcctacaagcggccctccaggaaacaatggcggttctctgctgagcgtaatcactgaaggcgtcggtgagctgtctgtgattgaccccgaggtggctcaaaaagcctgccaagaagtcctggagaaagtgaagcttctccacggtggggtagctgtatcatcaagggggacccctctggagctggtcaacggtgacggcgttgactccgaaatccgatgcctcgatgatcctcccgcacaaatccgggaagaggaagatgagatgggagccgcagtggcttccgggactgccaaaggagctcgacgacgccgtcagaacaactcggccaagcaaagttggttgctgcgcctgttcgagtctaagctttttgacatatcaatggccatatcatacttgtacaatagtaaggaacctggcgtgcaggcttacattggtaacagactgttctgtttcaggaatgaggacgtggatttctacctgccccaactgctgaacatgtatatccacatggacgaagatgtcggagacgctattaaaccatatattgtgcaccgctgcaggcagtccataaactttagcctgcagtgtgcactgttattaggtgcctattcttcagacatgcatatttccactcagcgccactcccggggtacgaagcttcgtaagctgatcctttcagacgagttaaagccagctcaccgcaaacgcgaactccctagcctgagccctgccccagatacaggtctcagcccgagcaagcgaacgcaccagcgttccaaaagcgatgccaccgcgtccatcagcctgagctccaacctgaagcggactgctagtaatcctaaagtcgagaacgaggatgaggagttgtcctcttctacagagtcgatcgacaatagcttctccagccccgttagattagctccggagagggaattcatcaaaagcctaatggccatcggcaaacggctggctacattgcccaccaaggaacagaaaacgcagagacttatttctgagctgagtctgctgaaccacaaattacccgctcgagtatggctgccaacagccggatttgatcatcacgtcgttcgggtacctcacacacaggctgttgttctgaactctaaagataaggctccgtacctcatttacgtggaggtcttggagtgcgaaaactttgacactaccagcgttccagcaaggatcccggaaaatcgcattagatccacccgatccgtggaaaacctgccagagtgcggaatcacccacgaacagagggccggatccttttcaactgtgccaaactacgataatgatgacgaggcttggtccgtggatgacattggagaactgcaggtagagcttccagaagtccacacaaattcatgcgataacatctctcaattttctgtcgattccatcactagccaggagagcaaagagcctgtgttcatagctgcaggcgatatcaggagacggcttagcgaacagctcgcccacacgcccaccgcgttcaagagagatccagaggatcctagcgccgtcgccctcaaggagccctggcaggagaaggtgcggcgtattcgagaaggctcaccttatgggcatttgcccaactggcgactgctcagtgttatcgttaaatgtggcgatgacctgaggcaggaacttctggcgtttcaggtgctgaagcagctccagtccatctgggagcaagagcgggtaccactttggattaaaccctataagatcctggtgatttccgccgacagtgggatgatcgagcccgttgtcaacgccgtgtccatacaccaggtaaaaaagcaaagtcagctgtccctcctggactactttctccaagaacatggatcgtacactactgaggcctttttgtccgcccagaggaacttcgtgcagtcatgtgctggatactgcttggtgtgttacctcctgcaggtgaaagatcgtcacaacggaaatatcttactcgacgccgaaggtcatatcattcatatcgattttggcttcattctgagtagttcccctcgtaatctggggtttgagacttctgctttcaagttgacgactgagttcgtcgatgtgatgggaggtctggatggagatatgttcaactattacaaaatgttgatgctgcaggggctcatcgctgcgaggaaacatatggacaaagtggtacagatagtagagattatgcagcagggatcccagctgccctgcttccacggttcttccacaatcaggaaccttaaagagcgcttccacatgtctatgaccgaagagcaactccaacttcttgtggagcaaatggtcgacggaagcatgcgttccattacgaccaaactctacgatgggttccaatatctaacaaatggtataatgtag

SEQ ID NO: 27592 - DNA, 4233 bp, Artificial Sequence
  Description of Artificial Sequence: Synthetic coding sequence
atggctgatactgacctctttatggaatgtgaggaggaggaactggagccttggcagaaaatttcagacgtcattgaagacagcgtcgtcgaggactataattctgtagacaaaaccacgacagtctctgtcagtcaacagccggtgtcggctccggtcccaatcgccgcacacgcctctgtggctggccacctgtcaactagcaccacagtgagctcgtctggcgcacaaaatagcgattccactaagaagaccctggtgacccttattgcaaataataacgcaggtaatccactggtccagcaaggcggacaacctctgatactgacgcagaatccagccccaggtttgggcaccatggttacccagcctgttttacgtcctgtgcaggtgatgcagaatgcaaaccatgtgacatccagccctgtggcttctcagcctattttcattactactcagggcttccctgtccgcaacgtgcgacctgtgcaaaacgcaatgaaccaggtgggcatcgtgctcaatgtgcaacaagggcagactgttaggccgatcaccctggtgcctgccccaggaactcaattcgtcaaacctacagtcggtgtgccacaggtattctctcagatgacaccagttcgtccaggctccacaatgccagtgcggcctacgacgaacaccttcaccactgtaatccctgctacactaaccatccgatccaccgtcccccaaagtcaaagtcagcagaccaagagcacgcctagcaccagcactacccctacagccacacagcccacctctttaggtcagctcgccgtgcagtcacctggccagagtaaccaaacaactaatcccaagctggccccaagtttcccaagcccacccgctgtctccatcgcaagcttcgtaaccgtgaaacgtcctggagtaactggagagaactccaatgaggtagccaaattagtcaacacccttaatactatacctagcttgggacagtccccagggcctgtggtggtgagcaataattctagtgcccacggatcacagaggacttcgggcccagagtcatctatgaaggttacgtcctccatccccgtgttcgatcttcaagatggcggtcggaagatctgtcctagatgtaacgctcaattcagggtgacagaagccttgcgtggccacatgtgctactgctgcccagagatggtcgagtaccagaagaaggggaaaagcctcgatagcgagccatctgtcccaagcgcagctaagcctccttcgcctgagaagacggcccctgtggcatctactccatcaagtactccaattccagcgttatcgccaccgacaaaggtgcctgaacccaacgaaaatgtaggggacgcggtacagaccaagctcatcatgttagtagacgacttttattatggccgtgatggaggaaaggtcgcacagctgaccaacttccctaaagttgctacttctttcagatgcccccattgtactaaaaggctgaaaaacaacatccgatttatgaaccacatgaagcatcacgtggagctggatcagcagaacggggaggtggacgggcacaccatatgccagcactgctacagacaattctcaactccctttcagctacaatgccacctggagaacgttcactctccttacgaaagcaccaccaagtgtaagatttgcgagtgggcattcgagagcgagcccctgttcttgcagcacatgaaggacacacacaagccaggcgaaatgccatatgtgtgtcaagtgtgccaatatagaagttctctgtatagcgaggtggacgtccacttccgcatgatccacgaggacaccaggcaccttctgtgtccttactgtctcaaggtctttaagaacggcaacgcttttcagcagcactacatgcgtcaccagaaacgaaatgtctaccattgtaataagtgtcggttgcagtttctgttcgcaaaagacaaaatcgaacataagctgcagcaccacaagacttttcggaagcccaagcagctagaaggactgaaaccgggaactaaagtgacaattcgggcttcccgtgggcagccacgaacagtgccagtttcatccaatgatacccccccttccgcactccaggaagcggctccgctgacaagctctatggatcccctacccgttttcctgtaccctcccgtgcagagaagcatccagaagagggcagtgagaaaaatgagcgtgatgggtcgtcagacatgcctggaatgttcctttgagattccagatttccctaatcactttcctacatatgtgcactgcagtttgtgtcgttactctacgtgttgttctagagcttacgctaaccatatgattaacaaccacgtccccagaaagtcgcctaagtatctggccctattcaagaacagcgtgagcggaatcaagctggcttgcacctcatgtacgttcgtaactagcgtgggtgatgctatggcgaagcacctggtgttcaatccatcccatcggtcctcctctatcctcccgaggggtcttacatggatagctcatagccgccatggacagacccgcgatcgtgttcatgatagaaacgttaagaacatgtaccccccaccgtcattccctactaacaaagccgcaactgtgaagtccgccggagctacccccgcagaacctgaggaactgctgactccactggcacccgctcttccctcgccggcttccacagccacgccacctccaacccccacacacccacaggcactggccttgccacccctggcaactgagggcgcagagtgtctgaacgtggacgatcaagacgagggatcccccgtgactcaagaaccagagctcgccagcggcggaggaggctcggggggagtaggaaagaaggaacaactgtccgtaaagaagctcagggtggtcctgtttgcactgtgctgcaatacagaacaagccgcagagcattttagaaacccacaacggcgtataaggagatggctcagaaggtttcaagcctcccaaggagagaacctggaaggaaagtatctgtcctttgaagctgaggagaagctggccgagtgggtgctgacgcagagagagcagcagcttcccgtaaatgaggagacattgttccaaaaagctaccaagatcggaaggagcctggaaggcggtttcaagatctcctatgaatgggcagtgagatttatgttgcgacatcacctgacgcctcacgccaggcgtgctgtcgcgcacacgttgcctaaagatgtggccgaaaatgccggactcttcatcgacttcgtacagcgtcagatacataaccaagacctgcccctcagcatgatagtagcgattgacgagatcagtctgttcctggacacggaagtgcttagctcagacgacaggaaagagaacgccctacagacggttggcacgggcgagccatggtgcgacgtcgtgctggccatactggccgacggcaccgtgttgcctacgcttgtcttctacagaggtcaaatggaccagcccgcaaacatgcccgacagcattcttctggaggctaaagaatctggttactctgacgacgagatcatggaactctggtctacacgggtttggcagaagcatactgcgtgccaacggtccaagggtatgctggtgatggattgccacagaacacacctgtccgaggaggtgctcgccatgttgtccgccagtagtactcttcccgcagtggtgccagcaggttgcagctccaaaatccagccccttgatgtgtgtatcaagcggaccgttaagaacttcttacacaagaaatggaaagagcaggccagagaaatggccgatacggcatgcgatagtgacgtgctactccagttagtgttagtttggctgggtgaagtactgggcgttattggagattgccctgagctcgtgcagcggagctttctagtggcgtctgtcctccccggaccggatggcaacatcaattctcctacgcgcaatgcggacatgcaggaagagctaatcgcctctctggaagaacagctgaaactgtcgggggagcactccgagtcctccacacctcgcccaagatcctcccccgaggagactattgaacccgagagccttcaccagttgtttgagggagagagcgagaccgagagcttttatggttttgaggaggctgacctggatctcatggaaatttag

SEQ ID NO: 27593 - DNA, 1488 bp, Artificial Sequence
  Description of Artificial Sequence: Synthetic coding sequence
atgccacagcttctccagaacattaatggtatcatcgaagccttcagacgttacgccaggactgagggaaattgcaccgccttgactagaggggaattgaagagactgctggaacaggagttcgccgacgtcatcgttaaaccacacgatcctgccactgtcgacgaagtgttacgcctgctggatgaggatcataccggcacagtggagttcaaggagtttctcgtcctggtgttcaaagtcgcgcaggcctgtttcaagactctgtcggagagcgccgaaggagcttgcgggtcccaggagagcggcagcctacatagtggagcctcccaggagctgggtgaaggccagaggagtggcacagaagtgggcagggctggtaaaggccagcactacgaaggcagctcacaccggcagagtcagcaaggatctagagggcagaatagaccaggagtccagacacaggggcaagccactggctcagcttgggtctcgtcctacgaccgccaggccgaatcacagagtcaagaaagaatttccccgcagatccagttgagcggccagactgaacagactcagaaagccggtgagggaaagcggaaccagaccaccgagatgcggccagaacggcagccacagacaagggagcaagatagggctcaccagacaggagagactgtaaccggatccggcacacagacccaagcgggagctactcagactgtggagcaggattcaagccatcaaaccggaaggactagcaaacagactcaggaagcaaccaacgatcagaacagaggcaccgaaacacacggccagggcagatcccagacgagtcaagccgtcaccggtggacacgcccaaatccaggctggcacccatacccagacacccacccagaccgtcgagcaggacagcagtcaccagactggtagcacgtcaacccaaactcaggagtccacaaacggccagaatcgcggaactgagatccatggacagggtcgatcccaaacatcccaggctgtaaccggagggcacacacagatccaggccggaagccacacagagaccgttgaacaagatcggtcccagaccgtgtcccatggcggagcgcgtgaacaaggccagacccagactcagcctgggtccgggcagaggtggatgcaagtatctaatcccgaagcaggcgaaacagtccctggcggacaggcccagaccggggcttcaactgaaagcggaagacaggagtggtcctctacccaccccaggcgctgcgtcacagagggccagggagataggcagcctacagtggtaggcgaggaatgggtggatgatcattcccgggaaacggtaatccttcggctggaccagggcaatttacatactagtgtgtcttctgcccaggggcaggacgcggcacaaagcgaggaaaagcgcggtataaccgcacgtgaattgtactcatatttgaggtctaccaagccatag

SEQ ID NO: 27594 - DNA, 1233 bp, Artificial Sequence
  Description of Artificial Sequence: Synthetic coding sequence
atgaatatgccatccacaccattagcgccaacaactgggaccgctacttgttcttggtcagcatctacctgcactactacgagacctgccgttcggcctccatcctttcctcatcggcctcccggaaatgctgctctgccaagccttatgccatcacgccctacacaggtcgccggacaatgcggcgcaggtaataattgggcgaaggggcactatacagaaggcgctgaattgatggaatccgtcatggatgttgtcagaaaagaggccgaatcttgcgattgcctccaaggattccagctcacccactcactgggaggagggacaggtagtggcatggggaccttattgctgagtaagattcgcgaggaataccctgatagaataataaacacgttctcaattttgccaagccccaaagtgtcagatacagtagtcgaaccatataatgccactctaagtgtgcatcagctgattgaaaacgctgacgagaccttctgtatcgataacgaagctctttatgacatatgctctaagacattaaagctcccaacgccaacttacggtgacctgaaccatctggtgtcagctaccatgtctggcgtgacgacgtgcctccgcttccccggacagctgaacgccgatctaagaaaactggccgtcaatatggtcccattccctcgactgcactttttcatgcccggttttgcccctctgacatctagagggagccaacaatacagggcgcttaccgtggccgagcttactcagcagatgttcgatgctaaaaacatgatggccgcttgtgacccacgccacggcagatacctgactgcagctgccatctttaggggacggatgcccatgcgcgaagtcgacgagcagatgtttaatatccaggacaaaaattccagttacttcgcagactggcttcctaacaatgtgaagacagctgtgtgtgacatccctcctcgcggattaaagatgagcgccacgttcattggtaacaatactgctatccaggagctttttaaaagagtgtccgagcaatttaccgctatgttccggagaaaagcattcctgcactggtatacaggtgaaggcatggacgagatggaattcacggaagcagagagtaatatgaacgacctggtctccgagtaccagcagtatcaggacgccactgcagaggaagaggaagatgaggagtacgccgaagaagaggtggcttag

SEQ ID NO: 27595 - DNA, 2106 bp, Artificial Sequence
  Description of Artificial Sequence: Synthetic coding sequence
atgggctcggccgcagatgtgaggttctcccttgggacaaccacacacgcgcctcctggcgtccacaggcgctacagcgcactccgggaagagagtgccaaggattgggagacctcgccactgcccggaatgcttgcccctgcagcagggccagcttttgactcggatccagaaattagcgacgtggacgaagatgagcctggagggttggtcggcagcgcagacgttgtctccccctcgggccactccgatgctcagaccttagctatgatgctccaggagcagttagatgctatcaatgaggagattagaatgatccaggaggaaaaggagtctacagaactgagggctgaagaaattgagacacgggtaactagcggctccatggaggcgctcaatctgaagcagcttagaaagagaggttccatacctacatctctgactgcattatcactcgcttctgcatcgccaccactctctggacgttccacgcctaaactgaccagccggtccgctgctcaggacctggacagaatgggagttatgacgctgccgtcagatttgcggaaacaccgtagaaagctgctgtcaccagtctcccgggaggagaatagggaagataaagcaacaatcaagtgtgagacctcgcccccatcatcccctaggaccctgaggttggaaaagctggggcaccctgctctgtctcaagaggaagggaaaagcgctctggaggatcaggggtccaatcctagctcctctaactcctctcaagattcgctccacaaaggggctaaacggaaaggaatcaagtcttccataggtcgcctgtttggaaaaaaagagaaagggcgattaatccagttatccagggacggcgctaccgggcacgtacttctcactgacagtgagttctccatgcaggagcctatggtgcccgcaaaactgggaacgcaggctgagaaggatagacgcttaaaaaagaagcaccagttactggaagacgcacgcagaaagggtatgcccttcgctcagtgggacggacctacagtggtaagttggttggaactctgggtcgggatgcccgcatggtacgtggccgcatgtcgtgctaacgtaaaatcaggggctatcatgtctgccctgtccgacaccgaaattcagagagaaattgggattagcaatgctctgcacagattgaaacttcggttggccatacaggagatggtgtccctcacctcaccttccgcccctcctacatctaggacttcttccgggaatgtttgggtgacacacgaggagatggaaactctagagacctccactaaaaccgacagcgaagaaggtagttgggctcagacgctagcctatggggatatgaatcacgagtggataggaaatgagtggctgcccagcctgggtctgccccagtatcgatcctacttcatggaatgtcttgtggacgctcgcatgctggaccatctcaccaaaaaagatcttagggtccacctgaagatggtcgattcattccaccggacaagtctgcaatacggcataatgtgcttgaagcgcctgaattacgaccgaaaagagctggaaaagagacgggaagaatctcagcacgagattaaagacgtgctggtgtggaccaacgaccaagtggtgcactgggtccagtcgatcggcctcagagactacgctggtaacttacatgagtccggcgtgcatggtgcactgttggcactggacgagaactttgatcacaatactcttgcactcatcttgcagattcctacccagaatacacaagcgaggcaggttatggagagggagttcaataacttattagcgctcggaacggaccggaaactcgatgacggagatgataaggtgttcagacgagcaccttcgtggcgtaaacgttttagaccaagagaacatcatggtcggggaggaatgctgtccgcctctgccgaaacccttccagctggtttccgcgtttctaccttaggaactctccagcccccaccggcacctccaaaaaaaatcatgccggaagcacattcccattacctgtacggccacatgctcagcgcctttagagattag

SEQ ID NO: 27596 - DNA, 1029 bp, Artificial Sequence
  Description of Artificial Sequence: Synthetic coding sequence
atggcatccgtgacacgggctgtttttggtgagttgcctagtggtggcggaacagtcgagaagttccagctacagtctgacttattaagagtagatatcatctcctggggctgcactataaccgcattggaggtcaaagacagacagggaagagcctccgacgtcgtcctaggtttcgctgagctggaaggatatctacaaaagcagccctattttggggcagttatcggccgagtggcaaacagaatcgcgaagggaactttcaaggtggatggaaaagagtatcacctggctatcaataaagaacctaacagcctccatggcggtgtgcgaggattcgacaaggtgctgtggactcctagggtcctgtctaacggggtgcagttctccaggatctcacctgacggagaggagggatatcctggagagctgaaagtgtgggtaacttacaccctcgacgggggtgaattgatcgtgaactatcgagcccaggcctcccaggccacccctgtgaatctcaccaaccactcttatttcaacttagccggacaagctagtccaaacattaatgaccacgaggtgacaattgaagcagatacctatctcccagtcgacgagaccctgatacctacgggcgaagtggcacccgtccaagggaccgcctttgacctaaggaagccggtggagttaggtaagcatctgcaggattttcacctcaacggtttcgatcataatttttgccttaaagggagcaaggagaagcacttctgcgctagggtgcatcatgcagcttcggggagagtgctagaagtatataccactcagcctggcgtccagttctatacaggcaattttttagatgggacactcaaaggaaagaacggcgcagtctatcccaaacacagcggattttgtctagagacccagaattggccagacgccgtgaatcagcctcgatttcctccagtgttattgcgcccaggagaggagtatgatcataccacctggtttaagtttagcgtcgcctag

SEQ ID NO: 27597 - DNA, 2295 bp, Artificial Sequence
  Description of Artificial Sequence: Synthetic coding sequence
atgtccgacacacgccgacgcgttaaggtttatacacttaacgaagatagacagtgggatgaccgtggaaccggacatgtctcttccacctacgtcgaagaattaaagggcatgagtcttctggtgagggccgagtcagatgggtccctgctactagagagcaaaatcaacccaaacacagcataccagaaacagcaggatacccttattgtctggtcagaagcggaaaactatgacttagcactcagctttcaagagaaggccggttgtgatgaaatctgggaaaagatctgtcaggtacaaggcaaagatccctccgttgaggtgacccaggacctcattgacgaatctgaggaagaacgatttgaggaaatgccggagacctcacacctgatcgacctccccacatgtgaattgaataagctagaggagattgctgatctggtgacatccgtcctctcatctccgatacgtcgggaaaagctagctctcgcattagaaaacgagggctatatcaaaaaacttctacagctgtttcaggcctgcgaaaacttagaaaatacagagggcctgcaccacttatacgagattattcgaggaatcctgtttctcaacaaagccactctgtttgaggtgatgttcagtgacgaatgtatcatggatgtggtggggtgcctggagtatgatcctgccctggcacagcccaagcgtcatagagaatttctgacgaagaccgcgaagtttaaggaagtcatacctattacagattcagagctgcggcagaagattcatcagacctaccgggtgcagtatattcaggatatcattctcccaactccaagcgtgttcgaagagaattttctcagcaccctgactagcttcatcttctttaataaggttgaaattgtgagtatgcttcaggaagatgagaagttcctgtccgaggtttttgctcaactgactgatgaggcgacagacgacgacaaacggagggaactcgtcaatttttttaaagagttctgtgcattcagccagaccctgcaaccacaaaatagggacgccttctttaaaactttggccaagctcggcatcctacccgctcttgagattgtaatgggaatggatgacctgcaggtgagatctgcagccaccgatatcttctcatacctggtggaattctcgcccagcatggttcgtgaatttgtgatgcaagaggcccagcagtcagacgatgacatcctcttaatcaatgtggttatcgaacagatgatctgtgacactgatccagagctgggcggagctgtgcagctcatggggctcctgcggaccttgattgatcccgagaatatgcttgctactaccaacaagaccgaaaagtctgaattcctgaacttcttttataaccattgtatgcatgtactgaccgcccctctccttaccaatacatctgaagataaatgcgaaaaagataatatcgtgggcagcaataagaataacaccatatgcccgggtgcattgagatttatgcgacggataatcgggctgaaagatgaattttacaatcgctatatcacaaaggggaacctgtttgaacctgtgatcaatgctcttcttgacaacggtactagatacaacttgcttaattccgcggtgatcgagttgtttgaatttatcagagtggaagacataaaaagtctgactgctcacattgtggaaaatttttataaggcactggagtctattgagtatgtacagaccttcaaagggcttaagaccaagtatgagcaggagaaggaccggcaaaaccagaaattgaatagcgtgccttcaatcttacggtctaatcgattccggcgagacgccaaggctctggaggaagacgaagaaatgtggtttaacgaagacgaagaagaagagggaaaggcagttgtggcgcctgtagaaaagccaaaaccagaagacgattttcctgataattacgagaagttcatggagactaaaaaagccaaagagagcgaggataaagaaaacttgccaaaaaggacctcaccaggcggattcaagtttacattttctcactctgcgtctgcagctaacggaacaaacagcaaatcagtcgttgctcaaatacccccagctacctcaaacggctctagtagtaagacaacaaacctgcccacctcagttacagcaacaaagggctctctggtcggtctagtggactatcccgacgacgaggaagaggatgaagaggaggaatcaagcccaaggaagcgaccaagactggggtcatag

SEQ ID NO: 27598 - DNA, 231 bp, Artificial Sequence
  Description of Artificial Sequence: Synthetic coding sequence
atgtctaaggcacacccaccggagctcaaaaagtttatggataagaagcttagcctgaaattaaacggaggcagacacgtccagggaatcctgagaggatttgatccctttatgaacctcgtgatcgacgagtgtgtcgagatggccacgagtggtcagcagaataacattggcatggtagtgattcggggtaacagtatcataatgctggaggccctggaaagagtctag

SEQ ID NO: 27599 - DNA, 528 bp, Artificial Sequence
  Description of Artificial Sequence: Synthetic coding sequence
atgcagctgactcaccagttagacttatttcccgaatgtcgggtaactctgcttctttttaaggacgtaaaaaatgccggtgacctgcgcagaaaagcaatggaggggaccatcgacggctccttgattaaccccactgtgatagtcgatcctttccagattttggtcgccgctaacaaagcagtccatctatacaagctgggtaagatgaagactcggacattgagtacagagatcatttttaacctctcacctaacaacaacatatctgaggccctgaaaaagttcggtatctccgctaacgataccagtatcctgatcgtctacatagaggagggggaaaaacagataaaccaagagtatctgataagccaggtggaggggcatcaggtgagtctcaagaatctaccggagataatgaatattacagaggtgaagaagatatataaactgagctcccaggaggaatcaataggcacacttttagacgctattatttgccgtatgagcacaaaagatgttctgtag

SEQ ID NO: 27600 - DNA, 909 bp, Artificial Sequence
  Description of Artificial Sequence: Synthetic coding sequence
atggctctgcacgatatggaggattttacctttgacgggacaaaaaggctgtcagtgaattacgtcaaaggtattttgcagccaacagatacttgcgacatatgggacaagatatggaatttccaggctaagcccgacgacctcctcatttcgacttacccaaaggccggaaccacatggacgcaggagatcgtagagctaatccagaacgagggagatgtggaaaaaagcaaaagggctccaacacatcagaggttccccttcttggaaatgaaaatcccgtctctaggtagcggacttgagcaagctcatgccatgccaagtcctagaattctaaagacccatctgccttttcaccttcttcccccatccctccttgagaaaaattgtaagatcatttatgtagccaggaatccaaaagacaatatggtttcttattaccacttccagcggatgaacaaagccttgccagctccaggcacctgggaagagtactttgaaacattcttggctgggaaagtgtgttgggggagctggcacgaacatgtgaaagggtggtgggaggcaaaagataaacataggattctttatctgttctacgaggacatgaagaaaaatcccaaacatgagattcagaagctggctgaatttataggcaaaaagctggacgataaagtgttagacaagatcgtccactatacaagcttcgatgtcatgaagcagaaccccatggctaactacagttccattcctgccgagattatggaccacagcatctcgccttttatgaggaagggcgcagtgggtgattggaagaagcatttcacagtagcgcagaatgaaagattcgatgaagattataaaaagaaaatgaccgacacgcggttgaccttccacttccagttttag

SEQ ID NO: 27601 - DNA, 2892 bp, Artificial Sequence
  Description of Artificial Sequence: Synthetic coding sequence
atgtggtgcttgcattgcaattctgagagaactcagagcctattggagttggaattggattccggcgtggagggagaagcaccatctagcgaaaccggtactagtcttgacagtccttccgcttatccgcaaggccctcttgtccctggatcgtccctgagtcccgatcattatgagcataccagcgtgggagcttacggactttactcagggccaccagggcagcaacaaagaaccagaaggcctaagttacagcacagcacctcaatcctgcggaagcaggcagaagaagaggcaattaagcggtcgcgatctctcagtgaatcatatgagttgagctctgacctccaggacaagcaagttgagatgctggagagaaaatatgggggacgcttggtcacacgccatgcagcaagaaccatacaaacagccttccgccagtatcagatgaacaagaactttgagaggcttcggagtagcatgtccgaaaatcgcatgtcaagacgcatcgtcctcagcaatatgaggatgcagttctcgttcgagggtccagaaaaggtgcatagttcctattttgagggcaaacaggtgtcagttacaaacgatggctcccagctcggcgcacttgtgtcccccgaatgcggcgatctttcagagcccactacacttaagtccccagccccttcttccgacttcgctgacgccatcaccgagctggaggacgcattcagccgccaagtgaaatccttagcagagagcatcgatgatgccctcaattgtcgcagcctccacaccgaggaggcccctgccctggatgccgcacgcgcaagagatactgagccgcaaactgccctccatggcatggaccatagaaaactggacgaaatgacggccagctactcagatgttaccctgtatatcgatgaagaggaactgtccccacctctaccactgtcccaggcaggagaccggccttcaagcactgaatccgacctgagactgcgggcaggaggagctgctcccgactactgggctctcgctcacaaagaagacaaagcggatacagatacatcctgccgctccacgccaagcttggaaagacaagaacagagactgcgtgtggagcatctcccccttctcacaatcgagcccccatcagacagcagcgtcgacctatcagataggagcgaacggggaagtttgaaaaggcagagtgcttacgagagatcactgggaggacaacagggcagccctaagcacgggccacattctggagcaccgaaatctctgcctcgcgaagagcctgagctgcggccacgcccacccagaccactcgacagccacctggctataaacggcagcgcaaatcgccagtccaaaagcgaaagcgattactcggatggggacaatgatagtattaacagcacttcaaattcaaacgacactattaattgctcatccgaaagttcctccagggattctctgcgggagcagacgctgagtaagcaaacttatcataaggaggctagaaatagttgggacagcccagctttctcaaatgacgtcataagaaagagacactatcgcatcggtctgaacctgttcaacaaaaagccagagaaaggggtgcagtacctgattgaaagggggttcgtaccagatacaccagtcggcgtggcccatttcctcctgcaacgcaagggcctgtctcggcagatgatcggagagttcctgggtaaccggcaaaaacaatttaaccgcgacgtcctagattgtgttgtcgatgagatggatttcagcacaatggagttagacgaggcccttaggaagtttcaggcacatatccgggttcagggcgaagctcaaaaggtggagaggctgatcgaagctttctcacaacgctactgcatatgcaatccaggtgttgttcgccagttcagaaacccagacactatctttattctagccttcgcaattatactgctgaacacggacatgtattcaccaaacgtgaaacctgagcgtaaaatgaagctcgaggatttcataaaaaacttgcgtggggtggacgatggggaggatatcccacgggaaatgctcatgggaatctacgagcggataagaaagcgagaactgaagacaaacgaagaccatgtaagccaagtgcagaaggtcgagaaactgattgtaggaaaaaaacctataggcagtctccaccccggactgggctgtgtgctctcactcccacatcggaggctggtgtgttattgccgcttgtttgaggtgccagaccctaacaaacctcagaagctggggcttcatcagagagagattttcttgttcaatgaccttcttgtcgtgacaaagatatttcaaaaaaaaaagaacagcgtcacatattcctttagacaaagcttctccctgtatggcatgcaggtgctactgttcgagaatcagtactaccctaatggaattaggctgacttcttcggtgccaggagccgacattaaggttctcattaatttcaatgcccctaatccccaagacaggaaaaagttcaccgacgacttgcgggagagtatcgctgaggtgcaagaaatggagaaacaccgcatcgagtcggagttggagaagcagaagggtgtggtcaggccttccatgtcccagtgcagtagcctgaagaaggaaagtggcaacggcaccttgtcccgagcttgtctggatgactcctacgccagcggcgagggtcttaagagatctgccttgtcctcctccctacgggatctgtcggaagcgggaaaacgcggaaggagatccagcgccggttccctggaatcaaatgtggagttccaaccctttgaaccccttcagccctctgttctgtgcagctag

SEQ ID NO: 27602 - DNA, 711 bp, Artificial Sequence
  Description of Artificial Sequence: Synthetic coding sequence
atggcaagccttgacagagtgaaggtactggtcctgggggactctggggttggaaagagttctctagtgcacctgctttgccagaaccaggtgctgggcaacccatcatggacagtgggctgcagcgtggacgtgcgagtgcacgactacaaagagggcactcccgaagagaaaacttactacatcgagctctgggacgtggggggatccgtagggagtgctagttccgtaaaatccacgcgcgctgtcttctacaacagtgttaatggcatcatcttcgtccatgacttgactaataaaaagagttcccagaatctgcgccgatggagcctggaagcgctgaatagggacttagtgcctacgggagtcctcgttactaatggcgactacgaccaggaacagttcgctgacaaccaaattcctctgctcgtgatcggaacgaaactggaccaaatccacgaaactaaacgtcacgaagtcctcacaaggacagctttcctcgcggaagattttaatccagaagagataaatctggactgtacaaatcctcggtacctggccgctgggtctagtaacgctgtcaagttgagcagattcttcgacaaagtcatcgaaaagcggtactttctccgggagggcaaccagattcccggatttccagaccgcaagaggtttggcgcaggcaccctcaaaagtttgcactatgactag

SEQ ID NO: 27603 - DNA, 2784 bp, Artificial Sequence
  Description of Artificial Sequence: Synthetic coding sequence
atgcaaagcatcctgtaccatgggctgattagggaccaggcttgtaggcgtcagaccgactattggcagttcgtgaaggatattagatggctcagcccacacagtgccctacacgtggagaaattcatctccgtccacgagaacgaccagagttccgctgatggtgcttccgaacgtgcagtcgctgagctctggctgcagcacagtttacagtaccactgcttatccgctcaactgaggcctctactgggagatagacaatacattaggaaattctacactgatgccgcattcctgctgagcgatgctcacgtaactgcgatgttacagtgtctcgaagctgtggagcagaataatccacgactcttagcacagatcgatgcatctatgttcgcaagaaagcacgagagcccactcctggtgactaagagccagtccctgacagccctgcccagcagtacctataccccccctaatagttatgcgcagcattcttacttcggatcctttagctctctgcatcagagcgtgcctaacaacggctcagaaagaagatccacctcattccctctgtcaggtccgccacggaagccccaggagtctagaggacatgtgagccctgctgaggaccagaccatccaggccccacctgtctctgttagtgcactcgcacgcgatagtcctctgacgcccaatgagatgagtagctctaccttaacaagtcctatcgaggcgtcctgggttagctcccaaaatgactctcccggagacgccagtgagggtcccgaatacttggcaataggaaatcttgatcccagaggaagaacggccagctgccagtcacattcatcaaatgcggaatcatcaagctctaatctgttctcaagtagtagcagccagaaacccgacagcgccgctagctcactgggcgaccaggaggggggaggtgagagccaacttagcagcgtattgagacgctcctcattcagcgaagggcagacactcactgttacatctggcgctaagaaatctcacattagatcacacagtgacaccagcatcgccagtcggggagccccaggtggaccacgcaacattacgatcatcgtggaagacccgatcgcagagtcgtgcaacgacaaagcaaaactccgcggtcccttaccctacagtggccagagtagcgaagtttcgacaccttcttcgctgtacatggagtatgaggggggtcggtacttatgttctggggagggcatgttccgcagaccctcagaaggtcagagtctgatttcctacctgtccgagcaggacttcgggagttgcgccgacctggaaaaagaaaacgctcacttttcaatcagcgaatccttgatcgcagccatcgaactgatgaaatgcaacatgatgagtcaatgcctcgaggaagaggaggttgaggaagaagactctgatagagaaatccaagagctgaaacagaagatccggctgcgcagacagcagatcaggaccaagaatctattgcctatgtaccaagaggcagaacacggatcatttcgggtgacctcttcttccagccagttttcttccagagacagcgcccagctatcagactctggatccgcggatgaagttgacgaattcgaaattcaggacgccgatattcgcagaaatacagcatcctcgagcaaatcattcgtctcctcgcagtcattttcccattgctttctccactccactagcgcggaggctgtggcgatgggacttctgaagcaattcgaggggatgcagctgccagcagcatcagagctcgaatggctagtcccggagcacgatgccccacagaaactgttgcccatccctgactcactacccatttctccagacgacggacagcatgcggacatctataagctgagaattcgggtgcgaggaaatttagaatgggctcccccacggcctcaaattatcttcaacgtgcatcctgctccgacacgcaagatcgccgtcgctaaacaaaattatcggtgtgcaggatgcgggatcaggacagacccagactacattaaacggctcaggtattgcgagtatctgggcaaatacttttgccagtgctgccacgagaacgcgcagatggccatcccgagccgagtgctccgcaaatgggatttttccaagtattacgtcagtaacttttccaaggatcttctgattaaaatctggaacgatcccttgtttaatgttcaggacattaactctgctctgtacagaaaggtaaaactgctgaatcaagtgaggttgttacgggtgcaactgtgtcatatgaaaaacatgtttaaaacttgccgcttggctaaggagttgctagattcattcgatacagtcccgggacatctgactgaggaccttcacctgtattcactcaacgaccttacagccacgcgaaagggagaacttggtccaaggctggccgaactgacaagggccggagctacgcacgtggagcgatgcatgctgtgtcaggctaagggcttcatttgtgaattctgccaaaacgaggacgacatcatttttcccttcgagctgcacaaatgccgtacatgtgaggaatgtaaggcatgttaccataaagcatgtttcaaatcaggatcttgcccgcgttgtgaacggctgcaagctcggcgtgaagcactcgcgaggcaatctctggaaagctacttgagcgattacgaggaggagccagccgaggccctcgccctagaagcagcagtactcgaagctacatag

SEQ ID NO: 27604 - DNA, 300 bp, Artificial Sequence
  Description of Artificial Sequence: Synthetic coding sequence
atggcaagcgcctcagcacggggtaatcaggataaggatgcccacttccctccaccatctaaacaaagtttattattttgccctaaatctaaattgcacattcaccgggcagagattagtaagatcatgagagagtgtcaggaagagtcattttggaagcgcgctctgcccttctccctcgtttctatgctagtgacccagggcctggtctatcagggatatctggccgcaaattcaagattcgggagccttccaaaggtagctcgcactgcttctctgccagttcggaacgctaaatag

SEQ ID NO: 27605 - DNA, 786 bp, Artificial Sequence
  Description of Artificial Sequence: Synthetic coding sequence
atggttgtcttaagcgtgcccgcagaggtgacagtgattctcctagacatagaagggaccactacccccatagcctttgtgaaagacatcctgtttccttacatcgaggaaaacgtgaaagaatacctgcagacacattgggaagaggaagagtgccagcaggatgttagtctgctgcgcaagcaggcggaggaagatgcccatttagacggggcagtccccatccccgctgcctcaggcaacggtgtggatgacttgcagcagatgattcaagcagtggtggataatgtttgctggcagatgtcactggaccggaagactacggccctcaagcagctgcagggacacatgtggcgcgcagcatttactgccggacgcatgaaggctgagttcttcgcagacgtcgtaccagccgtccgcaaatggagagaggcagggatgaaagtctatatctattcctcaggcagcgtagaagcccaaaagttattgttcgggcacagcaccgaaggagatattctggagctcgtggatggacattttgatactaaaattgggcataaagtggagagcgagtcttatcggaagatcgctgatagcattggctgctccacgaacaatatcctgtttttaacagacgttacccgtgaggcctctgcggctgaggaagccgacgtgcacgtcgcagtcgtggttcggcctggtaatgcaggtttgactgatgacgagaagacttactactccttgatcaccagctttagtgagctgtatctgcccagtagcacttag

SEQ ID NO: 27606 - DNA, 1188 bp, Artificial Sequence
  Description of Artificial Sequence: Synthetic coding sequence
atggccgaggatggcctgccaaaaatctacagccaccctcccacggagtccagcaaaacccccactgctgctactattttctttggagccgacaatgcaatccctaaaagtgaaactacaattacttctgaaggtgatcacgtgacaagcgttaatgaatacatgttggaatctgatttctcgaccaccaccgataacaagttgactgcaaagaaggagaaattaaaatcggaagatgacatggggaccgacttcattaaatcgaccactcacctgcagaaggagataacttccctgactgggaccacgaacagtataacacgtgattcaattactgagcactttatgcctgtgaagataggtaatataagctctccagtcaccacagtgtccctaatcgatttcagcaccgatatcgccaaggaggatattttgctggctacaatcgatacgggcgatgcggaaatttctattacctccgaggtgtcaggcacacttaaggactcaagcgccggtgtggccgacgctccagccttcccccgtaagaaggacgaggcagacatgagtaactacaattcttctatcaagtcgaatgtgccagctgacgaagctgtgcaagtgaccgattccactatccccgaggcagaaatccccccagcacctgaagaatccttcaccacgatccccgatatcacggcactggaggaggaaaagatcaccgaaatagatctgagcgtgttggaagatgacactagcgctgtggccaccttgactgactcagacgaaaaattcatcaccgttttcgaactgacaacctctgcggagaaggacaaggacaagagggaggatactttgttgaccgatgaggagacaaccgaaggcgcttccatctggatggagagagacactgctaatgaagcggagacacacagcgtgctgctgaccgcggtagaatctcggtacgacttcgtggttcccgctagcattgctaccaacttggtggaagagagctctactgaagaagacctctctgaaactgataatacagagaccgtgcccaagattaccgaacccttttcggggacgacatctgtgttagacaccccggattacaaagaggatacctctacgactgagaccgacatttttgagttgctgaaggaggagcctgatgagttcatgatctag

SEQ ID NO: 27607 - DNA, 921 bp, Artificial Sequence
  Description of Artificial Sequence: Synthetic coding sequence
atgtacttttgttggggggcagattcccgggagctgcagcgcagaagaacggctggcagtcccggtgcagaactgctgcaagcagcctctggagaacggcattccctgctccttttgacaaaccaccgagtgctgtcttgcggcgacaactctcgcggtcaactcggccgaagaggggctcaacgcggagagctccctgagccgattcaggcattggagacactcattgtggatctggtctcttgcgggaaagagcacagccttgctgtctgtcataaaggacgggtgttcgcctggggtgccggaagcgagggacagctgggtattggagaatttaaagagataagcttcacgcctaaaaaaatcatgacattaaacgatattaagattatacaggtcagttgtggacactatcacagcttggctctcagtaaagactcccaggtcttttcttgggggaagaattcccatggccagttagggctggggaaggagttcccgtctcaggctagcccacagcgcgtccggtccctagagggcatacccttggctcaggtcgctgccggtggagcacactccttcgctctgagtctgtgcggaacctcattcggctggggatccaactctgctggccagctggctttgtctgggaggaacgttccagtgcaaagtaacaagcccttgtctgtcggagcgcttaagaatttaggagtcgtgtatatctcctgtggcgacgcacacacagctgtgctgacccaggacggcaaggtatttaccttcggagataaccggtcgggacagcttggttacagcccaactccggaaaaaagaggcccacagttagtcgagcgaatcgacgggctggtgtcccagatcgactgtggcagaaatagcaagcatggatttatgacctttttttag

SEQ ID NO: 27608 - DNA, 909 bp, Artificial Sequence
  Description of Artificial Sequence: Synthetic coding sequence
atgggaaactgttgttggacccagtgtttcggccttctgcgaaaggaggccggacgacttcagcgtgtgggcggagggggaggcagcaagtattttcgcacctgtagcaggggagagcacttgacgattgagttcgagaacctggtagagtcggacgaaggcgagagtcctgggtcctcccataggcctttaaccgaggaggagatcgttgatctcagagaacgccactacgacagtattgctgagaaacagaaagatctggacaaaaagatccagaaagagctggccttacaggaagagaagttaagactggaagaagaggctctatacgctgcacagcgcgaagccgcacgtgctgcgaaacaacggaaactgctggagcaagagcggcaacgcattgtgcagcagtaccacccgtctaacaacggggagtatcagagttccggccctgaggatgactttgaatcatgcctccgtaacatgaagtcacagtatgaggtctttaggagctcacgcctgtcatccgacgccaccgtgcttacacctaataccgaaagcagctgtgatctgatgaccaaaaccaagagtacgtctggaaacgatgattctacctccctggatttagagtgggaagacgaagagggcatgaacaggatgctcccaatgagagagaggtccaagactgaggaggatattctacgcgcagccctgaaatatagtaacaagaagacaggctcaaatcccaccagcgcctcagatgactccaatggtctggagtgggagaacgatttcgtgagtgccgagatggacgacaacgggaatagtgagtattcaggctttgtcaatccggtgctcgaactgtcagattcagggatccggcattctgataccgatcagcaaacccgatag

SEQ ID NO: 27609 - DNA, 1641 bp, Artificial Sequence
  Description of Artificial Sequence: Synthetic coding sequence
atggccaccttggtggtgaataaactgggagccggtgtagattcaggtcgccagggtagtcggggtacagcggtggtaaaagtgctggagtgcggcgtctgtgaggatgtattttccctgcagggcgataaggttcctcggctgctactctgcggccacaccgtatgccatgattgcctcacacgactcccattgcatggcagagccatccgatgtccgtttgataggcaagttactgatttgggcgatagcggcgtgtggggcctcaaaaagaacttcgcgctcctggagctgttagagaggttgcaaaatggtcccattggacaatatggagccgctgaagaatcgatcggcatttcgggcgaaagtatcatccggtgtgacgaggatgaggctcacctggcctcagtgtactgcaccgtgtgcgccacccatctctgttctgaatgcagccaggttacacactcaaccaagaccctggcaaagcaccgcagggtgcctctggcggacaagccccacgagaaaacaatgtgttcccagcaccaagtccatgcgatcgagtttgtctgtttggaggaggggtgtcagacatctcctctgatgtgctgtgtgtgcaaagagtacggtaagcaccaagggcataagcacagcgtgttggagcctgaggcaaaccagattagagcctcaattctcgacatggcccactgcattcgaacttttaccgaggaaatttcagattactctaggaagctcgtggggatcgtgcaacatattgagggaggggaacagatcgttgaggacggcattggcatggctcatacggagcatgtcccaggcaccgccgagaatgcacggagttgcatacgtgcctatttttatgatttacatgagacactctgccggcaggaggagatggcactgtccgtggttgacgcccacgtccgcgaaaagttgatctggctgcggcagcaacaggaggatatgaccatcctgctgtcggaggtgagcgccgcatgcctccactgcgagaagaccctacaacaggacgactgtcgagtcgtgctggcaaagcaggagatcactaggctgctggaaacgcttcagaagcaacagcagcagtttactgaagtcgcagatcacattcagctggatgccagtatcccagtaacgtttaccaaggacaatcgagtgcatatcggtccaaagatggaaatccgggtggtcacactgggcttagatggcgcaggaaagactaccattctgttcaagcttaagcaggatgaattcatgcaacctattccgacaatcggatttaacgtggagaccgtggagtataagaacctgaagttcaccatctgggacgtgggaggcaagcataagcttcggccactctggaagcactactacctgaacacacaggcggttgtgttcgtggtggatagtagccatagggacaggatctcagaggcacactccgagctagccaagctgttgaccgaaaaggagttgcgagacgctcttttgctaatttttgctaacaagcaggacgtggccggtgcgctcagtgtggaagaaataaccgaactgctgagcttgcataagttatgctgtggacgatcatgtttctctgataatatgtag

SEQ ID NO: 27610 - DNA, 609 bp, Artificial Sequence
  Description of Artificial Sequence: Synthetic coding sequence
atggcggtacctgctgccctaattctgagagaatctcctagcatgaagaaggccgtatcactgataaacgcaattgacactggaagatttcctcggctgctaacaagaattctgcagaagctacatttaaaagccgagagcagcttctccgaagaggaagaagaaaagcttcaggccgcattctctttagagaagcaagatctccacctggtattggaaactatctcttttattctcgaacaagctgtttatcacaacgtgaagcccgctgcccttcaacagcaattggagaatatccacctgaggcaggacaaggcagaagcctttgtgaatacttggtcttcgatgggacaggaaactgtagaaaagtttcggcaacggattctggccccatgcaagctggagacagtaggatggcaactgaatttacagatggcccacagcgcccaggctaaactcaagagccctcaagctgtgctgcagctgggtgttaacaacgaggactctaagtctcttgagaaggtcctggtcgagttctctcacaaagagctctttgatttctataacaagcttgagaccatccaggcccagctggacagtctgacctag

SEQ ID NO: 27611 - DNA, 1521 bp, Artificial Sequence
  Description of Artificial Sequence: Synthetic coding sequence
atggaggctgatattattacaaaccttcgctgcagactgaaggaagcagaggaggagagactgaaagcagctcagtacgggttgcagctcgttgagtctcagaatgaactccagaaccaactcgacaaatgtaggaacgagatgatgaccatgactgagagctacgagcaagagaagtacacactccagcgagaggttgaactcaagtcacggatgctggagtccctgagttgtgagtgcgaagccataaaacaacaacagaaaatgcacctcgagaagctcgaagagcagttgagccggtctcacgggcaggaggtcaatgaactgaagaccaagattgagaagctgaaggtggaacttgacgaggccaggctttccgaaaagcagctgaaacaccaagttgaccatcagaaggagctcctgtcttgcaaatccgaggaactgagggtgatgtcagagagggttcaagaaagtatgtcttctgagatgcttgctttgcaaattgagctgaccgaaatggaatctatgaaggtgaaatatcagagcctgaaaaagcaaaatgtgtttaatcgtgaacagatgcaacgaatgaaactccagatcgcaaccctgttgcagatgaagggaagccagactgaatttgaacagcaggagagattgttggccatgttagagcagaaaaatggggaaataaagcacctcctgggcgaaatccgaaatctggaaaagtttaagaacctgtatgattcaatggagtcgaagccctccgtggattcggggaccttggaagataatacatattataccgacttgctccagatgaaactggacaatctcaataaagaaatcgagagcacaaagggggagctgtctattcagcggatgaaagccttgtttgaaagccagcgagctctagacatcgaaagaaagctgttcgccaatgaacggtgcctccagctgtcggaaagtgagaacatgaaacttcgtgccaagcttgacgagctaaaactgaagtatgagccggaggagactgtggaggttccggtcttaaagaagcggcgtgaggtgctgccagtggacatcacaactgcaaaagatgcatgcgttaataattcagcgcttggtggagaagtgtatcgactccctccccaaaaggaggaaacccaatcttgccctaactcacttgaagacaacaatctgcaactggagaagagcgtgtccatttacactcctgttgtgtctctgtccccacacaagaatctgccagtggacatgcagctgaagaaggaaaagaagtgcgtgaaattaatcggcgtgcctgcagacgccgaagccctttcagaacgcagcggaaataccccaaactccccaaggctcgccgcagaatcgaagcttcaaactgaagtgaaggagggaaaagaaacctcctccaagctcgaaaaggagacatgtaagaagctccatcccattctctacgtgtccagtaaatctactcctgagactcagtgcccccagcagtag

SEQ ID NO: 27612 - DNA, 1842 bp, Artificial Sequence
  Description of Artificial Sequence: Synthetic coding sequence
atggcaactattccggattggaagctacagctgctcgccaggcggagacaggaagaagcaagtgttcgcggaagggagaaggccgaacgggagcggctcagtcagatgcccgcttggaaacgaggcttgcttgaacgccgtcgcgctaagttgggactcagccccggagagcccagccccgtcctcggcacagtggaggccggtccaccagaccccgatgagtccgcggtgcttctggaggctatcgggccagtgcaccagaatagatttatccgccaggagcgtcagcaacagcagcaacagcaacaacggtcagaagagcttctggctgaacggaagccaggaccactggaggcaagagagcgtagaccttcaccaggtgagatgagagaccaaagtccgaagggcagagagtccagggaagaacggctgagcccccgagaaacaagggaaagacgacttggaataggaggtgctcaagagctgtcactcagacctcttgaggcacgtgattggcgccaatcacccggagaggtcggtgataggagctcaagactctctgaggcctggaagtggcgcctcagtcccggagagaccccggagaggagcttgcggctggctgaatcccgcgaacagtcccccagacggaaggaagtagagtcccgcctctctcctggcgagtccgcctaccaaaaactgggactaaccgaggcccataaatggaggccagacagtcgggagtctcaagagcaaagtctggtgcagctggaggcgaccgaatggcggctgagatctggagaggaacggcaggattattcagaggaatgtggccgaaaagaagagtggcccgtccctggagtcgcccctaaagagacagcagagctgtctgagacgctgactagggaggcccagggaaatagtagcgctggggtggaggctgccgagcaaaggccagtcgaggatggggagagaggcatgaagcctacggagggatggaagtggaccctcaattccggaaaggctcgggagtggactcccagagacatagaggcccaaactcagaagcctgaacccccagaaagcgccgagaaactcctggaaagccccggagtagaggcgggtgagggggaagccgaaaaggaggaggcaggcgctcagggcagacccctgcgagctctgcagaactgttgcagtgtcccctccccccttcctcccgaggacgctggaacgggagggctgcggcagcaagaagaggaggcagttgaattgcaacctccacccccagcccctctgtcgccacccccacctgctcccactgctcctcaaccacccggtgacccgttaatgtctaggctcttttatggggtcaaggcaggaccaggggtgggggcaccccgtaggtccggacacaccttcacagttaaccccagaaggtccgtgccccctgctacacccgctacaccaacctcccccgctacagtggacgccgcagtgccgggtgccggaaaaaaaagatatccaactgctgaagagattctggtgttgggtgggtacctcaggctgagtcgaagttgtctggcaaaagggagccctgagaggcaccataaacaactgaaaatcagcttctctgagaccgccctcgaaaccacataccagtaccccagtgaatcctcggtcttggaggagctgggccctgagcccgaagttccatctgccccaaatccccctgcagcccagcccgatgacgaagaggatgaagaggagcttcttttattgcagcccgaactgcaggggggattgaggaccaaggccctgattgtggatgagagctgccgacgatag

SEQ ID NO: 27613 - DNA, 654 bp, Artificial Sequence
  Description of Artificial Sequence: Synthetic coding sequence
atgtcttggacctgcccgcgatgtcagcaacctgtgttttttgccgagaaagtgtcatccttaggcaagaactggcacagattttgtttgaagtgcgagaggtgtcatagcattttaagccctgggggacacgcggaacataacggtcgcccttactgtcacaagccgtgctacggagccctcttcggccctagaggcgtgaacattggtggcgtcggatcttacctgtataatcccccaacccccagtcccggatgtacaacgcccctgagcccctcatcctttagcccaccacggcctaggacaggcttaccacagggaaaaaagtcaccgccacatatgaagaccttcaccggagaaacaagtctatgccctgggtgcggcgaacctgtgtatttcgccgaaaaggtgatgagcctgggccgtaactggcatcggccatgtcttaggtgtcagagatgtcataaaacgctgactgcagggagtcatgcagagcacgatggagtcccgtactgtcacgtgccctgctacggctatttattcggccctaaaggaggtcagccacacccacgccattgggacggaatgtacatgcccgaagtgtggcacgtgcacgggttatgggtttgcgtggacaatttcccatgtggctag

SEQ ID NO: 27614 - DNA, 1503 bp, Artificial Sequence
  Description of Artificial Sequence: Synthetic coding sequence
atgaaccagcgaagatctgaaagcaggccagggaaccacaggttgcaggcgtacgccgagcctggaaaaggagacagcgggggtgccggacccctgtccggcagtgcccgacgcggacgaggagggggaggagcaattcgggttcggagaccatgttggagcgggggagcgggaaggggcggtggccctgcttgggccgtgcgccttcctaccgttacagcgggatggacgtggcctgctcttcgcacactcagcagtctgcgcgctggcccttccgaaccacatagccccggtaggaggcctccgagggcgggacgccctctctgccaggccgacccccaacccggaaaggccgcaaggcgcagtctggagccagatcccgctcagacgggtccccgtcctgctagagccgctggcatgtcagaagctaggaaagggccagatgaggcggaggagagtcaatacgatagtggaattgaaagcctacgcagcctccggagcctgccggaatcgacaagcgcgccagccagtggcccttcagatggatctccacaaccatgtactcacccaccaggtccggtcaaagaaccccaagaaaaagaagatgccgacggcgaaagggccgattccacctacggatcttcctccctaacatataccctttctttactcgggggaccagaggccgaggatccagcgcctcggctgcctctcccccacgtcggcgctcttagcccacagcagctggaggccctgacgtacatctcggaagacggagacacacttgtccacttagccgttatccatgaagccccagctgtgttactgtgttgtctagccctgcttccccaggaggttctggatattcaaaataacttgtaccagacagcccttcacttggcagtgcacctggatcagcctggcgcagtgcgcgcactggtgcttaagggcgctagtagagcacttcaagatagacatggggatacagccttgcatgtcgcgtgtcagcgccagcacctggcgtgcgccaggtgcctcctcgagggtcgccctgagccaggcagaggcacctcgcattccctcgacttgcagttgcaaaattggcagggattggcctgccttcatattgcaacactgcaaaaaaatcagcccctgatggagctgctgcttcgcaatggtgcagacattgatgttcaggagggaacctcaggcaagaccgctctgcaccttgctgttgagacgcaagaacgcggactggtgcaatttttgctccaagccggtgcacaagtggacgctcgcatgctgaacggctgcacccccctgcacctagcagcagggagagggcttatggggataagtagtacgctctgtaaggcaggcgctgattcccttctgcgaaacgttgaggatgagacgccccaagatcttacagaggagtctctggtgctgttaccattcgatgacctcaaaatctctggaaagctgctcctatgcactgattag

SEQ ID NO: 27615 - DNA, 1881 bp, Artificial Sequence
  Description of Artificial Sequence: Synthetic coding sequence
atggagggcccacgagaaaaccaggacccgcctccccgtagtctcgcccgacacctgagcgacgcggatcgtctgagaaaggtgatccaggaactggtggacacagaaaaatcatatgtgaaggacctatcgtgcttattcgagctgtatctcgaacctttgcagaacgaaacattcttaacccaggatgaaatggaaagtcttttcggttccctgccagagatgctggaattccaaaaagtgtttctagagactctagaggatggcatttcagcatctagtgacttcaatacgctcgagaccccatcccagttcaggaagctgctgttctctttgggtggatctttcttatattatgccgatcactttaagttgtattcaggcttctgcgccaaccacataaaggtgcagaaagtgctggaacgcgctaagacagataaggcctttaaagccttcctcgatgcccgaaatccaacaaaacagcatagcagtacactggaatcttacctgattaagcccgtgcagcgagttctgaagtatccccttctcctaaaagagcttgtctccttaactgaccaggagagcgaggagcattaccatctcactgaagcgctgaaggctatggagaaggtggcctcgcatataaatgaaatgcagaagatctacgaggactacggcacggtgtttgaccagttagtggccgagcagtccggaaccgagaaagaggtgacggagttaagcatgggggagctgcttatgcattctactgtgtcttggctgaatcctttcctatccttgggcaaagctcgaaaggacctagaactcacggttttcgtattcaagagagccgtcatacttgtttacaaggagaattgcaagctgaagaaaaaactcccctcgaattctcgacccgcacataactcgacagacctcgacccgttcaagttccgctggctgatccctattagtgcgcttcaagtcaggttaggcaatccagctgggaccgaaaacaattctatttgggaactgattcataccaaatctgagatcgagggacgcccagagacaatctttcagttatgctgctcagacagcgagtccaaaacgaatatcgtgaaagtgattaggtctattttacgcgaaaatttccggagacacatcaagtgtgaattgcctttagaaaagacctgtaaggatcggctggttccattaaaaaaccgagtgcccgtctccgccaagctcgctagttccagatctcttaaagtccttaaaaacagcagttcaaacgagtggaccggggaaactggcaaggggaccctcctggactctgatgaagggagcctttcctcaggcactcaatcctccggttgccccaccgcggagggccgtcaggacagtaagtctacctcccctggaaaatatccacacccgggactggccgacttcgccgacaatctcattaaggagtccgatatactgagcgatgaagatgatgaccaccgtcagacggtgaagcagggatcgccaacaaaggatatcgaaattcagtttcagagactacggatttccgaagacccagatgttcatccagaagccgagcagcagcccggaccagagtcaggggagggccagaaaggtggagagcagccaaaactggttaggggtcatttttgccctatcaagcgcaaagcgaacagcaccaaacgcgatagaggaaccctgctcaaggcccaaatacgacatcagagcctggattcccaatcagagaacgctacaatcgacctgaatagcgtcctggaaagggagtttagcgtccagagccttacatctgtagtttcagaagagtgcttttatgagaccgaaagccatggcaagtcctag

SEQ ID NO: 27616 - DNA, 1596 bp, Artificial Sequence
  Description of Artificial Sequence: Synthetic coding sequence
atggccgctgtaaaaacactgaatccgaaagcagaagtcgccagagctcaggctgccctagccgtcaacatcagcgccgctaggggactgcaggacgtgctgcggaccaatctggggccaaaagggactatgaagatgctggtgtccggcgcaggcgatattaagctcacgaaggacggcaatgtcctcttgcacgaaatgcaaattcagcacccaacggcgagcttgatagctaaggtggccacagcccaggacgatatcaccggggatgggacaacttccaacgtgctgatcataggcgaactgttaaagcaggctgacctgtacatctctgaggggttgcatccaagaatcatcacggaaggattcgaagctgccaaggagaaagcacttcaattcttagaggaggtaaaggtatcgcgcgagatggatcgcgaaactttgattgatgtagcccgaacctccttgcggacaaaggtgcatgctgaacttgcagacgtccttacagaagctgttgtcgacagcattctggccatcaaaaaacaggacgagccgatcgatctgtttatgatcgaaataatggagatgaaacataaatccgaaactgacacctcgttaataagaggcctggtgctcgaccacggggctcgccacccagacatgaagaagcgggtggaggatgcctacatccttacatgtaatgtgtctcttgagtacgaaaagactgaagtgaacagcgggttcttctacaagagcgctgaggagagggagaagctagtgaaagccgaaagaaagtttatcgaagatcgagtgaagaagataatcgaactgaaacgcaaagtgtgcggcgactcagataaaggatttgtggtgatcaatcagaagggcatcgacccctttagcctggatgctctatccaaggagggcatcgttgcgctgcgcagagccaagagaaggaacatggaacggctaacacttgcctgtggaggcgtggctctcaactcctttgacgacctgtcgcccgactgtcttggccatgcaggtctggtgtacgagtatacactaggcgaggagaagtttacatttatcgaaaaatgcaataatcctaggtccgttacgttgttgattaaggggcctaataaacacactttaacccagattaaagacgccgttcgggatggcctgagggctgtgaagaacgccattgacgacggatgtgtagttccgggagccggagccgtagaggttgcgatggcagaagcccttataaagcataagccctccgtcaaaggtcgggctcagttaggggttcaggccttcgccgacgcactgctgatcattcctaaggtcctagcacagaactctggttttgatcttcaggaaacgttggtcaaaattcaggccgaacattcggagtccggccagctcgtgggggtggacctcaatactggcgagcctatggttgccgctgaggttggcgtgtgggacaactattgtgtcaagaagcaactcctgcatagctgcactgtgattgccaccaacattctgctcgtggatgagatcatgcgggctggtatgagcagcctgaagggttag

SEQ ID NO: 27617 - DNA, 666 bp, Artificial Sequence
  Description of Artificial Sequence: Synthetic coding sequence
atgtcagcttttggacatgacgaggcttggatggaagcagggggtttcggtctcgaggctgcggagcgcacagagtaccagtccctatgtaaatctaaactgttattcctgggggaacaatcaggcaagactagtatcatctctagatttatgtacaactccttcggatgtgcatgtcaggccacagtagggatcgattttctcagtaaaactatgtacttggaggatcaaattgtgcagctgcagctctgggatactgcagggcaagagaggtttcacagcctaatcccaagctacatacgcgactccacaattgccgttgtcgtgtacgacataacaaatattaactcatttaaggaaaccgataaatgggtggagcacgtgcgggcagagaggggagatgatgtggtaattatgctcctcggtaataagattgatctcgataacaagcgacaggttaccgcagaacagggggaggagaaatctaggaacctcaatgttatgtttatagagactagcgccaaaaccggatataacgtgaaaaagcttttccggagagtcgcttcggcactcctgagtactagaacttcccctcctcccaaagaaggcacagtcgagatagagcttgaaagtttcgaagagtccggaaaccggagctactgttag

SEQ ID NO: 27618 - DNA, 6222 bp, Artificial Sequence
  Description of Artificial Sequence: Synthetic coding sequence
atggctgaggtgagaaaatttaccaagcgcctctccaagcccggtactgcagcagaattacgtcagagcgtctccgaggccgttaggggaagcgtagttttagagaaggcaaaggtggttgaacccctcgactacgagaacgtgatagcccagcgcaagacgcagatctattccgatcccctgagagatctcttgatgtttccaatggaagacatctcaataagcgttatcggcagacaaaggcgcaccgtgcagtctacagtcccagaggacgcagaaaaacgtgcacagtctctttttgtgaaggagtgcattaaaacctacagcactgattggcacgttgtgaattataaatatgaagacttctctggcgatttccggatgttgccatgtaagtcccttcggcctgaaaagatcccgaaccacgtgtttgaaatcgatgaagactgtgagaaggatgaagactccagcagtctctgtagccagaagggaggtgtcataaaacagggttggctgcacaaggctaatgtgaactctacaataaccgtgactatgaaggtgttcaagcgacggtacttctacctcacgcagctcccagatggaagctacatactcaactcttacaaagacgagaagaactctaaggaatcaaagggatgcatctacctggacgcatgcatagatgtggtccaatgtcccaagatgaggaggcacgcttttgagctgaaaatgctggataagtattctcactacttagctgctgagactgagcaggaaatggaggaatggcttattaccctcaagaagataatccagataaacacagactctctggtccaggagaaaaaagagaccgtggagaccgctcaggacgatgaaacatcttcccaggggaaagccgaaaacattatggctagtctggaaaggagtatgcatccggaattgatgaagtatggacgtgagaccgagcagttgaacaaactgagtcgaggggatggacgccagaacctcttttcttttgactccgaggtgcagcgtctggactttagtggtattgagccagacattaagcctttcgaggaaaaatgtaacaaacgtttcctggtcaactgtcatgacctgacatttaatatcctgggacagattggagataacgcaaaaggtcctcccacgaacgtggaacctttctttatcaacctcgctttatttgatgtgaagaacaactgtaaaatctctgctgacttccatgtggacctcaaccccccttccgtcagggaaatgctgtgggggtcctcaacccagttggccagcgatggctctcccaagggcagttcgccagaatcgtacattcatggcattgccgaatcccagctccgatacattcaacagggcatcttctcagtaacaaacccgcatccggagatttttctggttgccagaatcgagaaggttttgcaaggaaatattactcattgtgccgagccctacatcaaaaattctgaccccgttaaaacagcgcagaaagtccataggactgcgaagcaggtatgtagcagactcggccagtaccgcatgccctttgcatgggcagcaaggccaatttttaaggatacccagggctctctggacctggacggtagattttctcctttatacaaacaagactccagcaagctcagttcagaggacatcctgaagctactcagtgagtacaaaaaacccgagaaaacgaagctacagataatccctggtcagctaaacattaccgtggagtgtgtgccagtggacttgagcaactgcataacatcctcctacgtgcccttgaaaccatttgagaaaaattgccagaatattactgtcgaagtcgaagagttcgtgcccgagatgaccaagtattgctacccgtttaccatttataaaaaccatctgtatgtataccccctccagctgaagtacgattcccagaagacatttgccaaggcccgaaatatcgcagtatgcgttgaatttagagattccgacgaaagtgacgcctccgccttaaagtgtatctacggaaaacctgccggatcggtgttcaccacaaatgcctacgctgttgtgagccaccataaccaaaaccctgaattttacgatgaaataaaaatagagcttcccatacacttgcaccagaagcaccatctcctgttcacattttatcacgtgtcatgtgagatcaatactaaagggactacaaagaaacaagataccgtggaaacaccggtgggtttcgcatgggttccactgctgaaggatgggagaattattacctttgagcagcaactgccagtctccgcaaacttgccgcctggctatttgaacttgaatgatgcggagtctagaaggcagtgtaacgtggacatcaaatgggtagatggggcaaaacccctactaaaaattaagagccatctcgaaagcactatttacacacaagatctccatgtgcacaaattttttcaccactgccaactcatccagtctggctctaaggaggtgcccggagaactgataaaatatcttaagtgcctgcatgcgatggaaatccaggtgatgatacaattccttcccgtgattctcatgcaattatttagagtgctgaccaacatgacacacgaggatgacgtgccaatcaactgcactatggtgctgttgcacattgtgagcaaatgtcatgaggaaggactggactcatatttgagatctttcattaaatactcgtttcgacccgagaagccttccgctcctcaggcccaactgattcatgagactcttgctaccaccatgattgctattctcaagcagtcagcagacttcctctccataaataaactgctgaagtattcctggtttttttttgaaatcatagctaaaagcatggccacatatctgctggaagaaaacaagattaaactgcctcggggacagaggtttcccgagacctaccaccacgttcttcatagtctgctgctcgctatcattccgcacgtaacaatccgctatgcagagataccagatgaaagcagaaacgttaattacagtttggcctcctttctgaaaaggtgtttgacgctgatggatagaggatttatttttaatctgatcaacgattacatctccgggtttagcccaaaagatcccaaggtacttgccgagtataagttcgagtttcttcagactatctgtaaccacgaacattacatccccttaaacctgcccatggccttcgcgaaacccaaactgcagcgtgtgcaggacagcaatttggagtattctctctccgatgagtattgtaaacaccacttcttggtcggacttctcctgagagagacatcgatagctctgcaagataactatgagatccgatatacagccatctctgttatcaagaatctgcttatcaaacacgcgtttgatacacgatatcagcataaaaaccaacaggcgaagatagcgcagctttacctgccctttgtcggtctgctgctcgagaatattcagcggctcgcgggacgagatacgctgtactcttgcgcagccatgccgaatagtgcctccagggacgaatttccatgtggatttacgagtcccgcaaacagaggtagcctttccactgacaaggatacggcctatggttccttccagaacggccacggcattaagagggaagattcacgcggttctcttatccccgaaggcgctacggggttcccggaccaagggaatacaggggaaaatactcgtcagagcagcacacgctcttcagtctcccagtacaacagactggatcagtacgagatcaggtctctgctgatgtgttatctatatattgtgaaaatgatttcggaggacaccttgttaacttattggaacaaagtgtcaccacaggagctaataaatattttaatccttctggaggtttgcctgtttcacttccggtatatggggaaacgcaacattgctcgcgtgcacgacgcatggctgtctaaacactttggaatcgaccgcaaatcacagacaatgcctgccctgcgcaatcggagtggggtaatgcaggccagactccaacacctgtctagcctcgaaagttccttcacccttaaccattccagtaccacaacggaggccgacatctttcatcaggctcttctcgaagggaacactgcaaccgaagtatccctcaccgtgcttgataccatctcctttttcacacagtgcttcaagacccagttactcaataacgacggtcacaatccactcatgaaaaaggtttttgacatccatcttgcctttctcaaaaacgggcaatctgaagtctctctaaagcacgttttcgcgtcccttcgggctttcatttccaaatttcctagtgccttcttcaaagggagagttaatatgtgtgcggcattctgttacgaagtgcttaaatgttgcacgtccaagatcagctctactagaaatgaggcttctgccctgctgtatttgctgatgcgcaataactttgagtacactaagcgcaagacctttctccggactcacctacaaattatcattgccgtgtcccagctgatcgctgatgtggcactgtccggtggatccaggttccaggagtcactgttcatcatcaataattttgctaattcggacaggcctatgaaggctactgcttttcctgctgaggtgaaggatctgactaagcgaatccgaacagtattaatggctaccgcccagatgaaagagcatgagaaagatcccgagatgctcatcgacctgcaatactctctggctaaaagttatgcctccacaccagagctgagaaaaacatggcttgactctatggccaaaattcacgtcaagaacggcgatttcagtgaggccgctatgtgctatgtacacgtcgcagcactggttgccgagtttctgcacagaaagaagttgtttccaaacggctgttctgcattcaagaaaattactcccaatattgacgaggaaggagctatgaaagaggatgccggaatgatggacgttcattattccgaagaggtgttgctggaacttcttgagcaatgcgtggacggcctctggaaggcggaacgatatgaaatcattagcgagatctccaagctgatcgtgcccatctatgagaaacgccgagagtttgagaaattgactcaggtctataggacactccacggcgcttatactaagatcttagaggtcatgcatactaaaaagaggctactgggtacttttttccgggtggccttttacggtcaatcatttttcgaggaagaggatgggaaggagtatatctacaaggagccgaaactgacgggccttagtgaaatttctctcaggctggtgaaactctatggagagaagttcggcaccgagaacgtgaaaataattcaggatagcgacaaggtgaacgcaaaggagctggaccccaagtacgctcacattcaggtgacttacgtgaaaccatattttgacgacaaggagctgaccgagcgcaaaaccgaattcgagaggaatcataacatctcccggtttgtgttcgaagccccatatactctgtcaggcaaaaaacagggatgcattgaagagcagtgtaagcggaggacaatcctcacaacatccaactcgtttccatatgtcaaaaagcgcattcccattaattgtgaacaacagattaatcttaagcctattgatgtcgcaactgatgaaatcaaagacaagactgcggagctgcagaaattgtgtagttccacggacgtggacatgatccaattgcagcttaagctgcagggctgtgtgagcgttcaagttaacgcaggccctctcgcatatgcccgagcattcctgaatgacagccaggccagcaagtatccccctaagaaagtgagtgaactgaaggacatgttccgaaagtttattcaggcctgttcaatagctctcgagttgaatgagaggctcatcaaagaagaccaggtcgagtatcacgagggcctgaagtcgaatttccgcgatatggtcaaagagctatcggacattattcatgagcagattctgcaagaagatacaatgcactccccttggatgagtaatacactccatgtcttttgcgccattagtggcacctccagcgatcgcggttatggaagccccagatatgcggaagtgtaa

SEQ ID NO: 27619 - DNA, 1644 bp, Artificial Sequence
  Description of Artificial Sequence: Synthetic coding sequence
atgggcggatgtatccctttcctgaaggctgcacgggcactgtgcccgaggattatgcccccactgcttctgctctctgcatttattttcttagtatctgtcctcgggggagctccaggccacaatcctgacagaaggacaaaaatggtctctatccacagcctctccgagctcgaacgcctcaaactgcaggaaactgcctatcacgagctggtggccagacattttctcagcgagttcaagccagaccgagcattgcccatcgatcgccctaacacccttgacaaatggtttcttatccttcgcggacagcaacgcgctgtctctcacaagacattcgggatctcccttgaagaagtgctcgtgaacgagttcacaaggcgtaagcatttggaactgactgctactatgcaggtcgaagaggctacagggcaggccgctggcagacgacggggaaatgtggtccgtcgggtcttcggaagaatccggaggttcttcagcaggagaaggaacgagcctaccctgccaagagaattcacacggaggggcaggcgtggagcagtcagtgtagattctcttgccgaattggaagacggcgcactgcttttgcaaacactgcaactgagtaagatttcgttcccgatcggccagcgattgttgggctccaagagaaaaatgtcactgaaccctattgccaaacagataccacaggttgtagaagcctgctgtcagtttatagagaagcatggcttatcggccgtcggcatctttactcttgagtattccgtccagcgcgtccgccagctcagagaagaattcgatcagggccttgacgtggtactggatgacaaccaaaacgtgcacgacgtcgctgcgctcctaaaagagttcttcagagatatgaaagactctctcctgccagacgatctatacatgagctttcttttgacagctaccctgaaacctcaggatcagttaagcgccctccagctgctcgtttacctgatgcccccatgtcattctgacaccttagaacgcctgcttaaagccctgcacaaaattaccgagaattgtgaggattctatcggaattgacggtcagctggtgcccggtaatcgcatgacctccacaaacctcgctttggtgttcggatcagcactcctgaaaaaaggtaagttcggcaagagagaaagtagaaagactaaactcgggatagatcactacgtcgcaagcgtgaacgtggtgcgagccatgatagacaactgggatgtgctgttccaagtaccccctcacatccagagacaggtggcaaaaagagtgtggaagtcatcccccgaagccttagacttcattagacgcaggaacctgcgaaaaatacaatcagcccgaatcaagatggaagaagacgccctcctgtctgaccccgttgagacatctgcagaagccagagctgctgttctggctcagagtaagccttccgacgaaggtagctccgaagaacccgcagtgccctcaggcacagcgaggagtcacgacgacgaagaaggggctggcaacccgcctattccagagcaggaccggcctctgctgcgggtgcccagggagaaagaagcaaagactggagtgtcctacttctttccctag

SEQ ID NO: 27620 - DNA, 5613 bp, Artificial Sequence
  Description of Artificial Sequence: Synthetic coding sequence
atggcgagatggattccaactaagcgacagaagtatggtgtggccatctataattataatgcatcccaggatgtggagctttcccttcagataggtgacacggtgcatatactggagatgtatgagggatggtacagaggatataccctgcagaataagtcaaagaagggcatcttccctgagacctatattcacctgaaagaggctacggtggaagacctcggtcagcacgagaccgtgatccctggggaactaccactcgttcaggagctgacctctaccctgcgggagtgggctgtcatatggcggaagttatacgtgaacaataagctaacattgttccgtcagttacagcagatgacctattccctcatcgaatggcggagccagatcttgagcggaactttgccgaaggacgaattagcggaacttaaaaaaaaggtcactgcaaaaattgatcacggaaatcgaatgctgggcctggatttagtggtgagagatgacaacgggaatattcttgatccagacgaaacatctacaatcgcattgtttaaagctcatgaagttgcctctaaacggattgaggagaagattcaggaagagaagtccatcctgcagaacttggatctgcgaggccagtcgatatttagcactattcacacctacggtctgtacgtcaacttcaagaatttcgtctgcaacatcggtgaagatgcggaacttttcatggccttatacgaccccgatcagagtacgttcatctctgaaaattatttaattcgctggggaagtaacggcatgcccaaggaaatcgagaaactcaacaacctgcaagcagtcttcactgatctctcctccatggatcttatccgacctcgtgtgagtctcgtctgtcaaatcgtaagggttggacatatggaattgaaggaagggaagaagcacacttgtggcctcaggcggccttttggggtggctgtgatggatattaccgatatcatccacgggaaggtcgacgacgaagaaaagcaacactttatcccctttcagcaaatcgccatggaaacctacattcggcaacggcaactgattatgtcccccctgattacctcccatgttattggagagaatgaaccactgaccagcgttttgaacaaggttattgcggctaaagaagtgaatcataaaggtcagggactgtgggtgtcccttaaacttctgcccggagatttgacacaagtacagaagaactttagccacctggtagaccggtcaactgccatcgctcggaagatgggcttcccagagatcatcttgccaggtgatgtgcgaaacgacatctacgtgacactgattcatggcgagtttgacaaagggaaaaaaaagacacccaagaatgtggaagtgaccatgtctgtacacgatgaggaaggtaagctgctcgaaaaggccattcatcccggagctggttacgagggtatctccgagtataagagtgtggtgtattatcaggtcaagcaaccatgctggtacgagaccgttaaggtttccatcgctattgaagaggttactcgctgtcacatccggttcacattccggcatagaagctcgcaggaaacaagagataaaagcgagcgggcttttggcgtagccttcgtcaagctaatgaatcctgatgggaccactcttcaggacgggagacatgatctcgtcgtgtataaaggggacaataaaaaaatggaagatgctaagttctacttaacattgcctggtactaaaatggagatggaagagaaggagctgcaagccagcaagaacctggtgacttttactccttcaaaggatagcacaaaagattccttccagattgctactttgatctgttcaaccaagctcacccagaacgtcgacctactcggcctgctcaactggcgttccaactctcagaacatcaagcataatctgaagaaactcatggaagttgatggcggagagatagttaagtttctgcaggacacactggacgctttatttaacatcatgatggagatgtcggactctgagacttacgactttctggtttttgacgctctggtcttcattatttccctcataggcgacatcaaatttcagcactttaatccggtcctcgagacctacatttacaagcacttctctgccactttagcctatgttaagctcagtaaggttctcaacttttacgtggcaaacgccgacgattcaagcaagacagaactactgttcgccgcacttaaggccctgaagtacttatttcgttttataattcagtcgcgcgttctgtatcttcgattctacggacagtctaaagacggagatgaattcaacaactccatccgccaactctttttggccttcaatatgcttatggacaggccgttagaagaagccgtcaaaatcaagggcgcagcactgaaatacttaccctccattataaacgatgtcaaactggtgtttgatcctgtagaactttccgttctattttgcaagttcattcagtccatcccagataaccaattggtacgtcagaagttgaactgtatgactaaaatagtcgagtcaactttgttcaggcagtcagagtgccgcgaggtgttgctgccactactcactgaccagctgtcgggccagctcgacgacaactccaacaaaccagatcacgaagcttcaagccagctgctctctaacatactggaggtgctggaccggaaagatgtaggagctactgccgttcatatccagctgatcatggaacgtttgctccggagaatcaacaggacagtgatcggtatgaatcgacagagcccacacatagggagttttgtcgcatgcatgatcgctctcctgcaacaaatggacgactcccactattcccactacattagcacatttaaaacaagacaagacattatcgattttctgatggaaacctttatcatgttcaaggacctgataggcaaaaacgtttatgccaaagactggatggtgatgaatatgacacagaaccgcgtgtttctacgcgcaattaatcagttcgcggaggtcctgacccggttctttatggaccaggcgagttttgaattgcagctgtggaacaactactttcatctagcagtcgcctttcttacgcatgaaagtctgcagttggagacctttagtcaggctaaacgtaacaagatcgtgaagaagtacggagacatgcgaaaagagattggtttcaggatccgggatatgtggtataatctgggaccacacaaaattaaattcatcccatcaatggtggggccaatactggaggtgacactgacgccagaggtggaattgcgtaaagctaccattccaattttctttgacatgatgcagtgtgagttcaatttcagtgggaatggcaactttcacatgttcgaaaatgagttgattacaaaacttgatcaggaagtcgaggggggaagaggggacgagcaatataaggttctccttgagaaactccttctcgagcattgtaggaaacacaagtacctgagcagttctggggaagtttttgctctgctcgtctcctccctgctggagaacctgctagattacagaacaattataatgcaggacgagtcaaaggagaatcgcatgtcatgcaccgtcaacgtgctcaatttttacaaggaaaagaaaagagaggatatttatatccgttatttgtacaaactgagggatctgcatagggactgtgaaaattatacggaggctgcctatacgctcctcctgcacgcagaattgctgcaatggtccgataaaccctgcgttccccatctcctccagaaggacagttactatgtctacactcagcaggaactaaaggaaaaactgtatcaagaaattatcagttactttgataaggggaagatgtgggagaaggccataaaactcagtaaagagctcgcagaaacctatgaaagcaaggtgtttgattatgagggactcggaaatttgctgaaaaagagggcctcattttacgagaacatcattaaggcgatgcggcctcagcccgaatacttcgcagtgggctactacggccaagggtttccctcttttcttcgcaataaaattttcatttacagggggaaagaatacgagcggagagaggacttctctctaaggctgctgacacagttccccaacgccgagaagatgactagtactactccacctggggaggacatcaaatcaagtccgaaacagtatatgcagtgcttcactgtgaagccagttatgtctttgccaccctcttataaggataaaccggtgcccgaacagattctgaattactatcgggcaaacgaggtgcagcagtttagatactctaggccatttcgaaagggagaaaaggatcctgataacgagtttgcgaccatgtggatagagcgtacgacctacaccaccgcttataccttccctggcattctgaagtggtttgaagtgaagcaaatttccaccgaggaaatttcacctctcgagaacgccatcgagaccatggaactcaccaatgagaggatctctaactgtgtacaacagcacgcctgggaccgctccctgtcggtgcatcccctgtctatgctgctctccggcatcgtggacccggctgtaatggggggattctcaaattatgaaaaagccttctttaccgagaagtatttacaggaacacccggaagatcaggaaaaggttgaacttctgaagaggctgatagcattgcagatgcccctcctaacagagggcattcgcatacatggggagaagctcaccgaacaactgaagccattacacgaacgcctgtcttcatgctttagggagctcaaggaaaaagtggaaaagcattacggggtgattactctaccccctaatcttaccgaacgtaagcagtcccgcaccggatcgatagtcctgccatacattatgagtagcacccttcggagactgtccataactagcgtgacatcttcagtggtcagcacttcaagcaactcttctgacaatgcgccatctaggcccggttctgatgggtctatactggagcctctgttggagagacgggcttccagcggggctagagtggaagacctcagtctgcgagaagagaactcagagaatcgaatttctaaattcaagcgcaaagactggagcctctcgaaatctcaggttatcgcagagaaagcgccagaacctgatttgatgtctccgaccagaaaagctcagcgcccaaagtctctgcagctgatggacaaccggctgtccccgttccatgggtcaagtccccctcaatctacacccttgagtcccccacccctcactccaaaggcaacgcggaccctttcatctcctagtctccaaactgatgggattgctgcaactcccgtcccaccgcctcctcctccaaaaagcaagccttacgagggctctcagcgaaatagtaccgaacttgcaccacctttgccggttcggagggaggcaaaggctccacctccccctccgccaaaggcaagaaaatccggaatcccaacaagcgagccaggctctcagtac

SEQ ID NO: 27621 - DNA, 1623 bp, Artificial Sequence
  Description of Artificial Sequence: Synthetic coding sequence
atgtcagcgtcactgaactataaatcattttccaaagagcaacagaccatggacaacctggagaagcaactgatttgcccaatctgtctggaaatgttcactaagcccgttgtaatcttgccatgccagcataacctgtgccgaaaatgtgcaagcgacatctttcaggctagtaatccctatctcccaacacgcggaggcactaccatggcctccggcggacgctttcgttgtccatcctgccgccacgaggtagtgctggatcggcacggggtatacgggctgcagaggaacctgctggtcgagaacatcattgacatctacaaacaagaatcgaccagacccgaaaagaaaagtgaccaacctatgtgcgaggagcatgaagaggagagaatcaatatttattgcctgaattgcgaagtgccaacctgttccctctgtaaagtttttggcgcacacaaggattgtcaggttgcgcctctcacacacgtctttcagagacagaaaagcgagctgtccgacgggatagccatcctggttggaagcaatgatcgcgttcagggcgtgatcagccagttggaggacacctgtaagactattgaggagtgttgtcgaaaacagaaacaggaactctgtgaaaaattcgactacctctatggaatccttgaggaaaggaaaaacgagatgacccaagtaattacccgtacacaggaggagaagctggaacatgtgagagctctaatcaagaaatactcagaccaccttgaaaatgtatctaagctggtggaatctgggatccagttcatggacgaacccgaaatggccgtgtttctgcagaacgcaaagacgcttctcaagaagatatccgaggcctctaaggcgttccaaatggaaaaaatcgagcacggttacgagaacatgaaccatttcaccgtcaacttgaaccgtgaagagaagatcatcagggaaattgatttttatagagaggatgaggacgaagaggaagaagaagggggagaaggcgaaaaggaaggcgaaggcgaggtgggcggagaagcggttgaagtcgaagaggtagaaaatgtccagaccgagttcccaggagaggacgaaaatccagaaaaagcctctgaattgtcccaggttgagctgcaggcagctcctggggcattaccagtctcctctccagaacctccccctgcactcccaccagccgctgacgctcccgtgacacaaggagaggtggtccctacaggatccgagcagacaactgagagcgagacccccgtcccggcagccgcagagacagctgaccctcttttttatccatcctggtataaaggtcagacccgtaaggcgacaaccaatcccccatgcacgcctgggagcgagggcttgggacaaattggccctccaggctcagaggactccaacgttcggaaagctgaagtcgccgctgcggctgctagtgaaagggccgcagtgtcaggcaaggaaacgtctgctcccgctgcaacgagtcaggaattagtcatctgccttgctctgctcgcatttcttatcttgcattacatatggagtcagatccaatgtctgatctttaccctaatggactggatttag

SEQ ID NO: 27622 - DNA, 3252 bp, Artificial Sequence
  Description of Artificial Sequence: Synthetic coding sequence
atgtcacagacgcaggactatgagtgccgttcacataacgtcgatcttcccgaatctaggattcccggaagcaatacgcgactggagtgggtcgagatcatcgagccacggaccagagagcggatgtacgctaatctggtaaccggggaatgcgtgtgggatcctcctgccggagtgcgtattaaacgtacgtcagaaaaccagtggtgggagctcttcgaccctaataccagccgattctactactataatgccagcacacagagaacagtctggcacaggccccagggctgcgacatcatacccctggccaaactccagacactcaaacaaaatacagaaagcccccgagcctccgccgagagtagccctggacgaggttcctccgtttcacgagagggctccacttcaagttcccttgaacctgagcccgacaccgaaaaagcacaagagttacccgctagggccggaaggcctgctgctttcgggacggttaaggaggacagtggaagctctagtccgccaggagtgtttctggaaaaagactacgagatttatcgcgactacagcgccgatggacagctgttacactaccgtacttcttcattgcggtggaactcgggagccaaggaacgtatgctgataaaagtggccgatagggagccctctttccttgcggcacagggcaatggttacgcacccgatggcccaccaggtgtgagatcccgtcggcctagcggctcccagcactcaccatccttacaaacatttgccccagaagccgatgggaccattttcttccctgaacggaggccctccccattcctgaagagagccgaactaccaggctcatcgtcccctctgctcgcgcagccacgtaaacccagtggcgattcgcagccaagcagtcccagatacggatacgaacccccactctatgaggagcccccagtggagtaccaagctccaatttacgatgagccaccaatggacgtccagtttgaagctggtggtggctaccaggcaggctctccgcagagatcccctgggaggaagccaaggccgttccttcaacccaacaagcagggacccccttccccttgccagcaacttgtattaacaaaacagaagtgcccggaacggtttctgtcactggaatactcccccgcaggaaaggagtatgtgcgccagttagtgtatgtggaacaggccggatctagccccaagttgcgtgctggacctagacataaatacgcacccaatcctggaggcggatcctatagtttacagcccagcccctgtctcctgcgtgatcagcgcctaggcgttaagtccggagattatagcacaatggaaggacccgagcttcgccactctcagcctcctactcctctacctcaggcacaggaggatgctatgtcgtggtcctcccagcaggatactctgtccagtaccggatacagtcctggaaccagaaaaaggaaatctcggaagccatccctttgccaggccacaagcgccacgcccaccgaaggcccaggcgacctgcttgtggaacagccgctggcagaggagcagccaccttgtggcacatcccttgctcccgtgaagagggcggaaggcgaggccgaaggggctcgtggagccgctgagcctttcctcgcccaggctcgactagcctgggaggcccaacaggcccattttcacatgaaacaaaggagtagttgggattcacaacaggacgggtccggctacgagagtgacggagccctgcccctgcctatgcctggtcccgtcgtccgcgcattctctgaggacgaggcgctggctcagcaggaaaatagacattggagaaggggaacatttgagaagctaggctttccacagattctgctagagaaatccgtgtcagtgcaaacaaacctcgccagtcctgagccctacctgcatccttcacagtccgaggacctggccgcatgtgcgcagtttgaatcatcaaggcagagtagaagcggagtgccatcaagttcttgcgtctttcctacattcacacttcgcaagccgtcctctgagactgacattgagaactgggcatctaaacacttcaacaagcatacgcagggcttgtttaggcgtaaggtgtccattgccaacatgctggcctggtcaagtgagtctattaagaaaccgatgatagttacaagtgatcgccacgtgaaaaaggaagcgtgtgagctgttcaaactaatccagatgtacatgggagataggcgtgccaaagccgaccccctccatgtcgcactggaggtggcaaccaaagggtggagtgtgcaaggcctcagagacgaactgtacatccagctgtgcagacagacgactgagaattttcgactggaatccctggcgaggggctgggagctgatggctatctgtctggccttttttccaccaaccccaaaattccactcctatctggagggctatatctatagacacatggaccctgttaatgatacgaaaggtgtggccatcagtacatacgcaaagtactgttaccacaagctgcagaaggccgcattgacaggtgcaaagaaggggctcaagaagcctaatgtggaggaaattcggcacgcaaaaaacgcagtctttagcccatccatgtttgggagcgcactccaggaggtgatgggcatgcagagggagaggtacccggaacggcagcttccctgggtgcagactcgcctgtcagaggaagtgctggccctcaatggggaccagacagaggggattttccgcgtgccaggggacattgatgaggtcaacgcactgaagctccaggtagaccagtggaaggtgccaaccgggctcgaagatcctcacgtgccagcatctcttctaaagctttggtatagagaactggaagagcccctgatcccccacgagttttacgagcaatgcattgctcattacgattctccagaagccgcagtggccgtggtgcatgccctgcccagaatcaacaggatggttctgtgctacttgatccgatttttgcaggtctttgttcagccagcaaacgttgccgttacgaagatggacgtgtccaaccttgcaatggtgatggccccaaattgtctgcgatgccagtctgatgacccacgtgtgatcttcgaaaatacaagaaaagaaatgtcattcttacgggtgctcatccagcacctcgacacatcctttatggagggcgtgctgtag

SEQ ID NO: 27623 - DNA, 426 bp, Artificial Sequence
  Description of Artificial Sequence: Synthetic coding sequence
atgggtaagggtattcctctcaacgatcaggatagaattccatggctctgtaatttgcatgacatcctcttacgggacgtagcttctggccaaagggttgtcctcgcatgcagcgccctcaagaagacataccgcgacattctgactcaggggaaggatggagtagcactgaaatgtgaggaatcaggcaaggaggccaaacaggctgaaatgcagttactcgtcgttcatttaagcgggagcttcgaggtgataagcgggagactgctgaagagggagggccatttcatgccgcctgagctgctgcaaagccagttcgaaacattagagccacccgctgcccctgagaacttcatccagatttctgtcgacaagaatgtctcggagattatcgccaccatcatggaaacattgaaaatgaaatag

SEQ ID NO: 27624 - DNA, 1701 bp, Artificial Sequence
  Description of Artificial Sequence: Synthetic coding sequence
atggacatccagctggatcctgcccgtgacgacttgccactcatggcaaatacgtcgcacatccttgtcaagcactacgtgctcgatctggacgttgatttcgaatcacaagtaatagagggtacaatcgtgctgtttctggaggatgggaataggtttaagaagcaaaattcctccattgaagaggcctgtcaaagcgagagtaacaaggcgtgcaagttcggcatgccagagccttgtcacatccccgtcaccaacgcacggacgttcagctctgagatggagtataacgattttgcaatttgctctaaaggagaaaaggataccagcgataaagatggcaaccatgacaaccaagaacacgccagcggcatttcaagcagtaaatattgctgtgacactgggaatcacggttctgaggattttctcctagttctggactgctgcgatttgtcagtgcttaaggtcgaagaagtggacgtggctgccgtgcccggtctagagaaattcacacgatcacccgaattaaccgtggtatccgaggagtttcggaaccaaattgtccgcgagttagtgaccctcccagccaaccggtggcgcgagcaactcgactactatgcgcgttgtagccaggcaccagggtgcggggagttgttgtttgatacagatacctggagtcttcaaataaggaaaaccggcgctcaaacagctacagacttcccccacgctatccggatctggtacaaaacgaaacctgaaggtaggtccgtcacatggacttctgaccagtctggccgaccttgcgtctatacagtgggctcacccattaataaccgggctctgttcccatgccaagagccgcctgtggctatgtcaacatggcaggccaccgtgcgagcagccgcatcctttgtagtcctgatgtccggagagaactcagcgaagccgacccagttatgggaggaatgcagctcatggtactattacgtgactatgccaatgcctgcctccacttttactattgcagtgggttgctggactgagatgaaaatggagacgtggtccagtaacgacctggccacagaacgtcccttttccccttccgaagccaattttcgccacgtgggagtttgttcacatatggagtatccttgtcggttccaaaatgcatctgccacgacccaagaaattatcccacacagggtatttgcacccgtgtgcctgactggcgcttgccaggaaaccctgctgcgactgattccgccttgcttgtccgcagctcacagtgtgctaggggctcatccctttagccgccttgatgttttgatagtacctgccaatttccccagcctgggcatggcctctcctcatattatgttcctgtcgcaaagcattctgactggagggaaccatctgtgcgggacacgtctgtgccacgagattgcccatgcatggttcggcttagctataggtgctcgcgattggaccgaagaatggctgtctgaaggttttgccacacacctcgaagacgttttttgggcaactgcacaacaactggcgccttacgaagcacgcgaacagcaggagctgcgggcatgtttacggtggaggagactgcaagacgagatgcagtgctctcccgaagagatgcaggtgctccgcttccctcacgtgggcggttgttcaggatcgttctcatag

SEQ ID NO: 27625 - DNA, 1266 bp, Artificial Sequence
  Description of Artificial Sequence: Synthetic coding sequence
atgccattcctgcatggcttccgcagaatcatctttgagtaccagcccctggtggatgctattctgggctccttaggaatccaggacccagagcgtcaggaaagcttggataggccaagttatgttgcctcagaagagagtcggatcttggttctcaccgagctcctagagaggaaggctcatagtcctttttatcaggagggcgtatctaatgcactgctgaagatggccgagctcgggctaacacgagctgctgatgtgctgctgcggcatggtgcaaacctgaacttcgaagatcccgtaacatattacacagccttgcacatcgctgttctacgaaaccaaccagacatggtggagctccttgtccaccacggggctgatgtgaatcgaagagaccggattcatgagtcctccccattagacctcgcctctgaagagccagaacgcctcccttgtctccagagattgctcgatctaggcgctgacgtcaatgcggctgataagcacgggaaaacagcactcctgcacgccctggcttcatcagatggcgtacagatccataataccgagaatatccgcctgctgctggagggcggagccgacgtgaaggctaccactaaagacggcgacaccgttttcacatgcataatttttttgctgggtgagacagtcggaggggacaaagaggaagcccagatgataaacagattttgctttcaggttacacggctgctgctagcccacggggctgatccatcagagtgtcctgctcacgagtcacttactcacatctgtctgaagagtttcaagcttcattttcctctactcaggtttctcctggaatcaggtgctgcctataattgctcgctccacggcgcttcatgctggagcgggttccacattatctttgaaagactgtgctcccaccctggttgcactgaggacgagtcacatgccgatttgctgcggaaggctgaaactgttctggacctgatggtgacaaatagccagaagctccaattacctgagaatttcgatattcaccccgttggctccttagctgaaaagatccaggctctgcacttcagcctgcggcagttagaatcataccctccccctctgaagcatctatgccgcgtcgctatccggctatatctccagccgtggcctgttgacgtcaaggtgaaagctttgcccctgcccgacagactgaagtggtatctcctttccgagcatagcggatctgttgaggacgacatatag

SEQ ID NO: 27626 - DNA, 594 bp, Artificial Sequence
  Description of Artificial Sequence: Synthetic coding sequence
atgccatttctgcatggatttcggaggataatttttgaatatcagcctcttgttgacgccatcctgggcagtctcggcatccaggaccctgaaaggcaggaaagtttggaccgtccttcatacgtcgcatcagaggagagccgtatcctggtgctcacagaactcctggagaggaaggcgcattcacccttctatcaggagggggtctccaacgctctgttgaagatggcggaattgggcctcacacgggctgctgatgttctcctgcgacatggcgcaaatctgaatttcgaggacccggtgacctactatacagcactgcacatagcagttctcaggaatcagccagatatggtggagctgttagtccaccatggagccgacgttaatagaagggaccgcgaaaagcttctgtgttcgatgctgtggcctgctgctacggggtgtcgttctaccatccttagaacatttgtgtcctattggaaagagggccagacatcaagaccccctccaaagatgggaacacagtgcagcccagcctcatctagctgcttggtgcggccttgggaaggtactaaacgcaggccaagatag

SEQ ID NO: 27627 - DNA, 684 bp, Artificial Sequence
  Description of Artificial Sequence: Synthetic coding sequence
atgtccgatatcaacctggattgggtagacaggcggcagctccagcgattagaggaaatgcttatcgtggtggacgaaaacgacaaggtgatcggggctgacaccaaaaggaactgccaccttaatgagaacattgagaaggggctgctgcaccgagctttcagcgtcgtgctcttcaacaccaaaaaccgcattttgattcaacagaggtccgataccaaggtgacttttcccggatacttcacagactcttgctcatcacatcccctttacaaccccgctgagctggaggagaaggacgcgatcggcgttaggcgcgcagctcagcgacggctgcaggctgagctgggcatccccggtgaacagatttcaccagaggacattgttttcatgaccatttaccatcacaaggccaagtcagaccgcatatggggagagcatgagatctgctatttattactggtaagaaagaacgtaacgttgaacccagatccatctgagaccaagtccatcctctacctgtcccaggaagaactctgggaattgctcgagcgcgaagctcgtggcgaggttaaggtgaccccctggctgcgcactattgccgagcggttcctgtacagatggtggcctcacctggacgatgtgacccccttcgttgagctacacaaaatccacagagtctag

SEQ ID NO: 27628 - DNA, 864 bp, Artificial Sequence
  Description of Artificial Sequence: Synthetic coding sequence
atggaggttatggaagggcctttaaacctggcgcaccaacagagtcgaagagccgaccggctgctggcagctgggaagtacgaagaagccataagctgccataaaaaggccgcagcctatctttccgaagcaatgaagttgacgcaatcggagcaggcgcatttatcactggagctccagcgtgattctcatatgaaacagctgctgctgattcaagaaaggtggaaaagggcacagcgagaggagcgtctgaaggcccagcaaaacaccgataaagacgcagccgctcacctgcagacttctcacaagccatctgcagaggatgccgaagggcagtctcccctttcccagaagtactcaccgtcaacagaaaagtgtctgccggagattcagggtattttcgatcgggaccccgatacgttgctttacctactccagcagaaatccgagcctgccgagccatgcatcggatcaaaggctcccaaggacgataagacgattatcgaggagcaggcgactaaaattgctgacctcaagaggcacgtggagtttcttgtagccgagaacgagcggttgcgaaaggagaacaagcaactcaaggctgaaaaagctaggctgctgaaaggcccaattgagaaggaactcgacgtggatgcagactttgtcgagaccagcgagttgtggtccctgccgcctcatgctgaaaccgccaccgcctcttctacctggcaaaaattcgcggcaaacaccgggaaggctaaagatatcccaatccctaacctgccccctttagacttcccgtcccccgagctgcctcttatggaactgagcgaagacatactcaagggatttatgaacaactag

SEQ ID NO: 27629 - DNA, 2844 bp, Artificial Sequence
  Description of Artificial Sequence: Synthetic coding sequence
atgtgtgtggactctctggtgcggatttgctccggactgtcatatggtagaatccggaatattaaatctcttagcgacattcaaattgtgcaggtggcctgcgggtactaccatagtctcgcactatccaaggcctcggaggttttctgctgggggcagaacaagtacgggcagcttggattggggacagattgcaaaaaacagacttcaccgcaactgctcaagtcattgcttggtattccgttcatgcaggtcgctgcaggcggagcccacagcttcgtactaacactttcaggcgctatttttggttggggtcgaaacaaattcggtcagcttggtctgaacgacgaaaacgatcgctatgtgcccaatctgctaaaatcactgagatcacagaagatcgtctatatctgttgtggagaggaccacactgcagccctgactaaggaaggtggggtgttcacattcggtgcaggagggtacggacagttgggccacaactcaacgagtcacgagataaatccaaggaaggtcttcgagctgatgggctccatagtgaccgagatcgcctgtgggagacagcacacttccgctttcgtcccaagtagcgggaggatatactccttcggactcggaggaaatggtcagctcggcaccggctccacttccaatcgaaaaagtccatttactgtaaaggggaactggtatccatacaacgggcagtgtcttcccgacatcgactccgaggagtatttttgtgtgaagcggatcttcagtggtggggatcaaagtttttcccactacagttcaccacagaactgtggaccacctgacgattttcgctgtcccaatccaaccaaacagatttggacagtcaatgaagccctgatccagaaatggctgtcttacccaagtggtaggttccccgtcgagatcgccaacgagattgatggcactttttcctcttcggggtgcctgaatgggagcttcctggccgtttcgaatgacgaccattaccggacaggcacaagattctcaggtgtggatatgaatgcggctaggctcctgtttcacaaactgatccagcccgatcatccccagattagccagcaagtcgccgcatccctggagaagaacttaattcccaaactgacctccagtctaccggatgtagaggctctccggttctacttaacgctgcctgagtgcccgttaatgtccgatagcaacaacttcactaccatcgccatcccatttggcacagctctggtaaatctggagaaggctccgctcaaggtgctggaaaattggtggtctgtgctggagccacctctctttctgaagatcgtggaactgtttaaggaggtggtcgtgcatctgctcaagctttataaaattgggattcctccctccgaacgccgaatttttaacagcttccttcacaccgcgctaaaggttctggagattctgcatagagtcaacgagaaaatgggacagatcatacagtacgacaagttttacatccatgaggtacaggagttgatcgacatacgcaacgattatatcaattgggtgcagcaacaagcatacggcatggatgtgaaccacggcctcaccgagctggcagatattccggtgacaatttgtacctatccatttgtgtttgatgcccaggcgaagacaacactgttgcagactgatgcagtgctgcaaatgcaaatggccattgaccaggcccaccggcaaaacgtcagttcgctgtttctacccgtaatagaatctgtcaacccttgcctgatcctggtggtccggagggaaaacatagtcggagatgcgatggaagtgcttagaaagaccaagaacatagattataagaaaccccttaaggtaatcttcgtgggagaagacgccgtggacgccggaggtgtgcgcaaagaattcttcctccttatcatgagagagctgctagaccccaagtacggcatgtttagatactatgaagactcccggttgatctggttctcagataaaaccttcgaagacagcgatttattccatttgataggcgtgatttgtggattagccatctacaattgcaccatcgtggatctgcactttccactggccctgtacaagaaactactgaagaaaaagccgagtctggacgatcttaaagaacttatgccagacgtgggcagatccatgcagcaattacttgactatcctgaggacgacatagaggaaacattttgcttaaacttcacaataactgtggagaactttggcgcaaccgaggttaaagagctggtcttaaacggagccgataccgcagtcaataagcagaaccgccaggaatttgtggacgcctacgtggactacatcttcaataagagcgtcgccagtctctttgacgcgttccatgctggcttccacaaagtctgtgggggaaaggtgcttctcctgttccaacccaacgagttgcaggctatggtcattggtaacacgaactatgactggaaggagctcgaaaaaaacacagaatataagggagagtactgggccgagcatccgaccattaagatattttgggaggtgtttcatgaacttcccctggaaaagaagaaacagttccttcttttcctgacaggtagtgatagaataccaatcctcggaatgaaatctttgaaactcgttatccagagtaccggaggtggcgaagagtacctgcctgtgagtcacacgtgctttaatttactggatctgcctaagtataccgaaaaagagactctcagatcaaaactgattcaggctatcgatcataacgaaggatttagtctgatctag

SEQ ID NO: 27630 - DNA, 2541 bp, Artificial Sequence
  Description of Artificial Sequence: Synthetic coding sequence
atgccagctttcttgggacttaagtgcctgggaaagctttgtagctcggagaagtcaaaggtgacgtctagcgagaggactagcgcccgaggctcaaaccggaagaggctgatagtggaggacaggagagtctccggcacctcattcacagctcatcggcgtgctacaataactcacttgctctatctgtgccccaaagattattgtccccgagggagagtttgcaactccgtcgatccatttgtcgcgcacccccaagaccctcaccacccatctgaaaaacctgtgatccattgccacaaatgtggcgaaccttgcaaaggagaagtcctgcgggtgcaaacgaagcacttccatatcaagtgcttcacttgcaaagtgtgcggctgcgaccttgctcagggtgggttttttatcaagaatggggagtacctttgtacattggactaccaacgaatgtatgggactcgttgccacggatgcggggagttcgtggaaggagaagttgttaccgcactgggaaaaacataccatcctaattgctttgcctgcaccatttgtaaaaggcctttccctcctggagaccgagtgacctttaatggtcgggactgtctgtgtcagctgtgcgcacagcccatgagcagctccccaaaagaaaccaccttctcttctaactgtgcaggatgcggccgagacataaagaacggtcaggccctgctcgcgctagataagcagtggcatttgggatgctttaaatgcaaaagctgcggcaaagtgcttaccggtgagtatatctcaaaagacggagcgccttattgtgagaaggattaccagggcctctttggtgtgaagtgtgaggcgtgtcaccaattcatcactgggaaggttctcgaagccggtgacaaacattaccaccccagttgtgccagatgctctagatgcaaccagatgttcaccgaaggggaggaaatgtatctgcaaggctcaacagtgtggcatcccgattgcaagcagtctacaaagacagaagagaagctgcgtctcccaaacatcaggcgcagctcatcagactttttctactctaagagtttaattagaagaaccgggaggtctccatcccttcagcctactagaacatcctctgagtcaatttattcaagaccagggtctagcataccgggttctccaggccatacaatatacgccaaggttgataatgagatccttgattacaaggacctggccgctatacctaaggttaaagcaatctatgacattgagcggccagaccttattacttacgagcctttctacacctcgggctatgatgataaacaagaaaggcaatccttaggcgagagccctcgcaccctgtctccgaccccttctgccgagggataccaggacgtgcgggatcgcatgatccacaggtccacaagtcagggatcaattaactccccagtgtattcccggcacagctatactcccaccaccagcaggagtccacagcatttccatcgtcccgagttactgtctcccggagttcaacgccttagctacctacgcacctccagccttagccccactcactcagatagcagacccaacccgccttttcgccatcatttcatcccccacatcaaagggaacgaaccaagctccgggcgtaattctccattaccatatagacctgactctaggccactgacaccgacttatgcacaggcacccaagcacttccacgtacctgatcagggtattaatatctatagaaagccccctatatacaagcaacacgcagctctcgccgctcaatccaagagttctgaagacatcataaaattcagtaagtttcctgctgcgcaagcccctgacccaagtgaaacccctaaaatcgaaacggaccattggcctgggccaccctcctttgctgtagtgggcccagacatgaagagacgcagcagtgggcgagaagaggatgatgaagaactgctgagacgcaggcagttacaggaggaacagcttatgaaattgaattcaggtctgggccagctgatactgaaagaagagatggagaaggagagtagagaaaggtcaagcctcctcgccagccgatatgacagtcctataaacagtgcttcccacatcccaagtagcaagaccgcatccctccccggatacggaaggaacgggttgcacaggcctgtatcaacagatttcgctcagtacaattcttacggggacgtgtcaggtggagtccgggactaccaaaccctccccgatgggcacatgccggctatgcgcatggacagaggggttagcatgccaaatatgctggaacccaaaattttcccttatgaaatgctgatggtgaccaatcgtggcagaaacaagattctacgcgaggtagaccgaacccggctggaaaggcacttggcacccgaggtttttagggaaatcttcgggatgagtattcaggaatttgatcgcttgccactctggcgtcggaatgatatgaaaaaaaaagctaagctcttttag

SEQ ID NO: 27631 - DNA, 594 bp, Artificial Sequence
  Description of Artificial Sequence: Synthetic coding sequence
atgtttggctgcctagtagccggacgcctagtgcagacagctgcccagcaggtggcagaggacaagtttgtgtttgacctgcctgactatgagagcattaatcacgtggtggtcttcatgctcggcactatcccttttcctgaggggatggggggatccgtgtattttagctaccctgactctaacggaatgccagtctggcagctgctcgggttcgtgacaaatggcaaaccctccgctatcttcaagattagcggactgaagagtggagaagggtcccagcatcccttcggggctatgaatattgttagaactccatccgtagcccaaataggaatctctgtagaactcttggactcgatggctcagcagacccctgtgggcaatgcagctgttagcagcgtagactcatttacgcaattcacccagaagatgctcgataatttttacaacttcgcgagcagctttgccgtctcccaagcccagatgacaccaagcccatctgagatgtttattcctgcaaacgtggtgctgaaatggtatgagaatttccaacgtagactcgctcagaacccacttttctggaagacgtag

SEQ ID NO: 27632 - DNA, 930 bp, Artificial Sequence
  Description of Artificial Sequence: Synthetic coding sequence
atggttttccccgcaaaacgcttttgcctcgtgccaagcatggagggcgtgaggtgggcgttctcatgcggaacatggctgccctcccgcgctgagtggctgctggctgtgaggtcgatccagcccgaagaaaaagaacggatagggcaattcgtgttcgctcgagatgccaaggcagctatggccggaagactgatgatccgtaagctggtggctgagaaacttaacatcccctggaaccacatccgactccagaggaccgccaaaggtaaacctgtcttagccaaagattcatccaatccgtatccgaatttcaacttcaacattagtcatcagggcgactatgccgtgctagcagctgaacctgaattgcaggtgggcattgacattatgaaaacaagcttcccaggtcgcggaagtatccctgagttctttcatattatgaagcgaaaattcacgaacaaggaatgggaaaccattcggtcattcaaggatgaatggacacagctagatatgttttaccggaattgggcacttaaggaatcttttattaaggcaatcggcgtcggcctcggatttgagttacagcgcctggaatttgacctaagccctctgaacttggatattggacaggtgtacaaagaaacccgccttttcttagacggcgaagaagagaaagaatgggcatttgaggagtccaaaatcgacgagcaccattttgtggcagtggcgctgagaaaaccagacggaagccgtcatcaggacgtccccagccaggatgattcaaagccaactcaacgacaattcaccattctgaactttaacgacttgatgagcagtgccgtccccatgacccccgaggacccctccttctgggactgtttttgcttcactgaggagattccgatcagaaacggtaccaaaagttag

SEQ ID NO: 27633 - DNA, 1599 bp, Artificial Sequence
  Description of Artificial Sequence: Synthetic coding sequence
atgcagagttgtgagagtagtggcgattccgcagatgaccccctgagtcgcggactccggagaaggggtcagccaagagtcgtggtgatcggggctggtttagccggactggctgcagctaaggcgctcctcgaacagggattcacggatgtaaccgtgcttgaggccagctcccatattgggggacgggtgcagtctgtgaaactcgggcatgctacattcgaactgggagcaacatggatccacggaagtcacggcaaccccatatatcacttggctgaggccaacggcctgctcgaggagacgaccgatggcgagcgctcagtgggcagaatctccctgtacagcaaaaatggagtagcatgctatcttaccaatcatggcagacgcattcccaaggatgtcgtggaggaattctctgacctgtacaacgaggtgtataatctgacgcaggaatttttccgtcacgacaaaccagtcaacgccgagagtcagaactctgtcggtgtcttcacccgcgaagaagtcaggaatcgcatccgaaacgaccccgatgaccctgaggctaccaaacgcctgaagctggccatgatacagcagtacttaaaagttgagtcatgcgagtcctccagtcattctatggacgaggttagtctgtccgcgtttggagagtggacggagatacctggagctcaccacattattccgagcgggttcatgagagtggtggaattgctggcggagggcatcccagcacacgtgatacagttaggaaaaccggtacgatgcatccattgggatcaagcctccgcacgtccgagaggacccgagattgagcctaggggcgtccttaagcgtcaatacaccagcttttttcgccctgggctgccaaccgagaaagtcgctgccatccatagactaggtattggcactacagacaagattttcctggaattcgaagagcccttctggggccctgagtgtaactcgctgcagttcgtttgggaagacgaagccgaatcccacactcttacttacccaccggaactgtggtatcggaaaatctgcggttttgacgtgctgtaccctcctgagcgctacggccacgtcctgtccgggtggatatgcggcgaggaggcgcttgtcatggaaaaatgtgatgatgaggctgtggccgaaatttgtacagagatgctgcgtcagtttacgggcaatcccaacatccctaaaccgcgtagaattttgagatctgcatggggctctaacccttactttagaggctcctacagttacacccaggtgggctcttccggagcagacgttgagaagctcgccaagccattgccttacactgagtccagcaagacagcccatggatcgtctactaaacagcaaccaggccacctgttttcaagtaaatgtccagagcagcccctggatgccaatcggggagctgtgaagcctatgcaagtgttgttcagtggcgaggccactcaccggaaatattactcaacgacgcatggcgcactcttaagcggtcagcgagaagccgctcggcttatcgaaatgtatcgcgacctctttcagcagggaacctag

SEQ ID NO: 27634 - DNA, 2349 bp, Artificial Sequence
  Description of Artificial Sequence: Synthetic coding sequence
atggactcttccatccatctgagttccctgatatcccggcatgacgacgaggccacaagaacctcgacttccgaaggattggaggagggcgaagtggagggggagacactgctcatcgtcgaatccgaagatcaggcttctgtggacctcagccacgatcagagcggtgacagcctgaactcggatgagggagatgtgagttggatggaggagcaactgtcttacttttgcgacaaatgccagaagtggatccctgcctcccagctgcgcgagcaactgagctacctgaagggagataatttttttaggttcacgtgctccgactgttctgccgatggcaaggagcagtacgagcgactaaaactgacctggcagcaggtggtgatgctggctatgtataacctgagtttggagggaagtgggagacaggggtattttagatggaaggaagatatttgcgccttcattgaaaaacactggacttttttgctcgggaaccggaaaaagacatccacttggtggtccacagtggcgggttgccttagcgtggggtctcccatgtacttcagaagtggcgcacaggagtttggggagccaggctggtggaagctggtgcacaacaagccacctacaatgaagccagagggagagaagctgtccgccagcactctgaaaatcaaggcagcctccaaacctacattggatccgataattactgttgaaggcttgcgcaagagagcttcaagaaaccctgttgagagcgcaatggagttgaaagagaagagatcaaggacccaggaggccaaagacatcagacgggctcagaaagaggccgctggttttctcgacagaagtacatcatctacaccagtgaagtttatttccaggggaagacgccctgatgtgatcctggagaagggcgaggttattgacttcagttccctgtcaagcagcgacaggacccctcttaccagtccgtctccttcccccagtctcgacttttcagccccaggcacacccgctagccatagtgctacgcctagtttgctgtctgaggctgacttgatcccggatgtgatgcctcctcaggcgctgtttcacgatgacgacgaaatggagggggatggcgtaatcgaccccggaatggagtatgttccccctcctgcaggatctgtggcctctgggccagtggtgggagtccggaaaaaagtgaggggccctgaacagattaaacaagaagtggagtctgaggaagagaagccagacaggatggatatcgattctgaggacacagatagcaatacttcgctccagacacgcgctcgtgagaagcggaagcctcaactcgaaaaagacactaaaccaaaagaacctcggtacactcccgtgtccatttacgaagagaagcttcttttgaagagactcgaagcttgtcccggtgctgtggccatgacaccagaggcccgacgactaaaacggaagctgattgtacgtcaggccaagcgtgatagagggttacccctgtttgaccttgaccaggttgttaacgccgctctgctgctagtcgatggcatttatggagccaaagaaggcggtatctctcggctgcccgcagggcaagctacgtaccggaccacctgtcaggactttaggatccttgatcgctaccaaacttcccttccatcccgaaagggctttcgacatcagaccacgaaatttctgtatcgcctcgtgggaagtgaggatatggcagtggatcagtctatagtgtccccctatacttctcgcatcctgaaaccctatatcagacgggattatgagacaaagccccctaagctgcagttgctgagccagattagaagccatttgcataggtctgaccctcattggacccccgaacccgacgcccctttagactattgctatgtcagacctaatcatattcctacgataaatagcatgtgtcaggagttcttctggccagggatagacttaagcgaatgcctgcagtatcctgatttctcagtcgtggttctttacaagaaagtcataatcgcgttcggctttatggtccccgatgtgaagtacaatgaggcatacataagctttctgtttgtgcaccccgagtggagaagggccggtatcgccacctttatgatttaccacctgattcaaacttgcatggggaaggacgtgaccctgcatgtctctgcgtctaaccccgctatgttattatatcagaagtttggattcaagacggaggaatatgtgttggatttctacgataagtactacccattggagtccactgagtgtaagcatgcattcttcctccgcttacgcaggtag

SEQ ID NO: 27635 - DNA, 2745 bp, Artificial Sequence
  Description of Artificial Sequence: Synthetic coding sequence
atgggaacgacggcccctgggccaattcatctgctggagctctgcgaccaaaaacttatggagttcctgtgcaatatggacaacaaggaccttgtgtggcttgaggagatccaggaagaggctgagcggatgtttactcgggagttctccaaggagcccgaactgatgcctaaaacaccttctcagaaaaacaggcggaagaaaaggcgcatcagctacgtacaggatgagaaccgggatccgattagacgtagactgtcaaggcgcaagagccgctcatcccagctgtcatcccgacggttacgctctaaagatagcgtggagaagcttgctaccgttgtcggggagaacggctctgtactgcggcgagtaacacgggctgcagccgctgctgccgctgccacaatggccctggctgcgccttctagtcctaccccagagtctcccaccatgttgactaaaaagcctgaagataaccatactcagtgccagctcgtaccagtggtggagatcggcatctcggagcgccaaaacgctgagcagcacgttacccagttgatgtctacagaacctcttccaaggaccctctctcctacaccagcttccgccaccgcaccaacatcacagggtatcccgaccagcgacgaggagagtacaccaaagaagagtaaagcgaggattctcgagtcaattaccgtgagttccctgatggccacgccgcaagatcccaagggacagggggtcggaactggacggtcagcatcaaagctgcgcatcgcacaggtgtcccctgggcctcgcgactctcctgccttcccagactctccatggagggaacgggtccttgctcctatcctgcccgataatttctcaacaccaacaggctcaagaaccgactctcagagcgtcaggcactctcccatcgccccatcttctcctagcccccaggtactggcgcagaaatactctctggtggcaaagcaagagagtgtcgtgcgacgggcatctcgcaggctcgccaagaagacagcagaggagcctgccgctagcggaagaatcatttgccactcctacttggaaagattgcttaacgtggaagtgccccagaaggtggggtcagagcagaaagagcccccagaagaggccgaacctgtggccgcagcagagcccgaagtcccggagaataatggcaataactcttggcctcataatgacaccgagatcgcgaacagcacacctaacccaaagccggctgcctcaagccctgagacccccagcgcaggccaacaggaggcgaagactgatcaggctgacgggcctagggaacccccacagagcgccagacgtaagcggagctataaacaggcagtaagtgagctggacgaggagcagcacttggaagatgaagagttgcaacctcctcgtagcaagactccctcttcaccctgtccggcaagtaaggtggtgaggccactgaggacattccttcacacagtgcagagaaaccagatgttaatgacacctacctctgcacccagatccgtgatgaaatccttcataaagcggaacactcctctcaggatggatccgaaggagaaagagcggcaacgcctcgagaacctgaggcggaaggaagaggctgaacagttgcgtaggcagaaagtggaggaagataaacggagacggctcgaagaagtgaagctcaagcgcgaggagcggctcagaaaagtgcttcaggctagagaaagagtcgagcagatgaaggaggagaaaaaaaagcaaatcgagcagaagtttgcccagattgatgagaaaacagagaaagccaaggaggagagactcgctgaagaaaaggccaagaagaaggccgctgcaaagaagatggaagaggtcgaggccagaaggaagcaggaggaggaggcccgacggttgcggtggttgcagcaggaggaagaggagagaaggcaccaagaattgcttcagaagaagaaagaggaggagcaagagcggttgagaaaagccgcagaggccaaacggctggccgaacagagagagcaggagaggagagagcaagagagaagagaacaggagaggagagaacaggaacgaagagagcaggagaggcgtgaacaagaacgccagcttgcggagcaagaacgcaggagggagcaagaacggctgcaggccgagagggagctgcaagagcgcgaaaaagccctgcgcctgcagaaggagcagctgcaaagagagttagaggagaaaaagaagaaagaagagcagcagaggctagccgagcggcaattgcaggaagagcaggagaagaaggcaaaggaggccgctggagcgtccaaagcgctgaatgttaccgtcgatgtgcaaagtcctgcctgcacctcataccaaatgaccccccagggccatcgcgctcctcctaagatcaaccctgacaattacgggatggatttaaattctgatgattcgacagatgacgaagcacacccgagaaagccgataccaacatgggcccgtgggacacctttgagtcaagctattatccatcagtattaccacccacccaatttactggagctctttgggactattctgcctctggacctggaagatatcttcaagaaatcaaaacccagatatcataaaaggactagttccgctgtttggaactctccgccattgcaaggggcacgcgtgccatcctccctcgcatacagcctaaagaagcactag

SEQ ID NO: 27636 - DNA, 4149 bp, Artificial Sequence
  Description of Artificial Sequence: Synthetic coding sequence
atggacgaagaagagaatcactatgtttctcagctgcgagaggtttattcaagctgcgataccacggggactggtttcctcgatcgccaagagctgactcagctatgcctcaagcttcacctcgagcagcagctgccagtgctccttcaaacgcttctcggcaacgaccacttcgcaagagtgaattttgaagagtttaaggagggcttcgtggcagtcctatctagcaatgccggagtgcgcccaagcgacgaagacagctcttcacttgaatcagctgcctcctcggcgattcctcccaagtatgtcaatggatctaaatggtatggacggagaagcaggcccgagctctgtgatgccgcaacagaggccaggcgggtccccgaacaacaaacccaggcatctcttaaatcgcatctctggcgatccgccagtctggagagtgtcgagtcaccgaagagcgacgaagaagctgagtcaaccaaggaggcccaaaatgagcttttcgaggcgcagggccagctgcagacttgggacagcgaggactttggctcacctcagaagtcttgttccccctcttttgatactcccgaatctcagattcgcggagtctgggaggagcttggtgttgggtccagcggacacttatccgagcaggagctggcagtggtatgtcagagtgttggcctgcagggactcgagaaagaggagctcgaagatctatttaacaaacttgatcaggatggggatggaaaagtgagtctggaagagtttcaactagggctcttctcacacgaaccagctcttctgttagaaagctctaccagggttaagccctccaaggcttggtctcattaccaggtgcctgaggagtccggatgtcacacaacgaccacctccagcctcgtgagcctgtgcagttcattgagactcttttcatcaatagacgatggaagcggattcgctttccctgatcaggtgcttgctatgtggacacaggaggggattcagaacggtagggagatcctgcagagccttgatttcagtgtggatgaaaaggtcaacctgctggagctgacctgggccctcgataatgagctgatgactgtggacagtgcggtgcagcaagctgcgcttgcctgttaccaccaagaactttcatatcagcagggccaagttgagcaactcgccagggaaagagataaggccagacaggatctggagagagcagaaaaaaggaacctggagttcgtgaaggagatggacgactgccactcaactcttgaacaactcactgaaaagaaaatcaaacatctcgaacaaggatacagggaaaggctgtccttgctccgcagcgaagtagaggctgagcgcgaactcttctgggagcaggctcacaggcaaagagctgccctagaatgggacgtgggcagactgcaggctgaggaggcgggactgagagaaaaacttacactcgctctgaaggagaacagtcgcctgcaaaaagaaatcgtggaggtggtagagaagctctcagactcagagcgtctcgctctgaagctgcaaaaggacctggagttcgttctcaaggacaagcttgaacctcaatccgcagagctactagcacaggaagaacggtttgctgcggttctgaaagagtacgaactgaagtgtagggacctccaagatcgcaatgatgagctccaagcagagctcgagggtctgtgggcaaggcttccaaagaaccgacacagcccttcttggtctcctgacggacgccgacgccaactccccggattgggtcctgctggaatttcttttctaggaaactcagccccagtttcaatcgaaacagaactcatgatggagcaagtgaaagaacactaccaggatctgcgtactcagttggagactaaggtgaactattatgagcgcgaaattgctgcactgaagagaaattttgaaaaagagcgcaaagatatggagcaggccaggaggcgagaagtttccgtgctggaaggacagaaagcagaccttgaggaacttcacgaaaaatctcaggaggttatatggggcctgcaggaacagttacaggacacggcacggggtcccgaacccgaacagatgggattagcaccttgttgtacccaggccctgtgcggcctcgccctcagacatcactctcatctgcagcaaatcaggagggaagctgaagccgaactgtcgggggaactctcgggactgggtgccctgcccgctagacgagacctgacgctggagttggaagaaccccctcaggggccactgcccagagggtctcaacgcagcgaacagctcgagctcgagagagcactgaagctgcagccatgcgccagcgagaaacgtgcgcagatgtgcgtgtctctcgcgctcgaagaggaggagctggagcttgcccgagggaagagagtcgatggcccatctctggaagcagagatgcaggccctgcccaaggacggccttgtggcgggatctggacaggaaggcactcgagggctgttgcctttgcggccagggtgcggggaaagacctctcgcctggttggccccaggagacggtcgggagtccgaggaagcagccggtgccggtcctcggaggagacaggctcaggacaccgaagcaacccagtcacctgccccagcccctgcacccgcttctcatgggccttcagaacgctggtcgagaatgcagccctgtggggtggacggcgatattgtgcccaaagaacccgagcccttcggagcctcagctgcaggccttgaacagcctggcgctagagaacttccactgttgggcaccgagagggacgcgtcccaaacccagccaaggatgtgggaaccgccactcaggccagccgcatcctgccgcggtcaggctgagagactgcaggccatccaggaggagcgggcacgatcatggagcagaggaactcaagagcaggcaagcgagcagcaagctcgtgctgaaggcgcactggaacctggctgccataagcattccgtggaggtggctcggaggggcagcctcccttcccacctgcagttagccgacccccagggtagctggcaagaacagctcgctgcgccagaggagggcgaaacaaagatagccttagagagggagaaagatgacatggaaacaaaactgctacaccttgaggatgtcgtcagggcactcgagaaacacgtcgacctgagagagaacgaccgactcgagtttcatcggctgtcggaagagaataccctccttaagaatgatctgggacgcgttaggcaggaattggaggctgcggaatcaacccatgatgcccagcggaaggaaatcgaggttctaaagaaggacaaagagaaggcatgttctgaaatggaagtgctcaatcgccagaaccaaaactataaggatcagctttcccaactaaacgtacgggtgctccagcttggacaggaagcatcaacccaccaggctcagaatgaggagcaccgtgtcactatccagatgctgacccagtccctggaggaggtcgtccggtctggacaacagcaatcagaccagatacaaaagcttcgtgtcgagttggaatgcctgaaccaggaacaccagtccctccagctgccatggtccgagcttactcagacactggaagagagccaggatcaagttcagggcgcacatctaaggctccgccaagctcaagcccagcacctgcaggaagtacgactcgtgccacaggaccgagtggccgagctccatcgcctgctgtcgctgcagggcgaacaagccaggcgacgcctggacgctcagagggaagaacacgaaaaacaactgaaggcgaccgaagaaagagtcgaagaggccgagatgatcctgaagaacatggagatgctgttacaggagaaagtggataagctcaaggagcagtttgagaaaaatactaagagtgatctcctgctgaaggaactctatgtggagaatgcccacctcgtgcgcgcactccaggccactgaggaaaagcagcgaggtgcagagaagcagagccggctcttggaagaaaaggtcagggcacttaacaagctggtgtccagaattgcacctgccgctttgtccgtgtag

SEQ ID NO: 27637 - DNA, 4383 bp, Artificial Sequence
  Description of Artificial Sequence: Synthetic coding sequence
atggctgggagacctctcagaattggagaccagttggtcctcgaggaggactacgatgagacctatattccatccgagcaggaaatcctcgagtttgcgcgagagattggtatcgaccctattaaggagcctgagcttatgtggctggctagagagggaatcgtggcaccgctgcccggagaatggaagccttgccaggacattactggcgatatttactactttaatttcgccaacggtcagtctatgtgggatcacccctgtgacgaacattataggtccctcgtgatccaagagcgcgctaagctctccacctctggcgcaatcaagaaaaagaagaagaagaaagagaagaaggacaaaaaagatcgagacccgccaaagtcttcccttgcccttggctcatcccttgccccagtccatgtgcctctggggggactagccccactccggggattggtggacaccccaccttcagcactcaggggtagtcaatctgtctctctcggttcgtcggtcgaatctgggcgacaattgggtgaactgatgcttcctagtcagggattgaagaccagcgcctacacaaaaggtctactgggttccatatacgaagataagaccgcgttatcattgctaggcctgggtgaagagacaaacgaagaagatgaggaagagtctgacaaccagtccgtgcacagctcttctgagccgttacgcaatctccacctggatattggcgcacttggaggagactttgaatacgaggaaagtctacgcaccagccagcctgaggaaaagaaggatgtctcccttgattccgatgcagccggaccaccgaccccctgtaagccgtctagtcctggtgcggacagttctctttctagcgctgtaggcaagggacggcaggggtcaggtgccagacccggactaccggaaaaggaagaaaatgagaagagtgagccaaagatctgccgaaacctcgtgactcctaaggccgaccctactggatcagaaccagccaaggcctctgagaaagaggcgcctgaggacaccgtagatgcaggcgaagaggggtccagacgggaagaggccgcaaaggagccaaaaaaaaaggcatcagcccttgaggaaggctcatctgatgcatctcaggaactcgagatctcagaacacatgaaagaaccccagctgtctgattccatcgcctccgatccaaaatctttccatgggctggacttcggcttccggagccgaatctctgagcacctgctcgacgtagacgtgttgtcccctgttctgggcggtgcctgccggcaggctcaacaacccctaggtatcgaggacaaggacgactcacaatcctctcaggatgaactccagtcaaaacaatcaaaggggttagaagagcgcttatcccccccattgcctcacgaagagcgggcacagagtccccctcggtcactcgccaccgaagaggaacctccacaaggccctgagggccagccagagtggaaggaagcagaggagctcggggaggactccgctgccagtcttagtttgcagctgagcctgcagagagaacaggcccctagccccccagccgcatgtgagaaaggcaaggagcaacactctcaggccgaagagttaggccctggccaggaggaagcagaagacccagaggagaaggtggccgtctcccctacaccgcctgtctctccggaagtgcggagcacagaacccgttgcaccacccgagcaactgtcggaagccgcactcaaagcgatggaggaagcagtagcccaggtcctagaacaggatcagagacacctcctcgaaagcaaacaagaaaaaatgcagcagctcagagagaagctgtgccaggaggaggaagaggagattctccgtctacaccaacagaaggagcagtcactctcttctctgagggagcgcctccagaaggctatagaagaagaggaggcgcgtatgcgcgaggaggaatcccagcgtctgagttggctcagggcccaggtacagagctccacccaggctgatgaagaccaaatacgtgccgagcaggaggcttctttgcagaaactgagggaggaactggaatcccagcagaaagccgaacgggctagcctcgaacagaagaataggcagatgctcgaacaattgaaggaagagatcgaggcctccgagaagagcgagcaagccgcactaaacgccgcaaaagagaaagcactgcaacaattaagagaacaattggaaggcgaaaggaaggaagctgttgctaccttagaaaaggaacactctgcggagctggagagactctgttcgagtcttgaggccaagcatagagaggtggtcagttctcttcagaaaaagattcaggaggcgcagcagaaggaagaggctcaattgcaaaagtgcctgggacaggtcgaacatagagtccatcaaaagtcttaccacgtggctggctacgagcacgagctctcaagtctgctgagggagaagcgccaagaagtggaaggggaacatgagagacgcttagataagatgaaggaagagcaccaacaggtcatggcgaaggccagagagcagtatgaggctgaagagcgcaaacagagggctgagctgctcggtcacctaactggcgaactggagcgccttcagagagctcatgagcgggagctggagaccgtaagacaggagcagcataagcgcttggaggacctgcgcaggagacatcgagagcaggaacggaaattgcaggacctcgaactggatttggagaccagggccaaagacgttaaagctcgccttgccttattagaagtccaggaagagactgccagacgagaaaagcagcagctgctggatgttcaacgacaggtagctctgaagtccgaagaggctacagctacccatcagcagctagaggaggcacaaaaggagcacacccatctgttgcagtccaaccagcagctacgagagatactggacgagcttcaagcacggaagttgaagttagagagtcaagtggatctgctacaagcacagtcacagcagctccaaaagcatttcagtagccttgaggccgaggcccagaaaaaacagcaccttttaagggaggtgacagtagaagaaaacaacgcatcacctcatttcgagccagacctccacattgaggacctgcgcaagagtctcgggacaaatcaaactaaagaagtttcctcatcgctgtcccagtcaaaagaggacctgtacctggacagtctgtctagccataacgtatggcacctcctttctgccgagggggtcgccttgcgttccgccaaggagttcctggtccagcagacacgctctatgcgccgaagacagactgctttgaaggccgcacagcaacattggcggcacgagctggcgtccgcccaggaggtggccaaagatcctccagggatcaaggcactggaggatatgagaaaaaacttggagaaggagaccaggcacctcgacgaaatgaagagtgcaatgcgaaaaggccacaacctcctaaagaaaaaagaagagaagctcaaccagcttgaaagttccctgtgggaagaggcaagtgatgagggtacactgggaggctcccctacaaaaaaggccgtgacatttgacctgagtgatatggattccctctcatccgagtcctcagaatcctttagtccccctcaccgagagtggtggcgccaacagagaatagatagtaccccatccctgacaagtaggaaaattcatggccttagccactcattgagacaaattagctcccaactgtcctctgtgttgagtatccttgactcactgaatccgcagagtccccctccactgttggcatccatgcccgctcaattacctccccgagatcccaaaagcacgcctaccccaacgtactacggatctctggctcggttcagcgctctatcctcggctacacccacctcaacgcagtgggcatgggactcaggccaaggcccacggctcccttcaagcgttgcccagactgtcgatgatttcttactggagaagtggcgcaaatattttccaagcggcattcctctgttgagtaactcaccaacccctctcgagtcaagacttggctacatgagcgcctcagaacagctccggctgctacagcatagccactctcaggtcccagaggccggttcgaccacattccagggtatcattgaggctaatcgacgatggttggaaagagtgaaaaatgatccaaggcttcccctgttctcctcgacccccaagcccaaagccacattaagcctgctgcagctggggctcgatgagcacaatagggttaaagtctatcgattctag

SEQ ID NO: 27638 - DNA, 1881 bp, Artificial Sequence
  Description of Artificial Sequence: Synthetic coding sequence
atgatggccaatgacgccaaaccggacgtgaagactgtacaggttctgagggacacggcaaatagactgagaatccattccatcagggcaacctgcgcgagcgggagcggccagctgacttcttgttgtagcgctgccgaagtggtcagtgtgctgttttttcacactatgaagtataaacagaccgatccggaacaccccgacaacgaccggttcatcctgagccgcggacacgcagcccctattctgtatgcggcatgggtcgaggtaggggacatctctgagagcgatctcctcaatctgaggaagctccattctgatctcgagaggcaccctacacccagacttccattcgtggacgtggctaccggcagccttgggcaaggtttaggcactgcttgcggtatggcctacacaggtaagtatttagacaaggcgagttatcgcgtcttctgcctcatgggagatggcgaatcctcggaggggtccgtctgggaagcattcgctttcgctagccactacaacctggacaatctcgtggctgtgtttgacgttaatcgcttagggcagagtggtcccgcacccctggaacatggtgccgacatttatcagaattgctgcgaggcatttggctggaatacatatcttgtggatggtcatgatgtcgaggccttgtgccaagctttctggcaagcctcacaggtgaaaaacaaacccacagcaatagtagcaaaaactttcaaaggtcgcggaatccctaacatagaggacgcggagaactggcatgggaaacctgtgcctaaggaacgcgcagacgccattgtcaaactcatcgagtctcagatccagactaacgaaaacctgattcccaaaagtcccgtggaagatagcccccaaatatcaatcacggatatcaaaatgaccagtcccccagcctacaaggtgggtgataagattgctacccagaagacatacggccttgctcttgcaaaactggggcgtgctaacgagagggtgatcgtgcttagcggagacaccatgaacagtacgttctctgagattttcaggaaggagcatcctgagaggttcatcgagtgtatcatagcggaacagaatatggtctccgtcgccctcgggtgtgccaccagaggccgtacaattgccttcgccggagcctttgccgctttctttaccagggcctttgatcaactgcgtatgggagcgatcagccaggctaacatcaatctcataggatcacactgtggtgtgtcgactggagaagacggagtatcacaaatggctctggaggacctcgccatgtttaggtccatccccaactgcacggtgttctacccttccgatgccatttccaccgagcacgccatttacctcgccgctaataccaagggcatgtgtttcatccgcacctctcaaccggagacggccgtaatttatactccccaggagaattttgaaataggacaggcaaaagtcgtccgtcacggagtaaatgacaaagttaccgtcataggggcaggcgttaccctgcacgaggccttggaggcagcggatcacctctcacagcaaggcatcagtgtccgagttatcgatcccttcaccatcaaacccctggatgccgcaaccattatatcctccgctaaggccacagggggacgagtaattacggtagaggaccactatagagaaggtggaattggagaggccgtctgcgctgcagtgtcccgtgagcctgatatcttggtccaccaacttgcagtgagtggagtaccccagaggggcaaaacctcagaacttttggatatgttcggtatttcgactagacacattatcgccgctgtgacgctgacgttaatgaaatag

SEQ ID NO: 27639 - DNA, 999 bp, Artificial Sequence
  Description of Artificial Sequence: Synthetic coding sequence
atggctactatcaaaagcgaactcatcaaaaactttgccgaagaggaagctatccatcataataagatcagcatcgtcggaaccggctccgtcggagttgcctgcgctattagtattctcctgaagggactgtccgacgaactggtgttggtggatgttgacgagggtaagttgaaaggtgagacaatggaccttcagcacggctctcctttcatgaagatgcctaatatagtatctagcaaggattacctagttacggctaattcgaatctggtcattattaccgccggtgcccgtcaaaagaaaggggaaacacggttagatctcgtacagcgaaatgtcagtattttcaaactaatgatcccaaatatcactcagtattcacctcactgcaagctgttaattgttactaatccagtggacattctgacgtacgtggcatggaagctcagtggcttccctaaaaacagggtgatcggttctggttgcaatttggatagtgctcgtttccggtactttattggccagagactcggaatccattctgaatcctgtcacggcctcatactcggtgaacacggtgatagttcggtgccagtgtggtcaggcgtgaacatcgccggagtgccattaaaggacctcaacccagacattggaacagataaggaccccgagcagtgggagaatgtacataagaaggtcatctcatccggatacgagatggtgaaaatgaaaggttacacttcctggggcatcagtttgagtgttgctgatctgaccgaatctatcctgaaaaacttgagacgcgtgcatcctgtttctacactcagcaagggcctttacggtataaacgaggatatttttctgtccgtcccatgtattctcggggagaacggcattacggatctcataaaagtgaaactgaccctggaggaggaagcttgcttacagaagagtgctgaaaccctatgggagatccaaaaggaactaaaactgtag

SEQ ID NO: 27640 - DNA, 972 bp, Artificial Sequence
  Description of Artificial Sequence: Synthetic coding sequence
atgcctgaaatgccggaagacatggaacaggaggaggtgaatatcccaaacaggagggtgctcgtgacaggcgcaaccggattgctgggtcgggcagtgcacaaggagttccagcagaacaactggcacgccgtcgggtgcggcttccgcagagccaggccaaagttcgagcaagtcaaccttctagatagcaatgcagttcatcatataattcacgattttcagccacacgttattgtccattgtgctgctgagaggcggcctgatgtcgtcgaaaaccagccagacgccgctagccagctgaatgtggacgcttccggcaacctcgccaaggaggcagccgctgtgggggcttttctcatttatatctccagcgactacgtcttcgacgggactaacccgccttaccgggaagaggatatcccagccccacttaacttgtacggcaaaacgaaactggatggagagaaagccgtgctcgagaacaacttgggggcagcagtgctgcgcatacccatcctgtatggagaagtggagaaacttgaggaatcggcagtgaccgtcatgttcgataaggtgcagttttctaataagagtgcaaatatggatcactggcagcagcgattcccaacacacgtgaaggatgtcgcaaccgtctgtagacagttggctgaaaaacgcatgctggacccatcaattaagggcaccttccattggagtggcaacgagcaaatgactaagtatgagatggcctgcgccatcgctgacgcctttaatctaccaagctcccatctgcggccaataaccgatagcccagtgctgggcgcacagaggcccagaaatgcacagctggattgttcaaaattagagactctcggtatcggtcagaggacaccctttagaatcggtatcaaagagagcttatggccttttcttatcgataaacgatggaggcaaacagtgttccactag

SEQ ID NO: 27641 - DNA, 3285 bp, Artificial Sequence
  Description of Artificial Sequence: Synthetic coding sequence
atggcagaatcctccagtgagtccgaccatttccgctgtagagataggctttccccctgggccgcacgttccactcatagaggaacccgtagtctccctacagtggaagtaaccgaaaaagtgaatacaatcacctcaacgctgcaagatacatcaaggaatctgaggcaagttgatcagatgctgggaagatatcgcgaatacagtaacggccaggcaggcgcaatcgaacacctgaaggaatcactcgagcagagcattgaccaactgcgctcccagcggctgcttaggaattctggcggtaggtcgatcagcgtgacgtccctttcggcctcagatctggatgggggtaccggaagcgaactgcaccattttccccctacaagcccactgaaggattatggcgatccgcaaggcatcaagcgcatgcggtctaggaccggggtcagattcgtgcaggagactgatgatatgactcagttgcatgggtttcaccagagcctgagagacttgtcttcagagcagatccggctgggggatgattttaaccgcgagctgtctcggcgatctaggagtgatgccgagaccaagagggccctggaagagctgacagagaagttgaacgaggctcagaagcaggaggtggtcagcgatagagtggaaagacggctgcaagagttggagcgagagatgaggaccgagcgggaactagtggagaggcggcaggaccagctgggcctcatgagtctccagctacaagaggcgctcaagaagcaggaagctaaggcggacgagcacgagggggctatcaagaacaagctaagacagaccgaaaccgaaaaaaaccagctggaacaggagctagaactttcccgcagactgctcaaccagagcgagggatcgcgggagaccctgttgcatcaagtagaggagctgcgcactcagctcaccaaagctgagggagatcgaaaagggctccagcaccaagtgtcccagattagcaagcaacagtcgaattatcaggatgagcagggggaagactggcggttccgtcggggagtcgagagagagaagcaagatctggaaaagcagatgtctgatcttcgagtccagctcaacttttccgccatggcctcagagctggaggaagtgaaacgctgtatggagcgcaaggataaagagaaagcccacctggcttcacaagtggagaacttaacgcgagagctggagaatggtgagaagcagcagttacagatgcttgatagactgaaagagattcaaaatcatttcgacacatgcgaggcagagcgtaagcatgctgacttgcaaatcagcgagttgactaggcacgcagaggacgctacaaagcaggctgaacgctatctgagtgagctacagcaaagtgaggccctgaaggaagaggctgagaaaaggagagaggacttaaaactgaaagctcaggagtcgataaggcagtggaaactcaagcataagaaactcgagcgcgcactcgagaagcaaagcgaaacagtcgacgagctcactggcaaaaacaatcagattctgaaggaaaaagacgaattaaaaacacagctttacgccgctttacagcagattgagaacctgaggaaggagcttaacgacgtactgactaaaagagccctgcaagaggaggaactccactctaaggaggaaaaattaagggacattaaatcacaccaggcagacctggaactggaagtcaaaaattctctggacacgatacatcgtctggaatccgagctgaagaaacagagcaaaatacaatcccaaatgaaagtggaaaaggcgcatctggaggaggagattgccgaactgaagaagagtcaggctcaggacaaggccaagctgctcgaaatgcaagagagcataaaagacctgagtgccatccgcgcagacctggctaacaagttggcggaagaggagcgcgctaagaaagccgtactgaaagatctgtctgacctgactgcccaggcaaaatctcgcgatgaggagacagcaactatcatcactcaattaaagctggagcgtgacgtgcaccagcgcgagttgaaggatctgacttcatcgcttcagagcgttaaaaccaagcacgagcagaacattcaagaactaatgaaacacttcaagaaggagaagtccgaggcagagaatcatataaggacactcaaagccgaaagcctggaggagaagaacatggccaaaatccatcgtggacagctcgagaaacttaaatcccagtgcgataggttgacagaggagctgacccaaaacgaaaacgagaacaagaaactcaagcttaaataccaatgcttgaaggatcagctagaggaaagggagaagcacattagcatcgaggaagaacacctgcgcagaatggaggaggctaggctacaattgaaggatcagcttctgtgccttgagaccgagcaagagagcattctgggcgtcattggaaaggaaatcgacgcggcttgcaagaccttttccaaagattccgtcgagaagctcaaggttttcagcagcggcccagatattcactacgatccacatcgctggttggccgagtcaaagactaagctgcagtggttgtgcgaagaacttaaagaacgcgagaaccgcgaaaagaatctgaggcatcagctgatgttgtgcagacagcagttacggaatctgacagagaacaaagagtccgaactccaatgtctcttccaacagatcgaaagacaggagcagctgcttgacgaaattcacagggagaaacgagacttactcgaggaaacccagcgcaaagacgaggagatgggaagtcttcaggatagagtaatcgctctcgagacatcgactcaggttgctctcgatcaccttgagtcagtaccagaaaagctatctctgctggaagattttaaggattttagagattcatgtagcagtagtgaacgaacagacggcaggtactccaagtaccgggttaggaggaatagtctgcaacaccatcaagatgacacaaagtatcggacaaaatctttcaaaggggataggacttttctggaaggatcgcatactagggggcttgatcacagtagctcatggcaggaccatagccgattcctaagtagcccacgctttagctatgttaatagctttacaaaaaggactgttgcacccgattcagcctccaataaggaggatgctactatgaacggtacctcatctcagcctaaaaaagaggaatacggcagttag

SEQ ID NO: 27642 - DNA, 1011 bp, Artificial Sequence
  Description of Artificial Sequence: Synthetic coding sequence
atgaagaaggagcacgtactccattgccaattctcagcatggtatcccttcttccgcggtgtgactatcaagtctgtcattctcccactgccgcagaatgtgaaggattatctgctggacgacggcaccctggtggtgtccggaagggacgatccacctacccacagccaaccagattcggatgacgaggctgaggaaatccaatggtccgacgatgaaaatacagccacactcactgcccctgaattcccagagttcgcaacaaaggtgcaggaggctatcaactctctcggtggctcagtatttcctaaactgaactggtccgcccctcgtgatgcgtattggattgccatgaactccagcttaaaatgcaaaactctatccgatatcttcctcctgtttaagtcttccgattttatcacacgcgatttcacgcagccatttatccattgtactgatgattcaccagatccttgcatagagtatgagttagtgctgcgtaaatggtgcgaacttatccctggtgcggagttccggtgcttcgtgaaggagaacaagctgatcggcattagccagagggattatacccagtattatgaccatatctccaaacaaaaagaagaaattcgaaggtgcatccaagacttctttaagaaacacatccagtataaattcctggatgaggactttgtgtttgatatatacagggattctcgcggaaaggtgtggctgatcgactttaatccattcggagaagtgaccgactctttgcttttcacctgggaggaacttatttctgagaacaatctgaacggggacttctcagaggtggacgctcaagaacaggatagcccagcatttcgctgtacaaatagcgaagtcaccgttcagccttctccttacctatcctatagactaccaaaggattttgtcgacctgtcaaccggggaagacgctcacaagttgatcgattttcttaagttaaaacggaatcaacaggaagacgactag

SEQ ID NO: 27643 - DNA, 1248 bp, Artificial Sequence
  Description of Artificial Sequence: Synthetic coding sequence
atgaaattgtcccttactaaggttgttaatggctgtaggctggggaagattaagaacctcggcaaaacaggtgatcatactatggacatccccggttgtctgctgtacacaaaaaccggcagcgcaccgcacctgactcaccacaccctccataatatccacggggtcccagccatggcccaacttacattgagctcactagccgagcatcatgaggttttgaccgagtataaggaaggagtgggaaagttcatagggatgccagaaagcctgctctactgttcactacatgaccccgtgtctccatgcccagcaggctatgtcacaaacaaatcagtctcagtgtggagcgtggctggaagagtcgagatgaccgtatcaaagtttatggcaatccaaaaggctctacagccagactggttccagtgcctgtccgatggcgaagtttcttgcaaggaggccacgtcaatcaagcgcgtgcgcaagtctgtagatagatccctgttattcctcgacaactgcctccgacttcaggaagaatctgaggtgctacagaaaagcgtaataatcggggtgatagagggaggggacgtgatggaagagcggctgaggagtgctcgcgagactgctaaaaggcccgttggcggttttctgcttgacggatttcaggggaatcctacgaccttagaggcaaggctacgactcctgtcctccgtgacggccgagctgcccgaggataagccacgattgatatccggcgtgtctcgaccagacgaggtcttagagtgcatcgagaggggcgtcgatctgtttgaatccttcttcccataccaggtgacagaacggggatgcgctctcaccttttccttcgactaccagcccaaccccgaagaaactctgctgcagcagaatggaactcaggaggagattaaatgtatggatcaaatcaaaaagattgagaccacagggtgcaatcaggagatcaccagcttcgaaataaatcttaaggaaaaaaagtaccaggaagactttaatcctctggtacggggttgttcatgctactgttgcaaaaatcacaccagagcctatatacaccatttgctcgttacaaacgagttgctggctggggttttactgatgatgcacaactttgagcactacttcggcttcttccactacatacgggaagcacttaagtctgacaagcttgctcagttgaaggagctcattcatcggcaggcgtcttag

SEQ ID NO: 27644 - DNA, 1770 bp, Artificial Sequence
  Description of Artificial Sequence: Synthetic coding sequence
atgcccactgtatctgtcaagcgcgacttactatttcaagcattgggcagaacgtataccgacgaggaatttgacgaactgtgtttcgagttcggactggaactcgatgaaattaccagcgaaaaggagataatctcaaaagagcagggtaatgtgaaggctgcaggcgcatctgacgtggtactatacaagatcgacgttcctgcaaaccggtatgatctactgtgcctggagggcctggtaaggggtctacaagtgttcaaggaacgcataaaggcacccgtctataaacgagtaatgccagatggcaaaatacaaaagctgataatcacagaagaaactgccaagatccggccattcgcggttgctgccgtgctgagaaatatcaaatttacaaaagaccgctatgactctttcatcgagctgcaggaaaaactgcaccagaatatttgtcgcaaaagggcgctcgtcgccatagggacacacgacctggacactcttagcggacctttcacttacaccgccaagaggcctagcgatattaaatttaaaccgctcaacaaaacaaaagagtacactgcttgtgagcttatgaacatttacaagaccgataaccacctcaaacactacctgcacattatcgagaacaagcctctctaccctgtaatttacgatagcaacggcgttgtgctatccatgcccccaattattaatggggaccacagccgcatcacagtgaataccagaaatatctttatcgaatgtaccgggacggattttactaaagccaagattgttcttgacataatagttactatgttcagcgagtactgcgaaaatcagtttaccgtcgaggcagcagaggtcgtgttccctaatgggaaatcccacacgttcccagagctagcataccggaaagagatggtccgggcagacttgattaacaagaaagtgggaatcagagagaccccagaaaatcttgccaagcttctgactcggatgtacctaaaatcagaagtgatcggagatggaaatcagatagagatcgagatcccccctacaagagctgacatcattcacgcatgtgatattgtagaagacgccgcaatcgcatacggctacaataacattcaaatgactctgccaaagacatacactatagccaaccagtttcctctgaacaaactgactgaactgctaaggcatgacatggctgcggctggattcacagaggcccttacattcgccctgtgttcccaagaggacatcgcagacaaactaggtgtggacatttctgccactaaggcagttcatattagtaatcccaagaccgctgagttccaggtggctaggactaccctcctccccggtctgctcaagacaattgctgctaacaggaagatgccactacctctcaaactgtttgagatttctgacattgtcataaaggattccaacacggatgtaggtgccaagaactaccgtcacttgtgcgccgtttactacaataagaaccccggtttcgaaattattcacggactgctggaccgcattatgcagctgctggacgtgccccctggcgaagataaaggcggttacgtgataaaagccagtgaaggtccggctttcttccccggaagatgcgccgaaattttcgccagaggacaatcagttggcaagcttggggtgctgcaccctgacgtgatcacaaagtttgaattgactatgccatgctcaagcctggagatcaatgtaggaccctttctttag

SEQ ID NO: 27645 - DNA, 477 bp, Artificial Sequence
  Description of Artificial Sequence: Synthetic coding sequence
atggccgctcagggagttggacctggacctgggtccgctgccccacccggacttgaggccgcacggcaaaagctggccttgaggcgtaaaaaggtactgagcacagaagagatggagctgtatgagctcgcccaggccgcaggaggggctatagatcccgatgtctttaaaattctagtggacctcctgaaactgaacgttgcacccttagccgtgttccaaatgttaaagagtatgtgcgccggacagcggctagctagtgaacctcaggaccccgctgccgtttccctccctacttcgtctgtgccagaaactagaggtagaaataaaggcagcgctgctctgggcggagctttagctctcgcggaaaggtcatctcgagaggggtcgtcacagcgcatgccaagacaaccctcagctaccagactccccaagggaggtggccctggcaagtcacctacaaggggatcaacctag

SEQ ID NO: 27646 - DNA, 675 bp, Artificial Sequence
  Description of Artificial Sequence: Synthetic coding sequence
atggtcgaggacgaactggccctgtttgataaatctatcaatgaattctggaacaagttcaagtcgaccgatacatcttgccagatggccggactgcgggacacatacaaggatagcattaaggcttttgccgagaaactgagcgttaagcttaaggaagaagagagaatggtcgagatgtttctcgagtaccagaatcaaattagtcggcagaataagctcatccaggaaaaaaaagacaacctccttaagctgatagccgaggtcaaaggaaagaaacaagagctcgaggtgttgacggctaatatccaggacctgaaggaggaatactccagaaagaaggaaacgatatcaaccgccaataaagctaacgccgagcggctgaagcgactccagaagagcgctgacctgtacaaggacaggctgggcttggagataagaaagatttatggggagaagcttcagttcatctttaccaatattgatccaaaaaacccagagagtcccttcatgttctccctccacctgaatgaagccagggactacgaggtgtccgattctgcaccacacttagaaggcctcgcagagtttcaggagaacgtaaggaagacaaataacttctccgcatttctggctaatgtccgaaaggcattcaccgctaccgtttacaattag

SEQ ID NO: 27647 - DNA, 1728 bp, Artificial Sequence
  Description of Artificial Sequence: Synthetic coding sequence
atgaaactcaccgattcaaccaaaggctggattgtgtgggcggcactcgactcctccatgcgcggaatgagtctcagtgcagggtcaagccctttgcacagtcctaagataacaccccacaccagcccagctcctaggagaagatcacacactcctaatccagcaagctacatggtccccagctccgccagtacctcagtgaataatcccgtatctcagaccccgagctcaggccaggttattcagaaggagacagtgggcggaactacctacttttacacagatacaactcccgcaccactgactgggatggtgtttcccaattaccacatttacccgcctacggcccctcatgtagcttatatgcagcccaaggcaaacgcaccctctttctttatggcggatgagttgagacaagaattgatcaaccggcacctgattactatggcacagatcgatcaggctgacatgccagctgtacccaccgaagtagatagctatcactccctgtttcccctagaacctctcccccctcctaaccgaattcagaagtcctctaattttggctacatcacgtcatgttacaaggctgtgaactccaaggatgatctcccgtattgcctgcgacgcattcatggattccggttggtgaatacgaaatgtatggtcctggtcgatatgtggaaaaaaattcagcattcaaacatcgtgaccctgagagaggtgttcactacaaaggcatttgccgaaccctccctggtctttgcttacgatttccacgccggaggcgagaccatgatgagccgccactttaacgaccctaacgctgatgcctatttcaccaagcgcaagtggggacagcacgaagggccattgcctcgccaacacgccggactgctgcctgagtcgcttatctgggcttatattgtgcagctgtcaagtgccttgcgcacaatccatacagcgggacttgcctgcagggtaatggaccctactaagatactaatcacagggaagaccaggctgcgtgtgaattgcgtaggagtcttcgatgtgcttacatttgataattcacagaataataatcctctcgctctgatggctcagtatcaacaggccgacttgatttccttgggcaaggtagtcttggcattggcgtgtaactctctcgccggtatccaaagggagaacctgcagaaggccatggaacttgtgacgatcaattattcttcagacctcaagaatctgatcctgtatctactgacagaccaaaatcgcatgaggtctgtcaatgatataatgcccatgatcggcgcacgattctatactcagctggacgcagctcagatgcggaatgacgtaattgaagaggacctcgccaaggaagtccaaaatggacgactattccgtctgctggcgaaattggggactattaacgaaaggcccgagttccagaaagatcctacgtggtccgaaacaggagataggtacttgcttaagctgttcagagaccatctatttcatcaggtcactgaggcaggagctccttggatcgatttgtcccatattattagttgcttgaacaaactagatgccggagtacccgagaaaatttcactcatcagcagagacgagaagagcgtgcttgtagtcacatattctgacctaaaacggtgcttcgagaacacctttcaagaactcattgcagccgctaatgggcagctatag

SEQ ID NO: 27648 - DNA, 1785 bp, Artificial Sequence
  Description of Artificial Sequence: Synthetic coding sequence
atggagtcaaatcacaaaagtggtgacgggctgtcgggaacacaaaaggaagctgccttacgggctcttgtgcagcgcactggctattccctggtgcaggaaaatggtcaacgcaagtacggcggacctcccccaggatgggacgcagctccccctgagcggggatgtgaaattttcatcggcaagttaccccgagacctgtttgaagatgagttgatccccctgtgcgaaaaaatcggcaagatctacgaaatgagaatgatgatggacttcaatgggaacaatcgaggatatgctttcgtcacatttagcaacaaggtggaggccaagaacgctatcaagcagttgaataactatgagatccgtaatggtcgtctcctgggtgtgtgtgcctctgtggataattgtcgcttgttcgtgggtggcatcccaaagactaaaaaacgggaggaaattctgtctgagatgaaaaaagtaaccgaaggcgtcgtggacgtgattgtgtacccttccgctgctgacaaaaccaagaaccgaggcttcgcttttgtggagtatgaatctcaccgggctgccgctatggcgaggcgcaaattgctccctggtcggatacagttgtggggacatggtattgccgtcgattgggctgagcccgaagtggaggttgacgaggacacaatgagctctgtgaaaattctgtatgttagaaaccttatgctgagtacaagtgaggagatgatcgaaaaggaatttaataacatcaaacccggtgccgtcgagagagtgaaaaagatcagagactacgcgtttgtccatttttcgaacagagaggatgctgtcgaggcgatgaaagcactgaatgggaaggttttagatgggtctcccattgaagtgaccctggctaaacctgtggataaagattcctatgtgcggtacacccgcggaaccggtggcagggggacaatgctgcagggagaatacacatactcgctgggacaagtctacgatccgacgacaacctacttgggagcgccagtcttctacgccccacagacctatgcggcaattccgtccttacactttccagccacaaaaggacacctcagtaacagagccattatccgcgctccctccgtaagggaaatctatatgaacgtgcctgttggcgctgcaggtgtcagagggttgggcggacggggatatttggcttacacaggcctgggacgtggttatcaagtcaagggtgacaagcgtgaagataaactatatgacattttgcccggaatggagctgacgcccatgaatcctgtgacgctgaaacctcaaggtattaaactggcaccacagatcctagaggagatttgtcagaaaaataattggggacagcccgtctaccaattgcacagtgcaattggtcaggatcaacgacagctgttcctctataaaatcaccatacctgcccttgcgtcccagaatcccgctatacacccattcacgccgcctaaactgtcagcctttgtggacgaggctaaaacatatgccgctgaatatactctacaaacactgggtatccctactgatggaggagacgggaccatggctaccgctgccgctgctgctaccgcattcccgggatatgctgtgccaaatgcaaccgccccagtgtcggccgctcagcttaaacaggctgtgacactcgggcaagatctggcagcatacaccacttatgaagtatacccaacctttgccgtgacagctcgtggagacggatacggaacattttag

SEQ ID NO: 27649 - DNA, 1167 bp, Artificial Sequence
  Description of Artificial Sequence: Synthetic coding sequence
atgttggaaggatcatggatcaacagacgagaagataagctgggcgtgtactctctggtgcatttttcccccaaaatgctaggctcggtcgcaacaacccttccactcagctcatcaaactcctccgggatgcccctcggctattacctgagcagcccacagatttccagggtgacaatttcaactaccggtcagttgacctctaaagccacagtggggtcctgctccagggtggagaacagcctcgatgccagtccatttagcgtgccgaagaagcaggacgaaagccctatgatcggcgacggtgaggactacttcctttctctgttcggggactccaagaaacttacagctcatagcaattatacccagaaaacactgaaatactttagcatgatccttgaagaggtcggacaattcacaagttcatccctaggcgacgtcgagattgccgaagttaatgtcaaaggcctctttgtaaagctgatcaactcgtcgctggataaagagatggccatcggtgatcacatacttcagcagaatgtgaatggccagactatcagcctataccgcttccttcctaacattgtcatgcaagcaaattctacggtcactgtgtgggccgctgcatccgaagctaaacatcagccgccaagcgactttctttggaaggaacaggataaatttcgtgccagcccagactgtataaccatcttgtgcaaacccaatggccaggccattgcttggtacacccccatccactggaagcaggcctgggagaagcttgacgccgacgtggagttcaatcgctgtagtgtggtgagtcccaccttccgaaagcgggtcttccaatggacagcctcaacggcaacaattacaaaggagaaacaggatcaacccaagaaggacatttccaattaccaggtggagcaggcacaggtcttgcttaaaagggagaaggaaatccctccgaccgttttcccgaatagatctccttggtgccagaatccttatgtgagcgctcatccttactgccccttgatcgagccacataacacttcgactgcaggaggaaggctggaccgccaacccagaacacggtctactcgccctaatcgcgctagtggatctaaaaagaagaaaacttccgagtcgcaaaagcagtag

SEQ ID NO: 27650 - DNA, 744 bp, Artificial Sequence
  Description of Artificial Sequence: Synthetic coding sequence
atggaggaacaaccccagatgcaggacgctgatgaacctgctgactcaggcggtgaaggtcgggcaggaggacctcctcaagtcgccggtgcccaggcagcatgctccgaggataggatgactctgctattgagactacgggcacagacgaagcaacagctccttgaatacaaatcaatggtagacgctagcgaagagaagacccctgagcagatcatgcaggagaagcaaatcgaagccaagattgaagatctggagaacgaaattgaggaagtgaaggtggccttcgagatcaaaaaacttgccctggatagaatgcggctctccacggcactgaagaaaaatctggagaaaattagcaggcagagcagcgtgctgatggacaatatgaagcatctgctagagttgaataaactcattatgaaatcccagcaagagagctgggaccttgaggaaaagcttctggacattcgaaagaaaagactgcagctgaaacaggcttcagagtccaagctgctcgaaatccagaccgagaagaataaacaaaaaatagacctggattccatggaaaattccgagagaatcaaaattataagacaaaaccttcagatggaaatcaaaatcacgacagtcatccagcacgtgtttcaaaatttgattctaggttcaaaggtcaactgggctgaagacccagctctgaaagagatcgtgctgcaactggagaaaaacgtggacatgatgtag

SEQ ID NO: 27651 - DNA, 1458 bp, Artificial Sequence
  Description of Artificial Sequence: Synthetic coding sequence
atggaatttctgggtacgacacaaacggcctcatactgcggtcctaagaagtgctgcggcctgactagcctgcccgctgtccaagcgccagtgatacaggagtgctaccagccatattacttacccggataccggtatctgaatagctggcgccctagcctgttttacaagatcgccaatgttcagacctgtccagatgaatcaacgagtactttacggccacccacaatactccctacccttcggtcagcactctttagccggtatagcccacacgattgggatcagtccaatcagctgcaggtccggggtgctgaagcttcaagactatgggcgagtcgcctgacggacgactctatgcgactcctgcaggacaaagaccaactgacacaccagatgcaggaaggaacctgtcggaatttgggacagcggctgtccgacatcgggttctggaagagtgaattgtcttacgagctggaccggctactcaccgagaaccagaatttggaaactgtcaaaagaagactcgaatgtgctgcaaatgaagtgaactgccctctgcaggtggccttggaatgcctctaccatcgagagaagaggatcggcattgatctggtgcacgacaatgtggagaagaatctgatcagggaggtggacctcctcaaatgctgccaagaacagatgagaaaacttgcccaacgcattgatattcagatgagagataatcgggacgctcaacatgtgttagagcgggacctggaggacaaaagttcagcccagtgcatcgatgagaaatgctttaacctgagaaacacctcagactgtatttcctttttccatgggatggagaagatcgacggcaccatctcagtacctgaaacctgggcaaaattttcgaatgataacatcaaacactcccagaatatgagggctaactcaatccagctgagggaagaggccgaacatctctttgaaaccttgtccgaccagatgtggcggcaattcactgatactaacctggcatttaacgctcggatctctgaggttaccgacgtaaaaaataaactgcagacccagttggccaaaactttgcaggagatcttccaggcagagaacactattatgttactggaaaggtcaatcatggctaaggaggggccactcaaagtggcccagacgcgattggaatgccgcacacgtcgccctaacatggagctctgtcgcgatatcccccagctaaagttggtcaatgaggtgttcactatcgatgataccctgcagactcttaagctgaggctacgggagactcaagacaccctgcaactgctagttatgaccaagtgtcggctagaacacgaactggctatcaaggctaatactctttgcattgataaagaaaaatgcatgggcatgcgcaagacttttccttgcaccccccgtctggtcggccacacttag

SEQ ID NO: 27652 - DNA, 837 bp, Artificial Sequence
  Description of Artificial Sequence: Synthetic coding sequence
atgggaaagtctagtgagtggtgcgagaggatcgccggtatccagaaatttgtgctggagaagtggacgaaaaaggccaaacctgaggatacgttgaatctgtgccaactcttgaataacgatctcgccagtaccgtcgtgagctatccacggcgattcgtagggttgggtactctaccaatgcaggcaccagagttagccgtgaaagaaatggagaggtgtgtgaaagagctgggctttcctggcgtccaaataggaactcacgtgaatgaatgggatctgaacgcacaggagctgttccccgtttacgctgccgctgaaagactgaaatgttccctgtttgtccatccttgggacatgcagatggacggtagaatggccaagtactggctgccatggctggtcgggatgcctgctgagactaccattgccatctgcagcatgatcatggggggtgtgttcgagaaatttcccaagctgaaagtgtgtttcgcccacgggggtggagcatttccttttactgtcggtcgcatatcgcatggattttcaatgcgtcccgacctctgcgctcaggacaatccaatgaatcccaagaaatacctgggcagtttctacactgatgctcttgtgcacgatccattgtccctcaaacttctgacggacgtgatcggcaaagacaaggtgattctcggcacggattatccttttccactcggcgaactggagcctggcaaacttatcgagtcgatggaagagttcgatgaagagactaagaataaactaaaagctgggaacgccctggcgtttctggggctggagcggaagcaattcgagtag

SEQ ID NO: 27653 - DNA, 2478 bp, Artificial Sequence
  Description of Artificial Sequence: Synthetic coding sequence
atgtcaagcagcccagtgaacgtaaaaaaactgaaagtgtcagagctgaaagaggagctgaaaaagcggcgtctgtccgacaaaggactcaaggccgagctgatggagaggttgcaagccgctcttgacgacgaggaagcgggaggcaggccagcaatggagcctggcaatgggagccttgacctcgggggtgactcagccggtcgcagcggggctggcctcgagcaggaggcagctgctggaggcgatgaggaggaggaagaggaggaggaggaggaggaaggaatctctgctctcgacggggatcaaatggagctcggcgaggaaaatggagcagcgggtgcagccgatagtggaccaatggaggaggaggaggccgcaagcgaggatgaaaatggcgacgatcaaggctttcaggagggtgaggacgagctcggcgatgaagaggaaggggctggggatgagaacggccacggagagcaacaaccccagcctcccgcaacacagcagcagcagccgcagcagcagaggggcgctgcaaaagaggcagcaggcaagagcagtggccctacaagcctgtttgctgtgaccgtggcgcctccgggtgctcggcagggccaacagcaagccggagggaaaaagaaagccgagggagggggaggcggaggcaggcccggtgcacccgctgcgggagatgggaaaacggagcaaaaagggggagacaaaaagcgaggggtaaagcgtcctagagaagaccacggcagaggctacttcgagtacatcgaggagaacaagtattccagagccaagagtccccagccccctgtcgaagaagaagacgagcactttgatgatacagttgtctgtctcgacacatacaattgtgatctccactttaagattagcagagatcgtcttagcgccagctctttaacaatggaatctttcgcctttctctgggctgggggtcgcgcatcctacggtgtcagtaagggcaaggtatgctttgaaatgaaagttactgagaaaattcccgtccgacacctctacactaaagacatcgatatccacgaggtcaggatcggctggtcgctcacaactagcggcatgctgctgggggaagaggaattttcatacgggtattctctcaaaggcattaagacatgcaactgcgaaacagaggactacggcgagaagtttgacgagaacgatgttattacctgtttcgccaactttgagtccgacgaggtcgagctaagttacgctaagaacggtcaggatctcggcgtggccttcaagatttccaaggaagtgctggctggcaggcccctgttcccccatgtgctctgccataattgcgcagtcgaatttaatttcggccagaaagagaagccatactttcccattcctgaagaatataccttcatccagaatgttcccctggaggatagagtccgtgggccaaaaggacccgaagaaaaaaaggactgcgaagtggtgatgatgatcggacttccgggagccggaaagaccacttgggtgaccaaacatgcagccgagaacccaggtaagtataacatcctcgggactaacacaattatggacaagatgatggtggctggctttaaaaagcaaatggctgatacaggtaaactaaatactttgttgcagcgggctcctcagtgtctcggaaagtttatcgagatcgccgcacggaagaaaagaaacttcatactggatcaaactaatgttagtgccgctgctcagagaagaaagatgtgcttattcgctggatttcagcgcaaagctgtcgtggtgtgccccaaagatgaagactataaacagagaacccagaagaaagccgaagtagaagggaaggaccttccggaacacgccgttcttaagatgaaaggtaatttcactttacccgaagtcgccgagtgtttcgatgagattacctatgtcgaactgcagaaagaggaggcccaaaagctcctggaacagtacaaagaagagagcaagaaggctctcccacctgagaagaagcagaacactggcagtaagaagtccaacaaaaataagtccggtaaaaatcagtttaatagaggagggggacatcggggaaggggtggctttaatatgaggggtggaaactttcgaggtggggctccagggaatagaggaggctacaaccgacggggtaacatgccccaacgcggagggggtggcggaggttcaggaggaatcgggtacccttacccccgtgcacccgtgtttcccggtagagggagctattctaaccggggaaactataatagagggggaatgccgaaccgcggaaattataatcaaaacttcagaggtcgcggaaataataggggatataaaaatcagtcacaagggtataatcagtggcaacagggacagttctgggggcagaagccctggtcccaacattaccatcagggatattactag

SEQ ID NO: 27654 - DNA, 945 bp, Artificial Sequence
  Description of Artificial Sequence: Synthetic coding sequence
atgcagaatgtgattaataccgtcaagggtaaagcccttgaagttgctgagtacctgacacccgtcttaaaagagtccaaattcaaggaaacgggagtcattacccccgaggagttcgttgcagccggtgatcacttggtgcaccactgtccaacctggcagtgggccacaggggaagaactgaaggtcaaggcctaccttcctaccgggaagcagttccttgttacaaaaaacgtcccctgctataagcggtgcaagcaaatggagtacagtgacgagctggaggccatcattgaggaggacgacggggacggaggctgggtggacacatatcacaatactggtatcactggaataactgaagcagttaaagagattacactcgagaataaagacaatatccgactccaggattgctccgcactgtgtgaagaggaagaggatgaagatgaaggagaagccgctgatatggaggaatacgaggagagcggccttctcgaaactgacgaggcgaccttggacacgagaaagattgtcgaggcttgcaaagcgaaaaccgatgccggtggcgaagacgcgatcttacaaacaaggacttatgacctctacatcacatacgataaatactaccagactccgcgactgtggctgttcggatacgatgagcaacgccaaccactcaccgtcgaacacatgtacgaggacatcagccaggaccatgtgaaaaagactgtgaccatagaaaatcacccacacttgcctccaccacctatgtgttctgtacacccctgcaggcatgctgaagttatgaaaaagataatcgagactgttgccgagggcggaggggagctcggcgtgcacatgtaccttctaatctttctgaagttcgtacaagccgttatacccactatagagtatgactatactcgacattttaccatgtag

SEQ ID NO: 27655 - DNA, 900 bp, Artificial Sequence
  Description of Artificial Sequence: Synthetic coding sequence
atggttgacaagaagctggttgtcgtgttcggaggaactggagcacagggcggaagtgtagcaaggacactactggaagacggtacttttaaggttcgcgtggttaccagaaatcctcgtaagaaggctgcgaaggagctgaggcttcaaggagccgaggtggtgcagggcgatcaggatgatcaggtgattatggagctggctttaaacggcgcttatgccactttcatagtcactaattattgggagagctgcagtcaagagcaggaggtcaagcaagggaagctattagctgacctggcacgcaggctgggcctgcactacgtggtctactccggcctggagaacattaagaaattgacggcagggagactggctgccgcacattttgatgggaagggagaagtggaggagtacttcagggacatcggtgtccctatgacttcagtccgtctgccctgttacttcgagaacctgctgagccacttcctgccgcagaaggcaccagacggcaaatcatatttactttcactaccaacaggcgacgtgccgatggacggcatgagcgtttcggatttggggccagtggtattatccttactgaagatgcccgagaaatatgtcggtcaaaatatcgggctgagtacatgtaggcatacagcagaagaatatgctgccttgctaactaagcacacgagaaaggtggtgcacgacgctaagatgacaccagaagattacgagaagctgggcttccccggagccagagatctagcgaacatgtttagattctacgctctgagaccagaccgagatattgaactgacccttcggctgaaccctaaggccctgactctggaccagtggctggaacagcataagggcgatttcaacctcttgtag

SEQ ID NO: 27656 - DNA, 2571 bp, Artificial Sequence
  Description of Artificial Sequence: Synthetic coding sequence
atggatataagtaagggcctccccggaatgcaggggggactgcatatttggatctcagaaaaccggaagatggtcccagtaccggagggtgcgtacggcaactttttcgaagagcactgctacgttatcctgcatgtccctcaatctccgaaagccactcagggtgcttcttctgacctgcattattgggtcggaaagcaggcaggtgcagaagctcagggtgctgctgaggcgtttcagcagcggcttcaagatgagctcggagggcagacagtgttgcatagagaagcccaggggcacgagagtgactgtttctgcagctacttcagaccagggatcatctatcgcaagggcggattggcatcagatctgaagcatgtagagaccaacctctttaacatccagcgtctgctccacatcaagggccgtaagcacgtctctgcgacggaagtggagttgagctggaattcctttaataagggcgacatatttttgttggatctcggcaagatgatgatacagtggaatggacctaagacatccatctcagagaaggctcgtgggcttgcgctgacgtactctctgagggacagggaacggggaggagggagagcacagatcggcgttgtggacgatgaggcaaaagcacctgacctgatgcagataatggaagctgttctcggccgtcgggtgggttccctcagagcggctacaccctcaaaagacataaaccagcttcagaaagctaatgtgcggctatatcacgtttacgagaaggggaaggaccttgtggtgctagagctggctacacctcccctgactcaggatctgttacaagaggaagatttctacattttagaccaaggtggctttaagatttacgtatggcaagggcgaatgagttccctgcaggagaggaaggccgcattttcaagggcagtgggtttcatacaggcaaaggggtatcctacctacacaaatgtcgaagtggtgaatgatggagccgagtccgctgcattcaaacagctatttcgtacttggtccgaaaagcggagacgcaatcagaaactgggcggacgcgacaagagtatccacgtgaagctggatgtcggcaaactgcacactcaaccaaaactcgctgcccagctcagaatggtggacgatggctccggaaaggtcgaggtttggtgtatccaggatctgcatcggcagccagtcgatccaaaacggcatggccagctgtgtgcgggaaattgttatctcgtgctgtatacctatcagcgcttaggacgggttcaatacatcctatatctgtggcaagggcaccaagcaactgcggatgagatcgaggcgttgaactctaacgctgaggagctggatgtcatgtatggtggcgtcttagtacaggagcacgtgaccatgggctcggaacctccccatttcctggcaatattccaggggcagctagttatctttcaggagagggcaggacaccacggcaaaggccagtccgcatcgactactcggctctttcaggtgcagggaacagattcgcacaacactcgaacaatggaagttcccgctagagccagctccctgaactcctccgacatcttcctgctcgtgacggcgtcggtctgctacctctggttcggcaaaggctgcaacggagaccaaagggagatggctagggtggtcgtcacagtgatcagtcggaaaaacgaggaaactgtacttgagggccaggaaccccctcatttctgggaagccctgggaggacgcgcaccatacccatccaacaagcggctgccagaagaggtgccctcctttcagcccagactgttcgaatgtagctcgcatatgggatgtcttgtgttggcagaggttggcttcttcagtcaggaggacctggacaaatatgacattatgctcttggatacatggcaggagatcttcctgtggctcggcgaagccgcttctgagtggaaagaagcagtagcctggggccaagagtacttgaagacccatcctgccggaaggagccccgctacgcctatcgtgctggtaaaacaaggtcacgagcctcccacatttatcggctggttcttcacttgggacccatacaagtggacttcccatcctagtcataaggaggtggtggacggatctccagcagcggctagcactatctccgagatcaccgctgaggtgaataatctccggctgagcaggtggcccggtaatggccgtgctggagcagtggcgttgcaggcactgaagggatcccaggacagctctgagaatgatctggttcggtcacctaaatctgcgggatctcggacctcttccagcgtcagttccacctctgcaactattaatggtgggctgcgcagggaacagttgatgcaccaggccgtggaggacctaccggaaggcgttgatccggctcgcagggagttctatctatctgattctgatttccaagatatctttgggaagtcgaaggaggagttttatagcatggccacttggaggcagcgtcaagagaagaagcagctaggctttttctag

SEQ ID NO: 27657 - DNA, 987 bp, Artificial Sequence
  Description of Artificial Sequence: Synthetic coding sequence
atggaggcgaatgggagtcagggtactagcggttcggccaatgactcacagcacgaccctggcaagatgtttatcggcggactctcttggcagaccagccccgatagcctgagggattacttctctaagttcggtgaaatcagggaatgtatggtcatgcgcgaccctaccactaaaagaagccggggttttggctttgtgacctttgcagatcctgcttcagttgataaggttctggggcaaccccaccacgagttggactctaaaaccatcgacccgaaggtcgcttttcctcgaagggcacagcctaagatggtgacgagaacaaagaaaatttttgtcggcggattatcggctaataccgtggttgaagacgtcaaacaatattttgagcagttcgggaaagtcgaagatgcaatgcttatgttcgacaaaacaaccaaccgacacagagggtttggtttcgtcacattcgaaaatgaagatgtcgttgagaaggtctgcgagattcacttccatgagataaacaacaaaatggtggagtgcaaaaaagctcagcccaaggaagtgatgtttcccccagggacacgcggtcgggctcggggactgccttacacaatggacgctttcatgcttgggatgggcatgctaggataccccaattttgtggccacctacggtagaggctatcctggatttgccccttcttacgggtatcagttccccggattccctgccgctgcctatggacccgtggctgcggctgctgtggctgctgcgcgtgggtccggaagcaacccagcaaggcccggtggattcccaggggctaatagtcccggacccgttgctgatctgtacgggccagcctcgcaggattcaggggtcgggaattatatttcggcggcatcccctcagcctggaagtggatttggtcacggcatcgccggtcctctgatcgcgaccgcttttacaaacggctatcactag

SEQ ID NO: 27658 - DNA, 654 bp, Artificial Sequence
  Description of Artificial Sequence: Synthetic coding sequence
atggagtcagtggctctgtactcttttcaggccaccgagtccgacgaacttgccttcaacaagggagataccctcaaaatactgaacatggaggacgatcagaattggtacaaggctgaactacggggtgtcgagggtttcattccgaagaactacattcgcgtaaagcctcacccatggtacagtggtagaattagccgccagctggccgaggaaatcctgatgaagaggaaccatttgggcgcttttctcattagagagtccgagtcttccccaggcgagttctctgtgagcgtgaactatggtgaccaagtacagcatttcaaggtgctaagagaagcatctggcaaatattttctctgggaagaaaagttcaatagcctgaatgaattggtggatttttaccggactactaccatcgctaagaagcggcaaatcttccttcgtgatgaggaacctctactgaaaagccctggagcctgcttcgctcaggcccaattcgacttttccgctcaagaccccagtcagctcagttttagaagaggagacatcattgaagtcctcgagaggcctgatcctcactggtggcgtggcaggagttgtggtcgggtaggcttttttcctcgatcatatgtgcagcctgtgcatttgtag

SEQ ID NO: 27659 - DNA, 231 bp, Artificial Sequence
  Description of Artificial Sequence: Synthetic coding sequence
atgggcctgaagatgagctgtcttaaaggctttcagatgtgtgtcagcagttcatccagctcccacgatgaggctcctgtcctcaacgacaaacacctcgatgttcccgacatcatcattacaccacccaccccaacaggaatgatgttacccagagatctcggctctaccgtgtggctggacgagacaggttcctgcccagatgacggggagatagatcccgaagcatag

SEQ ID NO: 27660 - DNA, 19863 bp, Artificial Sequence
  Description of Artificial Sequence: Synthetic coding sequence
atggatcagccccagtttagcggtgctcctaggttcttgactaggccaaaggcctttgtcgtttcggtcggaaaagatgcgactttgtcctgtcaaatagtaggcaatcccacacctcaggtttcgtgggagaaggatcagcagcctgtcgcagccggagccaggtttcgtttagcacaggacggagacctctacaggctgactattctggacctggctctaggcgactctgggcagtatgtctgcagagcgcgtaacgctattggtgaggcttttgccgctgttggacttcaggttgatgctgaagccgcttgcgccgaacaggctcctcatttcctgctacgaccaactagcattagagtcagagaaggttcggaagccaccttcaggtgtagagtggggggatccccccgacctgcagtctcttggtcaaaggatgggagaagactgggcgagccagacggccctcgggtgagggtggaggagctgggcgaagcaagcgctctgcgaatccgggcagccaggcctcgcgatggaggcacctacgaggtacgtgctgagaaccccttgggtgccgcttctgctgccgctgccctggtggtcgactccgacgcagcagatactgcctccagacctgggacgtccaccgctgcactgctggcccacttacagcggcgtagagaggcgatgagagcagagggcgctcctgcctcccctccttcgaccggtactaggacatgtactgtgacagagggaaagcatgccagattgtcctgctatgtaactggggaacccaaacctgagaccgtgtggaaaaaggacggccaactggtcacagaagggagacgccatgtggtgtatgaggacgctcaggaaaactttgtgctgaagattctcttctgcaagcagtctgacaggggcctgtacacatgcactgcatcaaatctcgtggggcaaacttacagtagcgtgctggtcgtcgtcagggaaccggctgtgcctttcaagaagcggctgcaggatctcgaggtgcgggagaaggaatcagccacttttctgtgcgaagttccccaacccagcactgaagcagcttggttcaaagaagaaacacggctctgggcatccgctaaatacgggatcgaggaagaggggacagagagacgccttacagtaaggaacgtgtctgctgacgacgatgccgtgtacatttgcgagacaccagagggaagtcgaaccgtggctgagctggcagtccaggggaatttactccgcaagctaccgcgtaaaaccgcggtgcgcgtgggcgacaccgcgatgttctgcgtcgaacttgcagtccctgttggccctgtccattggctgcggaaccaggaagaggtggtcgcgggagggcgtgtcgcaattagcgcagaaggaaccaggcacaccctcacaatcagtcaatgctgcctggaggacgttggccaggtggcttttatggcgggtgactgccagacatcaacacaattttgcgtttcagcacccagaaagccaccgttgcagccacccgtggaccccgtggtgaaggccagaatggagtctagcgtgattctgagctggtcgcccccaccacatggcgaacgtcccgtgacaattgacggatatctggtggagaagaaaaaactcggaacctacacatggatccgttgccacgaggcagaatgggtggctacgcccgagctgactgtggcagacgtggctgaggagggcaacttccagttcagagtcagcgccctcaactcattcggccagtccccctacctcgaatttcctgggaccgtgcaccttgctcctaagctcgctgttcggactcctctaaaagctgtgcaggccgtggaggggggtgaagtgaccttcagcgtggatctgactgtggctagcgcgggagagtggtttctcgacgggcaggccctaaaggccagctccgtgtatgagatccattgcgataggacccgtcacacgttgacaatcagagaggtgcccgcatctctgcatggtgctcagctgaaatttgtggctaatgggatagaatcaagcatacgaatggaagtgcgagctgccccaggattgaccgcaaataaacctccagctgctgctgcccgagaggtcctggctaggttgcacgaagaagcccagctgctggccgagctgtcagatcaggccgcagccgtgacctggttaaaagacggtcggacactctccccagggccaaaatacgaagtgcaagccagcgccggtaggagggtgctgctagtgcgcgacgtggcccgagacgatgccggtttgtatgaatgcgtgtccagaggcggacgaattgcataccagctgagcgttcaagggctggctagatttttgcacaaagatatggccggttcctgcgtcgacgcagtggcaggagggccagcacaattcgaatgcgagacatccgaagcacatgtgcatgttcactggtacaaagacggcatggagctcggccatagcggggagcgattcctgcaggaggatgtgggcaccaggcacagactcgttgccgcaactgtcactcgtcaggatgaaggtacgtattcttgtcgggtgggtgaagactcggttgattttagactgcgcgttagtgaaccaaaggttgtatttgccaaggaacagcttgccaggaggaagctgcaagctgaagctggcgcttcagcgaccctgagctgcgaagtcgcgcaggcccaaaccgaggtgacttggtataaagatggaaagaagttgtcttcttcttcaaaggtgtgtatggaggccacgggctgtaccaggcgtctagtggtacagcaagccggacaagccgacgcgggagaatattcctgtgaagcagggggtcagcggttaagctttcatctcgacgtgaaagagcctaaagtggtttttgctaaggatcaggtcgcccatagtgaggtgcaggcagaagctggcgcttcagcaactctgtcttgtgaagttgcacaggctcagacagaggtaatgtggtataaggatggcaagaaattgtcatcctctttgaaggtacatgtggaggccaagggttgtcgacggcgtcttgtggtgcaacaggcaggcaaaactgatgctggtgactatagctgcgaggccagaggccaacgcgtctccttcaggctgcacattaccgagcccaaaatgatgttcgctaaggaacagtccgtgcataatgaggtgcaggccgaggctggggcatctgccatgctcagttgcgaggttgcccaggctcagaccgaggtaacttggtataaggacgggaaaaagctctctagctcctctaaggttggaatggaagtgaaaggatgtactcggcgtctggttctgccacaagctggcaaggctgatgctggggaatattcatgtgaagccggtggtcagcgtgtcagctttcatcttcatattacggagcctaaaggagtgtttgcgaaagagcagtcagtacataatgaggttcaggccgaagccggaacaaccgccatgctgtcatgtgaggtggcccagccccagaccgaggtgacctggtacaaggatggaaagaaattatccagctcctcaaaggttcgcatggaagtgaaagggtgcacccgaaggctggtagtccagcaggttggcaaagcggatgcgggagagtactcctgtgaggcgggaggacaaagagtgagcttccagttgcatatcactgaacctaaggctgtatttgcaaaggaacaactggtacataacgaggtccgcaccgaagctggcgcttctgccaccctatcctgcgaagttgctcaggcacagacggaggttacctggtacaaggatgggaagaaactatcctcgagcagtaaagtgagaattgaggcagccggttgcatgaggcagttggttgtccagcaggccggacaggcagacgctggcgaatacacatgtgaggccggaggtcagcggctctcttttcacctggatgtctccgagccgaaagccgtatttgcgaaagagcagttggcacatagaaaggttcaggccgaggcaggggcaattgccacactttcctgcgaggtggcacaggcacagactgaagtgacctggtataaggatgggaagaagttatcgagttcgagcaaggttaggatggaagccgtggggtgtacccgacgcctggtggtccaacaggcctgccaggcggatacgggtgaatactcttgcgaagctggcggacaacggttaagttttagcctggacgtcgccgagcctaaggtcgtgttcgcaaaggagcagcccgtacatcgtgaagtgcaggctcaggctggggcttctactaccctttcttgtgaggtggctcaggcccagactgaagtcatgtggtacaaggacggaaaaaagttatctttttcgagtaaggtccgtatggaagctgtagggtgtaccagaaggctcgtcgtgcaacaagcgggtcaggctgtcgctggcgaatattcttgcgaggcgggaagccagagactctcctttcatctgcacgtggcggaaccaaaagcggttttcgcgaaggagcagcccgcttctagagaggtgcaggcggaggctgggacatctgccactttgagttgtgaggtggcccaggcgcagacagaagtaacctggtacaaagacggaaagaagctctctagctcaagtaaagttcgaatggaagccgtgggttgcaccagacggctcgtagtgcaggaggctgggcaagcggacgctggcgagtattcatgtaaagccggagaccagcgactttcattccacctgcatgtggctgagccgaaggtggtctttgcaaaagaacagcctgctcaccgggaggtgcaggctgaagccggagcctccgccaccctgtcctgcgaagtcgcccaggcccaaactgaggttacttggtataaagacggcaaaaaattatctagctcatcaaaggtgagagtggaggcagtcggatgcacccgcaggctggtcgtccagcaagcaggccaggccgaggctggcgagtacagttgcgaggccggtggacagcagctgagcttcagattgcaagtcgccgagcttgaaccacaaatttcagagaggccctgtcgccgtgaacccctggttgtcaaggagcacgaggacatcatcttgactgccacactcgccacaccctcggctgctactgtgacgtggctcaaagacggagtcgagattagaagatccaagcgacacgagaccgccagccagggggatacgcatactctgacagtccatggcgctcaggtgctagactccgccatttattcctgccgcgtgggagctgaggggcaagattttccagtgcaggttgaagaggtggcagccaagttctgccgcctcctggaaccagtgtgtggagaactcggagggacagttacgctcgcttgtgagctgtcccccgcttgtgcagaagtggtctggaggtgtggcaatactcagctgcgtgtaggaaaaagatttcaaatggtcgcagagggacctgtgcggtcactgacagtccttggcttgagagctgaggacgcaggcgaatacgtctgcgaatccagggacgatcacacgtcagcacagttaacagtcagcgttccaagagtggtcaagttcatgtcaggtctctccaccgtcgtcgctgaagagggcggagaggcaacgttccaatgcgtcgtgagtccttcagacgtggctgttgtttggttccgggacggagcactactacagccatctgagaagtttgctatctcacaaagtggcgctagtcattcactgactattagcgacttggtcctggaggacgccggtcaaattacagtcgaagcagagggcgctagttcatccgcagccctgagggtgagagaagccccagtgctgttcaagaaaaaactcgagccccagaccgtagaggaaagaagctccgtaactctggaagtcgagctcaccaggccatggcccgagctaaggtggacgcggaacgcaaccgcgctggctcccggtaagaatgtggagatccacgccgagggcgctcgacaccgactcgtgctacataacgtggggtttgccgacagaggtttcttcggctgtgaaacacccgacgataagacgcaggccaaactcaccgtagagatgcggcaggtacgcctcgtccgtggccttcaggcagtagaagcaagagagcagggaactgccacaatggaagtacagctatcacacgcagatgtggacggtagttggactagagacggattacgatttcaacagggaccaacctgtcacttggccgtccggggtcctatgcatacattgactctctccggactcagacccgaggactccgggctgatggtgttcaaggccgaaggagtgcatacgagtgcacgactagtggtgaccgaacttccagtgtcgttctcacgacctctccaggacgttgtgactacagaaaaagagaaggtgaccctcgaatgcgagctcagcagacctaacgtggacgtgagatggttaaaggatggagttgagctgagagcaggcaaaaccatggctatcgccgcacaaggtgcttgcaggtctctgacaatctacaggtgtgagttcgccgaccagggcgtgtacgtgtgcgatgcgcacgacgcacagagttcagcatctgtgaaggtacaaggcaggacgtacaccctgatttatagacgcgtccttgccgaagacgcgggtgagatccaattcgtggcggagaatgctgagagtcgtgcacaactcagggtgaaagaactgccagtgacactggttagacctttgagggacaaaattgccatggagaagcaccgtggagtcttggaatgccaggtatcaagagcctctgcccaagtcaggtggtttaagggcagccaagaactacaaccagggccaaagtacgaacttgtctctgatggtctgtatcggaagctgatcatttcagacgtgcatgccgaggatgaagacacctatacgtgtgatgctggggacgttaaaaccagcgcgcagttcttcgtagaagaacaatccatcactatcgtacggggtctgcaagacgtgaccgtcatggagcctgcccctgcatggtttgaatgcgaaacgagcatcccttccgtccgcccacccaagtggttactaggaaaaacagtcctgcaagccggagggaatgtagggctagagcaggaagggaccgtacatcggctgatgttacgccgaacgtgctccaccatgacgggccctgttcattttacagttggcaagtcgaggtcctctgcacgccttgtggtctcagatattcctgtggttctgaccagaccattggaacctaaaaccgggagagagctacagagcgtcgtcttgagctgcgacttcaggcccgctcccaaggccgtgcagtggtacaaagatgacacacccttgagcccatccgagaagttcaagatgtccttagaaggccagatggcggagctccggatcttgcggcttatgcccgcagacgcaggggtctaccgctgtcaggcaggtagcgcccatagctccacagaggtgactgttgaggcgcgagaagtgactgtaaccggacctttgcaggatgcagaggccaccgaggagggctgggccagcttctcttgcgaactgtctcatgaggacgaggaggtagaatggtctctcaacggcatgccattgtataacgattctttccacgagataagccacaagggacgacgccataccctggtgctgaagtcgatccagcgcgctgatgctggaattgtccgtgccagcagtttaaaagtatctacctctgcaaggctagaggttagggtgaagcccgtggtatttctgaaggcccttgatgacctcagcgccgaagaaaggggcaccctggcactgcagtgcgaggtcagcgaccctgaggcacacgtggtttggcggaaggacggggtgcagctcgggccttcagataaatatgatttcttgcacactgcgggtaccagaggcttggtcgttcacgacgttagtcccgaagacgccggtttgtatacttgtcacgttggaagcgaagagacgcgtgccagggtacgtgtccatgatttgcacgttggcatcacaaagagactaaaaacgatggaagtcttagaaggggagtcttgctccttcgagtgtgtgctgtcacacgagtcagcctccgacccagcgatgtggaccgtcggcggaaaaacagtgggctcctcatccagatttcaggccacccggcagggcaggaagtacatcttggtcgtgagagaggcagcccctagcgacgccggagaggttgttttctccgtcagaggtcttacgtcaaaagccagcttaatcgtgagagaaaggcctgcagctatcattaagcccctggaagaccagtgggtggcccctggggaggatgtggagctgcggtgcgagctgtccagggctgggactccagtgcattggttgaaagacaggaaagcaatacgaaaatcacagaaatacgatgtcgtctgtgaaggcacaatggcaatgcttgtgattcgcggagctagtctgaaagacgctggcgagtatacctgtgaggtagaggcaagtaagtccacagctagtcttcacgtggaagaaaaggcaaactgttttacagaagagttaactaacctgcaggtagaagaaaaggggaccgctgtctttacctgcaaaactgaacaccccgcagctacggtcacatggcggaaggggttactggaattgagagcgtccggtaagcaccaacccagccaggaaggactaacccttcggttgacaatatccgctttagagaaagccgactccgacacctacacttgcgacattgggcaggctcagagtcgcgcacagctgctggtgcagggccgtagagtgcacatcattgaagatttggaagacgtggatgtccaggagggcagctcggctactttccgctgcagaatttcacccgctaattatgaacccgtccactggttccttgacaagacaccactgcatgccaatgaattaaatgagatagatgctcagccaggtggatatcatgtactgactctaaggcaactggccctgaaggactccggtacaatctattttgaagcaggcgaccagcgcgcttctgccgctctacgcgtgacagaaaagccttctgtcttcagtcgagaactgactgacgccaccatcactgagggcgaggacttgaccctggtttgcgagacatcaacttgtgacattccagtgtgttggacaaaggacgggaagacactccggggatctgcccgatgccaactgtctcacgaagggcaccgcgctcagctgcttattactggagccacattgcaggactccggtcggtataaatgtgaagccggaggggcatgttcctctagtatcgtgagagttcacgccaggccggtacgcttccaggaggcgctgaaggatctagaggttttggaggggggtgccgctaccctgcggtgtgtcctgagctcggtcgccgcaccggtaaagtggtgctacgggaacaacgtgctgcggcctggtgacaagtattctttgagacaagaaggggcaatgctcgaactggtggtacggaatctccgtcctcaagacagtgggaggtatagctgctccttcggagatcagaccacctcagccaccttgactgtgaccgcgctcccggctcagtttatcggaaaacttcggaacaaggaagcgaccgagggtgccactgctacactccggtgtgagctgtctaaagccgcaccagtggagtggaggaaagggagcgagactttgcgcgacggagatcgatactgtctgcggcaggacggcgcaatgtgcgagctgcagatccgcggactggccatggttgacgccgcagaatattcttgtgtgtgtggagaagaacgaacttctgctagtctcactatccgtccgatgcccgctcactttattggacgtctgcggcatcaggaaagcatcgagggagccaccgccacactcagatgcgagctctccaaggcagcccctgtggaatggaggaagggtcgtgaatctttgagggacggggatcgccacagtctgcgccaagacggggcagtttgtgaattacagatctgtggcctggctgtggctgacgccggtgagtactcctgcgtttgcggagaagaaagaacatccgcgactttgacagtgaaggctctgcccgctaagttcaccgagggcctgaggaacgaggaggccgtggaaggtgccactgcaatgctgtggtgtgaactgtcgaaagttgctccggttgaatggcgcaaagggccagagaatctaagagacggagataggtacatcttaagacaagagggcaccaggtgtgagttacaaatttgcggtttggcaatggctgacgctggcgaatatctctgtgtgtgtggccaggaacggacctctgccaccctcaccatccgcgctttgcccgctcggttcatcgaggacgtaaagaatcaagaagctcgtgaaggtgcaactgctgtacttcagtgcgagctgaattctgcggctccagtcgagtggaggaagggctctgaaaccctgcgcgacggcgacagatacagtctgcgccaggatggtacgaagtgcgagttgcaaatccgcggactcgctatggctgacacaggcgagtatagctgtgtctgcggacaagaaaggacctctgcaatgctgaccgtgcgcgcactaccgattaagtttaccgaggggctgaggaatgaggaggctacagaaggcgctaccgccgtgctgaggtgtgaactgagcaagatggcccctgtggagtggtggaagggtcacgagacactgcgtgacggcgatagacacagcctcagacaagatggtgcaaggtgtgagttacaaatacgaggcttggtggctgaggacgccggagagtacctctgtatgtgcggaaaagaaaggacctctgcaatgttgacagtgcgggcaatgccaagcaagtttatcgaaggcttacgcaatgaagaggccaccgaaggggacaccgcgactctgtggtgcgagctgagcaaagccgctcccgttgaatggcggaaggggcacgagacactgagggacggtgatcgacacagcttacgtcaggatggaagcagatgcgaattacaaatcaggggactggcagtggtggatgcaggagagtatagctgtgtgtgtggccaagagaggacaagcgccaccttgaccgtgcgggcactccctgccaggttcatcgaggacgtaaaaaatcaggaagctcgagagggcgcaactgccgttctccagtgcgagttgagtaaggctgccccagtggagtggagaaaaggctcagaaactctaagggggggagaccgctactctctgagacaggatgggaccagatgcgagctccaaatccacggcctgtccgtagcagacaccggagaatacagctgcgtctgtggtcaagagcgcacgtctgccacccttacggtgcgggctccacagccagtgttccgcgagccgctccaaagcctgcaagctgaggagggaagtactgcaacccttcaatgcgaactttcggagccaacagccacagtggtttggagtaaggggggtttacagctccaggcaaatggaagacgcgagccccgattgcaggggtgcaccgctgaactagtactccaagacttgcaacgcgaggacaccggcgagtatacgtgtacttgtggctcacaggccaccagcgccactctcacagtgacggctgcccctgtgcgtttccttcgggagctccaacaccaagaagtcgatgagggtggtacggcccacctgtgttgcgaactgtccagagccggtgcctcggttgagtggcggaagggcagcctgcagctgttcccgtgcgctaaatatcagatggtacaagatggcgcagcagccgaactattggtgcgcggtgtggagcaggaagatgcaggtgattacacatgcgacaccggacacacacagtctatggcctctttgtcagtgcgggttccgcgtcctaagttcaaaactcgcctgcaatccctggagcaggagacgggggatattgccaggctgtgttgccaactatccgacgccgagtctggcgcagtagtccaatggctaaaagagggggttgagctgcacgccggtcccaagtatgagatgcgctcacaaggtgctacgcgtgagctcctgatccatcaactggaagccaaggatactggggagtatgcttgtgtcaccggagggcagaagaccgccgcatccctgcgtgtgaccgaacctgaagtgaccatcgtgcgtggcctcgtagatgcggaagtgacagctgacgaggatgtggaattcagctgtgaggtgtccagggctggagctaccggcgtccagtggtgtctgcagggactgccccttcagtcgaatgaagtcacagaggtcgccgtccgcgacggtcggattcatactctgcgcctcaaaggcgtgactcctgaggacgctggaaccgtatcttttcatttgggaaatcatgccagcagcgcacagttgacagtgcgcgctcctgaagtgacaatcctggaacctctgcaggacgtgcaactatccgaaggccaggacgcttccttccagtgtagattgtctagagcatcggggcaggaggcaaggtgggctctgggtggcgttcctctgcaggccaatgaaatgaacgacatcaccgttgaacagggaactcttcatcttctgacccttcacaaggtcacacttgaggacgccggaaccgtctcgtttcacgtgggcacttgttcgagtgaggcccagcttaaggtcaccgctaaaaacacggttgtgcggggactcgaaaacgtggaggcactggaaggaggggaggcattgttcgaatgccagctatctcagccggaggtggccgcacacacgtggctgctcgacgatgagcctgtgcacacgtccgagaatgccgaagttgtcttctttgaaaacgggttgagacatctgctgcttcttaaaaatctgaggccccaggattcttgtcgggtcacattcttggcaggagacatggttacctccgcgtttctgactgtgaggggctggagactggagatattggagcccctgaagaatgccgcagttcgggctggcgctcaggcctgtttcacatgtacactttctgaggccgtaccagtgggcgaggccagttggtatatcaatggagctgccgtgcagcccgacgattccgactggacagtaaccgccgatgggtcacaccacgccctcctgctcaggagcgcccagccccaccacgccggagaggtgacatttgcatgccgtgatgctgtcgcctctgctagattgactgtattgggactgcccgatcctcctgaagacgctgaagtagtagccaggagctcacatactgttacacttagttgggccgctccaatgtcagatggaggcggaggtttgtgcggctaccgggttgaggttaaagaaggcgctactggacagtggagactctgccacgaactcgtcccaggcccagagtgtgtcgttgacggactggccccaggcgagacctataggttccgggtagcagctgtcggacccgttggggcaggcgagccagttcacctgcctcaaactgtgcgactggcagaacctcccaaaccagtgcctccacagccttcggcccctgagagccggcaggtggcggctggcgaggatgtctcactcgaactggaggtggtggctgaggctggcgaggttatctggcataaagggatggaaagaattcaacccggagggagattcgaagtggtgtcccaggggaggcagcagatgctggtaattaaagggttcactgcggaagaccagggggaatatcactgtgggcttgcccagggatcaatctgccctgcggctgccaccttccaggtcgccctttcacccgcaagtgtggacgaggcacctcagccctcccttccacccgaagccgctcaggagggcgacttgcacttactctgggaggcactggctcggaaacgaaggatgtcccgcgagccgaccctggacagcattagcgaacttcccgaggaggatggccgttcacagcggctacctcaggaggccgaagaggtcgctccggacttgagcgaaggatattccacagccgatgaactggctagaaccggcgatgcagacctatctcatacatcttcggatgatgaaagccgcgctggcacccccagtctggtgacatacttaaaaaaagccggaagaccgggaacaagccctttggcctccaaagttggcgctcctgcggctccttccgtcaagccacagcaacagcaggaacctctcgccgctgtgcgaccaccgttgggcgatctatcaaccaaggatctcggggacccctctatggataaggccgctgtgaagatacaggcagcctttaagggatacaaagttcggaaagagatgaagcaacaggagggcccaatgttcagccacacatttggcgatactgaggcacaggttggcgacgcccttcgcctggaatgcgtcgtggcaagcaaagcagacgtgcgggctcgctggctgaaagatggcgtcgagctgacagacggaaggcatcatcatatcgaccagctgggtgacgggacgtgctctctcctgattaccgggctggaccgtgccgatgctggatgctacacctgccaagtgtccaacaaatttggtcaggttacccattctgcatgtgtagtggtgtcggggagtgagagcgaagctgaatccagttctggtggcgagctggatgacgcattccgaagagcggcacgccgtttacaccgacttttccggactaagagtcctgcagaagtctctgacgaagaattgtttttgtcggcagacgaaggacccgcagagccagaggaacctgctgactggcagacgtatagagaagatgaacatttcatctgcatcagatttgaggctctcacagaagctagacaggcagtgacccgttttcaggaaatgtttgccacactgggcatcggggtggaaattaaactagtggaacaagggcctcgccgagttgagatgtgtatctctaaggagacacccgcaccagtggtaccaccggaacccctgccctcactgttgacaagcgatgcagctcccgtttttcttactgagctgcagaatcaggaggttcaagacggctaccctgtctcgtttgactgcgtggttacaggccaacctatgccctcagttcggtggtttaaggatggtaagttgctcgaggaagatgaccactacatgattaatgaggaccaacagggaggtcatcagctgattatcactgcggtggtgcctgctgatatgggtgtgtatcgctgccttgcagagaacagtatgggtgtcagctctaccaaagcggaactgagggttgatctgacgtcaaccgattatgatactgctgcagatgctaccgagagttcctcttatttcagtgcacagggatatctgagttctagagaacaagagggaacagaaagcaccaccgatgaaggccagctcccacaggtggtcgaggaactgcgcgacctgcaggtcgcgccaggtacccgcctggctaaattccagctgaaggttaaaggctacccagcgccacgcctatactggtttaaagacggccagccactgactgctagcgcccatatccgcatgacagataagaagattcttcacacccttgaaataattagcgtgactcgggaagactcaggtcagtatgccgcatatatttcaaacgctatgggagcagcatattcatctgcaagactgctggtcagaggcccagatgaacccgaagagaaacccgctagtgatgtgcatgaacagcttgtgccacccaggatgcttgagagatttaccccaaaaaaagtgaaaaaggggtcgtctatcaccttctctgtcaaagtagagggtcgacctgtgccaacggtgcattggctccgcgaggaggcggagcgaggagtgctgtggatcggtcccgatacacctggatataccgtcgcctcctccgcccagcaacacagcctcgtgctgttggatgtaggacggcagcatcagggaacttacacatgtattgccagcaatgccgctggccaggccctatgtagtgcctccttgcatgtgtctgggctaccaaaagtggaagagcaggagaaagttaaagaggccctgatttcaacctttctgcaagggacgactcaggccatctctgcacagggccttgaaacggcatccttcgccgacttgggtggtcagcgaaaagaggaaccgctggccgcaaaggaagcgctggggcacctgtcactggccgaggtagggactgaagagttcctgcagaaattgacctctcagataactgagatggttagcgccaaaatcacacaggccaagctccaagtgccgggtggggactccgatgaggactcaaaaacaccctcggctagccctcgtcacggcaggagtcgccctagtagctccatccaggagagtagcagcgagtccgaggacggcgacgccagaggagagatctttgacatctacgtggttacagctgattatctgcccctcggagcggagcaagatgccatcacgttacgcgaagggcagtatgtggaggtgctggatgcggcacatccactccggtggttggttagaacgaagccaacaaagtcctctccctcgaggcaagggtgggtgagcccagcttatctggaccgacggctgaagctgagcccagagtggggtgctgctgaggcccctgaatttccaggcgaagccgtgagcgaggatgagtataaggcccgactgtcgtctgttattcaggagcttctgtcctcagagcaggccttcgtcgaagagctgcagttcctccagagccaccatctgcagcatcttgaacggtgcccccatgttcccattgccgtcgcgggtcagaaggcagtgatcttcaggaacgtaagggacatcgggcgtttccatagcagttttcttcaggaactgcagcagtgtgatactgatgacgacgtggctatgtgcttcatcaaaaaccaggctgccttcgagcagtacctggagtttcttgtgggtcgagtgcaggccgagtccgtcgtggtgagcacagccatccaggagttttataagaagtacgctgaagaggctctactagccggagacccttctcaaccccctcccccaccactccagcactacttggaacagcccgtggagcgggtccagcgatatcaggccttactaaaggaactgatccggaataaagcgcgtaaccgccagaattgcgccctgttggagcaagcttatgccgtggtctcagcgttgccacaacgtgccgaaaacaaactgcatgtgtctttgatggaaaattaccctggaactcttcaagcacttggcgagcctattaggcaggggcattttattgtttgggaaggggcacccggtgccagaatgccatggaaggggcacaacagacacgtgtttctcttccgtaaccacctcgtgatctgcaaaccccgacgggattcaagaacagacaccgtgagttatgtgtttcggaacatgatgaagctgagttctattgacttgaatgaccaagtagagggcgatgacagagcattcgaagtgtggcaagagcgcgaggattccgttagaaagtaccttctccaggccagaacagccatcattaagagctcctgggttaaggaaatttgcggcattcagcaacgtcttgccctgcctgtatggcgccctcccgattttgaagaggagctggccgactgtaccgcagaactgggcgaaacagttaagctcgcctgtagggtcaccgggacccctaagccggtgatttcatggtataaggatggcaaagctgtgcaggttgaccctcatcatatactgatagaagacccggatggatcctgcgctctgatcctggatagtttgacgggggtcgacagtggtcaatatatgtgctttgctgcctccgctgccggaaattgcagtaccctcgggaagatcctcgtgcaggtgccgccaagatttgtgaacaaggtgcgggcttctcctttcgtggagggagaggacgcacaatttacatgtactattgagggggcaccctatcctcagatccgctggtataaggacggcgctctgctgaccactggcaacaagttccaaactttgtctgagccgcgtagcggcttactggtactggtgattagagccgcttcgaaagaggacctggggttgtacgaatgcgaacttgtgaatcgattgggaagcgcaagagctagcgcggagctccgtatacagtcacccatgctgcaggctcaagagcagtgccacagggaacagttagtggccgcagtcgaggttaccgaacaggagaccaaggtgcctaaaaagaccgtcatcatcgaagagaccatcaccacagtggttaagtcccccagggggcaacggaggagtccgtcaaaaagcccgtcacgtagtccatctaggtgtagcgctagcccattgaggcctggtcttctcgcacccgatcttctgtacctgccaggtgccggtcagccgaggaggccagaggccgaaccgggacagaaacctgttgttcctactctgtacgtaacagaggccgaagcccattcacccgctctgcccggactcagtggccctcagccaaagtgggtcgaggtcgaggagacaatcgaggtgagggttaagaaaatgggtcctcaaggcgtctctcccacgacagaggtgcctaggtcttcctccggacacctcttcacacttcccggtgccactcccggtggtgacccgaactctaataacagtaacaataagctgcttgcccaggaggcctgggcccagggtactgcaatggtgggcgtcagggaaccccttgtttttcgagtggacgcccgaggctccgtagactgggcggcatctggaatgggttccctggaggaagaaggaaccatggaggaggccggagaagaggaaggagaagatggagacgcctttgtgacagaggaatcccaggatacccactctctgggagatcgtgatcccaagatcttgacacataacgggcgaatgctcactctagctgacctagaggattacgttcctggcgaaggtgagacttttcattgcgggggtccgggtcctggggcaccggatgatccaccgtgcgaggtgtcagtcatccagagggaaatcggggagcccaccgttggccagcccgtcctgctatccgtgggacacgccttaggacccaggggccctctcggtttattcagacccgagcctaggggcgcaagtccaccaggcccacaagtgagaagccttgaaggaacgtcgtttctgctaagagaggctccggcacggccagtaggctcagcgccatggacacaatctttttgcaccaggatcaggcgcagtgccgactcgggccagagttcgttcacgactgagttatcaacgcagaccgtgaacttcgggacagtcggtgagaccgtaactctacacatatgccccgatagggacggtgatgaggctgctcagccctac

SEQ ID NO: 27661 - DNA, 1407 bp, Artificial Sequence
  Description of Artificial Sequence: Synthetic coding sequence
atggcggcacccgacctttccacaaacctgcaggaagaagcaacttgtgccatctgcctggattactttactgacccagtgatgactgactgcgggcataacttctgccgcgagtgcatccgacggtgctggggccaacctgagggaccatacgcttgcccagagtgtcgcgagctgagtccgcagaggaacttaaggcccaacaggcccctggccaaaatggctgaaatggcccgacggttacatccgcctagccccgtgccccagggtgtgtgcccggcacaccgcgagcctttggcagctttttgtggtgacgagctgagactgctctgcgccgcatgcgagcggagcggggaacactgggctcaccgggtacgcccacttcaggatgccgcagaagatcttaaggccaagttagagaagagtctggaacacctgcgcaaacagatgcaggatgccttgctgttccaggcccaggccgatgagacctgcgttctttggcagaagatggtggaatcccaaaggcagaatgttctgggagagttcgagcggttgaggcgcctactagcagaagaagagcagcaattgctccagagattggaagaagaagagcttgaggtattgccaagattacgggagggtgccgctcacctgggccagcagtctgcccacctcgccgagctgatcgcggaactggaagggaggtgccagttacccgcactgggactcctgcaggacattaaggacgcattgcggagagtccaggatgtgaaactgcagcccccagaagtggtgcccatggaactgcgaactgtctgccgcgtccccggtctggtggaaacactgcgcaggttccggggtgacgtaactctggatccagacacagccaaccccgagctgatcctgagcgaagataggcgaagcgtacagcggggtgatctgcggcaggctttaccagatagccctgagagatttgacccaggtccctgtgtcctcgggcaggagcgctttacatcaggcaggcattactgggaagttgaagttggtgatcgtacctcttgggctctgggcgtgtgcagggagaacgttaacagaaaggagaaaggagagctgtctgctggcaacgggttctggatcctggtctttctaggatcatactataacagcagtgagcgagcactagcccctcttcgagatcctcctaggagggtggggatattcctcgactatgaagccggacacctgtcattttactccgcgacagacgggtctctgctttttattttccccgaaatccccttctccggcaccttacgaccactcttctcccccctgtcctctagtcccacaccaatgaccatttgcaggccaaagggtggcagcggcgacactctcgccccacaatag

SEQ ID NO: 27662 - DNA, 813 bp, Artificial Sequence
  Description of Artificial Sequence: Synthetic coding sequence
atgagccctggatctggggtgaaatctgaatatatgaagaggtaccaggaaccccgttgggaggaatatggaccttgttatagagaacttctgcactataggctgggccgacggctgctggagcaggcccatgcaccttggctgtgggatgattgggggccagccggatcttccgaggactctgcctcgagcgaatcttctggcgctggcggtcccgcacccagatgtgccccaccgtcgcctccaccaccagtggaacccgcaactcaagaagaggcagagcgtagagctcggggagccccagaggagcaggacgccgaggccggagacgcagaggccgaggatgccgaggatgcggctctgcccgctctacctgtaaaggatgtggaagacaaacctgaacaacagaccagaacccgggaaacagataaatctccaacgtccactgagcccagacagcagccaagcgctctgttcgccagggggaatcggaaggccgtgaagagccctcagcgctccagttctaagatcaaggaaaacaaacacccttttgccctgtacggctggggcgaaaagcaaaccgacactgggtcacaaaagacccacaacgtctgcgccagcgcgcctgtgcacgagatccatgaaagtgctctgcgggcaaagaaccgacggcaggtggagaagaggaagttagtggcgcaacggcagcgggcacatagtgtggacgtagaaaaaaataggaaaatgaaagcctcatcttcagagaatccctggatgacagagtacatgaggtgttatagcgctagggcatag

SEQ ID NO: 27663 - DNA, 2667 bp, Artificial Sequence
  Description of Artificial Sequence: Synthetic coding sequence
atggacgaaagtgccttgctggatctattggaatgtcctgtttgcctggagcgtctggacgcaagcgctaaagttctgccctgtcagcatacattttgtaaacgctgtctgctgggaattgtgggatcccgaaatgagctccgttgtcccgaatgcaggaccctggtcgggagcggggtggaagagctgcctagcaatatcctgttggtgagactactggacggaattaagcagaggccatggaagcctggcccaggtggcggaagcggcaccaattgtacgaatgctctcaggtcacagtccagcaccgttgccaattgcagcagtaaagacctccagtcaagccagggaggacagcaaccgcgtgtccagtcatggagcccacctgtccggggaatcccgcagctgccatgtgctaaagccctgtacaattatgagggaaaggaacccggtgatctcaaattttcaaagggcgatatcatcatccttcgtaggcaggttgatgaaaattggtatcacggggaagtcaacggcattcacgggttttttcccactaacttcgtccagataattaagcctcttcctcagcctccacctcaatgtaaggccctgtacgattttgaagtgaaagataaagaagccgataaggactgtctgccatttgccaaagatgacgtcctgacagttatacgacgcgtggacgaaaattgggccgaagggatgctcgccgacaaaatcggaatctttccaatttcctacgtcgagtttaacagcgccgctaagcagttgattgagtgggataagccaccagtgccaggagtcgatgcgggtgaatgctcatccgctgctgcacagagttctaccgcccctaagcacagtgacaccaagaagaacacaaaaaaacggcacagcttcacgtccctgaccatggccaataaatctagccaggctagccagaatcgccattctatggaaataagtccaccagtcctcatttcttcctcgaatcctacagccgctgccagaattagtgagctgagtggcctgtcctgctcagccccttcacaggtgcacatctcaaccacgggtttgattgtcactcctccaccaagttcccccgtgacgaccggcccaagcttcacgttccccagcgacgtcccataccaagctgccctcggcaccctgaatccgccattgcccccacctccactgctggctgccaccgtgctggcttcgaccccaccaggagccaccgccgcagctgctgctgccggaatggggcctcgtcctatggctgggtcaacggatcagatcgcccatctgagacctcagaccaggccctctgtgtatgtggccatctacccatatacccccaggaaagaagatgaattggagctccggaaaggagagatgtttttggtcttcgagcggtgtcaggacgggtggttcaagggtaccagcatgcacacctctaaaatcggtgtatttcctggcaactacgtggcgcctgtcacccgtgccgtgacaaatgcaagccaggcaaaggtgccaatgagcaccgccggacagacttcgcgaggggtcacgatggtcagtccttccacagcaggcggaccggctcagaaactccagggtaatggcgtggccggttcccctagtgtagtgcctgccgctgtcgtttccgctgcccacattcagacatctccccaggcaaaggtcctactgcacatgacaggtcagatgactgtgaaccaagcccgaaatgcagtgcgcacagtagccgcacacaatcaagagcgcccaaccgcggcagttaccccaatccaagtgcaaaatgccgctggactttcccccgcaagcgtgggactcagtcatcattcactggccagtccgcagccagccccactgatgccaggatccgctacccacacagccgcaatctctattagcagggcgtctgcgcctttggcctgtgcagctgccgctcccctgacttctccttctatcaccagcgcatccctcgaagccgaaccttcaggacgcattgtaactgttctgccaggactgccgacttcacctgactccgcaagttcagcctgcggaaatagtagtgccacaaaaccggataaggattcaaagaaggaaaaaaaagggcttctgaaactgcttagtggagccagcaccaagcgaaaaccccgtgtcagtccacctgcatcccctacactggaagtggagttgggaagcgccgaacttccgctccaaggtgcagtcggacccgagcttccccctgggggtggtcatggtagagcagggagctgccctgtagacggcgacgggccagtgaccacagcggtggcgggtgctgcactggcacaggacgccttccaccgtaaagctagtagcctggactccgctgtgcctatcgccccaccacctcggcaggcctgcagtagcctgggtcccgttctcaatgaaagtcggccagtggtgtgcgaaaggcacagagttgtggtgtcatacccaccgcagagcgaagccgaactcgaacttaaagaaggggatatcgtgttcgtacacaagaaaagagaagacggctggttcaagggcacattgcaacggaacggcaaaaccggactcttccccggatcttttgtcgaaaacatttag

SEQ ID NO: 27664 - DNA, 570 bp, Artificial Sequence
  Description of Artificial Sequence: Synthetic coding sequence
atgccccagaccgtcattctgcccggaccagccccttggggcttccgcctgtcagggggtatcgatttcaatcaacccctggttataacccgcattacacccggatcaaaggccgcagcagccaatctctgtccaggagatgtaattttagcaatagatggtttcggcacagaatccatgacacacgccgatgcacaagacagaattaaagccgcagcgcaccagctctgcctgaaaattgatcgaggagagacacacttgtggtcaccacaagtatccgaggatggtaaggcccatccctttaaaattaacttagagtcggagccacaagagttcaagccaataggaactgctcataacagacgcgctcagcccttcgtggcagcagctaatattgacgataagcgtcaggtagtgtcggcctcctataattccccgatcggcctctattccacctccaatattcaggacgctctgcacggacaactgcggggacttataccctcaagtcctcagaagacaggaaccaccctgaacacatctattattttcggacctaatctgtcttag

SEQ ID NO: 27665 - DNA, 1095 bp, Artificial Sequence
  Description of Artificial Sequence: Synthetic coding sequence
atgccccagaccgtgattcttccagggccagcgccatgggggtttcgactgagcggaggtattgacttcaatcagcccttggtgataacacggatcacaccaggatctaaggcagccgctgcgaatctgtgtcctggtgatgtgatcttggctatagatggatttggaactgaatccatgacacacgccgacgcccaggacaggatcaaggccgctgcacatcaactctgcctgaaaatcgataggggcgagacacacctgtggagcccacaagtctcagaagacggcaaggctcatcctttcaagattaaccttgaatcagaaccccaagacggaaattactttgaacacaagcacaacatcaggccaaagccattcgtgattcccggtcggtcctctgggtgctctacccccagcggaatcgattgcggaagtggcaggtccacgccgtcatccgtgagtactgtgagtactatttgtcctggcgatctaaaggtagctgccaaactggcgcctaacattccactagaaatggagctgccgggtgttaagatagtgcacgcccaattcaataccccgatgcagctgtacagcgacgataacatcatggaaaccctgcaggggcaggtaagtactgcgctgggggagacccccctgatgtccgagcctaccgcctccgtgccccctgaatcagacgtataccgcatgctccatgacaaccgaaacgaaccgacccaaccacgacagagtggctccttccgcgtgctgcagggcatggtggacgatgggagtgacgaccggcctgctgggactaggagtgtgcgagcccctgtgactaaagttcacggcggtagcggaggcgctcagaggatgccactctgcgataaatgcgggtctggtatcgtaggggcagtcgtgaaggcccgtgataagtataggcatcctgaatgttttgtgtgcgccgactgtaatttaaatctcaaacagaagggctacttcttcattgagggggaactgtactgcgagactcacgcacgagccaggacgaaaccacccgaaggatacgataccgtcacattgtatcccaaggcatag

SEQ ID NO: 27666 - DNA, 951 bp, Artificial Sequence
  Description of Artificial Sequence: Synthetic coding sequence
atgccccagaccgtgatcctcccagggcctgctccttggggctttcggcttagcgggggaatcgacttcaaccaacctctcgtgatcacacgcattacacccggaagcaaagccgctgccgcaaatttatgtcctggggacgtcatcctggctattgacggcttcggcaccgagagtatgacgcatgcagatgcccaagaccgaatcaaggctgcagcacaccagctatgtctaaagattgacaggggagagactcatctctggtcaccccaggtctcagaggatggcaaagctcatccgtttaagataaatctggagtcagagccgcaggaatttaagcctatagggacggctcacaacagacgagcccagcctttcgtggcagccgcaaacatcgacgacaagaggcaggtagtctccgcaagctataacagtccgatcggactttactcaacctctaacattcaggacgcactgcacggtcagttgcgcggtctgatcccgtcatcccctcagaacgaaccgacagcatcagtcccgcctgaaagtgatgtctatcgtatgctgcatgacaatcggaacgagccaacgcaaccaaggcagtccggttccttcagagtcctgcagggaatggtggacgatggctctgatgatagacccgctgggaccaggtcagtgagggcacccgtgacaaaagtacacgggggttcaggaggcgcacagaggatgccactgtgtgacaaatgcggcagcggcattgttggtgccgtggtgaaggcccgagataaatatcgtcatcccgaatgctttgtgtgtgccgactgcaacctgaatctcaagcagaagggttacttcttcatcgagggagagttatactgcgaaacccacgcacgagctagaaccaagcctccagagggatatgatacagttactctgtacccaaaagcctag

SEQ ID NO: 27667 - DNA, 3303 bp, Artificial Sequence
  Description of Artificial Sequence: Synthetic coding sequence
atgagttattatcagagaccgttttctccttctgcgtacagcttaccggctagccttaatagcagcattgtaatgcaacacggtactagtctggattcaacagatacctatccgcaacacgcccagagtctggacggtacaacatccagctcaatacctctgtatagatcgtccgaagaagaaaagcgagtgactgttatcaaagccccacactaccccggaatcggcccagtagatgaatcaggtatccccacagctatcagaacgacggtcgataggcctaaggactggtataaaacaatgttcaaacagattcacatggttcataagcctgacgacgacactgacatgtacaacaccccctacacatataatgcagggctgtacaacccaccttatagcgcccagagccaccctgccgctaagacccagacttaccggccattgagcaaaagtcatagtgacaacagtcccaacgcctttaaagacgctagttcccctgttcctcccccacacgtgccaccacctgttcctcccctcaggcccagagaccgtagttccacagagaagcatgattgggatccaccagacagaaaggtcgacactaggaagttcagaagtgaacctcgttcgattttcgagtatgagcccggtaagtcttcaattctacagcatgagcgccctgcctctctgtaccagagcagtatcgacaggagtttagagcgccctatgtcgtccgcttcaatggctagcgactttagaaaacggagaaaatccgagcctgcagtcggtcctccgaggggtctcggtgaccagagtgctagcagaacctccccgggtcgcgtcgatctgccgggaagcagtacaacacttacaaagtcatttacgagcagcagcccatcaagtccctccagggctaagggtggggacgactctaagatctgtcccagtctgtgttcctacagtgggcttaacggtaatccatcttctgagctcgattactgttcaacctatagacagcatctggatgtgccacgcgattccccacgcgctatctctttcaaaaacggatggcagatggccaggcaaaacgcagagatctggtcctcaacagaagagacagtctctccgaaaataaagtcccgtagctgtgatgacctgctcaacgacgattgcgactcattccctgatccaaaagtgaagtctgaatccatgggaagcctgctttgcgaagaagattcaaaagagtcttgcccgatggcatggggcagtccctacgtcccagaggtacgcagcaatggtcgatctcggattagacaccgctcagccaggaatgcccctggtttccttaagatgtacaaaaagatgcatcgtatcaatcgtaaagacttgatgaacagcgaagttatctgctcggttaaatcaaggatactccagtatgagagcgaacagcagcataaagacttactccgtgcatggagccagtgcagtactgaggaagtgccacgcgacatggtgcctacgcgtatttccgaatttgagaagctgattcagaaatctaaaagtatgcccaacctgggagatgatatgctgagccccgtgacacttgagcctccacaaaatggactgtgtccaaaaaggcgtttcagcattgagtacttactggaggaggaaaatcagtctggcccaccagcccgaggacgtagggggtgccaaagtaacgccctggttccaatccatatcgaagtcacatctgatgagcagccacgcgcacacgtggagttctctgactcagatcaggacggcgtcgtatcagaccactccgattatattcacctggaagggtcctccttctgctctgagtctgactttgatcatttcagtttcactagttctgaatcattctatggatcaagccaccatcaccatcatcaccaccatcaccaccatagacacctgataagctcatgtaagggcagatgtcccgcatcttacacccggttcacgacaatgctgaaacatgaacgcgctcgacacgaaaacaccgaagaacccagaagacaggaaatggacccagggcttagcaaactagcttttctcgtgtcaccggtgcccttcagaagaaagaagaattcggccccaaaaaagcagacagagaaggctaaatgcaaagcttcagtttttgaagctctcgactcagctctgaaggatatctgcgatcaaataaaagccgagaaaaagcgaggcagtctgccagataattctatcctccacaggctcataagtgaactgctgcctgacgtgccagaaaggaattcctcgttgagggccctgcgacgttcccctctgcaccagcccctgcacccactccccccagacggcgctattcattgccctccctatcaaaacgactgtggcaggatgcctcgctcagcctctttccaagacgtagacacagctaatagctcatgtcaccatcaggaccgcggaggtgcgctgcaagacagagaaagccccagatcttatagttctaccctcacagatatggggaggtccgcacctagggagcgcaggggaaccccagagaaggaaaaactgccagctaaggctgtctatgacttcaaggcccagactagtaaagaactttcatttaagaagggtgatactgtgtatatattgcggaagatcgaccagaattggtacgaaggcgagcaccacgggagagttgggatatttcccatctcatacgtagagaagctgacaccacctgaaaaggctcagcccgctcggcctccccctccggctcagcctggtgagatcggcgaagcaattgccaagtacaacttcaatgctgacactaatgtggaattaagcctgagaaaaggagacagagtaatactcctgaaaagggttgatcagaactggtacgagggcaaaattccgggaaccaaccgccagggaatattccctgtgagctatgtggaggtcgtgaagaagaacaccaaaggcgctgaagactatcccgacccacccattcctcactcatacagttccgataggatacatagcttgtctagcaataagcctcagcgacctgtgttcacgcacgaaaacatccaggggggtggagaaccttttcaggccctgtacaactacacccctagaaatgaggatgagttggagcttcgcgaaagtgatgtaatcgatgtcatggagaagtgcgacgatggttggtttgtgggaaccagtaggagaactaagttcttcggtacattccccggtaactacgtgaagcgcctctag

SEQ ID NO: 27668 - DNA, 4389 bp, Artificial Sequence
  Description of Artificial Sequence: Synthetic coding sequence
atgttcaggggtccgaagcccccaatcgcccctaagcccaggttgaccgcacctaatgagtggcgtgccagtgtgtatctgaatgatagcctgaacaaatgctctaacggtcggcttccttgtgtggacagaggtcttgacgagggacctcggtctattccaaagtgtagtgagtccgaaaccgacgaggactatatcgtcgttccgagggttccactccgcgaggatgagccaaaagacgagggatccgtgggcaataaagccttagtgtccccagagagctccgcagaagaagaggaggaaagagaagagggcggtgaggcatgtgggctagaaggcactggcgcaggtgaggattcggtggctcccgcagcaccgggtgccggtgccttgtccagagagggcgaagaagggacagatctggccctggaggacgaaggggaaggttgcgcagacgaaccaggcaccctagaacaagttagcagatctgaggaagaagaaaagttggttcagccacaccgggagtgcagtctagaagattcagggccatgggccggtgagggggtatttcagagtgaccttctcctacctcatatacacggcgaagatcaagagcctcccgataccccaggggaagccgaggaggacgatgaagaaggctgtgctagtactgatcccgcaggagctgatgagggctcaggccctgatagaccgaccgaggatatggggcaggatgctgaggatacatccgaggaaccaccggaaaaggaggaactcgctggagttcaggaagcggaaaccgctaccgactgtcccgaggtcctcgaggagggatgtgaagaagccactggcgtgaccggaggtgagcaggtggatctgtcagagcctcctgaccacgagaagaagactaatcaggaagtggcggcagcaacgcttgaggaccatgcacaggacgaatccgcagaagagtcttgccaaatcgtgcccttcgaaaacgattgcatggaggacttcgtgacaagcctcacaggatctccctatgagttttttcccactgaatcaaccagcttctgttctgaatcttgcagccctctgagcgaaagtgcgaagggactggagtcagagcaagccccaaagctggggctgagagccgaagaaaatcccatggtgggagcgctctgtggccagtgcggcagtctgcagggaggcgctgcagaaggacctgctgccccagacgtcgtcgtggtgttggaagaggaagctttagatgatgccctggcgaacccctacgtgatgggggtgggcctgcccggacaagcagcgccaggcgaaggcggtcaagcagcatcagatgccctgggtgggtacggcagcaaagaggaattaaactgtgaagctgagggcggacttgtgcccgcagatagaaaaaataccagcacccgagtgcgcccacattccgggaaggtcgcgggttacgtgccagaaacagtgccagaggaaacaggccctgaggcaggatccagcgccccaggaatagggggtgccgcagaagaggtgggaaagactctactgagcctcgagggaaagcccctggaagctagtagggccttacctgccaaacctagggccttcactctgtatcctcgatctttctcagtggaggggagggagatcccagtaagcgtgtatcaagaaccagaggggagcggacttgacgaccacaggattaagagaaaagaggataacttgtccctgtcctgtgtgatagggagcagtggcagtttcagccaaagaaaccaccttcctagctctgggaccagcaccccgtcctcgatggtggatatccccccaccctttgatctcgcctgcataacaaagaagccaataacgaagtccagcccatcactgctcatagaatccgactctcccgacaagtataagaaaaaaaagtctagctttaaaaggttcctggctctgaccttcaaaaagaagacagagaacaaattgcatgttgacgtgaacgtgtctagtagtcgttcttctagcgagtcttcctaccacgggccatctcggatcctggaggtggatcggcgttccctttctaacagccctcaacttaagagcaggacaggaaaactgcgggcttctgagtccccctcaagtctgatcttctatcgggacgggaaacgcaagggagtgcctttttctcggaccgtgtcgagagtggagtcctttgaggaccggagtcgcccacccttcctgccactcccccttacgaagcctagatctatttcatttcctagcgctgacacatccgattacgagaatatccctgcaatgaattccgactatgaaaacatccagataccccctagaaggcccgctagagcaggagccttcaccaaattgttcgaagaccagagtcgggctctgtcgacagctaacgaaaacgatggctatgtagacatgagcagcttcaatgctttcgaaagcaaacagcagtccgccgaccaagatgctgaaagcgcatatacggagccttacaaagtttgccctatttcgagcgccgcaccgaaggaggatctgactagcgatgaggaacaacggtctagtgaggaggaagacagcgcttcacgcgatccatccgtgacccacaaggtagaaggtcagagtcgggcactcgttattgcacaggaactgctctcatccgagaaggcatacgtggagatgttgcagcacctgaatcttgattttcatggtgccgtcatgcgagctctggacgacatggatcacgagggacgagatactctggccagagaggagctgcggcaaggcctttcggaattgccggctattcatgacctgcaccaggggatactcgaggagctggaggagcggctgtctaactgggaatcgcagcagaaagtggccgacgtgtttctagcccgagaacaaggctttgaccaccacgcgactcatatcttacagttcgatcgctatctggggcttttatccgagaactgccttcattcccccagactggccgctgccgtcagggagtttgagcagagtgtccagggcggttcccagactgccaagcatcgcctgctacgagtggtccagcgcctctttcagtatcaggtacttctgacggactacctgaataatctgtgccctgactcagcagagtacgacaacactcaaggtgcactgtctctaatctccaaagtcacggaccgtgcgaatgattccatggaacagggggagaatctgcagaaactcgttcacattgagcattcagtgcggggacaaggcgatcttttacagccagggagagagttcctcaaggagggaacactcatgaaggtcacaggaaaaaataggcgccctagacatctgttcctgatgaatgacgtcctgctgtacacatatcctcagaaagacggcaagtatagattgaaaaatactctggccgtggccaacatgaaagtgtcgcggcctgtcatggagaaagtgccatacgctctgaagatcgagacgtcagaatcttgcctaatgctgtccgcaagttcctgtgccgagagagatgagtggtacggctgcctcagtcgtgcgttgcccgaggactacaaagcacaggcactcgcagccttccaccactcagtcgaaatcagagaaagactgggggtgagcctgggggaacgaccgcctaccctggttcctgtgactcacgtgatgatgtgcatgaattgtggttgcgacttttcccttaccctgcgcaggcatcactgccacgcctgtggcaagatcgtgtgcagaaattgcagcaggaacaagtacccccttaagtatttgaaagatcgcatggcgaaagtgtgcgatggttgtttcggcgagctcaagaagcgcggtagggccgtgccgggactcatgcgcgaacgcccagtcagcatgtcattcccactttcttccccaagattttctggttccgccttctccagtgtctttcagtcgataaaccccagcacatttaaaaagcagaaaaaggtgcctagcgcgctcacagaggtggcagccagcggggagggcagcgccatttcaggatacctgtccaggtgcaaacgtggaaagagacactggaagaaactttggttcgtgatcaaggggaaagtgttatatacatacatggcttccgaggacaaagtagctctggagtctatgccactgctcggatttacaatcgcacctgagaaggaggaggggagctccgaagttggccctatctttcacctgtaccacaagaagacattattttattccttcaaggccgaagacacgaactcagctcagcgatggatagaagcaatggaggacgcctcagtcctgtag

SEQ ID NO: 27669 - DNA, 768 bp, Artificial Sequence
  Description of Artificial Sequence: Synthetic coding sequence
atggccagctccgacttggagcagttgtgtagtcatgtcaacgagaagatcggcaacatcaaaaaaacgctgtcccttcgaaactgtggccaggaacccaccctcaagacggtcctcaacaagataggcgatgagatcattgtgataaacgaattgctgaataagctggagctggaaatccaatatcaggagcagaccaataacagcctaaaggaactgtgcgagtcactcgaggaggattacaaggatatagagcaccttaaggagaatgtgccctcccaccttccccaggtgacggttacacagtcctgcgtgaaaggttcagatttggacccagaggagcccattaaggtcgaggagccggagccagttaagaagcctcccaaagagcagagatcaattaaagaaatgcccttcatcacttgcgacgagttcaatggtgtcccaagctacatgaagagccgcctaacctacaatcagattaatgatgtgatcaaagaaatcaacaaggcagtgatttccaaatataaaatcctgcatcagcccaagaagtctatgaatagcgtgacacgtaacttgtatcaccgtttcatcgacgaggagactaaagataccaagggccgttacttcatcgttgaagctgatattaaggagttcacaactctgaaagccgataaaaaattccatgtgctactgaatatactccgacactgcagaaggctgagtgaggtgcgcggtgggggtttgacaaggtatgtgataacctag

SEQ ID NO: 27670 - DNA, 627 bp, Artificial Sequence
  Description of Artificial Sequence: Synthetic coding sequence
atgtcagccggaggcgatttcggcaatcccttgaggaagtttaaacttgtgtttctgggcgaacagtccgttgggaaaacaagtctcatcacacgtttcatgtacgatagcttcgacaacacctatcaggccacaattggcatcgacttcttgtccaaaaccatgtacctggaggaccgcaccgttcgtctccagctttgggatactgcaggacaggagaggttcagatctctgatcccctcttatatcagagattccacagtagcagtagtggtttatgacattactaacctgaatagtttccagcaaacctctaaatggatcgatgacgtgaggactgagagggggagcgatgtgattataatgctggtggggaataaaaccgacctggccgataagaggcagatcaccatagaggagggagaacaaagggccaaggagctttccgtgatgttcattgaaacctcggcaaaaactggatacaatgtaaagcaattattccgccgagtggcatctgccctgccgggaatggagaatgtgcaggagaaatccaaagagggcatgatagatatcaagctggacaagccacaggagccgccagctagcgaagggggatgtagctgctag

SEQ ID NO: 27671 - DNA, 3168 bp, Artificial Sequence
  Description of Artificial Sequence: Synthetic coding sequence
atgacagtagagcagaatgtgctgcagcaaagtgccgctcaaaaacatcagcagaccttcttaaatcagctgcgcgagattaccggtatcaatgatactcagatcttgcagcaggccctgaaggattccaacgggaatcttgaactggccgtggcttttctcactgccaaaaatgcgaagactccacaacaggaagagacaacatactaccagactgccctgccgggtaatgatcgatatatttctgttggaagccaggcggatactaacgtgatagatctaacaggcgacgataaggatgatctccagagagccatagccctgagcttggctgagtccaatagagcctttcgtgaaacaggcatcaccgacgaggagcaggcaatctccagggttctcgaggcctccattgctgaaaacaaggcgtgcctcaagcgcactcccaccgaggtctggcgggactcccgaaacccttacgaccgcaagcgccaagacaaggcccctgtaggacttaagaacgttggcaacacgtgttggttttcagccgtgattcagtccctgttcaacctgctggagttccgcaggctggtactgaattacaaacccccatctaacgcgcaggacctgccacgaaatcagaaagagcatcgtaacttaccttttatgagagagctcaggtatctattcgcactcctagtgggcaccaagcggaaatatgttgacccctctcgggcagtggaaattctcaaagacgcttttaaatcaaacgactcccagcagcaagatgttagcgagtttactcataaactgctcgactggctcgaagatgcctttcagatgaaagcagaggaagaaacggatgaggagaagccaaagaatcctatggtggagttattctacggacgcttcttggccgtgggagtgcttgaagggaagaaattcgaaaataccgagatgttcggccagtaccctttacaagtgaacggtttcaaagaccttcatgaatgtctggaggcggctatgatagagggagagatcgagtccttgcatagtgaaaatagcggcaagtccggtcaagaacactggtttaccgaattgccgcctgtattgactttcgagcttagccgcttcgaattcaaccaggcactgggtcggcctgagaaaattcataataagctcgaatttcctcaggtcctgtacctggatagatacatgcatcgtaatagagagatcacccgcatcaaacgcgaagagatcaagaggctaaaagattatctgactgtgctccagcagcgactcgaaaggtatctatcttatgggtcggggccaaagaggtttccgctggtcgacgtgctgcagtatgccctcgagtttgcaagcagcaagcccgtctgcacaagtccagtagacgacatcgatgcttctagcccgccatccggtagcatcccatcacagaccctcccctctaccacagagcagcagggtgctctcagttcggagctgcccagcaccagcccctcgagtgttgccgctatcagtagcagatccgtcatccataaacccttcacccaatcccggatacccccagatttaccaatgcatccggctccacgccacatcacagaggaggagctgtcggtgttagagagttgcctccacaggtggaggacagagatcgaaaacgacaccagagatctgcaggagtccatttcccgcatacacaggacgatagagctcatgtatagtgataagagtatgatccaagtgccctatcggcttcatgccgtccttgtgcacgagggacaggccaacgctggccactattgggcttacatttttgaccatcgggagtctcgctggatgaagtacaacgacattgcagtgactaagagttcttgggaagaactcgttcgagatagcttcggaggataccgtaatgcctccgcttactgcctgatgtacattaacgacaaggctcagtttctgatccaggaagaatttaacaaagagaccggtcagccgctggtcgggattgagacccttccacctgacctgcgcgacttcgtcgaagaggataaccagaggtttgagaaggagttggaggagtgggatgcgcagctggcccagaaagctcttcaggaaaagctgttagcttctcagaagcttagagaatccgagacatcagttactactgctcaggctgccggtgatccagagtacctggagcaaccctcccgatcagacttttcgaaacacttgaaggaggagaccattcagattatcacaaaggcctcacatgaacacgaggacaagtccccagaaaccgtgctgcagagcgccattaaattggaatatgcaaggctcgttaaactcgcccaggaggatactccccctgagacagactatcggctacatcacgtggtggtatacttcattcagaatcaagccccaaaaaagatcatcgagaagaccttactggagcagttcggcgaccggaatctaagttttgacgagcggtgtcacaacataatgaaggtcgcccaagctaagctggagatgatcaagccagaagaggtgaacctggaagagtatgaggagtggcaccaggattatagaaagtttcgggagacaactatgtatctgattattgggttagagaacttccagcgggaaagttacatagacagcctactgtttctaatttgtgcttaccagaataataaggagttgctgtccaaggggctctataggggacacgacgaggagttaatctcacactaccgccgtgaatgcctactgaaactgaacgagcaagccgctgagctttttgagtccggggaagacagggaggtcaacaacgggctgattattatgaatgagtttatcgtgcctttccttcccctactgctggtagatgaaatggaggaaaaagatatccttgccgtcgaagatatgcgtaatagatggtgtagttatttgggtcaggaaatggagccccacttacaagaaaaactgaccgatttcctcccaaaattgctggattgttccatggagatcaaatcgttccacgagcctcccaagttgccgagttacagcacacacgaactctgcgaaaggttcgcccgtattatgctctccctctctcggacacccgctgatgggcgatag

SEQ ID NO: 27672 - DNA, 3264 bp, Artificial Sequence
  Description of Artificial Sequence: Synthetic coding sequence
atgactgtcgagcagaacgtcctacagcagtccgcggcacagaagcaccagcagaccttcctgaaccagctgcgggagattaccggaatcaacgacacacagattctacaacaggccctcaaggacagtaatggcaatcttgagttagccgtggcctttctgacggccaagaatgcaaagacgcctcaacaagaggagaccacctattaccagacggccctaccgggaaatgaccggtacatcagcgttgggagccaggcagacacgaatgtgattgacctgactggtgatgataaggatgatctgcagagagcaattgccttgagcctagccgagtcaaaccgggcttttagggaaactgggatcacagacgaggaacaagccatcagcagggtgctcgaagcctctatagccgagaacaaggcctgtctcaagagaaccccgactgaggtgtggcgcgacagccgcaacccgtatgacagaaaacggcaggacaaagccccagtcggactaaagaatgtgggcaatacatgctggtttagcgctgtgatccagtcattgttcaatttgctggaattccggcgtttagtgttgaattataaaccgccatccaacgctcaggacctcccaaggaaccagaaagaacataggaacttgccgttcatgcgtgaattgaggtatctgtttgcgttgttggtcgggacgaagagaaagtatgtcgacccctcccgagctgtcgagattctaaaagacgctttcaagagcaacgacagtcagcaacaggacgtctcggaattcacccacaagctgcttgattggttggaggatgccttccagatgaaggcggaagaggagacggacgaggagaagccaaagaacccaatggtggaactgttctacgggagatttcttgccgtaggggtactagagggtaaaaagtttgagaacactgaaatgtttggccagtacccactccaggtcaatgggtttaaggacttgcacgagtgtttagaggcagccatgatagaaggtgaaatcgaatctctacactccgaaaactctggcaaatctgggcaggaacactggtttacagaactaccaccagtcttaactttcgagctcagtcggttcgagttcaatcaggccctcggcaggccagaaaagatccacaacaagcttgaatttccccaggtgctctacctggaccgctatatgcaccgtaacagagaaatcacccgcattaaacgcgaagaaatcaagcggctgaaagattatctcaccgtgttgcagcagagattggagcgttacctgtcatatggtagcggccctaagcgtttcccgttagtggatgtcttgcagtatgctctggaattcgcatcctcaaagcctgtatgtacgtcccccgttgatgacatagacgccagctcaccgccaagtgggtccatcccatctcaaacactgcctagtactaccgaacagcagggcgcactgtcaagcgaattaccttccacatctccttcctctgtcgcagctatttcaagtcgtagcgtaattcataagccatttacccaatcccggattcctcctgacctacccatgcatcctgctcctcgccatatcactgaagaagagctgtcagtactcgaaagttgtctgcatcgatggcgcacagagattgaaaacgatacacgcgacctgcaggagtccatctcacggatccatcgcaccatcgagctcatgtattctgataaatccatgattcaggtaccctatcggctgcacgctgtattagtccacgaaggccaggctaatgcaggccactattgggcatacatttttgatcaccgtgaaagccgttggatgaaatacaatgatattgccgtcacaaagtcatcttgggaggagctcgtgagagattcctttgggggttatagaaacgcttctgcgtattgcctgatgtacataaacgacaaggcgcaatttctgattcaggaagagttcaataaggagactggccagccgctcgtgggtattgagacactccctcctgatctgagggacttcgtagaagaggacaatcagcgtttcgagaaagaactggaagagtgggatgcacaactcgctcaaaaagctctccaagagaagctgctggccagccagaagctgcgtgaatctgagaccagtgttacaacagctcaggccgctggggacccggagtatctcgagcagccctctcgatccgacttttctaaacacctgaaagaggaaactattcagatcataaccaaggcctctcacgagcatgaggataagagccccgaaactgtgctgcagagcatcatgatgactccaaacatgcagggaatcatcatggccatcggtaagtccagaagcgtttacgatcggtgtggacccgaagctggttttttcaaggctattaagttggaatacgccaggctggtgaaacttgctcaagaagacacgcccccagagacagactatcgactgcaccacgtcgtcgtgtactttatccaaaaccaggctccgaaaaagataatcgagaagaccctgttggagcaattcggagaccgaaatctatcattcgacgagaggtgtcataatattatgaaggttgcccaagcaaagctggaaatgatcaaaccggaagaggtcaatcttgaggagtacgaggaatggcatcaagactaccgaaagtttcgggaaacaacgatgtatctgatcattggcctcgaaaactttcaaagagaatcatatatcgatagtctcctgttcctcatctgtgcatatcagaacaataaagaactgttaagcaagggtctgtaccgcggacacgatgaggaactcattagccattatagacgggagtgcctgctgaagctgaacgaacaggcagccgaactcttcgagagcggagaggatagggaagtgaataacggcctgatcattatgaatgagtttattgtaccttttctgcccttgttgttggtcgatgaaatggaagaaaaagatatattagccgtggaggatatgagaaacaggtggtgctcctacctgggacaggagatggagcctcacctacaggagaagctaacagattttctaccaaagcttctggactgcagtatggaaatcaagtcttttcatgaaccacccaagctgccctcctattcaactcacgagttgtgcgagagattcgccaggataatgctatctctctcgcgaaccccagcagacggcaggtag

SEQ ID NO: 27673 - DNA, 2559 bp, Artificial Sequence
  Description of Artificial Sequence: Synthetic coding sequence
atgtcctctgtcagtcccattcaaatacctagtcgcctgcccctgctcctgacccacgaaggcgttctcctacccggaagcacaatgcgtaccagcgtcgacagcgcacgcaacctgcaactggtgagaagccggctgttgaagggtaccagcctgcagtccactattctcggtgtaattccaaataccccagatcccgcatcggatgcccaggacctgccgccactccacagaatcggcacagccgctctagccgtgcaagtagtcggatccaactggcccaaaccccactatactctactcattacaggactatgtcgcttccagattgtccaggttctcaaagagaaaccgtaccctattgcagaagtggagcagctcgacagactcgaagagttccctaacacctgtaagatgcgtgaagaactgggggagttatcagagcagttttacaagtatgctgtgcagctggtggagatgttggacatgtcagtcccggcagtggccaagcttcgtaggttgttggacagtctccccagggaggcccttccagacatcctgacttctattatccggacctccaataaagagaagctgcagattctagatgcagttagcctggaagaacgctttaagatgaccatcccactactggtgcgtcagatcgagggactcaagttgctgcagaaaacccgcaagcccaagcaggatgatgataagagagtcatcgccatcaggcccattcgtcgtataacacatatctcaggaaccctggaggacgaggatgaagacgaggacaacgacgatattgtcatgctcgaaaagaagatccggactagctcaatgcccgaacaggctcataaagtttgcgtcaaggagattaagagactcaagaaaatgccccagtccatgcctgagtacgcgctcacccgaaactatttggaactaatggtggaactcccctggaacaagtccactaccgatagattggacattcgagcagctaggattcttctcgataacgatcattacgctatggagaagctgaagaaacgcgtgctcgaatatctggccgtacggcagctgaagaacaatctaaaagggccaatcctgtgtttcgtcggccctccaggagtcggtaaaactagcgtcggccgatccgtagccaagactctgggacgggagttccaccgcattgccctcggcggagtttgcgaccagagtgacatcaggggtcatagacggacgtacgtgggaagcatgcccggacggataatcaatggcctaaagactgtgggtgtcaacaatccagttttcctcctcgacgaggtcgataagctcggcaaaagcctgcaaggggaccctgctgcggctcttttagaggttctggaccccgaacaaaatcacaatttcacggaccattacctgaacgtagccttcgatctctcacaggtcctgttcatcgctaccgctaacacaacagccaccatcccagctgccctacttgatagaatggagatcatccaggttcccggatacacccaggaggaaaaaatcgagatagcgcaccgccacctcatacctaaacagctcgagcaacatggactgacccctcagcaaatacaaatccctcaggtcactactctagacataataaccagatatacacgagaagccggtgtccgttccctggacagaaagctgggggcaatctgtcgagccgtggcagttaaggtggctgagggccaacataaggaggcaaaactagaccggtccgatgttactgaaagggagggatgcagagagcacatcctggaagacgaaaaacctgaatccatttctgacacaacagatttagccctcccacccgagatgcccatcctgattgacttccatgcgcttaaagatatccttggcccacctatgtacgaaatggaagtatcccagcgcctgtcacagcctggcgtggccatcggccttgcttggacccccctgggcggagagataatgtttgtagaagcctctcgcatggacggggaggggcagctgactttgacaggtcagttaggtgacgtcatgaaagaatccgcgcacctagccatttcctggttacggtcaaacgcaaagaaatatcaactgacaaatgcattcggctcattcgacctcctcgataacacagacatacacttgcattttccagctggtgccgtgaccaaagacggtccctctgccggagtgactattgttacatgcttggcctccctcttttctggccgactggtgcggtccgatgtcgctatgacaggagagataacacttcggggactggtgctgcccgtggggggaattaaagacaaagtgctcgccgctcacagggccggtttgaagcaggtgattatccctcggaggaacgaaaaggacttagaaggaataccagggaatgtccggcaggacctgagtttcgtaaccgccagctgtctggacgaagttctgaacgccgcattcgacggcggattcactgtaaagaccagaccaggactactcaattcaaaattgtag

SEQ ID NO: 27674 - DNA, 390 bp, Artificial Sequence
  Description of Artificial Sequence: Synthetic coding sequence
atggctgatgggggagggggagggggtacaggcgctgtcggtgggggaggcacaagccaggccagtgctggtgcagcaaccggcgcaacaggcgcttctggagggggtgggcctatcaacccagcttctctgccccctggggacccgcagctgattgccctgatcgtggaacagctgaaaagtcgcggattgttcgactcgttccgcagggactgtctcgctgacgtcgatacgaaaccagcataccagaatcttagacagaaggtggataacttcgtcagtacacacctggacaagcaggaatggaacccgaccatgaataaaaaccaactgcggaacggtctgaggcagtctgtcgttcagatacgccaaactccctttgaatcatag

SEQ ID NO: 27675 - DNA, 1425 bp, Artificial Sequence
  Description of Artificial Sequence: Synthetic coding sequence
atggatgaggctggcagcagcgcctccggcggtgggtttcgccctggcgtggactccctagacgaaccccctaatagccgaatatttctcgttatttccaagtacacaccggagtccgtattgcgagaacgtttttctccgttcggggacattcaggatatctgggttgtccgagataagcacacaaaggagtcaaaaggtatcgcctttgtcaagttcgctaggtcgtctcaggcctgtcgcgcaatggaagagatgcacggacaatgtttgggtccaaacgacacaaagcctattaaggtctttattgctcagtccaggagttctggtagccaccgcgacgtagaggacgaagagctcactaggatattcgtgatgatcccaaagagttatactgaagaggacctgagagagaagttcaaggtctacggagacatagaatattgcagtattatcaagaataaagtcaccggcgagtccaagggactcggctacgttagatacctgaagccctcacaggctgcccaggccatagagaactgtgacaggagctttagggcaattctggcagaacctaaaaacaaggcctccgagagctccgagcaggattactacagcaatatgcgccaggaggctctgggccacgagccgagagtgaatatgttcccgttcgaacagcaatccgagttttcttccttcgacaaaaacgactccagagggcaagaggcgatttccaagcgcctcagcgtggtaagcagggttccgttcaccgaagagcagctgttttcaattttcgacatagtgcccggtcttgaatactgtgaggtgcagcgggacccgtattctaattatgggcatggtgtggtccagtactttaatgtggccagcgcaatttatgccaaatacaagctgcacgggtttcagtatccgcctggaaaccgcatcggggttagctttattgatgatggctccaacgccactgacctactccggaagatggccacgcagatggtggccgcacagctcgcatccatggtatggaacaatccatctcaacaacagttcatgcagtttggaggaagctctggcagccaactgcctcaaattcagactgacgtggtcttacccagttgcaaaaaaaaagcgccagctgagacgccggttaaggagagactctttatcgtcttcaatccacatcctctgcccttagacgttcttgaggacattttttgtcgatttggaaacctgatcgaagtgtaccttgtgtcaggtaaaaacgtggggtacgcaaaatacgctgatcgaatttcggcaaatgacgcaatcgctaccctacacgggaaaatcctaaatggagtcagactcaaagtcatgcttgcagatagcccgagagaggaaagtaacaaacgccagcggacttactag

SEQ ID NO: 27676 - DNA, 1938 bp, Artificial Sequence
  Description of Artificial Sequence: Synthetic coding sequence
atgaggcccagaaaggcattcctcctgctcctgttgcttggactcgtgcagctcctagccgttgccggtgccgagggccctgacgaagattcctccaatcgggagaacgctatcgaggatgaagaagaggaggaagaagaggacgatgatgaggaggaagacgacctggaggtgaaagaggagaatggagtgctcgtgctgaacgacgccaatttcgacaactttgtagctgacaaagacacagtgctcctcgagttctatgctccgtggtgcggtcattgcaaacagttcgctcccgagtacgagaagatcgctaatattctcaaggataaggatccacccatccctgttgcgaagattgatgctacatcagccagcgtgttggcatctaggtttgatgtttccgggtatccaacaattaagatcctcaagaaagggcaagccgttgactatgagggcagccggacccaggaggagatcgtcgcaaaagtccgcgaagtgtctcagccagattggacacccccacccgaagtcactctggtgctcactaaagagaattttgatgaggtcgtgaacgacgccgacatcatcctcgtggaattctatgccccttggtgcgggcactgcaagaaactggcgcctgaatacgaaaaggccgctaaggagctctctaagagatccccgccaattcctctcgccaaagttgatgccactgcagagaccgacctagccaagcgttttgacgtctcaggataccccaccctgaagatcttcaggaaaggacgcccttacgattataatggcccacgagaaaagtatggcatcgtggactatatgatcgagcagtccggcccaccctccaaggaaatcctcacactgaaacaggttcaggaatttttaaaggatggtgatgatgtgatcattattggcgtgttcaagggcgagtcagatccagcgtaccaacagtaccaggatgctgccaataatctccgcgaggattataagttccatcacaccttttccactgagatcgccaaatttttaaaagtctcccaaggacagctggttgtgatgcagcctgagaaatttcagagtaagtacgaacccaggtcccatatgatggatgtgcagggtagtacgcaggacagcgcgattaaggactttgttctcaaatatgccctaccactggtggggcatcggaaggtgagcaacgacgccaagagatatacaaggcgcccactggtggtggtgtactatagcgttgatttctccttcgattatcgtgccgcaacccagttttggcgctcaaaagtgctggaggtcgctaaagatttcccagagtatacctttgcaattgctgacgaagaagactacgctggcgaggtgaaagatctgggcctttctgagtctggggaagacgtgaacgccgctatcttagacgagtctggaaagaaattcgctatggaacccgaggagttcgactccgacactctccgcgaatttgttacagcttttaagaagggtaaattgaaacccgttatcaagtctcagcccgtgccaaagaacaataaagggccagtcaaggtggtggtgggcaagaccttcgattctattgtgatggaccctaagaaggatgtacttatcgagttctacgccccttggtgcggccattgcaagcaactcgagccagtgtataactccctggccaagaagtacaagggccagaaggggttggtgatcgccaagatggacgctaccgctaatgacgtgccctcagacagatacaaagtagagggtttcccaacgatatatttcgcgccatcaggggacaagaagaaccccgtaaaattcgaagggggtgatagagatctcgaacatttgagtaagtttatagaagagcatgccaccaagctcagtcgaaccaaagaagagctctag

SEQ ID NO: 27677 - DNA, 1338 bp, Artificial Sequence
  Description of Artificial Sequence: Synthetic coding sequence
atgtaccctaacccattaatttactgcacatgctgggatccatggaatcttgggccaaggaaattgatcaagactccacaactgccgcgtaagaactcaacagggagcagcaaactcacaccgctggtgccggcacccaagaaccacaactacctgcagcccacaaaaccggttgtgagcccaaaaatgaagattcactctgcccgacaagaagagactaacaagagcttttacgaagtgatcaatgtttcccctgggtaccaactggtgagaaatcgtgaacaaatatctgtgaccctcggcgacgaaatgttcgatagaaagaaaaggtgggaatccgaaatccctgacaagggacgcttctctcggaccaacatcatatccgatcttgaagaacagatatctgagcttacagcaatcattgaacagatgaacagagaccatcaatctgcacaaaaactgttatctagtgaaatggacctgaggtgtgccgaaatgaagcagaactttgagaataaaaaccgggagctgaaagaggcacacgaggcagaactctcagaattagaaaataattataaagccgctctgaaggcagagaagctggccgcacaggaaaagctcgaggagatgggcaaagaatacaaatatctgaaaaatatgtttaggacgtaccaagactcgatctatgacgaaatggaggagaagtggtccaaacagaaagcaaagtggaagaaggacgaaaagtttgaaagagagaacatcctattgcagcaaaagaagaagatgacaaagaagttcgagatggaaagcggcgaagaagataaaaaaatcaacgaaagctgctcagctgtattcgagaattttattcaggagaaagaagaactgttgaaacagcatcagtccgacaccctccagttggaagagctgcgcaagacaaaagaggtaccttggaggcgcgaccagatcaaccgccactggcacgatgtgctgcaacagctgctgctgatgcaagtgatgcaggaagagttgcatgcccaggctctaatactcgaaagtttgaatacgaacctgtactacacccagctcgagctgcagaaggagaaggcaatcgtggggaatctcgagaagatgctacagacgaagttcgcggaaactgaggagaagtataaacatactattcagatcctgaccgaggagaacatccacctcaaacagaagattatcagcaaaaacgaggagatttgtgagggttgttctggccgattggctagcatcaccgtgtctaaggacgactcagatactgtccaagacggttctaagaaaggacaggaaagttag

SEQ ID NO: 27678 - DNA, 1872 bp, Artificial Sequence
  Description of Artificial Sequence: Synthetic coding sequence
atggagcctccccaagaaaccaatcggccttttagcacgctggacaaccggagtggacaggtgcaagtgctgagcgccacccccctgctccagaggaacccttattccagcccggacattatgcatataaaggggagcgaagcctctagtgtgccctatgccctgaaccaggggaccactgccctgccgaagaataaaaaccaggaaggaaccggacaccggctgctaaacatgctcagaaagacccttaaggaatccgattcagaagaactggagatcacccaggaaacccccaacctcgtccctttcggggatgtcgttggttgcctggggatacatattaagaattgtagacatttcatgccgaagatctctttacagcactatgctaatctgttcattagaatttcaattaataaagccgtcaaatgcacaaaaatgtgctctctgctatctaaaaacgatgaaaaaaatactgttataaagttcgacgaggtgaagtacttcagcgttcaggtgcctcgcaggtatgacgataagcgaaataatatcctactagagctgatccagtacgataatagggaaaaacgagcgttcctgctgggtagtgtgcagatccatctgtacgaagtaatacagaagggttgtttcatcgaggaagtgcaggtcctgcacggaaacatctttgtatgcaggctcgaggtcgagtttatgttcagttacgggaattttggatacgggtttagccaccagctaaaacccctgcagaaaattacagagccctcaatgtttatgaatctggcccctccccctgagcgcactgacccagtcaccaaagtcataacgccgcagacagtggaatatcccgctttcctatccccagacctcaatgtcaccgtcggaacccctgcagtgcagtcctccaaccagccaagtgtggtcaggctggaaaagctgcagcagcagcctagggagaggctggagaaaatgaagaaagagtatcggaacctcaacacatggattgataaagctaactacttggaatcaattttaatgccgaaactcgagcataaagacagcgaagagactaacatcgacgaagcctctgagaatactaaatcgaaccatcccgaggaggaactagagaatattgtcggggtggacataccgctcgttaatgaagaagccgagactaccgccaatgagctgctcgacaacgatagtgaaaagggactgactataccgacactgaaccagtccgaccaggataatagcacagccgatgccagcaaaaacgatgagtccacaccatccccgacggaggtgcacagtctgtgtaccattagtaaccaagagactatcaaagcagggagaattcctccgctaggagaacgtcagagcgagagtatgcccgaccgaaagatgaaaaacgtcttcttccccctcgaggttaagctaaaagacaactatccctccatcctcaaagcagactcttctttgtctgaggttgccttctccccaaaggagtataattctcctagcttccggcctgagtacatcgaattcaaaccgaagttccaggactgttccgacaagttcgaagacctccatgatatgactagttttacccatctgaaaaaagtcaaaagccggagcaggctgttgggtaagtcgtccgacgatatccacaatcacgctaggcacagcgctcgaccatacaccgccccagaagtgaacaaacagagggagtcctacagtgggaagtttacctccagacggatggtgagcagcggcctggttcacataaacgacaaaacctccgactacgagatgcacaaaatgcgacctaagaaaataaaacggggatactag

SEQ ID NO: 27679 - DNA, 3594 bp, Artificial Sequence
  Description of Artificial Sequence: Synthetic coding sequence
atgcatattaaaagtattatccttgagggattcaaatcatatgcacagagaactgaggtcaatggattcgaccccctcttcaatgccattacgggcctgaacggcagcggtaagtctaacattctggacagtatttgtttcttactgggaatctccaacctgtcacaggtgcgtgcgtcaaatctgcaggatctcgtgtataagaatgggcaggctggcatcaccaaggccagcgtcagcattaccttcgataattctgataaaaaacagtcaccactggggtttgaggtgcacgatgaaattacagttacgcgccaagtggttatcggtggaaggaataaatatctgatcaatggggtaaatgccaataatactcgcgtgcaggaccttttctgctcggtgggcctgaacgtcaacaatcctcactttctgattatgcaaggaagaatcactaaagtgctaaatatgaagcccccagagatcctgtcgatgatcgaggaagcagcaggcaccaggatgtacgaatataaaaagatcgcggcacaaaaaactattgagaagaaggaagccaagcttaaggagataaaaaccattctcgaagaagagatcacccctaccatccagaagctcaaggaagaacgctctagttacctggagtaccagaaagtgatgagagaaattgaacacctttctcggctgtacattgcctatcagtttctgctagccgaagacactaaggtacggtcagcagaggagttgaaggagatgcaagataaggtgatcaagctgcaggaggagctctctgagaacgataaaaagatcaaggctctcaaccatgagattgaagagcttgaaaaacgcaaagacaaagaaactggtggcatcctgcgctctctggaggacgccctagccgaggctcagcgcgtcaatacaaaatcccagtcggcattcgacctcaagaagaaaaatctggcatgcgaagagagcaagcggaaggagctggaaaagaacatggtggaagattcaaagacattggccgcaaaagaaaaagaagtgaagaagattactgacggcctgcacgccctacaggaagcttcgaacaaggacgccgaagctctggctgcggcacagcagcactttaacgccgtcagcgcaggcctgtcctcaaatgaagacggtgcggaggccacactagcaggccagatgatggcctgcaagaacgatatttccaaagcccagaccgaggccaagcaagctcagatgaaactgaagcatgcccaacaggagctcaaaaataagcaggcggaagtcaaaaagatggattcaggctacaggaaagaccaggaagcacttgaggccgtgaagcgattaaaagagaagctggaggccgaaatgaagaagctgaactatgaggaaaacaaggaggagtctctgctggaaaagcggagacaactatctcgcgacatcgggcgactgaaagagacgtacgaggccctcttagcccgatttccgaacctgaggtttgcatataaagaccctgagaaaaactggaacaggaattgtgtcaagggcttggtcgcatcactgatatcggtcaaggacaccagtgccacaaccgcgctggaactggtcgccggagaacgtctgtataacgtggtggtcgacacggaagtgacaggaaagaaattactggaacggggtgagctgaaaagaagatacactatcatcccgctaaacaaaatttccgccagatgcattgctccagagaccctgagagttgcccaaaacttggtcggcccagataatgttcatgtggccctctctctggttgagtacaaaccagagttgcaaaaagcaatggaatttgtctttggcaccacattcgtatgcgataacatggacaatgccaaaaaggtcgcttttgacaaaagaattatgacacgcaccgtgaccttggggggagacgtatttgatccccatgggacactctcggggggagccagaagtcaggcagcctccatcctgactaagtttcaggaattgaaggatgtgcaggatgagctgcggattaaggaaaacgaactgcgtgcgcttgaagaagagctcgcagggctcaagaatacggcagaaaagtatcgccaactgaagcagcaatgggagatgaagaccgaagaggcagatttgctccaaacgaaactgcagcagtccagttaccataagcagcaggaagaactcgatgccctcaaaaagacaatcgaggagagtgaggagaccttaaagaataccaaagagattcaaaggaaggcagaggagaagtatgaggttctggagaacaagatgaagaacgccgaggcagaacgggaacgcgaactaaaggatgcacagaaaaagctcgattgcgctaagacaaaggcagatgcctccagcaaaaagatgaaagagaagcagcaagaagttgaagcaataacgctcgagctggaggagcttaagagagaacacacgagctacaagcagcagctggaggccgttaatgaagctatcaaatcatacgaaagccagatcgaagtgatggccgctgaggtagccaagaacaaagagagtgtcaacaaagcacaggaagaagtgaccaagcaaaaagaggtgattacggcccaggataccgtgatcaaggccaaatacgcggaggtggcaaaacacaaggagcagaataatgacagccaactcaagatcaaggagcttgaccataacatttctaagcacaaacgtgaggcagaggatggtgccgctaaggtgagtaagatgcttaaagactacgattggatcaatgccgaaaggcacctatttggccagccaaatagtgcatacgacttcaagaccaataacccgaaagaggctggccagcgtctgcaaaagctgcaggagatgaaagaaaaactcggacggaacgtgaatatgcgggctatgaacgttctaaccgaagccgaggagaggtacaatgatcttatgaagaaaaagcggatcgtggagaacgacaaaagtaaaatccttaccaccattgaggatcttgaccagaaaaagaatcaagctttgaacattgcttggcagaaagtgaataaggattttgggagcattttcagcacccttcttcccggtgcaaacgctatgttggctcccccagaggggcagaccgtgttggatggactggagtttaaggtggccctgggaaatacttggaaagaaaatctcactgaactctccgggggacagagaagcctggttgctctctctctcatactgagtatgctgctcttcaaacctgcccctatttacattctagacgaggtggatgccgcactggatttatcgcacactcagaatattgggcagatgctccgcacacatttcactcactcacagttcatagtcgtcagtctgaaggagggaatgttcaacaatgccaacgtcctatttaagacgaagttcgtcgacggggtgtcaactgtggctcgcttcactcagtgtcaaaatggcaagatatccaaggaggcaaagagtaaggccaagccgcctaagggtgcacatgtcgaggtgtag

SEQ ID NO: 27680 - DNA, 1080 bp, Artificial Sequence
  Description of Artificial Sequence: Synthetic coding sequence
atgcggaccgctgatcgcgaggcccgacccggtctaccaagccttctgctcctcttgctagctggtgccggattgagtgccgcaagcccgcctgcagctccacgatttaacgtgtccttggattctgtgcctgaactgcggtggctgccagtgctccgccattatgacctagatctggttagggcagccatggcacaggtgatcggcgatcgggtacccaagtgggtccacgtcttgatcggtaaggtggtgctcgaacttgaaaggttcttaccccagccgttcacaggtgagattaggggcatgtgcgactttatgaatctcagcctcgcagactgcctgctggtgaacctcgcttatgaaagttcggtgttttgtacttccatcgttgcccaagactcgcgagggcacatctatcacgggcgaaacttagactatccgttcggcaatgtgctgcgaaagttgacagtggacgtccagttcctgaagaatggccaaatcgcctttactggaaccacattcattggatatgttggcctctggactgggcagtctccacacaaatttaccgtctctggggacgagagggataagggatggtggtgggaaaacgctattgcagcactgtttcgccgtcatattcccgtctcctggctcatcagagctactctctcggagtctgagaacttcgaggcggctgtggggaaactcgccaagacccctttgatagctgacgtgtactacattgtgggaggcacgagccccagggagggagttgtgattacacggaacagagacggacctgcagatatttggccattagaccctctgaacggggcttggtttagagttgaaacaaattatgatcactggaagcccgctccgaaagaagacgataggcgcacctctgcaattaaggccctaaacgccactggtcaagcaaacctctcgctggaggctctgttccagatcttaagcgtggtccccgtctacaataatttcaccatttataccactgttatgtctgccggttcaccagacaagtatatgaccaggatccgaaatccttcacggaaatag

SEQ ID NO: 27681 - DNA, 1647 bp, Artificial Sequence
  Description of Artificial Sequence: Synthetic coding sequence
atggccctccacgttcccaaggccccaggattcgcacagatgctcaaagaaggagcaaagcactttagcggtttggaagaggccgtttaccgcaacattcaggcctgtaaagaattagctcagacaactcgcactgcctatggaccaaatggaatgaataagatggttataaaccatttggaaaaactttttgtaactaatgacgccgcaaccatactgagggagcttgaggtgcagcaccctgcagccaaaatgatcgtgatggcctcccatatgcaggagcaggaagttggcgacggcaccaattttgttctcgtgttcgccggagcgctgttggagcttgccgaggagctgctacggattggactttccgtgtccgaggtgattgaaggttacgagatagcttgtcggaaagcccacgaaatcctccctaacctagtttgctgttcggctaagaatctccgcgatattgatgaggtgagctcgctgcttaggacttcgattatgagtaaacagtatggaaacgaagtattcctcgctaaacttatagcccaggcctgcgtgtctatcttccccgattcggggcactttaatgtggacaacatacgagtctgcaagatcttggggagtggaatatcctcttccagtgtcttacatggcatggtttttaagaaggagaccgaaggagacgtcacttccgtgaaggatgcaaaaattgccgtatatagttgtcctttcgacggcatgatcaccgagaccaaaggaactgttctcattaaaaccgcagaagagcttatgaacttctctaagggggaggaaaacttaatggatgcgcaagtgaaggctatcgctgatactggagccaacgttgtcgttactggtggtaaagttgcagatatggctctccattacgcaaacaagtataatattatgctcgtgcgactcaactcaaaatgggatcttcgacgtttgtgcaagacggtgggcgcaacagccttacctcgcctgactcctcctgtgctcgaagaaatgggacactgtgactcagtgtatctctcagaggttggcgatacacaggtcgtggtgttcaagcacgagaaggaggatggcgcaatctcgaccattgtgctgcgaggaagcaccgataacttgatggatgacatcgaacgggcagtagatgacggtgtgaataccttcaaggtactcacacgagacaagcgcctagtcccgggaggaggtgccaccgaaatagagttggcgaagcagatcacctcctacggtgagacctgcccaggactggaacagtacgctattaagaaattcgctgaggcctttgaggcaattccacgcgctcttgctgaaaactccggggtcaaagccaatgaggttatttccaagctttatgctgtgcaccaagagggaaacaaaaatgtcggcttggacatagaagcagaagtgccagccgtgaaggacatgctcgaagcgggaatcctggacacctacctgggcaaatactgggccatcaaactcgccaccaacgcagccgtgactgttctccgcgtcgaccagattatcatggccaagcctgccggaggcccaaaaccaccatcaggcaagaaggactgggacgacgatcagaatgattag

SEQ ID NO: 27682 - DNA, 690 bp, Artificial Sequence
  Description of Artificial Sequence: Synthetic coding sequence
atgaacatccgaaatgcccagccagatgacctaatgaacatgcagcactgtaatctgttatgcctccccgaaaattatcagatgaagtattatctctaccatggactatcctggccacagctgagctacatcgcggaagatgaggacggaaagatcgttgggtatgtgctggctaagatggaggaagaacctgacgatgtgccccatgggcatattacatccctcgctgtgaagagatctcatagaagattgggcttagcccagaaacttatggatcaagccagtcgagcaatgattgagaattttaatgccaagtatgtcagtcttcacgtgagaaagtcaaaccgcccagccctgcacctctattccaacaccctgaacttccaaataagtgaggtggagccaaagtattatgcagatggggaagatgcttacgccatgaagagagatctgagccaaatggccgacgagcttagaaggcaaatggaccttaagaaggggggatacgtggtgctgggatcgcgcgaaaatcaggaaacgcaaggctctacgttgtccgacagcgaggaggcttgtcagcaaaagaaccccgctacagaagagtccgggtccgacagtaaggaacctaaagagtccgttgagtccaccaatgtgcaggactccagcgaaagctcagactccacgagctag

SEQ ID NO: 27683 - DNA, 1374 bp, Artificial Sequence
  Description of Artificial Sequence: Synthetic coding sequence
atgagtgcccttaggcgcagcgggtacggcccttccgacggtccttcttacgggcgttattatggccctggtggcggtgacgtgcctgtgcacccacccccacctttgtatcctctccggccagagcctccccagcctcccattagctggagggtccggggagggggtcccgcagaaaccacctggctcggcgaaggaggtggcggagacggctattatccatccgggggtgcatggccagagcctggacgcgctggcggaagtcaccaggagcagcccccttacccctcctacaactccaattactggaacagtactgcaaggagtcgtgccccatatccgtcaacttaccctgtccgtcccgagctacagggccagagccttaatagttacactaacggggcatacgggccaacctaccccccagggccaggcgctaacacggcttcctacagcggggcatactacgctcccggatacacccagacatcttactccaccgaggttccaagtacttacagatcatccggaaattctccgacaccagtgagtcgttggatctatccacagcaggactgtcaaactgaagctcctccactgcggggacaggttcctggctatcccccttcccagaacccaggaatgacattgccacattacccatacggggacggcaacaggagtgtaccccagagcggacccaccgtacgccctcaagaggacgcttgggcctcccctggcgcttatggaatgggcggaaggtacccttggccaagtagcgccccatctgcgcctcccggaaacctctatatgactgaatccacctccccctggccttcaagtggaagcccacagagccccccaagcccacctgtacagcagcctaaagacagcagctacccatattcacagtccgatcagagcatgaacagacacaacttcccttgctcagttcaccagtacgagtcctccgggactgttaataatgatgattccgacctgctggattctcaggtacaatactctgcagaacctcaactgtatggaaacgcaacttcagatcatcctaacaatcaggatcagtcatcctcgcttccggaggagtgcgtcccgtccgatgaaagcacaccccctagcatcaaaaagattattcatgtgttggaaaaagtgcaatatctcgagcaggaagtggaggaatttgttggcaagaaaaccgacaaagcttactggttgttggaggaaatgctgactaaagagctcctggaactggacagcgttgagacaggtggccaggactccgttcggcaggccagaaaagaggccgtctgtaaaatccaagccatcctcgaaaaactcgaaaagaaggggctatag

SEQ ID NO: 27684 - DNA, 3201 bp, Artificial Sequence
  Description of Artificial Sequence: Synthetic coding sequence
atgcagagtacagacctcggcaataaggagagcgggaaaatctggcaccggaagccatccccggctacgagagatggaattatagtcaacattattcataacacatctgactatcacccgaaggttttgcgctttctgaacgtagcctttgacgggacaggagattgcctcatcgctggggatcaccagggaaatatttatgtcttcgatcttcatggcaatagattcaatctggtgcaacgcactgcccaagcctgtacagccctggctttcaacctgcgaaggaagtcagagtttctcgttgctctggctgattatagcattaaatgtttcgatacagtgactaaggaattagtttcttggatgcggggacacgaatcgtcggtgttctcgatatctgtccatgcgagtgggaaatacgctataactaccagctccgacacggcgcaactctgggatcttgacacgttccaacggaagcgtaaactcaacatccgccagtcggtgggaatacagaaggtgtttttcctgccacttagcaacactattctgtcctgtttcaaggacaacagcatattcgcctgggagtgcgataccctgttctgcaaataccagctgcccgcacctcccgaaagctctagcatcctgtataaggtctttgccgtgacacgggacggacggattctggctgccggaggaaaaagcaatcatctccatctgtggtgtttggaggctagacaacttttccgtatcatccagatgcctacaaaagttagggccataaggcacctggagttcctcccagattcctttgacgccggatctaatcaggtcctgggcgtgctgtcgcaggatggaattatgcgcttcattaatatgcagacgtgtaaactgttgttcgagatcggttctttggatgagggtatctcttccagtgccatatcacctcatggtcgctacatcgctagcattatggagaacggctccttgaacatctattctgttcaggctctgacccaagagattaataaacccccacccccactggtcaaggttatagaggacctacctaagaataaactatccagcagcgaccttaagatgaaagtgactagcgggcgagtgcagcagccagcaaagtctagggagtctaagatgcaaacaagaatcctcaagcaggacctgactggagattttgagagtaaaaagaatgagctgcctgacggactgaataaaaagcgtctgcagatactgctaaaaggttacggagaatatccaactaagtacagaatgtttatctggcgcagtcttctacagctccccgaaaaccacacagccttttcaaccttgatcgataagggtacccacgtcgcctttttgaaccttcaaaagaagtaccctattaagagtagaaagcttcttagagtactgcaacggacactgagcgccttggctcactggtccgtgattttttctgacactccttatctgcccctgttagcattcccgttcgtaaagctatttcagaacaatcagctgatttgtttcgaggtgattgcgacactgattattaactggtgccagcattggttcgagtactttccaaatcctcccatcaacatcctctctatgattgagaatgtactcgcttttcatgacaaggagttgctgcagcactttatcgaccatgacatcactagtcaactgtacgcctggccacttctggaaacagtctttagcgaagtgctaacaagagaggagtggttgaagctgttcgacaatatcttttcaaaccacccatccttcctgctaatgaccgttgtggcttacaatatttgctcacggacacccctactgtcctgcaatttgaaagacgattttgagttctttttccaccaccggaataaccttgatatcaacgtggtgataaggcaggtttatcacctcatggaaactacccctaccgatatccacccagacagcatgctcaacgtgttcgtggccctcaccaagggccagtacccagtgttcaaccagtacccgaaattcatcgtcgactaccagacacaggaaagagagcggatcagaaatgacgaactcgactatttgagagagcggcagacagtggaggacatgcaggccaaagtggatcagcaacgcgttgaggacgaggcttggtaccagaaacaagagttactgcgcaaggccgaggaaacaaggcgggagatgttgttacaggaagaggaaaaaatgattcagcagcggcaacggctggcagccgtgaagcgggagcttaaagtgaaggaaatgcacttacaggatgccgctagacggaggtttttaaagctgcagcaggatcagcaggagatggaattgcgtcgcttagacgatgaaatcgggagaaaagtgtatatgagagaccgcgagatcgctgccacagcccgtgacctggagatgagacagctcgagttagagtcccagaagaggctgtacgagaagaatcttaccgagaaccaggaggcactcgcaaaagagatgagagctgacgccgacgcctaccgacgcaaagtcgatctcgaagagcacatgtttcacaaactgattgaggcaggagagacccagagtcagaagacgcagaaggtgattaaggagaacttagccaaggcagagcaggcctgtctgaatactgattggcagatccagagcttgcacaagcagaagtgtgacgatctacagagaaacaagtgctaccaagaggtggccaagctgctccgggagaatagaagaaaggagattgaaataattaacgcaatggtagaggaggaggcaaaaaagtggaaagaagcagagggaaaggagttccgactgaggtcagccaagaaggcatcagccctcagcgacgccagtcggaaatggtttcttaaacaggagatcaatgccgctgtcgaacatgcagaaaacccatgccacaaggaagaaccacgctttcaaaacgagcaggacagttcttgtctgcccagaaccagccagcttaatgattcgagtgaaatggacccgtcgactcagatttcactcaataggagagccgtcgaatgggacaccacaggccaaaatctgataaagaaggtgcgtaatctgcgacaacgactgaccgccagggcccgacacagatgtcagaccccacacttacttgctgcctag

SEQ ID NO: 27685 - DNA, 618 bp, Artificial Sequence
  Description of Artificial Sequence: Synthetic coding sequence
atggagggcaacgggcctgcagccgtacactatcagcccgctagcccccctcgcgacgcatgtgtttactcatcatgttattgcgaagagaatatctggaagctctgtgaatatatcaaaaatcacgaccaataccccctggaagaatgttacgccgttttcatctccaacgagcggaagatgattcctatctggaaacagcaggcaagacctggcgatggcccagtgatttgggattaccatgttgtcttgctgcatgttagctcgggtggccagaattttatctacgacttagatacagttctgccgtttccctgcctgtttgacacttacgtggaggatgcctttaagagcgacgacgatatccaccctcagtttcggcgaaagtttcgggtgataagagctgactcatatttaaaaaattttgcctctgatcgttctcacatgaaggactcctccggtaactggcgtgagccgcctccaccctacccctgtatcgagacaggcgactccaagatgaatctcaacgacttcatttctatggaccccaaagtcggctggggggctgtttacactctttcagagtttacccataggttcggatccaaaaattgctag

SEQ ID NO: 27686 - DNA, 1974 bp, Artificial Sequence
  Description of Artificial Sequence: Synthetic coding sequence
atgtctcaggtgctgttccaccaactggttcccctgcaggtgaaatgtaaggactgcgaagaacgaagggtgagcattcgtatgagcatcgagcttcagtctgtttccaatcccgtgcatagaaaagatctagtcatccggctcacagacgacactgacccttttttcctgtacaacctggtgattagtgaggaggacttccagtcgctgaaattccagcagggcctgttggtcgacttcctcgctttcccgcagaaattcattgacctgctacagcagtgtacacaagagcacgccaaggagattcccagattcttattgcagttggtgagtccggcagccatcctggacaattccccggcatttctgaatgtagtcgagaccaatcctttcaagcacctgactcacctttccctgaaattgctgcctggcaacgacgtcgaaatcaagaagttcctggcagggtgcttgaaatgtagcaaggaggaaaaattgtcactgatgcagtctttggatgacgctactaagcagttagacttcactcgcaaaactctggctgaaaagaagcaggaactcgacaagttaagaaatgaatgggcaagccatactgctgccctgaccaataaacacagccaggagctcaccaatgaaaaggagaaggctctgcaagcccaggtgcagtatcaacagcaacacgagcaacagaaaaaggacctagaaatcctacaccagcaaaacattcaccagttgcagaaccggctttcggaactggaggccgctaataaggatctgacagaacgtaagtacaaaggcgactcgactattagggagctgaaagcaaagctttctggtgtggaagaggaactgcagcgtaccaagcaggaggtgttgtctctgcggagggagaattccacactagatgtagaatgtcacgagaaggaaaagcatgttaaccaactccagacaaaggtcgcagtccttgagcaggaaattaaagacaaggaccagctggttctaagaaccaaagaggcattcgacactatccaagaacagaaagttgtgctggaagaaaatggtgaaaaaaatcaggtgcagctaggcaagctggaagctacaatcaaatctctcagcgcagagttattgaaagctaacgaaattatcaagaaactccaaggcgatttgaagactttgatgggtaagctgaaattgaaaaatactgtgaccatccagcaagaaaagctactggctgagaaggaagaaaagttgcagaaagaacaaaaggaacttcaggacgttggacagtctctaagaatcaaggaacaagaagtttgcaaattgcaggaacagctggaagccaccgtcaagaaactggaggaatccaaacaactgttaaagaataacgagaagctgatcacatggctgaacaaggagctgaatgagaaccagctggtgaggaagcaggatgttctcgggcctagtactacccccccagctcattcttcatccaatacaatccgcagcggcatttctcccaatctaaacgtggtcgacgggagattaacctaccctacctgcggcatcggttaccccgtgtcgtccgcattcgctttccaaaatacattcccccattccatttccgccaaaaacaccagtcaccccggaagtggcactaaggtccaattcaacttgcagtttaccaagcctaacgcgtcgctcggcgatgtccagagcggggcaacaattagcatgccttgttcaacagataaagagaatggcgaaaatgtaggtttagagtctaagtacttaaaaaaacgcgaagattccatccctctaagaggactatcacagaatctgttcagtaattccgaccaccagagagacggaacccttggcgctctgcacacaagctccaagcctaccgccctgccttcagcctcaagcgcttacttcccagggcaactacccaacagctag

SEQ ID NO: 27687 - DNA, 237 bp, Artificial Sequence
  Description of Artificial Sequence: Synthetic coding sequence
atgcggtttatgatgatgagagccgaaaattttttcatactgcgcaggaaacccgtcgaggggtatgacatcagcttcctgatcactaactttcacacagagcaaatgtacaagcataaattggttgattttgtcatccattttatggaagagattgacaaggagataagtgaaatgaagctgtccgtcaacgccagagcaagaatagtggctgaagagttcctgaaaaatttttag

SEQ ID NO: 27688 - DNA, 933 bp, Artificial Sequence
  Description of Artificial Sequence: Synthetic coding sequence
atgcccctgctggtggaggggagacgcgtgagactgccccagtctgcaggagatctggttcgcgcacatccccctctcgaagagcgggcaagactgctgagagggcaatctgtccagcaggttggtccccagggactgctctacgttcagcaaagagaactggcagtgactagcccaaaggacggcagcattagcatcctgggtagcgacgatgccactacgtgccacatcgtggtcctccgccacactgggaatggagctacctgccttacacactgcgacggcactgatactaaagccgaggtgcctcttataatgaactcaatcaagtcattctctgatcatgcccaatgcgggagactggaggtccacctggtgggcggattctctgacgataggcaactaagtcagaagcttacccatcagctactgtcagagttcgatcgccaggaagatgacattcatctggtgacactgtgtgtgacagaactcaatgaccgtgaggaaaatgaaaatcattttcctgtgatctacggtattgctgtcaacattaagaccgccgaaatttacagggcaagctttcaggatagaggaccagaagaacaactcagggctgcacgtactctcgctggcggacccatgatctccatatatgacgccgaaacagagcagcttcgaataggtccatatagttggacacctttcccgcatgtggatttttggttacaccaggacgacaaacagatcctggagaacctttcaacttctccactagctgaacccccacattttgtggaacatattcgcagtaccctgatgtttttaaaaaagcacccctcgccagcccacacccttttctctggcaataaggccctgctgtacaagaaaaatgaagatgggttatgggagaaaatttctagccctggcagttag

SEQ ID NO: 27689 - DNA, 924 bp, Artificial Sequence
  Description of Artificial Sequence: Synthetic coding sequence
atgacagagactacaaagactcacgtgatcctcctggcttgtgggtccttcaacccaataactaagggccacattcagatgtttgagcgcgctagggattacctccacaaaaccggccgttttatcgttatcggtggcatcgtcagccccgtgcacgactcatatgggaaacagggccttgtgtcatccaggcataggctaatcatgtgccagctcgcagtccagaactcagactggatccgcgtcgacccttgggaatgttatcaggatacctggcagaccacttgctctgtactggagcatcacagagatcttatgaaaagggttactggctgtatcctgtccaatgtgaacacccccagtatgactcctgtgatcggacagccacagaacgaaactccacagcccatctaccagaacagcaacgtggctactaagcctactgctgctaagatcctgggaaaagttggtgaaagcctctcccggatttgctgtgtcagaccaccggtcgaacggttcacattcgttgatgaaaatgccaatctagggactgtgatgaggtatgaggaaatcgaactgaggatcctgctactgtgcgggagtgatctgctggaatctttctgcattccaggtttatggaacgaagcagatatggaggtgatcgttggcgactttggtattgtcgtggtgccccgagatgccgcagacaccgaccgaatcatgaaccactcttcaattctgagaaaatacaagaacaacataatggtagtgaaagacgacattaatcaccccatgtctgtcgtatcctcaaccaagtcccggctagcattgcagcacggcgacggtcacgtggtcgactatctgtctcagccagttatagattacattttgaaatctcaattatacataaacgcctctgggtag

SEQ ID NO: 27690 - DNA, 1476 bp, Artificial Sequence
  Description of Artificial Sequence: Synthetic coding sequence
atggaagaaggaaaaatggacgagaatgagtgggggtaccatggcgagggaaacaaaagtctagtcgtagcacacgcgcagagatgtgtcgtcttgcgattcctgaaattcccaccgaacaggaagaagacctcggaggagattttccagcatctgcagaatatagtggacttcggcaaaaatgtgatgaaagaattccttggagagaattacgtgcattacggggaagtcgttcagctccctcttgagtttgtaaaacagctgtgcttgaagatccaatcagagaggcccgagagtaggtgtgacaaagacctggatacactgtctggctacgcgatgtgcctccccaacttgactcggctgcaaacctaccgcttcgccgagcacaggcctatactgtgcgtggagatcaaaccaaagtgtggcttcatcccattttcctccgatgtgacccacgagatgaagcacaaagtatgccgctactgtatgcaccaacatcttaaagttgcaacaggaaaatggaagcagatcagcaaatattgccccttggatctctattcaggaaataagcagaggatgcatttcgcccttaagagtctgctgcaggaagcccaaaacaacttaaaaatattcaaaaatggagagctcatctacgggtgtaaggatgctaggagccctgtggctgactggtccgagcttgcccatcatctaaaacccttctttttcccctctaatggactagcctctggccctcattgtactagagcggtcatccgggaattagtgcatgttattaccagagtgctgctgagcggaagtgataaaggacgcgctgggacccttagccccggtctgggaccacagggcccacgcgtgtgcgaagcctccccattcagcaggagcctccgttgtcagggaaaaaatacccctgagcgaagcggactccccaaggggtgcctgctgtataaaaccctccaagtgcagatgctcgacttgcttgatattgaaggcctctaccccctctataatcgtgtcgaacggtacctcgaagagttccctgaggagaggaagactctgcagattgatgggccttatgatgaagcattctaccagaaactgttagacctgagcactgaggacgacggcacagtggccttcgctttaactaaggtccagcagtaccgggtggccatgacagctaaggactgctctattatgattgctctgagcccatgtctgcaagacgcgagctccgaccagagaccggtggtgcccagctctcggtctcgctttgcttttagcgtgagtgtgctggacctggatctcaagccatatgagtctatcccccaccagtataagctggacggaaagatcgtaaactattacagcaagacggtccgagctaaggataatgccgttatgtccacccgcttcaaggaatctgaagattgcaccctcgttctacacaaagtgtag

SEQ ID NO: 27691 - DNA, 2640 bp, Artificial Sequence
  Description of Artificial Sequence: Synthetic coding sequence
atgatgttttatagactgctttccatcgttggcagacaaagagcttccccagggtggcaaaattggagttccgctcgcaacagcacttccgccgcagaggcccgaagcatggccctccctacacaggcgcaagtggtcatctgcggtggcggtattactgggacctccgtcgcctatcatttgagtaagatggggtggaaagatatagtgcttctggagcagggcagactggccgctggttctacccgattctgtgcaggcatcctgagcacagctagacatttaaccattgagcagaagatggcagattactctaacaagctttattatcagcttgagcaggaaaccggaattcagactggctataccagaacagggtctatctttctagcgcagacccaagataggctgatctctctgaagagaataaatgctggactgaatgtgatcggaatccctagtgagattatttcacctaaaaaggtggcagagctccaccacctccttaatgttcacgatctggtgggcgctatgcatgttccagaggacgcagtcgtgagcagcgccgacgtggccctggcgttagcttctgcagccagccagaacggtgtgcaaatctacgacaggactagcgtcttgcacgtgatggtgaaaaaaggacaggttacaggggtggagaccgacaagggacagattgagtgtcaatactttgtgaactgtgccggtcagtgggcttacgaacttggcttatctaacgaggaacccgtgagcattccactccatgcttgcgaacacttttatcttctgacgagacccctggaaaccccactgcagagctccacacccactatcgtggatgcagacgggcgtatatacattcggaattggcaaggcggaattctttcaggcggattcgaaaagaatcctaagcccatttttaccgagggcaaaaaccaactggaaattcagaacctgcaggaagattgggaccattttgagccccttctgagtagcttactgagaaggatgccagagttagagactctggaaatcatgaaacttgtgaattgccccgagacctttacacctgacatgagatgcataatgggcgagtctccggcagtgcagggatacttcgtgctggcgggtatgaactcagcgggtctgtctttcggcggtggcgctgggaaatacctagccgagtggatggtccacggctatccaagtgaaaatgtttgggagcttgacctgaaaaggtttggtgcactgcagagcagccggaccttcttgaggcatcgcgtaatggaggtcatgcctctgatgtatgatctcaaggtgccgagatgggacttccagaccggcagacagttacgcaccagtcctctgtatgataggttagatgcgcagggcgctcggtggatggaaaaacacggttttgagagaccaaaatacttcgtccctcccgacaaagatctcttagcgttggaacaaagtaaaacattttacaaaccagattggttcgatatcgtggagtccgaggtgaagtgttgcaaggaagctgtatgcgtcattgacatgagctcatttacaaaatttgaaataacctcaactggcgatcaagcccttgaagtgttgcagtatctcttttccaacgatttagacgttcccgtcggtcacattgtgcacacaggaatgttgaatgaaggcggtggctatgaaaacgattgtagtatcgcaagactgaataagaggagtttcttcatgatatcgcctactgatcagcaggtgcactgttgggcatggctgaagaagcacatgcccaaagacagtaatctactcctggaagacgtgacctggaaatacacagcgttaaacctgatcgggccaagggccgtcgatgtcctgtctgagctaagttatgccccaatgacccctgaccattttccctccctgttctgtaaagaaatgtccgtgggctacgccaatggaatccgcgttatgagcatgacccacactggggaacccggttttatgttgtatattcccattgaatacgctttgcatgtctataatgaggttatgtcagttggccagaagtacggcatccgcaatgccggttattatgccctgagatcactacgaatcgagaaattcttcgctttttggggccaggacattaacaatctgactactcctcttgagtgcgggagggagagtagggttaagcttgagaaaggtatggattttattgggcgagatgcgctgctgcagcagaagcagaacggggtctataagcggctcacaatgttcattctcgatgatcacgactcagatttagacctgtggccctggtggggtgaacctatttaccggaatggacagtatgtgggcaaaacaacttcaagcgcatatagttattcactggagcgccacgtgtgcttgggcttcgtgcacaattttagcgaggatacgggcgaggagcaggtggtgacggctgatttcattaatcgcggagagtatgagatcgacattgcagggtaccgcttccaggccaaagccaagctgtacccggtagcctctttgtttactcagaaacgaagaaaggacgacatggaattgtccgacctgcatggcaaatag

SEQ ID NO: 27692 - DNA, 1440 bp, Artificial Sequence
  Description of Artificial Sequence: Synthetic coding sequence
atggccacagactcatgggcgttggccgtggatgagcaggaggcagcggcagaatctctgagcaacctacacctgaaagaggaaaagatcaaaccagacactaatggcgctgtggtgaagactaatgcaaacgccgaaaaaaccgacgaggaagaaaaagaggacagagcagctcagtctctcctgaacaagttaatccgatctaatttggtggacaacacaaaccaggtggaggtactgcagagagatccgaacagtccactctactctgtgaagagttttgaagaactccggctcaaaccccagcttctgcaaggagtgtacgccatgggcttcaaccggccttcaaagatccaggaaaacgctctgccactgatgttggccgagccccctcagaacctgatcgcccagtcacagtctggtaccggcaagaccgccgcattcgttctcgccatgttgagtcaggtggagccagcgaataagtacccccagtgcctttgtctttcccctacatatgagctggctttgcagacaggtaaagttatcgagcagatgggcaaattttaccctgaactcaaactcgcatacgccgtgcgaggaaacaagcttgaaagggggcagaaaatctctgaacagatagtgattgggactcctggcacagttttggactggtgctccaagttgaagtttatcgacccaaagaagatcaaggtcttcgttctggacgaagctgacgtcatgatcgcgacccagggccatcaagatcagtccatccggattcagagaatgctccccaggaattgccagatgctcctgttcagcgctacatttgaagactctgtgtggaaattcgcccagaaggtcgtgcctgaccccaacgtgatcaaacttaaaagggaggaagagacgctcgacaccattaaacaatattacgtactctgttcctctagggatgagaagtttcaggcgctttgtaatttgtacggtgccatcactatagcccaggcaatgatcttttgtcatactcgaaagacagcatcttggttggccgctgaactatctaaggaaggacaccaagttgcgctattaagcggcgagatgatggtggaacagagggccgcagtgatcgaacgtttccgggagggcaaagaaaaggtgctggttaccacaaacgtgtgcgctcgaggcatcgacgtcgaacaggtgtcggtcgtaattaattttgaccttcctgtggacaaggatggtaacccagataatgaaacttatctccatcggatcggaaggactggcaggttcggcaaacggggactggccgtaaatatggtggattcaaaacatagtatgaacatcctgaataggattcaggaacacttcaataagaaaattgagcggcttgacacagatgacctggacgagatagaaaaaatcgctaactag

SEQ ID NO: 27693 - DNA, 3255 bp, Artificial Sequence
  Description of Artificial Sequence: Synthetic coding sequence
atggagcaacccaagggggtggactggaccgtgatcattctcacctgtcagtacaaggattccgtccaggtgttccagcgagaactggaggtgcgccaaaagagagaacagatacccgcaggtacattgcttctagctgtggaggaccctgagaaacgtgtcggcagcggtggcgctaccctgaatgcgctccttgtggccgcagagcacctcagtgcacgcgctgggttcaccgtggtgacatccgacgtgctccattcagcttggatactgatcctacacatgggcagggactttccctttgacgactgcggacgagcatttacctgtcttcctgtcgaaaatcctgaagccccagtggaggcgctggtgtgcaatctcgactgcctgcttgacatcatgacatacaggctgggcccaggctcccctccgggtgtgtgggtttgcagtactgacatgctactttctgtcccagctaatccaggcatttcatgggacagcttcagaggtgcaagggtcatcgccctcccaggcagtcccgcatacgcacaaaaccacggtgtgtacctgaccgacccacaaggactcgtgctagacatctactaccaaggcacagaagcggagattcagaggtgtgtgcggccagacggccgtgtccctctggtgtcaggtgtcgtctttttttctgtggagacagccgaacggctcctcgcaacgcatgtctccccacccctggacgcatgtacctacttggggctggacagcggtgctcggcctgtgcagctatcgttattctttgatattcttcactgtatggctgaaaatgtgacgcgggaagacttcctggtgggacggcctcctgagcttgggcagggcgacgctgatgttgccggatatctgcagtctgctagggcgcagttgtggagagagctgagggaccagccccttacaatggcctatgtctcatcaggaagctactcgtacatgactagcagtgcctcagagtttctcctatccttgacactgccaggtgcaccaggcgcacagatcgtgcattctcaggtggaggagcagcagttgctagccgcaggctccagcgttgtttcatgccttcttgagggccctgtacagcttggacccggttccgtccttcaacactgtcacctgcagggtccaattcacatcggagccggatgtcttgtgactggtctggataccgctcactcaaaagcactgcacgggagggaactgcgggacctggtgttacaggggcaccatacccgattacacgggagccccggtcacgctttcacactcgtcgggcgattggattcatgggagcgtcaaggcgctgggacctacttgaatgtgccttggagtgagttttttaagcgtaccggggtgcgagcctgggatttgtgggatcctgagacattgcctgcagagtattgcctgccatccgcgcgtctgtttccggtgctgcacccgagtcgggagctaggtcctcaggatttactctggatgcttgaccaccaagaggatggcggagaagctcttagggcatggcgcgcatcgtggaggcttagctgggaacagttacagccatgtttggacagagccgctaccctggcaagccgaagggaccttttcttcaggcaggccctgcacaaggccaggcacgtgctcgaagccaggcaggatctttctctccgccctctgatctgggcagccgttagggaaggatgtcctggcccactgctcgccacacttgaccaggtagctgccggtgcaggagaccccggtgtcgcagctcgagccctcgcctgtgtcgctgacgtgctgggctgtatggccgaaggtcgcggaggtctgaggagtgggcctgcagccaacccagaatggatgcgacccttttcgtatttggaatgtggagacttagcagctggtgtggaagctctcgcacaggaacgggacaagtggctgtccagacccgctcttctggtgcgcgctgccaggcattacgagggggcaggtcagatattgattaggcaggcagtgatgtccgcacagcactttgttagcactgagcaggtcgagctacctggcccagggcagtgggtggttgctgaatgcccagcaagagtagatttctctgggggatggagcgacaccccgcctctggcttatgagctcggcggagcggtcttggggctggctgttcgcgtggatggaaggcggcctatcggggcaagagccaggagaatccccgagccagaactgtggctggccgttgggcctaggcaagacgaaatgactgtgaaaatcgtctgtaggtgcctcgccgatttaagagactattgccagccccacgcacccggagccttgttgaaggcggctttcatctgtgcaggcatcgtccacgtgcattctgaactgcagttgagtgaacagctactgcgcacgtttgggggtggcttcgagctgcacacgtggagcgagctccctcacggctcaggcctgggaacgtcgtcaatcctcgcaggaaccgcccttgccgcattacagcgcgcagctgggagagttgttggcaccgaggcactcatccacgcggtgctgcacctcgaacaggtgctgaccactgggggaggctggcaggatcaggtcgggggactgatgcctggaatcaaggtgggacgatctagagcacagctccccctgaaggtggaggtggaagaggtgacagtgccggaagggttcgtgcaaaagttaaacgatcatctactgctcgtatatacgggcaaaactcgccttgcgagaaacttgctgcaggatgtgctgaggtcgtggtacgcccgtctgccagccgtggttcaaaatgcgcattcgctggttcggcagactgaagagtgcgcagaagggttccggcagggctcacttcccctgctcggccagtgtctgacgtcctattgggaacagaaaaagttgatggcaccgggttgcgaaccgcttacggtgcgccgtatgatggatgtacttgctccccacgtgcacggacagtctctagccggagccggaggagggggattcttgtatctgctcacgaaagagcctcagcaaaaagaggcattagaggccgtcctcgccaagacagaggggttgggcaactatagcatacacctggtggaagtcgatacgcagggcctttcgcttaagttgctcggcactgaagcttccacctgttgtccctttccctag

SEQ ID NO: 27694 - DNA, 2139 bp, Artificial Sequence
  Description of Artificial Sequence: Synthetic coding sequence
atgcagccagggtccgctcccccacccggacgcatggacccgtcagctcctcagccgagagccgagacatccggcaaagatatctggcaccctggcgagaggtgcctcgctccaagcccagataacggaaaactgtgcgaagccagtataaagagcataacagtggatgagaatgggaagagctttgctgtggtactctatgctgactttcaggagaggaagattcccctcaagcaactgcaagaagtcaaatttgtcaaggattgtcctcggaaccttatcttcgacgacgaggacctggagaagccttatttccctaaccgtaaattcccctcatcaagcgtggcttttaaattgtccgataacggagactccattccatatactatcaacagatacttgcgggattaccaacgcgagggaactagattcctgtacggtcattatatccacggaggcggttgtatcttaggtgacgacatgggcttgggtaagactgtgcaggtgataagcttcctagcagcagtgctacataaaaaagggacgcgcgaggatattgagaataacatgcctgaattcttgctgagatcaatgaaaaaggagcccctctcctccacagcaaaaaagatgtttttgatcgtggccccactgtcagtcttgtataattggaaggacgaacttgacacatggggatacttccgcgtcaccgtgttgcacggtaacagaaaagacaacgaactgatacgtgtgaagcagcgaaagtgcgaaatcgctttgacaacatatgagactcttaggctctgtttggacgagctgaatagcctggaatggtcagcagttatcgtcgatgaggctcaccgtatcaaaaatccaaaggcacgcgtaacagaggtgatgaaggcactgaaatgtaacgtccgtataggactcaccggcacgattctgcagaacaacatgaaagagctgtggtgcgtcatggattgggcagtgccaggcctgctcgggtccggtacatactttaaaaaacagttttcggatcctgtcgagcacggccagcgccataccgctacaaagagagaactggctactggcagaaaagctatgcaaagactcgctaagaaaatgagtgggtggtttctaaggcgtacgaaaacgctcatcaaggatcaactgcctaaaaaggaggaccggatggtttattgctcgttgaccgatttccagaaagctgtgtaccagactgtgttggagactgaagacgtaactctgatcctgcaatcatccgagccctgcacctgcagaagtgggcagaagcggagaaattgctgctacaaaaccaattctcatggggagaccgtcaagacactgtatttgagttatttaactgtgctccaaaaagttgcaaaccatgtggctctcctgcaggcagcgtccacatcaaagcagcaagaaacactgattaagagaatctgtgaccaagtcttctcccggtttccggactttgttcagaagagtaaagacgccgcttttgaaactctctctgatcctaagtattcaggtaaaatgaaagtgctgcaacaacttttgaatcactgcagaaagaacagggataaggtgctgctgttctccttttccactaagctcctggacgtgttgcagcagtattgtatggctagcgggctggactatcgccgactggatgggagtacaaaaagcgaagaacggctgaagattgtaaaggagttcaattctactcaggatgttaacatctgtctcgtgagcaccatggccggtggcctcgggctgaatttcgtgggtgcaaacgttgtggttctgtttgatccaacctggaatccagcgaacgacttgcaggccattgatagagcctacagaatcggacagtgtcgggacgtgaaggttctgcgcttaatcagcctggggaccgttgaagagattatgtacctgcgacaaatatataaacaacaactgcactgtgtcgtcgtcgggtcagagaacgctaaaagatactttgaggctgtgcaaggcagcaaggagcatcagggtgaactctttggcatccataaccttttcaaattccgatcccaggggtcttgcctgactaaggatatacttgaggtgtag

SEQ ID NO: 27695 - DNA, 1212 bp, Artificial Sequence
  Description of Artificial Sequence: Synthetic coding sequence
atgaaacagcgcaagggccaggggagcggagggtcacgcggacgaaagaagagaggtctcagcgatatatccccgtcaaccagcctgcctccactcgttgaggggcagctcagatgttttctcaaactgaccgtaaaccgcgtcatctggaaaattgcaaaaccaccaacctgcgtgctcgtgagagtcagatggtggggagaaacctccgatggcaccctgttctgcccaagagatgccttacagactgaacccaaggctgtgcggaccaccaccaggtacgccattagatgcgggcctaagcagttcacatcttacttgaccgacatggcagtgctcgtgctagaggtcattactaagcttgatggtctgcccatcggaagggtgcagatcaacgggctggcacagctaagccccactcatcaaatcaatggtttcttcacaatcgtctctagcacttccaagaaactgggggaactgcaggtgtccctggccctggagccattgagtgagacgtacgacagttatcatcctctgcccaccactgatatgactgaaaacgtactgctttcgaagcaggggtttagggagaacacagagccatcctcaacccagttccaagtgccaagtcgcccacgggatattcatactattaagattgatggcaaagagttggcggcaaactcgtctcgctcgactacaccaaggggtaaagatcatgtttgttttgccgagaatcctgatacaataaaagatagttctttcgggctgcagcacagtctcaacagcggacaaagcctcgagtcggtaacattgaaagggcgtgcccctcggaaacagatgagtctcctgaactcttctgaattccaaccacagatccgcaccgtagccaaatcccactcagattcatgcatcctctcaagtaataacctgcccactaaagatttgttgagcgcccttcttgaacagggtaacaagctccgaaatgccatggtcatcagcgctatgaaatcttcacccgagacctcaatgctcctggaccaagtccatccacttctgatgaaaattttgctagaacaccagcatagaagtgagcctttcctgggaatcggtctgaagactactcttaaaatcactagctccctgcaacttcggattcacttcggcgacatgacacaaaagctgataccggaattgtacagttgctattag

SEQ ID NO: 27696 - DNA, 3663 bp, Artificial Sequence
  Description of Artificial Sequence: Synthetic coding sequence
atgggcaaaaagcagaaaaataaaagcgaggacagcaccaaagacgacattgatcttgatgccttagctgcggaaatcgagggcgctggcgctgctaaagaacaagagcctcagaagagcaagggaaagaagaagaaggaaaagaagaaacaggactttgatgaggacgatattctgaaggagctcgaagagctgagtcttgaagcacaggggatcaaagccgatagggagacagtagctgtcaaaccaactgagaacaacgaggaggaattcacatccaaagacaagaagaaaaaaggacagaagggcaaaaagcaaagtttcgatgacaatgacagcgaagaactcgaggacaaggactctaagtccaaaaaaacagccaaacccaaggtagagatgtactccgggagcgacgacgacgatgactttaataagttgccaaagaaggcaaagggtaaagcacagaaatccaataagaagtgggatggttctgaagaggatgaggacaactccaagaagatcaaggagcgttcacgaatcaactcaagtggggagagcggggacgagtcagacgaatttctgcagagtcgcaagggacagaaaaagaaccaaaagaacaaacctggccctaacatcgaatccggcaacgaggacgacgacgcatcattcaagattaagacagtggctcagaagaaagctgagaaaaaggagcgcgagaggaaaaaacgggatgaagaaaaagccaagctgcgcaaactgaaagagaaagaggagttggagacagggaagaaagaccagagcaaacagaaagagtcccagaggaagttcgaggaagagaccgtcaaatccaaggtgaccgtggataccggcgtaatacctgctagtgaagaaaaagcagaaacaccgactgccgctgaggacgataatgagggcgataagaaaaagaaggacaagaaaaaaaagaaaggtgaaaaggaagaaaaagaaaaagaaaagaagaagggccctagtaaggctacagtgaaggccatgcaggaagctctcgcgaaactgaaggaggaggaagagaggcagaagagggaagaggaggagaggattaaaaggctggaagagctggaagcaaaacgcaaagaagaagaacgcctcgaacaggagaagcgtgaaagaaaaaaacagaaggagaaggaacgcaaagagcgtttgaagaaggagggcaagctacttaccaaaagccagagggaagcgagagccagggcagaggccactcttaagcttttgcaggcgcaaggagttgaggttccaagcaaagacagccttcctaaaaaaagacccatctatgaggacaaaaaaagaaaaaagatccctcagcaactcgaaagcaaagaagtgtccgaatccatggagctttgtgccgctgtggaggtgatggaacagggagtcccagagaaggaggaaacccccccaccagttgaaccagaggaggaagaagacactgaggacgctggactagatgattgggaggccatggcatctgacgaggaaaccgagaaagtcgagggtaacaaagtccatatcgaagtgaaagagaatcccgaggaggaagaggaggaagaggaggaagaggaggaggacgaagaatcagaggaagaggaggaggaagaaggggagagcgaggggtccgaaggggatgaagaagatgaaaaggtgtctgacgaaaaagactccgggaagaccctggacaaaaaaccttcaaaggagatgagctcggattctgagtatgatagcgatgatgaccggaccaaagaagaacgggcatatgacaaagcaaagagaagaatagagaagcgccgattggagcacagcaagaatgtcaataccgagaaacttcgcgcacccattatttgcgtgttgggacacgttgacaccgggaagacaaaaatcctcgataaacttcggcacactcatgtccaagacggcgaagcgggaggcataacccagcagatcggcgctacaaacgtcccccttgaagctatcaacgaacagaccaaaatgatcaaaaacttcgatagggaaaatgtgaggatcccaggaatgctgataattgatacccctggccacgaaagttttagtaacctgcggaaccggggttccagtctctgtgacatcgccatactcgtggtggacatcatgcacggtctcgaacctcagaccattgagtccataaacctgttgaaaagcaagaaatgtccttttattgtggcccttaacaaaatcgacagactgtatgattggaaaaaatctcctgactcagacgtggctgccacccttaagaaacagaagaagaacacgaaggacgagttcgaagagcgagcaaaagctatcatagtggagtttgcacagcaagggctgaacgcagccttattctacgagaacaaggatccgagaacattcgtgagtctggtgccaacaagcgctcacactggtgacgggatgggatcccttatatacctgctggtagagctgacccagacgatgctttctaagcgactagcccactgcgaggagctcagagcccaggttatggaagtcaaggcgctaccaggcatggggacgacgattgatgttattctcataaacgggagattaaaagagggagataccataattgtgccgggagtggagggccctattgttactcagatccgcggacttctcctgccccctccaatgaaagagcttcgcgtgaagaaccaatatgaaaagcataaagaagtggaagctgcccagggggtgaagattctaggcaaagatctggaaaagaccctggccggactccccctccttgtggcctataaagaggacgagatcccagtgctgaaggatgagctgatccacgaactgaagcagacactcaatgcgatcaagcttgaggagaaaggcgtgtatgtgcaagcctctactctgggttcccttgaggccctcctcgaattcctgaaaaccagtgaggtgccatatgcaggcataaatattggaccagtacataaaaaagacgtgatgaaggccagtgtaatgctagaacatgatcctcagtatgccgtcattctggcattcgacgtgagaatcgagcgggacgcccaggaaatggcagattctttgggcgtcaggatcttcagcgcagagatcatctatcaccttttcgacgcttttactaagtacagacaggactacaagaaacagaagcaggaagagtttaaacacattgctgtcttcccatgtaaaattaagatcttgccgcagtacatctttaactctagagatcctatcgtgatgggtgtgactgtcgaagctgggcaggtgaagcaggggactcccatgtgcgtgccatccaaaaatttcgtggatattggcatcgtgacatccatcgagatcaatcacaagcaggtcgacgtagccaagaagggccaggaggtttgcgtgaaaatagaacctataccgggagagagcccaaaaatgttcggtcggcattttgaggccacggatattcttgtgtccaagatttcacgacagagcatcgacgccctcaaagattggttcagggatgagatgcaaaaaagtgactggcagctgatcgtggagctcaagaaagttttcgagatcatatag

SEQ ID NO: 27697 - DNA, 138 bp, Artificial Sequence
  Description of Artificial Sequence: Synthetic coding sequence
atgtccgacaagccggacctcagcgaggtggaaaaattcgatcgaagcaagctgaaaaagaccaacacagaggagaagaacactctgcctagtaaggagaccattcagcaggagaaggagtgtgtgcagacctcatag

SEQ ID NO: 27698 - DNA, 1533 bp, Artificial Sequence
  Description of Artificial Sequence: Synthetic coding sequence
atgcccggaggtggcgcttctgcagcttccggaagactcctgacggccgcagagcagaggggttcacgggaggctgccggaagcgcttcgcgctcggggtttgggggatcaggcggtgggaggggaggcgctagcgggccagggtctggaagtggcggtcctggagggcctgctggtcgcatgtcactgaccccgaaggagctgtcatcactgctctctatcataagcgaggaagcaggcggtggtagtactttcgaggggttgtcaactgctttccatcactatttcagcaaagcagaccattttaggttaggctcagttcttgtgatgttgctgcagcagcctgacctgctgccctcagcagctcaacggttaaccgctctctacttgttatgggagatgtaccgcactgagccacttgccgcaaatccattcgccgcatcttttgctcacttactgaatcccgcacctccggctcgcggaggtcaggagcctgaccgcccaccattatccggctttcttcctccaatcaccccccctgagaaatttttcttgtcacaactgatgctggcacctcctcgggaactttttaagaaaaccccacggcaaatcgccctgatggacgtcgggaacatgggccagtccgtggacattagtggattgcagcttgccctcgctgagcggcaaagcgaacttcctactcagtctaaggcatcattcccctccatactctcagacccggaccccgactcttctaactccggattcgattccagcgtagcctctcagatcacagaggcccttgtatcaggcccaaagccacctatcgaaagtcatttcaggcctgaatttattcgaccacccccaccgctccatatctgcgaagatgagctggcctggctaaatcctactgagccagatcacgctatccagtgggataaatcgatgtgcgttaagaactctaccggcgtggaaataaaacggattatggcaaaagctttcaaaagtcctctttcctccccgcaacagacccagctcctgggggagctggagaaggatcctaagctggtctaccacattgggctcacccccgctaaactgccagacctagttgaaaacaatcccttggtcgctatcgagatgttactcaaactcatgcagtcctcccagattactgaatacttctctgtgctcgttaacatggacatgagtctccattccatggaggtggttaataggctgactaccgctgtagacctgccaccagagttcatccatctgtacatctccaattgcatatccacatgcgaacagataaaagataagtatatgcaaaatcggttggtcagactcgtatgcgtgtttctccagagcctgattagaaacaagattattaacgtgcaggaccttttcatagaggtgcaggcgttctgcatagaattctcacgcatcagggaggctgccggactgtttaggttactaaaaacgctggataccggagagacaccatcagagaccaaaatgtctaagtag

SEQ ID NO: 27699 - DNA, 2184 bp, Artificial Sequence
  Description of Artificial Sequence: Synthetic coding sequence
atgtctggacggaagcggtctttcacctttggggcatatggtggtgtggataagtcattcacttctaggcgctcagtgtggagaagcgatggccagaatcaacactttccccaagcgctggatctcagcagagtgaacctggttccgagttacaccccgagcttgtaccccaaaaacaccgatctgttcgaaatgattgagaagatgcaaggaagccgaatggatgaacagcgttgctcgtttccacctccccttaagacggaggaggattatatcccttatcccagtgtacatgaggtactgggcagagagggacctttccctctaatcctgctgccccagttcgggggttattggattgagggcacgaatcacgagattacttcgattcctgagaccgagccactgcagtcaccgaccaccaaagtgaaactggagtgtaatcctacagctagaatctaccgtaaacatttccttggaaaggaacatttcaactattacagcctggacgctgccttgggccacttagtgttctctctgaaatacgatgtcattggcgaccaggagcacctgaggctcctgttgagaactaaatgcaggacttatcatgacgttattcccatcagttgtctgacggaatttccaaacgtcgtgcagatggcgaaactcgtctgtgaggatgtgaacgttgacaggttctaccctgtgctgtaccccaaagcgtccaggctgatcgtgacgtttgacgagcatgtaatctccaacaatttcaagttcggagtcatttaccagaagttgggacagactagcgaagaagagctgtttagcactaacgaagagagcccagctttcgtcgaattcttggaatttctgggccagaaagtaaaacttcaggacttcaagggcttcaggggcggactggatgttactcacggtcaaaccgggacagaatctgtgtattgtaattttcgtaacaaggaaatcatgtttcacgtctcgacaaaactgccctataccgaaggcgatgcacaacagctacagagaaagagacatattggtaatgatatcgtcgcagtggtgtttcaggacgagaacaccccattcgttccagatatgatcgcatctaactttctgcacgcatacgtggttgtgcaggctgagggaggaggacccgatggtccactgtacaaggtgtcagtgactgccagggatgacgtgcctttcttcggtccacccctgcccgacccagccgtgtttcgaaaggggcctgagttccaggaatttctgctgaccaaactcatcaacgctgaatacgcctgctacaaagctgagaaatttgccaaactggaggagaggacaagggcagcgttactggagaccctgtatgaggaattacacatacacagtcaaagcatgatgggcctgggaggcgacgaagataaaatggagaacgggtcaggaggaggaggtttctttgagtctttcaaacgggttatccgatctcgatcccagtcgatggacgctatgggtttgtccaataaaaagcccaacaccgtcagtacgtcccactctggttcttttgcccctaataatccagatctcgcaaaggccgctgggatcagcctgattgtcccaggcaaatctcccaccagaaagaagagcgggcctttcggcagtcgaagatcgagtgctatcggcatagagaacatccaggaagtccaggagaaacgcgaatcccccccagccggtcagaaaacacctgattcagggcacgtgtcccaagaacccaaatcggagaactcttcaacccaaagctccccagaaatgcctacaacgaaaaaccgagcagaaaccgcagcccaacgggctgaagcactgaaggatttttctagatcgtcctcttctgcgtcgagttttgcttccgtggtagaggaaacagagggagtagacggggaagatacaggcctcgagagcgtgtcctcctccgggacaccccacaaaagagattcttttatctacagcacatggctggaggattctgtatccactacctctgggggttcatcacctggcccttcccgcagcccgcatccggacgcgggaaagctaggtgatcccgcttgccccgagatcaagatacagttggaggcctcagagcagcacatgccccagttgggctgttag

SEQ ID NO: 27700 - DNA, 873 bp, Artificial Sequence
  Description of Artificial Sequence: Synthetic coding sequence
atggtactcctgcacgtcaagcgtggagacgagagccaatttctgttgcaagcccctgggtctacagaactagaggaactgacagtgcaggtggcaagagtctacaacggacggctcaaggttcaacgactgtgttccgaaatggaggaactagccgagcacggcatcttcctgccaccaaacatgcaggggctgaccgacgaccagatcgaagaacttaaactcaaagacgagtggggagagaaatgtgtgccatcgggcggtgcagtgtttaaaaaagacgacataggcaggcgcaacggacaagcacctaatgaaaaaatgaagcaggtgctgaaaaaaactatcgaagaggccaaagcgatcatatccaaaaagcaggttgaagccggtgtatgcgttactatggaaatggttaaggatgctctggatcagctcaggggcgctgtcatgatcgtgtaccccatgggcctgccaccatatgacccaattcggatggaatttgaaaataaagaagatctgtcgggtacccaggccggacttaatgtgatcaaggaggccgaggcccagctgtggtgggcagctaaagaactgcgcagaaccaagaagctatccgattacgtgggcaaaaacgaaaaaaccaagattatcgcaaagatccagcagaggggtcagggggctcctgcaagagaacctattatttcgagtgaagaacaaaaacaactcatgctgtattatcataggcgacaggaggaactaaagaggttagaggaaaatgatgatgatgcctatttgaatagcccttgggccgacaatacggccctgaagcgacactttcacggtgttaaagacatcaagtggagacctcggtag

SEQ ID NO: 27701 - DNA, 567 bp, Artificial Sequence
  Description of Artificial Sequence: Synthetic coding sequence
atggaaccgcctaggggaccacctgcaaatggcgctgagcctagtcgtgccgtagggacagtgaaggtttacctaccaaataagcagcggaccgtggtgaccgtacgggatgggatgtctgtttacgactctttggacaaggccttgaaggtacgcggactcaatcaggactgttgcgtggtctaccggttgatcaagggacggaagacagtcaccgcctgggacaccgctattgcgcctctcgatggcgaggagttaatagttgaggtgctcgaggacgtgccactcacaatgcataacttcgtgcggaaaactttcttttccctcgccttttgcgatttttgcctgaaattcctttttcacggctttcggtgccagacgtgcggctacaagttccatcaacactgttcctccaaagtgcccacagtatgcgtggatatgtcaaccaacagacagcaattttatcactcggttcaggaccttagcggcggaagtagacagcatgaagccccttctaatcggcctctgaatgaactcctgacccctcagggaccgagttgcagatag

SEQ ID NO: 27702 - DNA, 2034 bp, Artificial Sequence
  Description of Artificial Sequence: Synthetic coding sequence
atggatgaccccgactgtgatagtacctgggaggaggatgaggaagatgccgaagacgccgaagatgaggattgcgaggatggtgaagctgctggagccagggatgccgacgcaggtgacgaggacgaagagagcgaagaaccccgtgctgctcgccctagcagctttcagagccgaatgacagggtcgcgcaactggcgggcaacgcgggatatgtgccgctatcggcataattacccagaccttgtcgaaagagactgcaatggcgatacgccaaatctatcattttacaggaatgagatcagattcttacctaacggatgctttatcgaagatatccttcagaattggactgacaactacgatctgttggaagataaccacagctacatccaatggctgtttccgctgcgagagcccggagtcaattggcacgctaaacctcttactttgcgggaagttgaggtgtttaaaagctcccaagagatacaggagaggctggttagagcttacgagctgatgttaggattctatgggattagactcgaggacagaggaacgggcacagtggggagagcacaaaactaccagaaaaggtttcagaaccttaattggcgcagccataacaacttgcgcattaccagaatattgaaatctctaggtgagctaggattggagcatttccaagctcctctggtaaggttcttcctggaagagaccctggtgcgccgagagttacctggtgttcgccagagtgccctggattacttcatgttcgcagtgcggtgtagacatcagcgcaggcaactcgtccatttcgcctgggagcatttccgcccaagatgcaagtttgtctggggtcctcaggacaaactgagacgattcaaaccttcctccctcccccatcccctggagggaagccgtaaagtcgaggaggaagggtctcccggtgatcccgatcatgaggccagcacccaggggaggacatgcggcccagaacactcaaagggagggggtcgagtcgatgagggcccacagcctaggtcagttgagccccaggacgctgggcctttggagagatcccagggggatgaagctggtggtcatggtgaagatcgccctgagcctttgagccccaaagagagtaaaaagcgtaaactggaactctctcggagggagcagcctcccacggaacccggaccacagtctgcttcggaagtggaaaagatcgcattgaacctcgagggctgtgctttatctcagggctcactaagaacgggcacacaagaggtcggtggacaggaccccggagaggctgtccagccttgccggcagccactaggggcaagggtggccgataaggtgagaaagaggcggaaggtcgacgagggggcaggggactctgcagccgtggcctccggcggagcacaaacactcgcgctcgctggcagcccagcgccttcaggccacccaaaggccggtcatagtgaaaacggggttgaggaggacactgaagggcgtaccggtcccaaggagggcacgccaggctccccatccgaaacgccgggaccatcccctgccggaccagccggagacgagccagccgagtcgcccagcgagacccccggaccccgtcccgcaggacctgcaggggacgaaccagctgaaagcccatcagaaacccctggtcctaggcccgctggacccgctggcgacgagcctgcggagagtccctctgaaactcctggtccatctcctgccggacccacgagagatgagcctgccgagagcccttctgaaacaccaggccctcggccagccggacccgctggagacgaacccgcagagtctccctccgaaacaccgggaccgcgtccggctggcccagctggggatgaaccggctgagtcaccctcggaaaccccaggtcccagccccgctggtccgacgcgagatgagccagctaaagctggggaggcagccgagctacaggacgcagaagtggaatcctcagcaaagtccgggaagccgtag

SEQ ID NO: 27703 - DNA, 735 bp, Artificial Sequence
  Description of Artificial Sequence: Synthetic coding sequence
atggggctcgaactgtttttagatctggtgagccaaccgagtcgcgcagtttacatttttgctaagaagaatggaattcccctggaactgcggaccgtcgacctcgtgaagggacagcacaagagcaaggagttccttcagatcaactcactggggaagctgccgaccttaaaagatggcgacttcatcctgactgagtcatcggctattctgatctacttaagttgcaagtatcagacgcctgaccactggtatcctagtgatcttcaggcccgagctagagtgcatgaatacctcggttggcacgctgactgtataagagggactttcgggatcccactgtgggtccaagtgctgggacctctgatcggcgttcaggtcccagaagaaaaagttgagaggaaccggacagccatggaccaagctctgcaatggctggaagataagttcctaggagacaggcccttcttggccggacagcaggttactctggcggacctcatggccctggaggagctcatgcaacccgtggcacttgggtatgaactttttgagggcaggcctcgccttgcagcttggaggggtagggtagaagcattccttggagcagagctatgtcaggaagcccacagtatcattcttagcatcctagagcaggccgctaaaaaaacactacccacaccaagtcccgaggcttaccaggccatgctgctcagaatcgcaagaatcccatag

SEQ ID NO: 27704 - DNA, 531 bp, Artificial Sequence
  Description of Artificial Sequence: Synthetic coding sequence
atggcagcaagcaccgatatggctgggctcgaggaatccttcagaaagtttgctattcatggggaccccaaggcaagcggtcaggagatgaatgggaaaaactgggccaaactgtgtaaggattgtaaggtagccgatgggaagtcagtcacaggaacagacgtggatattgtcttctccaaagtgaagggaaagtctgcaagagtgattaactatgaagagtttaaaaaagcacttgaagagctggctaccaagaggttcaagggtaaatcaaaggaggaggcctttgacgcgatttgccagctcgtggccggaaaggagcctgcaaacgttggcgtgacaaaggcaaaaacaggcggagccgtcgatagacttactgataccagcagatacaccggctctcataaagaaagatttgatgaaagcggtaaaggcaagggcattgctgggagacaggacatcctggacgactccggctacgtgtctgcctacaagaatgcagggacctacgacgcaaaagttaagaaatag

SEQ ID NO: 27705 - DNA, 930 bp, Artificial Sequence
  Description of Artificial Sequence: Synthetic coding sequence
atgagcgatctcggttctgaggagctggaggaagagggtgaaaatgatattggggaatacgagggaggaagaaacgaagctggcgaacggcatggcaggggtagagcacggctgccgaatggggacacttacgagggatcttatgagtttggcaagagacacggccagggcatatacaaatttaaaaatggggctcgatacatcggcgaatacgtgaggaataagaagcacggacagggaacatttatttacccagatggttcaagatacgaaggtgagtgggccaatgaccttcgtcatgggcacggcgtgtattattacataaacaacgacacgtacacaggtgaatggttcgcacaccagagacacggccaggggacttatctatacgccgagacaggctctaagtatgtcggcacctgggtgaacggtcagcaggaaggaacagccgagttgatccatctcaatcatagataccaggggaaatttctgaacaagaatccggtaggaccaggtaagtacgtcttcgatgtaggatgcgaacagcacggggagtaccggctgaccgacatggaaagaggggaggaagaggaggaagaggagctggtcactgtggttccaaaatggaaagcaactcagatcaccgagctggcgttatggaccccaacacttcccaaaaaacccacaagcacggatggacccggacaagatgctcctggcgctgagtcagcaggagaacccggtgaagaagcccaggctttgctggagggctttgaaggagaaatggatatgaggccaggggacgaggatgctgatgttcttcgcgaggaaagtcgggaatatgaccaggaagaatttcggtacgatatggacgaaggtaacatcaatagtgaagaggaagaaactagacagagtgatcttcaagactag

SEQ ID NO: 27706 - DNA, 5943 bp, Artificial Sequence
  Description of Artificial Sequence: Synthetic coding sequence
atgaaccccactaacccgtttagcggccaacagccctccgctttctcggcgagctcaagcaacgttgggacgctgccctcgaagcccccattccgtttcgggcagccctccttgttcgggcagaattccaccctgagcggcaagtcttccgggttttcccaagtgtcctcgttccctgcaagcagcggcgtctcccacagtagctctgtccagacactaggctttacacagacctcaagcgttggccctttttcaggacttgagcatacttctacttttgtcgctacgtctggtccaagttcctccagcgtgctcggaaataccggcttcagcttcaagagtcccacctccgtgggcgcattccctagcacttctgccttcgggcaagaggcaggggagatcgtgaattcgggctttgggaagaccgagttctcatttaaaccgctggagaacgctgtgtttaagcctattctgggagccgaaagcgaaccagaaaagacccaatcacagatcgcctctggctttttcactttctcacacccgatctcgagcgccccagggggacttgcgcctttctcttttcctcaagtcacatctagctccgccaccacaagcaacttcacattttcaaagcctgtgtcaagcaataacagcctgtccgcttttaccccagcactgagtaaccagaacgttgaagaggaaaaacggggtcctaagagcatcttcgggtcttcgaataattcattcagcagtttccccgtcagcagtgctgtcctcggcgaaccttttcaagcgtcaaaagctggtgtgcgccaaggttgtgaggaggccgtcagccaggtggagcctctcccctccttaatgaagggacttaaaaggaaggaggatcaggaccgaagcccccgtaggcacggccatgaacctgcagaggactctgacccactgtcacgtggtgatcatccacctgataagcgacccgtgaggctgaatcggcctcgcggtggaaccctattcggtagaacgatccaggatgtgttcaagtcaaataaagaggtcggccgtctgggcaataaagaggcgaagaaagagactggctttgtggagtctgcggagagcgaccacatggccatccccggaggcaaccaatcagtgctggcaccaagccggatccctggggtgaacaaagaggaagagacagaatcacgtgaaaagaaggaagacagcttacgcggaacacctgctcgccagtcaaataggtcagaatccacagattctctcggcggtctgtcgccttctgaagtcacagctatccagtgcaagaacatcccggattatctgaacgatagaacgatcctggagaaccactttggcaagatcgccaaggtgcagagaatatttaccagaaggtctaaaaaacttgcggtagttcatttcttcgaccatgcctcggcagcgctggcgcgtaagaaaggaaaaagcctacacaaagacatggctatattctggcatagaaagaagattagccccaataaaaaaccattttcgctgaaggaaaagaaacctggagatggcgaggtcagtccgagtacagaggacgcccctttccagcacagtcccctggggaaagcagcgggtcgaaccggcgcaagctccctcctgaataaatcctccccagtcaagaagccttcactcctgaaggctcatcaattcgaaggtgattcatttgattctgcttctgaaggcagtgaaggcctgggaccatgtgtcctaagcctctctaccctgattggcaccgttgccgaaaccagtaaagagaagtatcggctcctggaccagagggaccgtattatgcggcaggccagagtgaagcgcaccgatcttgacaaggctcgcactttcgttggcacttgtctggatatgtgcccagagaaggagagatacatgcgcgaaactcgctcccagctttctgtcttcgaggtcgtccccggtactgaccaagtagatcatgccgcagccgtcaaggaatatagtcgctccagcgccgaccaggaggagcccctgccacacgaactgcgtcccttgcctgttctgtctaggactatggattatctggtgacacagattatggatcagaaggaggggagcttgagagactggtacgactttgtgtggaatcgaacccggggtataagaaaggacatcacgcaacagcatctgtgtgaccctctcactgtatcactgattgaaaagtgcacgcggtttcatatccactgtgcccactttatgtgcgaggagcccatgtcctcgttcgacgctaaaattaataacgagaatatgaccaagtgcctccaaagcctcaaagagatgtaccaggatctgcggaataagggggtgttttgtgcatccgaggctgaatttcaaggctacaatgtcctgttaagtctgaataagggcgacattttaagagaagtgcagcaattccatccagccgtccggaacagcagcgaagtgaaatttgccgtgcaagccttcgcggctctgaactcaaataattttgtgagattctttaagcttgtccagagcgcctcttacttgaacgcctgcttgctgcactgttatttctctcagatacgcaaagatgcactcagggcgcttaactttgcatatacggtgtcaacccaacgcagcacaattttccccctcgacggcgttgtgcgaatgcttttattccgggattgtgaggaggctactgatttcctcacttgtcacggactcacagtttcagatgggtgtgtcgaattgaatcggtccgcattcttagagccagagggcctgtctaaaacacgcaagagcgtgttcatcacgaggaagctgaccgtgagcgtgggtgagatcgtgaacgggggtcccttgccccctgtgcccaggcacacacctgtgtgtagcttcaattcacagaacaagtatatcggcgaaagtctggcagccgagctgcctgtgtctactcagaggcccggtagcgacacagtcgggggaggaagaggcgaagagtgcggggtcgagccagacgctcctctttcttccctcccacagtcattaccagcccctgcgccttcacctgtcccgctccctccagtgttggccttaacaccttccgttgcccctagtcttttccaactgagcgtgcagcccgaacctccaccccctgagccagtgcctatgtacagtgacgaagaccttgcgcaggtcgtagatgaactcatccaggaagctctccagcgggactgcgaagaagtgggatctgccggagccgcatacgctgctgcagcacttggtgtgtcaaatgcagctatggaggatctgctgaccgccgctactaccggaatcctgcgacatatcgccgcagaggaggtgtcaaaagagagagagcggagggagcaggaacgacaacgggctgaagaggaaagactgaagcaggaaagagagctcgtgttgtcagaactttcccagggcctggccgtggagctgatggaaagggtcatgatggagtttgtcagggagacatgctcacaagaactgaagaacgccgtggagactgaccagagggtgagggtggcacgctgttgtgaagacgtgtgtgcccacttggtagacctgtttctcgtagaagagattttccagacggcaaaagaaacccttcaagaactccagtgtttttgcaagtacttgcagcggtggcgggaagccgttactgcccgtaagaaacttaggcggcagatgcgcgctttccctgccgctccgtgctgtgtagacgtgagtgatcgcttgagggccctggctccatccgcggagtgtcctattgccgaggagaacctggctcgaggcttgctagatctggggcatgccggaaggcttggcattagctgcacccgcttgcgcaggcttcgtaacaaaaccgcacaccagatgaaggttcaacacttttaccaacaattgctctctgatgttgcttgggcctccctcgatctgccatcactggtggccgagcacttgcccggacggcaggaacacgtgttctggaagctggtgctggtcttacccgacgtggaggagcagagtccggagtcatgtggacgaatcttagcaaactggttgaaggtgaagtttatgggagatgaagggagcgtcgacgacacatccagtgacgccggaggaatacaaacgctctcactgtttaactcactctcatctaagggtgatcagatgatttcagtcaacgtatgtataaaggtggcccatggcgctctctctgacggagcaatagatgcagtggagacccagaaggatttgctgggcgcttccggcctgatgctgctgctaccaccaaaaatgaagtccgaggacatggctgaagaagatgtgtactggcttagtgcactgctgcaactcaaacagctgctgcaggctaagcctttccagcccgcattgcccctggtggttcttgtgccttctcccggaggtgatgccgtggagaaagaggtagaagacggactgatgctgcaagatctcgttagtgccaaattgatctccgattacacagttaccgaaattcctgatacaatcaatgatcttcagggatctaccaaggttctgcaggcagtgcagtggctcgtgtcgcactgtccacactctttagatttgtgttgccaaaccttaatccagtatgtagaagatggaatcggccatgaattttccggtagattttttcatgaccggagagaaagacggctaggtggacttgctagccaggagccaggcgcaattattgaactttttaatagtgtgctgcaatttttagcctcagtggtcagcagtgagcagctctgtgacctgtcctggcccgtgacagagttcgctgaggccggtgggagtcgtctcttaccacatctgcactggaacgctcctgagcacttggcctggctgaaacaagcggtcctggggtttcagctgccccagatggatctgcccccattaggtgccccttggctgccggtatgttctatggttgtacaatacgcgagtcaaatcccatcttctagacagacccagcctgtgctccagagccaggtggaaaatctcctgcatagaacgtactgccgatggaaatctaagtcacccagcccagtgcacggagcaggccctagcgtgatggagataccttgggatgatctgattgcgttgtgcatcaatcataagttaagagattggaccccgcctaggctgcccgtgactagtgaggctttatccgaggatggacaaatatgcgtgtactttttcaaaaacgacttaaagaaatacgatgtgcccctgtcttgggagcaagccaggctgcagacacagaaagaactgcagttgagggaggggcgacttgccataaaaccgttccatccatcagctaacaattttcccatccccctgctgcatatgcatcgtaactggaaacgctcgaccgagtgtgctcaggaaggaagaatcccctccacggaagacttaatgagaggggctagcgcagaagaattgctggcccagtgcttaagctcctccctcctacttgaaaaagaggaaaataagcgcttcgaagaccagctgcagcagtggctgtcagaggacagtggagcctttaccgacctgacatcactgcctctgtacctgccacagactctggtctccttgtctcacacaatagagcctgtgatgaaaacgtctgtgacgactagtcctcagtccgacatgatgcgcgaacagctccagctcagtgaggctaccggcacgtgtctcggggaacgcctcaaacacctggagagactcattcggagttccagagaggaggaggtggcgtcagagctacacttgtccgccctcctggatatggttgacatttac

SEQ ID NO: 27707 - DNA, 3147 bp, Artificial Sequence
  Description of Artificial Sequence: Synthetic coding sequence
atgtcagatgtgaatccgccatccgatacaccaatcccgttttcatctagctcaacccatagtagccatatccctccgtggacctttagctgttacccgggatcgccgtgcgaaaacggtgtgatgctgtatatgcggaacgtcagccacgaggagctgcagcggtttaaacagcttctcttgaccgagctctcaaccggcaccatgcctattacatgggatcaggtggagaccgcatcttgggccgaagttgtccatcttcttatagagcgcttccccggtagaagagcctgggacgtgacctcaaatatattcgcaattatgaattgtgataaaatgtgcgttgttgtgaggagggaaattaacgcgatcctgcctacccttgagcccgaagacctcaatgtcggcgagacccaggtcaacctggaggagggagagtctggtaaaatccgcagatataagtccaatgtgatggagaaattctttccgatatgggatataacaacctggcccggaaaccaaagggatttcttctatcagggcgtccacagacatgaggaatatttgccatgcctgttactacctaagagaccccaaggtcggcagcccaagaccgtggccatccagggggctcccggaatcggcaagactattttggcgaagaaagtcatgttcgaatgggccaggaataagttctatgcacataaaaggtggtgtgccttctatttccattgccaggaagtcaaccaaaccacagatcagtccttctcagagttgattgagcaaaaatggccagggagtcaggacctggtctctaagatcatgtctaagccagaccaactgctgctgctgctggatggcttcgaggagctcacctctacattaatagatcgtctggaggatctatcagaagactggcgacagaagctaccgggttctgtcctcctctcatctctcctgtctaagacgatgctccctgaggccacacttctgataatgatacggttcacctcttggcaaacgtgcaaacctctgttgaaatgcccttcactcgtaactctaccagggtttaacacaatggagaagatcaagtattttcagatgtacttcggccatacagaggaaggagaccaggttctctcttttgcgatggaaaataccattttatttagcatgtgtagagtgcctgtggtgtgctggatggtgtgctccggcctgaagcagcagatggaacgcggtaacaacctgacccagtcctgtccaaatgccacctcagtattcgtgcggtacatctcctccctgtttcctactcgtgcagaaaacttttcccggaagatccaccaggcccaacttgagggactgtgtcatctggctgctgacagtatgtggcaccggaagtgggtgcttgggaaggaggacctggaggaagcaaaacttgaccaaaccggggttaccgccttcctcggtatgtccatacttcggagaattgccggagaagaggatcactatgtcttcactctcgtcacgttccaggaatttttcgcagcccttttttacgtgctctgctttcctcagcgtcttaaaaatttccacgtcctcagccacgtgaacatccagaggcttatcgcatctcccagaggctctaaaagctacctgtcccatatgggcctgtttttgtttggctttctgaatgaggcatgcgcttctgccgttgagcagagcttccagtgcaaggtgagctttggaaacaagcgcaaactgctgaaagtgatcccgttgctgcacaaatgcgacccaccaagccctggctccggtgtaccccagctgttttactgtctacacgagattcgtgaggaggcctttgtctcccaggcactaaatgactatcacaaagttgttctcagaattggtaacaacaaggaggtccaagtttctgcattctgcctgaaaagatgccagtatctgcacgaagtggaattgacagtcactcttaatttcatgaacgtgtggaaactgagctcctcatcccaccctgggagtgaagcacctgagagcaacggccttcacagatggtggcaggatttatgttcagtttttgccaccaatgacaagctggaggtcctgaccatgactaacagtgttcttggacctccgtttcttaaggcgcttgcagccgctctgcgccatcctcagtgtaagctgcagaagctgctgttgcgtagagtaaattcaactatgctgaaccaagacctgatcggcgttctcaccggtaaccagcatcttcgctatctggaaattcagcacgtggaggtcgagagcaaggcagtgaagctgctctgtcgcgttttgcgctcccccagatgccgcttgcagtgtctgagactcgaagattgcctcgcaaccccacggatttggacggacttaggtaacaatctgcagggcaacggccatctgaagacacttattttgcgcaaaaactctttggaaaattgtggggcttattatctcagcgtggctcagctggagcgtttgtcaattgaaaattgcaacctcacacagttgacctgtgagtcccttgcctcatgccttagacagtcaaaaatgttgacacacctttcgttggctgaaaacgcactcaaagatgagggtgctaaacatatctggaacgccctcccccacctcaggtgccctttgcagcgcctggttctgaggaaatgcgacttgacgtttaattgttgccaggacatgatttcggccttgtgcaagaacaagaccttaaagagcctagacctgtcatttaacagcctaaaggacgacggtgtcattctgctgtgcgaagccctgaagaatccagactgtaccctccagattttggagctagaaaattgcctgtttacatctatctgctgccaagcgatggcctcaatgctgagaaagaaccaacatctccgtcatctcgacctgagcaagaatgctataggtgtttacgggatccttacactgtgcgaagctttttcatcccagaagaaaagagaggaagtaatcttctgcatccccgcttggacccgtatcacctctttttcccctactccccatcccccagacttcaccggaaagtctgattgcctctctcagattaacccttag

SEQ ID NO: 27708 - DNA, 3792 bp, Artificial Sequence
  Description of Artificial Sequence: Synthetic coding sequence
atgcctgccagaatcggctactacgaaatagatcggacaattgggaaaggcaatttcgccgtggtcaaacgggcaacccatctggtcaccaaggcaaaggtggccatcaagattattgataagacccagctggatgaggagaatctaaagaagattttcagagaggtccaaattatgaagatgctgtgccacccgcacataattagactttaccaagtgatggaaactgagcgcatgatataccttgtcacagagtacgctagtggcggtgagattttcgaccacctggtggcccatggacggatggccgagaaggaggcccgacgtaagttcaaacagatcgttaccgcagtatacttttgtcattgccgcaatatcgtgcacagggatctgaaagctgaaaacctgctgctggatgccaaccttaatataaagattgctgattttggcttcagcaacctctttactccgggacaactgttaaagacttggtgtggcagtcctccttacgcagctcccgagctttttgaagggaaggaatacgatggacccaaggtggatatttggtccctgggagtggtgctttatgtcctggtctgcggcgcacttccttttgatgggagcactctacagaatttaagagccagagtcctgtctgggaaattccggattccgtttttcatgtctaccgaatgcgaacacctgattcggcacatgctcgttctggatcctaacaagaggctcagtatggagcagatttgcaaacacaaatggatgaagcttggcgacgccgatcctaatttcgatcggttgatcgctgaatgccaacagttaaaagaggagagacaggtggatccactcaacgaagatgtgttgttggccatggaagacatgggcttggataaagagcaaactctacagagcttgcggtcagatgcgtatgatcactactccgcaatttactcacttctctgcgaccggcacaaaaggcataaaacgctccgccttggagccctcccttcaatgccgcgagcccttgccttccaggcccctgtgaatatacaagctgaacaagcgggtactgctatgaacatctcggtcccccaggtgcagctaataaacccggaaaaccaaattgtcgagccagacggcactctgaatctcgatagtgatgagggcgaagaaccttctccggaagccctggtccgctacctgagcatgcggcgtcataccgtcggagtagcagacccacggactgaagtgatggaagacctgcagaaactgcttccaggattcccaggtgtcaacccacaggctccattcctacaggttgcccctaatgtaaacttcatgcacaatctgctgcccatgcaaaatctgcagccaacgggccagctagagtacaaggaacaatccctcttgcagccccctacactgcaactgctgaatgggatgggccctctaggtcgtcgggcatctgatggaggggcaaacatccaactgcacgcccagcagctgctgaagcggcctcgcggtccatcccccctcgtgacaatgacgcccgcagtgcccgcagttacacctgtcgatgaggaaagttccgatggggaacccgaccaagaggccgtccaatcatcaacatacaaagacagtaacacacttcaccttcccaccgaacgctttagccccgtgagaagattttctgacggagccgcttccattcaagctttcaaagctcatcttgaaaaaatgggcaataattccagcataaagcaactacaacaagagtgtgagcagcttcagaagatgtatgggggacagatcgacgaacgaacccttgaaaagacccagcaacagcatatgctctaccagcaggagcagcatcatcagattctgcaacagcagattcaggacagtatttgtccaccgcaaccttccccacctcttcaggccgcatgcgaaaaccagccagccctgctgactcatcagctgcagaggctccgaatccagccatcatcccctcctcccaatcatccgaataatcacctgttcagacagccctcgaactcgccaccacctatgtccagcgcaatgatccagccccacggtgccgcaagctcctctcagttccaggggcttccatcacggagcgctattttccagcagcagcccgagaactgctcttcaccaccaaacgtagcgctaacttgcctcgggatgcaacagcctgcgcagtcacagcaggtgacgatccaggtgcaggagccggtggacatgttatccaacatgcccggtactgccgctggaagtagtggaagagggatatccatctccccttcggctgggcagatgcagatgcagcatcgtacaaatctcatggcaacgctctcttacggtcacaggccactgtctaaacaactgtctgcggactccgccgaagcacacagcttgaatgtcaacagattcagccctgccaactatgatcaagcacacctgcatccgcatctttttagtgaccaatcccggggaagcccttcttcatactctccctctacgggcgtgggattttctcctacccaggcactgaaagtgccaccactggatcagttccctactttccccccttcggctcaccagcagccccctcattacacaacgtccgcgctgcagcaggctctgctctcccctaccccccctgattatacaagacaccaacaggtcccccatattctgcaggggttactgtcaccacggcatagcctgacaggacactcagacatacgcctaccgcctaccgagttcgctcagctaatcaagcgccaacagcagcagagacagcagcagcagcagcagcagcagcagcaggaataccaagaactgtttagacacatgaaccagggggacgccggttcgctcgccccatccctgggcggacagtccatgaccgagcgccaggccctgtcataccaaaacgccgactcctaccaccaccatacttccccccagcacctcttacagattagagcccaggagtgcgtgtcgcaagcctcaagtccaaccccacctcacggctacgctcatcaacccgctttaatgcactcagagtccatggaggaggactgcagctgcgagggagctaaagatggcttccaagactctaagagcagctccaccctcacgaaagggtgccacgattctccattattgctctcaactggaggacccggagaccctgaatctctgctgggcaccgtgtcccatgctcaggagctgggaattcacccatatggtcaccaacccaccgctgcctttagcaaaaataaagtaccctcaagggagccggtgattgggaactgcatggacaggagctctccaggacaagctgttgaactgcccgatcacaatgggctcggctatcctgctagaccttccgtgcacgaacatcaccgcccacgggctctgcagcggcaccatactatccaaaattctgacgacgcctatgtgcaattagacaacctgccagggatgtctctggtcgcgggaaaggccctctccagtgcacggatgagcgatgcggtgttgtcgcagtccagccttatggggtcccaacagtttcaggatggagagaatgaggagtgtggcgcttccttaggcggacacgaacacccggatctttctgatgggtcacagcatttaaattcatcctgctacccgtctacgtgtatcactgatatcctgcttagttataaacatcccgaagtcagtttttcgatggaacaagcaggggtttag

SEQ ID NO: 27709 - DNA, 4395 bp, Artificial Sequence
  Description of Artificial Sequence: Synthetic coding sequence
atgtatcagcccgaggacgacaataatagtgacgtgacaagtgacgacgacatgactcgcaacaggcgagagagttctcctccccactcagttcactcattctccggggatcgagactgggaccgaagaggcagatcgagagacatggagcctcgggaccggtggtcgcatactcgcaaccctcggagtcgcatgcctcccagagatctgagcctgcccgtcgtagctaaaacttcttttgaaatggaccgggaagatgacagagattctagagcctatgaatcaaggtcccaagacgcagagtcttatcaaaacgtggtggatttagctgaggaccgcaaaccacacaatactattcaggacaacatggaaaactaccgaaagttactcagtctcggtgtgcaactggctgaggacgatggacattcccatatgactcaggggcattccagcagaagtaaacgctcagcctaccctagcacgtcccggggtctgaagaccatgcctgaagctaagaaatctacacatagaaggggcatctgtgaagacgagtcctcccatggggtcatcatggagaaattcattaaggatgtctctcgatcaagcaaaagcgggagggccagggagagctccgaccggtctcagagattcccaaggatgtctgatgataactggaaagacatcagcctcaataaacgggaaagcgtgattcagcagagggtgtacgaggggaatgctttcagagggggtttccgctttaactccaccctggtcagccgcaagcgagtgctggaacgcaagcgccgataccatttcgatacagacggcaaaggtagcattcatgatcagaagggatgcccgcgtaagaagccgttcgagtgcggctccgagatgcggaaagctatgtctgtgtcgtccctaagctcactgagttctccctcattcaccgaatctcaacctatcgactttggagctatgccgtacgtatgcgacgaatgtggcagaagcttctccgtgatatctgaatttgtggaacatcagatcatgcatactcgtgagaatctttacgagtacggagaatcttttatccatagtgttgctgtctccgaggtgcagaagagccaagtgggaggcaaaaggtttgaatgtaaggattgtggcgagacctttaataagtccgctgccttagcagagcacagaaagatccacgctaggggttacctggttgaatgcaagaaccaagaatgcgaggaggccttcatgccatcccccaccttttccgaattgcagaagatttacggtaaggacaagttttatgaatgccgagtatgcaaggagacctttctccatagcagtgcactcatcgaacatcagaagatccactttggcgacgacaaggataacgagagggagcacgaaagagagcgcgaacgtgagagaggagagactttcaggccctcccctgctctgaatgaatttcagaaaatgtacggcaaagaaaagatgtacgaatgcaaggtatgcggggagacgtttctgcactcttcatcccttaaagagcatcagaagattcataccagaggaaacccattcgaaaataaaggaaaggtgtgcgaggagaccttcattcctgggcagtccttaaagagaagacagaagacttataacaaggaaaaactgtgtgattttactgacggccgtgacgccttcatgcagagctctgaactctccgagcatcagaagattcattcacgaaagaaccttttcgaaggccgtgggtatgaaaagagtgtgatccacagtggccctttcacagagtcgcaaaaaagtcacacaattacccgcccattggagtccgatgaagatgagaaggcatttactatcagtagcaacccatacgagaaccagaaaattcccacaaaggagaacgtgtatgaagcaaagagttacgaacgatctgtcattcattccctggcatccgttgaagcacagaagagtcactccgtcgccggacctagcaagccgaaagtgatggctgaaagcaccatccagtcgtttgatgcgataaaccaccagagggtccgggctgggggtaatacctctgagggcagagagtacagccgaagtgtaatacatagcttggttgcttccaaaccgccaaggtcgcataacggtaatgaactggttgagagcaacgagaaaggggagtcatcgatctatatctctgatctcaacgacaagcgtcagaaaattcctgcgagagagaacccctgtgaaggtggaagtaagaatagaaactacgaagacagcgtgatccagtccgtgttccgcgctaagccacagaagagcgtacccggtgaaggctccggcgaattcaaaaaagacggagaattttcagtgccttcctctaatgtgagggagtatcagaaagcacgcgctaaaaaaaaatacattgagcacaggtctaatgagacatctgtgatccactcccttcccttcggggaacagacctttcgtccccgaggaatgctttatgagtgccaggaatgtggggagtgcttcgcccacagctccgacctgacagagcaccagaagatccatgaccgcgagaaacccagcgggagcagaaactatgaatggagcgtgataaggagcctcgcccctacagacccgcagacatcatacgcacaagaacagtacgccaaggagcaagccaggaacaaatgcaaggacttcaggcagttcttcgccacttccgaagacctgaatactaaccaaaagatctatgaccaagagaagtcacacggggaggagtcccagggcgaaaatacagatggcgaggagacccactctgaggaaacacatggacaggagaccattgaggacccagtaatacagggatccgatatggaggacccacagaaagacgatcctgacgacaagatttacgagtgcgaagactgtggcctgggtttcgtggacctaaccgacctgactgatcatcagaaggtgcactcccggaaatgtctggttgatagtcgcgagtatactcactccgttatccacacacattcaatctctgaatatcaaagagactataccggggagcaactgtatgagtgtcccaagtgcggcgagagcttcatccactcttccttcctgttcgagcatcaacgcatacacgagcaggatcagctctactctatgaagggctgtgatgatggctttatcgctttgcttcccatgaaaccacggcgtaaccgcgcagcagaacgcaaccccgcattggccggatctgccataagatgcctgctctgcggtcagggctttattcatagtagtgctctgaatgaacacatgcggctgcatagagaagacgatttgcttgaacagagtcaaatggccgaggaggctattattcctggcttggctctgaccgaattccagcgatcacagacagaagagcgactctttgaatgtgcggtttgcggcgagtcatttgtgaacccagcagaattggctgaccacgtgacagtgcacaaaaacgagccttatgaatatgggtcgagctatacgcacaccagctttttaacagagcctttgaagggggcaatacctttctacgagtgtaaggattgtggtaaatccttcatacatagtaccgtattgactaagcataaggagctacacttagaggaagaagaggaggatgaagcagcggctgctgccgcagctgccgctcaagaagtcgaagccaacgtgcacgtgcctcaggtggtgctccgcatacagggactgaacgtggaggcggcagagcccgaggtggaagctgcagagccagaagtcgaggccgcagagcccgaagtggaagcagcagagccaaatggggaggctgaagggcctgacggggaggccgctgaacctatcggggaggcgggacagcccaatggagaggctgaacagccaaatggcgatgctgatgagccagatggtgcaggcatcgaagacccagaggaaagggccgaggaaccggagggcaaggccgaagagcctgagggggacgcagacgaacccgacggggtgggaattgaagatccagaagagggtgaagaccaggaaatccaggtggaagaaccctactatgactgtcacgagtgcaccgagacattcaccagctccaccgcttttagcgagcacctgaaaactcacgccagtatgatcatctttgaaccggctaatgcgtttggagaatgctctggttatattgagcgcgcttctacctccactggaggcgcaaaccaggcagatgaaaagtattttaaatgtgatgtgtgcggtcagctgttcaacgaccgcctgtccctggcacggcaccagaatacacataccggttag

SEQ ID NO: 27710 - DNA, 1302 bp, Artificial Sequence
  Description of Artificial Sequence: Synthetic coding sequence
atggcagaagcgcagtcaggtacggggcagctgcaggaacaaaaaaaggggctgctgattgccgtgagcgtgagcgtcgataagatcatcagccactttggcgctgccagaaatttggtccagaaggcacagctgggcgacagcagactcagcccagatgtcggtcacctcgtactcaccacactctgcccggctctacatgccctcgttgctgacggacttaaaccctttagaaaggacttaattacaggtcagcgccgatcttctccttggagcgtcgtggaggcctccgtgaagcccggatccagtacgcggagtctgggcacattatactcacaggtgtccagactggcaccactatcctcctctaggagccgcttccacgccttcattctggggctgctcaacacaaaacagttggaactatggttttcatctttacaagaagacgccggtcttctgtctcttctatacctgccaacaggttttttctccttagctagaggcggttgtcccagtttaagcactgaactcctgcttttgctgcagcccttgtccgttcttacgtttcacctggacctgctctttgagcaccaccaccacttgcccctggggccaccccaggccccagcgcctcctggccctccccctgcgcttcaacagaccatgcaggcaatgctgcactttggaggtagactggcgcaatcattgcggggtacttcgaaggaagctgcctcggatcccagcgattctcctaatttacctacacctggctcatggtgggagcagttgacacaggcctctcgcgtatacgcatctggaggcacagagggctttccactgagtcgctgggccccagggaggcacgggaccgccgctgaagagggggctcaggagagacccctgccaactgatgagatggccccaggaaggggcctgtggctcgggcgtctgtttggcgtgcctgggggtccagctgagaatgagaacggcgcattaaagagccgcagacccagttcgtggctgccacctaccgtgtctgtactggccctggtcaagcgcggagcacccccagagatgccatcacctcaggagttagaagcgagtgccccaaggatggttcagacccaccgtgctgttcgtgccctgtgtgaccataccgcagccagacctgatcagttgtctttcagacggggagaggttctgcgggtgatcacaaccgtcgacgaggactggcttcggtgtggaagggatggaatggagggtctcgtccctgtcggctatacctctctcgtgttgtag

SEQ ID NO: 27711 - DNA, 1584 bp, Artificial Sequence
  Description of Artificial Sequence: Synthetic coding sequence
atggctcaaaccctgcagatggagattcccaactttggaaacagtattctagagtgtctgaatgaacaaagattgcagggactgtattgtgatgtctcagtggtcgtcaaaggacacgccttcaaggcacatagggctgtgttggccgcatcttcttcttactttcgggacctcttcaataactctcgcagtgcggtggttgaattgcccgctgccgtacagccacaaagttttcagcagatcctgagtttctgttacacaggaagactgtccatgaatgtgggagatcaatttttactgatgtacacggcaggctttttgcagattcaggaaatcatggagaaggggaccgagttcttcctgaaagtgagttccccttcctgtgacagtcagggtttacacgcagaggaagccccaagttccgagccccagtctcctgtagcccaaacctctggctggccagcgtgctctacgcctctgccgctcgttagtcgtgtgaagactgagcagcaggaaagtgactccgttcagtgtatgccagtggctaagagactttgggatagcggccagaaggaggcaggcggaggaggcaacggtagtcggaagatggctaagttctctaccccagacctggctgccaacaggccacatcagccgcctccacctcagcaggcccctgtagtggcagctgcccagcctgcagtggcagcgggtgccggacaacctgcaggaggcgtggccgcagcaggaggagtcgtgtctggacccagcacctccgagagaactagtcccggaacctcgagtgcctatacatcagattcaccgggttcctaccacaacgaggaggatgaagaggaggatggcggagaagagggtatggatgagcaatatcgacaaatttgtaacatgtatacaatgtacagcatgatgaatgtgggacagaccgctgagaaagtggaggccctacccgagcaggtcgctcccgaatcccggaatcgcatccgcgtccggcaggacttagcaagcctgccggcagaactcatcaaccaaattggaaatcgatgccatccaaaactgtacgatgaaggagatccgagtgagaaactcgagttggttaccggcacgaacgtctatatcacaagagctcaactgatgaactgtcacgtgtcagccggaacccgccacaaagtacttctccgtcgattgctggcgagcttctttgacaggaacaccctcgccaacagctgtggaacggggatacggtcatcaaccaatgatcctcgtcgcaagcctttggactcgcgggtgctgcatgctgtgaagtactactgccagaattttgccccaaatttcaaagaatctgaaatgaacgctatcgccgctgacatgtgcacaaacgccagaagggtggtgcgaaagtcatggatgcccaaggtaaaagtccttaaggcggaggacgatgcatataccacttttatcagcgaaacaggtaagattgaaccggatatgatgggcgtggaacacgggtttgagacggctagtcacgagggggaggctgggcctagtgcggaggccctgcaatag

SEQ ID NO: 27712 - DNA, 672 bp, Artificial Sequence
  Description of Artificial Sequence: Synthetic coding sequence
atggaggtgcaaaaagaagcacaacgtatcatgactttgtccgtctggaagatgtaccactcccgcatgcagcggggaggactgcgtctccacagatctcttcagctgagtctggtgatgcggtctgcccgtgaactttatctcagtgctaaagtggaagcactggaacccgaggtgtctctacccgcagccctgccctctgaccctagattgcacccccctcgggaggctgagtctaccgccgaaactgcaacccctgacggcgagcacccgttcccagaacccatggacactcaggaggcaccgactgcggaagagactagcgcctgttgcgcccctaggccagccaaggtcagcaggaaacgcaggtcttccagtcttagcgacggtggcgacgccggactcgtgccatcgaagaaagccaggcttgaggagaaggaggaagaagaaggtgcctcttccgaggtcgccgatagattgcaaccccctcccgcacaggctgagggcgctttccccaatctagcccgtgttttgcagcgtcgtttttccggtctccttaactgttctccagcggctccccctaccgctccacccgcttgtgaagctaaacccgcatgtcgcccagctgactctatgttgaacgtgcttgtcagggctgtggtggccttctag

SEQ ID NO: 27713 - DNA, 1500 bp, Artificial Sequence
  Description of Artificial Sequence: Synthetic coding sequence
atgcgtgtcctggtgcccccagctgaacgttcacaagatacacgcgtgggggctccagcgtggagagaagctgcgcaggcaatggcaagaactgctcatattctgactgaccgctgtggacaggaagctgtaacaatgtggcagcctaaagacagcgtcttggatcctaatgtggcccatcatctcggaagagcagcctacatccaaccatggcgctttagagtggaaatgatcaaaggaggcggtaccctggagaagcccccaccgggtgaaggggtaacgctttggaaaggtaagatgaaacctcccgcttggtatgccagactgccactgccactgcacaggaaagccagagccctgcagactaccgaggtcgtgcacgcccacgcaagaggggcaagactcactgcagccagattagggagggcacagcaccagatcaacggccgagtgcggcagcttctgcgtcagcgggaagtgactgaccatcgattgtcggaagtcagaaaagggctgctgatcaatcaacaatccgttaagctgcgagggtacagacccaaatcagagaaggtacctgacaaggctgatagcatgctgacctgggagaaggaggagctgaagtcaatgaaaagaaaaatggagagggacatggagaagtctgaggtcctgttgaagacgttggcctcatgtcgcgacactctgaacttttgtttcaaagagcgcctgcaggccgttgaccttatgaatcaaccactcgataaggtgctcgagcaagctcggcgacactcttgggtgaatttgtcccgggcacccacacctagaacccaggggcagaagacacccccaccagatcccgtgggaacatataacccagcgtgcgcactcgcgctgaacgaggcaaagcggttgctggtggagagtaaggacacgctcgtcgagatggccaagaatgaggttgacgtgcgggaacagcagctgcagatttcagatcgcgtatgtgcctccctggcgcagaaagctagcgaaacactcgagttgaaagagagactcaacatgacattggggcttatgaggggtaccattctaaggtgcaccaaatacaaccaggaactgtacacaacccacggactgatcaagggcccactgtctaaagttcaccttgagaccgcagagaaattggatagacccctggtgaggatgtatcagcgacacgtgggaactcagcttccggaagcagccagactggcccagggcacagacaaactacagtgtcacatcacgtacctggaaaagaatctagatgagttgctcgctacccataagaacttgagttggggactcaattgtaaaaatatcggacacgaggtagacggcaatgtggtacggctgcgactgcggcaaagacagccccacgtctgctacgagcaggcacagaggctcgtcaaggactgggatcctagaacaccacccccaaggtccaaaagttctgctgatccatag

SEQ ID NO: 27714 - DNA, 1827 bp, Artificial Sequence
  Description of Artificial Sequence: Synthetic coding sequence
atggagatggaatcagcagctgccagtacgcggtttcaccagccgcacatggaaaggaaaatgagtgcaatggcgtgcgagatattcaatgaattgagactggagggcaagttgtgcgacgtggtcattaaggttaacgggttcgaatttagcgctcacaaaaacatcctctgctcctgtagctcctacttcagagccctgttcacatccggctggaataatactgaaaaaaaggtgtataatattcccggtataagccccgatatgatgaaattaattatcgaatacgcctacacccgcacagtgcctataacacccgacaacgtggagaaactgttagcggcagctgatcagtttaacattatgggcattgtcagagggtgttgtgagttcctgaagtctgagctctgtttggataattgcataggtatttgcaagttcaccgattattattactgccctgagttgagacagaaggcctacatgtttattctgcataatttcgaggaaatggtgaaagtgtctgctgaatttctggaactaagtgtaaccgagctaaaggacattatcgaaaaggacgagcttaacgtaaagcaagaagatgcagtttttgaggcgattctcaagtggatcagccatgatccacagaaccggaagcagcacataagtatcctactgcccaaagtacgtctggccctgatgcatgccgagtactttatgaataatgttaagatgaacgattatgttaaagacagtgaagaatgcaaaccagtcataataaatgccttgaaggcaatgtacgatctgaacatgaatggtccctccaatagcgactttaccaaccctttgacccgtccacgcctcccctatgcaattttgttcgctatcggcggttggtcgggcggaagccccactaatgccattgaggcctacgatgctcgcgcagaccgctgggtcaacgttacttgtgaggaagaatctcccagagcatatcatggcgctgcatacttaaagggctatgtctacataatcggaggctttgatagcgttgattactttaattctgtaaagcgattcgatccagttaaaaaaacctggcaccaagttgccccaatgcatagccggcgttgttacgtttctgtcacagtccttgggaacttcatctacgctatgggcggtttcgacggatatgtgaggttgaataccgccgagagatacgagcccgagactaatcagtggactcttatagcacctatgcacgagcagaggagcgacgcttccgccactaccctgtatggcaaggtgtacatatgtggcggtttcaatggcaacgaatgtctttttaccgccgaggtttacaacaccgagtccaaccagtggaccgttatcgccccaatgcgtagccggcgatcaggcatcggcgtcatcgcctacggcgaacacgtgtacgcggttggaggttttgacggggcaaataggctcagatccgccgaggcctacagccctgtggccaacacttggcgtacaatccctacaatgttcaaccctcgcagtaattttggaattgaagttgttgacgatctgctgtttgtcgttgggggtttcaacggctttactactacattcaacgttgagtgctatgatgagaagaccgatgaatggtacgacgcgcatgatatgagcatataccgatccgcactatcatgctgtgtggttccgggattggcaaatgtcgaagagtacgccgcaagacgcgataatttcccaggactcgccttgagggatgaggtcaagtattctgctagtaccagcaccctgcctgtatag

SEQ ID NO: 27715 - DNA, 942 bp, Artificial Sequence
  Description of Artificial Sequence: Synthetic coding sequence
atggcggctttaacagatttgtctttcatgtatcggtggtttaaaaactgtaacctggtgggcaatctgtcagagaaatatgtcttcatcactggttgtgactctggattcggcaatctccttgccaagcagttagtagatcggggaatgcaagtgcttgcagcttgctttaccgaggaagggtcccagaagcttcagcgcgatacttcataccgactgcagactactctgttagacgttacaaagtctgaaagcattaaggccgctgctcagtgggtaagagacaaagtgggagagcagggcttatgggcactcgtgaacaacgcaggcgtgggcctgccaagtggaccaaatgagtggctgactaaagacgattttgtgaaagttattaatgtcaatttggtaggcctgatagaagtgaccttgcacatgctccctatggtgaaaagagccagagggagagtggtgaatatgtcttccagtgggggaagggtcgccgtcattggcggaggctattgtgtgtctaagttcggggttgaagccttttcagattcaattcgtagggagctgtattatttcggcgtcaaggtctgcattatcgaacctggcaattacaggactgccatactcggaaaagaaaacttagaaagccgtatgagaaagctttgggaacgcctgcctcaggaaactcgggattcttacggcgaggactatttcagaatctataccgacaagcttaaaaatattatgcaggtggccgaaccaagggtccgagatgtgattaattctatggaacacgccatagtatcccgtagccccagaatacgctataatccaggtttggacgcaaaattgctctacatcccacttgctaaactgcctactcctgtcactgattttatattatcaagatatctgcctcgacctgcagactccgtttag

SEQ ID NO: 27716 - DNA, 1461 bp, Artificial Sequence
  Description of Artificial Sequence: Synthetic coding sequence
atgacatgcggcagttattgtggcggaagagccttcagctgtatatctgcatgtggacctaggccaggtaggtgctgtataactgccgcaccctatcgcggaatttcttgttacagaggcctgaccgggggtttcgggagccattcagtctgtgggggtttcagagctggcagctgcggccgaagtttcggctacagatctggaggggtgtgcggcccttcaccaccgtgcattaccactgtctctgtaaacgagtcactactgacgcctctcaacctggagatcgaccccaatgcacagtgtgtgaagcaggaggagaaagagcagataaaatcactaaacagcagattcgccgctttcattgataaggtccgtttcctggagcagcagaataagttgttagaaacaaagctgcagttctatcagaatagggagtgttgtcaaagcaatctggaacccctgttcgagggatatattgagacactcaggcgcgaggccgaatgtgtagaagccgattcaggccgactcgccagtgagctgaaccacgtgcaggaggttcttgaagggtataaaaagaagtacgaagaggaagtgtctctccgagctaccgctgagaacgagtttgttgccctgaaaaaggacgtggactgtgcatatctgaggaagtcagacttggaggctaatgtggaggccttgatacaggagattgattttctacggcgtctttacgaggaggagatcagggtgctccagagccacatttccgacacttccgtcgtcgttaagctggataactcaagggaccttaacatggattgtatcatcgctgagatcaaagcccagtacgatgacatcgtcacacgctctcgcgcagaggctgaaagctggtataggtccaagtgcgaggaaatgaaagctactgtaataagacatggtgagaccttgaggaggaccaaagaggagataaacgagctcaacagaatgatccaaaggttgactgctgaggtagagaacgccaaatgccagaactcaaaattggaagcagccgtcgcccagtcagagcagcagggagaggctgccctgagcgacgccagatgtaagctcgctgagctcgagggagccctgcaaaaggcaaagcaagatatggcttgtctcattagggagtatcaggaggtgatgaactccaaactgggccttgatattgagatcgccacgtaccgcaggctgttggaaggcgaggagcagaggctgtgtgagggggtgggatcggtaaatgtttgtgttagttccagccgaggtggggtggtgtgtggtgatctgtgtgcgtcaaccaccgctccagtagtctcaacgagggtgtcctcggtcccatccaactccaatgtggtggtcggaacaacaaacgcctgtgccccatccgccagagtcggggtttgcggtggcagctgcaagcggtgctag

SEQ ID NO: 27717 - DNA, 939 bp, Artificial Sequence
  Description of Artificial Sequence: Synthetic coding sequence
atggcggaactcactgccttggagtcgttaatcgagatgggttttccacgcggtcgcgctgagaaggcgttagcgttgacaggaaatcagggcatcgaagccgctatggattggctgatggagcacgaagacgatcccgacgtcgacgagccactggaaactccacttgggcacatactcggccgtgaacccacatcgtctgagcagggcggtctcgagggcagtggaagtgccgcaggagagggaaaacccgctctgtcagaagaggagcggcaggagcagacaaagaggatgttagaattagtcgcccaaaagcagagagaacgggaagaaagagaagaaagggaggctctcgagcgcgagagacagcggagacgccagggtcaggagctgagtgctgcaagacagagattacaggaggacgaaatgcgcagagcagcagaggagcggaggcgagagaaagcggaggagctggccgcaagacagcgcgttagagaaaaaatcgaaagggataaggccgagcgcgcaaagaagtacggcggaagcgtgggatcccagccccctccagtggccccagaacctggacccgttccttcatctcccagtcaagagccccctaccaaacgagagtacgaccagtgccgtatccaggtcaggctaccagacgggaccagtctcacacaaacatttcgggcacgtgaacaactggcagctgtccgtctctatgtggagttacacagaggtgaagagctgggcggaggccaagatccggttcagctactaagtggtttccccagaagagccttttctgaagccgacatggaaagacctctgcaggagttggggatggccgcacggcttgagactcgcacgcggaattggggctcgcgggaagcatgcctgggaaaagggggaatgcagcgagagggtgcgctatag

SEQ ID NO: 27718 - DNA, 405 bp, Artificial Sequence
  Description of Artificial Sequence: Synthetic coding sequence
atgcctgccgacctctccgggacatggacactgctttcaagtgacaactttgaaggttatatgctggctctcggaattgacttcgccacaaggaagatcgctaaactactgaaaccacagaaagtcatcgaacagaatggcgattcctttaccatccataccaactcgtctttacgcaattattttgtgaagtttaaggtcggagaggaatttgacgaagacaatcggggattggacaataggaagtgtaagtccctggtcatttgggataacgacagactaacatgtatacagaagggagaaaaaaaaaatagaggctggacccattggatcgaaggggacaagctacacctcgagatgttctgcgaaggacaggtgtgcaaacagacctttcaacgcgcatag

SEQ ID NO: 27719 - DNA, 1383 bp, Artificial Sequence
  Description of Artificial Sequence: Synthetic coding sequence
atggcgggttacttgagtgaatccgattttgtgatggttgaggagggcttttcaactagggatctcctgaaggagctgacgctgggcgcaagccaagctacgacagatgaggtggctgctttcttcgtggcagaccttggagccatcgtgagaaagcacttctgttttttaaagtgtctgcctcgggtccgcccattctatgcagttaaatgtaactctagcccgggagttttaaaggtcctagcgcagctggggttagggttttcctgcgctaacaaagctgaaatggagctggttcaacatatcggcatccctgcctcaaaaatcatctgcgcaaacccctgcaagcagatcgctcagattaaatacgctgccaaacacgggatacagctgctgtctttcgataacgaaatggaactagctaaggtggtcaagagccatccaagcgccaagatggttctgtgtattgccacggatgattcacatagtctttcatgtcttagcctcaaattcggagtaagcctgaagtcgtgtcgacatctgctggagaacgccaagaaacatcacgtggaagtcgtgggcgtatctttccatataggcagtggctgccctgaccctcaggcctacgcccagagcattgccgacgcacgtctagtgtttgaaatgggaactgaactggggcacaaaatgcatgtcctggacttgggcggagggttccctggcaccgagggagcaaaagtcagattcgaggagatcgcgagcgtgataaactctgccctggacctgtatttcccagagggttgcggggtggacatttttgccgagttgggtcgttactacgttacctcggccttcaccgtcgcagtttcaatcatcgccaaaaaagaagtgttgctcgatcagccgggtagggaggaagaaaacggaagtacgagcaagactatcgtgtaccaccttgatgaaggtgtgtacggcatatttaactccgtgctgttcgataatatctgtccaacacctattcttcagaaaaagccgagtacagagcagccactctacagtagctcactgtggggcccagcagtggatggatgcgactgcgtggccgaagggttatggctccctcaattacatgtgggtgattggttggtcttcgacaacatgggggcttatacagtgggtatgggtagtcctttttggggaacacaagcgtgtcacatcacatacgccatgagtagggtggcatgggaggctctgagacgccaattgatggccgctgagcaggaagacgacgttgaaggggtgtgcaagcctttatcctgcggctgggagatcaccgatacactttgcgtcgggccagtgtttacacctgcctcgatcatgtag

SEQ ID NO: 27720 - DNA, 1209 bp, Artificial Sequence
  Description of Artificial Sequence: Synthetic coding sequence
gggggacctagaggctcaggaagcgctgcagaaacaatgccagaaatccgggtgactccactcggcgctgggcaggatgtgggaaggtcatgtatcctggttagtattgcgggtaaaaatgtgatgctggactgcggcatgcacatgggatttaacgacgaccggcgattcccagatttctcctatataacacaaaacggcaggctcaccgactttttggactgtgtaataattagccacttccacttggaccactgcggtgccttgccctactttagtgaaatggtagggtacgacgggccaatatatatgacacaccccacccaggctatctgcccgatcctactggaagactacaggaagatcgcggtggacaagaaaggtgaagctaacttcttcacatcccaaatgattaaggactgtatgaatctgttggagaccttttgggagcgtatgaatctgaaggtgccgatctacttcagcacaggtctaacagagaaggcaaaccactattacaagttgttcatcccatggactaaccaaaagataaggaaaaccttcgtccagaggaacatgttcgaatttaaacatatcaaggcttttgatcgggcttttgctgacaacccaggaccaatggtggttttcgcaactcccggtatgctgcatgctgggcagtctctccaaatctttcggaagtgggccggtaacgagaaaaatatggtgataatgcccggttattgtgtgcaagggaccgttggacacaagattttgtcagggcaaaggaaactggaaatggaaggtcgtcaggtgctggaggttaagatgcaagttgaatacatgtctttctctgcacatgccgatgctaaaggcattatgcagttagttagctcagaacaggcacttaaggagctggggctggcagagcaccagctgcggtttacatgcagggtgcacctgcatgatacacgcaaggagcaggaaacagcactgcgcgtgtatagccaccttaagtcagtcttaaaggatcactgcgtccagcacctcccggatggatctgtgaccgttgagagtgttctgcttcaggccgcagccccatccgaggaccccggtactaaggtactcctggtctcctggacttaccaggacgaggaactcggctcatttctgacgagccttctgaaaaagggactgcctcaagcgccatcatag

SEQ ID NO: 27721 - DNA, 1863 bp, Artificial Sequence
  Description of Artificial Sequence: Synthetic coding sequence
atggagaaggcagtgaacgacggatcccattcggaggagttgttttgtcacctaaagactatctcagaaaaggaggatttgcctcgctgcacatctgaatcccacttatcttgcttaaagcaggacattcttaacgaaaaaacggagttagaagcaacactgaaggaggccgagctcgttacacatagtgttgagctgctgctaccattattcaaagataccattgagaagattaactttgagaacgccaacctttccgctctcaacttaaagatttcagaacagaaggaaattctgatcaaagagctcgatacctttaaaagtgtgaagttagccctggagcacttgctgcgcaaaagagactataagcagacaggggacaatttgagcagcatgctgctggaaaacctcactgacaacgagtcggaaaacaccaacttgaaaaaaaaggtgtttgaaaaggaggctcacattcaggaactctcctgcttgtttcagtccgagaaggcaaatacactcaaggcaaaccggttctcccagagtgtcaaggtcgtacatgaacgtttacagattcaaatacacaagcgtgaggcagaaaatgataaattgaaagagtatgtcaagtctctggagacaaaaatcgcaaaatggaatctccagagcagaatgaataaaaacgaggccatagtcatgaaagaggctagcagacaaaagactgtggccctcaagaaggcatccaaggtatataagcagcgtctcgaccacttcacaggcgctattgagaaacttacttcccagattagggaccaggaggcaaagctcagtgaaacgatatcagcatcaaatgcatggaagtcccactacgagaaaatagtcatagagaagaccgaactggaagtccaaattgaaacgatgaagaagcagattattaatcttctggaggacctcaaaaaaatggaagatcacggaaaaaacagttgtgaggaaattcttcggaaggtgcattctatagagtacgagaatgagacattaaacctggaaaacactaaattgaaaactacactggccgcactcaaggatgaggttgttagtgttgagaacgagctctctgaacttcaggaagtggaaaagaaacagaagaccctgatcgagatgtacaaaacacaggtgcagaaactgcaggaggcagctgagatcgtgaaatcacggtgtgagaacctcctgcacaagaataaccagataaccaagacaaagaataaaaacgtggagaagatgaggggccagatggagtcccatctcaaggaactggaaagggtgtgtgactccctcactgcagcagagagacgtctgcacgaatgccaggagagtcttcagtgctgcaagggcaaatgtgctgatcaggaacatactatccgtgagcttcagggtcaaatcctgaaacaatgggaagagtactcggtactggcatgggtggacggcaaccacaatctgctgacgaaattaagcctggaggaagagaactgtttgatacagcttaaatgcgaaaatctacagcaaaagctggagcagatggatgctgagaacaaagagctggagaagaagctagcaaatcaagaagagtgtttgaaacacagcaacctgaaattcaaggaaaagtctgctgaatacactgccctcgcacgccaactggaagcggctctggaggaagggagacagaaagtggcggaggagattgaaaaaatgtcatcgcgggagagcgccctgcagatcaagatcttggatctcgagacagagctcaggaaaaaaaacgaggaacagaatcagttagtgtgcaagatgaattccgatcccgaaacaccttag

SEQ ID NO: 27722 - DNA, 465 bp, Artificial Sequence
  Description of Artificial Sequence: Synthetic coding sequence
atgtctaaaaacacggtgtcctccgctcggtttaggaaagtcgacgtagacgagtacgacgagaacaaattcgtggacgaggaggacggcggtgatgggcaggccggaccggacgaaggcgaggttgatagctgcttgcggcactcaattacaggcaacatgactgcagcgcttcaagctgctctgaaaaaccctcccatcaacacaaagtcccaggccgtcaaagaccgggcaggatccatagtgctgaaagtcctgatctccttcaaggccaacgacatcgaaaaggctgtgcaaagcttggacaagaacggcgttgacctactgatgaaatacatttacaaaggcttcgagtctccgagcgataacagcagtgctatgttactgcaatggcacgaaaaggccctcgctgccggaggggtcggaagcatcgtccgagtgctcaccgccaggaaaacggtgtag

SEQ ID NO: 27723 - DNA, 2946 bp, Artificial Sequence
  Description of Artificial Sequence: Synthetic coding sequence
atgagtgaacaggaacgcattcaggagtgtctgagaaaggagatcaggtcactgctgattagcaccaaggacggcctaagtcctcaggaactcgagaaggaatacttgttgatggtgggaaaccatcttcccttgaggatccttggctaccgcagtacaatggaactggtcttagatatgcctgacgttgttagggtttgccctggtgcgggaggaacggtaatacttaaagccatccccgacgagagcaccaaaggaattgcctccctcgtggcaaaacagcgctcttctcacaaacttagaaatagtatgcacaagggacggccaagtatctactcaggcccaaggagccacagacgcgtgccatatcgcggacgcgttgcgcctatccttccggcagttgtgaaatctgagcttaaggacctgctcgctctctcacctgtgttgttgagcgatttcgagaaagccttcgccaaacggttcggccgatcattccagtacatgcagtacggttttctgtcaatgttcgaggtcctaaacgccgcttccgacgttatctcagtggagcagactcgcgctggctctctgctcatgctcaagaaaagtgtgacggaagagaagccccgaggatgccccgctggcaaaatttttacccagcctttccggatgaagcaagggagttactcaacaggcttccccgtagctaagccttgcttctcccagcccacctccaacatggagccgcctaagcaaatcatgtctatggaaaaaaccagcaaactcaacgttgtggagacctcgagattgaaccacacggaaaagttaaaccagctggaaaatacgttcaagtctgttattgcccaaatcggtcccggtggaaccatttctagtgaacttaaacataagatcaaatttgtggttagtaaattcccagaggggcttttcatctccaaactcttaggcgagtatgaagttatctttaaagagcagctaagccccaagaaattaggatttctgaacgttaccgaactggtgggtgcactttctgacatactgcacgtggaatttagaaaaggccaccaggatctgttggtcttcgatgcggacaaaaagcctcttccccctgtccagagtgacaagaagattgaggcaaaagcgtgtgtgtcttctcctccacgaaacagtttaagtacggccgctgttaaggaaacagtgtggaattgtccgagcaagaaacaaaaagagccgcagcaaaagatttgcaagaagcctaatcttgtggtgaaaccacttcagctgcaggtggagactaacaaatccgagctgaatctggctatggcaaaccacgatataccgccagatgccgtacccaacaaaaaactgtgcaggctgcctcctttggacactagctcccttatcggcgtgtttgtggagtatataatttccccaagccaattctacatacgcatttattcccgggacagttcagagctgctggaggacatgatgatcgaaatgcgcagatgttacagcaatcagttagttagcgatcgttatgtgatgcctgagtgctttattcagcctggccatctgtgctgtgtcaggatcagcgaggacaaatggtggtaccgggtgattattcacagggtgctcgaaaagcaggaggttgaagttttctacccagatttcggaaacatcggaatagtacagaagtctagccttagattcctgaaatgttgctatactaaactgccagcacaagccatcccctgctcactggcctgggtgaggcctgtcgaagagcactggacaagcaaggccattctccagttccagaagctctgcgggctgaaacctctggtgggggtagtggacgaatatgtggacggtatcttaaatatttttttgtgtgacacatcttctaatgaggatgtttactttcaccacgttctcaggaccgaggggcatgcaatcgtatgccgggagaatattagttcaaagggcttcagcgagcttaatcccctcgcgctctacacaacttcaagtggaggccctgaggacatcgtgctgacggagctgggctacccatcgcagcagcattatttcaatgaggaccgtaagatctcccctcaaagcaaagagtcggaactccgaatcctcgacgaaattccgaccggtatgccttgcctggaatccgtgaccattggcgatgacatttgggacgaaaactggctccccctgcaggcaaaaatgggtaaggggggagacgcagcgtctcatttattcaccgcttcactcggaggcaagaaccaatacagtagttgtaaagagatgcctcaaaaagattggtgcttcagcaccccgaaagatacatgggacgatagctggcagccctcaggcctggtgaacgggacaaaggtggaggttcacaagccagaagtgctgggagcccaggagaaaaacacgggcactaatcggacccagaaacagctcgatatcaacggatcatctgactcaagtacactgcccaaattggaagagttttgcactagcctgacccagagtgaacagtctgcagatggctcacagtcagagcccaataacagccagacccagcctaaacagattcaactgtcaacggcagcaccgtgttcaaccacagcagtggacgattcagccgagaagccatcagggtcggtggaatcctccccagagatcctaaaaaatgaggacttttcatccagtcgagcgatcaccctctacaaagataaacggcaagaatctgtggaccaactcagcttgatactgagttatgaatgtcaaatatctcagaagttgtatatccctcggagcacagctaccgctgccttaggagctgccgcaagactggccacctcccgatcccttctccattggtatcctagtgtgaaaaggatggaggcctag

SEQ ID NO: 27724 - DNA, 909 bp, Artificial Sequence
  Description of Artificial Sequence: Synthetic coding sequence
atggaaatacaggaacttgaggagattcaagcctgccagggcctctgggaggtcttcgtaaccctttctgaaagggcacgcgactacctccacaagacaggcaggttcatcgtgatcggaggcattgtgagcccagttcatgattcatatgggaaacaaggactggtaagttcacgtcaccgcctgatcatgtgccaattggcagtgcagaattcggattggattcgcgtcgacccctgggagtgctatcaagacacatggcagaccacatgctccgtgctggagcatcacagggacctcatgaaacgcgtaacgggttgcatcctctccaacgtgaatacacccagtatgacccccgtgatcggccaaccgcaaaacgagacacctcagcctatctatcagaactcaaacgtcgctacgaagccgacagccgcaaagattttgggtaaggtgggtgagtctctgtcccgcatctgttgtgttcgccctcccgtggagagatttacgtttgtagatgaaaatgctaatcttggcactgtgatgaggtacgaggaaatcgagctgcggatactgttactgtgtggctctgatttacttgagtctttctgcattcctgggctgtggaacgaggcggatatggaagtgatagtcggagacttcggaatcgtcgtagttccaagagacgccgcagacacagaccgcattatgaaccattctagtattctcaggaagtataaaaataatatcatggtggttaaggatgacatcaatcaccccatgtctgtggttagctcaacaaaatctcggcttgcgttgcagcatggggacggccatgtggtggattacctgtcccagcccgttatcgactatatcctgaaatctcagctgtacattaatgccagcggatag

SEQ ID NO: 27725 - DNA, 861 bp, Artificial Sequence
  Description of Artificial Sequence: Synthetic coding sequence
atggaacgcagactgggcgtgagagcatgggttaaagaaaaccggggaagctttcagcccccagtgtgtaacaagctcatgcatcaggaacagctgaaggtaatgttcataggagggcctaacacaagaaaagactaccatatcgaggaaggcgaagaagtgttttaccaattggagggcgacatggtgctgcgcgtgttggagcagggcaagcatcgagacgtagttattcggcagggagagattttcctgctgcccgcacgagtgccccactccccacagcgattcgccaatactgtggggctcgtggttgagcgtcgcaggctggaaactgagctggatggcttaagatattacgtgggtgatacaatggacgtactttttgaaaagtggttctactgcaaggaccttggtacacaacttgcccctatcattcaggagttcttttcgtccgagcagtatcggacaggaaagcccatcccagatcagctgcttaaggagccaccatttccactcagtacccggtcaataatggaacccatgtccctagatgcttggctcgatagccaccatcgagagctgcaggccggtactccgctgagcctcttcggcgatacctacgaaacacaggtgatcgcgtatgggcagggatcttccgaaggcctgcgtcagaatgtggacgtctggctgtggcagctagaggggagcagcgtggtgacaatgggcggacgtcgtctgagcttggcacccgacgatagcttgctggtgctcgcaggcacttcatatgcttgggaacgcacccaaggcagcgtggctctgagtgtgacccaggatcccgcatgtaagaaacccctgggatag

SEQ ID NO: 27726 - DNA, 1545 bp, Artificial Sequence
  Description of Artificial Sequence: Synthetic coding sequence
atgcaggagagtgggtgccgtttagaacacccatctgctaccaaatttcgcaaccacgtcatggagggtgactgggataaagctgaaaatgatttaaatgaacttaagccactcgttcattccccccatgccatcgtggtcagaggggcactcgaaatatctcagacacttctggggatcattgttaggatgaaatttctcttgctccagcaaaagtatctcgaatacctagaggacgggaaggtcctcgaagcgctgcaggtgctcagatgtgagctcactccccttaaatacaacacagagcggatccatgtccttagtggttatttaatgtgctcccatgctgaagacctgagggccaaagctgagtgggaaggtaagggtaccgcctcgcggtctaaactgcttgacaagctgcagacctatctgccaccaagcgtgatgctcccacctagacgtctgcaaacacttctgaggcaggcagtcgaactgcagcgcgatcggtgtttgtatcataacactaagttggataataatctggactcggtttccttgctcattgatcatgtatgtagtagacgacagtttccctgttatacgcagcagatcctcacagagcactgtaacgaggtttggttctgtaaatttagtaacgatgggaccaagctggccactgggtcaaaggacactaccgttattatttggcaagtcgacccagacacacacctgctgaagcttctgaagacactcgagggccacgcatatggggtgtcttatatcgcctggagtcccgacgataattacttggtggcctgcggacctgacgattgtagcgaactgtggttgtggaatgtgcagactggagagctgcgaacgaagatgtctcagagccacgaagacagcttgaccagcgtggcttggaacccagatggaaaaagattcgtcaccggcggtcaaaggggccaattttatcagtgcgacctcgatgggaatcttctggacagttgggagggtgtacgcgtccagtgtttgtggtgtcttagcgacgggaaaaccgtgcttgcgagtgacacgcaccagcgtatccggggttacaatttcgaggacctcactgatagaaacatcgtacaggaagatcacccgattatgtccttcacaatttccaagaatggccgtctggcgctgcttaacgtcgctactcagggagttcacttgtgggacttacaggacagggtacttgtcagaaagtaccagggcgtgacacaaggattctacacgatccacagttgtttcggaggccacaatgaggacttcattgccagcggtagcgaagatcacaaggtgtatatctggcacaaaaggtctgagttgcccatcgcggagcttaccggtcatactaggacggtgaattgcgttagttggaacccccagattccaagcatgatggcttcagcctctgatgatggcactgtgcggatatgggggccagcccctttcattgatcaccaaaatatcgaagaagagtgttcctcaatggactcatag

SEQ ID NO: 27727 - DNA, 540 bp, Artificial Sequence
  Description of Artificial Sequence: Synthetic coding sequence
atgggtatacttttcacaagaatatggcggctgtttaatcatcaagaacacaaagtaatcatcgtggggttagacaacgcaggtaaaacgactatcctgtaccagttctctatgaatgaggtggtccatacctccccaaccatcggctcaaacgtggaagagatcgtcatcaataacacgcgatttctgatgtgggacatcggtggtcaggaatccctgcggtcaagttggaatacatattataccaatactgagttcgtgatagttgtggttgacagcacagaccgggagcggatctcagttaccagggaagagttgtataagatgttagcacatgaggatttacgtaaggctggcctcctgattttcgccaacaagcaggacgtgaaggagtgcatgaccgttgctgagatttcacagtttctgaagttgacatccattaaggaccatcaatggcatatccaagcctgttgcgcactaactggagagggactgtgtcagggtttagaatggatgatgagcaggttaaagattagatag

SEQ ID NO: 27728 - DNA, 1428 bp, Artificial Sequence
  Description of Artificial Sequence: Synthetic coding sequence
atgcagaaaagcactaatagcgacacgtctgtggaaactctcaacagtactcgtcagggtaccggcgctgtccagatgagaatcaagaacgccaactctcaccacgatcgactgagtcaatcaaagtcaatgattctgacagacgtgggcaaggttaccgagcctatctctcggcaccggaggaatcatagccagcacatcctgaaggacgtaatccctccactcgagcagctcatggtcgagaaagaggggtatctgcagaaagcaaaaatagccgacggtggcaagaagctacgtaagaattggagcacgtcctggatagtgctttcttcgcggaggattgagttttataaagagtcaaaacagcaagctctctccaacatgaagaccggtcacaaacccgagtccgtggacttgtgtggagctcacatcgagtgggctaaggagaaatctagtcgaaagaacgtgttccagatcaccaccgtgtctggtaacgagtttctcctacagtcagacatcgactttatcatcttggattggtttcatgcaatcaagaacgccatcgaccggctgccaaaagatagctcctgcccgagtagaaatctggaactcttcaagatacagaggtcctcatcaacagagttgctcagtcattacgattccgacatcaaggaacagaagcccgaacaccggaaatccctcatgttcaggctgcatcatagcgccagcgatacgtccgataagaatcgagtaaagtctaggcttaaaaagttcattacacggagaccatctctgaagacactgcaagaaaaaggtctgatcaaggaccagatttttggatcccaccttcacaaggtgtgtgaaagggagaacagcaccgttccatggttcgttaaacagtgcattgaagctgtcgagaagaggggactagatgtcgatggcatttatcgcgtgagcggaaacctggccacaatccagaaactgcggttcattgtgaatcaggaggagaagctgaacctagacgactcgcaatgggaagatatacacgttgtcaccggcgctctgaagatgttttttagggagctgccggaacctctgtttccctacagttttttcgaacagttcgttgaggctatcaaaaagcaggacaacaacacgaggattgaggccgtcaagtcactggtgcagaagctgccccctccaaaccgagatacgatgaaggtgctttttggacaccttacaaaaattgtggctaaagctagcaagaacctgatgagtacacaatcgttaggcatcgtgttcggacctacattgctgcgggcagagaacgaaactgggaatatggctatacatatggtgtaccagaaccagatagccgagctgatgcttagtgagtatagtaaaatctttggatccgaggaagactag

SEQ ID NO: 27729 - DNA, 1308 bp, Artificial Sequence
  Description of Artificial Sequence: Synthetic coding sequence
atggcgcagaccgttcccccatgcgaactcccttgcaaggagtatgatgtggctcggaatacaggcgcatatacatccagcggcctcgctacagcctcctttcgaacaagtaagtatctgctcgaagaatggtttcagaattgttatgccagatatcaccaggcattcgccgatagagaccagtctgagaggcagcggcatgagagccaacagctcgcgacagaaacccaggcgcttgctcaaagaacacagcaagactcaactagaacagtgggagagaggttacaggatacacactcctggaagtccgagctccagagggaaatggaggccctggccgctgaaaccaaccttttgctggctcagaaacagcgcctggagcgagccctggacgccacagaagtgcctttcagcattacgaccgacaatctgcagtgtagggagcggagggagcatcccaacttggtcagggatcacgtagaaacagagctgctgaaggaggccgaattaattagaaatattcaagagcttcttaagcggactatcatgcaagcagtgagccagatccgtctgaaccgcgagcataaagagacgtgtgaaatggattggagtgataagatggaagcctacaacattgatgagacctgtggcagacaccatagccagtccaccgaggtccaggcacacccttatagcacaacctttcaggaaagcgcgtctacgcccgaaacaagagcaaagtttactcaggataatctgtgtcgggcacagcgggaacggctggcttcagccaatctgagggtgttagtcgactgtatactaagagacacctccgaggacctacgacttcagtgtgacgctgtaaatctggcattcggaagaagatgtgaagaactcgaagacgcgagatacaagctgcaccatcacctccataagacactcagagaaataactgatcaggagcacaacgttgctgcactgaagcaggcaataaaagacaaggaggccccattacatgtcgctcaaaccagattatacctgagatcccataggcccaacatggagctctgccgcgacgctgcccagttccggctgttatctgaagtagaggaactgaacatgtcccttacagcccttcgtgagaaacttctcgaggcagaacagtccctccgtaatcttgaggatattcatatgagtctcgagaaggatattgcggctatgaccaatagcctgttcatcgacagacagaagtgtatggcacatcgcaccaggtaccctacaattttacagctggccggatatcagtag

SEQ ID NO: 27730 - DNA, 828 bp, Artificial Sequence
  Description of Artificial Sequence: Synthetic coding sequence
atgcgcaagcgtctgtctgcacccgagttaaggttgagtcttaccaaaggccctgggaacgacggggcttccccgacccagtccgccccaagctccccagacggcagtagtgatcttgaaattgatgagttggagactcccagcgattcagagcagttggattccggccatgaattcgagtgggaagacgagctccccagggcagaagggcttggtacttccgaaaccgccgaacggctagggagaggatgcatgtgggacgtgactggcgaggacggtcaccattggcgcgtgttcaggatggggccaagggagcagagagtggatatgacagtgatcgagccctacaaaaaagtgctgagccacgggggataccatggagacggcctgaacgcagtgatcctattcgctagttgctacctgccccgatcttcaattcctaactatacatatgtgatggaacacctctttcggtatatggtgggaacgctcgaacttcttgtggccgagaactatcttctggttcatctttccgggggaacatctcgtgctcaagtaccccctctaagctggattcgccagtgttatcgtaccctcgataggcggctgagaaaaaacctccgcgctctagtggtggtgcacgcgacgtggtatgtgaaagccttcctggccctgcttcgtccctttattagctcgaagttcacacgcaagatacgctttcttgactctttaggcgaactggcccaattaatatcgctggatcaagtgcatataccagaggcagtacgccagctagaccgcgatctgcacgggtctggcggaacctag

SEQ ID NO: 27731 - DNA, 2391 bp, Artificial Sequence
  Description of Artificial Sequence: Synthetic coding sequence
atggaagaggaagccagtcgtagcgctgccgcaaccaatcctggatcccggctcacccggtggccccctcctgacaagcgcgagggttctgccgttgaccccggaaagcggagatctctggccgcaacaccatcgagctccctgccttgtactctgattgcgctggggttacggcacgaaaaagaggccaacgaattaatggaagacttgttcgagacattccaggacgagatgggcttctctaatatggaggatgacggccctgaggaggaagagcgggtggcagaaccgcaagctaacttcaacacgccacaggccctgagattcgaggagctgctggcaaaccttctaaatgaacaacaccagatcgctaaggagctttttgagcagctgaagatgaagaagccttcagccaaacaacagaaagaggtggagaaagttaagccacagtgtaaggaggtccatcagactctgattctcgatcccgctcagcgtaaaaggctacagcaacagatgcagcagcacgtgcagctcctcacacaaatccaccttcttgccacatgtaatcctaatctgaacccggaagcctcatcaactaggatttgcctgaaagaacttggcactttcgcccaaagtagcatcgcattacatcatcagtataacccaaagttccagaccttattccagccttgtaacctcatgggggctatgcagctgatagaagatttctcgacccacgtctcaattgactgctcccctcataaaactgtgaagaaaaccgcaaacgagttcccttgtttgcccaagcaggtggcttggatcctggctacatcaaaggtattcatgtatcctgaacttctcccggtctgcagcttaaaagccaagaatccacaggataaaattttgttcactaaagccgaggataataagtacctgctgacatgcaagactgccaggcagctgactgtgagaattaaaaatcttaacatgaacagagccccagacaatattatcaagttttacaaaaaaaccaagcagcttccagtgctggggaagtgttgcgaagaaattcagccgcaccagtggaaaccacccatagaaagggaagaacaccgcctgcctttctggctgaaggcaagtctgccatccatccaagaagagctgcgtcacatggcagacggcgctcgggaggtgggaaacatgacggggaccacagagatcaatagcgaccagggtcttgaaaaagacaatagcgagctgggctctgagacccggtatccgctgctgctgccgaagggagtggtgctgaaacttaaacccgtcgctgatagatttccgaagaaggcctggcgccagaaacggtcaagtgtgctgaaacctcttctgattcagccgagcccgtctttacaaccctcatttaacccaggcaaaacccctgcccagagcacacatagtgaagctccaccttccaagatggttttgcgaatacctcatccaatccaacccgctaccgttctgcaaactgtgccaggagttcccccactgggtgtgtccggtggagagtcctttgaatccccggctgccctccctgccatgccacctgaagccagaacatcttttcccttaagcgaaagtcagactcttctgtcatccgcccctgtgccaaaggtgatgatgccgtctccagcttcaagtatgttccgtaaaccctacgtccgaaggagacctagtaagcggagaggagctcgcgctttccggtgtattaagcccgcaccggttatacacccagcctccgtcatatttaccgtgcctgccacaactgtgaagatcgtgtccttaggcggagggtgcaatatgatccagccagtaaatgccgctgtcgctcaatcaccccagactatcccaattgccactctgctcgtcaaccctacctcctttccgtgtcccctcaatcagcccttggtcgcctcctctgtgagtcccctgatagtgagtggtaattcagtaaacctgcctataccctctactccggaggataaggcccacatgaacgttgatattgcatgcgctgtcgctgacggcgaaaacgcgttccagggattggaaccgaagctggagccgcaggagttgtcaccacttagtgccacagtgttccccaaggtggagcactcaccaggaccacctcctgtcgataagcagtgccaggaaggtctctcagaaaactcagcgtaccgctggaccgtcgtcaaaacagaggaagggcgtcaggcactcgagccactgccacaggggatccaggagtccctcaacaactcttccccaggggatcttgaagaggtagtgaagatggagcctgaggacgctaccgaggaaatctccggctttctgtag

SEQ ID NO: 27732 - DNA, 1380 bp, Artificial Sequence
  Description of Artificial Sequence: Synthetic coding sequence
atggcagcatccgcttctgccgctgccggagaggaagactgggttctgccatctgaggtcgaagtcctggagtccatataccttgatgagctccaggtgatcaagggaaatggcaggacatccccctgggagatatacattaccctgcaccctgcaacggctgaagaccaggacagtcagtacgtgtgctttacactcgtcctccaggtcccggctgagtatccccatgaggtgccacagatctccattaggaatccacggggactctcagacgagcagatccacacaatcctccaggtgctgggccatgtggccaaagccggattaggcaccgctatgctgtatgagttgattgaaaagggcaaagagatcttgaccgataacaacatcccacatggtcagtgcgtcatttgcctgtatggcttccaggagaaggaggcctttacaaaaactccttgctatcattacttccactgtcattgcctggcaaggtacatacaacacatggagcaagaactgaaggcccaaggccaagagcaggagcaggagaggcaacacgctacaactaagcagaaggccgtgggggttcagtgtccagtgtgtagagaacccctggtatacgatttggccagtctcaaggcggcacctgagccgcagcagccgatggagctttatcagccgtccgcagagagtttgaggcaacaagaggagaggaaacgcctgtatcaacgccaacaggagcggggagggataatcgacctggaggctgaaaggaacaggtatttcatcagtctccagcagccccctgcgcctgcagagccggagagcgctgtggatgtgagtaagggttcccagcccccttctacactcgccgcagagctaagcacaagtcccgctgtacagagtaccctcccgcctcctttgcctgtggctacccagcacatttgtgaaaaaattccgggaacaagatctaaccagcagaggctgggcgaaacgcagaaagccatgctagatccccctaagccatctagggggccatggcgacagccggagcggcgtcacccaaagggcggagagtgtcacgcacctaaaggcactcgggacacccaggagctgccacctccagagggcccacttaaggaaccaatggacctgaaacctgagccccactcacagggcgtcgagggccctccacaggaaaaaggacctggctcatggcagggacctccgcctaggcgaacaagggactgtgtgcggtgggaaaggagtaagggcagaacaccgggatcttcctatccccgacttccccgaggacagggagcgtatcgccctggtacgcgcagggagagcctaggcttagagtctaaagatggaagctag

SEQ ID NO: 27733 - DNA, 2079 bp, Artificial Sequence
  Description of Artificial Sequence: Synthetic coding sequence
atgggcagcgctgcagacgtaaggttcagtctaggcaccactactcatgctcccccaggggtacacagaagatactccgcactgagggaagagtcagccaaagactgggaaacaagccccctgcccggaatgctggccccagccgctggaccagcttttgactcggacccggagattagtgatgtcgatgaagatgaacctggtggtcttgtcggctctgcagatgtcgtttccccaagcgggcattcagacgcccagacacttgctatgatgttgcaggaacagttggacgccataaacgaggagatccgtatgatacaggaagagaaagaatcgactgaactccgagccgaggagattgagacgagggtgacttcaggcagcatggaggctctcaacctgaagcaactgcgcaaacgaggcagcattcccacatccctcacagcgctgtccctggcctctgcgtcgccacctctgagtgggagatctacccccaaattaactagccgttcggcggctcaggacctggataggatgggcgttatgacattaccttccgatttgcggaaacataggcgtaagttattatccccagtctcccgggaggagaaccgggaggataaggccaccatcaaatgtgaaaccagtcccccttcgtctcccaggacacttaggcttgagaagctgggccaccctgccctttcccaggaagagggcaagagtgcactggaagatcagggctccaacccttctagctccaactcgtctcaggacagtctgcataaaggagccaagcgaaaaggcatcaagtcatccattggcagattgtttggcaagaaagagaaaggcagattgattcagttgtcccgcgatggcgcaaccgggcatgtcctgttaactgacagtgaattttcaatgcaggaaccaatggtgccggcaaagctcggcacccaagccgagaaagatcgtagattaaagaagaaacaccagctgctcgaggacgcacgtcgcaagggcatgcctttcgcacaatgggatggccctaccgtggttagctggttagaattatgggtgggcatgccagcatggtatgttgccgcttgtcgggctaacgtgaagtcaggcgcaataatgagcgcgctgagcgatactgagatacaaagagagatcggcatttctaatgccctacatcgactcaagctgcgtctcgccattcaggaaatggtgtccctgacctctccatcagcccctccaacttcccgcacctctagtggcaatgtgtgggttacccacgaagagatggagactttagaaacaagcaccaaaaccacgctggcttatggcgacatgaaccacgaatggatcggaaacgagtggctgccgagcctgggcctccctcagtatagatcttactttatggagtgcctggtcgacgcacgcatgctggatcatctgacgaagaaagatctacgagtgcacctaaagatggttgactcttttcacagaacttcgctgcagtacggaatcatgtgtctcaagaggctaaattatgatcgaaaagagcttgaaaaaaggcgggaagagagccagcacgaaatcaaggacgtattagtgtggacaaatgatcaagtagtgcactgggtccagagcatcgggctccgcgactacgctggcaaccttcatgaatctggcgtccacggcgctctgttggctttagacgaaaacttcgatcacaatacactggccttgatcctgcagattcctacccagaatactcaggctagacaagtaatggagcgtgagttcaacaatcttttagccctgggtaccgaccggaaacttgacgacggtgacgataaggtctttagaagggcgccttcttggcggaagcgctttagaccgcgagaacatcacgggaggggcggaatgcttagcgcaagtgcagaaactctgcctgcaggattcagagtcagtaccttggggacccttcaacctcccccagctccaccgaagaagattatgcctgaagctcacagccactatttgtacgggcatatgctgtctgcgttcagggactag

SEQ ID NO: 27734 - DNA, 369 bp, Artificial Sequence
  Description of Artificial Sequence: Synthetic coding sequence
atggccccacagaaagacagaaaaccgaaacgctcaacttggcgattcaaccttgacttgacacatcctgtagaagacgggatctttgatagtgggaacttcgagcagttcctgcgagagaaagtcaaggttaacggcaaaaccggcaaccttggaaatgttgtgcacatcgaacggtttaaaaacaagattactgtggtttctgaaaaacagttctctaagagatacctgaaatacttgacaaagaagtacctgaaaaagaataacctgcgcgactggctaagagtggtggcctctgataaagaaacttatgagctgaggtacttccagatctcccaggatgaggatgagtcagagtcagaggactag

SEQ ID NO: 27735 - DNA, 936 bp, Artificial Sequence
  Description of Artificial Sequence: Synthetic coding sequence
atgcagtacatctctcatattttcggtgtaataaactgcaacggcttcacactctccgatcagagaggactgcaagccgtcggcgtgggcatcttcccaaatctcgggttggttaaccatgactgctggcctaattgcactgttatttttaataacgggaagattgagttgcgagctttagggaagattagcgaaggcgaggaattgacggtgtcatacatcgatttcttaaacgtgagtgaagagagaaagaggcagctcaagaaacaatattatttcgactgtacttgcgaacactgccagaagaagttaaaggacgacctgtttctgggagtcaaggataacccaaaacctagtcaggaagtggtcaaggagatgatccagtttagcaaggatacactggaaaaaattgacaaggctagatcagagggcctctaccatgaggtagttaagttatgcagagagtgtctagaaaaacaagaaccggtgttcgcggacactaatatttacatgcttcggatgctgagcatagtgagtgaagttttgtcttatctccaggcattcgaggaggcctctttctacgcgaggcgtatggtggatggctacatgaagctctatcacccaaataacgctcaactggggatggccgttatgagagccggtttgaccaattggcatgccggaaacattgaggttggacatggcatgatttgcaaggcttatgctattcttttggtgacccatgggccttctcaccctattaccaaagatcttgaagctatgcgtgtccagaccgagatggagctaagaatgtttcgccagaatgagttcatgtactataagatgcgggaagccgcactgaacaatcagcccatgcaggttatggccgagccatctaacgaacctagcccagcactgtttcacaaaaagcagtag

SEQ ID NO: 27736 - DNA, 1542 bp, Artificial Sequence
  Description of Artificial Sequence: Synthetic coding sequence
atggcagagctgcagatgcttctggaggaggagatccctggcggtcgcagggccctgttcgacagctacactaatttggaacgtgtcgccgattattgtgagaataactatatacagagcgccgacaagcagcgtgccctggaagaaaccaaggcctacactacacagtcactcgcttcggtggcctaccttatcaacacacttgccaacaacgttctgcagatgcttgacattcaggctagccaactgaggcgtatggagtccagcatcaatcatattagtcagacagttgatatacataaagaaaaagtagcacgcagagaaataggcatcctgaccaccaacaagaatacctccaggacccataagataatcgccccagccaatctggagaggcccgtacgctatattagaaaacctattgactacaccattctggatgatatcggacatggggtaaagtggctgctgcgatttaaggtttcaacccagaatatgaaaatggggggactgcccagaaccaccccccctacccagaagccgccttcgccaccaatgtcgggtaaaggtactctcggcaggcactctccataccgcacacttgagcccgtccgtccgccagttgttccaaatgactacgtcccgtcccctactcggaatatggctcccagccagcagtcccccgtcaggacagcttcggtaaatcaacgaaaccgcacatatagtagtagcggctcttcagggggtagccacccaagcagtcgaagctcatccagggagaactccggaagcggcagcgtcggcgtgcccatcgctgtgccgacaccctcacctccatccgtcttccccgctcctgctgggtccgctgggaccccacctctgccagccacatccgccagtgccccagcccctttagttcccgcaaccgtgccctcttcaaccgccccagacgcagcggcagggggtgcgcagacactggccgatggcttcacaagccctacaccccctgtggtgagctctaccccaccaaccggacatccagtacagttctattcaatgaacagacccgcatcaaggcacaccccaccaaccattgggggatccctgccataccgtaggcccccatcaataaccagccagactagtcttcaaaatcagatgaacggtggacctttttacagccagaacccagtgagcgataccccccctcccccaccgccagtggaagagcctgtatttgatgagagtcccccacctcccccaccgccagaagactacgaggaagaggaggctgctgttgtcgagtactcagatccctacgcagaagaggacccaccctgggccccacgttcctatttggaaaaagtggttgccatttatgattataccaaggacaaagaggacgaacttagcttccaggaaggcgcaatcatctacgtcattaaaaagaacgacgatggatggtacgaaggagttatgaacggcgtgaccgggctctttccagggaactacgtggagtccatcatgcattattctgaatag

SEQ ID NO: 27737 - DNA, 1170 bp, Artificial Sequence
  Description of Artificial Sequence: Synthetic coding sequence
atgcccctagagaacctcgaagaggaaggcttacctaagaatcctgacttacgcatcgctcagctgcggttcctgttgtccctgcccgaacatcgtggagacgctgcagtacgtgacgaactgatggccgcagtgagggataacaacatggcaccctactatgaggccctgtgtaagagtctcgactggcagatcgacgtggatcttcttaacaaaatgaagaaggcgaacgaggatgagctcaagcgcctggatgaggaactcgaggatgccgagaagaacctgggggagagcgagattcgggatgcaatgatggccaaggccgagtacctctgccgcattggggacaaggagggagcattaacagcctttcgcaagacctatgacaaaactgtagcgctggggcaccgcctggacatagttttttacttgttgcgcatcggtttgttttacatggacaacgacttgataacgcgtaatacggaaaaagccaagagtcttatcgaggaggggggagactgggaccgtcgaaacagactaaaagtgtatcaagggctttattgtgtggccatccgtgatttcaagcaggctgccgagctctttttagacacagtttccaccttcacttcttacgagctgatggattataagacttttgtgacctacactgtgtacgtttccatgatcgcgttagagagacccgacctgagggaaaaggtcatcaagggtgctgaaatcctcgaagtgctccacagcctgcctgctgtccggcagtatctgtttagcctctatgagtgtcgttatagtgtgttttttcaatccttagccgtggttgagcaagaaatgaagaaggattggttgttcgccccacattacagatactacgtacgagaaatgcgcattcatgcctactctcaactgttagagtcatatcgttctctcactttagggtatatggccgaggcattcggtgtaggggttgaattcatagaccaggaattgtcccgctttattgccgctgggagactgcactgcaaaattgataaggtcaacgagattgtggagacgaatcggcctgattctaagaattggcagtaccaagagacaattaagaaaggggatttgcttctaaaccgcgtccagaaactctcccgggtgattaatatgtag

SEQ ID NO: 27738 - DNA, 420 bp, Artificial Sequence
  Description of Artificial Sequence: Synthetic coding sequence
atggccaatatcgccgtccagcgcatcaagcgagagttcaaggaagtgttgaagagcgaggagacctcaaaaaaccagattaaagtcgaccttgtagatgaaaacttcactgaacttagaggcgagatcgccggacccccagacaccccctatgaaggcggaagatatcaactggagataaagattcccgagacctatccctttaaccccccaaaatataaacaaaaccctgagatgtttaaacaaaccgcccgtctttgggctcacgtatatgctggagcccctgtgtcctcacccgaatatactaaaaagatagagaatctgtgtgccatggggttcgaccgcaacgcggtgattgtcgcactatcctcaaaatcatgggacgtggaaacagctacagagcttctcctgtccaattag

SEQ ID NO: 27739 - DNA, 1203 bp, Artificial Sequence
  Description of Artificial Sequence: Synthetic coding sequence
atgaattttacggtgggcttcaaacctctcctgggagacgcacatagcatggacaacctggaaaagcagctgatctgccccatctgcttagagatgtttagcaagcctgttgtcatactgccatgtcaacacaatctgtgccggaagtgtgcgaatgacgtgttccaggcaagcaaccccctatggcagtcaaggggatccactacggtctcttcagggggaagatttcgctgcccatcgtgcagacacgaagtggtgctggaccggcatggtgtctacggacttcaacgcaatctgctcgttgagaacattatcgacatttacaagcaggaatcctcgcgaccactccacagcaaggctgaacagcacctcatgtgcgaggagcacgaagaggagaaaattaacatatactgcctttcctgtgaggtgcctacctgttcgctctgcaaagtgtttggggcacacaaagattgcgaggtcgcgccacttccaacaatctacaaacgccagaaaaaacaagatcttacactcctccccaggttggagtgctccggaactaatacgacctattgttcattagacttgccctcgagctcagacccacccattttggcttcccaaaatacaaagatcatcgactctgaactctcagatggcatcgccatgctggttgctgggaatgatcgggtgcaggctgttatcactcagatggaagaagtttgccagaccattgaagacaatagccgaaggcagaaacaacttttaaaccagcgattcgagagtctgtgcgcagtactggaggaaaggaagggtgagttgctccaagcactcgctcgcgagcaggaggaaaaactgcagcgcgtgaggggcctaattaggcagtatggagaccacctcgaagcttcaagtaaactggttgagagtgctatccagtcgatggaagagccccagatggccctgtatttgcagcaggcgaaggaattgattaacaaagtaggggctatgtcaaaggtggagctggccggacggcctgaacccggatacgaatctatggagcagttcacggttagagtcgaacacgtcgctgagatgctaaggacgatcgactttcagcccggagcctcgggggaggaagaggaagtggcaccagacggagaagaaggatcggcgggacccgaggaagaacgcccagacggcccatag

SEQ ID NO: 27740 - DNA, 198 bp, Artificial Sequence
  Description of Artificial Sequence: Synthetic coding sequence
atgttcctgtcagctgtcttttttgccaaatcgaagtcgaagaacatcctggtgcgcatggtctccgaggccggtaccggattttgctttaataccaagcggaatcggttgagagagaaactgacactgctccattatgatccggtagttaaacagagggtgcttttcgtggagaaaaaaaaaatccgaagcctatag

SEQ ID NO: 27741 - DNA, 2919 bp, Artificial Sequence
  Description of Artificial Sequence: Synthetic coding sequence
atgcgtccagagggagccggtatggagctgggcggtggcgaagaaaggttgcctgaagagtcccgaagagagcattggcagttactagggaacctcaaaacaaccgtcgaggggctggtttccactaatagtccaaacgtgtggtctaagtacggcggactagagagactttgccgggacatgcagtcaatcctctaccatggattaatacgcgatcaggcatgtaggaggcagacagactactggcagtttgtgaaagacattcgatggctgagtcctcactccgctctccacgtggagaaattcatttccgtgcacgaaaatgatcaatcctcagcagatggcgcttctgagagagccgttgccgagttgtggctccaacacagcctccagtatcattgcctgtctgcacaactgcgcccattgttgggagaccggcagtatattagaaaattttacacggacgctgcttttctactgtctgacgctcatgtgaccgctatgctgcagtgtctggaggccgtcgagcagaataacccacggttgcttgcacagatagatgcgagcatgtttgcgaggaagcatgagtcacccctactggtcactaagagtcagtctctgactgccttgccatcgtccacatacacaccacctaattcttatgctcagcatagctattttggctctttctcaagcctgcaccagtccgtccccaacaacggatccgaaaggaggtctacttctttcccattatccggaccccctcgtaaaccccaggagagtcgtggacacgtgtcacccgcagaggatcagaccattcaggctccacctgttagcgtttcggctcttgcccgtgatagtcccctgactcccaacgagatgagttcatcgactttgacatcccccatagaggctagctgggtgtcctcgcagaacgattctcccggtgatgcgagcgaaggtccagagtatctggctattgggaatctggatcctcggggaagaacagccagctgccagagccatagtagcaatgctgagtcgtcctcgtcaaacctcttctcctcaagctcctcgcagaaacctgatagcgctgccagcagcttgggcgaccaggagggcggaggcgagagccaactgtcttccgtgcttcgcagaagttctttctctgaggggcagactctgacggtgacatccggtgctaaaaaatcccacattcgcagccactcagatactagcattgcatctagaggcgctccagagtcatgcaatgataaagcaaagctaaggggacccctcccatactctggccagagttcagaggtgtctactcctagttcgctctacatggagtacgaaggcggtcggtatctatgttctggagaggggatgttccggagaccttcagaaggacagtccttaatctcctacctgtcagagcaggattttggctcttgtgcagatcttgaaaaggaaaacgctcacttctctatcagtgaatctttgatcgctgccatagagttgatgaaatgcaatatgatgagccagtgcttagaagaagaagaggtggaggaggaggactctgacagggaaattcaagaactgaaacagaagatcaggctgagacgccagcagatcaggacaaagaatttgctgcccatgtaccaggaagcagagcacggaagctttagagtcacttcttcatcatcccagttctcctcccgagactccgcccagctttccgactcgggaagtgcagacgaggttgacgagttcgagatccaggatgctgatatacgcaggaataccgcatcttccagcaagtcgtttgtaagctcccaatccttctctcattgtttcctccattccacctccgccgaggcggtcgctatgggactcttaaagcagttcgaagggatgcagctcccggctgccagcgaactagaatggctggtccccgagcatgatgcaccccagaagctcctcccaattcccgactctctacccattagcccagatgatggccagcacgccgatatctacaaactgaggatccgggttcgtgggaatctggaatgggctcctccaaggccccagattattttcaatgtgcacccggcacccaccagaaagatcgccgtagctaagcagaattatcgctgcgcgggttgtggtattaggaccgatccagattacataaaacgcctgaggtactgcgaatatctgggcaagtacttttgtcagtgctgtcatgagaacgcccaaatggcgattccttcgcgcgtgctgagaaagtgggacttttcgaagtactacgtctctaacttctccaaggatctgctaatcaaaatatggaatgaccctctcttcaatgtgcaggatataaactctgccctgtatagaaaggtcaagctgttgaaccaggtgaggcttctgcgggtacagctgtgtcacatgaagaatatgtttaaaacttgtagattagcaaaggaactgctcgactcctttgacacagtgccagggcatctcacagaggatctccacctctattccttaaatgatctgacggcgacacggaaaggcgagctggggcctagattggccgaattgactagagccggagcaacacatgtggaacgctgtatgctgtgccaagcaaaaggattcatctgtgaattttgtcagaatgaagacgatattatattcccttttgagctccataagtgccgaacatgcgaggagtgcaaggcctgctaccacaaggcatgcttcaagagcggtagttgcccacgctgcgaacgcctgcaggccaggcgagaagccctcgcgaggcaaagcctagagtcttacttaagcgactacgaagaggagcccgctgaagcactcgcccttgaagccgctgtgttagaggctacctag

SEQ ID NO: 27742 - DNA, 1161 bp, Artificial Sequence
  Description of Artificial Sequence: Synthetic coding sequence
atggcggcagtagagacgagggtctgcgagactgacggctgctcaagtgaggcaaaattgcagtgtccaacctgtattaaactcgggatccaagggtcatacttttgcagccaggaatgcttcaaaggaagctgggccacccacaaattgttacacaagaaggccaaggatgaaaaggcgaaacgagaggtttccagttggacggtggaaggtgacataaacaccgacccttgggccggttacaggtataccgggaagcttcggccacattacccactgatgcctacccgaccagtgccttcatacatccagcggccagattatgctgaccaccctctcgggatgagcgagtccgagcaggcacttaagggtacaagtcagatcaagctgctgtcaagcgaggatattgagggcatgagactggtgtgccgactggccagggaagtgcttgacgttgccgcagggatgattaaacctggggtgaccaccgaagaaattgatcacgctgttcatcttgcttgtattgcccgaaactgctatccttcccctctgaactattacaactttcctaaatcttgttgtacctcggttaacgaagttatctgtcatggcattccagatcgcaggccccttcaggaaggtgatatcgtaaacgtggacatcaccttgtacaggaacgggtatcacggggatctgaacgagacgttcttcgttggtgaggtggacgacggggctcgaaagctggttcaaaccacctatgagtgcctcatgcaggccattgatgccgtgaaacctggagtccggtacagagagcttggcaatatcatccagaaacacgcccaggccaatggattcagtgtcgtgcgctcgtattgtggccacggtattcacaagctgtttcacactgcgcctaacgtgcctcactatgccaagaataaagccgtcggcgtcatgaaatcgggtcatgtgttcacaatcgagcctatgatatgtgaagggggttggcaagacgaaacctggcccgacggctggactgccgtgactcgcgatggaaaacggtctgcccagtttgagcacacactgctggtgactgacactggatgcgaaatactgacacgcaggcttgatagtgctcggcctcacttcatgtcccagttttag

SEQ ID NO: 27743 - DNA, 738 bp, Artificial Sequence
  Description of Artificial Sequence: Synthetic coding sequence
atgggcaggctcgacggtaaggtgatcattctcacggccgcagcacagggaatcggacaggctgctgccctggcattcgccagagagggggctaaggttatcgcaaccgacataaatgagtcaaaactgcaagaattggagaaatatcccggaatccagaccagagtacttgacgtgactaagaaaaagcagatcgatcaatttgcaaatgaagtggagagactcgacgttctgtttaatgtggctgggttcgtccatcatggcactgtgttggactgcgaagagaaggattgggactttagcatgaacctgaacgtgagatctatgtaccttatgattaaagcctttctgcctaagatgttggcccagaagtccggtaatatcataaacatgagttccgttgcatcctcagtgaagggcgtcgtgaacagatgtgtttactcgacgacgaaggctgccgtgattggtctgacaaagagtgttgcggctgactttattcaacagggcatccgctgtaattgcgtttgccctggaaccgtcgataccccctccttacaagaacggattcaggccagggggaaccccgaggaggccagaaatgatttcctgaagaggcaaaagaccggcagattcgcgacagcggaagagattgcgatgttgtgtgtttatctggctagcgacgaaagcgcatatgtcacaggcaacccagtgattatagatgggggatggagtctgtag

SEQ ID NO: 27744 - DNA, 2520 bp, Artificial Sequence
  Description of Artificial Sequence: Synthetic coding sequence
atgagcgtagtgggcatcgacctgggcttcctcaattgctatattgctgtagcacgcagtggtggcatcgagacgatcgctaacgaatactccgatagatgcaccccggcatgtataagtttaggatcgcggactagagccattgggaatgccgcaaaatctcagatcgtcaccaacgtgcggaacacgattcacgggttcaagaaacttcatggaagatccttcgatgaccccatcgttcaaactgagcgcattcgcctgccatatgagctccaaaaaatgcctaatggcagcgctggcgttaaggtgcggtatctcgaagaagagcgccctttcgccattgagcaggtgaccggaatgctgcttgcgaaactgaaagaaacttcagaaaacgcccttaaaaagcccgtggccgactgtgttatttctataccctcgttctttactgacgctgaaaggaggagtgtgatggcagctgcgcaggtggctggtctgaactgtctgagactgatgaatgagaccacagctgtggccttagcctacggcatttacaaacaggaccttcccccactggacgaaaaacctagaaacgtggtgtttatcgatatgggccactcggcttatcaggtgctggtgtgtgcctttaacaagggtaagttgaaggttctggccactacgttcgatccctatctggggggacgcaattttgatgaggctcttgtggactacttctgcgacgaattcaaaacaaagtataagataaatgtgaaagagaactcacgtgctttgttgcggctttaccaggagtgcgagaagctcaaaaaactcatgagcgctaacgcatccgatctgccactgaatatcgagtgcttcatgaacgacctggatgtgtcatctaagatgaacagggcacagtttgagcagttgtgtgcttcattgctggcgagggtggaaccgcctctgaaagctgtcatggaacaggcaaatcttcagcgagaagacattagttctatagagattgtgggtggagccaccaggattcccgcagtgaaggagcagatcacgaagttttttctcaaagacatcagcacaaccctcaacgcagacgaggctgtcgccagagggtgtgctctgcagtgtgccatcctttcccctgcattcaaagtgagggagttttcaatcaccgacctagtgccttacagcatcacactccgctggaaaacctcgttcgaagatgggtctggagaatgcgaggtattctgtaagaatcatccagcacctttctccaaggtcattacttttcacaaaaaggaaccattcgagctggaagctttctatacgaacttgcacgaggtcccctaccctgatgcacggattggttcgtttaccatccagaacgtgtttccccaatcagatggcgatagctccaaagtgaaggtcaaggttagagtgaacattcacggcattttctccgtggcctccgcaagcgtgatcgagaaacagaatctggagggcgaccatagtgatgctccgatggagacagagacttctttcaaaaatgaaaataaagacaatatggataaaatgcaggtggatcaggaggaaggccaccaaaagtgccatgctgaacacacccctgaggaggagattgatcacactggcgcaaaaacaaaaagtgccgtaagcgacaagcaggatagactgaaccagacactaaaaaaggggaaagtgaaatccattgatctaccaattcagtcatcactgtgccgacagctgggccaggatctactgaattcttacatcgagaacgaggggaagatgataatgcaagacaaactcgagaaggagcgaaacgatgcaaaaaacgctgtggaagaatatgtgtatgattttcgcgatcggcttggcactgtctatgagaagtttataacccccgaggacctttctaaattaagtgccgttctggaagataccgagaattggctgtatgaggatggtgaggatcaacctaagcaggtttatgtggataaacttcaggagctcaaaaaatatggtcagccaatacagatgaaatacatggagcacgaggaacggcctaaggcgttaaatgacctcggcaagaaaatccagttggtcatgaaggtcattgaggcttaccgcaacaaggatgagcggtacgatcacctggacccaactgagatggaaaaggtggagaagtgtataagcgacgccatgagctggttgaacagcaaaatgaatgcccaaaacaagctaagtttaactcaggatccagtagtgaaggtaagtgagatcgtggccaaaagcaaggagctggataatttttgtaatcctataatatataaaccgaaaccgaaggccgaggtgcctgaagacaagccgaaagcaaattctgagcacaacggtccaatggacgggcagagcggcaccgagacgaaaagcgacagcacaaaggactcttcacaacacaccaagagtagtggcgagatggaagttgattag

SEQ ID NO: 27745 - DNA, 1224 bp, Artificial Sequence
  Description of Artificial Sequence: Synthetic coding sequence
atggccgctccctgtgctgaggatccttccctcgagcggcattttaagggccatcgtgatgccgtgacctgcgtagacttttcgattaatactaaacagttagctagcggatccatggactcctgcctgatggtctggcacatgaagccacagtctcgcgcttataggtttacgggacacaaggacgccgttacatgcgtaaacttctctcccagtgggcatctgttggcaagtggaagtcgggacaagacagtgcgcatatgggtacctaacgtcaaaggagaatctactgttttccgagcacatacagctacagtgaggtctgtgcatttctgcagtgatgggcaatcattcgtgaccgcaagcgacgataaaactgtgaaagtgtgggctacccatcggcagaaattcttgtttagtctgagccagcacattaattgggtgcggtgtgccaagttctccccagacgggcgactcattgtgtcagcttccgacgataagacagtaaagttgtgggacaaatcctccagagagtgtgtgcattcatactgtgagcacggcggttttgtgacctacgtggattttcaccctagtggcacttgcatcgctgccgcaggtatggacaacaccgtgaaggtgtgggatgtacggacccaccgtctgctgcagcattaccagctgcatagcgcagccgtgaacggactgtcctttcatcctagcggaaactacctcatcactgcaagctcagactctacactgaagatccttgacctgatggaaggtaggcttctttacaccctgcatggacatcaggggcctgcaacgacggttgcctttagccgtaccggagaatattttgcaagcggaggctccgatgaacaggtcatggtttggaagtctaacttcgacatcgtggatcacggagaagttaccaaggtccctcgcccacctgctaccttagcatcctcaatgggcaatctgcctgaggtggactttccggtccccccagggagagggaggtcagtcgaaagcgtgcaatcacagccgcaggaacccgtgtcggtcccacagacacttacgtccacgctagaacatattgttggtcagttagatgtcttaacacagaccgtctctattttggagcagagacttacactaaccgaggacaaacttaagcagtgtctggagaaccaacaactcataatgcagcgggcaacaccatag

SEQ ID NO: 27746 - DNA, 1173 bp, Artificial Sequence
  Description of Artificial Sequence: Synthetic coding sequence
atggccaccggcgatttgaagcggtcattaaggaaccttgagcaagttttgcggcttcttaattacccggaggaagtagattgtgttggattaataaagggtgaccctgccgcatcattgccaatcatctcctactcttttacatcctacagtccctatgtgaccgaacttataatggagtccaacgtggagctgattgctaaaaatgacctcagattcatcgatgcggtctacaaactgttacgagatcaattcaattacaaacccattctgactaaaaaacagttcatccagtgcgggttcgccgagtggaagatccagatcgtctgcgatattctgaactgcgtgatgaagaaacataaagagctttccagcttgcagaagataccgtcacaacagcgtaagaaaatcagttccggtaagtccgagcctccattgggcaatgagaagataagtgcagaagccgtaggtgttgatatctcaggacgcttcatgacgtctggaaaaaagaaggctgtcgtgatccggcacctgtacaacgaggacaatgtcgatatctcagaagatacactgtcaccaattaccgatgtgaatgaggccgtggacgtgtccgatttgaatgctacagaaattaagatgcccgaggtcaaggtgcccgagatcaaggccgaacaacaggacgtgaacgttaatccagaaatcaccgccctgcaaacgatgctggccgaatgtcaggagaatctgaagaaactgacctctatcgagaagagactggattgcctagagcaaaaaatgaagggcaaagtgatggtagatgaaaacacctggacaaatctgctttcccgagtaacgctgctagagacagaaatgctattatcaaaaaaaaatgatgaatttatcgagttcaatgaggtgtcggaggattatgctagctgttccgacatggatctgctcaatccccaccggaagtccgaggtggagagacccgcatctatcccgctcagctccggatatagcaccgcaagctcagactcaactccaagagcttctacagtaaactactgtgggttaaacgaaatttcagaggagacaaccattcagaagatggagcgtatgaaaaaaatgtttgaggaaacagctgagctgctgaaatgtccaaatcactacctttag

SEQ ID NO: 27747 - DNA, 2601 bp, Artificial Sequence
  Description of Artificial Sequence: Synthetic coding sequence
atgccagccgtttcccttccacccaaagaaaatgcacttttcaaaagaatcctgcgatgttacgaacacaagcagtatcggaacgggttgaagttttgtaagcagatcctaagcaatcccaagttcgcggaacacggcgaaaccctggccatgaagggcctgacacttaactgcctggggaagaaagaggaggcttatgagctggtgcggaggggcctgcgcaatgatttgaaatctcatgtctgctggcatgtctacggactcctacagcggtccgacaaaaagtatgacgaggcgatcaaatgttacaggaacgcactgaaatgggataaggacaacctgcagatcttgcgggacctcagcctgcttcagattcaaatgcgagacttagagggctatcgagaaacccgatatcagctgctacagttgcgccctgcgcagagagcgagctggattggatatgccattgcctatcacctcctggaagactatgaaatggccgctaagatccttgaagaatttaggaaaacacagcagacaagccctgacaaggtagactacgagtactcggaactgctgctgtaccagaatcaggtgctacgggaggctggtctctaccgcgaagctctggagcatctctgcacttacgagaagcagatctgtgataagctggcggtagaagagactaagggggagctactgttacagctttgcaggctcgaggatgcagccgacgtttacagagggctgcaggagaggaaccctgaaaattgggcgtactataagggcctggagaaagcgctgaaaccggcaaatatgctggagcgcttgaagatctacgaagaggcatggaccaagtacccccgagggcttgtgccgaggaggctcccactgaactttctgtcaggtgagaagtttaaagaatgtctggacaagtttctgaggatgaacttttctaagggctgtcccccagtgtttaacactctgcggagtctgtataaggataaagaaaaggtcgcaattattgaagagctggtcgtggggtatgagacttcccttaagagttgccgcctttttaacccgaacgacgatgggaaagaggaacctcccaccactctcctctgggtgcagtactatctcgcacaacactacgacaaaatagggcaaccctccatcgccctggagtatatcaacactgcaatcgaaagtacgcctacactcattgaactgttcctcgtcaaagccaaaatatataagcacgcaggtaacatcaaggaagccgctcgctggatggatgaagctcaggcactggacacggccgaccgttttatcaactctaagtgtgccaaatacatgctgaaagcaaacctcattaaagaagcagaggagatgtgctcaaaattcacccgggagggcacctcagccgttgaaaatctcaacgagatgcagtgtatgtggttccagacggagtgcgcccaagcctataaggcaatgaataagtttggcgaagccctgaagaagtgtcacgaaattgaaaggcactttatcgagatcactgacgatcagttcgactttcatacctattgcatgcgtaaaattacccttcgctcgtacgtggacttgctcaagctggaggacgtgctccgacagcaccccttttatttcaaagccgcacgcatcgccattgaaatctacctcaagctgcatgacaaccctctaactgatgagaataaagagcacgaggctgacaccgcgaacatgtccgacaaggaactgaaaaaactccgaaacaaacagaggcgagcacagaaaaaagctcagatcgaggaagaaaaaaagaacgctgaaaaggagaaacagcagaggaaccagaaaaaaaaaaaagatgacgacgatgaggaaatcggcggaccaaaagaagagcttatccccgaaaagctggcaaaggttgaaacccctcttgaagaggccatcaagttccttacccctctcaagaacctcgtcaagaacaagattgaaacacacctcttcgctttcgagatatacttccggaaagaaaagtttttgctaatgctgcagtcagtcaagagagcttttgcaattgacagttcacatccatggctccatgaatgcatgatcagactttttaacacagctgtgtgcgagtcgaaggatttatccgacacagttagaacagtgctaaagcaagagatgaatcgcttatttggcgctactaaccccaagaattttaatgaaacattcctgaagcgcaactctgattcattgccacataggcttagcgccgctaagatggtttattacctcgacccgtcttcccagaagcgggctatagagctcgccacgactctagatgaaagtcttacaaatcgtaatctccagacttgcatggaagtcttggaagccctgtacgacggaagtctgggcgattgcaaggaagccgctgagatttaccgtgctaactgtcataaactgttcccatacgccctggcttttatgcccccaggctatgaagaggacatgaagattacggtgaatggagacagttctgccgaggcagaggagctggctaacgagatctag

SEQ ID NO: 27748 - DNA, 1293 bp, Artificial Sequence
  Description of Artificial Sequence: Synthetic coding sequence
atggcgagctcggccaagtccgccgagatgccaactatctctaaaactgtaaaccctactcccgatccacaccaggagtatctggatccaagaataacaatcgccttattcgaaattggtagccactccccaagttcttggggttcccttccattccttaagaattcttcccaccaggtgacagagcaacagaccgcccagaaattcaacaacctcctaaaagaaataaaggacatcctcaaaaatatggcagggttcgaggaaaaaattactgaggccaaagaattgttcgaggagacaaacattacagaggacgtgtctgcccataaggaaaacatccggggattagataagataaacgaaatgctatctactaacctgcctgtgtccttggctcctgagaaggaagataatgaaaaaaaacaggaaatgatcctggaaacgaatatcacagaagacgtcagtgcacacaaagagaacattagaggcctggacaagatcaatgagatgctgagtacaaatctgccggtttcactcgctccagagaaagaggacaatgaaaaaaaacagcagatgatcatggagaaccagaacagtgagaataccgcacaggtattcgcacgagacctagtgaaccggctggaggaaaagaaggtgcttaatgagacccagcagagtcaagaaaaagccaagaaccgacttaacgtccaagaggagaccatgaaaatcagaaacaacatggagcagttactgcaggaagccgagcattggagtaaacagcacacagaattatctaaactgatcaagagctaccagaagagccagaaagacatatctgagactctcggtaataatggtgtgggtttccaaacgcaaccaaacaacgaggtgtcagccaagcacgaactggaggagcaggtcaaaaagctgtcacatgacacatatagcctgcagctgatggccgcattattggaaaacgagtgccagatcctgcagcagcgcgtcgaaattctgaaggagttacatcaccagaaacagggcaccctccaagaaaaaccgatacagatcaactacaagcaggacaaaaagaaccaaaagccttccgaggccaagaaagtggaaatgtataagcagaataagcaggctatgaagggaactttctggaaaaaggaccgatcctgccggtcactggacgtctgtctgaacaagaaagcgtgcaatactcagttcaacattcatgtagcacgcaaagcacttcgcggtaagatgagaagcgcttcaagccttcgctag

SEQ ID NO: 27749 - DNA, 5199 bp, Artificial Sequence
  Description of Artificial Sequence: Synthetic coding sequence
atggcagcgatcggcagaggaagaagtctcaaaaatttaagagtgagaggaaggaatgacagtggcgaggagaacgtgcccctagacttaaccagagaaccctctgacaacctcagagagatcctgcagaacgtggctagattgcagggcgtcagcaatatgaggaagctggggcatctaaataattttactaagctgctctgcgacattgggcattcagaagagaaattggggttccactacgaggacatcattatctgcctgcgcttggctttattaaacgaggctaaagaggttcgggcagccggtctccgagctttacgctacctgattcaggactctagtatactgcagaaagtcctgaaattaaaagtggattacttaatcgcccgttgtatcgacatccagcagtcaaacgaggtggagaggacccaagctctgagactggtgcgcaaaatgattacagtaaacgcgagcctcttcccgagtagcgtgacaaatagcctgatcgccgtgggaaacgatggccttcaagagcgcgatcgcatggtgcgagcctgcatagcaattatttgcgaactggccttgcaaaacccagaagtcgtggccttgagaggtggattgaacacaatccttaagaatgtaatcgattgccagctaagtcgcatcaacgaagcacttattacaacaattctacatctgctgaaccacccaaagacaaggcaatatgttcgggctgatgttgagcttgaacggatactggctccttataccgattttcactaccgccattcccccgacacagctgagggccagttaaaggaggacagagaagctaggtttctggccagcaaaatggggattattgccacatttcgctcttgggcaggcattattaatctgtgcaaacccggtaactcgggtatacagtctctcattggtgtgctttgtatccctaatatggaaatccgaagaggactgctggaagttctgtatgacatattcaggctgcccctcccagtcgtgacggaggaattcattgaggccctgctgagcgtggatcccggacgctttcaggacagttggcgcttatctgacggattcgtggcagcggaggctaagactattctgcctcaccgcgctcggagtcgccctgacttaatggataattatctggccctcattctttctgcgtttattcgtaacgggctgctggagggtctagtggaggttatcactaacagcgacgaccacatttcggtccgcgcaaccatcttgctgggggagctgcttcatatggctaacaccatcttgccccactcacatagtcatcatctccactgtctcccaacacttatgaatatggcggctagcttcgacatcccaaaggagaagagacttcgagcgtctgccgctctcaattgtctcaagcgcttccacgaaatgaaaaaacgcggtccaaagccttacagcttacaccttgaccacatcatacaaaaggccatagctactcaccagaaaagggaccagtatctgagagtccagaaagacattttcatcctgaaagataccgaggaggcgctgctgatcaatctgagggattctcaagtgttgcagcataaagaaaatttggagtggaactggaatctcataggcactatcctgaagtggccaaacgtgaatttgcgaaactacaaagatgaacaattgcacagatttgtgaggagacttctgtatttttacaaacctagtagtaaactgtacgctaatctggatttggactttgccaaggctaaacagttgaccgtggtgggatgtcagttcaccgagtttctcctcgaatcggaagaggacgggcagggatatttggaggatttggtcaaagacatagtacagtggctcaatgcgagctcaggaatgaagccagaaagaagcctgcaaaacaacgggctgttgactaccttgagccagcactactttctatttattggaactctgtcctgccacccccacggcgtgaagatgcttgaaaagtgttccgtgtttcaatgcctccttaacctgtgctctctgaagaaccaggaccacctgttgaaactaactgtctcttcgctcgattactctcgagatgggctcgcacgcgtgatcctgagtaagatcctcactgctgcaacagatgcatgccgcttgtacgccactaaacacttacgagtcctccttcgcgcaaatgttgaatttttcaataattggggcattgaactgttggtgactcaactgcatgacaagaacaaaacaattagctctgaggcccttgacattttggacgaagcatgcgaggacaaggcaaatctccacgccctgatccagatgaaaccggctctttctcacctcggagacaaagggttactgttgttactgcgtttcctttctatccccaaaggcttttcatacctgaatgaacgaggatacgtggccaagcagcttgagaagtggcaccgtgagtataattctaagtatgttgatctcatcgaagagcagctcaatgaggcccttactacctataggaaacctgtggacggcgataactacgttaggcgctccaaccagcgtttgcagaggccacatgtgtacctcccgattcatctgtatggccagctcgtccaccataaaacaggctgtcacctactggaggtccaaaacatcatcaccgagctatgcagaaacgttaggactccagatctcgacaagtgggaagaaatcaagaaactgaaggcctccctgtgggccctgggcaatattggctctagcaattggggcctgaacctcttgcaggaggagaatgtgataccggatatactcaagctggctaagcaatgtgaggtgctttccatccgcggaacatgtgtatacgtgctcgggctgatcgccaaaacgaagcagggctgcgatatcctcaaatgccataattgggatgcggtgcgccactcgaggaagcacctgtggccagtggtgccagatgatgtggaacaactttgtaacgaacttagttcaattccctctaccttgtctttaaactcagaaagcacatcttctcgacataattccgagtctgagtctgtgccttcttccatgttcatcctcgaggatgacaggttcggcagcagcagtactagcaccttttttttggacattaacgaagataccgaacccacattctacgaccggtcgggacccatcaaagacaagaactcattcccattctttgcgagcagcaagcttgtgaaaaataggatactgaactctctcaccctaccgaacaaaaaacacaggagttcctcagaccctaagggtggcaaactgtcttctgaatcaaaaacgtcaaaccgtagaattcggactctcacggagccttctgtggacttcaaccatagtgacgactttactccgatcagtaccgtgcagaaaactctgcagctcgaaacttcattcatgggtaataagcacattgaagacacgggcagcacgccttctatcggcgagaatgatctgaagttcactaaaaacttcggcaccgagaaccatcgcgaaaacacaagtcgggagcggctggtggtcgagtcatccactagctcacacatgaaaatccgatctcagtcatttaatacggacactaccacctcagggattagctcaatgtcctctagcccaagcagggaaacagtaggtgtcgatgcaacgaccatggacacagattgtgggtccatgtctactgtggtgtctaccaaaactatcaagacttctcactacctcaccccccagtctaaccatctatctctgagcaagtcgaacagcgtgtcactagtgcctcctggaagcagccataccctccccagacgcgctcagagtctgaaagccccttctatcgcaacgataaagagcctcgccgactgcaactttagctacacaagtagcagggatgcctttggatacgccaccctaaaaaggctgcagcagcagcgcatgcatccctccctgtcccacagcgaggccctagcttctcccgctaaagatgttttgtttacagacacaataacaatgaaggcgaactcctttgaatctaggctaacgccatctcgcatagacttcaaaaaaaagcacgttgggggaatccgctctctgagacccactataacgaacaacctgttcaggtttatgaaagcattaagttatgctagcctcgacaaggaagacttacttagccccatcaaccagaacaccctccagagaagctcttcggtgaggtcgatggtctcttccgccacctacggcggatcggacgactacatcgggcttgcattacctgtcgacattaatgacatcttccaggtcaaggatatcccttacttccagaccaagaatatccctccacatgatgataggggcgctcgagcttttgcccacgatgccggagggttgcccagcggaaccggcggactggttaaaaattcatttcatttgctgcgtcagcagatgtctttaactgagataatgaattctatccactcagacgccagcctgttcttggaatcaacagaagacaccgggctgcaggagcatacggacgacaattgtctttactgcgtgtgcattgaaatcctaggttttcagccttccaaccagttgagcgctatctgcagccattctgactttcaggatatcccctacagcgactggtgtgaacagacaatccataatccgctggaggtagttccgagcaaattttctggaatcagtggatgttccgatggtgtgtcacaggaggggagcgcttcaagtaccaagtccacagaactgctgctaggggtaaaaacaattcctgatgacacacccatgtgcaggattctgcttaggaaagaggtgctgcggcttgttataaatctctcttcgtctgtgtccaccaaatgtcatgagacggggctcctgacaatcaaggagaagtatccacagacatttgacgacatctgcctgtacagcgaggtgtcgcacctgctgagtcactgcaccttccgcctgccttgtcggagattcatccaggaattgttccaggatgttcagtttttgcagatgcatgaggaggcagaagcggtcctggctacccccccaaaacaaccaattgtggatactagtgccgaatcctaa

SEQ ID NO: 27750 - DNA, 1761 bp, Artificial Sequence
  Description of Artificial Sequence: Synthetic coding sequence
atgagcgccactgtcgtcgatgctgtgaatgccgcacccttatcaggtagcaaagaaatgagtctcgaagaacccaagaagatgactcgagaggattggcgtaagaaaaaagagctggaagaacagcgcaagttgggcaatgcccctgctgaggtggatgaggagggcaaagacatcaatccacatattcctcagtacatttcaagcgtgccctggtacatcgaccctagtaagagaccaaccctgaaacatcagaggcctcagcctgagaagcagaaacaattttcttctagcggagaatggtacaagcgcggagtaaaagagaacagcattataaccaagtacagaaagggcgcttgtgagaactgtggagccatgacccacaagaagaaggactgttttgagcggcctaggcgggtcggtgctaagtttacgggaacaaatatagctcccgacgagcacgtgcagcctcagttgatgttcgactacgacggcaagcgggaccgctggaatggttataatcccgaggagcacatgaagatcgtcgaggagtatgctaaagtggatctggcgaagcgtacattgaaggcacagaaattgcaggaagagctggcttcagggaagctcgtggagcaggccaactctcccaaacatcagtggggcgaggaagagcccaattcccagatggaaaaggatcataattccgaagacgaagacgaagacaaatatgcagacgacatcgatatgcctggccagaattttgactctaaaaggcgaattactgtacggaacctgagaatccgtgaggatatcgcgaaatacctgagaaatttggatcctaactcagcatactacgatcctaagacccgtgctatgcgggagaatccctatgcaaacgccggtaaaaaccctgacgaggtcagctatgccggagacaacttcgttcgctatacgggcgatacaatcagtatggcacaaacgcagctctttgcctgggaagcttacgacaagggctcagaggtgcacctccaagccgatcctacaaaactggaattactgtataaaagcttcaaggttaagaaagaagactttaaagagcagcaaaaggagagtatactagagaaatacggcggacaggagcatctcgatgctcctcccgcagaattgctgctggcgcaaactgaggactatgtagagtacagccggcacggtactgtgatcaagggccaggagcgcgcagttgcctgttccaagtatgaggaagacgtgaaaatacacaatcacacccacatatggggatcctactggaaggagggccgttgggggtacaagtgttgccattcttttttcaagtattcctattgcaccggcgaagcgggtaaagagatcgtgaactctgaagagtgtattataaacgagattacaggtgaagaaagcgtgaagaaaccgcagaccctgatggaattgcaccaggagaaactgaaagaggaaaagaagaagaagaaaaaaaaaaagaagaagcaccggaaatcgtccagtgattcagacgacgaggaaaagaaacacgagaagttaaaaaaagctcttaacgccgaggaggctagactccttcatgttaaagagaccatgcagatcgatgagagaaagaggccatacaatagcatgtatgaaacaagagagccaacagaggaagaaatggaagcatacagaatgaaacggcagcgccctgacgacccaatggccagcttcctgggacaatag

SEQ ID NO: 27751 - DNA, 1185 bp, Artificial Sequence
  Description of Artificial Sequence: Synthetic coding sequence
atggcgctggaggtgggagacatggaagatgggcagttatcggactccgactcagacatgacagttgcgccatcagatcggccactgcagttgcccaaagtgctgggcggagactcagcaatgagagcgttccaaaacaccgccaccgcttgtgccccagtttcacactacagagccgtggaaagcgtggactcatcagaggagtcttttagtgactcggacgatgattcttgcctgtggaagcgtaaacgccagaagtgttttaatccaccacccaaaccagaaccattccagttcgggcagtcttctcagaaacctccagtcgccggaggcaaaaagatcaacaatatttggggggctgtgttacaagaacagaatcaggacgccgtggcaaccgaacttggcattctgggaatggagggaacaatcgacagaagccgccagagcgagacctacaattaccttttggcaaagaaactgagaaaagaatcccaagaacacacgaaagacctcgacaaggaactggacgagtacatgcacggagggaagaagatgggctctaaggaggaggagaacggacaaggacatttaaaacgcaagcggcctgtgaaggacagattgggaaaccgtccggagatgaattacaaggggaggtatgaaattacggctgaggactctcaggagaaggtcgccgatgaaattagctttaggctgcaggaacctaagaaggacctgatagctagggtagtgagaatcattggcaataagaaggctattgagttgctgatggaaaccgctgaggtcgagcagaacggaggcctgtttatcatgaatggctcccgcagacggactccgggaggggtgttcctgaacctgctgaagaacaccccttcaatctctgaagaacagattaaagacattttttatattgagaatcagaaggaatatgagaacaaaaaggctgcaaggaaaaggcgtactcaggtcctcggaaagaagatgaaacaggcaatcaaatcgctgaacttccaggaggacgacgacacctccagggaaacatttgcctctgacactaacgaggccctggcgagcctcgacgaatcacaagaaggccacgccgaggctaagctggaagcagaggaggcgatcgaagtcgatcatagtcatgatctggatattttttag

SEQ ID NO: 27752 - DNA, 789 bp, Artificial Sequence
  Description of Artificial Sequence: Synthetic coding sequence
atgttcctgttttcccgtaaaaccaggactccaatcagtacatactctgactcatatcgcgctccaacctccattaaggaagtgtataaggatcccccattatgcgcttgggaggcgaacaagtttctaactcccggactcacccacacaatggaacgccacgttgacccagaggcacttcaaaagatggctaagtgtgcggtccaggattatacctatcgagggagcatttccggccatccctacttgccagagaagtattggttatcccaggaggaagcggacaaatgcagcccgaattatctggggagcgactggtataacacatggagaatggagccatataattcaagctgttgcaacaaatacaccacatatctccctcggctgcccaaagaagctagaatggagaccgccgttagaggcatgccactggagtgtccacccagacccgaaaggctgaatgcctacgagcgtgaggtgatggtgaacatgctgaactctctgtctcgcaatcagcagctcccgagaataaccccacgatgtggttgcgtagaccctcttcctggcaggctgcctttccacggctacgaaagcgcctgtagcggccgacactactgtctgaggggaatggattattatgcttccggtgcaccatgcacagacagaaggctgcgaccctggtgtcgggaacagcctacgatgtgtacgtctctccgcgctcccgcaagaaatgcagtgtgctgctataactccccagccgtgatactaccaatctcagagccctag

SEQ ID NO: 27753 - DNA, 4206 bp, Artificial Sequence
  Description of Artificial Sequence: Synthetic coding sequence
atggaagagattccagtaaaagtggcggtgaggatcagaccacttttgtgtaaggaggccctgcacaaccaccaagtgtgcgtacgagtaatccccaattctcaacaggtaattatagggcgagatagggtgtttacgtttgatttcgtcttcggaaagaacagcacccaggatgaggtctataatacatgtattaagccactcgtactgagcttgatcgaagggtataatgctacagtcttcgcctatgggcaaacgggctcaggaaagacgtacacaattgggggtggccatattgccagtgtggtcgagggccagaaggggattatcccaagggccattcaggagattttccagtcgatcagcgagcatccctctattgactttaacgtgaaggtcagctacatcgaagtgtacaaggaggatttgcgtgacctgcttgagctcgagacctccatgaaggaccttcacatccgtgaggacgaaaaagggaacactgtcatcgtgggcgctaaggaatgtcacgtagagtctgccggagaagtgatgtctttgctcgagatgggaaacgctgccaggcatacagggaccacacagatgaatgaacattcgtctcgatcacacgctattttcaccatcagtatctgtcaagtccacaaaaacatggaggccgctgaagatggttcctggtactcacccaggcatattgtgagcaagttccatttcgttgacctggctggcagtgagcgggtaaccaaaacaggtaacactggagagaggtttaaagagtctattcaaatcaattccggccttttagccctcggaaacgttattagcgccctgggtgatccccgacgcaagtctagccacatcccctatcgcgatgccaagattacacgactcctgaaagactcactgggcggttccgccaaaaccgtcatgattacttgcgtgtctccatcctctagcaattttgacgagtctttgaatagtctgaagtacgctaatcgcgcacggaacatccgcaacaagcctaccgtcaacttttcaccagagtcagacagaattgacgagatggagttcgagatcaaacttttacgggaggcactacagtcacagcaagctggagtgtcacaaactacgcagatcaatcgggaggggagccctgataccaatagaatccacagtctcgaggagcaggtggcgcaactacagggagagtgtttgggataccaatgctgtgtagaggaggcttttactttcctggtggacttaaaggatactgtgaggctaaacgaaaaacagcagcacaaactgcaggagtggttcaatatgatccaggaggttcgaaaggcagtgctgacctcttttagggggattggaggcaccgcttcactagaagaggggcctcagcatgtgactgtgctgcagctgaagcgcgaactaaaaaagtgccagtgtgtgctggcagccgatgaagtcgtcttcaaccagaaggaactcgaagtgaaggaactgaagaatcaggttcagatgatggtccaggagaacaagggccacgcagtttctctaaaggaagcccaaaaagtcaatagattacaaaacgaaaaaattattgagcagcagttactggtggatcagctgtcagaagagctgacgaagctgaacctctcagtaacaagctctgccaaggagaactgcggggacggcccagatgccaggatcccagaacgaaggccctacactgtcccctttgatacacacctgggacactacatctacataccttctaggcaggattctcgaaaagtccacacatctccaccgatgtattccctggaccggattttcgcaggatttagaactaggagccaaatgttgcttggccatatcgaagagcaagacaaggtattacactgccagttttctgacaattctgatgacgaagaaagcgaggggcaggagaaatctgggactagatgccggagtcgatcctggatccagaaacccgatagcgtttgctcattggtcgaattgtctgacacgcaggatgaaacccaaaagtcggaccttgagaacgaagacctaaaaatcgactgtctgcaggagtcacaagagctaaacctgcagaagctgaagaatagcgagaggatcctcacggaagccaagcagaagatgagagagctgacaattaatattaagatgaaggaggacctgattaaggagctaatcaagaccgggaacgatgcgaagagtgtcagcaagcaatactcactgaaagtcaccaaactggagcatgacgccgagcaagccaaagtcgagttgatcgagactcaaaaacaattacaagagcttgaaaacaaggacctaagtgatgtagccatgaaagtgaagctccaaaaggaattcaggaagaagatggatgccgctaagctgcgggtgcaggtgctgcagaaaaagcagcaggactctaaaaagctcgctagtttgagcatccagaacgaaaaacgcgcaaacgaactcgagcagtcagttgaccatatgaagtaccaaaaaatccaactgcagagaaaactccgtgaagaaaatgagaagcgcaaacagctcgacgctgtgatcaagagggaccagcaaaaaatcaaggagattcagctgaaaaccggtcaggaggaagggctgaagccaaaggccgaggaccttgacgcatgtaatcttaagcgtcgaaaaggcagctttgggtctatcgatcatctccagaaactggacgaacagaagaagtggttagatgaggaggtcgaaaaggtactaaaccagcgacaggagctggaggagctggaggccgacctcaagaagcgcgaagccatagtgtccaaaaaggaggccttgctgcaggagaagtcacacctggagaataaaaaactgaggtccagccaggccctgaatacagacagcctgaagatctccacacggttaaacttgctggagcaagaattgtcagaaaaaaacgtccagctgcagacgtctaccgccgaggaaaagacgaaaatttccgaacaagtagaagtcctgcagaaagaaaaagaccagttgcagaaacgcaggcataacgtggatgaaaagctgaagaatggtagagtgctgtctcccgaggaggaacacgtactgtttcaacttgaggaggggatcgaggccttggaggctgcaattgagtatagaaatgagtcgatccagaaccgacaaaagtccctgcgcgctagtttccacaatttgagccgaggcgaggcgaatgtccttgaaaagttggcctgtctgtctcctgtggaaatccgcacaatactattcaggtacttcaataaggtcgtgaacctgcgggaggccgaaagaaaacagcagttgtacaatgaagaaatgaaaatgaaagtcctggaacgcgacaacatggtccgagaattggagtcagcactggatcacctcaagcttcagtgcgaccgacgactcacactgcaacagaaagaacacgagcagaagatgcagctgttactccaccattttaaggagcaggatggagaagggatcatggagacgtttaagacgtacgaagataagattcagcagcttgaaaaggatttatatttctataagaagacttcccgggaccacaagaagaagctgaaggaactggtgggggaggctatccgcaggcagctggccccttctgaatatcaggaagctggagatggggtgctgaaacccgagggtgggggaatgctgagtgaggaactgaagtgggcctccaggcctgagagtatgaaactgtcaggcagggaaagagaaatggactcctcagcgagttccctgcgaacacagcctaatccgcagaagctgtgggaggatattcctgaactgccccctatacactcatctctagctccccctagcggccacatgctcggcaacgaaaacaaaacagagacggacgacaatcaattcaccaagtcccactccaggctatccagtcaaatccaggtggtgggcaatgtcggaagactgcacggggtcacccctgtgaagctgtgcaggaaggaacttcggcagatctcagcattagaacttagcctgcggaggagcagcctcggagtggggattggttccatggccgctgattcaattgaggtgtccagaaaaccacgcgacttgaagacatag

SEQ ID NO: 27754 - DNA, 768 bp, Artificial Sequence
  Description of Artificial Sequence: Synthetic coding sequence
atggtcaagggagaaaagggtcctaaaggcaagaaaatcacgctgaaggtagcgcgtaactgtatcaaaatcacgtttgatggaaagaagaggctagatctgagcaagatgggcattacaaccttcccaaagtgtatcttgagattgtcagacatggatgaactggaccttagtagaaatttaattcgcaaaattccagacagtatctctaaatttcagaacttgcgctggcttgacctgcatagcaactatatcgacaagctccccgagagtatcggccagatgacctctctcctttatcttaatgtatcaaataaccgcctcacgtcaaacggattgcccgtggaactgaagcagctaaaaaacattcgcgctgtgaaccttggactcaatcatctggactccgtgccgactactctcggagctttgaaagaacttcacgaagttggactccatgacaatctgctgaataacattcctgtttctatcagcaaactccccaagctgaagaagctgaacattaagcgcaacccgttccccaagcccggagagtctgaaattttcattgactctatcaggcggctcgagaatctctatgtagtggaggaaaaggacctctgtgccgcatgtctgcggaagtgtcaaaacgctcgcgataacttaaaccggattaagaatatggcaactaccacacctagaaagactattttccccaatctcatcagtcctaactctatggccaaagattcttgggaggattggaggtag

SEQ ID NO: 27755 - DNA, 645 bp, Artificial Sequence
  Description of Artificial Sequence: Synthetic coding sequence
atgggaaggcggcctgctcgctgttacaggtattgtaaaaacaaaccctatcctaaatctaggttttgccggggagtccctgatgcgaagatccgcatcttcgatttaggcaggaagaaggctaaggtggatgaatttccgctgggaggtcatatggtcagtgatgaatacgaacagctttccagcgaagctctggaagcagctagaatttgtgctaacaagtacatggtgaagtcatgtgggcgtgacggcttccacatgcgggtgaggttgcacccgtttcatgtgatccgtatcaacaagatgctgtcctgcgcaggtgcagatcgcctgcagaccgggatgaggggcgcattcggcaagccccaaggaacagtggcgagggtgcacataggccaggtaattatgagcatccgaaccaagttacagaatgaggagcacgtgatagaagccctgaggagagctaagttcaaatttcccggacggcagaaaatccatatttcaaaaaaatggggtttcacaaaattcaatgccgacgaattcgaggatatggtcgctaaaaaatgtcttattcctgatggatgtggcgtaaagtacgttccgagtcatggcccactggacaaatggagggtgcttcactcatag

SEQ ID NO: 27756 - DNA, 3231 bp, Artificial Sequence
  Description of Artificial Sequence: Synthetic coding sequence
atgaaatcgaggttttcaacaatcgacctgcgcgcagttctcgccgagcttaacgcctccctgttgggcatgagagtgaataatgtgtatgacgtagataacaaaacatatctgatcagactccagaagccagacttcaaggccacactgctgctggagtccgggattaggattcatacaacagagtttgagtggcctaaaaacatgatgccatcatcgttcgcgatgaagtgcaggaaacatcttaagtctcgtaggctcgtctcagctaagcagcttggggttgatcggattgtcgactttcaattcggctcagacgaggccgcatatcatctgattatcgagttatacgaccgaggaaacatcgttctgaccgactatgagtacgttattctcaacatcctacggtttcggacagacgaagcagatgatgttaagtttgcagtgagggaaaggtacccacttgaccacgcaagagctgctgagccattgcttacattagaaagactgactgagattgtggcctccgctcctaagggcgagctgcttaaacgcgtattaaacccgctgttaccttatggtcccgctctcatcgagcactgtttactcgagaatgggttctcgggcaatgtgaaggtggatgaaaagctggaaaccaaggacatcgagaaggtgctggtgtctctgcagaaggccgaggactacatgaagactacaagtaatttcagcgggaaagggtatatcatccagaaaagggaaatcaagccctcactggaggccgataaacccgtggaggacattcttacatatgaagagtttcacccttttctgttttctcagcactctcagtgcccgtacattgaatttgagagcttcgacaaggctgttgacgaattctattccaagatagagggccagaagattgatctcaaagccctacagcaggaaaaacaggccctcaaaaaacttgacaacgtcaggaaggaccacgaaaataggctcgaggcactccagcaagcccaggagatcgacaaactaaaaggagaactcattgagatgaacctgcagatcgtggatcgcgctatccaggtggtcagatcagctctggccaaccaaattgattggactgaaatcggacttatcgtgaaggaggctcaagcccagggcgaccctgttgcctccgcgatcaaggagctgaaactgcagacaaaccacgttacgatgttattgcggaacccatatctgttgtcagaggaggaggatgatgacgtagacggagatgtgaacgttgaaaagaatgaaactgaaccaccgaaggggaaaaagaaaaagcaaaaaaataaacagctgcaaaaaccccaaaaaaataagccactgttggtcgatgttgacctgagcctttccgcctacgccaacgcgaagaaatattatgaccacaaaaggtatgcggctaaaaaaactcagaagacagtggaggcagccgaaaaggccttcaagagtgccgagaaaaaaaccaaacaaaccctgaaagaagttcagacggtgacgagtattcagaaggctaggaaggtttattggttcgagaagttcctgtggtttatctctagtgagaactatctgatcattgggggaagggatcagcagcaaaacgagattatagtcaaaaggtaccttacgcctggggacatatacgtccacgctgacctgcatggagccacctcttgtgtgatcaaaaatcccacgggtgagccaattccccctcgcactctaacagaagcgggaactatggcactctgctatagcgctgcctgggacgcaagagttattacctctgcttggtgggtttaccaccaccaggtgagtaagactgccccaactggtgaatacctgacaacgggcagcttcatgatcaggggcaaaaaaaatttcttaccacctagttacctgatgatgggcttttccttcttgtttaaggtggacgagtcgtgtgtctggaggcaccagggggaacgaaaagtgagagtgcaagacgaagatatggagacccttgccagctgtacgtcagaactgatttcagaagaaatggagcagctagacgggggagataccagctcggatgaggataaggaagagcatgagacccccgtggaggtggagctcatgacacaggtcgaccaggaagatattactcttcagtctggcagggatgaactgaacgaggagctgatccaggaggaaagctctgaggacgagggggagtacgaggaagtacggaaagatcaagacagcgttggtgaaatgaaggacgaaggtgaggagactctcaattacccagacaccacaattgatctaagccatttgcaaccgcaacgatcaattcagaagctggcttccaaggaagagtccagcaatagcagcgactcgaagtcacagtcccggagacacctttcagctaaggagaggagagaaatgaagaagaagaaattgccatcagactccggcgacctggaggcactagagggcaaggataaagagaaggagagcaccgtgcatatcgaaacacaccaaaatacgagcaaaaatgtggccgctgtacagccaatgaagcggggtcaaaaatccaaaatgaagaagatgaaagagaagtacaaagaccaggatgaagaggaccgggagctcatcatgaagctgcttgggtctgcgggaagtaataaagaagaaaaaggtaaaaagggaaaaaaaggcaaaacaaaagatgagccggtgaagaaacagccacaaaagcctaggggaggccagcgcgtgagcgataatattaaaaaggaaacgccatttctcgaagtgatcacccacgagcttcaggatttcgcggtagatgatccccatgacgacaaggaggagcaggatctggatcaacaggggaatgaagagaacctatttgattctctgactggccaaccccaccctgaagatgtgctgttgttcgcaatcccaatctgcgcaccgtatactacaatgaccaactacaagtacaaggttaaacttacaccgggagtgcaaaagaagggaaaggccgctaagactgctctgaatagttttatgcactccaaggaagccacagcaagggagaaggacctattcagatctgtcaaggacacagacctgtcaagaaatatccctggtaaggtcaaggtgtccgctcctaacctgctgaatgtgaagcgcaaatag

SEQ ID NO: 27757 - DNA, 963 bp, Artificial Sequence
  Description of Artificial Sequence: Synthetic coding sequence
atgggagatatcccagcggttggcctgagttcttggaaggccagccccggaaaagtgactgaggccgtgaaagaggcgatcgatgccggatataggcatttcgattgtgcctacttctaccataacgaacgcgaggttggcgctgggatcagatgtaaaatcaaagaaggggcagttaggcgtgaagacctgtttattgctactaagctatggtgcacatgccataaaaagagcctagtagaaacagcctgtagaaagtcacttaaagcattgaagctaaactacctggatttgtaccttattcattggcccatgggcttcaagcctcctcatccggagtggattatgtcctgcagcgaattgagcttctgtctctcacatccacgggttcaggacctgcccctggatgaatctaatatggttattccatccgacaccgattttctggacacatgggaggcaatggaggacctcgtgataacaggactggttaaaaacattggtgttagcaacttcaaccacgagcagctggagcgcctccttaataagcctggattgagatttaagcctttaaccaatcagattgagtgccatccctatctcacccagaaaaacctgatctccttctgccagtcacgggacgtgtcagtcactgcatatcggccattgggaggaagctgcgagggcgtcgacctgattgacaatcccgtaatcaagagaatagccaaagagcatggaaagagtccagcccagatccttatcagattccagatacagaggaatgtcattgttattccaggctcaataacgccttcccacattaaggagaatatccaggtgtttgattttgaattgacacagcatgacatggacaatattctgtccctgaataggaaccttcggttagccatgttccccattacaaagaatcacaaggattacccatttcacattgagtattag

SEQ ID NO: 27758 - DNA, 1239 bp, Artificial Sequence
  Description of Artificial Sequence: Synthetic coding sequence
atgagcggctaccagcgacgccctggagctaccccactgtctcgcgctcgttcccttgctatccccgacgctccagcgttctatgaacgacggtcttgcctgcctcagttgaattgtgagcggcctcacggacgcgatctggatagccccttttttggcattcggcctgccttcatgtgttatgttccaagcccagtgctggcatcggtcggcgacaccgatgatcggtttgaggacctcgaagaagccaacccttttagtttcagagaattcttaaagactaaaaatctgggactgagcaaggaggatcccgctagcagaatatacgctaaagaggcaagtcggcactctctgggtctagatcataacagcccccctagccagaccggaggctacgggttagagtaccaacagcccttctttgaagacccaaccggggctggcgacctgctggatgaggaagaagacgaggatacgggctggtctggagcgtacctaccaagtgccatcgagcagacgcaccctgagcgcgttccagccggtacctccccttgctcaacctacctttcctttttttcaacaccttcagagctggctgggccagagagcctgccttcttgggctttgtccgacacagactccagagtgtcccctgctagtcccgcaggatcaccttctgcggattttgccgtgcatggcgagagcctgggcgaccgccacctcaggactctccagattagctatgacgcactcaaggacgaaaattccaaactgcggaggaaactgaatgaagttcagagtttctctgaagcacagacagaaatggtgaggacactcgaaaggaaattagaggcaaagatgatcaaggaagagagtgactaccacgatctcgaatcggtagtgcaacaggtggagcagaatctcgaactaatgactaagagggcagtgaaagcggaaaaccatgtcgtgaagctcaagcaagagatcagcctattgcaggcccaggtcagtaattttcagagggagaatgaggcactgaggtgtggccagggagctagtcttactgtggtgaaacaaaacgcagatgtggccttgcaaaacctgcgcgtggtgatgaattccgcccaggctagcatcaagcaacttgtgagcggggctgagactttgaatcttgtggccgagattctcaaaagcatcgatagaataagcgaggtcaaggacgaagaagaggattcctag

SEQ ID NO: 27759 - DNA, 1440 bp, Artificial Sequence
  Description of Artificial Sequence: Synthetic coding sequence
atggacgcaacgatagcaccacatcggatacccccagaaatgccacagtatggggaggagaatcacatctttgagctgatgcagaatatgcttgagcagctgctcattcatcaacccgaagatccaataccatttatgatccagcacctccacagggataatgacaatgtgccccgaattgttatccttggtcctccagcctcaggtaaaacgactatcgcgatgtggctgtgcaaacatcttaacagcagcctgcttacactggagaatctcattttaaacgagttcagctatacggctaccgaagccagaaggctctatctgcagagaaagaccgtcccctcagccttattagttcaattgattcaggagcggttggcggaggaagattgcattaaacagggttggattttggacggtattcccgagactcgggaacaagctctgcggatccagaccctaggaatcacacccaggcacgttatcgtgctgagtgcacctgatacggtgttgatcgagagaaatctcggcaaaagaatcgacccacaaaccggtgaaatataccacacaaccttcgattggcctcccgaatctgaaattcagaatagattaatggttcctgaagatataagcgaactcgaaaccgcacaaaaacttctggaataccataggaatattgtgcgcgtgattccttcctaccccaagatccttaaagttatctctgccgaccagccgtgcgtggatgttttttaccaggccctgacctacgtgcaaagcaatcacaggactaatgcaccatttactccgagggtactcctcctggggcctgtggggagcggaaaatccttgcaggctgctttactggcccagaagtataggctggtgaatgtgtgctgcgggcagctgctgaaggaggcagtggccgaccgcaccactttcggcgaattgatccagccgtttttcgagaaagaaatggctgtcccggatagtctcctcatgaaagtgcttagtcagagactagatcaacaggactgtatacagaaaggatgggtcttacatggggtgcccagagacctcgaccaggctcacctcctcaataggctcggctacaatccaaacagagtgttttttctgaacgtcccattcgactccatcatggagagattgacactgcgtcggattgatcctgtaaccggcgagcggtaccacctaatgtataagccacctcctaccatggaaattcaagccagacttctccagaatccaaaagatgctgaggaacaagtgaagctgaagatggacttgttttaccgcaacagcgcagacctggaacagctttacggtagtgctattacgctcaatggtgatcaggacccttataccgtgtttgaatatatcgaatctgggatcatcaatccactgcctaagaaaatcccatag

SEQ ID NO: 27760 - DNA, 432 bp, Artificial Sequence
  Description of Artificial Sequence: Synthetic coding sequence
atggcacatgaaatgataggaacgcaaattgtaacagagcgcctggtggccctgctagagtctggcaccgaaaaggtgttgctaattgacagccggcctttcgtagagtataacacctcccatattctggaggccattaatattaactgctcaaaattaatgaaaaggagattacagcaagataaggtacttattactgagttgatccagcatagtgccaagcataaagtcgacattgattgtagtcaaaaggtggttgtttacgaccagagttctcaagacgtggccagcctcagttctgattgcttcctgacagttcttctcggtaagttagaaaaatccttcaacagcgtgcatttattggctggcgcagatgccgcagagtgggactggctgtgcgtgaaatgtcaacagtatctgagcaaggcatag

SEQ ID NO: 27761 - DNA, 1191 bp, Artificial Sequence
  Description of Artificial Sequence: Synthetic coding sequence
atggctagcctgagtcgggcactaagagtcgcagcagcccatccaaggcagtcaccgactagaggcatgggcccttgcaacctgagctccgccgcaggaccaacagccgagaagtccgtgccctaccaacgtaccctcaaggagggacagggaacctctgtcgtggcacaaggtccttcgcggccacttccatcaactgccaacgtggtcgtcatcggcggtggaagcctagggtgtcagaccttatatcatctggccaaactgggcatgagtggtgccgtgctgttagagcgtgagagactgacgtctggcaccacctggcacactgccggtctcctgtggcagcttagacctagcgatgttgaggttgagcttctggcccatacaagaagggtggtgagccgcgagctggaggaagagacaggcctgcatactggatggatccagaacggagggctgtttatcgcctccaaccgtcagcgcctagacgagtataagagactgatgagcctcgggaaagcctacggagtggaatcccacgttctgtctcctgcggagaccaagactctgtaccccttgatgaatgtcgacgatctctatggcaccctatatgtgcctcatgatggcacgatggacccagccggtacctgtaccaccctggcaagagccgcttctgcccgtggagctcaggtgatcgaaaactgccccgtgacgggaattcgggtatggaccgacgatttcggcgtgcggagagttgctggagtcgaaacacagcatgggagcattcaaacaccttgtgttgtaaattgcgctggggtctgggcatctgcagtcggaaggatggcgggagttaaagtgcctctcgtggccatgcaccacgcctatgtcgtcacagaacgaatcgaggggattcagagcttcactctcttacccacactggaatattcaggcaccgtcagcgcccactgcaacttaaggcttcctggatccagtaatagtcgcgctagtgccagccacgtggcaggcattaagtgcgcgaggcaccatacccgcctaattttcttctgcattctggtggaaaccgaattccatcatgtggccaaggccggattggaactgctctcgtcaggaaaccctcctatctctgattttcagtctgctcgcattacaggcgtgtctcaccacgcctag

SEQ ID NO: 27762 - DNA, 4416 bp, Artificial Sequence
  Description of Artificial Sequence: Synthetic coding sequence
atggaacccgaacccgtggaggactgcgtacaaagcactctggctgctctgtatccacccttcgaagccactgccccaaccctccttggccaggtgttccaggtggtcgagagaacttaccgcgaggatgcgctgcggtacacccttgattttctggtgcctgccaagcacctcctggccaaagtgcagcaggaggcttgcgcccagtattcgggattcctcttcttccacgaaggatggcctttatgcctgcacgaacaggtagtggtacagctcgcggcactcccctggcagttactccgcccaggagacttttacctgcaggtagttccttcagcagcccaagcccctaggctagccctgaagtgcctggcacccggtggcggtcgcgtccaagaggtgccagtccccaacgaggcatgtgcctatctcttcacccccgaatggctgcagggaattaataaggataggccaactggtcgccttagtacatgcctcctgtccgctcctagtggcattcagcggttgccgtgggccgagttgatctgtcccaggttcgttcataaagaaggcttgatggtcggacaccagccctctaccctgcctcccgaacttccatccggaccaccaggtttgccctctccgccactgccagaggaggcactcgggacaaggagtcccggtgatgggcacaacgcacctgtcgagggacctgaaggcgagtacgtggagctgctcgaggtcactctcccggtgcggggttcacccacggacgctgaaggaagccctgggctgagcagagtgcgcaccgttcctacaagaaaaggagccggagggaaaggccgtcaccgcaggcaccgagcctggatgcatcagaaaggcctaggtccaagaggtcaggacggcgcaagaccgccaggggaggggagctcaactggtgcaagcccggaatcacctccaggcgctgaagccgtacccgaagctgctgtgctggaggtctctgagccccctgcagaggccgtaggcgaagccagcggttcatgcccactgaggcctggagaactccgaggtggcggtggaggcggacagggggctgagggcccaccgggtacgcccagaaggacaggaaaaggtaatcggaggaaaaagcgcgctgccggtagaggagcgctgtctaggggaggcgattcagctccgctttccccaggtgataaggaggacgctagccatcaggaggctctgggaaatttgcccagtccatcagagcataaacttcctgagtgtcacctggtgaaggaggagtatgaaggctcgggaaaaccagagagcgaacccaaggaactgaaaaccgccggtgagaaagagcctcaattgtcagaagcctgcggacctaccgaggagggagccggagaacgagaactggagggcccaggactcctgtgtatggcaggacatactggccctgaaggtccactctcagatacgcctactccccctctggagactgtccaggagggaaaaggagataatattcccgaggaggcgttggctgtgtccgtgtcagaccaccccgacgtggcctgggaccttatggcctccggattcctgatcctcacgggaggagttgaccagtccggaagagcccttctcaccatcacccccccttgtcccccagaagagccgccaccctcccgggacaccctaaataccacattacattacctgcacagtcttctccgacccgatctgcaaactctaggcctgagcgtgctgctggacctgaggcaagccccaccattgcccccagcccttattcctgccctgtctcagcttcaggactccggcgacccccctcttgtgcagcgactcttgatcctcatccacgatgacctgcctacagagctatgtggcttccagggcgctgaggtgctctcagagaacgatctgaaaagagtcgcgaagcctgaagagctgcagtgggagctggggggacacagggacccgtcaccctcccactgggtcgaaattcaccaagaagttgtccgactgtgtcgcctgtgccagggcgtgctaggctctgtgcgacaggccatcgaggagctggagggagctgccgagcctgaagaggaggaggccgtcggaatgccaaagcctctacagaaagtgctggctgacccgagactcactgccctccagagagatggaggtgccatactaatgcggctgaggtctactcccagctctaaattggaaggacaggggcctgctacactgtatcaagaagttgacgaggcaatccaccaactagtccgactgagtaacctccatgtgcagcaacaggaacagcgtcaatgcttgagacgactgcagcaggtcctgcagtggttgtcaggacccggagaggagcaactcgcaagcttcgctatgccaggagataccctgtccgcccttcaggaaacagaacttcggtttagagcctttagcgccgaggttcaagagaggctggctcaggcaagagaggctctggcattagaggagaacgccacctctcagaaagtgcttgatatcttcgagcagagactggagcaggtcgaaagcggactgcacagagccctccgcctccaacgcttttttcagcaagcacacgaatgggtggacgagggctttgcgagacttgcaggcgcaggacccggaagggaggcggtcctggcagcactagcactccgacgcgcacctgaaccatcagccggaacgttccaggagatgagggccctcgcactggacctgggaagcccggctgccctgcgggagtggggtaggtgccaggctcgctgccaagaactggagcgtaggatacagcaacatgtgggggaggaggcctctccacgtggttaccgcagacgaagggctgatggcgctagctccggaggcgctcaatggggcccaaggtccccttcgccgagcttgtcatctctcctgctcccctcgagtcccggtcctagaccagcgccatctcactgctcccttgccccttgcggggaagattatgaggaggagggccctgaactggctcctgaggccgaagggagacctccccgagccgtgctcatcagaggactggaggttactagcaccgaggtggttgataggacctgcagccccagggagcacgtcttactcggccgagcccgtgggcctgatgggccttggggcgttggcacccctcgtatggaaaggaagagatcgatcagtgcccagcagcgtttggtgtctgagctgatcgcatgtgagcaggattatgtggcgactttgtccgaaccagtacctccccctggacccgagctcactcctgagctgcgcggaacctgggccgctgcactttctgccagggagcggttgcgctccttccatcgcacacacttcttgcgggagctgcaaggctgtgcaacacacccgctcagaataggcgcttgctttctgcggcacggagaccagttcagcttatacgcccaatacgtcaagcaccgccacaagctggagaatggcttggccgctctgagtcccctgtccaaaggctctatggaggccggtccttacttaccacgggctttacaacaacccctggagcagctgacgcgttatggtcgccttctggaagagcttttgcgggaggccggacctgaactgagctccgaatgcagagccctcggcgctgcggtgcagctcctcagagagcaggaggcccgtggacgggatctgcttgcagttgaggcagtgcggggatgcgaaatcgacttgaaggaacagggacagttgttgcacagggacccctttactgttatctgcggaaggaaaaagtgtctgagacacgtcttcctgttcgaacatctgctgctgttctccaagctaaagggcccagagggaggatcggagatgtttgtatacaagcaggcattcaagactgcagacatgggccttaccgaaaacatcggcgattcagggctgtgtttcgagctctggttccggagacgacgggcacgggaagcgtataccctccaggctaccagtccagaaatcaaactcaagtggacatcttcaatcgcccagctgctatggaggcaagccgctcacaacaaagagctgagagtccagcagatggtatcaatgggcatcgggaacaagcccttcttggatattaaggcactgggcgaaaggaccctctccgctttgctgaccgggagagcgccagaaaccctggatagctcaggggatgtctcacccggacctcggaattcaccgtctttacagccgccacatcctggttcctcaactccaacactggctagccggggaattctcgggctgtccagacagagccatgcacgggctctctccgatccgactaccccattgtag

SEQ ID NO: 27763 - DNA, 4560 bp, Artificial Sequence
  Description of Artificial Sequence: Synthetic coding sequence
atggaaccggagcccgtggaagattgcgtgcagtccactctggccgctctgtatccacccttcgaggcaaccgccccaaccctgcttgggcaagttttccaggtggtcgagcgaacctaccgcgaggacgctttgcgttacactctagactttctggttcccgctaaacacctgctggcgaaagtgcagcaggaagcctgtgcacagtattccgggttcttatttttccacgaaggctggcccctgtgcttacacgaacaagtcgttgtgcagttggccgcattaccatggcagctgctcagaccgggagacttttatttacaggtcgtgccctccgcagctcaagcgccacgcctagccttaaaatgtctcgcccctggaggcggaagggtacaggaggttcccgtgccaaatgaagcctgtgcatatctgtttacacccgaatggcttcagggtatcaacaaggatcgaccgaccggtcgactgtccacctgtctgctgagcgcaccgtccggcattcagcgacttccctgggctgaattgatctgtccacgttttgtccacaaggaaggccttatggttggccatcagccaagtaccctgcctcctgaactgccatcaggcccacctggtctcccatcacccccactgccagaggaagcactgggaacccgctctcccggtgacggccacaatgcacctgtggagggcccagagggggagtacgttgagctgctcgaggtcactcttcctgttcgcggatctcctacagatgccgagggatcccccggattatcgcgcgtgaggactgtaccaacgcggaagggggcaggtggtaagggccgacatcgtcgacaccgagcctggatgcaccagaaaggtttgggcccacgcggacaggatggagccaggcctccaggtgaaggttcctctaccggcgcatcccccgagtctccaccaggagcagaagcggttccagaagcagctgtcctggaggtgtcagagccacccgctgaggccgttggagaggctagtgggagttgtcccctgcgccctggcgaactgcggggagggggaggcggtggtcagggagccgagggacccccaggcactccgagacggacagggaaggggaatcggagaaagaaacgggctgctggcagaggcgcactcagcagagggggagattctgcacccctttctccaggggataaggaagatgcgagccatcaagaggcactgggtaacttgccaagcccctcagagcataagcttcctgagtgtcatctggtaaaggaagagtacgagggctccggcaagccggagtccgagccaaaggagcttaaaacagcaggcgagaaagagcctcaactcagcgaagcttgcgggcctactgaggaaggcgcaggagaacgcgagttagaaggtcccggtctgctttgtatggctggccacacaggccctgagggaccgctgagtgacaccccaactcccccactggagactgttcaagaaggaaagggcgataacatccctgaagaggccctcgccgtgagtgtatccgatcatcctgacgtggcctgggacctcatggcatccggttttttaatccttacagggggtgttgatcaatctggtagggctctcctgaccataaccccgccatgtccacccgaagagccaccaccctccagggacactttaaataccacattgcactatcttcattccctgctgcggccagatttacaaacgcttggactgtcggtgctgttggacctgaggcaagcccctccactgccgccagcactcattcctgctctctcacagttacaagactctggcgatcctccccttgtccagagattacttatcctcatacacgatgatctccctacagagctttgcggcttccagggcgcagaggtgctgagcgaaaacgatctgaaacgtgtggctaaacctgaagagctgcaatgggaacttggtgggcaccgcgacccttccccgtcacactgggtggagatacatcaggaggttgtgagactttgccggctctgtcaaggagtactgggtagcgtgagacaggctattgaggaactggagggtgccgctgagccagaggaggaggaagccgtgggcatgcccaaaccgctgcagaaggtgttggcagaccctcggctcaccgcgctgcagagggatggtggcgctattcttatgaggctcagatccacccccagcagcaaactggagggccagggcccagctaccctttaccaggaggtggatgaagccatacatcaattggtgcgcctcagcaatctccatgtgcagcaacaggagcaacggcagtgcctgcggagactacagcaggtacttcagtggcttagcggtcctggggaagaacaactcgcgtcattcgcgatgcccggagatacactctccgcccttcaggagaccgagctgcgcttccgggctttctctgccgaggtgcaggagagacttgcccaagcccgagaggcactggccctggaggaaaatgcgacctcccagaaagttctggatatctttgagcagcgattagagcaagttgaaagtggactgcaccgcgcacttcggcttcagcggttcttccagcaagcccatgaatgggtggatgaaggctttgccaggctcgccggtgccggtccaggaagggaagcagttctagcggcactcgccctgcgacgagcccctgaacccagtgcagggacatttcaagagatgagggccttggcattggatctcgggagcccagcagcattgagggagtggggacgttgccaggcacggtgccaggagttagagagacggatccagcaacacgtcggagaggaggctagccctagggggtaccgaaggaggagggctgatggtgccagctccggcggagcccagtggggccctcgaagtccctcaccttccttaagcagcctgttgctgccctcttccccaggccctaggcctgctccgagccactgtagcctggcgccatgtggcgaagactatgaggaagagggccctgaactcgctccagaagctgagggacgaccccctcgggctgtgttgattcggggtctcgaggtaactagtactgaagtggtcgatcgtacctgcagccctagggagcacgtactattagggcgagcccgaggcccagacggaccatggggtgtagggacgccacgaatggagaggaagcggtccatctcagcacaacagcggctcgttagcgaacttatcgcctgcgagcaggactacgtcgccaccctctctgaaccagtgccaccccctggaccggaactgactcctgagctcagggggacttgggctgctgctttaagcgctcgggagcgcctccgcagttttcaccggacacatttcttgagggagctgcaagggtgcgccacccaccccctcaggattggggcttgctttttaaggcacggggaccagtttagcctatacgcacagtatgtcaagcaccgccacaaattggagaacggactcgctgccctgtctcctctaagtaagggaagtatggaggcaggcccatacctgccgcgagcccttcaacagccacttgagcagcttactcgttacggaagattacttgaggaactgcttcgagaggccggacctgaactgtcctccgagtgtagggccctaggggctgcagttcaactgctccgagaacaagaggccagaggtagagatctgttggcagtggaggcagtccgcggttgcgaaatcgacctcaaggagcaaggccagttgctacaccgagacccattcacagtgatctgcgggcgtaagaaatgcttgcggcacgtatttctcttcgagcacctgctgctgttttcgaagctgaaggggcctgaagggggatccgaaatgttcgtgtacaagcaagccttcaagactgccgacatggggctgaccgagaacatcggcgacagcgggctgtgcttcgagctctggtttcggaggaggcgcgcacgagaagcctatactcttcaggccaccagccccgagattaagctgaagtggaccagcagcatcgctcagttgctttggcgtcaagctgcccataacaaggaactgcgggtacagcagatggtgtcaatgggcattggcaacaaaccgttcctggacataaaagccctcggcgaaagaactctgtccgccctcctgacagggagggccgctcgtacccgtgcctctgtggcagtctcctcttttgagcacgctggcccttcgcttccgggactaagtcccggagcatgctctctcccagcccgagtggaggaagaggcctgggatcttgatgttaagcagatcagcctggctcctgagacacttgactctagtggcgacgtctcaccaggtccgaggaatagcccaagcctccagcccccacatccgggttcatctacccctaccctggcttcgagggggattctgggcctgagtcgccagtcacacgccagggccttgtctgatcctacgacaccactgtag

SEQ ID NO: 27764 - DNA, 2709 bp, Artificial Sequence
  Description of Artificial Sequence: Synthetic coding sequence
atgtttcccgctctcgaaactcatttgaaacagaccataccggatccctatgaggatttcatgtacaggcacctgcagtactatgggtatttcaaagcacaaagaggctctctccctaattccgctactcaccaacatgttaggaagaacaatccccagtgtctgttgaacggtagcctaggagagaaggacgatcttatcccagacacactgcagaaggagaagttgctttggcccatctctctgtctagtgctgtgcaccgacagattgaagcaattaaccgcgatttccacagctgtcttggctggatgcagtggaggggtttgtccagtcttcagccccctccacccagattcaaggactcaccagcctcagcatttcgggtggcagggataactgatagccacatgctatccctgccgcacctgcggtctagacagctgctgtacgatgagcttgacgaagtgaacccacgactgagggaaccccaagagctgttttctatcctgtctacaaagagaccgttgcaggctccacgctggcccattgaatgtgaggtgatcaaagaaaacattcatcatatcgagtgggcccctccacagccagagtatttttatcaaccaaagggaaacgaaaaggtccctgagattgttggagagaagaagggtacagtggtatatcagttagattcagttccgattgaaggcagttacttcaccagctccagagttggcggtaagcgcggaatcgtcaaagagctcgcagtgacactccagggccctgaggataacacacttctgtttgagtccaggttcgaatctgggaacctgcagaaagcggtccgggtggatacctatgagtatgagttgactttacgaacggatctatacaccaacaaacacacgcagtggttttattttagggtgcagaatacacggaaggacgctacttaccgttttacaatcgtgaatctgcttaaacccaagagtctctacaccgtgggcatgaaaccccttttatacagccaactggatgccaatacaagaaatatcggatggcggagagaaggaaacgaaatcaagtactacaagaacaatacagatgacggccagcagcctttttattgcctgacttggacaattcagttcccctacgaccaggatacttgcttttttgcccatttttacccgtatacttacacagacctgcagtgttatctcctgtccgttgcaaacaatccaatccagagtcagttctgcaagctccagactttgtgccgatcactggctggcaacactgtgtatctgctcacgattaccaatccttctcagaccccacaggaggcagctgcaaagaaagctgtggtcctcagcgctagggtccatccaggagaaagcaacggaagctgggttatgaaaggattcctggactttatcctgtctaatagtcccgatgctcagctgctccgagacatattcgtttttaaagtgcttccaatgcttaaccctgatggggtgatcgtgggtaattacagatgcagcctggcgggacgcgatctgaatagacactataagacgatcctgaaggaaagcttcccatgtatatggtacacaaggaatatgattaagaggctgcttgaggaacgggaggtactgctgtactgtgactttcatggacactcccgtaaaaataatatattcctgtatggctgcaacaacaacaatcgcaaatactggctgcatgagagggtgttccccttaatgctgtgcaaaaatgccccagataagttctcttttcactcttgcaacttcaaggtacagaagtgcaaggagggaacaggccgtgtcgtgatgtggagaatgggtattctcaactcgtatactatggagtctaccttcggcggttctactctgggcaataagcgggatacccacttcaccattgaggacctaaagagcctgggctatcatgtttgcgataccctccttgatttttgtgatcccgaccagatgaagttcactcaatgtttggccgaactgaaggagctgctcagacaggaaatccacaagaaatttcatgagctgggccaggatgtggacttagaaggaagctggtccgatataagcctgtccgacatcgagtcctccacgtctggaagcgactcctctctttccgacggcctccccgtccatcttgcgaatatcgccgatgaactgacccagaagaagaaaatgtttaagaaaaagaagaagaaatccctgcaaactcggaaacaaagaaacgaacagtaccaaaaaaaaaacctgatgcaaaagctgaagttgacagaggacacctcagagaaggccggtttcgcatcaactcttcaaaagcaacccacgtttttcaaaaactcagagaattcaagttttcttcccatgaaaaacgagaatcccaggctgaatgagactaatttgaaccgaagagacaaagataccccactggatccatctatggccaccttgatcttacctaagaacaagggcagaatgcagaacaagaaaccaggattcacggtgtcttgtagtccaaaaagaactatcaattcctctcaagaacccgcaccgggtatgaaacctaactggccacgctcgcgataccccgctacaaagcggggttgtgccgctatggcagcctatccatcgctacacatctacacctacccatag

SEQ ID NO: 27765 - DNA, 3234 bp, Artificial Sequence
  Description of Artificial Sequence: Synthetic coding sequence
atggaggttcaggtttctcaggccagcctggggtttgagctaacttcagtggagaaatctttaagagagtggtcaagactttccagagaagttatcgcatggctttgtccaagctcaccaaacttcattcttaatttcccccctccgccttctgcatcctccgtaagtatggtgcaattgtttagcagccctttcggctaccagtccccttccgggcattcagaagaggagcgtgaaggaaacatgaagtctgctaagcctcaggtgaaccactcacagcacggcgaatcccagcgggcactatcgccgcttcaatctacattgtctagtgctgcctcacccagtcaggcttacgagacgtacattgaaaacgggctgatctgtctgaagcacaagatccgtaatatcgagaagaaaaagcttaaacttgaggattacaaagatcgcctgaaatctggtgagcacttgaaccccgatcagctagaggcggttgaaaaatacgaggaagtgctgcacaacttagaatttgcaaaggagcttcagaagacgttttcagggttgtctctagacctcctcaaagcgcagaagaaggcacaaagaagggagcacatgcttaaactggaggcagaaaagaaaaagttacgtaccatcctgcaagtccagtacgtgctgcagaacttgacacaagagcatgtgcaaaaagacttcaaaggcggactcaacggggctgtttacctaccctcaaaagaactggactacttaatcaaattttccaaactaacgtgcccagaacggaacgaatcactgagtgtggaagaccagatggagcagagttcattgtacttttgggacctgttagagggttccgaaaaggccgtggtggggacgacatacaagcacctcaaagacttgcttagtaagttgctgaactctggatacttcgagtctattcccgtgccgaagaatgctaaggaaaaggaggtacccctggaggaggaaatgctgatccagagcgagaagaagacccagctgtcaaagaccgagtctgtgaaagagagtgagtctcttatggagttcgcccagcctgaaatacagcctcaagagtttcttaatagacgctatatgacagaggtggattacagcaacaagcaaggcgaggagcagccgtgggaagccgattacgctagaaaacccaacctgccgaaaagatgggatatgctgacagagcccgacggccaggaaaaaaagcaggagagctttaaatcttgggaggccagcggaaaacatcaggaggtatccaagccagcagtttcactggaacagcgaaagcaggataccagtaagctcaggtcaactttgcccgaggagcagaagaaacaggaaatctccaaatcgaagccctccccttcgcagtggaagcaggacactccaaagagtaaggccggttatgtacaagaggagcagaagaagcaggaaactcccaagctgtggccagtccagttacaaaaggaacaggacccaaagaagcagacaccaaagtcatggacaccaagcatgcagtcagagcagaataccaccaaatcttggaccaccccaatgtgtgaggagcaggatagcaagcagccggagacaccaaagtcatgggagaacaacgtcgagtctcagaagcacagtttgacaagtcagtcacagatatctcctaagtcttggggcgtggcgaccgcatccctgatccccaatgatcaactgttgcctaggaaactcaatacagaacccaaggatgtgcctaagccggtgcaccagccggtgggatcatccagcacccttccgaaagatcccgtcttgcgcaaggaaaagctgcaggacttgatgactcagatacagggcacctgtaattttatgcaagagagcgttcttgacttcgataaaccatctagcgccatccctacgtctcagcctccctccgccacaccaggttcacctgttgcctcaaaggaacagaatctcagcagtcaatccgattttctccaggagcctctccaggcgacatccagccctgttacgtgcagtagcaacgcctgcctcgtgacaaccgaccaagcctcgtctggatccgaaaccgagtttatgacaagcgaaacccctgaggtgtttaacgtcaatgcaccgttgccaccacggaaagaacaggagattaaagaatcaccctactcccccggatataatcagagctttacaaccgcctccacccagacaccaccgcaatgtcagctgcctagcatacacgtggaacaaaccgtacattcccaagagacagccaattaccacccagatggaacgatccaagtgtcaaatggctctttagccttttacccggctcagacgaatgtgttccctcgaccaactcaaccctttgtgaactctcgagggtctgttcgtggttgcactagaggcggtaggctcattactaattcttatcgatctccgggagggtacaaggggttcgacacatatagaggcttgccatcaattagcaacgggaattacagccagctgcagtttcaggcccgtgagtatagtggagccccttactcgcaacgggataattttcagcaatgctacaaacgcggtggcacgtccggcggacctcgagctaattcccgcgctgggtggagtgatagcagccaagtatccagccccgaaagggataatgaaacattcaacagtggggactcaggtcaaggggattcgaggtcaatgacccccgtggacgttcccgtgaccaatcccgctgctaccatactaccagtgcacgtttacccactccctcagcagatgagggtggccttttctgccgcacgaacttcaaatctagctcccggaactctggaccagcctattgtgttcgacttattgttgaataatctgggggagacctttgacctccagctcggcaggttcaactgccctgtgaacggaacgtatgtgttcatattccacatgctgaagctcgcggtgaacgtacccttgtacgtgaatctgatgaagaacgaagaagttctagtgagcgcatacgccaacgatggcgcaccagaccacgaaaccgcctccaatcacgccattctccagctgttccagggcgaccagatctggctgcgattgcatagaggagcaatatatggttcctcttggaagtactcaacattcagcggttatttactgtaccaggactag

SEQ ID NO: 27766 - DNA, 1056 bp, Artificial Sequence
  Description of Artificial Sequence: Synthetic coding sequence
atgactcttagactgcttgaagactggtgtcgcggtatggacatgaacccccgaaaggccctccttatagccggaatttctcagagttgcagtgtggcagaaattgaggaagcactccaggcaggactggcccctcttggagagtacagattacttggtcgcatgttcaggcgagacgagaataggaaggtcgcactagtggggctgacagcagaaacatcacatgctcttgtgccaaaggagatcccaggaaaaggaggcatctggagggtgatctttaaacctccagatcccgacaacacttttttgagccgtttgaatgagtttttagcaggcgaaggaatgactgtgggcgagctcagccgggcattaggccatgaaaatggctcactagacccagaacagggcatgataccggagatgtgggccccaatgctcgcgcaggctctggaggctctgcagccggcactccagtgtctcaagtataagaagctacgggtgttttctgggcgagaaagccccgaaccaggtgaggaggagtttggtcggtggatgttccacacaacgcagatgatcaaagcttggcaggtgccggatgtggagaaacgccgaaggctgttagagtcactgcgtggaccagccctggacgtgattagggttctgaagatcaacaatcccctcattactgtcgatgagtgcctgcaggcgctggaggaggtgttcggagtcacggataacccgcgagaactgcaggtcaaatatctgaccacctaccagaaggacgaggaaaagctgtcagcttacgtgctccgacttgagccccttcttcagaagctggtccaacggggagcaatcgaacgcgatgccgtcaatcaggctcgtttggatcaggtgatcgctggagccgttcataaaaccatcaggcgcgaactcaatttgcccgaagacggacctgcgcctggattcttgcagttgctggtgctcattaaagattacgaagccgcagaggaggaagaggctctgctccaggctatactggagggcaatttcacatag

SEQ ID NO: 27767 - DNA, 2559 bp, Artificial Sequence
  Description of Artificial Sequence: Synthetic coding sequence
atgtctggaagggccagagtcaaagccaggggcattgctcgcagcccttcagctacggaggtgggtaggatccaggcaagtccactgcctcggtcagtggacctatccaacaatgaggcgagctcgtctaacgggtttctcggcacatctcggatttccactaacgataagtacggaatcagcagcggcgatgcaggctcaacattcatggaacggggtgtgaaaaataagcaagatttcatggatctgagcatctgtacgagagaaaaactcgcccatgtacgcaactgcaaaactggttcttctgggatcccagtgaagctcgtgaccaatttattcaatctggacttccctcaggactggcagctgtatcagtaccacgtcacgtacattccagatctggccagccgccgattaagaattgcattgctttatagtcacagtgaattgtcaaacaaggcaaaggcttttgacggggcaatcttgttccttagccagaagctggaggagaaagtcaccgaattgtcttctgaaacacagcggggtgagacaataaagatgaccataactctgaagcgcgagctaccctcgagttcacccgtatgcatccaggtgtttaatatcatctttagaaaaatcttgaagaagctgagcatgtaccagataggcaggaacttctataatccctctgagccaatggagataccccagcacaagctgtctctgtggcccggatttgcaattagcgtttcatacttcgagcgcaagctgttgtttagcgccgatgtatcttacaaggtgctgagaaatgaaaccgtgttggaatttatgactgcactgtgccagcggaccggactatcctgctttacccaaacttgtgagaagcagctgatcgggttaatcgtcctgacccggtacaacaatagaacctactcaatcgatgatattgactggtcagtgaaacccacccacacatttcagaagagggatgggacagaaatcacatatgtcgactattataagcaacaatatgacatcaccgtgagtgacctgaaccagccgatgcttgtgagccttttaaagaagaaacggaatgataattcagaggcccagctcgcccacttaattcctgaattatgttttctgacaggactcacagaccaggccacttcggacttccagttaatgaaagccgtcgctgagaaaactcgcctgtcccccagcggccgacagcagaggctggccagactcgtggataacattcaaaggaacacgaacgcccgattcgaactggaaacttggggtctccacttcggcagccagatcagtctgacaggcagaatagtcccatctgagaaaatcctcatgcaggaccacatctgccagccagtaagtgctgcagattggtccaaagacatcagaacctgtaaaatcctgaacgctcaatcccttaatacctggctgatcctatgctcggaccggaccgagtatgtggcagagtctttcctgaactgtctgaggcgagttgcagggtccatgggctttaacgtggattaccccaagattattaaggttcaagaaaaccctgctgctttcgttcgcgctattcagcaatacgtggatcctgacgtgcagctggttatgtgcatcttaccttccaatcagaaaacttactacgacagcataaagaagtacctgagtagcgattgcccagttccttcccagtgtgttctggccaggacactcaacaaacagggcatgatgatgtccattgccacaaaaatcgccatgcaaatgacctgtaaactgggcggtgagctttgggccgtcgaaattccattgaaatcactcatggtggtgggcatcgacgtctgcaaagacgctctgagcaaagatgtcatggtggtaggttgtgtagcctcggtgaacccccgtatcacacgctggttttcccggtgtatcctgcagcgtactatgactgatgtggcagactgcttaaaggtatttatgacaggcgctctaaacaagtggtataagtacaatcacgatctgccagcacgaataattgtgtaccgagcaggagtgggggacggccaactaaaaacccttattgagtacgaggtcccacaacttctatcctccgtggctgaaagcagctcaaacaccagttctcgcctaagtgtgatagtggtgagaaaaaagtgtatgccccgattcttcaccgagatgaaccgcactgtgcagaaccctcccctaggcaccgtggtggacagtgaagcaacacgcaacgaatggtacgatttttacttgatctcacaggtggcttgtaggggcaccgtttcaccgacctattacaacgttatctatgacgacaacggtttaaagcctgaccacatgcagcgtctgacgtttaaactgtgtcatctctactataattggccaggtatagtgagcgtgccggctccttgtcagtacgctcacaagctgaccttcctggtggcacagtccattcacaaggagccatcgctggaactggcaaaccatcttttttatttatag

SEQ ID NO: 27768 - DNA, 2163 bp, Artificial Sequence
  Description of Artificial Sequence: Synthetic coding sequence
atgtatgggtctgcgaggtccgtggggaaggttgagcccagttcacaatcccctggcagatcaccaagacttcctaggagcccaagacttggccacagaagaacaaacagcaccgggggaagctccggcagctctgttggaggcggatctggcaaaactcttagcatggagaatattcaatccctcaacgctgcgtatgcaacaagcggacctatgtatctgtccgaccatgagaatgtaggcagtgagacccctaagagtacgatgaccttggggagatctggtgggagattgccctacggggtcaggatgacggctatggggagttcgcccaatatcgcatcaagtggggtggccagcgataccattgccttcggcgaacatcatttacctcctgtcagcatggctagcacagtcccacacagcctccggcaggcaagagacaacactattatggacttacagacccagctaaaggaggtgttaagagagaacgacttgttgagaaaggatgtcgaagtgaaggagtccaagctgtcgtcctcgatgaattccattaagaccttttggtctccggaactaaagaaggagcgcgctttgagaaaggacgaggcatctaaaatcaccatttggaaggagcagtatagagttgtgcaggaggaaaaccaagtggacgccctgcgcctacggttggaagaaaaggagactatgctcaacaagaaaacaaaacagattcaagatatggccgaggagaagggcacacaggccggagagattcatgacctgaaagacatgttggacgtaaaagaaaggaaggtgaatgtcttacaaaaaaaaatcgagaacctgcaggagcaactgcgagacaaggagaagcagatgtcatcgctaaaggagcgggttaagtctcttcaggcggataccactaatacagataccgctctgactaccctggaggaggcacttgcggagaaggagaggactatcgagcggttaaaggagcagagggatcgggatgaacgagagaagcaggaagagatcgataattacaagaaggaccttaaggacctgaaagaaaaggtgtccctgctccagggagacttgtcagaaaaggaagcgtcgctactcgaccttaaggaacacgcgagctctcttgcgtcgtctgggcttaagaaggattctcgtcttaaaaccctggagattgcactggagcagaagaaagaagagtgcctgaagatggagtctcaactcaaaaaggcccatgaggcagctctcgaggccagggcctctccggagatgagtgatcgaattcaacacctggagagggaaattaccaggtacaaggatgagagttccaaggcgcaggccgaggtggacaggctcctggagatcctgaaggaggtcgaaaacgagaagaatgataaagacaagaagatcgccgaacttgaaagtttatttagtcgccaggtgaaagaccagaataaaaaggtcgctaatttgaagcataaggagcaagtcgagaagaaaaagagtgcccagatgctcgaagaagcgagacgtagagaagacaatctgaacgactctagtcagcagctccaagacagtctacggaaaaaggatgatcgaatcgaggaattagaagaagcactacgtgagtctgtgcagattactgccgagcgagagatggtgctggcccaagaggaatcagctcggacgaacgctgagaaacaggtggaggagctgctgatggcaatggaaaaagtaaaacaggagctagagagtatgaaggctaagctgagcagcacacaacaaagtctcgcagagaaagagacacatcttactaatcttagggcagagcgtaggaagcatctcgaagaggtcctggagatgaaacaagaagcattactcgccgctatttcggaaaaagacgctaatattgcactgttagaactttcaagctctaaaaagaaaacacaagaggaagtggctgcacttaagagagagaaggatagactggtgcaacaactgaagcagcagacccaaaatcgcatgaagctaatggcagacaactatgaggacgaccatttcaaaagttcccactccaatcagactaatcataagcctagtccagaccaggatgaggaggaggggatttgggcctag

SEQ ID NO: 27769 - DNA, 1344 bp, Artificial Sequence
  Description of Artificial Sequence: Synthetic coding sequence
atggatatggggaaccagcatccctccattagccgactccaggaaatccagaaagaggtgaagtctgttgagcaacaggtgattggcttttcgggcctctctgatgacaaaaattacaaaaaactggaaaggatacttactaaacagctgtttgagatcgactctgtggacacagagggtaagggagatatccagcaggctcgcaagcgcgcagcccaagagacagagaggctgctgaaagagttggagcaaaacgccaaccacccacatcgcatcgagattcagaacatctttgaggaagctcaatccttagtgagagagaagatcgttcccttctacaacggcggaaactgtgtgaccgatgagtttgaggaagggattcaggacatcatcctgcggctcacccacgtgaagactgggggaaagataagcctgcgtaaggctagataccatacactcactaagatctgtgccgtccaggagattattgaagattgcatgaaaaagcaacctagcctgcccctttccgaggatgcccatcctagcgtagccaagataaacttcgtcatgtgtgaggtgaacaaagcgagaggggtactcattgccctgctgatgggagtgaacaacaacgagacctgtcgccatctatcctgcgttctgagcggactcattgcagatctagacgctctggatgtctgtgggagaacagagatccggaattaccgtcgtgaagtggtagaagatatcaataagctgctcaagtacctggacctggaagaggaggctgacacaactaaagccttcgatctgcggcagaaccactcaatattaaagatcgaaaaggtccttaaaaggatgcgggagatcaaaaacgagctgctgcaggcacagaacccatccgagctgtatctttcctcgaaaaccgagctacaggggcttatcgggcagcttgatgaggtgagcctggagaagaacccctgtatacgcgaagcccgtcgcagagccgtcatagaggtacagaccctgatcacctatatcgaccttaaggaggctctggagaagcgcaaactgttcgcatgcgaagaacatccctctcataaagccgtgtggaacgtcctcgggaacctatcagaaatccagggagaggtgctgtcatttgacggaaacaggacggataaaaattacattagactcgaagagctcctgacaaagcagctgctggctctggatgcagtggacccacagggggaagagaagtgcaaggccgctcgtaaacaggcagtacgtctggcccagaacattctgagctatctggatctgaaaagcgacgagtgggagtactag

SEQ ID NO: 27770 - DNA, 1476 bp, Artificial Sequence
  Description of Artificial Sequence: Synthetic coding sequence
atggcccaaagcggcggagaggccaggccagggcctaagactgctgttcagatcagagttgccatccaggaagctgaggatgtggacgagctggaggacgaggaggagggggctgagacaaggggcgcaggggacccagcccgatacttgtctcctggttggggttccgctagcgaggaagagccatcgcgcggacactctggaactactgccagcgggggagagaacgagagagaagacctggaacaggagtggaagccaccagacgaggaactcataaagaaactggttgaccagattgaattttatttctctgatgagaacctggaaaaagacgcgttcctcctgaaacacgtgcgcagaaataaactggggtatgttagcgtcaagttacttacaagcttcaagaaggtaaagcatctaaccagggactggcggacgacagcacacgcgctgaagtactcagtggtgctggagctgaacgaggaccacaggaaagtccggaggacaacacccgtgcctctttttccaaacgagaatcttcctagcaaaatgcttctggtgtatgatttgtacctaagcccaaagctgtgggctctcgcgactccccaaaagaacggcagggtccaggagaaagtgatggaacatttgctgaaactgtttggcacatttggtgtcatttcatccgtgcgcatattgaagcctgggagagaactaccacccgacataaggaggatatcatcccgctactcacaagtgggtacccaggaatgcgcaattgtcgaattcgaggaggtggaagcagctatcaaggcccatgagttcatgatcacagagagccaaggcaaggagaatatgaaggctgtgcttataggcatgaagccacctaagaaaaaaccagcaaaggacaaaaaccacgatgaggagcctactgccagcattcaccttaataaatcactcaacaagagagtggaagaactacagtacatgggtgatgaatcttcagctaacagctcaagcgaccctgagagcaatcccacctcacccatggcaggcaggcggcacgccgcaactaacaagctctcaccctctggccaccagaacctgttcctgagccctaatgcgagcccatgcacaagtccatggagcagtcctttagcgcagcgcaagggcgttagccgcaaaagcccactagctgaagagggcagattgaactgcagcacaagtcccgaaatcttccgtaaatgtatggactattccagtgacagcagcgttactccttctggaagcccatgggttagacgtaggcgtcaagcagagatgggaacccaagagaagtcgcctggtacctcccctttgctgagtcgcaaaatgcagacagcagacggactgcccgtgggtgtcctgcggctgcccagaggcccagacaacactcgcggatttcacggccatgagagatccagagcctgcgtgtag

SEQ ID NO: 27771 - DNA, 315 bp, Artificial Sequence
  Description of Artificial Sequence: Synthetic coding sequence
atggccggaaaagctcatcgcctgtccgcagaggagagggatcagttgcttccaaacctccgggcagtgggttggaatgagctagaagggcgtgacgcaatatttaaacaatttcattttaaggactttaatagggctttcgggtttatgacacgagtggcacttcaagcagagaaattggaccatcatcccgagtggttcaacgtctacaataaggtgcacattactctgtcaactcacgagtgcgctgggctcagcgagagagacatcaacctcgcttcatttattgaacaggtggcagtgtctatgacctag

SEQ ID NO: 27772 - DNA, 738 bp, Artificial Sequence
  Description of Artificial Sequence: Synthetic coding sequence
atgatcggcgtttcatttgaagaagctaaaagcataataacgggcgctaagctttctacccggctcgagtcagcgtgggagatcgcttttatcagacagaagagtgataatatccagccagagaacctctcctgcacctccctcatcgaggcttcaggggagtatggccctcaagcatccaccctttctcttttttcatccccccctgaaatcttgatacctaagacgtcatcaaccccaaagacaaataacgacatactgagctcatgtgagatcaaaaccggatacaataagacagtgcaaattcccatcacttcagaaaactccactgttggtctttctaacaccgatgttgcttccgcctggaccgagaactatgggctccaagaaaagatctccctcaacccctcagtcagatttaaggcagaaaaattagagatggccctcaactatctcggcatccagcccactaaggagcagcatcaggccctacgccagcaggtgcaagccgactctaagggcacagttagttttggcgacttcgtgcaggtggcccgtaaccttttctgcctgcagctcgatgaggtgaacgtcggtgctcatgagatcagcaacatactcgattcccagctactgccctgtgattcaagcgaggccgatgagatggagcggttgaagtgtgagcgagacgacgcattgaaagaggtgaacacccttaaatggccaggccagaattag

SEQ ID NO: 27773 - DNA, 849 bp, Artificial Sequence
  Description of Artificial Sequence: Synthetic coding sequence
atgggcggagcagtatcagccggagaagataatgatgaactaattgacaatctgaaagaagcacagtatatcaggaccgaactggtggaacaggcgttcagagcaattgatcgagccgactattacctggaggaattcaaggagaacgcttataaagaccttgcatggaagcatggcaatatccacttgtcagctccatgtatatactcggaggtgatggaggcattggacttacagcccggattgtcgtttctgaacttaggctctgggacaggttacctctcgtcgatggtcgggctaattctaggaccattcggtgttaaccacggcgtcgaattacattccgatgtaatcgagtacgccaagcagaagctcgatttttttattaggacaagcgactcattcgacaagttcgatttctgcgagcccagcttcgtaaccgggaactgtttggagatctctcctgattgttctcagtatgaccgcgtatattgcggagccggagtgcagaaggaacacgaagagtatatgaagaatttgctcaaagtgggtggcattctcgtaatgccattagaggagaagcttaccaaaattacaaggaccggaccatccgcatgggaaaccaagaagatactggcggtctctttcgcacctttaatccagccatgtcatagtgaaagcggtaagtcacgcctggtgcaacttaggagccccagctttgtgcaaggctggagcgtcgtggtgctttctcagctgaccgcagctagtactttccaggctgaggccatcctgcctagtcagtccccaacctggctaaccttacaggtgttagccactatgccaaactag

SEQ ID NO: 27774 - DNA, 612 bp, Artificial Sequence
  Description of Artificial Sequence: Synthetic coding sequence
atggccaggcctcgaccacgcgaatataaggccggtgacttagtgttcgcaaagatgaagggttacccgcactggccagctcgaattgacgaactccccgaaggcgctgtgaagcccccagccaacaagtatccgatttttttcttcgggactcatgagaccgcctttctcgggcctaaggacctctttccatacaaagaatacaaagacaagtttgggaagtccaacaaacgcaaggggttcaatgagggactttgggagatcgagaataatcctggagtcaaatttacaggttaccaggcaatccagcaacagagcagttccgagaccgagggagaaggaggaaataccgcagacgcctcctccgaggaagaaggagacagggttgaagaggatggcaagggcaaacgcaagaacgaaaaagccggtagtaagcggaaaaagtcctatacaagcaagaagtcatccaagcagtccagaaaatctcctggcgacgaggacgataaggactgcaaagaggaagaaaacaagtcgtcctctgaggggggtgacgcaggcaacgatacgcggaataccacaagcgacctgcagaagactagtgaaggcacatag

SEQ ID NO: 27775 - DNA, 540 bp, Artificial Sequence
  Description of Artificial Sequence: Synthetic coding sequence
atgaaaacacccgtggaactcgccgtctccggaatgcaaacactgggtctgcagcaccgttgccggggaggatacagggtgaaagcccgaacgtcatacgttgatgagacgctgtttgggagcccagccggaacacgcccaacacccccagactttgaccccccttgggtcgaaaaagccaatcggacccgaggggtggggaaggaagctagtaaggctttgggagccaaaggctcttgtgagaccacgccctctaggggctcaacacccacgctgactccccgaaaaaagaacaagtacaggcccatttcacatacgccatcctattgcgacgaaagccttttcggcagtaggagtgagggggctagtttcggcgctcccagaatggccaagggggatgcggcaaaactcagggccctgttgtggacccccccaccaactcccaggggttcgcactcaccacgtccacgagaggcaccgccacctgtaccacccactcagatgggtctgagaatcagcgggcttcctcgccaaggttag

SEQ ID NO: 27776 - DNA, 1104 bp, Artificial Sequence
  Description of Artificial Sequence: Synthetic coding sequence
atggatggtgaggacatcccagatttctcatcactcaaggaggaaaccgcttattggaaagaactgtccttgaagtataagcagtcattccaggaggcaagggatgagctggtggaatttcaagaaggaagcagggagctggaggcagaactcgaagcccagcttgtgcaggctgagcagcgaaatagagacctgcaggctgacaaccagcggctgaagtatgaggttgaggcactgaaggagaagctagaacatcagtatgcacagtcttataaacaagtgtctgtcctggaggatgacctttcccagacacgagccattaaagaacagcttcataagtatgtcagagagttggaacaagcaaatgatgacctagaacgggctaaacgtgccacaatcgtgtcattggaagattttgagcagagactgaatcaggcaatcgaaaggaatgcttttctggagtccgaactcgacgagaaggagtctctgctggttagcgtgcagcgcctcaaggacgaggcccgagatctacggcaagaactggccgtgcgcgagagacagcaggaagtgactcgcaagtccgctccctcatcccccaccctggattgcgagaaaatggattccgctgtgcaggcctccctgagccttcctgccactccagtcgggaaggggacagagaacactttcccatcaccgaaggccattcccaacggattcggtacttcgcctctgaccccctctgcacggatctccgctctgaatatcgtgggagatctactgcgtaaggtcggggctttggaatctaagctggctgcatgccgcaactttgcgaaagaccaggcatctcgcaaatcatatatcagtgggaacgtgaactgtggggtgttgaacggcaacgggacgaagttttcaaggtccggacacacctcttttttcgacaagggctcatcaagcagctgcgccatacgagcaagcagaaggcggttttcctcctctagtgctgacttagccggtcgagggggaggggacgggtctatccccgcacagcacagtacgggcgcaagtggcaaggccccacctcccacccttctccttgagacttag

SEQ ID NO: 27777 - DNA, 591 bp, Artificial Sequence
  Description of Artificial Sequence: Synthetic coding sequence
atgggctctcggtctagccatgctgctgtgatcccagacggcgactccatccgacgagagacaggattctcccaggcctccctgttgcgattacaccaccggtttcgggctctagatcggaacaagaaagggtacttaagccgaatggacttacagcagattggggcattggccgttaacccgctcggagatagaattattgaatccttcttccctgacggctcccagagagtggatttcccaggattcgtgcgggtgttggcacacttcagacccgtcgaggatgaagacacagaaacacaagaccccaagaaaccagagcctctcaatagccgtagaaataaattacactatgcattccaactgtatgacctggatcgggatgggaagatcagccgacatgaaatgctacaagttctgcggctgatggttggagtgcaggtgacagaggaacagctggagaatatagctgatcgaaccgtgcaagaagccgacgaggatggggatggagctgtatcatttgttgaatttacaaaaagtctggaaaagatggatgtcgagcagaagatgtcaatcaggatacttaaatag

SEQ ID NO: 27778 - DNA, 2313 bp, Artificial Sequence
  Description of Artificial Sequence: Synthetic coding sequence
atgttccgatacgaatcactggaagattgtcctcttgatgaggatgaggacgccttccaagggctgggcgaggaggatgaagagatagatcagttcaatgacgacacgttcgggtcgggcgcagtggacgacgattggcaagaagcgcacgaacgacttgccgaactggaggagaagctgccagtggccgtcaatgagcagacgggaaatggcgagagagacgaaatggacctgctcggtgaccacgaggagaatctagcagagaggctgtccaagatggtgatcgaaaatgagctagaagatccagctattatgagagcagtgcaaacccgtcccgtgctgcaaccacagcctggatctctgaacagttctatctgggacggcagtgaagtgttgcggaggatccgcggtcccctgctggctcaggagatgccaaccgtctccgtgcttgagtacgccttgccccagagacctccccagggccctgaggatgatcgggacctgtccgagagggcactgcctagacgatcgacatcacctataatcggcagcccaccggtcagagcggtccctatcggcacccccccaaagcaaatggccgttccttctttcactcagcagatcctgtgccctaagccagtccatgtgagaccacctatgccccctcggtaccccgctccttacggcgagagaatgagtcctaaccagttgtgctcggtgcccaattccagcctgctgggacatcccttcccccctagcgtgcctccggtactcagccccctgcagcgcgcacagttactcggaggggcacagctgcagccaggcaggatgtctccctcccagttcgctagggtgcccggattcgtcggtagcccgttagccgctatgaatcccaaactcctccagggccgtgtgggccagatgctcccccctgcccctggcttccgcgctttctttagcgctcccccttccgccactcctcctccccaacagcacccaccaggaccagggccacacctgcagaatctcaggtcacaggcccctatgttcaggccagacacaacccatctccatccccagcaccgcagactgctgcatcagcggcagcagcagaaccggtcccagcataggaacttgaacggcgctggcgatcgaggttcacatcggagcagtcatcaggatcatttgcggaaggacccatatgccaacttgatgttgcagcgcgaaaaggactgggtttctaagatccagatgatgcagctgcagtctaccgatccatacctggatgacttttactatcagaattacttcgaaaaactggaaaaactctctgctgctgaggagatccagggagatgggcctaaaaaagagagaacaaagctgattaccccccaggtggccaaactggagcacgcctataaacctgtgcaattcgagggttcccttggaaagctcaccgttagttctgtcaataatccacgaaagatgatcgatgcagtggtgacctctcgctctgaagacgacgaaacgaaagagaagcaggtcagagataagaggcgtaagaccctagtgataatcgagaagacatattctctgctgcttgacgtcgaagattacgaacggaggtatctactttctttggaggaagaaaggcccgctctcatggatgaccggaaacacaaaatctgcagcatgtacgacaacctccggggtaagctgcctggccaggaaaggccttctgacgatcactttgtgcagatcatgtgcatcaggaaaggaaagaggatggtagcgaggatcctgcccttcctgagcaccgagcaagcggcagacatccttatgactaccgctcgtaacctgcccttccttatcaagaaagatgcacaggatgaggtgttaccctgtctgctgtcaccgttcagtctgttactgtatcacctgccaagcgtgtctattacctctctgctgcgacagctgatgaatctgcctcagagcgccgctactccggcactgtccaatccacatttgactgccgttctgcaaaacaagttcgggctgagtcttctactcattctgctcagtcgtggtgaggatttgcagagtagtgaccctgctactgaaagcacacagaataatcagtggaccgaagtgatgtttatggccacccgcgaactgctgaggattccccaggctgccctggctaagccgatttccattccgacgaatttggttagcctgttttcgagatacgtggacaggcaaaagctgaatctgttagagaccaagctgcaattggttcaggggatacggtag

SEQ ID NO: 27779 - DNA, 1518 bp, Artificial Sequence
  Description of Artificial Sequence: Synthetic coding sequence
atgcgcctgcgacgtctggctcttttccccggagtagctctcctgttagccgcagcacggttggcagcagcaagcgacgtgctggaattaacggacgataattttgaatcacggattagtgataccggttcagcgggtcttatgttggtcgaattcttcgcaccctggtgtggccattgcaagagattggctcctgaatacgaggccgcagctacacgcctcaagggaattgtccccctcgctaaggtggattgcactgccaatactaacacatgtaacaagtatggagtaagcggctacccgacgctcaagatattccgtgacggcgaggaagcaggcgcttacgacgggccacgcactgcagatggcatagtctcacacttgaaaaagcaggcgggtccagcctcagttcccctgcggaccgaggaggagttcaaaaaattcattagcgataaggacgctagtatagtcggtttcttcgatgactcattctctgaagcccactctgaatttctgaaagccgctagtaacctgagagacaattacagattcgcccacaccaacgtggaatctttggtgaatgagtatgatgacaatggggagggaatcattctgttccgcccaagtcatctgaccaacaaattcgaggacaagaccgtggcctacacagagcagaagatgacgagcggcaagattaaaaaattcattcaggagaacattttcggcatctgtccgcatatgacagaagacaacaaagatttaatccagggcaaggacttgttgatagcctactacgatgtcgattacgaaaaaaacgcaaaagggtctaactattggcggaatagggtgatgatggtggctaagaagtttttggatgccggacacaaactgaactttgcagtggccagccgcaagactttctcacacgaactgtctgattttggcctcgagtcaactgctggagagattccagtcgtagcgatcagaaccgctaagggtgagaaatttgtgatgcaggaagaattctcccgtgacgggaaagctcttgaacggttcctgcaggactactttgacgggaacctgaagcgctacctaaaatcagaaccaatccccgaaagcaatgatggccctgtaaaggtcgtggtggccgagaattttgacgagatcgtgaataatgaaaataaagatgtcctcatagaattctacgcaccctggtgcgggcactgtaagaacctggagccaaaatataaagagctgggggagaagctgagtaaagatccaaacattgtgatcgcaaaaatggacgcaactgccaatgacgtacccagtccctacgaagttcggggattccctaccatttatttctcacccgcaaataaaaaactcaatccaaagaaatatgagggaggaagagagctttcagattttatcagctaccttcagcgagaagcaacaaatccacctgtgattcaggaagaaaagcctaaaaagaaaaagaaggcacaggaagatctgtag

SEQ ID NO: 27780 - DNA, 684 bp, Artificial Sequence
  Description of Artificial Sequence: Synthetic coding sequence
atgagcgtggtgccaccaaacagatctcaaaccggttggcctaggggtgtgacccaatttgggaacaaatacatacaacagaccaagcctctcaccttggaacggactattaatttgtaccctttaactaattacacctttggaactaaagaaccactatatgagaaggacagctccgtggcggcacgatttcagcgcatgcgtgaagagtttgataaaatcggaatgcgccgaacagtcgagggggtcctgatcgttcacgagcaccggctgcctcatgttctgctattgcagttaggaaccacgtttttcaagctcccaggcggagaactcaatcccggagaggatgaggtggaggggcttaagcgactgatgaccgagatcctgggcaggcaggacggcgtgctccaggactgggtgatagacgactgtattggcaactggtggagacctaacttcgagccaccccagtatccttatatacctgcccatatcacaaagcctaaggaacacaaaaaattgtttttagttcaactccaggaaaaggccctcttcgctgtgcctaagaactacaaactggtcgccgctcccctattcgagctttatgataatgctccgggatacggtcctattatttcctccctgccccagcttctatcacgcttcaatttcatctacaattag

SEQ ID NO: 27781 - DNA, 2244 bp, Artificial Sequence
  Description of Artificial Sequence: Synthetic coding sequence
atgagccaggtcaagtcgagctactcctatgatgccccttcagactttataaattttagtagtttagacgacgagggcgacactcaaaacatcgacagctggttcgaagagaaggctaacctcgagaataagctcttgggaaagaatggcaccgggggactgttccagggaaagacacctctgcgcaaagccaacctgcaacaagccatcgtgacaccactgaagcccgttgataacacttactacaaagaagccgagaaagagaatctggtggaacagtctattcctagcaatgcctgcagctccctggaggtggaggccgctataagccggaagacgcccgctcagccgcagcggaggtcactacgcctttcagcgcaaaaagaccttgaacagaaggaaaaacaccatgtgaagatgaaggctaaaaggtgtgccacgccagtcatcatcgatgaaatccttccctccaagaaaatgaaagtgtcaaataataaaaaaaagcctgaggaggaaggatccgcgcatcaggatacggcagaaaagaatgccagctcacccgaaaaggcaaaagggcgtcatactgtcccatgtatgccccctgctaaacaaaagttcctgaagtccactgaggagcaggagctggaaaagtctatgaagatgcagcaagaagtggtagagatgaggaaaaaaaacgaggagtttaagaaactggccctggccggtattggccagccggtgaagaagtcagttagccaggtgaccaaatctgtggacttccatttcagaacagacgagcggatcaagcaacacccgaagaatcaggaggaatataaagaggtgaattttacatccgagctgcgtaaacaccctagcagccccgctagagtaacaaagggatgtaccatagtgaagccatttaatttatctcaaggaaaaaagaggacctttgacgaaaccgtgtctacgtacgtacctctggcacagcaagtcgaggattttcataaaaggactccgaaccggtaccatctgcgttccaagaaagacgatattaacttactgccatccaagagctccgtgacaaagatttgcagagacccgcagacacctgtactgcaaaccaaacaccgtgccagagccgtgacctgcaaaagcactgctgaactcgaggctgaggaactagagaagttgcagcagtataagttcaaagccagagaacttgatcctagaatcctggagggcggtccgattctgccaaagaaaccaccagtgaagccacccactgagccgattggctttgatctcgaaatcgagaagcgtatccaggagcgggaatctaaaaagaagacagaggacgaacattttgaattccactcgaggccatgtccaactaaaattctggaggacgtcgtcggagtgccagaaaagaaggtgcttcccatcacagtccctaagtctcctgcttttgctctcaagaatagaataagaatgccaacgaaagaggacgaggaagaagatgaacccgtcgttataaaggctcagcctgtgccccattatggtgtgccatttaaacctcaaatccctgaagcaaggaccgtcgagatctgtccatttagctttgacagtagagataaggagcgacagctgcagaaagaaaagaagattaaggaactgcagaagggggaggtcccaaaattcaaggcattgcccctcccccatttcgataccatcaatcttcctgaaaagaaggttaagaatgttacacaaatagagccgttctgtcttgagacagatcggaggggggctctgaaggcccaaacctggaagcatcaactcgaggaggaattaaggcaacaaaaggaggcagcctgtttcaaggcgcgtcccaataccgtgatcagccaggagccgttcgtgcctaaaaaggagaagaaatccgtggccgagggtttgtctgggagtcttgtccaagaaccttttcaacttgcgacagaaaagcgggctaaggagaggcaagaactcgaaaagcgcatggcagaagttgaagcccagaaagctcaacaactagaagaagcgaggctgcaggaggaggagcagaaaaaagaggaactggctaggctccggagagagttagtgcacaaagccaatcccatcagaaagtaccaaggactggagatcaagtcatcagatcaaccgttgaccgtgccagtctcacccaagttctctacccgcttccactgttag

SEQ ID NO: 27782 - DNA, 360 bp, Artificial Sequence
  Description of Artificial Sequence: Synthetic coding sequence
atgaaactcgttaggtttttgatgaaactgtcgcatgaaacggtgaccattgagctgaaaaacggaacgcaggtacatggcaccatcacaggcgtcgacgtgtccatgaatacccacctgaaagctgtcaagatgactcttaaaaaccgtgaaccggtccagctggagaccttgagtatcagaggcaacaatatacggtactttatcctcccagactcactgcccctggacacccttctggttgacgttgaaccaaaagtgaagtccaagaagcgggaggcggtcgcaggtcggggacgcggaaggggcagaggcagagggagaggtcgcggacggggacgcggaggtccgagaaggtag

SEQ ID NO: 27783 - DNA, 555 bp, Artificial Sequence
  Description of Artificial Sequence: Synthetic coding sequence
atgatgggggcatccacccttcaggagccagctctgtcccctgggcgatgtcctagacagcccctgcgaagtaaattcgggcatcaagggtccacggtgcagcgcaaatgcagcaaaactaatgctctcaatgtaagccagaagatgatcgaaatgttcgtgaggacaaagcataagattgataagagccatgagttcgccctggttgtcgtgaacgacgatactgcatggctgtccgggctgacgagcgacccgcgtgaactatgcagttgcctctatgatctcgagacagcctcatgtagtacattcaatatttccggggcttctccagctagacagcagaagaccgagttaccagttaccgaaaatgttcagaccataccacccccttacgttgttcgtactatacttgtatacagcagacccccatgccagccacagttttctttgactgaaccgatgaaaaaaatgttccagtgcccctacttcttttttgatgtggtgtacatccataacgggactgaagagaaggaggaggaaatgtcgtggaaatag

SEQ ID NO: 27784 - DNA, 1203 bp, Artificial Sequence
  Description of Artificial Sequence: Synthetic coding sequence
atggcttccgaaaaacccctagccgcagtcacgtgtacagcacccgtcaatatagccgtgattaaatactggggaaagcgcgatgaggagctggttcttccaataaactcaagtctaagtgtaacgctgcaccaggaccagctgaaaactaccacaaccgcggtgatttctaaggactttacagaggatcggatctggctgaacgggagggaagaggacgtgggccagccccgattacaggcctgcctccgagagattcgatgcctagctcggaagcggagaaactctagggacggggaccctctgccctccagcctgagttgcaaggttcacgtggcatccgtgaataactttccgacagcagccggactggcttcctcagccgcaggatatgcatgtctagcttatacgctggctcgagtgtacggagttgaatccgatctgtccgaggtcgctcggcgagggtccggaagtgcatgcaggagcctctacggtggatttgtggaatggcagatgggagagcaagcggacggtaaggattctattgcccgacaggtggctccagagagtcattggccggaactgcgtgtgctgatactcgtcgtgtctgccgagaaaaaactgactggatccactgtaggaatgcgggcatccgttgagacatctccactgcttagatttcgcgcagagtccgtcgtgccagcaaggatggccgaaatggcccgttgcatccgcgagcgagattttccatcattcgcacagctgacaatgaaggattccaaccagtttcatgccacctgtcttgatacattcccgccaatcagttatttaaatgctatcagttggaggatcatacacctggtccatagattcaacgctcaccacggggataccaaggtggcttacacctttgatgccggtcctaacgccgttatctttactctagacgatacagttgctgagttcgtagctgcagtctggcacggttttcctccgggatccaatggcgatacatttctcaaaggcctgcaggtgcgcccagctccactcagcgccgagcttcaggcagccctggcaatggaacccaccccaggaggagtgaaatatattattgtcacacaagtcggtcctggtccccagattttggacgatccttgtgcccacctacttgggcctgacggactccccaaacctgctgcgtag

SEQ ID NO: 27785 - DNA, 1350 bp, Artificial Sequence
  Description of Artificial Sequence: Synthetic coding sequence
atgagggaatgtatcagtattcacgtgggccaggccggtgttcaaatcgggaacgcctgctgggagctatattgcttagaacacggcattcaaccagacggtcagatgccctcagataagaccatcggcggaggagatgactcctttaatactttttttagcgagaccggcgctggaaaacacgtgcccagggctgtgtttgtggatctggaacccaccgtcatcgacgaggtcagaacaggcacttacaggcaactctttcacccagagcagcttattaccggaaaagaggatgcggcaaataattatgccagaggccattatactattggcaaggaaatcatcgacctcgtcctcgaccgtattcgcaagttggccgatcagtgtacagggctgcaaggattccttgtttttcactcatttggcggaggaaccggctcaggctttacttcgctgctgatggaacgccttagtgttgattatggcaagaaatccaagttagaattcagcatctaccccgctcctcaggtgagtacggcagtggtagagccctataacagtatcttaaccacccataccaccttagagcattccgattgtgcttttatggtcgacaatgaggcaatctatgacatctgtagacgtaatctagacattgaaagacccacttacacaaatctgaaccgcttaatatctcagatcgtaagcagtatcaccgcgagccttcggttcgatggcgctttaaacgtagatttaactgagttccaaacgaacctcgttccctaccctcgcatacattttcccctagccacatacgctcccgtcatatcagctgaaaaggcatatcatgagcaactaaccgttgcagaaattactaatgcctgctttgaaccagccaaccagatggtgaagtgtgacccaagacatggtaaatacatggcgtgctgcttgctatacaggggcgacgtcgtgccgaaggacgtgaatgcagccatcgccacaataaagacaaaaaggactatacagttcgtcgattggtgccctactgggtttaaggtgggaattaactaccagcccccaacggtcgtccccggaggtgacctggctaaggtgcaaagggcagtctgcatgttgtccaataccacagccgtcgccgaagcctgggcaagacttgaccacaaattcgatttaatgtacgcgaagcgagccttcgtccactggtacgtgggtgagggcatggaggaaggggagttttccgaggcgcgagaagacatggcagccttggagaaggactacgaggaggtcggtgctgactcagccgacggtgaagacgagggggaggagtattag

SEQ ID NO: 27786 - DNA, 1365 bp, Artificial Sequence
  Description of Artificial Sequence: Synthetic coding sequence
atgagtacgtttaggcaggaggacgttgaagatcattacgagatgggcgaagagcttggctctggacagttcgcaatcgtccgcaagtgcaggcaaaaaggtaccgggaaggagtacgcagctaagttcattaagaaaaggagactgtcatcctccagaaggggcgtgagccgcgaggaaattgagcgagaggtgaacattttgagagagatacgacacccaaatattatcaccctgcatgatatattcgagaacaagaccgatgtggtgttgatcctggaattggtatccggtggcgagctgttcgactttctcgctgagaaggaatcactcactgaagacgaggctactcaattcctgaaacagattttagacggcgttcactatctccacagcaaacgaatcgctcatttcgacctgaaacctgaaaacataatgttacttgataaaaacgttcctaacccccgtatcaagcttatagattttggtattgcccataagattgaagccggtaacgagtttaagaatatttttgggactcctgagttcgtggcccctgagatcgtgaattacgaaccactgggcctggaggcagacatgtggtccattggggtgatcacatatatattattgtccggcgcttctccctttctcggcgagacgaaacaagagacgctgaccaatattagtgccgtgaactatgattttgatgaagaatatttctccaatacttcagaattagcaaaggattttatccgaaggctgctggtcaaagatccaaaaaggcgcatgactattgctcagtcactcgagcatagctggattaaggctataagacgccgtaatgttcggggtgaagacagcggccgaaaacccgaaagaagacggctgaagacaacgcggctcaaggaatacacaattaaatcacactccagcctgcctccaaacaattcttacgctgacttcgaacgattttcaaaagttctggaagaagccgctgccgcagaagagggcctgcgggagctccagcggtcacgccgtctctgtcacgaggatgtcgaagcgctggccgctatctatgaggagaaagaggcctggtacagggaggaatctgactccctgggccaggacctgaggcggctgcggcaggaactgctgaagaccgaagccctcaagcggcaggctcaggaggaagccaaaggtgccctgctcgggaccagcgggctgaagagaagatttagccgcctggagaaccggtatgaagcgctggctaaacaggtcgctagcgagatgaggttcgttcaggatttggtgcgcgctctagaacaggaaaagctgcagggtgttgagtgtgggctgcggtag

SEQ ID NO: 27787 - DNA, 1326 bp, Artificial Sequence
  Description of Artificial Sequence: Synthetic coding sequence
atgaaaaaattcttccaagaattcaaggccgacataaagtttaagtcagcaggaccaggccagaaactcaaggaatcagtaggagaaaaagcccataaggaaaaacccaatcagcctgctccaaggcccccaaggcaagggcctacgaacgaggcccagatggccgcagcagccgcactggccagactggaacagaagcagtctcgcgcatggggacccacctcacaggacactatccgaaatcaagtgcgcaaggagctgcaggccgaggctaccgtatctgggtctccagaagcccctggaacaaacgtagttagcgaacccagagaagaaggaagcgcgcacttggcggtacctggcgtgtattttacttgccctctaactggtgccaccctgaggaaggatcagagagatgcatgcatcaaagaggcaatattactgcacttcagcacagacccagtggctgctagtataatgaagatctacactttcaataaggatcaggatcgggtcaagcttggcgtcgacaccatagccaagtatctcgacaatatacacttacatcccgaggaggagaaatataggaaaatcaaattgcagaataaggtcttccaggagcggatcaactgcctagagggcactcatgaattctttgaagccatagggtttcagaaggtcttgctcccagcgcaggatcaagaggatccagaggaattctatgtgctcagcgagacgacgctcgcacagccgcagtccctagagcggcataaagaacagctcctcgccgcagagcccgttagagccaagctagatcgacaaaggcgggtgttccagccatcccctctagcgagccaattcgagctgcccggagacttttttaacctaactgcagaggagatcaagagggagcaacgacttcgctccgaagctgtggagagactctccgtcctccgaaccaaggcgatgcgagagaaggaggaacagagaggcctcagaaagtacaactacacactccttagagtgcgacttccagacggatgcctgctccagggcacattctacgccagggagaggctgggagctgtatatggattcgtccgcgaggcacttcaaagcgactggctgccctttgaactactggcttctggtggtcagaagctttctgaagatgaaaacttggccctgaacgagtgcggtttagtcccctctgccttactcaccttctcctgggacatggctgtgctggaggatatcaaagcagctggagctgaacccgattctattctgaagccagagcttctgagcgccatcgagaagctcctttag

SEQ ID NO: 27788 - DNA, 900 bp, Artificial Sequence
  Description of Artificial Sequence: Synthetic coding sequence
atgcgggatcttctacttcactggggacctggccctccaattagagccccacaggaggaggccgaggccttgctcgagctccaaggcaggttgcaggaagcccaggatacaacagaagccctgagagcccagctgggtgtccaagaagtccagctccagggcctccagggtgccctgcagcagctgcaacaagaaacagagcagaactgccgaagagagcttcagcaaatgcacgggcaactcgccggactgagggctcggatggcctccctacgccaaggctgtggagacttgagaggcctggtttccaccttcactcaatcgtgtcaagggtccctgtctgaggctcgcggacaggtgagctgggctctgggagctttgagcagcgggggtcccggaacccaactccctgaaggccagcagggtcctccagccggatgccctggaagactacctgagctgaagggcaatattcgtgttctatgtagactacgtccagggacatccagctctctggtatccgtggagccaggtccaggtggtaccgtgactacctgctaccgcggacgacaccgtcgatttcgcttggactgggtgttcccccctgatgcttctcaagaggaagtgttcagagagctggaacccgctgtactgtcatgtctgagaggatactctgtctgcatcttcacgtacgggcagaccggaaccggaaagacctattccatggaggggccacccgaagacccagggatcgtgccaagagccttgcagtctttatttcgtgaaatgggggctgggagacaacatagacgctaccacggcagatgcctcagccccgctgagtcacccgagcatccgagacctgggctgccaccatgccgcgcacgctccccattatag

SEQ ID NO: 27789 - DNA, 2517 bp, Artificial Sequence
  Description of Artificial Sequence: Synthetic coding sequence
atgtacgccttctacagcctgctcatctatatattttatagcttgttccggcgagatgggggtgccgcagccgctgccgaacccggtgacccagcacagcgtgccaggaagcccagaggcagaaggagaccagacctgccagcccctgaattgtggaccgaacttaccgggttggccgcaagctccgaacctgaagacggatctgaaggcgctgcagaggggcgtgccgcagccgtttcgttagaagaggctctcttgcggctggccgagtttctgtctgtgcagttgggtgccgaggaatcttgcgggggtccagcagatttggggcagtccggcgaggtgccctccctgctgacagtcactagtcagctccttgcactcctggcctggttacgatcgccgagaggccgacaagccctgttgcagggcacacaaccggcaccaagagtccggcctccgtctcctgacggttccacttcgcaggaggagagcccaagtcacttcacggccgtgcccggagaaccattaggcgatgagacccagggccaacagccactgcagttggaagaagaccagcgcgcttggcaacgtctggaacagttgattttgggtcaactggaggagcttaagcagcagctggagcagcaggaagaagagctgggaaggctgcgactcggggttggcgctacagactccgagaagagggtgcagcatcttaccctagagaatgaggccctgaaacagagcttaagtctgatgagagatctgctcctgcattggggacctggcccacctatcagagctccacaagaagaggctgaggcactgctagagctgcaggggcgactgcaggaggcccaggatactaccgaggctttacgagcgcagcttggggttcaggaagttcaactacagggtctgcagggcgctttacagcagctgcagcaggagactgagcagaactgcagacgggagcttcaacagatgcatgggcaactcgcgggtctcagggcgaggatggcctctcttcgccaaggatgtggcgatctccgcggacttgtgtcaacgttcacacagagctgtcagggctcattgtcagaagcaaggggccaggttagttgggctttgggagctctgtccagcggcggtcctggcacccagttgcccgaaggtcagcagggaccgccagcgggatgccctgggcgtctgcctgagctgaaaggcaacattcgcgtgctatgtcgactgcgccctgggacatctagctctctcgttagtgtggagccgggacctgggggtactgtaacgacctgctatcgcggtcggcatcggaggttcagactcgactgggtgtttccaccagatgcctcacaggaggaagtgtttagggaactggagcctgcagtgcttagctgcctcagaggatactcggtctgtatctttacatacgggcagacaggcacagggaaaacctacagtatggaggggcctccagaagatcctggaattgtaccaagagctctgcagagtctgttccgggaaatgggcgctggtagacagcatcgcgtcaccctgagtatggtggagatttacaacgaggccgtccgtgatctgcttgccccagggcctcctgaacgcttagcggtgcgtcaagggccagagggccagggaggtatccaggtcgcaggactcacacactgggacgtgcccaatttggaaacattgcatcaaatgctgaaactcggaaggtccaaccgagcgactgccgctactgctatgaatcaaaggtctagccggagtcatgcgctggttaccctgaccctccgcgctgcgtcccctcctagggccccaggcactgccggaaccctgcacctggtggatctagccggaagcgaacgcgctcggaaggccggtgccgcaggtcctccgcgtggggaccccgacggagcaaggcgactgagagaagcgcagacgataaatcgaagtctgcttgccttgggaggcgtcatggcagctctccgggcacacagaccgcacgttcccttccgggattctcagttgactcgcctgctgcaacccgcactgggccctggtaccactgcagtcctgctgcttcaggtgggtgccggtgctggccaagtgtgtgcctgccgctcgcctccaacgagggctagacctcccgctcccctcgcacgccgatcccccagaggcaggcggatatcaggccgtcaaagtgccccttcgtcttctccaactgagtgggtcaagtggtcatgggggcaacccggtgccgctggttctagagctccccctggaagattattgcccagcgcacctactcttagatctccagggccacctgccccactgcggaggcccctggccgtgcttcatgctccggtcccaactactgccagagctaggctgagtcgcccacagagagcatgtccttcgagcccgggatctcgtccttgtccatggggacttcggcctggcttgtgttggcaacggagatag

SEQ ID NO: 27790 - DNA, 597 bp, Artificial Sequence
  Description of Artificial Sequence: Synthetic coding sequence
atggcttctgggaacgcccgtataggcaagcctgcacctgatttcaaggccacggcggtggtagacggtgcttttaaagaggtcaaactgtctgactacaaaggcaaatacgttgttttgtttttctaccccctagatttcactttcgtgtgcccgacggagattatcgcttttagcaaccgcgcagaggatttccggaaactcgggtgcgaggttctgggagtgtcagtcgactcacagttcacacaccttgcttggatcaatactcctcggaaagaagggggattgggccctctgaatatccccctcctggccgacgttacaaggaggctgagtgaggattacggagttctcaagaccgatgaggggattgcttatcgcggattgttcatcatcgatggcaaaggggtgctgcgccagatcactgtgaatgacctcccggttgggagatctgtggacgaagctctcagattggtgcaggcttttcagtacaccgatgaacacggcgaggtatgccccgctggttggaagcctggctcagatacaattaaacccaatgttgatgattctaaggagtatttctcaaaacacaattag

SEQ ID NO: 27791 - DNA, 1380 bp, Artificial Sequence
  Description of Artificial Sequence: Synthetic coding sequence
atgtctgtgcgcttctcctcaacaagcaggagactggggagttgtggcggtacaggcagtgtgagactgtcatctggtggtgccggttttggagccggaaatacatgcggagtgccgggtatcggtagtggattttcctgcgccttcggcggtagcagcagcgccggtggttatggaggcggtctaggagggggaagtgcctcctgcgccgcttttaccggaaacgagcacgggctcctctcagggaacgagaaggtaacgatgcaaaatctgaatgacagactagcctcctacttagaaaacgtaagagccctggaagaggccaacgccgacctggagcaaaagattaagggctggtatgagaagttcggcccaggcagctgtcgcggactcgaccacgactactcgagatatttccccataatcgacgaactcaagaatcagatcatatcagctaccacctccaatgctcatgtcgtccttcagaacgataacgcgagactgactgcggacgactttcgattaaagtttgagaacgaactggctctgcatcagtccgtggaagccgacattaatggtctgcgtcgggtgttggatgaacttacactctgcaggacagaccttgagatccagctggaaactctgagcgaggaactggcctacctgaagaaaaatcatgaagaggagatgaaagccctgcagtgtgctgctggcggaaatgtgaacgtcgaaatgaacgctgctcccggagtggatctgaccgtgctgcttaacaatatgcgagcggaatacgaggcactggcagagcagaatcggcgtgatgccgaggcatggtttaacgagaaatcagccagtttacaacagcagataagtgacgacgctggggctaccacttcagctcggaatgaactgatcgaaatgaagcgcactttacagacattagagatcgaactacaaagcctgttggccactaaacattctttggaatgctcactgacggaaaccgaaagtaattactgcgcccagctcgcacaaatacaggcgcaaattggggctctggaagaacagctccaccaggtgaggactgaaaccgagggccagaagctggagtacgagcagttgttagatatcaaggtgcatctggaaaaggaaattgaaacttactgccttctgattgatggcgaagatggctcctgctccaagtccaagggatacggcggtccaggtaatcagactaaggatagctcaaagactaccatcgtaaagacagttgtggaagagatagatccacggggtaaagtgttatcctcccgtgtgcacacagtggaagaaaagtctacaaaagtgaacaacaaaaacgagcagcgagtttctagttag

SEQ ID NO: 27792 - DNA, 834 bp, Artificial Sequence
  Description of Artificial Sequence: Synthetic coding sequence
atgccttctgtgtcaaaggccgcagccgctgccctttctgggagcccgccacagacagaaaagcctacacactacaggtatctgaaggagttccggactgaacagtgcccgctgttcagccagcacaagtgcgcgcagcatcggccatttacatgtttccattggcacttcctcaatcagaggagacggcgacctttaagaagaagggacggcacatttaactacagtccagatgtttattgcagtaagtataatgaggccactggcgtgtgccctgacggcgacgaatgtccatacctgcatcgaacaacgggggacactgaacgcaagtaccacctccggtattacaagacaggcacgtgcatacacgagaccgacgcgcgaggccactgtgtaaagaacggcctgcactgtgctttcgcgcatggccctctcgatttacgcccacctgtgtgtgacgtgcgagaactccaggcccaagaagcactgcagaatggtcagctgggcggtggggagggggtgccagacttgcagcccggtgtcctagcatcgcaggccatgattgagaagatcctgtcggaagatcctcgctggcaggatgcgaatttcgtcctgggctcttataaaactgagcagtgccccaaaccccctaggctgtgccgccagggatacgcttgcccgcattaccacaattcacgggatcgacggaggaatccccgaaggtttcagtactcttggcagctcggacgtcgggtgttgcggttaagtccacgagctaacaatcctcgggtggcactccccagagtacatactggaccatcttccactgcttag

SEQ ID NO: 27793 - DNA, 918 bp, Artificial Sequence
  Description of Artificial Sequence: Synthetic coding sequence
atggacttatccggggttaagaagaaatcactgctgggtgtgaaggagaacaacaagaagagctccaccagggcgccatccccaactaagcgcaaagaccgttccgacgagaaatccaaagacagatcaaaagacaagggggctaccaaagaaagcagtgaaaaggatcgaggaagggataagacacgcaaaaggcgaagcgcttcatccgggagctccagtacacggtcacgaagctccagtacgagctcctctggaagttccacttccaccggatccagtagcggatcttcgtcgtcgagcgcatcttccaggtccggtagttcctcaactagccggtcttcctccagctccagcagttccggatctcctagtcccagcaggcggcgtcacgacaaccggagacgctcgaggtccaagagcaaacccccaaagagagacgagaaggagcgcaaaaggcgcagcccctctccaaagccaacgaaggtgcacatcgggcgattgacaagaaacgtcacaaaagatcacatcatggagatcttctcgacttacgggaagatcaagatgattgacatgcctgtggagcggatgcacccacacttaagtaagggctacgcttacgtggaatttgagaaccctgatgaggcggagaaggccctcaagcatatggacgggggtcaaatcgacgggcaggaaatcactgccacagcagtacttgccccatggccccgacctccaccgagacggttctctccccctcgacgaatgctgccgcctcctcccatgtggagacgtagcccacctaggatgcggcgtcggtcgcggagcccaaggcgccgaagccctgttaggaggcgcagcaggagtcctgggcgacggagacaccgttctcgcagcagcagcaacagctcgcgttag

SEQ ID NO: 27794 - DNA, 3198 bp, Artificial Sequence
  Description of Artificial Sequence: Synthetic coding sequence
atgagaaagcaggaagtaaggaccggcagagaagctggtcagggccacggaactgggtcaccggcagagcaagtcaaggccctgatggacctgctggcagggaaaggcagccaggggagccaagcacctcaggcactggatcgtacccctgacgcacctctgggcccttgttcgaacgactcccgaatccagaggcaccgcaaagccttgttgtcaaaggtgggtgggggaccagagctgggcggtccatggcatcgcctggcgtcactgctgctggtcgagggcctgactgacttacagctgcgcgaacacgacttcacgcaggtggaagcaaccagagggggaggccatccagcacgtacagtcgcactcgaccgcttattcctgccgctgagccgggtgagtgtaccaccaagagtttctattactatcggcgtggccggaatgggtaagacaactcttgtgagacatttcgtcagactttgggcccacggacaggttgggaaggacttttcgctggtgctgcctttgaccttcagagatctaaacacccacgagaagctgtgtgccgacaggctgatatgtagcgtctttcctcacgtgggcgaaccctccctcgccgtcgcagttccggctagagctctgctcatactcgacggactggacgaatgtcggacccccctcgatttcagcaacaccgtggcatgtactgatcctaagaaggagattccagtggaccaccttattacaaatattatcagaggcaatctgttccccgaagtctcgatttggattacttcgaggccttctgccagtggacagattcccggaggcctggtggatagaatgaccgagatccggggttttaacgaagaggagataaaggtctgcttagaacagatgtttcctgaggaccaagccctgcttggctggatgctgtcacaagttcaggccgaccgcgctctgtacctgatgtgtactgtgcccgcattctgtaggctcacggggatggcactgggtcacctctggcgctcccgaacgggaccccaggatgccgaactgtggccacccagaaccctgtgcgagctgtattcctggtactttaggatggcactgtcaggggagggacaggagaagggaaaggcctcccccagaatcgagcaggtagcccatggcggacggaaaatggtaggcaccctgggaaggctggcattccatggcctgctaaagaagaagtatgtgttctacgaacaagacatgaaggccttcggtgtggatttggccctgctccagggtgccccatgttcttgcttcctgcagcgcgaggagactctggcctccagcgtcgcctactgcttcacccacctcagtctgcaggagttcgtggcagcagcttactactatggggcaagccggagggcgatctttgatctgttcacagaatcgggcgtgagctggccaagattgggcttcctaactcacttcagatccgcagcccagcgggctatgcaggccgaagacggcaggttagacgtgttcctgaggtttcttagcggcttattgtcacccagagtcaatgccttgcttgctggaagtctcctggcacaaggtgaacaccaagcctaccgcacacaagtagcagaactgctgcaggggtgtttaagacccgatgccgcagtgtgtgccagggcgattaacgtgctacactgtttgcatgaactacagcatactgagctggccagatccgtggaggaggcaatggaatccggcgctctcgctcgacttacaggtccagcccatcgcgctgctttagcctacctgctgcaagtctcggatgcctgtgctcaggaggcaaatctttcactgtctcttagccagggcgtgctgcagagcctcctgccccagcttctgtattgtcggaagctgcgcctggacacaaaccagttccaagatcccgttatggaactgttggggtccgtgttaagcggaaaggactgtagaattcagaagatcagtcttgcggaaaatcagatttccaataaaggggcaaaggccctcgctcggtctctgctggtgaataggtctctgaccagcttggacctgcgcggaaacagcattgggccacagggagccaaggcactagcggacgccttaaaaatcaacaggacattgacatccctgtcactgcaaggaaacaccgtccgggatgacggggctagatccatggcggaagctctagcatccaataggactctttcaatgctacacctacagaagaattccataggacccatgggggcacagcgcatggctgacgccctgaaacagaatagatccttgaaagaactgatgttttcatcaaacagtattggagatggaggtgccaaggcacttgctgaggccctcaaagtcaaccagggattggagtccctggacctgcagtccaattcgatcagcgatgcaggtgtggctgcccttatgggagcactctgtaccaaccaaactctgttatccctaagtctgcgggagaatagtatatcccccgaaggcgctcaggctattgcacatgccctgtgcgcgaactctacgctgaagaatttggacttgaccgctaacttactccacgatcaaggagcaagggctatcgctgtcgccgtgcgggagaatagaacactgacttcactccacttgcagtggaacttcatccaggctggcgctgcccaagccctgggccaagccctacagctgaatcggtcgttgacttcgctggacctccaggagaacgccattggcgacgacggggcatgcgccgtcgctcgggcactgaaggtcaacacagccctgaccgcactgtatcttcaggtcgccagtattggggctagcggcgcacaggtgcttggcgaagcgctagcagtgaatagaacactggagattctggacctcaggggaaatgctattggggtagcaggagccaaggccctggctaacgccctgaaagttaacagttcattgcgcaggcttaacctgcaagagaattcgttgggaatggacggagccatttgtatcgctaccgcactctccggaaaccacagactgcaacatattaacctgcagggaaatcacataggggattccggtgcgcgtatgataagcgaagcaataaagactaacgctccaacgtgcacggtggagatgtag

SEQ ID NO: 27795 - DNA, 927 bp, Artificial Sequence
  Description of Artificial Sequence: Synthetic coding sequence
atgaacccaatagtggtggtgcatggcggaggggcaggacccatctctaaggatcgcaaagaacgagtccaccagggcatggtccgcgcagccacagttggctacgggattcttcgggagggcggatctgccgtagatgccgtggagggcgcagtagtggcactcgaagatgatcctgagttcaatgcagggtgtgggtccgttctgaacacaaacggcgaggtagagatggatgcatccattatggacggcaaagacctgagtgctggcgcagtcagtgctgtgcagtgcatagcaaacccaattaaactcgccagactagtgatggaaaagaccccacactgtttcctgactgatcaaggggcagcccagttcgctgccgcaatgggcgtgcctgagatcccaggggagaagctcgtcacagagcggaacaaaaagagactcgagaaggagaaacacgagaagggcgctcagaaaacggattgtcaaaagaacctaggaaccgtgggggctgtcgccctggattgcaaaggcaatgtggcctacgccacaagcaccggagggattgtcaacaagatggtcggcagggtgggagacagtccctgcttgggcgctggcggatatgcggacaacgatatcggggcagtgtcaaccaccggtcatggagaatccattctgaaagtcaatttagcacgcctgactttgtttcatattgaacaaggaaaaacagtagaggaggccgcagacctgagtctggggtacatgaagtctagagtgaaaggactgggaggcttaatagttgtgtcaaaaaccggggactgggtggccaaatggacaagtacttcgatgccatgggcagctgctaaggacgggaagctccacttcggaattgacccagacgatactacaatcaccgatctgccatag

SEQ ID NO: 27796 - DNA, 1212 bp, Artificial Sequence
  Description of Artificial Sequence: Synthetic coding sequence
atggccggacgtcgggcacagaccggtagtgcgccaccgaggccagctgcgcctcaccccccagctagtagggctttcccacagcattgcaggcctagagatgcggaacgacctccgagccccaggtcccccttgatgccgggatgtgagctccccgtgggaacttgcccggatatgtgcccagcggctgaacgagcacagcgcgagcgagagcatcgcttgcatagacttgaagtagtgcccggatgtagacaagatccaccaagagccgatccacaaagggccgtaaaggagtatagtcgtcccgcagcaggaaaaccaaggccacccccaagccagcttagacccccatcagtgttgcttgccacagtacgttacctggccggagaagtggctgaaagtgctgatattgccagagcggaagtggcctcattcgtggccgatcggctgagggccgtcttgctcgatctggcactccagggggcaggagacgcagaagctgccgtggtccttgaggcagctctcgctaccctgttgaccgtcgtcgctagacttggacccgatgccgctcggggaccagcagacccagtgctgttacaggcacaggtacaagaagggtttggaagccttcggcgatgttatgcaaggggggctggaccccacccccgacagccagcttttcaggggctcttcctcctttataatctggggtccgttgaagctctgcatgaagtcttacaactgcccgctgcactcagggcctgccctcctcttcggaaagctctggccgttgacgcagcctttcgggaggggaacgcagctcgtctctttaggctgctccagacattaccgtatctgccatcttgtgcggtgcagtgccatgtgggccatgcacgccgagaggcactggcaagattcgcacgggctttctctacgcccaaaggccagacgctcccccttgggttcatggtgaacctactagctctggacggattgcgggaggctcgcgatctgtgccaggcacacgggctgcccttagacggagaggaacgggtggtgtttcttcgaggacgatatgttgaagagggcctccccccagcaagtacatgcaaagttctggttgagtctaagctgcgtggacgcaccttggaagaagtggtgatggccgaagaggaagacgagggcacagatcgacccggatctccggcatag

SEQ ID NO: 27797 - DNA, 894 bp, Artificial Sequence
  Description of Artificial Sequence: Synthetic coding sequence
atggccgaactgacagccctggagagcctgattgagatgggctttccgcgaggtagggcggagaaagcactggctctgacaggtaaccagggaatcgaggctgcaatggattggctcatggagcacgaggacgaccctgatgtggacgagcccttggagactcctttgggtcacatattgggcagggagccaacatcctcagagcaaggcggactcgaaggtagcggcagcgctgctggcgagggcaagcctgctctgagcgaagaagagcgtcaggagcagaccaagcgtatgctcgagcttgtggcccagaaacagagggaaagagaggagcgggaggagcgggaggctttggaaagagaaagacagcggagaaggcagggacaggagctttccgcagcaaggcaaagactgcaagaagacgagatgaggcgagcagctgaggagaggaggagggaaaaggctgaagagctggccgcaagacagcgtgtcagagagaaaatcgaaagagataaagctgaacgtgcaaaaaagtacggaggaagcgtggggtcacagcctccccctgtggcgccagagccaggccctgtcccttcctccccctcccaggagccgccaacgaaaagggagtacgaccaatgtaggatacaggtcagactaccggatggtaccagcctgacacagactttccgcgctagggaacaactggccgctgtgagactgtatgtggagcttcataggggtgaggagctggggggaggacaagaccccgtccagttgctcagcggatttccaaggagggcattcagtgaggcagacatggagcgtccattacaagaactcgggctggtgccctcagcagtgctgatcgtcgcaaagaagtgcccttcttag

SEQ ID NO: 27798 - DNA, 570 bp, Artificial Sequence
  Description of Artificial Sequence: Synthetic coding sequence
atgcgactgagtctgcctttactattactactcctgggagcctgggctataccaggaggactgggggaccgcgctcccctgaccgccaccgcccctcagctagacgacgaggaaatgtactcagctcatatgcccgcacacttaaggtgcgacgcatgccgggctgtcgcatatcagatgtggcagaatttggctaaggcagagacaaagttacatacaagcaacagtgggggtaggcgagaactatctgagttagtgtacacagatgtgctggaccggagctgcagcaggaattggcaggactacggggtgcgggaggtcgaccaggtgaaaagactaaccgggcctggactttcggagggaccggagccttccatctctgtcatggtcaccgggggaccatggccaacccgactgtctcgaacctgcctccattatctgggcgagttcggcgaggatcaaatttacgaagcgcaccagcaggggcgtggtgccttggaggccttgctttgcggtggcccacagggggcatgctcggaaaaggtgagcgctactagggaggaactttag

SEQ ID NO: 27799 - DNA, 3129 bp, Artificial Sequence
  Description of Artificial Sequence: Synthetic coding sequence
atggcaaatgattctcccgctaagtctctcgttgacatcgatctgagcagtctcagggacccagctggaatctttgagctggttgaggttgtgggaaatggaacatacgggcaagtatacaaagggagacacgtgaaaaccggacagctagctgcaattaaggtcatggatgtgacagaagacgaagaagaagagatcaagctggaaattaatatgctgaaaaaatatagccatcacagaaatatcgcgacctactacggggcttttatcaaaaagagccctcctgggcacgacgaccagttgtggcttgtgatggaattttgtggcgctggcagcataacagacctggttaagaatactaagggaaacacacttaaagaggactggatcgcctacataagcagagaaattctacgtggcttagctcatctgcacatacaccacgtgatccacagggatattaagggacaaaacgttctactgactgaaaacgctgaggtcaagctggacgagacggaatatgaatactctggtagtgaggaggaggaggaagaggtgcctgaacaggagggggagccatcatctattgttaatgtccctggagaatccaccctgagaagggactttcttcggctccagcaagagaataaggaacggagcgaggctttaagaaggcagcagcttttgcaagaacaacagctaagagagcaggaagagtataaaaggcagttgttggcagagagacaaaagaggattgaacagcagaaggagcagagaaggcgcttagaggagcagcagcggagggaaagggaggccagacggcagcaagagcgagagcagaggaggcgtgagcaagaagaaaagcgacgtctggaggaacttgaaaggcgaagaaaggaggaagaagagagaaggagggccgaagaggagaagcgaagagtcgagagagaacaagagtatattcgtaggcagttagaggaggagcaacgtcaccttgaagtactgcaacagcaactgctccaggagcaagccatgcttctggaatgcaggtggagggagatggaagaacaccgccaggctgaaagactgcaacggcaactccagcaggagcaagcatatttacttagtctccagcacgaccacagaaggccgcacccccagcacagtcagcagcctcccccaccacaacaagagaggagcaaaccaagttttcacgcgcctgaaccaaaggctcattacgagcccgctgacagggcaagggaagtgcccgtgagaaccacctccaggagccctgtgctgagccgtcgggattcacctctgcaaggatccggacagcagaacagccaggccggtcagcggaactcaacaagctctattgagccgcgattgctgtgggaacgggtggaaaaactggtgcctcggccaggttcaggctcgtcttccggcagctcaaactcaggtagccaaccagggagtcatcccggttctcaaagtggctcaggtgaacgcttccgagtcagaagctcctctaagtccgaggggagcccctcgcagcgtctcgagaatgctgtcaagaagcctgaggacaagaaagaagtgttcaggcctctgaagcctgccgtgaggattgacctcacggctctggcgaaggagctgagagcggttgaggatgtgcggccaccacacaaagtgactgactattcttcgtcctctgaagaatcagggacaaccgatgaagaagatgacgatgtcgaacaggaaggagctgatgaatccacatccgggccagaggatacgcgggcagccagttctctgaacctgtctaatggagagacagaaagcgttaaaacaatgatcgtgcacgatgacgtcgaatcagaacccgctatgaccccgagtaaggaaggcactctgattgttagacaaacccaatccgctagtagtacactccaaaagcataaatcatcgagcagtttcactcctttcatcgatccaaggctcttacaaatctctccatcctccggaactacagtgacctctgttgttggattctcatgcgacgggatgcgaccggaggctatcaggcaagaccctacacgaaaaggcagtgtggtgaacgtgaatccaactaatactaggccccagtccgacacaccagagattcgaaagtacaagaagcgcttcaattccgagatcctgtgcgcagcactctggggcgtgaacttgctggttggaacagagagcggattaatgcttctagataggagcggtcaggggaaagtgtacccattgatcaaccgcagacggtttcagcagatggatgtcctggaaggtctcaacgtgcttgtgacaatcagcggcaaaaaagataagctaagggtgtattaccttagctggctgcgaaacaagatattacacaatgacccggaggtcgagaaaaagcagggctggacaaccgttggcgacttggaaggttgcgttcattataaagtagtgaagtacgagagaataaaattcctggtcatcgctttgaaaagtagcgtcgaagtctacgcatgggcaccaaagccctaccacaagttcatggcctttaagtctttcggtgaacttgtccataagcctctcctagtagaccttacggtcgaagagggtcagagactaaaggtcatatatggctcttgcgctggctttcatgccgttgacgtagattccggctcagtgtacgacatctacctccctacacacatccagtgcagtataaagcctcacgcaatcattatccttcccaacacggatgggatggagcttctggtctgttatgaagacgagggagtctacgttaatacgtacggtcggataaccaaagacgtcgtgctgcaatggggagaaatgccaacttctgtggcctatattcggagtaatcagacaatgggttggggcgagaaggctattgaaatcaggagcgtagagacaggccacctggacggggtattcatgcataagagagcacagaggctcaagttcttgtgtgagcgcaacgataaggtgttcttcgccagtgtgcgcagtggcggttcatcccaggtgtactttatgaccctgggaaggacaagcctcctcagttggtag

SEQ ID NO: 27800 - DNA, 1113 bp, Artificial Sequence
  Description of Artificial Sequence: Synthetic coding sequence
atggggttcaaccgtcccagcaaaatacaagagaatgctctgcctatgatgttggcggagccaccacagaatctgatagcacagtctcaaagcggaactgggaaaaccgcagctttcgttctggcgatgctttcgagggttgaaccaagcgacaggtacccacaatgtttatgcctgagtcctacatatgaactggctctgcagactgggaaagtcatagagcagatgggaaaattctatcctgagttaaaactcgcttatgccgtgagggggaataaactagaaagaggacagaaaattagcgaacagattgtgatcgggactcccggtacggtgctggactggtgcagcaaacttaaatttattgatcccaagaaaattaaagttttcgtcctggatgaggccgatgttatgatagctacacagggccatcaagaccaaagtattagaatacagaggatgctgccacggaactgccagatgctccttttctcggccacttttgaggatagtgtgtggaaatttgcccagaaggtggtgcccgaccccaatgttataaagctgaagcgtgaggaagagactctggatacgatcaagcagtattatgttctgtgttcaagccgggatgagaagtttcaggcactgtgcaacctctatggggctataacaatcgctcaggctatgatcttctgccatacacggaaaaccgcgagttggcttgctgctgagctaagcaaggaaggccatcaggtggcactgttgagcggtgaaatgatggtagagcaacgcgcagctgtcatcgagcggttccgcgagggaaaggaaaaagtattagttacaactaacgtatgcgccaggggtatcgacgtggagcaagtgtcggtagttatcaactttgaccttccggtggacaaggatgggaatcccgacaacgaaacatacttgcatcggattgggagaaccggcagattcggcaagagggggctcgctgtgaatatggtggacagtaagcactccatgaacattctaaacaggatccaggaacacttcaacaagaagatcgaacgcctggatactgacgacctcgatgaaattgagaaaatcgcaaactag

SEQ ID NO: 27801 - DNA, 1437 bp, Artificial Sequence
  Description of Artificial Sequence: Synthetic coding sequence
atggccaccgactcttgggctctggctgtggacgagcaggaagcggcagttaagagtatgaccaatctgcagatcaaagaggagaaggtgaaggcagacaccaacggcatcattaaaacatccacaacagccgagaaaaccgacgaggaggagaaggaagatcgggctgctcagtccctgctaaacaagctgatccgcagcaacctcgtggacaatactaaccaagtggaagttctgcagcgcgaccccaacagtccactttattccgtcaagtcctttgaggagttgcgtttgaaacctcagttactgcagggagtttatgctatgggctttaacagacccagcaagatccaggagaatgctttacctatgatgctggccgaaccaccccaaaacctcattgcccaaagccagtccggtacgggtaagaccgctgcctttgtcctggctatgttaagccgggtcgaaccctctgacaggtatcctcagtgcttgtgtttgtcccccacctacgagctggcattacaaaccgggaaagtgatcgaacagatgggcaaattctatccagagctgaaattggcctatgcagtaaggggcaacaaattagagcgtggccagaaaattagtgagcagattgtcatcgggaccccgggaactgtgctggactggtgttccaagttgaagtttattgatcccaaaaagataaaagtctttgtgctagacgaggctgatgtgatgatagccacccagggccatcaggatcagtcaatccgaatccagcggatgctcccaagaaattgccagatgctgcttttcagtgctaccttcgaagattcagtctggaaatttgcccagaaggtggtgccagatccgaacgtcattaagctcaagcgggaggaagagaccctggacacgattaagcagtactacgtgctctgttcaagcagagacgaaaagttccaggctctgtgcaatctgtacggcgctattaccatagctcaagctatgattttctgccacacacggaagactgcatcatggcttgccgcagagctgtctaaggaagggcaccaggtagccctcctgtcaggagagatgatggtggagcagagggctgccgtgattgaaaggtttagagaaggtaaggagaaggtccttgtaacaaccaatgtatgtgcacgtggaatcgatgtggagcaggtatcagttgtgattaacttcgacctgcctgtcgataaagatggaaatcccgacaatgagacctacctgcatagaattggtcgaacaggacggttcggcaaacgcggactggccgtgaatatggtggatagtaaacattctatgaatatcctgaaccgcatccaggagcactttaataaaaagattgagcgcctggacaccgacgacttggacgaaatcgaaaaaatcgcaaattag

SEQ ID NO: 27802 - DNA, 2238 bp, Artificial Sequence
  Description of Artificial Sequence: Synthetic coding sequence
atggtggggccagggccaacagccgctgccgctgtcgaagaacgacagagaaagctccaggaatacctggcagctaaaggcaagctgaagtctcagaacacgaagccttatttaaagagcaagaacaactgtcagaaccagcctcctagcaagtcaaccatacgcccaaagaacgatgtcacgaaccacgtcgtactcccggtcaaaccgaagagaagtatcagtattaagctgcagccgcgacctcctaacaccgccggttcacaaaagccaaagttggagcctccgaagctgttaggcaaacgactgacctcagagtgtgtttcctcaaacccttattcaaagccatctagcaaatctttccagcaatgtgaggcaggaagttctacgacgggggagctttctaggaaacctgtggggtcccttaacatcgagcaattaaagacaaccaaacagcagctcacggatcagggcaacggcaaatgtatagattttatgaataacattcacgtggagaacgaatccctggataacttcttgaaggagacgaacaaggagaatctcctggatatcctcacggagccagaacggaaaccagacccgaagctttacacaaggtccaagccaaagacggacagctacaatcagacaaaaaatagccttgttccaaaacaggcattagggaagtcgtccgtgaactcagctgtgcttaaggatagagtgaacaaacaatttgtcggagaaacacagtcacggaccttccccgtcaaaagccagcaactgagccgcggagcggatctggcgagacctggagtaaaaccctcccgaaccgtgccgagccattttatcaggactctatcaaaggttcaatcgagtaagaagcccgtcgtaaaaaacataaaagatattaaagtaaaccgaagtcagtacgagaggcccaacgaaaccaagattaggagttatcccgttacagaacagagagtgaaacatactaagcccagaacatacccttctttgctacaaggggagtacaataaccggcatcctaatataaagcaggaccaaaaatccagccaagtgtgcatcccccaaacttcctgcgtgttgcagaaatcaaaggccatcagccagagaccaaacctgacagttggcagattcaacagcgccatcccctcaacgccatccatccgtcccaacggcacctctgggaacaaacacaataacaatggatttcaacagaaggctcaaactctcgactccaaactgaaaaaggccgtgccccagaaccacttcctgaacaagaccgcccctaagacacaggctgacgtgaccactgtaaatggcacacagactaaccctaatatcaagaaaaaagcaacggcagaggatagacgcaaacagctagaggaatggcaaaaaagtaagggtaaaacgtataagaggcctcccatggagcttaagacaaaacgaaaggtgattaaggagatgaacatctctttctggaagtctatagagaaagaggaagaggagaagaaggcacagcttgagctgtccagcaaaattaacaacactctgacagagtgcctgaacctgatagaagggggagtcccatcgaatgagatcttaaacattttgtcgagcatccctgaggccgaaaagtttgctaagttttggatctgcaaagctaaactgctggcgagcaaggggacattcgatgtaatcgggctgtacgaagaggctattaaaaatggcgcaactccgattcaagaattacggaaggttgtgctcaacattctccaggactcaaatcgcaccacggagggaattacctcagacagtctggtcgccgaaactagcattactagtgtagaggagctggcgaaaaagatggagtccgttaaaagctgcctctcgccaaaagaacgggaacaggtgacggctacccctagaattgcaaaagctgaacaacacaactacccaggcatcaagctccagattggaccgattcctcggataaacggcatgccagaagtgcaggacatgaaatttataacccccgtcagaaggtccagtaggatagaaagggcagtcagccgatatcctgagatgcttcaggagcacgatctagtagtggcctctttggatgaacttctagaggtggaggagactaagtgtttcatctttaggcggaacgaggctctgccagtgacactggggtttcagaccccagaatcttag

SEQ ID NO: 27803 - DNA, 378 bp, Artificial Sequence
  Description of Artificial Sequence: Synthetic coding sequence
atgtcttcaaccctgggaaaactcagcaaccaggtggaggagaccctgcctttgctgaagaaagttcctgccaattacttccatatctgctccgccatcctcatgggattcagcctgagtaaatcagcaacgcaagtgtcagcgattcatatggacagcaaagtagacgaccaccttattagaggaacagagaaatccagacttgagccagccactcaactctttcagaacacgaagaagattcggttagaggataccaaccaggagaactttacaagaattgaaggcaccggaaccggcagcctctccggtaaggcgttgggaagcgtggtttacgtaaaagagagcgacggactcgagatgaccgatgtggagtag

SEQ ID NO: 27804 - DNA, 4284 bp, Artificial Sequence
  Description of Artificial Sequence: Synthetic coding sequence
atgtcgatgcttaaaccctcaggcctcaaggcacctaccaagattctgaaacctgggagcacagccctgaaaacccccacagccgtcgtggcacctgtggagaaaaccatctcttctgagaaggcatctagtacaccttccagcgaaacccaagaggagttcgtcgatgatttccgggttggggaacgagtgtgggtcaatggaaataaaccaggcttcattcagttcctcggtgaaacacagtttgccccaggccagtgggcgggtattgtcttggatgaacccataggaaaaaatgatgggtcagtggccggtgtccggtactttcaatgtgaacctctcaagggcattttcacaagaccatcaaaactcactaggaaagtccaggccgaagatgaggccaatggactgcagacgactccggctagccgggcaacttcccctctgtgcacctcgaccgctagcatggtatcatcttctcccagtacacctagcaatattccccaaaaaccatcccagccagccgctaaagaaccctctgccacacctcctatatctaatctcaccaagaccgcatccgaaagcatcagtaatctgtcggaggcaggcagcataaagaaaggcgaacgggagctgaagataggggatcgcgtcctcgtcggaggtactaaggccggtgtcgtgagatttttaggggagaccgactttgcgaagggggagtggtgtggagtagaactggacgagcccctgggaaaaaacgacggcgcagtcgctgggactagatactttcagtgccaaccaaaatatggcctgttcgcccctgtgcacaaggtaacgaaaataggattccccagcactactccagctaaagccaaagctaatgccgtgaggagagtgatggcgaccacatccgccagtctgaaaaggagcccgagcgcttcctccctaagctccatgtcctctgttgcatcctcagtctccagtcgaccctctagaacagggttgcttacggagacctcaagccggtatgcgagaaaaatttctggaacaacagccctccaggaggcactgaaagagaagcaacagcatattgagcaactgttggccgaacgggacctcgagcgtgctgaggtagcgaaggcaacatctcatgtcggtgagatagagcaggagctcgccttggcacgcgacggtcatgatcagcatgtgttagaactggaggctaaaatggaccagctgcgcacaatggttgaagctgctgatcgggagaaggtcgagttactgaatcagttggaagaagaaaagaggaaagtcgaggacctacaatttagagttgaggaggaatccatcaccaagggcgatctggaaactcaaacgaaactagaacatgcccgtataaaagagctggagcagagcctgctgtttgaaaaaacaaaggccgataagctccagagagaactcgaggacacgagggtggcgacggtatctgagaagtcgagaattatggaactagaaaaggacctagcactaagggtgcaggaagtggcggagctccgacgaaggctagaaagcaacaagcctgccggagacgtggacatgtccctgtcactccttcaggaaattagctcactgcaggagaaactggaggttacaaggacagaccaccagcgcgaaataacctctctcaaagagcacttcggcgcacgggaggagacgcaccagaaggagattaaagcactttatacggccacagagaagttatccaaggaaaatgaaagtctcaagtctaagttggaacatgctaataaggaaaatagcgacgttatcgcgctgtggaagtctaagctagagactgcaatcgcatcacaccagcaggctatggaggagcttaaagtctctttctccaaaggcctgggtactgaaactgccgagtttgccgaactcaaaactcaaatcgagaaaatgcgattggactatcagcacgaaatcgagaatctgcagaaccagcaagactccgagagagccgctcacgctaaagaaatggaagctctcagagctaaacttatgaaggtaatcaaggagaaggaaaattctctggaagctatccggagtaagctcgacaaagccgaagaccaacatctggtggaaatggaggacacgctcaacaaactccaggaggcagagattaaagtaaaagaactggaggtattacaggctaagtgcaatgagcaaacaaaagttatcgacaattttacctctcagctaaaggccactgaggaaaagcttctggatttggacgcactacgaaaagcctcctccgagggaaagtcggagatgaaaaagttgcggcaacagctggaagctgccgaaaagcagattaagcatctggagatcgagaagaacgcagaaagcagtaaggcctcaagcataaccagggagctccaggggagggagttgaaactcaccaatttacaggaaaatctctctgaggtgtcgcaggtgaaggagaccctggagaaggagctacagattctgaaggagaaatttgccgaagcctctgaagaagccgtgagtgtccagcgctccatgcaggaaaccgtcaacaagttgcaccaaaaagaagagcagttcaacatgttatcctccgacctggaaaaactgagagaaaatctagcagacatggaagctaaattccgcgagaaagatgagagagaggagcagcttataaaagccaaagagaagctcgagaacgacatcgcggagattatgaagatgtccggcgacaacagttcacaactcaccaagatgaatgacgagctccgactgaaggagcgggatgtggaggagctccaactgaagctcaccaaagccaatgaaaacgcctcattcctccaaaagtctatcgaagacatgactgtgaaagccgaacaatcacagcaggaagccgcaaagaagcacgaggaggagaagaaggagttggagcgtaagctgtccgacttagagaaaaagatggagacttcacacaatcaatgccaggagctgaaggccagatatgagcgagccacctcggagactaaaactaaacacgaggagattctccagaacttgcagaagactctgctggacactgaggacaaattaaaaggcgcacgcgaagaaaactccggtctgttgcaggaactggaggaacttcgcaaacaggctgataaggctaaggcagctcagacggccgaggatgccatgcagattatggaacagatgacaaaggaaaagactgaaaccctggcgtctctggaagataccaagcagaccaatgccaagctgcaaaatgaattggacaccctcaaggagaacaaccttaagaatgtggaggagctcaacaaaagtaaagaactgctgactgtagagaatcaaaaaatggaggagtttcgcaaggaaattgagacccttaagcaggccgctgctcagaagtcacagcagttgtctgccctgcaagaggaaaatgttaaattggccgaagaactcggtcgctctagggacgaggtgacatcacatcaaaagctcgaggaggagcgctcggtcttgaataaccaactactggagatgaaaaagagggagtccaaatttattaaggatgcggacgaggaaaaggcttccctgcagaaaagtatttccatcacttccgctttacttaccgaaaaggacgccgagctggagaaactcaggaacgaagtgaccgttctgcgcggtgagaacgcatccgctaaatctctacactccgtggtgcagacgctcgaatccgacaaagtcaagctggaactgaaggtgaaaaacctagaactacaactgaaggagaacaaaagacagctgagtagctccagcggaaatacagatacacaggccgatgaagacgagcgggctcaggaaagccagatagacttcctcaattcagttatcgtggatctccaacgcaaaaatcaggatttaaagatgaaggtagaaatgatgtccgaagcagccttgaatggtaatggtgatgacttgaacaactacgacagcgacgatcaggaaaagcagagcaagaagaagcctaggctgttctgtgacatctgcgattgtttcgatcttcatgatactgaagattgccccacacaggcacagatgagcgaggatccacctcattctacacaccacgggtctcggggagaggagcgcccttattgcgagatatgtgaaatgttcggtcactgggcgactaattgcaacgatgatgagactttttag

SEQ ID NO: 27805 - DNA, 975 bp, Artificial Sequence
  Description of Artificial Sequence: Synthetic coding sequence
atggcctcttccaacaccgtgcttatgcgcctggtggcgagcgcctattccatcgcccagaaggccggaatgattgtgaggagagtaattgcggaaggagacctaggaattgtggaaaaaacatgtgccacagacctgcagacaaaggcggacagattggctcagatgagcatatgctcatcacttgcgaggaagttccctaagctcacgattattggagaggaggatcttccgtctgaggaggtggatcaggagcttatcgaggactctcagtgggaggagatcctcaaacaaccgtgtccctcccaatacagcgccattaaagaggaagaccttgtcgtatgggtcgatcctctcgatggcactaaagagtacaccgaagggctgctggataacgttacagtattgataggcatagcctatgagggcaaggcaatcgctggagtgatcaaccagccatactacaactacgaagcagggccagacgcggtgctcgggcgaactatttggggggtgttaggcctaggagcatttggctttcaactgaaggaagtccccgcaggcaagcatatcattactactacaaggtcccatagcaacaagctcgtgaccgattgcgttgcagcaatgaaccccgatgctgttctaagggtaggaggggcaggtaataagattatccagctcatcgaaggcaaagcatctgcatacgtgttcgccagccctgggtgcaagaagtgggacacatgcgcacccgaggtcatcctacacgctgtcggtgggaaactcacagacattcatgggaacgtgctgcaataccacaagggtgtctctcatcggacatggcccaagcccgactttttccgtgcgcagttcttcctggaatctcattcttgcttcagtaacttcaaaaacgtgtccacaccaattaagaatatttacgatgttattatctatgcctacgagactgatttatag

SEQ ID NO: 27806 - DNA, 270 bp, Artificial Sequence
  Description of Artificial Sequence: Synthetic coding sequence
atgggaacgaagagagaagctatcttaaaggtgctcgaaaacttgacacctgaggagctgaaaaaatttaaaatgaagctgggcacagtgcctttgcgtgagggttttgagcgaatcccgaggggagctctgggccagctggatattgtcgaccttacagataagcttgtggctagttactacgaggactacgcagccgagcttgtagtcgcagtgctcagggacatgcgaatgctagaggaggccgcaaggctgcagagggccgcatag

SEQ ID NO: 27807 - DNA, 867 bp, Artificial Sequence
  Description of Artificial Sequence: Synthetic coding sequence
atgactgtggggaaatcttccaaaatgctccaacatattgactatagaatgcgatgcatcctgcaggacgggaggatttttataggaacatttaaggctttcgataagcatatgaatctcatcttgtgcgattgcgacgaattcagaaaaatcaaacctaaaaatagcaagcaggctgaaagagaagagaagcgcgtcctgggattagtcctgcttcgcggtgaaaacttggtgtccatgaccgtggaaggcccaccccctaaagataccggtatagccagggtgcccttggcaggtgctgcaggtgggcctggcatagggagagcggcaggacgcggaatcccagcaggcgtgccaatgccacaggcccctgccggactcgccggtcccgtccgcggtgtcggcggaccctcccaacaagtcatgacaccccaaggcagagggacagttgcagctgccgcagctgccgctacggctagcatcgctggtgcccctacgcagtatccccctggccgaggaggacccccacctcctatggggaggggcgcacctcctcccggtatgatgggtccaccccctggaatgcgccctcccatgggccctcccatgggcatccccccaggccgaggtactcccatgggcatgccacccccagggatgagacccccacctccgggatgcgaagctttctttgacccttggccccaatccatggaagttgctcctcaacgacggggattggatagctctgggcctcggtaccacaggcccgtttgtttcctatgctgttgtagttggtccctcatggggctgtcgggtttcctaactggaccaccaccccctggaatgagaccgccacggccatag

SEQ ID NO: 27808 - DNA, 3300 bp, Artificial Sequence
  Description of Artificial Sequence: Synthetic coding sequence
atgcacataaagtcgatcatcctggagggcttcaaatcctatgcgcagaggactgaagttaatgggttcgacccactcttcaacgctataacaggcctaaatggctccgggaaatccaatatactggactccatctgtttcttgctgggcatttcaaatttatcacaagttcgggctagcaacctgcaggatctggtgtacaagaatggacaggcaggcataaccaaagcttctgtgtcaattacattcgacaacagtgataagaagcagtcaccactgggcttcgaggtccatgacgagattacagttacaaggcaggtggtgatcggaggaaggaacaaatacctgattaatggcgtgaatgcgaacaacacgcgggtgcaggacttattctgcagcgtgggtcttaatgtcaacaacccccactttttgatcatgcagggcaggatcaccaaagtactgaatatgaaacctccagagatcctgtcaatgattgaggaagcagctggaacccgtatgtatgagtacaagaaaatcgctgcgcagaaaaccattgaaaagaaggaggccaagctcaaggagattaagacaattctggaagaggagataactccaacaatccagaaactgaaagaagagcgctccagttatctagagtaccaaaaggtaatgcgggagatcgagcatctatctaggttatatatcgcctatcagtttctactagcagaggacacaaaggtacggtccgcggaagagctcaaggagatgcaggacaaagtcattaagctacaggaggagctgtccgaaaacgataaaaagatcaaagctttaaaccatgaaatagaggagctagagaaacgcaaagataaagagactggaggaatcctgaggagtctggaggatgcgctcgccgaagcccagcgagtaaataccaagtcccagtcagcatttgaccttaaaaaaaagaatctggcttgcgaggaatcgaagcggaaagaactggagaagaacatggttgaggattctaagaccttggccgcaaaggagaaagaggttaagaagataactgatggtttacacgccctccaggaggcctcaaataaggatgcggaagccctggctgcggctcagcagcattttaatgccgtgagcgctgggctgtccagtaatgaagacggcgcagaggcaactcttgccggtcagatgatggcctgtaagaatgatatctcaaaggcgcagacagaggctaaacaggcacagatgaaactcaaacacgcccagcaggagttgaagaacaagcaggccgaggttaagaagatggatagcggctacagaaaggatcaggaagcattagaggcagttaagcgattgaaggaaaaactggaggctgagatgaaaaaactgaattatgaagaaaataaggaagagtctttactggagaaaagaagacaactttcgcgcgacataggtaggctgaaggaaacgtacgaagctctcttagcacgattccccaaccttcgatttgcgtacaaggaccccgaaaaaaactggaataggaactgcgtgaagggcttagtggcgtcattaatcagtgttaaagacacatctgctaccaccgcgcttgagttggtggccggagaacgcctgtacaacgtagtggtggatacagaagtgactggtaaaaagctgctcgagcgaggcgagctcaagcgcagatataccatcattcccctgaataaaatctctgccaggtgcattgccccagagaccttacgcgttgctcagaatctggtgggtcccgataacgtccatgtagccctatccctggttgaatacaaacccgagttacagaaggccatggaattcgtgtttggcacaaccttcgtttgtgacaacatggacaacgcaaagaaggtggccttcgacaaaaggataatgacaagaacagtaacattaggcggagacgtgtttgatccccatggcaccctgtctgggggagctaggagccaggcggcatcaattctgacaaagtttcaggaattaaaagacgtccaagacgaactacggattaaggagaacgaattaagggcattagaggaagagctcgcaggcttgaagaataccgctgaaaagtatagacagctcaaacagcagtgggaaatgaaaactgaggaagccgacctccttcagacgaaattacagcagtcttcctaccacaagcagcaagaggaactcgacgccctgaagaagaccattgaggagagcgaggaaacattgaaaaataccaaggagatccagagaaaggcagaagaaaagtatgaagtgctggagaacaaaatgaaaaacgccgaagcggagagagaacgcgaactgaaggatgcccaaaaaaagctcgattgtgctaagactaaggccgacgcaagttctaaaaagatgaaagagaagcagcaggaggtggaagctatcacccttgagcttgaagagctgaagcgagagcacaccagttacaagcagcagcttgaagccgttaatgaagccattaagtcctacgagtcccagatcgaagttatggccgcagaagtagccaagaacaaagagtcagtgaacaaggcacaggaggaggtgaccaagcagaaagaggtgattactgcgcaggacactgtgattaaggccaagtacgcagaggtggccaaacataaagagcaaaacaatgactcccaattgaagatcaaggagcttgaccataacatttcaaagcataaaagagaggcagaagatggggctgccaaagtttctaaaatgcttaaggactatgactggattaatgctgaaaggcacctgtttggacagcctaacagcgcatacgattttaagacaaataacccaaaagaggcgggacaacgcctccagaaactgcaggagatgaaagaaaagctgggtcgaaatgtgaatatgcgagcgatgaacgttctgacggaggctgaggagcgctataacgacctgatgaaaaagaagcggattgtcgaaaacgacaagtccaagatcctaactaccatcgaggacctggaccaaaagaagaaccaggccctgaacattgcttggcagaaggtcaataaagatttcggctcgattttctccacactgctacctggcgctaatgcgatgctagcccctcctgaaggccaaacagttcttgacggattagagtttaaggtggccctcggtaacacttggaaagagaatctgaccgagctgagcggaggccagagacagaagcagcagaaccatacaacaggctag

SEQ ID NO: 27809 - DNA, 381 bp, Artificial Sequence
  Description of Artificial Sequence: Synthetic coding sequence
atgttccagaaagacgaatattgcatcctcatcttaggccttgataatgctggtaaaactacatttttagagcagtcgaaaaccaggtttaataagaactataagggtatgtcactaagtaagattacaacaacagtgggtctgaacatcgggacagtcgatgtgggtaaagccagactcatgttttgggacctggggggtcaggaagagctacagtccctgtgggacaaggacaaaacaaaatgtggggatctcggcacactgcattcttccaaggtcagcgcgtccttcagattgcgggatctcgctgctgaccatcatcggactcaaaagtggcaacgtcccgacgtggggacagcaggctggctgcccctcccatag

SEQ ID NO: 27810 - DNA, 1119 bp, Artificial Sequence
  Description of Artificial Sequence: Synthetic coding sequence
atgactttccaatttaacttcacgattgaagaccatctggaaaacgagcttacaccaataagagatggtgctctgactttggacagtagtaaggagctctcagtgtccgaatcccagaagggagaggagcgtgataggaagtgcagcgctgagcaattcgacctcccccaggaccacttgtgggagcataagtccatggaaaacgctgccccatcgcaggacaccgactctcctctgagcgcagcttcctcatctagaaacctagagccccacggaaaacaaccatccctgcgggcagccaaggagcacgccatgcctaaggacttgaagaagatgcttgaaaataaagtgattgagacgctccccggtttccagcatgtgaagttgtccgtcgtaaaaaccattttattgaaggagaacttccctggagagaacattgtgagcaagtccttttcctcacacagcgaccttattacaggagtctatgagggcggactgaagatctgggaatgtaccttcgacctgctcgcatacttcacaaaggcgaaggtcaagttcgccggtaagaaggtgctcgatctcggatgtggatccgggttgctcgggatcacagcttttaagggcggaagcaaggagattcactttcaagattacaacagtatggttattgacgaggtcacactgccaaacgttgtggccaatagcacactcgaggacgaagagaacgacgtgaacgaaccggatgttaagcgctgccgcaagcctaaagtcacgcagctgtacaaatgtcgttttttctctggagaatggtcggagttctgcaagctggtcttgtcttcggaaaagcttttcgttaagtatgacctcatactaaccagcgagacgatttacaatcctgactattactctaacctgcatcagaccttcctaaggctgcttagcaaaaacggacgggttctactcgcctcaaaggcccactacttcggggtgggcggaggcgtccacctgttccaaaaatttgtggaagagagagatgttttcaagacaagaattttaaagatcatcgacgaggggctaaaacgattcataattgagatcaccttcaaatttccaggctag

SEQ ID NO: 27811 - DNA, 1635 bp, Artificial Sequence
  Description of Artificial Sequence: Synthetic coding sequence
atgaagtgccattacgaagcgttaggagtcaggcgggatgctagcgaagaggagttaaagaaggcataccggaagctggccttgaaatggcacccggacaagaatctcgataacgcagcagaagcggctgagcagtttaaactgatacaggcagcctacgatgtactatccgacccccaagagagggcctggtatgataaccacagggaggccttgctcaaaggcggatttgatggagagtaccaggatgacagtctggacctgctgagatatttcactgtgacctgttattctggttacggtgatgatgaaaaaggcttctataccgtgtatcgcaatgtattcgaaatgatcgccaaagaagaacttgaaagcgtcttggaggaggaagtcgatgattttccaacatttggcgatagccagagtgattatgatactgtggtgcaccctttttacgcctactggcagagtttctgcactcagaagaattttgcctggaaagaggaatatgacacgaggcaggccagcaaccgatgggaaaaacgggctatggaaaaggaaaataagaagatccgggataaggcaaggaaggaaaaaaatgagctggtgagacagctggtggcctttatacgaaagcgcgacaagagggtccaggcccaccgcaaactcgtggaagaacaaaatgctgaaaaggctcggaaagccgaagaaatgcgcagacagcagaagttaaagcaggctaagctggtggagcagtacagagagcagagttggatgactatggccaaccttgaaaaagaactgcaggaaatggaagcaagatacgagaaggagttcggggatgggtccgacgagaatgaaatggaggaacatgagttaaaggacgaggaggacggcaaagatagcgatgaggctgaggacgccgagctctacgatgatctgtactgccccgcatgtgacaagtcattcaaaaccgaaaaggcaatgaaaaatcacgagaaatccaaaaagcaccgggaaatggtggccctgctcaaacagcagctggaagaggaagaggagaacttcagtcgccctcagatcgatgaaaatccgttggacgacaattctgaagaggaaatggaggacgctcccaagcagaaggtgaaatatctaacctttcgattcatcttcgctcttcgactttccaaaaagcaaaagaagaaaaaacagaagccagcacagaactacgacgacaactttaacgtcaacggcccaggcgaaggtgtgaaagtagacccagaggatacaaatctgaatcaggactcagcaaaagagcttgaggatagcccgcaggagaacgtctcagtgacggagatcatcaaaccctgtgatgacccgaagtccgaggcaaaatctgtgccaaagccaaaaggaaagaaaactaaagatatgaaaaagccagtgcgcgttccagcagagccccagacaatgtctgttttgatcagttgtactacttgtcattccgagttcccatcccgaaataagttgtttgatcatctgaaagccacaggccacgctagggctcctagtagcagttcattaaacagcgcaacgagctcacagtcgaagaaagagaagagaaagaaccgttag

SEQ ID NO: 27812 - DNA, 945 bp, Artificial Sequence
  Description of Artificial Sequence: Synthetic coding sequence
atgcccggattcacttgctgtgttcccggatgttacaataatagccacagagataaagccctgcacttttatacctttcccaaggatgctgaactccggaggttgtggctgaagaacgttagccgcgcaggagtatcgggctgcttctcgacgttccagcccacaaccgggcatagactgtgtagcgtgcactttcagggcggacggaagacgtacaccgtgcgcgttcctaccattttccccctgcggggagttaacgaacgaaaggttgccagaaggccagcgggtgccgctgccgcacggaggcgccagcagcagcaacagcagcagcagcagcagcagcaacaacaacagcagcagcaacagcagcagcagcagcagcagcagcagcagcagtccagtccatcagcttctacggcccagactgctcaactgcagccgaacctcgtttctgcgtcagccgctgtcctgctcactctgcaggccactgtagactccagtcaggccccagggtctgttcagcctgccccaatcactccaaccggagaggacgtgaagcctatagaccttactgtacaggtggagtttgcagctgcagaaggcgctgcagcggcagccgcagctagcgagttgcaagccgctacagccggactcgaggctgccgagtgccctatgggcccacaactggtcgtcgtgggtgaggaaggattccctgacaccgggagtgatcattcttactcgctgagtagcggaactactgaagaggaactgctgcgcaagcttaacgaacagcgcgacatactggccctcatggaggttaagatgaaagagatgaagggaagcatcagacacctgcggctgactgaggcaaagctcagggaagagttgcgcgagaaggaccgactgctcgcaatggctgtgattcgaaaaaagcacggcatgtag

SEQ ID NO: 27813 - DNA, 645 bp, Artificial Sequence
  Description of Artificial Sequence: Synthetic coding sequence
atggctggcgagaactttgccacaccatttcacgggcatgtgggccgaggggcattcagcgacgtctacgagccggcagaggacacctttctgctactcaatgctctggaagccgctgcggcagagttggcaggcgtggagatttgcctagaggtgggcagtggtagtggcgtggtctctgctttcctggcatcaatgatcggtccgcaagcactgtatatgtgcacggacatcaacccggaggcagcagcctgtaccctcgaaactgctaggtgcaacaaggtacatatccagccagtgatcacggatttagtgaaaggacttctccccagactgacagagaaagtcgacctgctggtattcaacccgccttatgtcgttactccccctcaagaggtaggttcccacggcatcgaagcggcatgggctgggggaaagaacggacgagaggtcatggacaggtttttccccctggtgccggatctcctgagcccgaagggtcttttttacctggtgaccatcaaggagaataatccagaggagatcctgaagatcatgaaaaccaagggtttacaaggcactaccgcactttctcggcaggcaggccaggaaactctaagcgtcctgaaattcacaaagtcctag

SEQ ID NO: 27814 - DNA, 1536 bp, Artificial Sequence
  Description of Artificial Sequence: Synthetic coding sequence
atgagtgggggattcgaactgcagcccagagatggcggaccaagggtggcacttgctccaggcgagacggtgattggcaggggtcctctgttgggaattacagacaaacgggtaagccgcagacacgccatactcgaggtggcagggggacaactaagaatcaagcccatccatacaaatccttgcttttatcagtcctccgagaagtcccagctgctgccccttaagcccaacctgtggtgctaccttaatcctggagattccttttctctgctggtggataagtatatattccggatactttcaattccatccgaagtggagatgcagtgcaccctacggaatagtcaggtgcttgatgaggacaacattctgaatgagaccccaaagtctcctgtgatcaacctaccacacgaaactaccggggcttcgcagcttgaaggcagcaccgagatagccaagacccagatgacccccaccaactctgtctccttcctgggggagaacagagattgtaacaagcagcaacccattctcgcggagagaaaaagaatcctccccacctggatgctggccgaacacctttcagaccaaaatctgtccgtgccggctatcagtggtggaaacgtgatacagggatctgggaaagaggagatatgcaaggacaaatcccaactgaatacaactcagcaagggcgtagacagctgatatcaagtggctcgagtgagaatacgtccgctgagcaagacacgggcgaggagtgtaagaacactgaccaagaagaatccacgattagcagcaaggagatgccccagtcctttagcgccatcactctgtccaacaccgagatgaataacatcaagactaatgctcagagaaataaactgcctatcgaagagctggggaaagtgtctaagcacaagattgctactaagcgaactcctcacaaagaagatgaggccatgtcatgcagcgagaactgttccagcgcacaaggcgactccctgcaggacgaatcccagggatctcactctgaaagtagctcaaaccccagtaatcccgaaactcttcacgcgaaagctaccgatagcgttcttcagggctctgaagggaacaaagtcaagcgcacgagctgcatgtacggggcaaactgctacaggaagaatcccgtgcattttcagcacttcagccaccccggtgacagcgattatggtggagtgcagatcgtcggtcaagacgagacagacgacaggcccgagtgcccgtacgggcctagctgttataggaagaacccacagcataaaatcgaataccgacataatacactgcctgtgaggaatgtgctggacgaggataacgacaacgtcgggcagcctaacgaatatgacctgaatgactccttcttggacgatgaagaggaagattacgaacccacggacgaggatagcgattgggaacccggtaaggaagatgaagagaaggaggatgtggaagagctgcttaaagaagccaaacgattcatgaaacggaagtag

SEQ ID NO: 27815 - DNA, 984 bp, Artificial Sequence
  Description of Artificial Sequence: Synthetic coding sequence
atggccgctgctgcggctgccgctgcggcaacaaatggcaccggaggcagttcaggcatggaggtagacgccgcagtagtgccaagtgtgatggcctgcggggtgacggggtcagtaagcgtagcgctgcatccactggtgattttgaatatatctgatcactggatcaggatgagatcccaggaaggacgcccagtgcaggtgattggcgctttgattggtaaacaagagggcaggaacatcgaagtcatgaattcatttgagctgctctcacacaccgtggaggaaaagattatcatagacaaggagtactattacacaaaagaagaacagtttaagcaggtctttaaggagctggaatttttaggatggtatacaacaggaggccctcctgatccctcagacattcacgtgcataagcaagtttgtgaaatcattgaaagtcctctgttcctcaaacttaaccccatgactaaacacaccgacctgcccgtgtctgtctttgagtcagtgatcgacataatcaacggggaagccacaatgctatttgccgagctgacctacaccctggccaccgaggaagccgaaaggataggtgtggatcacgtagcccgtatgacagccaccgggtccggagaaaacagcacagtcgctgagcacctgattgcccagcattccgctataaagatgttacacagccgcgtgaaattgatcttggaatatgtgaaagcctccgaagccggtgaggtgccgtttaatcatgagattctgagagaggcatacgcgctctgtcattgcttgcccgtgttatctaccgacaagtttaagacagatttctatgaccaatgtaatgacgtgggactgatggcctatctcgggacgattacgaagacttgcaacaccatgaaccagtttgtgaataaattcaacgtcctgtacgatcgtcaggggattgggagaaggatgcggggtctttttttttag

SEQ ID NO: 27816 - DNA, 2574 bp, Artificial Sequence
  Description of Artificial Sequence: Synthetic coding sequence
atgaattaccaacagcagctcgccaatagcgcggcaattcgtgcagagatccagcgcttcgaatccgtgcaccccaacatatacagcatctatgaattactggaacgagtggaggagccagtgctgcaaaatcagattcgagaacacgtaatcgctattgaagacgcctttgttaatagccaggagtggactctctctcggtctgttcccgaactaaaggttgggatcgtgggtaacctggcctcgggcaaaagcgccctggtccacagatatctcaccggtacctatgtccaggaagaaagccctgaaggcggtagatttaagaaagagatcgtagtcgatggtcagagttacctcctgttgattcgggacgaaggtggcccacccgaggctcaattcgctatgtgggtagacgcagtaatcttcgtgttttcgcttgaggacgagatctcattccaaactgtgtatcactactactcaaggatggccaattatagaaacaccagcgaaatcccactggtactggtgggtacacaggacgctattagtagcgccaatccgagggtcatcgatgacgctcgagctcgaaaacttagcaatgatctgaagcgctgtacttattatgagacctgtgccacgtatggacttaatgttgagagggtgtttcaggacgttgcccagaaaatcgttgctactagaaagaagcaacaactgagcatcggcccttgcaagtccctgccgaactctccctcacacagtagcgtttgttctgcgcaggtatcagccgtgcacatcagccagacctccaatggcggaggaagcctgtcagactactcttcaagcgtgccctctacacccagcacctcccagaaggagcttcggattgacgttccgccaaccgcaaatacgcccacgccggtgcggaagcagtccaagagaaggagtaacctcttcacatcaagaaagggatcagacccagataaggaaaagaaaggcttggagtctcgcgctgattccataggatctgggcgtgctattcctattaagcaaggcatgttgttgaagagaagtggaaagagtctgaataaagaatggaagaagaagtacgtcacactctgcgacaacggtgtgctgacctaccacccaagcctgcacgactatatgcaaaatgttcacggaaaggagatcgatctgctgaggactacagtaaaggtccctggcaagaggcctcccagagcgacatccgcctgtgcacccatcagcagcccaaagacgaatggactctccaaggacatgtcctctcttcacatctcacccaattccggaaacgtgactagcgcttctggctcacagatggccagcggcatttcccttgtgtcattcaattcgagaccagatgggatgcaccagaggagttactccgtcagttccgcagaccagtggtctgaggctacagtgattgcaaatagtgcaattagcagcgacaccgggttgggcgatagcgtgtgctcctccccctcaatctcctccacaactagccccaaactcgacccacctcctagcccgcacgcaaacagaaaaaaacatcgcagaaaaaaatccacgagcaacttcaaggcagacggcctgtctggcaccgccgaggaacaagaagaaaattttgaattcataattgtgtcgctcacgggacagacctggcattttgaagccactacatatgaagagcgcgatgcatgggtgcaggcaattgagagccaaatattggcatccttacaatcatgcgaatccagtaaaaataaatcccggcttactagccaatccgaggctatggcgctccaaagcattaggaatatgagaggcaactcccattgcgtggactgtgagacccaaaatcccaactgggcgtcactcaacctgggagccctgatgtgcatcgagtgttccggcatccacaggaatctcggcacccatctcagtagagtgcggtctttagatctggacgattggcccgtggagcttattaaggttatgagctctatagggaatgaactggccaacagcgtgtgggaagagagttcccagggacggactaaaccaagtgtggactcaacaagggaggagaaagaacggtggatccgggctaagtacgagcaaaaactgttcttggctccactaccatgtaccgaactctcactcgggcagcatctcctccgagccacagcagacgaagacttacgaactgcaatcttactgctggcacacggtagcagggacgaagtgaacgagacttgtggggagggcgacggacgtactgcgctacacttggcatgcaggaagggcaatgtggtgttagcccagctgctcatatggtatggggttgacgtgaccgcccgagacgcccacggtaatacagccttggcctatgctcggcaggcgtcatctcaggaatgcatcgacgtattactgcagtacggctgtcccgatgagcggttcgttcttatggctacgcccaatctctcccggagaaacaataataggaacaattcatcaggccgagtgccaacaatcatctag

SEQ ID NO: 27817 - DNA, 1653 bp, Artificial Sequence
  Description of Artificial Sequence: Synthetic coding sequence
atgtctcagacatctcttaagcagaagaagaatgaacccggaatgcggtcatccaaagagtcactggaggctgaaaagaggaaagagtcagataagaccggtgttcgtctttcaaatcagggtagccaagagtcgagtctacgcaagacggactcaaggggctatctcgtcagaagtcagtggagccgaatttctaggtcaccctccacaaaggcccctagcatcgatgagccgagaagccgaaacacttccgcaaagctcccctcgtcatcaacctctagccggactccgtcaactagtccttctttgcacgacagcagccctccaccattgagcggccaaccgtctctgcagcctcccgcttccccacagctgcccagatccctggattcgaggccgccaacacctccagaacccgatccagggtcccgaaggtctactaagatgcaggaaaaccctgaggcatgggcccagggcatagtaagggaaatccgtcagactcgagattctcagccactggagtatagtcgcacgagccccactgagtggaagagctcaagccagagaagaggaatctaccccgcttcaacccagttggacagaaactccctctctgagcaacagcagcaacagagggaggatgaggacgactacgaggcagcttactgggcctctatgcgatctttttatgagaagaatcccagttgttcgagaccttggcccccaaagcctaaaaatgcgataactatcgccttgtcgagctgcgcactgttcaacatggtagatggacgcaaaatttacgaacaggagggcttagaaaagtatatggagtaccaattaacaaacgaaaacgtgatcctgaccccgggacctgcattccgcttcgtcaaagcactgcagtacgttaatgcacgtctgagggacctctaccccgacgagcaagacctgtttgatatcgtgctcatgacaaataatcatgcccaggtgggagtccgcctcattaattccgtaaaccactatggtctcctaatcgaccgcttttgtttaactggcggaaaggatcctatcgggtacttgaaagcttaccttaccaatttgtatatcgctgcagatagtgagaaggtgcaggaggccatacaggagggaatcgcttctgcaactatgttcgatggggctaaggatatggcctattgtgatacccagctacgcgtcgccttcgacggcgatgctgtcctgtttagcgatgagagcgaacatttcacgaaggagcacggtctggacaaattcttccagtacgacactttatgcgaatctaagccgttggcgcaggggcctctgaaaggtttccttgaggacctcggccgtcttcagaagaaattttacgccaagaatgagcgcctcttgtgccccatccggacatacctggtgacagcacggtccgcggctagttccggcgctagggtgctgaaaacacttcggagatgggggctcgaaatagatgaggctctgttcctggctggcgcaccgaagagtccgattctggttaaaatacgcccacacattttcttcgatgatcatatgttccacatcgagggagcgcagcgactcggatcaatagcagcgtacgggtttaacaaaaaattctcttcctag

SEQ ID NO: 27818 - DNA, 888 bp, Artificial Sequence
  Description of Artificial Sequence: Synthetic coding sequence
atgcctgtccatacgctctccccaggagccccttccgctccagcgctgccatgccgcctgcggacgcgtgtgcccggatacttgctcagggggccagccgatggcggtgcacggaaacccagcgcggtggaacgtctggaggcagataaggccaaatacgttaaatccctgcacgtggccaatacaagacaggaaccggtccaaccacttcttagcaaacagcccctctttagcccagagaccagacgcacggttctgaccccgtctcgtcgggcactgcctggcccatgcaggcgaccacagctcgacttggatatcttatcatcgctaatagacctttgcgacagtccagtgagccctgccgaggcatcccgcaccccgggaagagccgagggtgcaggtcgccctcccccagcaactcccccacggcctcctccctctaccagtgcggtaagacgcgtggatgtccgtcccctgccagcctctccagctagaccctgcccttcgcctggccctgcggcagccagttcgcctgctagacctccagggttgcaacgttcaaaaagcgacctgtctgagcgtttcagtagggcagccgcagacttagaaagattctttaatttctgcggattagatccagaggaggccaggggcttgggagtcgcacacctggctcgggcatcctccgacatcgtaagccttgctggcccttcagcaggtccaggctcttctgaaggcggttgttctcgacgatctagcgtgactgttgaggagagagctcgcgagcgcgtcccatatggagtcagcgtcgtcgagcgaaacgcaagggtgataaagtggctctatggcttgcgccaggccagggagagcccagctgctgaaggttag

SEQ ID NO: 27819 - DNA, 549 bp, Artificial Sequence
  Description of Artificial Sequence: Synthetic coding sequence
atgtcaggtcgaagtgtgccacatgcccatcctgctacggccgagtacgagttcgccaacccttctagacttggggagcaacgtttcggcgaaggcctgctgcccgaagaaatcctcacacccacgctataccatggatactatgtcaggcccagggctgccccagcaggcgagggttcacgggctggggcaagcgagctccgtctgtcggagggaaaatttcaggcatttctggacgtcagtcactttacgcctgatgaagtgacagtgcgaacagtcgataacctcctggaggtgtccgctcgtcatcctcagagactggatagacacggctttgtgtctagggaattctgtcggacttatgtgctccccgctgacgttgacccctggcgcgtgcgggctgcactgagccacgatggtattctcaacctcgaagcccctcggggaggcaggcacctagatacagaggtgaacgaggtctatattagtctgttgccagctcccccagaccccgaagaggaggaagaggcagccattgtggaaccatag

SEQ ID NO: 27820 - DNA, 636 bp, Artificial Sequence
  Description of Artificial Sequence: Synthetic coding sequence
atgagcaccgcggcagtccccgagctgaaacagatctcccgggttgaagcaatgaggctcgggccaggttggagccattcttgccatgcaatgctttacgccgctaatcccggacaattgttcggtaggatacccatgcggttctctgtcctgatgcagatgcgctttgacggcctgcttggtttcccagggggatttgtggaccgcaggttctggagtcttgaggacggcttgaacagggtcctcggattaggcctggggtgccttcgactaaccgaggccgactatctgagttcccacctcaccgagggcccacatagagtcgttgctcatctgtacgcccgacagctgacactcgaacagctgcatgcagtagagatatctgctgtccacagtagggaccacggcctggaggttctaggcctcgtgcgagtcccgctgtacacacaaaaggatagggtagggggtttccccaactttctgtccaacgcatttgtgtcaactgcgaaatgtcagctcctgtttgccctcaaggtgctgaatatgatgccagaagaaaaactagtggaggccctggctgcggcaaccgagaagcagaagaaggcgctggaaaagctgctcccggcatcttcttag

SEQ ID NO: 27821 - DNA, 2622 bp, Artificial Sequence
  Description of Artificial Sequence: Synthetic coding sequence
atgcatccaccgcctcctgctgcagctatggactttagtcaaaactcactgtttggttacatggaggacctacaggagctgacaataatagagaggcccgtgcgacgctcgctaaaaactcccgaagaaatcgaaagactcaccgtggacgaggatttgtcagatatagaacgggcagtttatctactgtcagcagggcaggatgtgcaaggtaccagtgtaatcgccaatctaccttttctgatgcggcagaaccccacggaaactcttcgtcgggtgttgcccaaagtgcgggaagcgcttcatgttgcgggtgttgagatgcagttaactgcagcaatgtcattcctgacaatccttcaggacgaatccgtctccatacacgcctatacacactcatttttgcaggtcatactactgcacctagaacaccgagacacgggagtgtccaacgcctggctggagacattgctgtccgtgattgaggtgcttcctaaagaaacactgcgccacgagatcctgaacccgctcgtgagcaaggcccagctctcacagacagtccagagtcgactggtttcctgcaaaattctcggcaagctcacaaacaagtttgatgcacatactattaaacgggaaattctgcctttggttaagagcctgtgtcaggacgtggagtacgaggtgagaagctgcatgtgtcgacaactggagaatatcgctcagggtataggcaccgagctgaccaaaagcgtcgtcctgcccgaattgatcgagctcagcagagacgagggatcttctgtgagactcgcggcatttgagactctggtcaatctcctagatatctttgacaccgatgatcgtagccagactattttgccactcgtgaagtccttttgcgagaaatcttttaaggccgacgaatccatcctcatctccttgtcattccaccttggcaagctctgccacgggttgtacggaattttcacacccgaccaacatctgagatttctcgaattctataaaaaactatgtacactgggattgcaacaggagaacggacacaacgagaatcagattccacctcagatcctcgagcaagagaaaaaatatatctcggtgcggaaaaactgcgcatacaatttcccagccatgatagtgtttgtagaccccaagaattttcatatggaactttactctacctttttttgcctgtgtcacgaccctgaggtgccagtccgctataccatcgccatctgtttctatgaagtatccaagctgctgaatagcggcgtatatttgattcacaaggaactgattacacttctccaagacgagtccctggaggtgttggacgcactgatagaccatctgccagagatcctcgagcttatgagcaccggaggtgagtcgagcgttcaagagaataagctcagttcgctccctgacctaatacccgctctgactgccgctgagcagcgcgctgccgctagcttaaagtggaggacacatgagaaacttttacagaagtacgcttgcctgccacatgtaatctcaagtgaccagatctactacagattcctccagcggatgtttactattatgatgactaacaacgtgttacctgtccagaaagcggcatcccggacattatgtatttttctccggtacaatcggaaacaggagcaacggcacgaggtgatacagaagctgatcgagcagctgggacagggcaagagctactggaaccggttaagatttttggacacttgtgaatttatcatcgaaatattcagtaaatccttcttctgtaagtacttctttttacctgcaattgagctaactcatgaccctgttgccaatgtgagaatgaaactttgttacctattgccgaaggtaaagagcaccctaaaaatccccgctgacaagcatctgctgcagcagttggaaatgtgcgtcagaaagttactctgccaagagaaagacaaggacgtgcttgctatcgtgaagcggaccgtgcttgaactagaccgcatggaaatgtctatggacgcattccagaagaagttctatgagaaggacctgctggatcaagaaaaagagcgtgaggagttgctcctcctggaaatggagcaactggaaaaagaaaagcagcagaatgacgggcgacctatgagtgacaaaatgttcgagaagaagcgcagagacacgaaaacacctacacagtctctgcctaagaacattcctatctcggtgcccggtcccagctcagtcactccttctactagcaaggagataaaaaagtccaaactgattaggagccagagcttcaacaatcaggccttccacgcaaagtatggaaatctggaaaagtgtgcctcaaagtcttcaaccactggctataccacctccgtcagcggtctcgggaagacctccgtgctgtcccttgcggacgactcctttagaaccaggaacgcatcaagcgttcctagttcttttagccccaatactcccctcccttccacctccaggggcactggaaacagtgtcgatccaaaatcatccgggagtaaggacacacagcctcgcaaagcgacactcaaatccaggaaaagtaacccctag

SEQ ID NO: 27822 - DNA, 951 bp, Artificial Sequence
  Description of Artificial Sequence: Synthetic coding sequence
atgcgtcagccactgagctggggtcgttggagggccatgttggccaggacctacggaccagggccaagcgcagggtatagatgggcatctggggcacagggatatgttcggaaccctcccgttggagcttgtgatctccagggggagctcgatagatttggaggtatctccgtgcgactagcacgactcgatgcactcgaccggctagacgcggctgcgttccaaaagggcctccaagccgctgtacagcagtggcggtcagagggtagaaccgcagtctggctccatattccaatcctgcagtcccggtttattgcacccgctgcatcgcttggcttctgtttccaccacgcagagtccgatagtagcaccctgaccctttggctgcgcgaaggcccatctaggctcccgggttacgcttcgcaccaggtaggcgtggcgggagcagtgttcgacgagtcaaccagaaagatcctggttgttcaggaccgcaataaattgaaaaacatgtggaagtttccaggtggattgtccgagcctgaggaggatatcggtgacacggcagtacgggaggtcttcgaggaaacggggataaagagcgaattccgaagtgtgttgtctatccgacagcagcatacgaatcccggtgcctttggtaagtccgacatgtacatcatttgcaggctaaaaccctatagctttactattaatttttgtcaagaggaatgcctgagatgcgaatggatggatttaaatgatcttgccaagactgagaacacaacgcccattaccagtcgtgttgcgaggctcttgttatatggctacagggaggggtttgacaagatcgatctgactgtagaggaactgcccgctgtatacacggggctgttctacaagctgtatcataaagagctgccggaaaactataagacaatgaaaggcattgactag

SEQ ID NO: 27823 - DNA, 537 bp, Artificial Sequence
  Description of Artificial Sequence: Synthetic coding sequence
atgggggaaacatggaagaacatttgttccactgttaggcatggctggtggctgcgcgaccaccgcatggccggacttcccatccctccagagattgttaaggaagcagaagtgccacaggccgcacttggtgttccggctcagggcaccggggataacgggcatacacctgtcgaggaagaggtgggcggtatcccagtgccagccccaggtctcctgcaggtgactgaacgcagacaacctctctctagtgtctcaagcctagaggttcattttgaccttctagacctcaccgagctgacagacatgagtgatcaagagcttgcagaagtgtttgccgattcagacgacgaaaaccttaacactgaaagtcctgccggtctgcacccactgccccgtgccggatatctgcgcagtcctagctggaccagaaccagggcagaacaatcacatgaaaaacagccactgggcgatccagagcgacaggcgactgtgctggatacatttctaaccgtcgaacgaccacaggaagactag

SEQ ID NO: 27824 - DNA, 741 bp, Artificial Sequence
  Description of Artificial Sequence: Synthetic coding sequence
atggccgagcaggagcagagaaaaatacctctcgttcccgaaaacctgcttaaaaagcgcaaggcgtatcaggcactgaaagcaacacaggccaaacaagcactcctggcaaaaaaggagcagaagaagggcaaaggtctgaggtttaaaagactggagagttttctgcatgacagttggcgtcagaagcgggataaggtcaggctgcgaaggttggaggtgaagccccatgctctcgagctccccgacaagcacagtctagcctttgtggtcagaatcgaaaggatcgacggagtcagtctgctggtgcagaggaccattgcaaggttgcgtttgaagaaaatcttctccggtgtatttgtgaaggtgaccccccaaaacttgaagatgttaaggattgtggagccatacgtcacttggggatttcctaatcttaagtcagtgagagagcttatattgaagcgcggtcaagcaaaagtaaaaaataaaacaatcccattgacagataacacagtaattgaggagcatctaggaaaatttggcgtcatctgtttggaggatctcattcacgagattgcctttcctggtaagcattttcaggagatctcctggtttctgtgccccttccacctctccgtagccagacacgccacaaagaaccgcgttgggtttctgaaagagatggggacgcctgggtaccggggtgaaaggatcaatcagttaattcgacaactgaactag

SEQ ID NO: 27825 - DNA, 2442 bp, Artificial Sequence
  Description of Artificial Sequence: Synthetic coding sequence
atggcatggccctgtatcacccgggcttgctgcattgctaggttttggaaccaactggataaagcagacattgccgtacctcttgtgtttaccaaatactcagaggctacagagcatccgggagcaccaccacagcctccccctccacagcaacaggctcagcccgctctcgcacccccatctgctcgcgctgttgcgattgaaacccagcccgctcagggagaattggatgccgtcgccagggctacaggaccagccccaggccctaccggagagcgtgaaccagcagctgggccaggacgctcaggaccaggtcccggactcggcagcggttcaacttcaggcccagcagactctgtgatgcgtcaggattatcgcgcatggaaagtccagagacccgaaccctcttgtcgcccacgttctgaatatcagccttcagacgcacccttcgagcgggagacccagtatcagaaggactttagggcatggccactgccacggagaggcgaccacccatggatcccaaagccagtccaaatcagcgccgcttcacaagctagcgctccaatactgggagcccctaaaagacggccacagtcacaggaaaggtggccggtccaggccgcagctgaagctcgtgagcaggaagccgctcccggtggagcaggcggtttggccgcaggcaaggcgtccggggctgatgagcgtgacacccggaggaaagctggtccagcttggatcgtgagacgcgctgaggggctgggccatgagcagacacccctgcccgctgcgcaggcacaagtacaggctaccggtccagaggctggacgaggacgagctgccgctgacgctctgaaccggcagattagagaggaagtggcctctgctgtgtcctcatcttatcggaatgagtttcgcgcatggaccgacattaagcctgtgaagccaattaaggcaaagccacagtacaagccacctgacgataagatggttcacgagacgagctatagcgcacaatttaaaggcgaagcaagcaagccgaccaccgccgataacaaggtgatcgataggaggcggatccggtcactatatagtgagcccttcaaagagcctccgaaggtggaaaagccatctgttcagtcatccaagccaaagaagacctccgccagtcacaagcctacacggaaagctaaggataagcaggccgtgtctggccaagcagcaaaaaagaagtcggctgagggtccgagcactaccaaacccgacgacaaggaacagagcaaagagatgaacaacaaattggccgaagcaaaagaatcgctggcccaacccgttagtgatagtagcaagacccagggccctgtggccacagaacccgacaaggaccagggatccgtagtccccggtctacttaaggggcagggccctatggtgcaggagcccctgaaaaaacaggggagtgttgtgccgggtccccctaaggatttgggccctatgattccactgcccgtgaaagatcaagaccacaccgtgccagagccacttaaaaacgagagccctgtgatttccgccccagtaaaagatcagggacctagcgtgcctgtcccccctaaaaatcagtccccaatggtgccggcaaaggttaaggaccagggaagtgtggtaccagagtctcttaaagatcaggggccacggatccccgagccagttaaaaatcaggccccaatggtgccagcacccgtcaaggatgaaggcccaatggtttccgctagtgttaaggatcaaggtcctatggtctccgctccagtaaaggatcagggtcccattgtccccgctccagttaaaggcgaggggccaatcgtacccgcacccgttaaggatgagggaccgatggtgtctgccccaattaaagaccaggaccctatggtgcctgaacatcctaaggatgagagtgcaatggctacagccccaattaagaaccagggctcgatggtgagcgagcccgtgaaaaaccagggcctcgttgtttccggcccagtgaaggatcaggacgtagttgttcccgaacatgccaaggtccacgattcagccgtggtcgccccagtgaaaaaccagggcccagtggtaccagaaagtgtaaaaaatcaggacccaatcctcccagtgctagtgaaggatcagggaccaaccgtgctacagccacccaagaaccaggggaggatagtccccgagccactcaagaatcaagtgccaattgtgcccgtacctttaaaggaccaagacccgttggtacccgtcccggctaaggaccagggacctgctgttcctgagcccctgaagactcaaggaccaagggacccccaacttcctacagtatccccactccccagggttatgatacccaccgccccacacaccgaatatatcgaatcatccccttag

SEQ ID NO: 27826 - DNA, 261 bp, Artificial Sequence
  Description of Artificial Sequence: Synthetic coding sequence
atgccacagtaccagacatgggaggagttcagcagagcagcagagaagttatatctggcggatccaatgaaagcgagagtggtgcttaaataccgccactcagatggtaacctctgtgtgaaggtgacggatgatcttgtctgcctggtttacaaaactgatcaggctcaggacgttaaaaagattgagaagtttcattcacagctgatgaggttgatggtcgccaaggaggcaaggaacgttaccatggaaaccgaatag

SEQ ID NO: 27827 - DNA, 1206 bp, Artificial Sequence
  Description of Artificial Sequence: Synthetic coding sequence
atggcccatgtttccagcgaaacccaagatgtaagtccaaaggatgaattaactgcaagtgaggcctctaccaggtcccccttgtgtgagcatacttttccaggcgactctgacctccgatcaatgattgaggaacatgccttccaggtgctctctcagggtagcctgctagaatcaccgagttacacagtatgtgtgtcagaacctgataaagatgatgactttctctcactgaacttccctcgcaagttgtggaagatagtggagtcagatcaattcaagtccatctcgtgggatgagaatggtacatgcattgtcatcaacgaggagctgttcaaaaaggaaatcctggaaaccaaagccccttatcggatttttcagacagacgccattaaaagctttgtcaggcagcttaacttatatggcttttccaagatacagcagaacttccaacgcagtgcttttctggctactttcctgtctgaggaaaaggagtccagcgtcctgtctaagctgaaattttactacaatcctaactttaaaagagggtacccacagttgcttgttcgagtcaagaggaggataggggtgaagaatgcttcccccatctctaccctgttcaacgaggattttaacaaaaagcacttcagggcgggtgctaatatggaaaaccacaatagcgcattggccgctgaagcaagcgaagagtcgctgttcagcgcatcaaaaaacctcaacatgccccttacacgcgaatcttccgttaggcagatcatagcaaatagtagcgtcccgattcggtctggatttccgccaccatcccccagtacaagcgttggaccttctgagcagatcgctacagaccagcacgccattctgaatcagctcaccacaatacacatgcattctcattcaacgtacatgcaggcccgagggcatatcgtaaatttcatcactaccaccacttcccagtaccatatcataagcccactccagaacggctacttcggcctcaccgtcgaacccagtgccgtgccaacacggtacccactggtcagcgtgaatgaagctccataccgaaacatgctgccggctgggaacccctggctacaaatgccgacaatagccgatcggagcgccgctcctcacagcaggcttgcactgcagcctagcccacttgataagtaccacccaaactataattag

SEQ ID NO: 27828 - DNA, 4302 bp, Artificial Sequence
  Description of Artificial Sequence: Synthetic coding sequence
atgtggtctttaacggcatctgagggtgagtctactaccgcccacttctttctcggcgcaggagacgaagggctgggcactaggggcattggaatgagaccagaggaatccgattctgagcttctagaggacgaggaagacgaagtgccacctgaaccacagatcattgtcggaatttgtgctatgacaaaaaagtccaagagcaaacctatgactcagatcctggagcgcctctgtagatttgactatctgacggtggtgatcctcggagaagacgtaatattaaacgagccggtggaaaattggccctcatgtcactgcctgatcagctttcactcaaaagggttccccctagacaaggccgtggcatactcgaaacttcgcaatcctttcctgataaatgacctggccatgcagtattacatacaggataggagggaggtgtatcggatactgcaagaggaaggtatcgacctgcctaggtatgccgtactgaatcgggaccccgctagacccgaggagtgcaacctgattgagggcgaagatcaggtcgaggtgaatggcgctgtgttccctaaaccatttgtggaaaagcccgtgagcgccgaagatcacaatgtgtatatttattatccctcctctgcgggtgggggaagtcaaaggctgttcagaaagattgggagccgttccagtgtgtactcccctgagagctcagtgaggaagactggctcgtacatttacgaagaatttatgcctactgacggcacagacgtgaaagtgtacactgtgggaccggattatgctcatgccgaggctcggaaatctcccgctctggacggaaaagttgagcgggattcagagggcaaagaaattagataccccgtcatgctgactgcaatggaaaagttggtggccagaaaggtctgcgttgcctttaagcaaaccgtatgcggattcgatctgctgcgagccaacggtcacagctttgtctgcgatgtgaacggctttagctttgtgaagaattccatgaaatactatgacgattgtgcgaagatcctggggaacaccatcatgagggagctggcccctcagtttcagattccttggtctatcccaacagaagctgaagacatccccatcgtgcccactacaagcggcactatgatggagctccgttgtgtgatcgcaatcatcaggcacggcgacaggacacccaaacagaagatgaagatggaagtcaaacaccctcgtttttttgccctgtttgagaaacatggtggatacaagacgggaaaattgaagctgaaacgccctgagcagctgcaagaggttctggacatcacacggcttctgctagcagagttagagaaggagccgggaggggagatagaggagaagaccgggaagttggagcagctcaagagtgtactcgagatgtatggacacttttctggaatcaacaggaaggttcagcttacgtattatcctcacggagtgaaagccagtaatgagggacaggacccacaacgagaaacactggccccatctttgctgcttgtcctcaaatggggcggtgaactgacacctgcgggtagagttcaggccgaagagctggggcgagcctttagatgtatgtatcccggagggcagggagattacgccggatttccaggatgcggtctgctgcgtctccactcgaccttccgccatgatctaaaaatctacgcttctgacgaaggtcgagtccagatgacagccgctgcattcgcaaagggactgttagcgctggagggagagctgaccccaatcctggtacagatggtgaagagcgcgaatatgaatggtcttttggacagcgatggagacagcctgagctcttgccaacatagggtgaaagcaagattgcaccatatcctacaacaggacgctccatttggacccgaagattacgatcagctggcgccaactcgatccactagcctgctgaattctatgactataatccagaacccagtgaaggtgtgcgatcaggtcttcgctcttatcgagaatctgacccatcagatcagagagagaatgcaagatccccgatccgtagaccttcagctctatcatagtgagactctggagcttatgctgcagcgctggtccaaactggagcgggactttcgtcagaagagtggccgatacgatatttcaaagatccctgatatatacgattgcgtcaagtacgatgtgcaacataacggatccttgggattgcaggggacagccgaacttctccggttgagcaaggcactggctgatgtagtcatcccacaggagtatggcatttctagggaagagaaattagaaatcgctgtgggtttctgtttaccacttctgcgcaaaatcctgctggatctacagcgaacccacgaggacgagagcgtcaacaaactgcatccattatgctacctgcggtactctcgaggcgtgctgagcccagggagacatgtacgtacacgcctgtactttaccagtgagtctcacgtgcacagtctactgagtgtgttcagatatggcggtctcctcgatgagacacaggatgcacagtggcagcgagcactcgactacctgtctgcaatctctgagctgaattacatgacccaaatcgttataatgctctacgaagataacactcaggatccactgtctgaggagagatttcatgtcgaattacacttttcccctggggtgaagggtgtggaggaggagggaagcgcgccagccggttgtggattcagaccagcctcctctgaaaacgaggaaatgaagactaatcaaggcagcatggagaacctctgccctggcaaagcctcagatgagccagatcgagccttgcagacctccccgcagcctccagagggacccggattgccacgcaggtctcccctgattcgtaacaggaaggccggttcgatggaggtgctttcagaaacgtcaagcagccgcccaggaggttatagactctttagcagcagcagaccccctaccgaaatgaaacagtcagggctcggatcacagtgcaccggcctgttctctaccacggtcttgggaggttcgagcagcgccccaaatctgcaggactatgccaggtcacatgggaagaaactgccccctgcatctctgaaacatagagacgaactcctcttcgtacccgctgtgaaaagattttcagtgtccttcgctaagcacccaactaacgggtttgaagggtgtagcatggtcccgactatctatccattggagactctccacaacgcgttgtcactccgacaagttagtgagttcttgagccgagtgtgtcagcgccatactgatgcccaggctcaggctagtgcagctctattcgactccatgcacagctcgcaagctagcgacaacccattcagcccccctcgtactctacactctccacccttacagctccagcagcggagtgaaaagccaccttggtattcatcaggaccatcttctacggtgagcagtgcagggccaagttcgcccacaactgttgatgggaattcccagtttggatttagcgaccaacccagcttaaacagccacgtggctgaggagcatcagggcctggggctcttgcaggagactcccggaagcggagctcaggagctgagtattgagggggagcaggaactgtttgagcctaatcagtcgccacaggtcccccctatggaaaccagccaaccttacgaggaagtgtctcagccttgccaggaggtgccagacatctctcagccttgtcaggatataagcgaagcactgagccagccctgtcagaaagtccccgacatttcccaacagtgtcaggaaaatcacgacaatggtaaccacacctgccaggaggtcccccacatcagccaaccatgccaaaagtcatcccagttgtgtcaaaaagtgtccgaggaggtctgtcagctgtgcctcgagaatagcgaagaggtgagccagccttgccagggagtgagtgtcgaagtcggtaaattagtgcataaatttcacgtaggggtgggaagcctggtgcaggaaaccctggtggaggtcggtagtcccgctgaggagatacccgaggaagtgatccagccatatcaagagttttccgtagaggtggggaggctggcgcaggagacctctgccatcaacttgttatcccagggtatccccgagattgacaaaccatctcaggagtttcccgaagagatcgacctccaggcccaggaggtgcccgaagaaattaattag

SEQ ID NO: 27829 - DNA, 1137 bp, Artificial Sequence
  Description of Artificial Sequence: Synthetic coding sequence
atggactctgtacgctctggtgcctttgggcaccttttcagacccgataactttattttcggacagagcggggctggcaacaactgggctaagggacactatactgaaggagcagagcttgtggatagcgttctggacgtcgtaaggaaagaatgtgaaaactgcgactgcctccaggggttccagctgacccactcgctcggaggcggtaccggatccggaatgggtaccctcttgatatccaaggtgagagaggaatatcctgatagaattatgaacacattctccgttgtgccctctccaaaggtctcagacactgtagttgaaccatataacgcaacactgtcgatacatcagctggtggagaacaccgacgagacatactgcatagacaatgaagcgctgtacgatatctgtttcaggacattaaagctggccaccccaacttacggcgacctgaaccatctggtgagcgccacaatgtccggtgtcacgactagcctgagattccccggacagcttaatgccgacctgagaaagctggctgtaaacatggtgcctttccctcggctccatttcttcatgccgggatttgcacctctgactgcccgtggctctcagcagtacagggcgctcactgtgcctgaactgacacagcaaatgttcgacgctaaaaacatgatggctgcttgcgatcctaggcatggcaggtacctgaccgtggctactgtgtttaggggcaggatgtcaatgaaagaagtggatgaacagatgctcgccatccagtccaagaacagttcttacttcgtggaatggattcccaacaatgtgaaggttgctgtatgcgatattcctcctaggggtctgaaaatgagttcgacattcatcggaaattccactgccattcaggagctgttcaaacgaatttcggaacagttcacagcgatgtttcggaggaaagcctttctgcactggtacacaggtgaagggatggacgagatggaatttacagaagcggagtccaacatgaacgatctggtttccgagtatcagcagtaccaggacgccaccgccgaggaggaaggggagatgtatgaagacgacgaagaggaatccgaagcccagggtcctaagtag

SEQ ID NO: 27830 - DNA, 1161 bp, Artificial Sequence
  Description of Artificial Sequence: Synthetic coding sequence
atgtgcgagcgggctgcaaggctgtgccgggcaggtgcacaccgtcttctgcgggaacctccccagcaggggagggccttgggaggcctcctgagatgggtgggcgcacgcatgggcgaaccaagggagtcattggcacccgctgctcccgctgaccctggcccagcctccccacgaggaggaactgctgtgatacttgacatttttcgccgagccgacaagaacgatgatggcaaattgtccttagaggagtttcagctgttcttcgccgacggggtgctgaatgaaaaagaacttgaggatttgtttcacaccatagattccgataatactaatcatgtggacaccaaggagctgtgcgactacttcgtggaccatatgggggattatgaagatgtattagcttccttggagactctgaatcatagtgtgttgaaggccatgggatataccaagaaggtgtatgagggaggaagcaacgtggaccagtttgtgacaaggtttctgcttaaagagacagctaatcagatccagtccttactgagtagcgtggaatccgcagttgaggccatcgaggaacagaccagccaattgcgacagaaccacatcaaaccgagccactccgcagcacagacctggtgtggaagtcctactcccgctagcgctcctaaccacaaattaatggcaatggagcagggtaagacacttccgagcgctacggaggatgctaaagaagaagggctggaagcacagatcagccgcttagcagagctgatcggcagactcgagtctaaggcactctggtttgatctccagcagcggctgtccgacgaggatgggacaaacatgcacctccagctggtgcggcaggagatggccgtctgcccggagcagttgagcgagtttcttgactcactccgacagtatcttcggggtactactggggtcagaaactgcttccacattacagctgtgcgtctttccgatgggttcaccttcgttatctacgagttttgggagaccgaggaggcatggaagcgccacctacagtctcctttatgtaaggcattccgacatgtaaaggtggataccctatcccagcccgaggccctgagcagaatccttgtgcctgctgcctggtgcaccgtgggccgagactag

SEQ ID NO: 27831 - DNA, 1482 bp, Artificial Sequence
  Description of Artificial Sequence: Synthetic coding sequence
atggagcgaagccctgatgtaagccccggtccctcccggtccttcaaggaagagctgctgtgtgctgtctgctatgatcctttccgtgatgccgtgacactcaggtgtggacataatttctgcaggggttgcgtctctcggtgctgggaagtacaggtctctcccacctgccctgtgtgtaaagatcgagcgtcacccgctgacctaaggacgaatcacacattaaataacctggtggagaaactgcttcgggaggaggcagaaggcgctaggtggacctcataccgtttttctcgggtgtgtcggctgcaccggggacagctgtctttattttgcttagaggataaggagctcctgtgttgcagttgccaggctgacccacggcatcaggggcaccgtgtccaaccagtcaaggataccgcccatgatttcagggctaagtgccgaaacatggagcacgccttgagggaaaaggctaaagccttttgggccatgagaagaagctatgaagccatcgccaagcacaatcaggtggaagcagcgtggctggagggtagaatacgtcaggagttcgataagcttcgtgaattcctcagggtggaagaacaggccatcctggacgcgatggccgaggaaacccgtcaaaaacagttactggccgacgaaaagatgaaacaactgactgaagaaacggaagtgttggcgcacgaaatcgagcgtctgcagatggagatgaaggaggacgatgtttcattcttgatgaaacacaagtcccgcaagcgcaggttgttttgtacgatggaacccgagcccgtccaaccagggatgcttatcgacgtgtgtaagtacttgggcagtctgcagtatcgcgtgtggaagaagatgctggcctctgtcgagtcagtccccttctcttttgaccctaacacggctgctgggtggcttagtgtgtccgatgacttaacctccgtgacaaaccacggatatcgggtgcaggtggagaatccagaacggttcagcagtgctccctgcctcctgggcagtagggtgttttcacaggggtcccatgcatgggaggtggcgttgggcggacttcagagctggagagtgggcgtcgtcagggtcaggcaggatagcggggcagagggccacagccatagttgctatcatgacacccgctctgggttttggtacgtatgccggactcagggcgtcgagggtgatcattgcgtaacaagtgaccctgcaactagcccccttgtgctggccatccctcggcgactcagggtggaactggagtgcgaggagggggagctgtccttctacgacgccgagcgccattgccacctgtacaccttccacgcgcgatttggagaggtcagaccctatttttatctgggcggtgcccgaggagcgggaccgcctgagccactgcgaatctgtcctttgcatatctcagtcaaggaggaactggacggctag

SEQ ID NO: 27832 - DNA, 2262 bp, Artificial Sequence
  Description of Artificial Sequence: Synthetic coding sequence
atggccccagatagcgatccatttccagagggccctctcctgaaactcctccctctggacgcgcgagataggggcacacagaggtgccgactgggccctgctgcactacatgccttaggggctagactaggcagtgcagtgaagatttccttgcctgatggtgggtcctgtctgtgcaccgcttggccgagacgagacggagccgacggcttcgtccagttagatcccctgtgcgcaagccccggagctgcagtcggagccagcagatccagacggagcctgtctttgaacaggctgctgctagtgccgtgtccccctctgcgacgcgtggcagtctggccggtgctccgggagcgcgctggggcaccaggagcccgaaacacagcagccgtcctggaggctgcccaggagttgctgcggaatcggcctatatcattaggtcatgtcgtggtcgccccacccggagcccctggattggtagcggcactgcacatagtcgggggtaccccgagccctgacccggcaggtcttgtgacacctcgtacacgagtctccttagggggagagcccccaagcgaagcacaaccacagcctgaagttccactgggcggactgtccgaagctgctgattccctgagggagctgctccggctaccgttgcgttatccccgagctcttacagctcttggcttggcagtgcccagaggcgttctcttagccggtccaccaggggtggggaaaacccagttggtgagggccgttgccagggaagcaggcgcagagctactggccgtgagtgctcccgcacttcagggtagtcgccctggggagacagaggagaacgtaaggcgcgtgtttcagagggcaagggagctcgcctctagggggcctagtctgctgtttttggatgaaatggacgccctgtgtccacagagaggcagtcgtgccccagagtcaagagtggttgcccaggtgctgacactgctcgacggtgcaagtggcgatcgcgaagtggtcgtcgtgggagctaccaaccgtcctgacgcgctagaccccgctctgcggcgtccgggacggtttgatagggaggtggtgatcggaactcccacgcttaagcagagaaaggagatcctgcaggtgatcactagtaaaatgcccatcagctcccatgtcgacctgggactgctggctgagatgactgtcggctacgtgggcgctgacctgacggccctttgccgtgaggcggctatgcatgcattgcttcactccgagaaaaaccaggacaaccccgtgatcgacgaaatcgacttcctggaggcctttaaaaacatccagcctagctcctttcgttccgtgataggtctcatggacatcaagccagtcgactgggaagagatcgggggtctcgaagacgtcaaattaaaattgaaacaatccatagagtggcctttaaagtttccttgggagttcgttcgaatgggcctcacccagccaaaaggagtgctcctgtatgggcctccagggtgcgccaagacaaccctcgtgcgcgctctggcaactagctgtcactgttcatttgttagtgtatccggcgcagacctcttctccccattcgtcggggatagcgagaaggtcttaagccagatttttaggcaggctcgggcttcaactccagccattctgttcctggatgagatcgattctatcttaggggctcggtccgcttctaaaactggatgtgatgtccaagaaagagtgctgtcagtgctccttaatgaactcgacggggtagggctgaagactatcgagagaaggggtagcaaaagcagtcagcaagaatttcaggaagtctttaacaggtccgtaatgattattgctgctacaaatcgccctgacgtgctggataccgcgttgctgaggcccggtcgactggataagatcatatacattcctccccctgatcacaaaggaaggttatcaatattgaaggtgtgtacaaaaaccatgccaatcggccctgacgtctcactcgaaaacttggctgccgagacttgtttcttctctggggctgatctgcgaaatctgtgtaccgaggctgctctgcttgcactgcaggaaaatggcctcgacgccacaactgtaaaacaggaacatttcctgaagtcgcttaaaacggtgaaacccagcttgtcttgtaaggatctcgccctctacgaaaacctgttcaagaaggagggtttcagcaacgttgaaggcatttag

SEQ ID NO: 27833 - DNA, 1026 bp, Artificial Sequence
  Description of Artificial Sequence: Synthetic coding sequence
atgccaaagcgtaaagtcacgtttcaaggtgtcggggatgaggaggacgaggatgagatcatcgtgccaaagaaaaaattggtggatcctgtggcaggatccgggggtccgggatccaggttcaaagggaagcacagcttggactccgatgaagaagaggatgatgacgatgggggatcatccaaatacgacatcttagcgagtgaggacgtagagggacaggaagccgctactcttcccagcgagggaggcgtccggattacaccctttaatctgcaggaggaaatggaagaaggacattttgatgccgacggaaattactttctcaaccgcgacgcccagattcgggattcatggctggacaatatagattgggtcaagatacgggagcgcccacctggtcagcgccaggcaagtgatagtgaggaggaggacagcctcggacagacatccatgagcgctcaggccctgctcgagggcctgctggaactgttgcttcccagggaaacggtggcaggggctttgcggaggctgggggcacgcggaggagggaaaggtagaaagggacccggacagccatctagcccccagcgcctcgacagactatctgggctcgcagaccagatggtggcccgaggcaaccttggcgtatatcaggaaacgagagagaggctcgccatgcgcctgaaaggtcttgggtgtcaaaccttaggtcctcataatccgacaccacccccatctctggacatgtttgccgaggagctggccgaggaggagctagaaactccgacgccgactcaacgtggagaagctgagtctcgcggagatggtcttgtggacgtcatgtgggagtataagtgggaaaatacaggagacgccgaactttatgggccattcacgagcgcacagatgcagacctgggtcagtgagggatacttcccggacggtgtctactgtcggaagctcgatcccccagggggacagttttataacagtaaacgaatcgattttgatctctatacctag

SEQ ID NO: 27834 - DNA, 690 bp, Artificial Sequence
  Description of Artificial Sequence: Synthetic coding sequence
atggctgaggaaatggagtctagcctcgaagcgtccttctctagttctggggctgtgtcaggcgcatctggctttctgcctcctgccaggtcaagaatctttaagataatcgttatcggagacagcaacgtcgggaagacatgtctgacataccgcttctgtgcagggaggtttccagacaggactgaagccacaatcggcgttgacttccgggaaagggccgtcgagatcgatggagagaggatcaagatccaactgtgggacaccgccggtcaggagcgttttcgtaagagtatggttcaacattactaccgcaatgtgcacgctgtcgtgttcgtgtatgatatgacaaacatggcatcttttcactcactacctagttggatcgaggaatgtaaacagcatctcttagcaaacgatatccccagaatcttggtaggtaacaaatgcgatctaaggtccgctatccaggtgccgactgatctggcccagaagttcgcggacacccactccatgccactgttcgaaacatctgctaaaaatccaaacgacaatgatcacgtggaggcaatatttatgaccctggctcacaaactgaaatcacacaagcctttgatgctgtcccagccccctgacaacggcatcattctgaagccagaacctaaacctgcaatgacctgctggtgctag

SEQ ID NO: 27835 - DNA, 2352 bp, Artificial Sequence
  Description of Artificial Sequence: Synthetic coding sequence
atgctgctggggtttcggcgtggcaggagatcgcacttcaagcacattattcatggacttttgcccgctgcttctgtcgcacctaaggcagccgtacctcggacccccccacctcgcagtccgaacccctctcctgagagacccaggagcgcactcgctgctgctatcctggctaccactctgactggtagaaccgtggcaatcccacaaccccgacagcgtagccgctccgagtcggatgtgtcctctgtggagcaggattcgtttatcgagccttacgccaccacttcccagttacgtccgaggccgaattggcagagcgaaatggggagaaggtcctcccttccatctttcgaaactttagactatggcgatgaagaggacattgagactcaactgagctcatccggcaaggaactgggcgacgtgtccgctcgggaggaccgcggaggacacagcgatgacctgtacgcggttccccacagaaaccaggtccccctgttgcacgaagtgaactcagaggatgatgagaacatatcgcatcaagatggattccctgggagtccacctgctccacagaggacccagcagaaagatgggaaacacccggtcctgaacctcaaggatgaaaaacccccactgtgcgagaagccgccaccttccccagatattacaggacgcgctaggcagagatacaccgagattactcgcgaaaaatttgaggccttgaaagaagagaacatggatctgaacaatatgaaccagtctctgacgctcgagcttaatactatgaagcaggcgatgaaagagcttcagttaaagcttaaaggaatggaaaaggagaagagaaaactcaaggaagccgaaaaggcaagtagccaggaagtagctgctcccgaattgctgtacctgaggaagcaggctcaggagcttgttgatgaaaatgacggcctgaaaatgactgtccaccggttaaatgtcgagttgtcccggtaccagacgaaatttaggcacctatctaaggaggaatctctcaacatagagggccttcctagcaaaggcccaattccaccttggcttctggatattaagtacctgtctcctcttcttttggcctatgaagatatgatgaaggagaaggatgagctgaacgcaaccctgaaggaagagatgagaatgttccgaatgcgcgtgcaggaggtggtgaaggagaacgaagaattacatcaagaactcaataagtcatccgcggtgaccagtgaagaatggcggcagctacagacgcaggccaaattggtacttgaagagaataaacttctgctggaacagctagagatacagcaacggaaagccaaagatagccatcaagagcgacttcaggaagtgagtaagctgaccaagcaactcatgctgctggaagcaaaaactcacggccaggagaaggagctggctgagaatcgcgagcaacttgagatcctccgtgctaagtgtcaggagctaaagacgcactctgacgggaagatcgcagtggaagtacataagtccattgtgaatgagttgaaatcccagttgcagaaagaagaggaaaaagagcgggctgaaatggaggagctgatggagaaactgaccgttttgcaggcccagaagaagagcctccttctggaaaagaacagcttgaccgagcagaacaaagcacttgaagccgagttggagagagctcagaagatcaatcggaagagccagaagaagatcgaggtcttgaagaagcaagtcgaaaaagctatgggcaacgagatgtctgcgcaccagtacttagcaaacctcgtagggctggctgaaaacatcacgcaagagcgcgactctttgatgtgcctcgccaaatgtctggaaagtgagaaagatggggtgctgaataaagtgatcaagagcaacatcagacttggaaagttggaagagaaagtgaagggctataagaagcaggctgctctgaagctgggcgatattagccaccggctgctggagcagcaagaggactttgctgggaagaccgcccaatataggcaggagatgcgccatctgcaccaggtgcttaaagacaagcaggaagtactagaccaggcgctccaacagaatcgggaaatggagggagaactcgaagtgatttgggaaagtactttccgcgaaaacaggcgaatacgagagttactacaggatacccttacccgaacgggcgtacaggacaacccacgcgcactcgtggctccgtccctgaatggcgtgagccaggcagatctgctggacggatgcgatgtctgttcatatgatctcaagtcccacgctccaacatgctag

SEQ ID NO: 27836 - DNA, 639 bp, Artificial Sequence
  Description of Artificial Sequence: Synthetic coding sequence
atggcggctcgaaggggggctcttatagtactggagggcgttgaccgagcgggaaagtcaacacagtctcgaaaacttgttgaggccttatgtgccgctggtcatagggctgagctcctccgcttcccagaacgctctacagagattgggaagctgctaagcagctacctccagaaaaaatcggacgtcgaggaccattccgtgcacctccttttttcagcaaacaggtgggaacaggtgcctcttattaaagaaaaattaagtcaaggcgtgacactggtggtggaccgttacgcgttttcaggggtggcgttcacaggcgcaaaagagaacttctcccttgattggtgcaagcagcccgacgtcggcttgcctaagcctgacctggtgctcttcctgcagctgcagttggctgacgcggctaaacgaggtgcttttggccacgaaagatatgaaaatggcgcatttcaggagcgtgcgctgcggtgttttcaccagctcatgaaagacacaacgctgaactggaaaatggtcgacgcatccaaatccattgaggcagttcatgaggacatcagagtcttgagcgaggacgccattcggaccgcgacagaaaagcctcttggtgagctatggaaatag

SEQ ID NO: 27837 - DNA, 504 bp, Artificial Sequence
  Description of Artificial Sequence: Synthetic coding sequence
atggaagaaacttatacggactcacttgacccagaaaagctgctgcaatgcccctatgataaaaaccaccagattcgagcgtgtcgcttcccgtaccacttgatcaagtgccggaagaatcacccggacgtcgcaagtaagctggctacatgtccttttaatgctcggcaccaagtgcctcgagcagagatctctcaccacatcagttcctgcgacgacaggtcatgtatcgaacaggacgtagtgaatcagactagatcactgagacaggagacgctggctgaatcgacgtggcaatgtccaccttgcgacgaagactgggataaggatctatgggagcagacctcaaccccttttgtgtggggtacaactcactatagcgacaataattccccagcatccaacatcgtcactgagcataaaaacaatttggcttccgggatgcgggttcctaagagcttgccctatgtcctgccttggaaaaacaatggcaatgcccagtag

SEQ ID NO: 27838 - DNA, 381 bp, Artificial Sequence
  Description of Artificial Sequence: Synthetic coding sequence
atggcggcagggccagaacccccagagtgggaaccacgctggagaaaggcactacgcggaaaggagaacaaaggttctgtcgaaatcatgcgtaaagacttgaatgatgcgagagatctgcatggtcaggcagagtctgccgctgctgtttggaaagggcacgtaatggaccggaggaaaaaagctctcactgactacaaaaagctgcgcgcattttttgtggaggaagaggagcactttctccaggaggcagagaaggaagagggcttacctgaggacgaactggccgaccccaccgaaaggttcagatccttactccaggccgttagcgaactagaaaaaaaacaccggaacctcggattatccatgttgctgcaatag

SEQ ID NO: 27839 - DNA, 1668 bp, Artificial Sequence
  Description of Artificial Sequence: Synthetic coding sequence
atgcaaagttgcgagagctccggggatagtgccgatgaccctctgtcccgagggttgagacgtcgagggcagccacgggttgttgtcatcggggcaggtctcgccggactggccgcagctaaggccctgctggagcagggattcaccgacgtgactgtgctcgaggcctcaagccacattgggggtagggtgcaatcggtcaaactggggcatgcaacatttgaactgggtgcgacatggattcacggttctcacggtaaccccatttatcatcttgcagaagccaatggacttctggaagagaccaccgacggagagcgcagcgtgggacgcattagtctctattccaaaaatggcgttgcttgctatctgaccaaccatgggagacggattcccaaggacgtggtcgaggagttcagcgacttgtataacgaagtgtacaatttgacccaggaattcttccggcacgacaagccagttaatgccgagagccaaaactccgtgggcgtgtttactcgtgaagaggtccgcaatcgaatccgaaacgaccccgatgatccagaggccaccaaacggctgaagttagcaatgattcaacagtacctgaaagtggaaagctgtgaatcgtcttcacacagtatggacgaggtgagcctttctgcttttggggagtggacagaaatccccggtgcccaccacattattccctcaggctttatgcgggttgtggagctgctggctgagggcataccagcccacgtcatccagcttgggaagccagtcagatgcatccattgggaccaggcatctgccagacccagaggccctgagattgagcccaggggcgagggggaccacaatcatgacactggtgagggtgggcaaggaggcgaggagccacgcggaggtcgctgggacgaggacgagcaatggtcggttgtggtggagtgtgaagattgtgaacttattcctgcagaccacgtgatagtcacagtttctttaggggtgcttaagaggcaatatacaagcttctttaggccaggcttgcccacagaaaaggtagcggctattcatcgccttggcattggcactaccgacaaaatcttcctggaatttgaagaaccgttttggggacccgagtgtaattccctgcagttcgtctgggaggacgaggctgagtcccatactctgacctatccacccgagctgtggtatagaaaaatttgtggcttcgatgtgctgtacccacccgaaagatacggacatgttctaagcggctggatctgcggcgaggaggccctggtaatggagaaatgtgacgacgaagcagttgcggagatctgcacggagatgctgcggcagttcacgggaaaccctaatatcccgaagccaaggagaatcctacgttctgcctggggctccaatccttattttagggggagctactcctatacgcaggtgggttcctccggggctgacgtggagaagctggccaagcccctgccttataccgagagctcaaaaaccgcacccatgcaggttttgttctctggggaggccacacaccgaaagtactactcaactacccatggggcactgctatctggccaacgcgaagccgcacgccttattgaaatgtatagggatttgttccagcagggcacatag

SEQ ID NO: 27840 - DNA, 3153 bp, Artificial Sequence
  Description of Artificial Sequence: Synthetic coding sequence
atggcgctctacgatgaggatttgctgaaaaatcctttctatctggcattgcagaagtgtaggccagacttatgttctaaggtagcccaaatccacggcatcgtcttggttccttgcaaaggatccttgtcttcttctatccagagcacatgccagttcgagtcttatattcttataccagtcgaagagcattttcagaccctcaatggaaaagatgtgtttatacaaggaaatcgcatcaagctcggcgctggatttgcatgtttgctctccgtccccatcctcttcgaggaaactttctacaacgagaaagaggagtcattcagcatcctctgtattgcccacccattggagaaacgggaaagtagcgaagagccactggctccatcagaccccttcagcttgaaaacgatcgaagacgttcgagaatttttgggcagacactccgaacgatttgataggaacatagcatcattccaccgcaccttcagagaatgtgagcgcaaaagccttaggcaccatatcgacagtgcaaatgctctttacactaagtgcctgcagcaattactgcgcgatagtcacttgaaaatgcttgccaagcaagaggcacaaatgaatctcatgaagcaggctgtggaaatctacgtgcaccacgagatatataacctgatttttaagtatgtcggaacaatggaagcttccgaggacgcagccttcaacaagattactcggtccctgcaggatttgcaacaaaaagatataggcgtgaagcctgaattctctttcaacatcccgagggctaaacgcgagttagctcaactcaacaagtgcacttccccccagcagaagttagtctgtctgcgcaaggttgtccagcttattactcagtcaccgtcccagagagtgaatctcgagactatgtgcgccgacgatctgctgtcagtgctgctgtatctgctcgtcaaaaccgagattccaaactggatggcgaacctcagctatatcaagaactttcggttttcaagcctagcaaaagacgagctggggtattgtttgacgtcgtttgaggctgccatcgagtacatccggcaaggctctctgtctgccaaacccccagagtccgagggctttggggatagattatttctgaagcagaggatgtctcttctttcccaaatgacttctagccccacggactgcctgtttaagcacatcgcctccggaaaccagaaagaggtcgaacggctcctgtcccaggaggatcacgataaagatacggtgcagaaaatgtgccaccctctgtgcttttgcgatgactgtgagaaactggtgagcgggaggctaaacgacccatcagtcgtcacacctttttcaagggacgaccgcggtcatactcctctgcatgtggccgcagtgtgcggccaggctagtctgatagaccttcttgtgagtaaaggggcaatggttaatgctactgactaccacggggcaacacccctccacttggcatgccagaagggctatcagagtgtcactctcctgttgctccactataaagcctcagccgaggtgcaagataataatgggaatacacccctgcacctggcatgtacctatgggcacgaggactgcgttaaagcgctcgtctactacgatgtcgagagctgtcggctcgatatcggaaacgagaaaggggatactcctcttcatatcgccgcacggtggggctaccagggcgtgattgaaacactgctccagaacggggcttccaccgaaatccagaatcgtcttaaggagaccccactcaaatgcgctctgaacagcaaaatcctaagcgtcatggaagcctaccacctctcattcgagcgcaggcagaaatcttctgaggctcctgtacaatccccccaacggtcagtggactctattagtcaggagtccagtactagttcctttagctccatgagcgcctcttcccggcaggaggagactaagaaggactacagagaggtggagaagctgctgcgcgcagtagctgatggggacctcgagatggttcgatatctgctcgagtggacagaggaagaccttgaagatgccgaggacacagtttcagccgctgacccagaattctgtcatcctctctgtcagtgcccaaaatgtgccccagcacagaaacggctggcaaaggtgccagcaagcggtctgggggtgaacgtgacaagccaggacggttcttccccactgcacgtggccgcattgcacgggagagcggatcttatccctctgctgctcaaacatggggctaatgccggagccagaaatgccgaccaggctgttccgctccatctggcttgtcagcaaggccatttccaggtggtgaaatgtttgctggatagtaatgccaagccaaataagaaggacttgtctggaaacaccccgcttatctacgcatgcagtggcggacaccacgaacttgtggcccttcttctgcagcacggagcctctattaacgcctcaaacaataagggcaatactgcactgcatgaggcggtgatcgagaagcatgtcttcgtggtggaacttttactcctgcacggagcttccgttcaggtcctaaacaagcgacagcgaaccgccgtggactgcgctgagcagaatagtaagatcatggagttacttcaggtggtaccaagttgcgtggccagcctcgacgatgtggcagaaacagacaggaaggaatatgtgactgtaaaaatacgaaaaaaatggaactccaaactgtacgatctgccagacgagcccttcacacggcagttctactttgtgcatagcgccggtcagtttaaaggtaagacaagtagggaaattatggccagagacagatcagtgcccaaccttaccgaaggatctctacatgagcccggacggcagtcagtgacattacggcagaataaccttccggctcagtcgggttctcatgccgcagaaaagggtaactctgattggccagaaaggcctgggctgacacagacgggaccagggcaccgtcgaatgctccgcagacacaccgtcgaggacgcggtagtaagccagggcccagaggccgctggaccgctatccacgccccaggaggtgagcgcttcacgcagttag

SEQ ID NO: 27841 - DNA, 1662 bp, Artificial Sequence
  Description of Artificial Sequence: Synthetic coding sequence
atggatgtagataaagagctgggcatggagtccgtgaaagccggtgcttccggtaaacccgagatgcgattgggcacacaggaagagacaagtgaaggtgacgccaacgagtcgtcactgctggtgctttctagtaatgttcctctgttagccttagagttcctggagatcgctcaagcaaaggaaaaagcctttcttccgatggtgtcacacactttccacatgcggaccgaggagtctgacgcctcccaggagggagatgacttgccaaaatcttccgcgaatacatcccatccgaagcaggatgactcacccaaatccagcgaggaaacgatccaacccaaagaaggagatatccctaaggcgccagaagagaccatacaatccaagaaggaagatttgcccaagagctctgaaaaagccatacagccaaaagaatccaacatccctaagagctctgccaagcctattcaacccaaactcgggaatatccctaaagcctctgttaaaccctcccaaccaaaagagggagacatccccaaagcacctgaagaaacaatccaaagcaagaaggaggatctcccaaaaagtagtgaggaggccattcagccaaaggagggcgacatacctaaatcttccgctaagccgatccagccgaaactggggaacattgcaaagacctcagtaaaacccagccaacccaaggaatccgacatccccaagagccctgaagagacaattcagccgaaggagggggatatccccaaaagttctgcaaagcctatccaaccaaagttgggaaatataccaaaggcatcagtaaagccctctcagcctaaagagggggatatttctaagtctcccgaggaggccatccagcctaaagaaggggacctccctaaatctttagaagaggccattcagccaaaagagggggacattcctaagtcccccgaagaagcaatccagccaaaagaaggcgacattccaaagtccctggaggaggcgatccagccaaaggaaggtgatattcctaaatcaccggaagaaacaatacagccgaaaaagggcgacattcccaagagtcctgaggaggctattcagccaaaggaaggcgatatcccaaagagtcccaagcaggcaatacagcctaaggaaggagacattccgaagagcctagaagaggcgattcctcccaaggaaatcgacatccctaagtctcctgaggagacaatccaacccaaggaagacgattcaccaaagtctctcgaggaggcgaccccatctaaggagggagatatcctgaagcctgaagaggaaacaatggaatttcctgagggggacaaggtgaaagtaatcttgtccaaggaggactttgaggcaagtctaaaagaagccggagaacgcctagtggcagtggacttctccgcaacttggtgtggtccttgtcgtacgatccgtcccttttttcacgcattgtccgtgaaacacgaggacgtcgtattcctggaggtagatgccgacaactgcgaagaggtggtgcgagagtgcgctatcatgtgtgttcccacattccagttctataagaaagaggagaaggtggatgagttgtgcggggctctgaaggaaaagctggaagcagtgattgcagaactcaagtag

SEQ ID NO: 27842 - DNA, 2268 bp, Artificial Sequence
  Description of Artificial Sequence: Synthetic coding sequence
atggtgtcccacgggagctctccctccctcctggaggcactctcgagtgacttcttggcctgtaaaatctgccttgaacaactcagggcacctaagactctcccgtgcctgcacacctactgtcaggattgcctggcccagctggccgacgggggtcgggttcgttgcccggagtgcagagaaactgttcctgtgccccctgagggtgtagcttctttcaagacaaacttttttgtcaatgggctccttgatctggtgaaagcgagagcatgtggggatttacgcgctggaaaaccagcttgtgccctctgccccctcgtggggggaactagcacaggtggccctgccacggcgagatgtcttgactgcgcagacgatctctgccaggcctgtgcagatggccaccggtgtacacgacaaacacacactcaccgggtggtggaccttgtcggctaccgcgctggctggtatgacgaggaggccagagaacggcaggctgcgcaatgtccccagcaccctggtgaggctctgcgtttcctgtgtcagccatgctcccagcttctatgccgcgaatgcagactggacccacacctggaccacccctgcctacctctggctgaggcagtcagagccagaaggcctggcctagaggggctgcttgccggagtcgataacaatctggtagaactcgaggcagcacggagagtagaaaaggaggcccttgctcggctcagggagcaagctgccagggtaggaacccaagtcgaggaggcagccgaaggcgtactccgagccctcttagctcaaaagcaggaagtgctgggtcagctcagggcccacgtggaagccgctgaagaggctgccagggaacgtctggccgagctggagggacgagaacaggtggcccgagctgctgccgcttttgccaggcgcgtcctatccctggggagagaggccgagatcctttccttggagggtgcaattgcacagaggcttcgccagctgcaaggctgtccctgggcacctggcccagctccatgcctgcttcctcagctggaactgcaccccggtctcttagacaaaaactgtcatctcctgaggctgtcttttgaagaacagcaaccccaaaaggacggaggcaaggacggtgccggaacacagggtggggaagagagccagtcaagaagggaagacgagccaaaaacagaaaggcaagggggagttcagccacaggcaggtgacggcgctcaaacacccaaggaggagaaggcacaaacaacccgcgaagagggtgctcagactctagaggaggaccgggctcagacgccacacgaagacggcggaccccaaccccatagaggaggcaggccaaacaaaaagaaaaagtttaaggggaggctgaagtcaattagtcgggagccgtcccctgccctcggtcctaaccttgatggatccgggttgctccccagacccatattctattgtagctttcctaccagaatgccgggagacaaacgcagcccgaggatcacgggattgtgccctttcgggccacgtgagatcctcgtggcagatgagcaaaatcgggctttgaagcggttctcactgaacggcgactataaaggcaccgtgcctgtgcctgagggatgttcaccttgtagtgtcgccgcattgcagtcggccgtggccttttctgcctcagcccgactttacctaataaatcctaacggagaagtgcagtggcgccgagcgctcagcctctcccaggccagccacgctgtggccgctctgccctcaggggaccgcgtcgccgtaagcgttgccggtcacgtagaggtctacaacatggagggctctctggcaacaagatttatcccaggcggaaaggcaagccggggactgagggccctcgttttcctcactaccagcccacagggacactttgttggttcagactggcaacagaacagtgttgtcatttgcgatggtctgggccaggtagtgggggaatataaggggcctgggctccatggatgccaaccagggagcgtgtcagtggataagaaaggctacatctttcttacattgagggaggtgaacaaagtggtaattctggatcccaaagggtctttgttgggggactttttgaccgcttatcatggattggagaagccgagggtcaccacaatggttgatggcagatacttggtggtgagcctcagtaacggtaccattcatatattcagggtgaggtctcccgattcttag

SEQ ID NO: 27843 - DNA, 1467 bp, Artificial Sequence
  Description of Artificial Sequence: Synthetic coding sequence
atggccgctggcagcgaggccacaaccccagtcattgtggctgccggagccggaggagaagaaggtgaacatgtgaaaccttttaagcctgaaaaggcgaaagagatcattatgagtctgcagcagcccgcaatattttgtaacatggtgtttgactggcccgctagacattggaacgcaaaatatctgtcccaagtgctgcatgggaagcaaatacggtttaggatgggaatgaagagcatgagcacagtgccgcagttcgagacaacgtgcaattacgtagaagccaccctcgaagagtttctgacgtggaactgcgatcaatctagtatcagcgggccatttagagattatgaccactcgaagttctgggcctatgcagactacaaatacttcgtttctttgttcgaagacaaaaccgacctgtttcaggacgtgaagtggagcgatttcggatttccgggtaggaacggtcaggaatccaccctgtggataggatcgctcggggctcacaccccatgtcaccttgacagttatgggtgcaacttagtttttcaggtgcagggtcgcaaaaggtggcacctgtttccccctgaggatacgccgtttctgtacccgacgcgcattccctacgaggagtcgagcgttttttcaaaaattaacgtggtgaaccccgatcttaaacggtttcctcagttcaggaaggcccagagacatgccgtcacgctctctccgggacaggtcctcttcgtcccacgccattggtggcactatgtggagagcattgaccccgtgacagtgagcattaactcctggattgaactcgaagaggaccacctggctcgggttgaggaggcaatcacccggatgctggtgtgcgctcttaaaactgcggagaatcctcagaatacgagggcttggctgaatccaaccgaggttgaagaaacttcccacgccgttaactgctgctacttgaatgccgctgtgtctgcattcttcgacaggtgccgcacaagcgaagttgtggagattcaagccctgaggacagacggtgagcacatgaaaaaagaagaactgaacgtgtgcaaccatatggaggtcggacagacaggcagtcagaatctgacaacgggcacggataagcctgaggctgcctccccctttgggcctgatctcgttcctgtggcccagcgatctgaagaaccgccaagcgaaagaggtggcatctttgggtccgacggaaaagatttcgtggataaagacggcgagcacttcggtaagctgcactgcgctaagagacagcagattatgtctaattctgagaatgccattgaggagcagattgcatccaacacaaccactaccccccaaactttcatatcgacagatgacttgctcgattgtctggtcaatcctcaagtgaccaggatcgtagcccagctccttatccagggccgatctttgtag

SEQ ID NO: 27844 - DNA, 579 bp, Artificial Sequence
  Description of Artificial Sequence: Synthetic coding sequence
atggctcctaaaccgggagctgaatggtcaactgccctgagccatctggtgttaggcgttgtcagcctccatgctgccgtgtccacagccgaggccagtaggggggctgccgctgggttcctgctgcaggtcctggctgcgactactacgcttgcacccggattgagcacacacgaggactgtcttgccggtgcatgggtcgccacggtcatcggcctccctttgctcgctttcgactttcattgggtgaacggggacagaagctccgccaatctgcttctcggtgggggaatggtgcttgccgtggcaggaggtcatctgggccctgagggacggtctgtcgccggacaggcaatgctgctcgtcgtagcggtgaccatcctcatcgtggcagtttttacggctaatacttatggtatgtggggcggagcaatgctaggcgtagcaggtctgctgtcacggctggaggaagacagattgctgctgctgcctaaagaggacgtgtgtaggtgggccctggcggtgggctcatgggcttattgcagagcgcttcatacacagcgtctacaatgggagtag

SEQ ID NO: 27845 - DNA, 462 bp, Artificial Sequence
  Description of Artificial Sequence: Synthetic coding sequence
atgacctctgagtccacctcaccccctgtggtgccgcctctccattctccaaagtctcctgtctggccaacattcccatttcatcgcgagggcagtcgagtgtgggagagaggaggtgtgccacccagggatttgccttcacccctgccaacaaaacggactaggacatactccgcaacagccagggcatcagcaggacccgtattcaaaggggtatgtaaacagttctcaagatcccaaggccatggcttcattactccagaaaacggttccgaagacattttcgtccacgtgtccgacatagaaggcgaatatgtgccagttgagggcgatgaagtgacgtataaaatgtgtcctatcccccctaagaaccaaaagttccaggccgtcgaagtcgtactgacacagctggccccacacaccccccacgaaacttggagtggccaggttgtggggtcctag

SEQ ID NO: 27846 - DNA, 537 bp, Artificial Sequence
  Description of Artificial Sequence: Synthetic coding sequence
atgagcagcttctcccgggctccacagcaatgggccacttttgctcgaatctggtacttactagatggtaaaatgcaacctccgggtaagctcgctgccatggcgtctatccgtctgcagggcctacataaacctgtttatcacgccctgagcgattgcggggatcacgtcgttatcatgaacacaagacacatagctttcagtggcaacaagtgggagcagaaggtatactctagccatacaggatatcctggtggatttagacaggtgactgctgcgcagctgcaccttcgagatcctgtagcaatcgtcaaacttgcaatttacgggatgctgcccaagaacctccacagaaggactatgatggagagactgcatctgttccccgacgagtacattccagaggacatacttaaaaacctggtggaagaactcccacagcccaggaaaatccccaagcgcctcgatgagtacacacaggaggaaatcgacgcctttccacggctttggactccccctgaggactatagattatag

SEQ ID NO: 27847 - DNA, 8763 bp, Artificial Sequence
  Description of Artificial Sequence: Synthetic coding sequence
atgagaggcaggaggggtcggccacccaaacagccggcagcgccagctgccgagagatgtgccccagctccaccaccccctcccccacctcccacaagcggcccaataggcggtctacgatctcgacaccgaggcagttctcggggacgatgggccgcagcccaagccgaagttgcccctaagacaagactatcctctccacgcggaggcagctctagtagaagaaaacccccacctccgccacctgcccctccgtctacttcagcaccaggacggggaggcagaggtggagggggtgggaggactggtggaggagggggaggtggtcacctggcaaggacaacggctgcgcgtagagctgttaataaagtcgtctacgatgatcacgaatcagaggaagaagaagaagaggaagacatggtgagtgaggaggaggaagaagaggacggtgacgcggaggagactcaggattccgaggatgacgaagaggatgaaatggaagaggacgacgacgactcagactacccagaagaaatggaggatgatgacgacgacgccagttactgtacagagtcttcttttaggtcccattctacttactcttcaacacccggacggaggaaaccccgtgtgcatcgacctcgttctccaattctggaggagaaggatatccccccactggaattcccaaagtcatctgaggacctcatggtccctaacgaacatatcatgaatgtcattgctatctacgaagtcttacggaattttggaacagtgctcagacttagcccgttccggttcgaggatttttgcgccgcactcgtgtcccaggagcagtgtaccctgatggcagagatgcacgtggtgcttctgaaagctgtgctacgggaggaagatacatctaacacaactttcgggccagccgaccttaaggactccgtcaattccacattgtacttcatcgatggaatgacttggcctgaagtgctccgggtatattgtgagagtgacaaagaatatcaccatgtcctgccataccaggaggccgaagactatccttacggtcctgtggagaataagattaaggttctgcaattcctggtcgatcagttccttaccactaatatcgcgagggaggaattaatgagtgagggcgtgatccagtatgatgatcactgccgagtctgccataagcttggggatctgctgtgttgtgagacctgcagtgcagtctatcacttggagtgcgtgaagccccctttggaagaagtcccggaggatgagtggcagtgtgaggtatgcgtcgcccacaaagtcccaggcgtcacagactgtgtagccgagatccaaaagaataaaccctacattcgccatgagccaattggttacgatcgctctaggagaaagtactggtttctgaaccggcgtctgataatagaggaggacacggaaaacgagaacgagaagaaaatttggtactactctaccaaggtccaactagcggagcttattgactgcctcgataaggattattgggaggccgaactttgcaagattctggaagagatgcgtgaggaaattcaccgtcatatggacataacggaagatctgactaacaaggccagaggttccaataaatcattcctggcagccgctaacgaagaaatactggagtccatccgcgcaaagaaaggcgacatcgacaacgtaaagtcaccggaagaaaccgagaaggacaaaaacgagactgaaaatgactctaaagacgccgaaaagaacagggaggagttcgaggaccagtcactcgagaaagactccgatgacaaaacccctgatgacgaccccgagcaaggaaaatccgaagtgggcgatttcaagtccgagaaatccaacggggagctttccgaaagcccgggagcgggtaagggcgcatccggttcaacccgcattatcactcgcctgcggaatccagatagcaagctttcacagcttaagagccagcaggtggccgcagcagcgcacgaagctaataaactgttcaaggaagggaaggaagtattggtggtcaactcccaaggtgagatctcgaggctgtcaactaaaaaggaggtgatcatgaagggtaacattaataattacttcaagctgggccaggaggggaaataccgcgtttaccacaatcagtattctactaattctttcgcattgaataaacatcagcacagggaagatcatgacaaacggcgacatttggctcacaagttttgcctgacacccgcaggtgagtttaaatggaatggctctgtccatggctctaaagttctaactatcagtactctgagactcacaattacccagctggaaaacaacatacccagctcattccttcacccaaactgggcatcacaccgcgctaattggattaaggcagtgcaaatgtgctccaagccacgcgaatttgctctagctctggccattctcgagtgcgccgtgaaaccagtggtgatgctccctatctggcgagagagcttggggcacacccggctacatcggatgacgtcaatcgaaagggaagaaaaggagaaggtgaagaagaaggaaaaaaaacaggaggaagaagaaactatgcagcaggcaacctgggtgaaatatacgttcccggttaaacaccaagtttggaagcaaaaaggggaagaatatcgggtgacggggtacggcggatggtcatggatcagcaagacccatgtgtatcggtttgttcctaaactccccggtaacacaaatgtgaattacaggaagagcctggaaggaacgaaaaacaatatggacgaaaatatggacgaaagcgacaaaagaaagtgttcccggagtcctaagaagatcaaaatcgagcctgatagtgaaaaagatgaagtcaaaggctccgacgccgcaaaaggggcagaccagaatgaaatggatatatctaaaattactgagaagaaggaccaggatgtaaaggagcttttggactctgatagcgataagccgtgtaaggaggaacctatggaagttgatgacgacatgaaaacagaatcccatgttaactgccaagagagctcccaggtagacgtcgtgaatgtctctgagggcttccacttaagaacatcctacaagaaaaagaccaaatctagtaagctggacggcctgctagagcgtagaataaaacagtttacactggaggagaagcagcggttagagaagatcaaacttgagggtggaatcaagggaatcggcaaaacaagcacaaactcatctaagaatttaagcgagagtccggttataaccaaggcaaaggaaggctgtcagagtgacagtatgcggcaggaacagtcacccaacgcgaacaacgaccagccagaggatcttatacagggttgctccgaaagcgattcctcagtactcagaatgtcagatccaagtcacaccactaacaaactgtacccaaaggacagagtgctggacgatgtctctattagatcccctgagactaagtgccctaaacaaaattcgatcgagaacgacattgaggagaaagtgtccgatctggcatccagaggccaggaacccagcaaaagcaaaacaaaggggaacgatttctttatcgacgattcaaaactggcgtctgctgacgatatcggtactctgatttgcaagaacaaaaagcccctgatccaggaagagtctgacactatcgtgtcctccagcaaatccgccctccattcctcggtgcctaagagtaccaacgatagagatgccacccctctgagtcgcgcaatggatttcgaggggaagctggggtgcgatagcgagagtaactcgaccctcgagaactctagtgacacggtatccattcaggacagcagtgaagaagatatgatagtacagaattcaaacgaaagcatcagtgagcaattccgtacccgggagcaggacgttgaggttctggagcctttaaaatgcgagctggtgtccggcgagtccaccggaaactgcgaggaccggctgccggtgaagggcacagaggctaacgggaagaaacctagtcagcaaaagaagttggaggagcggccagtcaacaagtgttctgaccagatcaaacttaagaacactactgacaagaagaataacgaaaacagggaatccgaaaaaaaaggccagagaacttccactttccaaatcaacggtaaagataacaaaccaaaaatttacctgaaaggtgaatgccttaaagaaatttccgagagccgagtagtttccggtaatgtcgagccaaaagtaaacaacatcaataaaattattcctgagaacgacatcaagtccctgacagttaaagaaagtgcaattaggccctttataaacggcgacgtgatcatggaagactttaatgagcgaaatagttcggaaactaagtcgcacctcttatcatcctccgacgccgagggtaactaccgcgatagcctagagacactgccttcaactaaggaatcagattctacccaaacaaccactccaagtgcatcatgcccagagagtaatagtgtaaatcaggtcgaagacatggagatcgagaccagcgaagtaaagaaggtgacaagttctcccattacttctgaagaggaatccaatctctctaacgacttcatcgacgaaaacggactacccattaataaaaacgagaatgtcaacggtgagtcaaaaaggaaaactgtcatcaccgaagtgaccacaatgactagcactgtggccacagagtcaaagactgtcataaaagtagagaagggcgataaacagacggtggtgagtagcactgaaaattgcgcaaaatctacagtgacaaccactaccaccactgtgacgaaactcagtacgccttcaaccggaggcagcgttgatattataagtgtgaaggaacagagtaagaccgtggtgaccactaccgtcacagatagtctcaccacaactgggggaaccctggttacctccatgactgtgtccaaggaatattccacccgggacaaggtcaaactgatgaaattctcgagaccaaagaagacccggtccggtactgcactgcctagctaccgcaaatttgtaactaaaagttctaagaaaagcatttttgtactgcccaatgatgacctgaagaaactcgccagaaaggggggaatccgggaggtgccctatttcaattacaacgctaagcccgctctggacatctggccctatccatccccgagacccactttcggaatcacatggagatatcggttacagacggtgaagtccctggctggtgtgtcactgatgctacggctgttgtgggcttctctgcggtgggacgacatggcagctaaagcaccaccaggcggtggcaccacgcggaccgagacatccgaaaccgagatcaccactacagaaataatcaaacggagagacgtgggcccatacggtataagatctgagtattgtatccggaaaatcatttgccccatcggggtgccagagacccccaaagaaacaccaaccccgcagcgaaaagggctgcgatcatccgcgctgcgcccaaaaaggccagaaacccccaagcagacagggcctgtcattattgagacatgggtagcagaagaggagctggagttgtgggagatacgggctttcgctgaaagggtggaaaaagagaaggcgcaggcagtagagcagcaggccaaaaagaggctggagcagcagaaacccactgtcatcgccacctctaccacttccccgacatcctcaactacctcaacaatatcccccgcacagaaagtcatggtggctcctatttctggctctgtcacaactgggaccaaaatggtccttactactaaggtcggctcacccgctacagtgactttccagcagaataaaaacttccaccagacgttcgccacttgggtcaaacagggtcagtcaaactctggagtggtgcaggtgcagcaaaaagtactggggattatcccctcctcaaccgggaccagccaacaaaccttcacctctttccagccgcgaacggccaccgtgacaatccgcccaaatacctctggcagtgggggaactactagcaatagtcaggtcattacaggccctcagattaggcctggaatgacagtcatcaggactccactacagcaaagtacactggggaaggcaatcattaggaccccagtgatggtgcagccaggagcgccacagcaggttatgactcaaattatccgcggacaaccagtgtccaccgctgtttctgcacctaacacagtatcttctaccccagggcagaaatctctcactagcgccaccagcacttccaacattcagtcttcagccagtcagcctcccagacctcagcagggacaggtaaaacttactatggcccagctgacacagctgacacagggccacggcggtaatcaaggcttaactgtcgttattcaaggacagggacagacgaccggacagcttcagctcatccctcagggcgtaacagttctgccgggtcctggccagcaactgatgcaggccgctatgcccaatggcactgtgcagcgcttcctatttacgccactggcgactacagcaacaacagcatcaacgaccacgactacagtaagcaccactgctgccggtaccggggagcaaaggcaaagcaagctatccccacagatgcaagtccaccaggacaagactttacccccagctcaatcatctagcgttgggcctgcggaagctcagccacagaccgcacaacccagtgcccagccacaacctcagacccagccccagagcccggcacaacccgaagtgcaaactcagcccgaggtgcaaacacagacaacggtaagcagtcacgttccgagcgaagcccagcctacacatgcacagtcttccaaaccccaggtagccgcacaatcacagccacagagcaacgtccaaggccagtcaccagtgagagtgcaatccccctcccaaacgcgaatcaggccgagcacccccagtcaactgagccctggacagcagagccaggtgcagaccacaacaagtcagcccatcccaattcagcctcatacctccctccagatccctagtcaggggcagcctcagagccagccccaggtgcagagttctacacaaactctgtccagcgggcaaaccctgaaccaagtgaccgtttctagtccgtctcgaccccaactgcaaattcagcagccccaacctcaagtgatcgctgtgccccagctacagcagcaggtgcaggtactgtctcagattcagagccaggttgtggcccagattcaggctcagcaatctggcgtccctcagcaaataaagctgcagcttcccatccaaatccagcagtctagcgccgtacagactcaccagatccagaacgtggtaaccgttcaagccgcatcagttcaggagcagctccagcgggtccaacaactgagggaccagcagcaaaaaaagaaacagcagcagattgagattaaacgagaacacaccctgcaggctagtaatcaaagtgaaattatccagaagcaggtagttatgaaacacaacgccgtaattgagcacttgaaacagaaaaaaagcatgactcccgcagagcgggaagagaatcaaagaatgatcgtgtgcaatcaggtgatgaagtacatcttggacaagatcgacaaggaggagaaacaggcagccaagaaacgtaaaagggaggagtctgtggagcagaaacgctccaagcagaacgccaccaagctgagcgccctcctcttcaagcacaaggagcagctcagagcagaaatactcaagaagcgggctttgctggacaaggacctgcagattgaggttcaggaggaactcaagagggatcttaaaatcaagaaggagaaagatctcatgcagctggctcaagctactgctgtcgccgcaccatgtcccccagtgacccctgcaccgccagccccaccggctccccctccaagtccacctcccccacccgcagtgcagcatactggcttgctcagcactcccactcttcccgctgcaagccaaaaaaggaaaagagaggaggagaaggattcgtcgtcgaagagtaaaaagaagaagatgattagcacaacaagtaaagaaactaagaaggacaccaaactttactgcatctgcaaaaccccttacgacgaaagcaagttttatatcggttgcgaccgatgtcagaattggtatcacggccgttgcgttggtatcctgcagagcgaagcggagctaatagatgagtatgtttgtcctcagtgccaaagcacagaggacgccatgacagttttgactcccttaacagaaaaagactatgaaggacttaagcgtgttctccgcagcctccaggcacacaagatggcctggccctttctcgagcctgttgacccaaatgatgcaccagattactacggggtgattaaagagccgatggaccttgccactatggaggagagggtgcagcgccgttattatgagaagctcactgagttcgtggcagacatgacaaagatattcgataattgtcgatactacaatcccagcgatagtcctttctaccagtgcgcagaggtactggaatcattttttgtccagaaactgaagggcttcaaggcatctagatcacacaacaacaaattgcagtctactgcctcgtaa

SEQ ID NO: 27848 - DNA, 390 bp, Artificial Sequence
  Description of Artificial Sequence: Synthetic coding sequence
atggctgacccaagagtgcgacagattaagatcaaaactggcgtcgtcaaacggttggtgaaagagaaagtgatgtacgaaaaggaagccaagcagcaggaagaaaagattgaaaaaatgagagccgaggacggggagaactacgacatcaaaaaacaggccgagatcttgcaggaaagtcggatgatgatacctgactgccagcggcgactcgaggccgcttacttggacctgcagaggatcttggtgagtaaggacttttgtgtgatgttcaagttttttttcagcattcaatacatggagtcacaaaagttcaagtaccttacccttaggacctcatggcagtactttctgttcacgtgtcccttgtacaggtatatcctcaagtag

SEQ ID NO: 27849 - DNA, 582 bp, Artificial Sequence
  Description of Artificial Sequence: Synthetic coding sequence
atgagcgacgacgatagcagagctagcaccagttccagctcatctagctcctccaatcagcaaactgaaaaggaaaccaacacccctaaaaaaaaggagtctaaagtgagtatgtccaagaatagcaagctgctgagcacaagtgctaaacggatacagaaggagttggccgacattacgctggacccccctccgaattgcagcgcgggtcccaaaggcgataacatttatgagtggcggtccacaatcctcggcccacctgggtccgtgtatgagggcggtgtattctttctggacattaccttcactccagagtaccccttcaaacctcctaaagttacattccgcacgcggatttaccactgcaatattaattctcaaggcgtgatttgtctcgacattcttaaagataattggtcccctgccctgacgatttctaaagtgctgttatccatttgcagcctcctcacggactgcaatcctgctgatccgctcgtggggtctatagctacccagtatatgacaaacagggctgagcatgacaggatggcgaggcagtggacaaaaagatacgccacatag

SEQ ID NO: 27850 - DNA, 1395 bp, Artificial Sequence
  Description of Artificial Sequence: Synthetic coding sequence
atgagtcttcagttttctaatggatctcggcacgtgtgtctgagaagtggagctggaagcgtcagaccactcaatggcggagccggattcgctggctccagcgcatgtgggggaagtgtggctggtagcgagttctcctgtgccctgggtgggggactgggatctgtccccggaggaagccacgcaggcggtgccctcgggaatgccgcatgcatcggcttcgccggttccgagggcggtctcctgtctgggaacgaaaaagtgacaatgcagaacttgaatgacagactggctagctacctcgataacgttcgggctttggaggaagccaacgccgagctagaaaggaaaataaagggttggtacgaaaaatatggccctgggtcttgtaggggcctggaccatgactattcccgttatcacctcactattgaggatctgaaaaacaagattatctccagtacgacaactaatgccaatgtaattctgcagatagataacgccagactggctgccgatgactttagactgaagtacgagaatgaactaacgctgcaccagaatgttgaggctgacatcaatggactccgcagagtgttggacgagctcactctctgccgaacagaccaagagctgcaatatgagtctctgtccgaggagatgacctacctgaaaaaaaatcatgaggaagaaatgaaagctctccagtgtgcggcaggcggaaacgtgaatgtggagatgaacgcagctccaggggtggacttggccgtcctactgaacaacatgcgggcagagtacgaagcactggctgaacagaatcggaaggacgcagaggcctggtttaacgagaagagtgctagtctgcagcagcagatttcacacgatagcggagctgccaccttcgctcggtcccaactaacagaaatgcgcaggaccctccaaactctcgagatacagttgcaatcactgatggcaactaagcatagcctggagtgcagcctcaccgagactgagtccaactactgcactcagttagcccagatccaagcgcagattggagctttggaggaacaacttcaccaggtgcgcaccgagaccgaaggccagaagctggagtatgagcacctgctagatgttaaggtgcatcttgaaaaagagattgaaacctactgcagactaattgacggagatgggaactcttgttcgaagagcaaagggtttgggagtggctctccagggaattcctccaaagacctaagcaagacgaccttggtgaaaactgtcgtggaagaactcgatcagcgtggcaaggtattaagcagtaggattcactctatagaagaaaagacctctaaaatgacaaacggcaagacggagcaacgtgtgcctttttag

SEQ ID NO: 27851 - DNA, 2013 bp, Artificial Sequence
  Description of Artificial Sequence: Synthetic coding sequence
atggaagagtttcggagatcatattctcgactttgtcgggagagcggcgctgagccgcaggaagcagtgctgcagcagcttcatcaattaccgcgagggagactggatttagcaactcagagtctgaccgtggaaacttgccgagcgcttggaaagttgctccctagagaaactctgtgtaccgagctcgtactgtcggactgtatgttgagcgaggaaggagccacacttctgctaagaggcctgtgtgctaacacagttctgcggtttcttgacctaaagggaaacaatctccgggctgccggtgccgaggccttgggaaagctgctgcagcaaaacaagtctatccaatccctaaccctggagtggaacagcctcggcacctgggacgacgctttcgcgactttttgcggtggcctggcagcaaacggcgctctacaacgcttggatctcaggaataaccagattagccacaagggtgctgaggaactggcgctggctctgaagggaaatacaacattgcagcaacttgacctcaggtggaataacgtaggccttctgggcggaagggccctgatgaactgcctaccaagcaataggacactgtggcggttagatctggcaggcaacaatatccccggagatgtgctaagagctgtggagcaggccatgggacacagtcaggataggctgacaacgtttcaggagaatcaggctcgtacgcatgttcttagcaaggaagttcaacacttgagggaggagaaatccaagcagttcctggacttgatggaaacaatcgacaagcagcgggaagagatggcaaagtcttcccgcgcatcagccgcaagggtgggccagcttcaggaggctctaaatgaacgccacagtataattaatgctctcaaagccaaattgcagatgacagaggcagccttggccctcagcgaacagaaggctcaagacctcggtgaattgctcgccacagcagaacaggagcaattgtcgctgtcccaacgtcaggccaaagagctcaagctcgaacagcaggaagcggcagaacgagaaagcaaactcctgcgggatttgagtgccgcaaacgaaaagaatttgctgctgcaaaatcaagtggatgagctggagaggaagttcagatgtcagcaggaacagctgtttcagacccggcaggagatgactagcatgtccgcagaactgaaaatgcgtgccatccaggcggaggagcgcttggatatggagaagagacgttgccgtcaaagcctagaggattccgaaagcctcaggataaaggaggtggagcacatgacaagacacctcgaagagagcgaaaaagccatgcaggaaagagtccagcgcttagaggcagccagactgagcttagaagaagaattaagccgggttaaggctgccgcactgagtgaaaggggtcaggccgaagaagaactaattaaggccaagagccaggcaaggctggaggagcagcaaagactggctcatctcgaagataaattgaggctgcttgcccaggccagagacgaggcccagggggcttgtctgcagcagaagcaggtcgtcgcagaagcacaaactagagtgagccagctcggcctccaggtggagggactgcgcagacgcttagaagaactccaacaggaattatctctcaaggatcaggaaagggtggcagaagtatcacgagtgcgcgtggagctgcaggagcagaatgggcgtttgcaggccgaattggcagctcaagaagccctgcgagaaaaagctgccgctctcgagaggcagttaaaagtgatggcaagtgaccatcgagaggccctgcttgatcgggaaagtgagaacgcatccctacgcgagaaactgaggttaagagaagccgaaattgcacgcatcagggatgaggaggcccaacgagcatcattcctgcagaacgctgttttggcctatgtgcaggcctccccagttagaaccctctctccccctaaatag

SEQ ID NO: 27852 - DNA, 1782 bp, Artificial Sequence
  Description of Artificial Sequence: Synthetic coding sequence
atggagcccgctactgcgcctcggccagatatggctcctgaactgacaccagaagaagagcaggctactaagcagtttctcgaagaaataaacaaatggaccgtgcagtacaatgttagtcccctcagctggaatgttgcagtaaagtttctaatggcaaggaagttcgatgtgctaagggccatcgagctgttccactcctatagagaaaccaggcgcaaggagggtattgtgaaactcaagccccacgaagaaccgttacgcagcgagatcttgtcagggaagtttaccatcctaaacgtccgcgaccctaccggggctagtatagctctgtttactgccaggctccaccacccacacaagtccgtgcaacatgtagtcctacaggcactcttctacctgctggatcgtgcagtggattcgttcgaaacacaaagaaacggcctggtctttatctatgacatgtgtggcagcaattacgccaacttcgagcttgacctgggaaagaaagtgttaaacctactgaaaggcgcttttcccgctcgcctcaagaaagtgctgattgtcggcgctccgatctggttcagggtcccatattcaattatctctcttctcctcaaggataaagtgagggaaaggattcagatcctgaaaaccagcgaggtgacacagcacttgcccagagaatgccttccagaaaacctaggcggatatgtcaaaatcgacctggccacttggaatttccagttccttccacaggtgaacggacaccccgatccctttgacgagattatcctattcagccttcctcccgctctggactgggacagtgtgcatgtgcctggtccccatgctatgaccatccaggagctggtcgattatgtgaacgcacgccagaagcaaggcatctacgaggagtatgaggacatccggagggagaaccccgtggggaccttccactgttctatgtctcctggcaacctggagaaaaatcgctatggcgatgttccatgtctggaccagacaagagttaaactgactaagcgctctggacatacccagacagattacataaatgcttcatttatggacgggtataagcaaaaaaacgcttatatcgggacccagggccctctcgaaaacacctaccgcgatttttggttgatggtttgggagcagaaggtcctagtgatcgtgatgaccactagattcgaagaaggaggcagaagaaagtgcggacagtactggcccttggaaaaggattcacgcataaggtttgggtttctgactgtgactaatctcggggtagagaatatgaaccattataaaaaaaccacacttgaaatacacaacaccgaggagagacaaaagaggcaggtcacccattttcaatttctatcctggcctgattacggggtcccaagtagcgccgcatcactgattgattttctaagagtcgttcgaaaccagcagtccctcgcagtgtcgaacatgggtgcacgcagtaaagggcagtgccccgaaccccctatcgttgtgcattgtagcgcaggcatcggaaggacggggactttttgctcattggatatctgcctggcacaactcgaggaactgggaaccctgaatgtcttccaaacagttagccgaatgagaactcagagagctttttcaattcagacccctgaacagtattatttctgttacaaggctatcctggaatttgctgagaaagaaggaatggtttccagcggccagaatctcttggcagtcgaatcccagtag

SEQ ID NO: 27853 - DNA, 1884 bp, Artificial Sequence
  Description of Artificial Sequence: Synthetic coding sequence
atggagggattggccggttacgtgtataaggcagcgtccgaaggaaaggtgctcactctcgctgcgttactgcttaaccgttcagagtccgatatccgctacctgttaggctacgtatctcagcaaggcggacaaaggagcactcctttgattattgccgctaggaacggccacgctaaagtggtgaggctgctacttgaacattaccgcgtgcagacccagcagaccggcaccgtaagattcgacggttatgtcattgacggtgccacagctctatggtgtgccgcaggtgcaggccactttgaggtggtgaaactgctggtgtctcacggggcaaatgtgaaccataccacagttactaactccacccctctgagggctgcttgcttcgatgggagactggacattgtaaaatacctagtcgagaacaatgctaatataagtatcgcaaacaaatatgataacacttgcctaatgattgccgcttataaaggacacaccgacgtggttcgttatcttctggaacagagggccgacccaaacgcgaaagcgcattgcggtgccactgccctgcacttcgcggctgaagcaggtcacatcgacatcgtcaaggagttaatcaagtggcgcgcagctatcgttgtcaacggacacggcatgacaccactgaaagtggcagcggagtcctgtaaagccgacgtggtcgagcttctgttgagccatgccgattgcgatagacgcagtcggatcgaggcactagagctgctgggcgcatccttcgctaacgacagagagaactatgacattatcaagacttatcactatctgtacttggccatgctggagcgctttcaggacggagacaatattctcgagaaggaagttcttccacccattcacgcttacgggaataggacagaatgccgcaatcctcaggagctagagagcatacggcaggaccgcgatgcactgcatatggaaggtctcatcgtccgggagaggatcctcggcgctgacaacattgacgtttcccacccaataatctacaggggggcagtatatgcagacaatatggagttcgagcagtgtatcaaactgtggctgcacgctctccatctacggcagaagggcaacaggaacactcacaaggatttgctcagattcgcccaggtgttctcgcagatgattcatcttaacgaaacagtaaaagctcccgatattgagtgcgttctgaggtgcagcgtgttggagatcgagcagtcaatgaatcgcgtgaaaaacatcagtgatgcggatgtccataatgcgatggacaactacgaatgtaacctgtacacatttctttatctcgtttgcatctccaccaaaacccagtgttctgaagaggatcagtgtaaaattaacaagcaaatttataaccttattcacctggaccctagaacccgggagggatttacactcctccaccttgctgttaactcgaacactcctgttgatgattttcacacaaacgatgtgtgctcctttcccaatgcccttgtcaccaagctgctcttggattgtggtgcagaagtgaacgcagtcgataatgagggaaactccgccctgcacattatagtacagtacaatagacccatatctgactttttaactctgcacagcataataataagtctggtcgaagccggtgcgcataccgacatgacgaacaaacagaacaaaacgccattggacaaaagcacgaccggtgtttccgaaattttgctgaaaacacagatgaaaatgtctctgaaatgtctggccgctagagctgtgagagccaacgatatcaactaccaagatcaaattccgaggactcttgaggaattcgtgggcttccactag

SEQ ID NO: 27854 - DNA, 378 bp, Artificial Sequence
  Description of Artificial Sequence: Synthetic coding sequence
atgcccagcgagaaaacatttaagcagagaagaaccttcgaacagcgcgtcgaggatgtgcgactgattagagagcagcaccccaccaagatccctgtgattattgagcggtacaaaggcgagaagcagctgcctgtgctggacaagaccaagttcctcgtgcctgaccacgtgaacatgagcgaactcatcaagatcatccggaggaggctacagttgaacgcgaatcaggctttctttcttctggtgaatgggcacagcatggtgtcagtgagcacgccgatcagcgaagtctatgaatctgagaaagatgaagacggtttcctctacatggtgtgcgcctcccaggagacttttggaatgaaactctccgtgtag

SEQ ID NO: 27855 - DNA, 3786 bp, Artificial Sequence
  Description of Artificial Sequence: Synthetic coding sequence
atggggactggtgatttcatctgcatttccatgaccggcggagccccttgggggtttaggctgcaggggggaaaggaacagaagcagccactgcaggtggctaagattaggaaccagtccaaggccagtggctccggcctgtgtgagggagacgaggtagtatctattaatggaaacccgtgcgccgacctgacctatccagaggtcattaaattaatggagtctataacagattcccttcaaatgctaataaaacgcccatcttcaggaatcagcgaggccttaatttcagagaatgagaataagaaccttgaacacctgacacatgggggttatgtcgagtctaccaccttgcagattcgccctgcaacaaagacccagtgcactgagttttttctcgccccagttaaaaccgaggtgccccttgcagaaaaccagcgatcaggccctgattgcgcaggctccttaaaggaagagacaggccctagctatcaaagagcaccacagatgccagactctcagcggggaagggtggctgaagaactgattctgcgcgagaaagtcgaagccgtgcagcctggtcccgtcgtggaactgcagctgagtctttcccaggagagacacaaaggagcctctggcccattggtggctctccccggtgccgagaaatccaaaagcccagatcctgacccaaatttatctcatgacagaatagtgcatattaatagcataccaaccaacgagaaggccgatccatttttgcgaagcagtaagattattcagattagttcgggccgagagctacgggtgatccaggagagcgaggcgggtgatgcgggactgcctagagtggaagttattctcgactgcagcgatcgacagaagacagaagggtgtagattacaggccggaaaagagtgtgttgactctccagtggagggcggtcaatccgaggccccaccatccctggtgtctttcgccgtctcgtctgagggcaccgagcagggcgaggatccgaggtccgagaaggatcacagccgcccacacaagcatcgggcaaggcacgcgagacttagacgctctgagtcccttagcgaaaagcaggtgaaggaagctaagagtaaatgcaaatccatagctttgctgctcacggatgcaccgaatccaaacagcaagggtgtcctgatgtttaagaagcgaagaagaagggcgcgtaagtacactctggtcagttatggaacaggcgagctagagcgtgaggccgatgaagaagaagaaggggataaggaagatacatgtgaagttgccttcctgggggcatcggagtctgaggtagatgaagagctgttatccgatgtcgacgataatactcaagtggtgaacttcgattgggactcgggtctggtggacatcgagaagaaactcaaccgcggtgacaaaatggagatgcttcctgacaccactgggaaaggcgcactgatgtttgccaaaagacgagaaagaatggaccagataaccgcgcagaaagaggaggacaaagtcggaggcacgcctagccgagaacaggacgctgcacaaactgatggactcaggaccactacgagctaccaaaggaaggaggaggagtcagtgcgtacacagtctagtgtgagtaagtcctatattgaggtctcgcacggcctcggccacgtcccccagcagaatgggttttccggtacgtctgagacagccaacattcagagaatggtacccatgaacaggacagcaaaacccttccccggtagtgtcaaccaaccagccacaccgttctcacctacccgaaacatgacgagtcccatcgccgacttccccgctccaccaccttatagcgccgtgactcctccacccgacgccttcagccgaggcgtgtcttctcctattgctggaccagctcagcctcccccttggccccagccagccccatggtcgcagcccgctttttacgattccagcgagcggattgccagccgagatgaacgcatctccgtgcctgcgaaacggaccggaattctccaagaagctaagcgacgcagtactaccaagcccatgtttacttttaaggaacctaaggtgtcacccaaccctgaactgctgtctctactgcaaaactcagagggcaaaagaggcactggggctgggggtgattctggccctgaggaggactacctgtcgctgggagccgaggcgtgcaatttcatgcaatcatcctcagcaaaacaaaaaacgccaccccctgtagcccctaagcctgcggtgaagagttcctcttcccaaccagtaactccggtgtctccagtgtggtctccgggtgtggcccctacccagcctcccgctttcccaacatccaaccctagcaagggaacagtggtctccagtattaaaattgcccaaccttcttatccacccgcacgtcccgcatcaaccctcaatgtcgccggaccattcaaaggcccacaagctgctgtggcttcacagaactacacgccaaagccaacggtgtccacaccgaccgttaacgctgttcaaccaggcgcagtgggtcctagtaatgaactgcccggaatgtcggggagaggggcacaactattcgccaaacgacagtcccggatggaaaaatacgtggtggactctgataccgtgcaagcacacgcagccagagcacaaagcccaaccccttcactgccggcttcatggaagtatagctcaaatgtcagagcccctcctcctgtggcttacaaccctattcacagcccctcttaccctcttgctgcccttaaatctcagccgagcgctgcccagccgtcaaagatgggaaaaaagaagggaaaaaagcctcttaatgccctggatgtcatgaaacaccaaccgtaccagctgaatgcaagcctgtttacatttcaacctcctgacgcgaaagacggcttaccccagaaaagctctgtgaaagtgaacagtgccctcgccatgaagcaggctctgcctcctagacccgtgaatgcagccagcccaaccaatgtgcaagccagttctgtttatagcgtgccggcatacacgtcccctccctcattctttgctgaggcctcgagtcctgtctctgcctcacccgtccccgtcggtatcccaacctctcctaaacaggaatcagccagctcctcttatttcgtagcacccaggcctaaattctctgccaagaaatccggcgtgacaattcaggagtccggcagatctctgtctcttccgggtcgctcagtgcctccacctatcagcactagcccctgggtctatcagcctacttattcgtactcatctaaacctactgatggtctggaaaaggcaaacaagcgccctaccccctgggaagctgctgccaaaagccctttgggacttgttgatgacgcgtttcagcctcggaatattcaagagtcgatagttgcgaatgtggtgtcggctgctcggagaaaggtgctgcccggtcctcccgaggattggaacgaaaggctcagctacatcccacagacccagaaggcctacatgggaagttgcggcaggcaggagtacaacgtcaccgccaacaataacatgagcacgacatctcagtacggctctcagttaccatatgcctactatcgccaggcttccagaaatgattccgctatcatgtctatggagactagaagcgactactgcctccctgtggctgactacaactataacccacatcctagagggtggcgacggcagacgtag

SEQ ID NO: 27856 - DNA, 1146 bp, Artificial Sequence
  Description of Artificial Sequence: Synthetic coding sequence
atgtcatggactgtcccagtcgtgcgtgccagccagagagtgagtagtgtgggggctaactttttatgcctggggatggctctatgtcctagacaggcgactcggatccctttgaatggcacatggctatttacccccgtctccaaaatggctactgtcaagtccgagttgattgagcgattcaccagcgagaagcccgttcatcactcaaaggtgagcattattggaacgggaagtgtgggcatggcatgtgcgatctccattcttctgaagggtctcagcgatgagctggccttagtcgatctggatgaggataagctcaagggagagactatggacttgcagcacggatctcccttcactaaaatgcctaatattgtgtgttcaaaagactattttgtgacggctaactctaaccttgtgataattactgcaggtgctcgacaggagaaaggagagacaagattaaaccttgtgcaacggaatgttgccatctttaagctgatgatctcttctatagttcagtactctcctcattgtaagctcatcatcgtgagtaatcccgtagacatcctgacctacgtggcctggaaactgtccgctttccctaaaaatcgcatcatcggatcgggctgtaacttggacactgcaagatttagattcttgattggccagaagcttggaattcacagtgagagttgccacggctggattttaggagaacacggcgactccagcgtccccgtgtggtctggagtcaacattgccggagtgcccctgaaggacctgaattcagatatcggaactgataaggatccagagcagtggaagaacgtacacaaggaggttaccgccactgcttatgagatcataaagatgaaggggtacacaagctgggcaattggcctctccgtcgcggaccttacagagtccattctcaaaaacctccggaggatccatcctgtttcaaccataatcaaaggcctatacggcattgacgaagaagtgtttctgtccattccttgcatccttggagaaaatggaattactaatttaataaaaattaagttgaccccggaggaagaggcacacctgaaaaagtcggcaaaaaccctctgggagatccagaacaagctgaagctgtag

SEQ ID NO: 27857 - DNA, 861 bp, Artificial Sequence
  Description of Artificial Sequence: Synthetic coding sequence
atgatggccacacccaaccagacggcctgcaatgccgagagcccagtcgccctggaggaggccaagacatcaggggcacctggatctccacaaacgcctccggaacgccacgactctggagggtcccttccactgacaccaaggatggagagtcactccgaggacgaggatttagccggagctgtgggtggacttgggtggaacagtagatcccctaggactcagagcccgggaggttgctctgccgaagctgttctggcaagaaagaagcaccgaagacgcccatcgaagagaaaacgccactggcggccatacctggagctctcttgggcggagaagcaacagagagatgagagacagagccaaagagcgagtcgggtaagggaggagatgttcgcgaagggacagccagtggctccctacaataccacacagttcttaatgaatgatcgggaccccgaagaacctaacctggacgtaccacatggcatatctcatccgggttccagtggagaatccgaggcaggtgatagtgacggcaggggaagagcccacggagagtttcagagaaaggattttagcgaaacttatgaacgcttccataccgaatccctgcagggaagaagtaaacaggaactggtacgcgattatcttgaactcgaaaaacggctgagccaggccgaagaagagactcgtcggctgcagcagttacaggcttgtaccggacaacagtcttgtaggcaggtggaggagctcgcagcagaggttcagagacttaggacggaaaaccaaagactacgtcaagaaaatcagatgtggaatcgcgagggatgccgctgcgatgaagaacccggtacatag

SEQ ID NO: 27858 - DNA, 1206 bp, Artificial Sequence
  Description of Artificial Sequence: Synthetic coding sequence
atggctcacgtaagctcagaaacgcaggatgtatcccctaaagatgaactgacagcttccgaggcttcaacgagatctcctctttgcgaacatactttccctggagacagtgacttgaggagtatgatcgaggagcacgctttccaggtcctgagccagggaagtttactggagagccctagttacaccgtttgtgtgagcgaaccagacaaggatgatgactttctgtccctgaatttccccaggaagctttggaaaattgtggaaagtgatcagttcaagtcaatctcctgggatgagaacggaacctgtatcgtgatcaacgaagagctctttaagaaggaaattctagagactaaggccccttatcggatattccagaccgatgccatcaaatccttcgtgcgtcagctcaacctgtacgggttttccaaaatccagcagaattttcaaagaagtgccttcttagccaccttcctgtccgaggagaaagaatcttccgtcttaagtaagttgaagttttactacaacccaaatttcaagaggggatatcctcaactgctggtaagggtgaagagacggattggagtaaagaacgccagcccaattagcacactgttcaacgaggatttcaacaagaagcacttcagagcgggagccaacatggagaaccataatagcgctctggcagctgaagcgtctgaggagtcactgtttagtgccagtaagaacttgaatatgccgcttacaagggagtctagtgttaggcagatcattgccaattcctcagtgccaatccgctccgggttcccaccaccatcaccaagcacaagtgtcgggccttccgaacagattgcaacagaccagcacgccattttgaaccagcttacaacgatccacatgcacagtcatagtacttatatgcaagcgcgtggccacattgttaattttatcactaccacaacgagccagtaccacattatttcaccactgcagaatggctatttcggtctgacagtggaaccatcggcggtaccaacacggtaccctctggtgagcgttaatgaagccccttacagaaacatgctaccggcaggcaacccatggcttcaaatgcctacaatcgcggataggagcgccgcaccacattctcgtctagctctccaaccgtctcccctggataaataccaccccaactacaactag

SEQ ID NO: 27859 - DNA, 1728 bp, Artificial Sequence
  Description of Artificial Sequence: Synthetic coding sequence
atggccatggctccttcaccaagcctggttcaggtgtataccagtccagcagcagttgctgtttgggaatggcaggatggcctcggcacatggcatccctatagcgctactgtatgctcgtttatcgagcagcaattcgtgcagcagaagggccaaagattcggactgggctccctcgcccattctatccctcttggccaggctgacccaagtctggcaccatacatcatagatctgccaagctggacgcagttcagacaggatactggaacgatgcgcgcagttagacggcaccttttccctcaacattccgcgcctggtcgtggcgtggtgtgggagtggttgagcgatgacggaagttggacggcttacgaagcctcggtctgtgactacctcgaacagcaggtcgctagagggaatcagttagtggatctcgccccactcggctataattacactgtgaattacactactcacacccagacaaacaagacctcctctttttgtaggtccgtgcggcgtcaggctggtcctccctaccctgtgacaaccatcatcgcccctcccggtcacacaggggtggcatgctcctgtcatcaatgtctttccggttcgcgtaccggccctgtttctggcagatatcggcacagcatgactaacctgccagcgtatcctgtcccccagcacccccctcaccgcactgcatctgtgttcggaacacaccaagcatttgctccatacaacaagcccagtttatctggcgcacgcagcgcgcctcgcttgaataccacaaacgcctggggcgcagctccgccttcactcggcagccagcctctgtaccggtcttctctaagccacctggggcctcaacacttaccccctggatcaagcacttctggagcagtgagcgcgtctctgccctctggccctagttcgtctccaggtagcgttcctgccacggtccccatgcagatgcctaagcccagtagagtccaacaagccctcgccggtgccacacccaagcccgagcctgagccagaacaggtaattaaaaactacacagaggaacttaaagtgcctcctgatgaggattgcatcatctgcatggagaaactctctacggcctccggctatagtgatgttactgactccaaagcaattggatctctcgcagtgggccacctgactaagtgttcccacgcattccacctcctgtgtctgttggcaatgtactgcaacggtaacaaggacggttctctccagtgcccctcatgcaagaccatttatggggaaaagaccggtactcagccacagggcaagatggaggtgctgcggtttcagatgtctctgcccggacatgaagattgcggcactatcctgatcgtgtacagcatcccgcatggaatccagggaccggagcacccaaatcccggtaaacctttcacagcgcgtgggttcccacggcaatgctacttgcccgataatgctcagggcagaaaagtcctcgagctactcaaggttgcctggaaacggaggctgatttttaccgtgggtacatcctcaaccaccggcgaaacagacacagtggtgtggaatgagatccatcataaaactgagatggatagaaacatcacgggccatgggtacccagatcctaactaccttcaaaatgtgctcgcggaactggcagcacagggcgtgactgaggactgtctcgagcaacagtag

SEQ ID NO: 27860 - DNA, 1095 bp, Artificial Sequence
  Description of Artificial Sequence: Synthetic coding sequence
atggagcacaatgggtccgcaagcaacgccgataagatccaccagaacagactgtcaagcgtgactgaggacgaggatcaggatgccgctctcacaatcgttaccgtacttgataaagtggcaagcatagtggattctgttcaggcgagtcagaaaaggatcgaagagagacatcgggagatggagaacgctatcaaaagcgtgcagattgacctactgaagctcagccaatcccattctaataccgggcatatcatcaataaattgttcgagaagacccggaaggttagcgcccatataaaagacgtgaaggctcgggtggagaaacagcaaattcacgtaaaaaaggtcgaggtcaaacaggaggaaatcatgaagaaaaataagtttcgtgttgtcatctttcaggaaaaatttcgttgtccaactagcctttctgttgtcaaggatcggaacttaactgaaaatcaggaggaggacgacgacgatatcttcgatcccccagtggatctgtcctcagacgaggaatattatgtggaggagtctagaagtgcgaggttgcgcaagagcgggaaggagcacattgacaacatcaagaaggccttttcaaaggagaatatgcagaaaactaggcaaaacttagacaagaaagttaacagaatccggaccaggatcgtcactccagagcggagagagcgccttagacagagcggcgagcgccttagacagtctggggagagattacgtcagtccggagagcgctttaagaagtccatttccaatgccgctccctcaaaagaggcatttaaaatgcgctccctgcgtaaaggcaaagatcgcaccgtggctgaaggagaagaatgtgctagagagatgggagtggatatcattgccaggagtgagtctctgggccctataagtgagctttactcagacgaattatctgaaccagagcatgaagccgctcggccagtatacccccctcacgaaggccgagagattcccacgcccgagcctctgaaagtcaccttcaaatctcaagtgaaagtggaggatgatgaaagtctgctgctcgatttgaagcactcaagttag

SEQ ID NO: 27861 - DNA, 1266 bp, Artificial Sequence
  Description of Artificial Sequence: Synthetic coding sequence
atgcccacgctcagcgtttttatggacgttccccttgcacataagctggaggggtccctgctcaaaacttacaagcaggacgattatccaaacaaaatcttcctggcctatagggtctgcatgactaatgaaggccacccgtgggtatctctggtggttcagaagaccagactccagatctcacaggacccttccctgaactatgagtacctgcctacaatgggacttaagagttttatccaggcgagtctggccctgctcttcggcaagcacagccaggcgatcgtcgagaacagagttggtggcgtccacactgtgggagatagcggtgccttccaactgggagtgcaatttctccgagcatggcataaggacgctagaatcgtttacatcattagtagccagaaggagttgcacggactcgtgtttcaagacatggggttcacagtttatgagtacagcgtgtgggaccccaaaaaactgtgcatggaccccgacatcttactgaatgtcgttgagcagatcccgcatggatgcgtcctggttatgggcaatattatcgattgcaagcttaccccatcggggtgggctaagctgatgtccatgatcaaatctaagcagatctttcctttcttcgatatcccctgccagggcctgtacacctccgacctggaggaagacacacggatcttgcagtattttgtctctcagggcttcgaattcttttgctcccagagcctgtccaagaactttggcatttacgacgaaggagtgggaatgcttgtcgtggtggctgtcaataaccaacagctgctctgcgtcctctcacaactggaaggcctagcccaggctctgtggcttaacccccctaatactggcgctcgggtgatcacgtcaattctttgtaacccagctctgttgggtgaatggaaacaatccctgaaggaggtcgtggagaacatcatgttgacaaaggaaaaggtcaaagagaaattgcagcttcttgggaccccgggtagctggggccacatcaccgaacagtccgggacccacggatatctcggtctgaactcccagcaagtggagtatctagtgcggaaaaagcatatttacatacctaaaaatggccaaatcaacttcagctgtataaacgccaacaatatcaactatatcacagaaggaatcaacgaggcagtgctcctgactgaatcctctgagatgtgtttgcccaaggaaaagaagacattgatcggaataaagctatag

SEQ ID NO: 27862 - DNA, 576 bp, Artificial Sequence
  Description of Artificial Sequence: Synthetic coding sequence
atggggaagagctgtaaggtcgttgtatgcggacaggcctctgtgggaaagacctcaattttagaacagctgctttacggaaaccacgtagtcggttccgagatgatcgagacccaagaggatatctacgtggggtctattgaaacggaccggggagtgagagaacaggttagattctatgatacacgcggattgcgcgacggagcggaactcccccgtcactgcttttcctgtaccgatggctacgtgttggtgtattccacagatagcagagaatcatttcagcgggtggagcttctgaaaaaggaaattgacaaatccaaggataaaaaggaagtgacaatcgtcgtattgggcaataagtgtgacctccaggaacagagacgtgtggaccccgacgtggcccaacattgggcgaagtccgaaaaagtgaaactgtgggaggtatcagtcgctgatcggaggtcactgctcgaaccttttgtgtatctagcatctaaaatgactcagccgcagagcaaaagtgccttcccactgtcccggaagaataagggctccggatcacttgatggatag

SEQ ID NO: 27863 - DNA, 3207 bp, Artificial Sequence
  Description of Artificial Sequence: Synthetic coding sequence
atggtgagttctgatagacctgtgtccctcgaagatgaggtgtctcatagtatgaaagagatgattggaggatgctgcgtgtgtagcgacgaaagaggatgggctgagaaccctctggtctattgcgatgggcacggctgcagcgttgctgtccatcaggcttgctatggcattgttcaggtgccgactgggccatggttttgccgaaagtgtgagtctcaggaacgggctgctcgcgtgagatgtgagctgtgtcctcacaaagacggtgccctgaagcgtacggataatggaggatgggcgcacgtggtctgtgcgctgtatattcctgaagtacagttcgcaaatgtaagtacaatggagccgattgtgcttcagtctgtccctcatgacagatacaacaaaacatgctacatctgtgatgagcaaggcagggagtccaaggccgctaccggcgcttgcatgacatgtaacaagcacggctgccggcaggctttccatgtgacgtgcgcccagttcgccggtctcctatgcgaagaggaggggaacggcgctgataatgttcagtattgcggttattgcaagtaccatttctcaaaactcaagaaatctaagcggggttccaaccgatcctatgatcagtccctctctgattcctcatcccactcccaggataaacatcatgagaaggagaaaaagaagtacaaagagaaggacaaacacaaacagaagcacaagaagcagccggaacccagtcctgccctggtgcctagtttgaccgtcaccaccgagaaaacctacacgagcacctccaacaatagtatctctggcagcctcaagcggctagaagatacaaccgcaaggtttacaaatgccaatttccaggaagtatctgcacataccagttcaggaaaggacgtctccgagaccagggggtcggaaggcaagggcaaaaagtcctcggctcattcctccggccagcgaggcagaaagcccggtggagggaggaatcccggaactaccgtgagcgcagctagcccattcccacagggctctttttcgggcacacccggttcagtaaaatcaagtagcggatcttcggtacagagccctcaagactttctgtcgttcaccgatagcgatctgcggaatgattcctacagccattcccaacagagttcagctaccaaagacgtgcataagggcgagtcaggatcccaggagggaggcgtcaactccttctccacactgatcggcctcccatccaccagcgccgtgacaagtcagcctaagtcattcgagaactcccccggagacctaggtaattcgtctttaccgaccgccggttataaaagagctcaaacttcgggcattgaagaggagactgtgaaagaaaagaagaggaaaggaaacaagcaatctaagcacgggccagggcgacctaaaggcaacaagaatcaagaaaatgtgtctcacctgtctgtaagttccgcctccccaacaagctcagttgcatcagctgctggctccatcacgtccagcagcctgcagaagtcaccaactctcttgagaaatggaagcctgcagtcccttagcgttggcagctcccctgtgggaagcgagatatccatgcagtatagacacgatggcgcttgcccgacaacaaccttctctgaactcctgaacgccattcacaacgggatatacaactctaatgatgttgccgtgtcattccccaatgtggtctcaggctcaggcagttcaacacccgtatcaagttcacacctgccccaacaatcgtccggccacctgcaacaagtgggtgctctcagtcctagtgcagtgtcttctgccgcacccgctgtggcgacgactcaggccaacacactgtcaggtagctctctgtcccaagcgcctagccatatgtacggcaatcggtcaaactccagtatggcagctctcattgcgcaatcagagaataaccagacagatcaagatttgggtgataattctcgaaacctggtcggtaggggcagtagtcctcgcggatccctctcgcccagatcaccggtgtcatctctgcaaattcgttacgatcagcctggcaattctagccttgagaacctgccacccgtggccgcaagtattgagcagctacttgagcgacagtggtccgaaggtcagcagttcctgctcgagcaaggaaccccttccgatatcctgggcatgctgaaatccctgcaccaactacaggtggaaaacaggcggttagaagaacagataaaaaatctgaccgctaaaaaagagcgcctgcagctgctgaacgctcaattgagtgtgccctttcctacaattactgccaacccctctccttctcatcagatacacacattctccgcccaaactgcgccaacaactgactctttgaattcgtccaagagtccccacatcggtaattccttcttaccagataacagtctgcccgttctcaaccaggatctgacaagttcgggccagtccacatctagctcttcagctctctcgacaccacccccagccggacagagccctgcccaacaaggctctggtgtttctggcgtgcagcaagtgaacggggtgactgtaggggcactcgcaagcggaatgcagccagtgactagcacaattcccgcagtatcagctgtcgggggaatcatcggagcactcccaggcaatcagctcgcgatcaatggcatcgtaggcgctctcaatggggtcatgcagacccctgtgacaatgagccaaaaccctacccctctcacccacacgactgtaccccctaacgctacccacccaatgccggctaccctaaccaatagcgcaagtggactcggacttctctccgaccagcagagacaaattctgattcaccaacaacagttccaacaactcctgaactctcagcagctgacgccagagcagcaccaggccttcctgtatcagctgatgcagcatcatcatcaacaacaccaccagcctgagctgcagcagctccagatccccggacccacacagattcccataaacaacctgctcgccggtacccaggctcctcctctccacaccgccaccaccaaccccttccttacaatccacggggacaacgcttctcagaaagtcgcgagactgagcgacaagactggcccagtggcgcaggaaaaaagctag

SEQ ID NO: 27864 - DNA, 1353 bp, Artificial Sequence
  Description of Artificial Sequence: Synthetic coding sequence
atgtcttgcctgatggtcgagcgctgtggtgagattttgttcgaaaaccccgatcagaacgctaaatgcgtgtgtatgctgggagacatccgccttagaggtcagaccggtgtgcgtgcagaaagacgaggatcatacccatttattgacttcaggttattaaattcgacaacatattccggagagatcggaaccaagaaaaaagtgaaacgcctgttgtccttccagcggtacttccacgcgtcccggttactgcgcggaatcataccacaggcgcctttgcacctgctggacgaggactacttgggccaagccaggcatatgctttccaaagttggaatgtgggacttcgatatcttcctattcgaccgactgacaaacggcaacagtctggtcaccttactttgtcacctgttcaacacgcatggcctgatccatcattttaagcttgatatggtaaccctgcaccggttcctggtcatggtgcaggaagactaccactcacagaatccctaccataacgcggtgcacgctgccgatgtgacgcaggcgatgcattgttacctaaaggagcccaaattggcctcgtttctgacacctctagacatcatgctgggacttcttgcggcagctgcccacgatgtcgatcacccaggagtgaaccagcccttcctgatcaagactaaccatcacctggccaatctgtatcaaaacatgtccgttctggagaaccaccactggaggtcaaccattgggatgttgcgcgagagcagactgctcgcacatctaccaaaagagatgacgcaggacatcgaacagcagctgggatcattgattttggccactgacataaacagacagaatgagttccttaccagactgaaggctcatctgcacaacaaggacctcaggctcgaagacgcccaggatagacatttcatgctccagattgctttgaaatgcgcagacatatgcaacccctgtcggatctgggaaatgtccaagcaatggtccgagcgcgtgtgcgaggagttttaccgccagggcgagctcgaacagaaattcgaactcgagatcagcccactctgtaaccaacaaaaggacagcataccatcgatacaaataggctttatgtcttacatagtggaacccctgttcagagagtgggcacactttactggaaactcgactctcagcgaaaatatgctggggcacctcgctcacaacaaggctcagtggaagagcttgttgcccagacagcaccggtcaagggggtcgtcaggaagcggacctgatcatgatcatgcaggccagggtacggaatccgaggaacaggaaggcgatagcccctag

SEQ ID NO: 27865 - DNA, 2268 bp, Artificial Sequence
  Description of Artificial Sequence: Synthetic coding sequence
atggcgggatgcatccccgaggaaaagacctatcgcaggttccttgagttattcctgggggagttcagaggtccatgcggcggaggagaacccgaacccgaacctgagcctgagccggagccagaacctgaatcagaaccggaacctgaaccggagctggtagaagcggaggccgctgaagcaagcgtggaggagcccggtgaggaagctgccaccgtagccgcaacggaagaaggagatcaggagcaagatcctgaaccagaagaggaggccgcagttgaaggggaagaagaagaagagggggctgccactgccgcagcagcgcctggacattcagcagtgccccctccccctccacaactccctcccttgcccccactcccacggcctctatccgagcggattactcgcgaggaggtggagggcgagagcctggatctctgcctccaacaattatataagtacaattgcccctcatttctggccgcagctctggcgagagctacgagcgatgaggtactgcaatccgacctgtccgcacactacattcccaaagaaacggacggcactgagggtaccgtggagattgagaccgttaaactcgcccgatcagtattttccaaactgcatgaaatatgctgcagttgggtgaaggattttcccctgaggagacgcccacagctgtactacgagaccagtatccacgctatcaaaaacatgcggaggaagatggaggacaaacacgtgtgtatcccggacttcaacatgttgtttaatcttgaggatcaggaggaacaagcctactttgctgtgttcgatgggcatggcggtgtggatgctgcgatctacgctagtattcacctgcatgtcaacctcgtgaggcaagaaatgtttccacacgatcccgcagaggctctatgtagagccttcagggtgaccgacgaacgcttcgtgcagaaagcagccagggagtcactcaggtgtggcacaaccggagtggttacgtttatccgcggaaacatgctgcacgttgcctgggtgggggattctcaagtcatgttggttagaaagggccaggcagttgaactgatgaaaccccacaagccagacagagaagatgaaaagcagaggatcgaggcgttgggaggctgtgtcgtctggttcggcgcatggcgggtgaatggctccctctcagttagtcgggctattggcgatgcagaacacaagccatacatttgcggagacgccgattccgccagtaccgtgttggacggaacggaagactatttgatcctcgcctgtgacggtttctatgacaccgtgaatccagacgaggcagtgaaagtggtctctgaccacttgaaagagaacaatggcgacagctcgatggtcgcacacaaattggtggcctctgccagggacgccggttcctccgataatatcaccgtgatcgtggtttttctgcgagacatgaacaaggcagtgaatgtgagtgaagaatctgactggacggaaaatagtttccaggggggacaggaagacggaggcgatgataaagagaatcacggtgagtgtaaaagaccctggcctcagcaccaatgctctgctcccgcagatcttggttatgatgggcgagtggactcctttacagaccgcacaagcctgagcccagggagccagattaacgtccttgaggacccaggttatttggacctaactcaaatcgaggcctcaaaacctcattcagcccaattcctcctgcccgttgagatgttcggacccggtgcgccaaagaaagcgaatctcattaacgagcttatgatggaaaagaagtcagtccagtcttcactgcctgaatggtccggagctggcgagttccctaccgcatttaacctaggaagcacaggggaacagatctataggatgcagtccctatccccagtctgttccgggctcgagaatgaacagttcaaatcaccagggaaccgagtgtctcgactgtcccatctgagacaccattattccaaaaagtggcatcgcttccggtttaaccctaaattctattccttcctctccgcacaggaaccttctcataaaatcggtacctcactctcttcattgaccggttctggcaagagaaatcgaattcgctcttccttgccatggagacagaactcgtggaaaggctactccgagaatatgaggaagctccggaagacacacgacatcccctgcccagatctgccatggtcatataagattgagtag

SEQ ID NO: 27866 - DNA, 771 bp, Artificial Sequence
  Description of Artificial Sequence: Synthetic coding sequence
atggccagcagatacgatcgcgctattacagttttttctccggacgggcacctgttccaggttgagtatgcccaggaggctgtgaagaaagggtcaaccgccgtagggatcagggggacaaatattgtggttctaggagtggaaaagaaatctgttgctaagctgcaggatgagcggacagtccgaaagatatgtgctctcgacgaccatgtttgcatggcctttgctgtattgaccatttttataggactgaccgctgatgccagagtggtgatcaatcgtgcaagggtggagtgtcagagtcataagctcactgtggaggatccggtaactgtagagtatattacgaggtttatcgcgacgcttaaacagaagtacacccagagtaatggccgtagaccctttggaatctctgccctcatcgtcggctttgacgatgacgggatctcgcgcttatatcagaccgacccgagtggcacataccatgcgtggaaggctaacgctatcggcaggtctgcaaaaacagtccgcgaattcctggagaaaaactacaccgaggacgccattgcgtcagattccgaggccataaagctggccattaaggccctgctggaagtggtccagagcggcggtaagaatatagaattagcgatcatacgccgaaatcagcctctgaagatgttctcggccaaggaggtagagctgtacgtgacagaaatcgagaaggagaaggaggaggccgagaaaaagaagagcaagaaaagtgtgtag

SEQ ID NO: 27867 - DNA, 3108 bp, Artificial Sequence
  Description of Artificial Sequence: Synthetic coding sequence
atggcacctcgtttgcagcttgaaaaagccgcttggcggtgggccgaaacagtaaggcccgaggaagtaagtcaggagcacatagaaaccgcttatagaatctggctagaaccttgcatcagaggggtgtgcagacgaaactgtaaagggaatccgaattgcttagtggggatcggggagcatatctggctgggggagatagacgagaactccttccataacatcgatgatcccaactgcgagagaaggaagaaaaatagtttcgtggggctgaccaatcttggcgctacttgttacgtcaacactttcctgcaagtatggtttcttaacttagagctacggcaggctttgtatctgtgcccttcaacctgcagcgactacatgctgggagacggcattcaagaagagaaggactatgaaccccagacgatctgtgaacacttgcaatacttgttcgctctgctacaaaacagcaacagacgttatatcgacccttccggattcgtgaaggcactgggtctggataccgggcagcaacaggacgcgcaagaatttagtaagctgttcatgagcttgctggaggacacactgtcgaagcagaagaaccccgacgtgcggaatatcgttcagcagcaattttgcggtgagtatgcgtatgtgacagtgtgtaatcagtgcgggcgagagagtaaactgctgagtaagttctacgagctcgaattaaatatccagggccacaaacagctcactgattgtataagtgagttcctcaaggaagaaaagctggagggggataataggtatttctgcgaaaactgtcaatctaagcagaacgccactcgcaagattcgtctcctttctcttccctgcaccctaaacctacaactgatgagattcgttttcgatagacagacaggacataagaaaaagttaaacacctacatcggcttttctgagattctggatatggaaccttatgtcgaacacaagggcggatcctatgtttatgagctgtcagcagtgctcatccacaggggagtctcggcttatagcggccactatatcgcccacgtgaaggacccacagagcggcgagtggtataagttcaatgatgaagacatcgagaagatggaaggtaagaaattgcagttaggaatcgaggaggatctggctgaaccatctaaatcccagacacggaaaccgaagtgtggcaaggggacccattgtagcagaaacgcgtatatgcttgtctacaggttgcagacccaggaaaagcctaacaccactgttcaggtcccggcattcctgcaggagctagtggacagagataatagtaagttcgaagagtggtgtattgagatggctgaaatgcgaaagcagtctgtagacaagggcaaggccaagcacgaagaagtgaaggagttgtatcagcgcctcccggctggcgcagagccatatgagtttgtctcactggaatggcttcaaaaatggctggatgagtcaacccctactaagcctattgacaatcatgcctgtctatgttctcacgacaagcttcaccctgacaaaatctccatcatgaagcggatttctgaatatgccgctgacatattttatagccgatatggaggaggcccacgcctgactgtgaaggctctgtgtaaggagtgcgtggtcgagcggtgccggatactgcgtctgaagaatcagctgaacgaagattacaaaacagtaaataatctgctgaaagctgcagtgaaaggatcagatggattctgggtcgggaagtctagcttgaggtcatggcgccagctagcactagaacagcttgacgagcaagatggggacgctgagcagtctaacggaaagatgaatggcagtacgttgaataaggacgagagtaaagaggagcgcaaggaggaagaggaattgaattttaacgaggatatcctctgccctcacggagagctctgcatttccgagaacgagaggcgactggttagtaaagaggcatggtctaaactccagcagtactttcccaaggccccagagttcccgtcatacaaagagtgttgctctcagtgtaaaatactggagagggagggggaggagaatgaagcccttcataagatgattgctaacgagcaaaaaactagcctcccgaatctcttccaggacaaaaaccggccttgcctttctaactggcctgaggacacagatgtgctttacatcgtttcccagttttttgtcgaggagtggcggaaatttgtgcgaaagcctacacgttgttccccggtctccagcgtcggaaatagtgccctgctgtgccctcatggcggactgatgttcacgttcgcatctatgacaaaggaagattcaaaattaattgccctgatttggccttctgaatggcaaatgatccagaagttattcgtagtcgatcacgtgatcaaaataacacggattgaggtcggtgatgtgaatccgtctgagactcaatatatatctgagccaaaactgtgtccagaatgcagggagggtctactttgtcagcaacagagagacttacgcgagtatacccaggcaaccatatacgtccacaaggtcgtagacaacaaaaaagtcatgaaggactccgccccagagctcaatgtgagctcaagcgagactgaggaggacaaggaagaagcaaagccagatggcgaaaaggatcccgacttcaatcagtccaacgggggtaccaaaaggcagaagatctcgcatcagaattatatagcctatcaaaaacaggtgattcgacgttctatgcgccatcgcaaggtgagaggagaaaaggccctcctagtcagcgccaatcagactttgaaagagcttaaaatccagatcatgcacgctttttcagtcgctcctttcgaccagaatttgagtatcgatgggaagattctgtctgatgactgtgccactctcgggacactgggcgtcattcctgaatccgtcatcctgcttaaggccgacgagcccattgccgattatgcagcaatggatgacgtgatgcaggtctgtatgcccgaggaaggctttaaagggacaggcctgctcggacattag

SEQ ID NO: 27868 - DNA, 2382 bp, Artificial Sequence
  Description of Artificial Sequence: Synthetic coding sequence
atgctgattcagagtgaaaagaaaacacagctttctaaaaccgaaagcgtgaaagaaagcgaaagcctcatggaatttgctcagcccgagatccagccccaggagtttctgaaccgcaggtatatgactgaagtggattactctaacaagcaaggggaagagcaaccgtgggaggcggactacgccagaaagccgaatctgcccaagcgctgggacatgcttacggagcctgatgggcaggagaagaagcaagagagtttcaaaagctgggaagcctccggaaaacaccaggaggtcagcaaacctgccgtctctctcgaacagcgcaagcaggacacttccaaactgaggtccaccctccccgaggaacaaaaaaagcaagaaataagcaagtccaagccatcaccttcacagtggaagcaagatacaccaaagagcaaagcaggctatgtgcaagaagaacagaaaaagcaggaaacccccaagctgtggcctgttcagcttcagaaggagcaggaccctaaaaaacaaacaccaaaatcttggacaccctccatgcagtccgagcaaaacactaccaagtcatggacaacccctatgtgcgaggagcaggacagcaagcagcctgaaactcccaagagttgggagaacaacgtcgagtctcaaaaacacagcctgacctcccagtctcagatctcccctaaatcatggggagtggccaccgcaagtttgattccaaatgaccagctgctgcccagaaagctcaacaccgaaccaaaagatgttcctaagcccgtgcaccagccagttggaagctcatctacactcccaaaggatcccgtgctccgaaaagagaaactgcaggacctgatgacgcagatacagggaacctgtaatttcatgcaggagtccgtcttggatttcgataaaccttctagcgcgatccccactagccaaccaccatccgccacccccggatcacccgttgccagcaaagagcagaacctcagctctcagtccgactttcttcaggaaccactccaggcgacatcaagccctgtaacttgtagcagtaatgcctgtctggttaccaccgatcaggctagctctggaagtgaaacagaatttatgacgagcgaaacccccgaagccgcaatccccccaggtaagcagccctcgtctctggcatctccaaatcccccaatggccaagggcagtgagcagggcttccagtcccctcctgcgtcttctagttccgttaccattaacacagcccctttccaggccatgcagactgtattcaacgttaatgctcccctgccccctaggaaggaacaggaaatcaaggagtctccctacagccccggatacaatcagtcattcaccaccgcctcgacccagacacctccccaatgtcagctcccctctatccacgtggagcaaaccgtgcattcccaagagacggccaactaccacccagatggcacaattcaggtgagcaatgggtctctcgcgttttatcccgctcagaccaatgtttttcctcgacccactcagccatttgtcaatagtagaggtagcgttcgcggatgtaccaggggaggcaggctcatcaccaacagctatcggtctccaggcggatataaaggctttgacacctatagggggctgccttcaatatctaatgggaactacagccaattgcagttccaggcacgggagtactcaggtgctccatattctcaaagagacaatttccagcagtgctacaagcgtggtggcactagcgggggacctcgagcaaactccagagctggctggtcagactccagccaagtgtcctcaccagaaagagacaacgaaaccttcaacagcggcgacagcgggcagggagatagccgctccatgacaccagtcgatgttcctgtcactaaccccgcagcaacgatacttcccgtgcatgtttaccctctacctcaacagatgcgggttgccttttcggctgcgaggacttccaatttggcccctggcaccctggatcaacccatagtctttgatctgctgcttaataatttgggagagacattcgatcttcaacttggcagatttaactgtcctgttaatggtacgtatgtgtttatctttcacatgctgaagctggctgttaacgttccgctgtacgttaacttgatgaagaatgaggaggtgctggtgtcagcctatgctaacgatggggctcctgaccacgagactgcctctaatcacgctattctccagcttttccaaggagatcagatttggttacgcctgcacaggggggcaatatacggatctagctggaagtactccacattttctggctatctcctctaccaggactag

SEQ ID NO: 27869 - DNA, 1083 bp, Artificial Sequence
  Description of Artificial Sequence: Synthetic coding sequence
atggaagagttgagccaggcgctcgcctcctcatttagcgtgtcacaagacctgaatagcactgcagcaccccatcctcggctgtctcagtataaatctaaatacagcagcctggagcagagcgaacggaggaggagactccttgagctgcaaaagtcgaaaagactcgattatgtgaatcatgcccgtagattggctgaggatgactggaccggtatggagagtgaagaggaaaataagaaagacgacgaagagatggacattgatacagtaaaaaagctcccaaagcattatgccaatcagctgatgctgtcagaatggctcatcgatgttccttctgatctgggccaagaatggattgtcgtggtgtgtcctgttgggaagagagcactcatcgttgcgagccggggtagcactagtgcatacaccaaaagcggctactgcgttaatcgcttcagcagcctgctgcccggaggtaaccggagaaattccacagcgaaggactacacaatcctggactgcatctataatgaggtgaaccagacatactatgtcttggatgtgatgtgttggcgcggtcacccattctacgactgccagacagattttaggttctattggatgcacagcaagctccccgaagaggagggccttggcgagaagaccaaattgaatccgtttaagttcgtcgggctgaagaactttccatgcacaccggagtccctctgcgatgtccttagcatggattttcctttcgaagttgatggcctgttgttttaccacaagcagacccactattctcccggatctacacctttggtgggctggctgagaccttacatggtctctgacgtcttgggcgtagccgtgcccgcaggccctctgactaccaagcctgactacgcaggccatcagttgcagcaaatcatggagcacaagaaatcccagaaggagggtatgaaagaaaagctgacacacaaagcgagcgaaaacggccattacgagctcgagcatctgagtacgccgaagctgaaaggaagcagccactctcctgatcatccaggatgccttatggagaactag

SEQ ID NO: 27870 - DNA, 525 bp, Artificial Sequence
  Description of Artificial Sequence: Synthetic coding sequence
ctaatacacaaaccgcttaaacgcgctatcacgaccctcatggccggaatacttcgccttgtggtgcagtggcctcctgggaggctgcagacggtgacaaagggggtagagtcactcatttgcacagactggattagacataaattcacccgcagtagaattcctgaaaaggtcttccaggcgtccccagaagaccacgaaaagtatggtggagaccctcagaacccccataaacttcatattgtaactcgcataaagtcaactcgacgaagaccttattgggagaaggacatcattaagatgctggggctcgagaaggcccacacccctcaggttcacaaaaacattccctccgtgaacgccaagctgaaagtggtgaaacatttaatccgcatcaaacctcttaaacttccccagggactgcctgccgaagagaatatgtctaacacttgtcttaaatctactggcgagcttgtcgtgcagtggcatcttaagccagtcgagcagaaggctcatgaatcttag

SEQ ID NO: 27871 - DNA, 1434 bp, Artificial Sequence
  Description of Artificial Sequence: Synthetic coding sequence
atggccacctatacctgcattacgtgcagagtggctttcagagatgccgacatgcagcgagctcattataagacagattggcatcgctataacctgcggcgaaaagttgcctcgatggcgccagtaaccgccgagggatttcaggaacgcgttcgggctcaacgggctgtggcagaagaagagtcgaaggggtccgccacctattgcaccgtctgcagtaagaagtttgctagtttcaacgcgtatgaaaaccatcttaagtctcggcgacatgtggagctcgaaaaaaaggccgtgcaagcagtgaaccggaaggtcgagatgatgaatgaaaagaacctggagaaaggcctgggcgttgattcagttgacaaagacgccatgaatgcagctatccagcaggccattaaggcgcagccttctatgtctcccaaaaaggcacctccagcccctgccaaggaggcccgaaacgttgtggccgtggggaccggcggacggggtactcatgacagagatccttccgaaaagcctcctcggctgcagtggttcgagcaacaagccaaaaagctcgcgaagcagcaggaagaagatagcgaggaggaagaagaagatctggacggggacgactgggaagacatcgattcagacgaagaactggaatgtgaagatactgaggcgatggatgacgtggtagagcaggacgccgaagaagaggaggccgaggaaggtcctccactgggtgctatccccatcacggattgcctgttttgcagtcatcactcatcctcgttgatgaaaaatgtcgctcatatgacaaaagaccactcattttttatcccagacatcgaatatctgagtgatattaagggactgataaaatatctcggcgagaaggtcggcgtcggcaaaatatgcctgtggtgcaatgagaaaggaaagtccttctacagcacggaagctgtccaggcccacatgaacgacaaaagccattgtaaattgtttacagacggcgacgcagctctggagtttgccgacttctatgattttcggtcttcttatcctgatcacaaggaaggagaggaccccaataaagctgaggaactgccgtctgaaaaaaacctggaatatgatgacgaaaccatggaactaattttgccatctggagcccgtgtcggccaccgctctctgatgcgctattacaagcaacgattcggcttaagtcgcgcagtcgccgtggctaagaaccgcaaagcagtgggtcgcgtgctccagcagtacagggcattaggctggacggggagcactggggctgcattaatgagagaaagagatatgcaatacgtgcaacggatgaaatccaaatggatgctaaagacgggcatgaaaaataatgctaccaagcagatgcacttcagggtacaggtcaggttttag

SEQ ID NO: 27872 - DNA, 2862 bp, Artificial Sequence
  Description of Artificial Sequence: Synthetic coding sequence
atgatcactagcgctgccggaattatcagcctactggacgaagatgaaccccagctgaaagaatttgctcttcataaactgaacgcagtagtgaatgacttttgggccgaaatcagtgagtctgttgacaagattgaagtgctgtacgaggacgagggctttaggagtaggcagttcgcagcactggtagcctcaaaggtgttctaccatctgggcgcttttgaggagtcactgaattatgcacttggtgccggtgatttattcaacgtgaacgacaacagcgagtacgtggagacaatcatcgcaaagtgcattgaccactacacaaaacaatgcgtggaaaacgccgacctgccagagggggagaaaaagcccatcgatcaacgtctggagggaatcgtgaataaaatgttccagcgttgcttagatgatcacaagtacaagcaagccattggtatcgcattagagactagacgactcgacgtctttgagaagaccattctggagtctaacgacgtccccggtatgctggcctattctctgaagctgtgtatgtcactgatgcagaacaagcagttcagaaacaaagttcttcgggtgctggtgaagatatacatgaatttagaaaaacccgactttatcaacgtttgccagtgcctgatctttttggacgacccacaagccgtttcagacatccttgagaaattggtgaaggaggataacctgctgatggcttaccaaatctgctttgatctgtacgagtccgccagccaacagtttctgagctcagtcattcagaatctgagaacggttggaacacctatagcgtcagttcccggatctacaaacaccggcaccgtgcccggatccgaaaaagactctgattctatggagaccgaagaaaaaacgtcatcggcctttgttggcaagacgcccgaggcctctccagaaccaaaggatcagactctgaaaatgataaaaatcctctctggcgagatggccattgaattgcatttacaattccttatccggaataacaacacagacctcatgatcctgaaaaacacaaaagacgcggtgaggaacagcgtttgtcatactgctacggtgatcgccaactcgttcatgcattgcggaaccacttctgaccagtttcttagggataacctggaatggttggccagggctacgaactgggctaagtttaccgcgacagctagtctgggggtaattcacaaaggacatgagaaggaggccctccagctaatggccacatatctgcctaaagatacaagccctggctccgcatatcaggagggagggggtctctacgccctgggcctgatccacgctaaccatggtggcgacatcatcgactatttgctgaatcagctgaaaaatgctagtaatgatatcgtccggcatgggggatcacttggactgggccttgccgcaatgggaacagcaagacaagacgtgtatgacttgctcaaaacaaatttgtaccaggatgatgccgtcaccggtgaagccgctgggctcgctctgggactcgtgatgctggggtctaaaaatgcccaggccatagaggatatggtgggctacgctcaggagacccagcacgagaagatcctgagaggtctcgctgtcggtatcgccctggtgatgtacggcagaatggaagaggcggatgcacttattgagagcctctgcagggacaaggatccaatcctcagaagatctggaatgtacaccgtcgccatggcgtactgtggcagcggaaataataaggctattcgcagactcttgcacgtggcagtgagtgacgtgaacgacgacgtacgacgggcagccgtcgaatctctgggatttattctatttcggacccctgaacagtgtcctagtgtggtgtctctgctttcggagtcatacaacccccacgtcaggtatggcgctgcgatggccctgggaatatgttgtgccggaactgggaacaaggaggcaataaacctgctagagcccatgactaacgatccagtaaattacgttcgacagggagccctgattgcgtccgcactgatcatgattcaacagacggaaataacatgtcctaaagttaatcagttcaggcagctttacagtaaggttattaatgacaagcatgatgatgtgatggcaaagttcggggctatcttggcacagggtattctggacgccggaggtcacaacgtaaccatttctctccaatctagaacaggtcacacccacatgccttctgtggttggagtcctggtctttacccagttttggttttggtttccattgtctcattttctaagtcttgcgtatacacccacttgcgtcattggcctgaacaaagaccttaaaatgccaaaggtccagtataaatccaattgtaagccaagcactttcgcatatcctgctccattagaggtaccaaaagaaaaagagaaggaaaaggtctccacggccgtcctgtcaatcacggccaaggctaaaaaaaaggaaaaagagaaagagaaaaaagaggaggaaaagatggaagtagatgaagccgagaagaaggaagagaaagaaaagaaaaaagaacccgagcctaatttccagttgctggacaacccggcaagggtgatgcccgcacagcttaaagtcctgacaatgcccgagacatgcagataccaaccttttaagcccctgtctataggcggtatcatcatcttgaaagatacctccgaggatatcgaagaactggtggagccagtggcagcccatgggccaaaaatagaagaggaggagcaggagcccgagccacccgagccctttgaatacatcgacgattag

SEQ ID NO: 27873 - DNA, 984 bp, Artificial Sequence
  Description of Artificial Sequence: Synthetic coding sequence
atgtgtagtacttcagggtgcgacttagaggagatacctctggatgacgacgatctaaataccatagaattcaaaattctcgcatactatacgcgacaccatgtctttaagtctacgcccgcattattcagtccaaagctcctaaggacgagatcactaagtcagcgcggactgggtaattgtagcgccaacgagtcttggaccgaggtgtcttggccctgccgcaactcccagagtagcgaaaaagcgatcaatctggggaaaaagaaaagctcttggaaagcttttttcggcgtggtcgaaaaggaagactcccagtccactcctgcgaaagtcagtgcccagggtcagcgcactctagaataccaggacagccatagccagcagtggtcacgatgcctttctaacgtagaacagtgtcttgaacacgaggctgttgacccgaaagtgatcagcatcgctaatagggtcgcagagatagtctacagctggccccctccgcaggctacccaggcgggaggattcaagagcaaagagatctttgtaactgaagggctgtctttccagctgcagggacatgtcccagtggcctcaagtagcaagaaggatgaggaggagcagatcctcgctaagatcgtggaactgctgaagtacagcggagaccagctggaacgaaagctcaaaaaggacaaagcccttatgggacactttcaggatggtctaagttacagcgtcttcaagactataacggaccaagtgctgatgggtgtggatccacgtggggaatctgaggtaaaggctcagggctttaaagctgctctcgtgatcgacgtgaccgccaagcttactgcaatagacaatcatcctatgaatcgggtactgggtttcggaacaaaatacctcaaagagaatttctccccgtggattcagcagcacgggggttgggagaagatactcggcatttcccacgaggaagtggattag

SEQ ID NO: 27874 - DNA, 1086 bp, Artificial Sequence
  Description of Artificial Sequence: Synthetic coding sequence
atggggggtgccgtaagtgcaggcgaagacaacgacgaactgatagacaacctcaaagaggcacaatatattaggaccgaactcgtggagcaggctttccgcgctatagaccgcgctgactactacctagaggagttcaaggaaaacgcatacaaggatctagcttggaagcacgggaacattcatctgtctgctccctgcatctattcggaagtgatggaagccctagaccttcagcctggactgagcttcctgaacttagggtcagggacgggctacttgtcctctatggtggggctgatcctgggtccttttggcgtaaaccacggggtggaactgcattccgatgttatcgagtatgcaaagcagaaattagactttttcatccgcacgtctgatagctttgacaaatttgatttctgtgaacctagctttgtcaccggcaattgcctggagatttcccccgactgctcccaatacgaccgcgtgtactgcggggctggcgtgcaaaaagaacacgaggaatatatgaagaatctgctcaaggtgggaggcatcctggtgatgccgctggaagagaagcttaccaagataacaaggacgggaccatccgcctgggagacgaaaaagattctggccgttagcttcgcccctctcatccaaccttgccattccgagagcggaaagtctaggcttgtgcagcttcccccagtggccgtccgatctttacaagatctggccagaattgccatccgcggaactatcaaaaagatcatacaccaggagactgtatccaagaatggtaacggactgaaaaacacaccacggttcaaaaggagacgggtaaggcggcgtagaatggagacaattgtgttcttggataaggaagtctttgcttcccgaatctctaacccatcagacgacaattcgtgcgaggatttagaagaggagcggagagaagaggaagaaaagactccacccgaaactaaacccgatccaccggtgaacttcctgagacagaaagtccttagcctgcccctgccagaccctctgaagtactatctcctctattatcgggagaaatag

SEQ ID NO: 27875 - DNA, 780 bp, Artificial Sequence
  Description of Artificial Sequence: Synthetic coding sequence
atgaaagacgtggataatctgaagtctattaaagaggaatgggtgtgtgagactggaagcgacaaccagcctctgggaaataaccagcagtcaaattgcgagtatttcgtggatagcctgttcgaggaggcgcagaaagtgagcagcaagtgtgttagtcccgcagagcagaaaaagcaagtggacgtgaacataaagttatggaagaatggctttacagtgaatgacgactttaggagctacagcgacggagctagtcagcagttcctgaacagtatcaaaaagggggagcttcccagtgaactgcaaggcatcttcgacaaagaggaggtagacgtcaaggttgaagacaagaaaaatgaaatctgtctgagtaccaaacccgtgtttcaacctttcagcgggcagggccacagactcggttcggctacccccaaaattgtatcaaaggcaaagaacatagaagtcgagaacaagaacaacttgtctgccgtgcctcttaataatctcgaacccataactaacatccagatctggttagccaacgggaagcggattgtccaaaagtttaacattactcatcgggtgtctcatataaaagatttcatcgagaaataccaaggctctcagcgcagcccaccgttctcactcgcgaccgcattaccagtgctccggctactcgacgagacgcttacattggaggaggccgatctgcagaatgctgttataatacagcgcctccagaagaccgcctcctttcgtgagttatccgaacactag

SEQ ID NO: 27876 - DNA, 990 bp, Artificial Sequence
  Description of Artificial Sequence: Synthetic coding sequence
atggtccgcacaaaaacctggacccttaagaaacactttgttggctatcctaccaatagcgattttgaactgaagaccgcggaactaccccctttgaagaacggagaggtgttactggaagcactcttcctgactgtggacccttacatgagagtcgctgctaaacgtctgaaggagggagataccatgatgggccagcaggtggccaaggtggtcgaaagcaagaacgtggcccttccgaagggaactatcgtcctggcttcccccggatggacaacccacagcatctccgatggcaaggacttggaaaagctcctcactgagtggcctgacaccattccgctctctttggcgctgggcacagtgggtatgcctggcttaaccgcatacttcggattgctggaaatatgcggggtgaagggcggtgagacagtgatggtgaatgcggcagccggagctgtcggcagcgtcgtgggccagattgcaaagttgaagggatgtaaagttgtcggagccgtcggtagcgacgagaaggtcgcatatttgcagaagctaggctttgacgtggttttcaactacaagaccgtggaatctctggaggaaaccctgaagaaagctagcccagacggatatgactgctacttcgacaacgtgggtggggagtttagtaacaccgtaattgggcagatgaagaagtttggccgtatcgccatctgtggagcgatttcgacgtataatcgcacagggccactcccccctggccctccccctgagattgttatataccaggagctaaggatggaggcgttcgtcgtttaccgctggcagggtgatgctcgccaaaaggccctcaaggatttgctaaagtgggtcctcgaaggaaagatccagtataaagagtatatcattgaaggatttgagaatatgcctgccgctttcatgggaatgctgaagggcgacaacctcggtaaaacaattgtgaaggcttag

SEQ ID NO: 27877 - DNA, 3006 bp, Artificial Sequence
  Description of Artificial Sequence: Synthetic coding sequence
atgcagtccacagatctaggtaataaggaatcaggtaaaatctggcaccgaaaaccgtctccggcaactagagatggcatcatagtgaacatcatccataacacgtcagattatcacccaaaggtcctgcggttcctaaacgtcgcgtttgacggaaccggggattgcctgatagccggagatcaccagggcaatatttatgtcttcgatctacacggcaaccgattcaatcttgtccaacgaacagctcaagcctgtactgcgctggcattcaaccttcggcgtaaatcggaattcttggtggcgctggccgactattccattaagtgttttgacactgtgacaaaggaactggtaagctggatgcggggacacgagtcgtccgtattctcaatttccgtgcacgcttccggcaagtacgccatcactacttcgagtgacaccgctcagctctgggacctggatacttttcaacggaagcggaagctgaacattcgccaatctgtcggcatccagaaggtgttttttctgcccctttccaacaccatcctctcgtgctttaaggataactccatcttcgcctgggagtgcgatacgcttttctgtaagtatcaactcccagcccctccagagagcagcagcatcctgtataaggtgtttgctgtgacgagggacggaagaattctagccgcaggaggtaagagtaaccatttgcacttgtggtgcttggaagctagacagctgttccggataatacagatgcctaccaaagtgagagctatcaggcatctggagttcctacctgactctttcgatgctggctctaaccaggtgctgggtgtcctgagtcaggacggcatcatgcgatttatcaatatgcaaacttgtaaactgctgtttgagatcggctctctcgacgaaggcataagcagcagcgctattagcccccacggccgttatatcgcttccatcatggagaatgggagcctcaatatttatagcgtgcaggctctaacacaggagatcaataaaccacccccaccactggttaaagtgatcgaggacttgccaaagaacaagctgtcctcctctgatctgaagatgaaggttacaagtggaagagtccagcagcccgcaaagtctcgcgagtccaaaatgcagacccgtatcctcaagcaggatctcactggggacttcgaatcgaagaaaaatgaattacccgacggactaaacaagaaaagactacagattctgctgaaaggatatggcgaatatccaactaagtaccgcatgttcatctggcgatccctcttgcagctgcccgaaaatcacacagctttttcaactctgatcgacaagggaacccatgtggcgtttttgaacctgcaaaagaagtaccctatcaagtcaagaaagcttcttagggtgctgcagcgcactctgtccgccctcgcccactggtcagtcattttcagtgacacaccctacttgccattactggcatttccctttgtgaaactgttccaaaacaaccagctcatctgtttcgaggtaattgccactctgatcatcaactggtgtcagcactggtttgaatactttccaaatcctcccataaatatcctgtccatgatcgaaaacgtgctggcatttcacgataaagagctgctgcagcatttcatcgaccatgacattacttcacagctgtacgcatggccccttttagagaccgtcttctcagaagtgctgactagagaagagtggctgaagctttttgacaatatttttagcaaccatcccagcttcctcctgatgaccgttgtggcgtacaatatctgcagtaggacccctctgctctcctgcaatctcaaggatgacttcgagttcttcttccatcacaggaataacctggatattaacgtcgtcatccgacaggtctatcatctcatggaaaccacgcctacggatatacacccagacagtatgctgaacgtgtttgtggctctgactaaaggccaatatccagtgtttaaccagtaccctaaatttattgtagattaccagacacaggaaagggaacgcattcggaatgatgaactggattatttaagagagaggcagaccgtggaagatatgcaggccaaggtggatcagcagcgggtggaagatgaagcctggtatcaaaagcaggagttgttgcgcaaagcagaggagactagaagggagatgcttctgcaggaggaagagaagatgattcagcagcgccagcggttagccgctgtgaagagagagctgaaagtaaaggaaatgcacctgcaagacgcggctagacggaggttcctaaaattgcagcaggatcaacaggagatggagctccgacgcctagacgacgagataggaagaaaggtttatatgcgtgatcgcgagattgccgctacagctagggatctggaaatgaggcagctggagctggagtctcagaaaaggctctacgagaaaaaccttaccgaaaatcaggaagcgcttgccaaggagatgcgagcggatgcagacgcatatcggaggaaagtggacctcgaggaacatatgttccacaaactgatagaagcaggcgaaactcagtcccagaagacacagaagtggaaagaggctgaagggaaggaattcagacttagatcagctaaaaaggcttctgctctgtccgatgcaagtagaaagtggttcctgaagcaagagatcaacgctgccgtggaacacgcagaaaatccctgccacaaggaggagcctcggttccagaacgagcaggattctagttgtctgccccgaacttcccagctgaacgactcaagcgaaatggatccctctacccagattagcctgaaccggagagcggtcgaatgggacaccacagggcaaaatttaatcaaaaaagtccggaacctgcggcagaggctgacagcccgagctcggcatcgctgccagacaccacatttgctcgccgcttag

SEQ ID NO: 27878 - DNA, 651 bp, Artificial Sequence
  Description of Artificial Sequence: Synthetic coding sequence
atgagcttcttattcgggagccgttcgagcaaaacttttaaacccaagaaaaacatacctgaggggagtcatcagtacgaactgctcaaacacgcagaggctacacttggcagcggaaatcttagaatggcggtgatgctcccggaaggcgaggatctgaacgagtgggtggctgttaatactgtggacttttttaatcaaatcaacatgctctacggtaccatcacagatttttgtacagaggaatcctgtcctgtgatgtccgctgggccaaagtacgaataccattgggctgatgggacaaatattaagaagccaattaagtgcagtgctccgaagtacatcgactatctgatgacatgggtgcaggaccagctggacgacgaaacactttttcccagcaagatcggggtcccctttcccaaaaactttatgtccgtcgctaagaccatacttaagcggctgttccgtgtatatgcgcatatttaccatcagcatttcgatcctgtgatccagttacaggaagaagcacatctcaatacttcgttcaaacactttattttttttgtgcaggagtttaacctgatagacagacgggagctggccccactgcaggaactcatagagaagctcacgtctaaagatcgatag

SEQ ID NO: 27879 - DNA, 477 bp, Artificial Sequence
  Description of Artificial Sequence: Synthetic coding sequence
atggcagcccagggcgttggacctggtccaggaagtgcagcgccacctggcttggaggctgcccgtcagaaactagcattgcgcaggaagaaagtgttgtccaccgaagagatggaactttacgagctggcccaagccgctgggggaggaattgacccggatgtgttcaaaatactggtagacctattaaagcttaatgtggcccctcttgccgtgtttcagatgctcaagagcatgtgcgccggacagcggttagccagcgagccacaagacccggcagccgtttcgctgcccacgtccagcgtcccagaaactcgaggtagagataaaggtagtgccgctctgggcggtgtattagcactggcggaaagaagcaaccatgaggggagttcccaaagaatgccaaggcagccttccgccacaagactgccaaaaggagggggtcctggcaaaagcccgacccagggatcaacgtag

SEQ ID NO: 27880 - DNA, 1425 bp, Artificial Sequence
  Description of Artificial Sequence: Synthetic coding sequence
atgaattcggtgtcgccagccgctgcacagtacaggtccagtagtccagaggatgccaggcgaagacccgaagcacggagacctagaggcccaaggggccctgatcccaatggcctgggtccctctggcgctagcggccctgctctcggctccccaggagcagggccatccgagccagacgaagttgataaattcaaagcgaaattcctgaccgcctggaacaatgtcaaatatgggtgggtggtcaaaagccgaacatcgttttctaagatctcttctatacatctctgcggacggaggtataggttcgaaggtgagggagacattcagcggtttcagagagactttgtgtctcgcctgtggctcacttacaggagagactttcctcccctgcccggtgggtgcctgaccagtgactgcggctggggatgtatgctgcggagcgggcagatgatgctcgctcagggcttgttgctgcacttcctgcctcgagactggacatgggctgaaggcatgggattgggacctccggaattgtctggttccgcaagcccatcccggtatcacggtcccgcacgatggatgccccctcgctgggcacagggagctcccgaactagagcaagagagaaggcataggcagattgtgagctggttcgcagatcatcccagggccccatttggtctgcatagactggtggagttaggacagtcgtcaggtaagaaggcaggagattggtacggaccctcactcgtggcgcacattcttcggaaagctgttgaatcctgttcagacgtaacgaggctggtagtctacgtgtcccaggactgtaccgtctacaaggctgacgtagcccgtctggtcgctagaccggatccaaccgccgagtggaagtctgtggtcatcctggtccccgtgagactcggtggggaaaccctgaatccagtgtacgttccctgtgtgaaggagttgctcagatgtgagctgtgtctgggcattatgggtggcaaaccacggcactctctctactttatcggttatcaggatgactttcttctctacctggatcctcactactgtcagcccaccgttgacgtatcccaggccgactttcccctagagtcgttccattgtaccagcccacggaaaatggcttttgctaaaatggacccatcctgcacagtaggtttctatgccggtgatagaaaagaatttgagaccctgtgttctgagcttacaagggtcttatccagtagtagcgccaccgaacggtaccccatgtttacattggccgagggacacgcacaggaccattcactggatgacttgtgttctcagcttgcccagcctaccttacgcctcccaaggacaggcaggttgttaagggccaagcgccctagttccgaggactttgtgtttctgtag

SEQ ID NO: 27881 - DNA, 945 bp, Artificial Sequence
  Description of Artificial Sequence: Synthetic coding sequence
atggcctttgtgacgcggcagtttatgcgatctgtatcatcttcttcaaccgctagcgctagtgcgaagaaaatcattgtgaagcatgtgaccgtcattggcggaggtttgatgggtgcagggatagctcaggtcgcagccgcaacaggtcacacagtggtattggtcgaccagaccgaggatattcttgctaagagtaaaaagggtatcgaggagagcttgcggaaagtggccaaaaagaagttcgcagagaacctaaaggccggtgatgaatttgtagaaaaaacactgtccacgatcgcaactagtaccgacgctgccagtgttgttcattctactgacctcgtcgtggaagcaatcgtggagaacttgaaagtgaaaaacgagctgttcaagcggcttgacaagttcgccgctgagcatactatctttgctagcaatacaagttcgttacagattacatcaattgctaatgccaccacgaggcaggaccgattcgctgggcttcactttttcaaccccgtccctgtcatgaaactcgtcgaggttatcaaaacgccaatgacgtcacagaaaacatttgagagcctggtggacttttcaaaggcgctcggcaagcacccagtaagttgtaaggatactccaggatttatcgtcaatcgccttttagtgccataccttatggaggctatccgcctgtacgagagaggagatgcttctaaggaagatattgacacggctatgaagttaggtgctgggtatcccatgggtccattcgagctgctggactacgttggcctcgacacaacgaaatttatagtggacgggtggcacgagatggacgcagaaaatccgctccaccagcctagccctagcctgaacaaactagttgctgagaataagtttggtaaaaaaaccggcgaaggcttttacaagtataagtag

SEQ ID NO: 27882 - DNA, 810 bp, Artificial Sequence
  Description of Artificial Sequence: Synthetic coding sequence
atggggaactgttgttggacccagtgcttcggcttgcttaggaaggaagcaggtagactgcagcgcgtgggtggcggaggaggaagtaaatatttccgaacgtgtagccggggagagcatttaacaattgagttcgagaatctcgtagaatcagacgagggtgaaagcccagggtccagccataggccactgaccgaggaggagattgtcgaccttagagagaggcattatgactccattgcggaaaaacaaaaggacctcgataagaagattcagaaagaacaggagagacaacggatagtgcagcagtatcacccctctaacaacggtgaatatcagagtagtggtccagaggacgacttcgagagctgtctacggaatatgaaatcccagtatgaagtctttagatcttctcgtctatcaagcgacgccactgtgcttacccccaacacagagtcttcttgtgacctgatgactaagacgaagtcgacttctggcaacgatgacagtacatctctcgatcttgagtgggaggatgaggagggtatgaacaggatgctgcctatgcgcgagcgctccaagaccgaggaggacatcctgagggcagcactgaaatattcaaataagaaaaccggaagcaatccaacgtcagcctcagacgactccaacggcctcgaatgggaaaatgatttcgtgtcagcagagatggatgataacggcaactctgaatactctggatttgtgaaccccgtcctggagctctcagatagcggcattaggcacagcgatacagaccaacaaacacggtag

SEQ ID NO: 27883 - DNA, 1371 bp, Artificial Sequence
  Description of Artificial Sequence: Synthetic coding sequence
atgaagtgcgagcattgcaccaggaaggagtgcagtaagaagacgaagaccgatgaccaggaaaacgtgtctgcagacgccccttctccggcacaagaaaacggagaaaagggagaattccataagctggccgacgcgaagatcttcttaagcgactgtctcgcttgtgacagttgcatgacggccgaggagggtgtgcagctctcgcagcagaatgcaaaagacttctttagggttctgaacctgaacaagaaatgcgacacttcaaaacataaggtcctggtggtgagcgtgtgcccacaaagcttaccctacttcgcggctaagttcaatctgtccgtgactgacgcaagtagacggttgtgcggtttcctgaagtctctcggagtccactacgtgttcgatacaacaatagccgctgacttctctattctcgagtctcagaaggagttcgtgcgaagatatcggcaacattcagaagaagagcggacccttcccatgctaactagcgcatgtccgggatgggtccggtacgcagaaagggtgctcggcaggccaataaccgcccatctctgcactgcgaagtctccacaacaggtgatgggttctctggtgaaagactatttcgctaggcaacagaatctgtctcccgaaaaaatcttccacgtaattgtggccccttgctacgacaaaaaattagaagcgctccaggagagcctcccacccgctttgcacgggagcagaggcgctgactgcgtgttgacgtctggtgaaatcgctcagataatggagcagggtgacttgtccgtccgcgacgctgctgttgacaccctttttggggacctgaaagaagacaaggtaacaaggcacgacggggcaagcagcgacgggcaccttgcacacatttttcggcatgcggcaaaagaattgtttaatgaggacgttgaggaggttacctatagagcactccggaataaggacttccaggaggtgacgctcgaaaagaacggcgaagtcgtgctgaggtttgcggctgcttacggctttcggaacatccagaatatgattctgaagctcaaaaaaggcaagttcccttttcatttcgtggaggtgctggcatgtgcgggaggttgcctgaatggcagaggacaggcacagacaccagatggtcacgcagataaggctctcttgcggcagatggaagggatctatgctgatatccccgtacgtagaccggagtccagtgcccatgtgcaggagttgtaccaggagtggctcgaagggatcaactccccaaaagcccgagaggtactccacaccacctatcaatcacaggagagaggcactcactcactcgatatcaaatggtag

SEQ ID NO: 27884 - DNA, 612 bp, Artificial Sequence
  Description of Artificial Sequence: Synthetic coding sequence
atggcacacgtgtccagtgaaacccaggatgtttcacctaaggatgagttaactgcctcggaggccagcacgcgatccccactttgtgaacacaccttccctggggattccgacctgaggtctatgattgaggagcacgcctttcaggtgctgtctcagggttccttgcttgagtccccgtcatacacagtctgcgtcagcgagcccgataaggacgacgactttctgagcttaaacttccccagaaaactttggaaaattgtggagtctgaccagtttaaatccatctcttgggacgaaaatggcacttgtatcgtcattaacgaagagctgtttaaaaaagaaattttagagactaaggccccttaccgcatttttcaaaccgatgcaattaagtcttttgtcaggcaactgaatctctacggtttctccaagatccagcagaattttcagcgttccgcatttctggctacttttctcagtgaggagaaggaatcctccgtgctgtcaaagatacgatttactaagatgaagctgtcaagatcatcgacatatgaaaaccgttacttgtgctgtaatctgcacttgaaagatgaatctaactattcctag

SEQ ID NO: 27885 - DNA, 2052 bp, Artificial Sequence
  Description of Artificial Sequence: Synthetic coding sequence
atgaacacctcaatcccctaccagcagaatccatacaatcctagagggagcagcaacgtgattcagtgctaccgctgtggcgacacttgtaagggtgaagttgtgagagttcacaacaatcattttcacattcggtgcttcacatgtcaggtctgcggatgtggtctcgcccagtccggattttttttcaagaaccaggaatatatttgcactcaggattatcaacagctttacggcaccaggtgtgacagctgcagagatttcattacaggcgaagtaatcagcgcgttaggccgaacataccaccctaagtgtttcgtctgcagcttgtgcaggaagcccttccctatcggcgacaaggtcacattttcaggcaaagaatgcgtctgccagacctgtagccagagtatggcaagcagcaagcccatcaagatccggggacccagccactgtgccggttgtaaggaggagattaaacatgggcagtccctactggcactggacaaacagtggcacgtttcctgcttcaagtgtcaaacctgctccgtgatcctgaccggagagtacattagcaaagacggggttccgtattgcgagagcgactaccacgcccaatttggaatcaagtgcgagacttgtgatcggtacatatccggcagggtactggaagccggtggtaagcactaccaccccacatgcgcaagatgtgttagatgtcaccagatgtttaccgagggtgaggaaatgtacctgactggaagtgaagtgtggcacccgatttgcaagcaagctgcaagagccgagaaaaaactgaaacacagacgaacatcagagacatcaatctcaccacctggaagtagtattggctccccgaatcgcgtcatatgcgccaaggttgacaacgaaatattgaactacaaagacctggcggcactccccaaggttaaatctatttacgaagttcaacgacccgaccttattagctacgagccacactcccgttacatgtccgacgagatgctcgaacggtgcggatatggagagtcgctaggtactttgagcccctacagccaggacatctacgaaaacttggacctcagacagagaagagcgtcatctcccggatatatcgattcgcccacctacagccgtcaggggatgtcccctacatttagtcggtcaccccatcactattataggtcaggtccagagtctgggaggtcttctccttaccatagtcaactggacgtgcggtcctccaccccaactagctaccaagcacctaaacattttcatattcctgcaggagattccaacatttatcgtaagccccctatttataaacgccatggcgacctgtccacagccaccaagtccaaaacttctgaggacatcagtcaaacctcaaagtactcccccatctatagtccagacccatactacgcttccgaaagcgaatactggacctatcatggaagccccaaggttcctagggctagacgtttctcaagcggaggtgaggaggatgactttgaccgctccatgcacaagctgcaatccggcatcggaaggctcattctcaaagaggaaatgaaggccagatcaagctcctacgccgacccctggaccccaccccgaagtagtacgtcctcccgagaggcacttcacacggccggatacgagatgagtctgaacggctcacctcgatcccactatcttgcggattctgatcccctcatatctaagtcagctagtttgcctgcttataggcgaaatggattgcatagaacaccttccgctgatctttttcattacgactctatgaacgctgtaaactggggcatgcgtgaatacaagatatacccttatgaactcctgcttgtgactactcggggaagaaacagattgccgaaggacgtcgaccgcactaggcttgaacgccatctcagccaggaagaattctatcaggtatttggcatgaccatttccgagttcgacaggctcgccctatggaaacgaaatgaactcaagaaacaggcgaggctcttttag

SEQ ID NO: 27886 - DNA, 2541 bp, Artificial Sequence
  Description of Artificial Sequence: Synthetic coding sequence
atgctgttcacggttagctgctccaagatgtccagcattgtggaccgcgatgactccagtatatttgatggacttgttgaggaagacgataaggataaggccaagcgtgtgtccaggaacaaatctgaaaaaaagcgcagggaccaattcaacgtactgatcaaagaattaggttccatgttacctggtaacgcaagaaaaatggacaaatcaacggtgctccaaaaaagcatagatttcctgcgcaaacacaaggaaattaccgcccagtccgacgctagcgagatccgccaggactggaagccaacctttttgtcaaacgaagagttcacgcagctgatgctggaggctctggacgggttcttcttggccatcatgaccgacggctctatcatctacgtgtctgagtccgttacttccctgctggagcatctgccaagcgacctggtggatcagtccatctttaattttatcccagaaggcgaacacagcgaggtgtataaaatactgagcacccatctgctggaaagtgactctctgacgccagaataccttaaaagtaagaaccaattagaattttgctgtcatatgctgcgcggaactattgacccaaaggagccatctacttacgagtacgtcaaattcatagggaattttaaatccttaaactctgtttccagctctgcacacaatggcttcgagggcacaatccaaagaactcaccggccttcctatgaggaccgggtctgtttcgtagcgaccgtgcggctggccacaccccagtttatcaaagagatgtgtaccgtggaggaacctaacgaagagtttacctcccggcacagcctcgagtggaagtttctgtttctggaccatcgtgctccacccatcatcggctatcttcctttcgaggtgctggggacctccggctatgactactatcacgttgacgatctcgagaacctggcaaaatgccatgaacatctaatgcaatacgggaaaggaaaatcgtgttattaccgcttcctgacaaaagggcagcaatggatttggctgcaaacacattactatatcacataccatcagtggaatagcagaccagaattcattgtctgcacgcataccgtggtgtcttacgctgaggtgcgagctgaacggcgacgagagctaggcatagaagagtcattgccagaaactgcagcggataagtctcaggactcaggcagcgacaatagaattaatactgtctctctgaaagaggcccttgaacgctttgaccacagccccactccttccgccagctcccggtcgagccgtaagagcagccacacagcggtgtctgatcccagttccacgcccacgaagattccgaccgacactagtacccccccacggcaacatttgccggctcacgagaagatggtgcagcgccgaagcagcttctcatcccagagcataaattcacagtctgtcggcagctcccttacacagccagtgatgtcccaggcgaccaacctgccaatccctcagggcatgagtcagttccagttttcagcccaactgggagcaatgcagcatctgaaggatcagttggagcagagaacacgcatgatcgaggccaatatccaccggcaacaagaggagctgcgtaaaatacaggagcagctccagatggtccacggacagggcctacagatgtttttgcagcagagtaaccccggactgaacttcggatcagttcagttgtccagcggcaatagcagtaatattcagcaattggcaccaattaacatgcagggtcaggttgtgcctactaaccaaatccagagcggcatgaataccggtcatatcggcacaacccagcatatgatacaacaacagacacttcaaagtacaagtactcagagtcagcagaacgttctaagcggccattcccagcaaacgagcctgcccagccaaacccagagcacgttaactgcccctctgtataacaccatggtgatttctcagccggctgcgggaagcatggtccaaatacccagttcgatgccccagaacagtacccagtctgccgctgttaccacgttcactcaagatcgccagatacgtttttcccaggggcaacagctggtgaccaaactggttaccgccccagttgcctgcggcgctgttatggtgcccagcactatgcttatgggccaggtcgtgacagcttatccgacattcgccacccaacagcaacagtcccagacactctcggtcacgcagcagcaacagcaacagtcaagccaggaacagcagctgacttctgtccagcaacctagccaggcgcagctgactcaacctccgcaacagtttctgcagacatctaggctgctgcacggaaatccctctacccagctgatactgagtgctgcatttcctctccagcagtccaccttccctcaatcccatcatcagcaacatcagtcccagcagcagcagcagctcagtcgccaccggaccgactcacttcctgaccctagcaaggttcagcctcagtag

SEQ ID NO: 27887 - DNA, 1656 bp, Artificial Sequence
  Description of Artificial Sequence: Synthetic coding sequence
atggggcgaaaagccattgtcctggctatcgcaaatacttccctcgccttcccgctttgccagcacctggtcaccttttgcttaggggaggacgatggcgtgcatacagtagaggatgcaagccggaagctggccgttatggacagccaggggagagtatgggcacaggagatgcttcttcgcgtctcacctgaccacgtcactttacttgaccctgcctcaaaggaagagttggagtcttatcctctcggcgcaatcgtgcgttgcgatgcggtcatgccacctggcagatctagaagcctcttgcttcttgtttgccaggagcctgagcgcgctcagcccgatgtgcacttctttcagggacttagacttggagccgaactaatacgtgaggatattcagggcgctctacataactatcggtccgggagaggagaacggcgagctgccgctcttcgagccactcaagaggaattacaaagggacaggagtccagctgcggaaaccccaccgctgcagaggcgcccttcagttcgcgcagttatctcgacagtggagcgcggagctgggaggggtagaccccaggccaaaccaattccagaggctgaggaagctcagcggccagagcctgtggggacttcctctaatgcagactccgcctctcctgatctaggtcctcgtggaccggacctcgccgtgctccaagctgagagggaagtggacatcctgaatcatgtttttgacgacgtagagtcttttgtttcgaggttgcagaagagcgccgaggcagccagggtgctggagcaccgtgagcgcggaaggcgctcgaggaggcgagcagctggcgaaggtttactcaccctgcgcgcaaaaccaccatccgaagctgaatatacagatgtgctgcagaagataaagtatgcttttagtctactggcacggctccgagggaatatagcagacccatcctcacctgagctcctgcattttctgttcgggccactgcagatgatcgtgaatacctccggcggaccagaattcgcctcctctgtgcgccgtccccatctcaccagcgacgctgtggcgcttctgcgggacaatgtgactcccagggagaatgagttgtggacgagcctgggggattcttggacccgtcccggtcttgagttgtcccctgaggagggacctccctacagacccgaattcttctctggatgggagccccctgtcacagatcctcagtcacgcgcatgggaagacccagtggaaaagcagctccaacatgagcgacgcaggagacaggttacccaggcaacacaacaggggagggggtgggaagtgagaggacgtgggcgtagcgcttggccgagactgaccagactgagctacttccttcaacagagcgcacctcaagtcgccgtaaatggccaccgcgacctggagcccgaaagtgagcctcagttagagagcgaaacagccggaaaatgggtgctgtgtaactatgattttcaggccaggaactcgagcgagcttagcgttaagcagagggacgtcctcgaggcgctgcaagacaaggaaaaagtttccgagctagaagccgtgatggaaaaacagaagaaaaaggtggagggagaggtggagatggaggtcatttag

SEQ ID NO: 27888 - DNA, 1689 bp, Artificial Sequence
  Description of Artificial Sequence: Synthetic coding sequence
atggccgctagcgccaagagaaagcaggaagaaaagcatttaaagatgttacgcgacatgaccggtctcccacacaatcgcaaatgcttcgattgcgaccagagaggcccaacatatgtgaacatgacagtcggttcttttgtgtgcacaagctgttctggtagtttgagaggactgaaccctccccatagggtgaaatccatctccatgactacatttacacagcaggaaatagaattcctgcagaagcatggtaacgaggtgtgtaagcaaatatggctgggactgttcgacgaccggtcctcggccatccctgacttcagggatcctcaaaaagtgaaagaattcttgcaggagaagtatgaaaaaaaacgctggtatgtgcctccagagcaagccaaggtggtcgcctctgtacatgcgtcaatttctggtagttctgcctcctccacaagctccacccccgaggttaaacccctaaaaagtttattgggagattcggcaccgacattgcatctgaacaagggtactccttctcagagcccggtagtggggaggtcccaggggcagcagcaggaaaagaagcagtttgacctcttatcagacctggggtccgacatcttcgcggcacccgcaccacaatccactgcgacagctaactttgcaaacttcgcacacttcaattcccacgcagcccagaattctgcaaacgcagacttcgctaatttcgatgcctttggtcagagctctgggagtagtaacttcggaggctttcctactgcatcacactccccgttccagccccaaactacaggaggcagcgctgcttcagtgaatgcaaacttcgctcatttcgataattttcctaaaagttcatccgcagatttcgggacgtttaatacctcccagtcccaccagacggcctccgccgtgagcaaggtgagcacaaacaaagcagggctgcagaccgccgacaaatatgccgctttggccaacctggacaatattttctcagctggacaagggggtgaccaggggagcgggttcggtacaacaggcaaggcgcctgtgggctctgtcgtatctgttccctcacagtcaagcgcctcttccgataagtatgcggctcttgccgagctcgattctgtgttctcaagtgctgcgacatctagcaatgcatacacgtctacatccaacgccagctctaatgtgttcggcacggtgccagtggttgcttcagcacagacacagcccgcttcctcttcagttccggctccttttggagctacaccttccacgaatcccttcgtggccgctgccggtccgagtgtagcatctagtacaaacccgttccaaactaacgcgaggggggctaccgcagctacttttggtactgcttccatgagcatgcctacaggcttcgggacccccgcaccctacagtctgcctacatccttcagtggctcgtttcagcaacccgctttcccagcccaagctgcctttccccagcagacagcatttagtcagcaaccgaatggggcaggatttgcagcgttcggccagactaagcctgtcgtcactccattcgggcaggtggctgcggcaggagtgagcagtaatccctttatgacgggcgctcctacaggccagttccccaccggctcaagctctacaaatcctttcctctag

SEQ ID NO: 27889 - DNA, 2052 bp, Artificial Sequence
  Description of Artificial Sequence: Synthetic coding sequence
atggctgcagctgtggcagcgcctctcgcagcagggggtgaagaggcagccgcaaccacctcagttcccggtagccccggtttacctggtaggcggagtgctgagagagctctggaggaagccgtcgctaccggcacattgaacctctctaatcgcagactgaaacacttccctcgtggcgctgctcggtcctatgatttgtcagatatcacgcaagccgatttatcacgtaatagattcccagaagtacccgaggccgcatgccaactggttagcctggagggcctgtcactctaccataactgcctaagatgtctcaaccctgcacttggaaatctgactgccttgacttacttgaacctgtctcgcaaccagctgagtctactgcccccatacatctgccaactgcccctgcgggtactgatcgtgtcaaataataagcttggcgctctcccacccgatataggtactcttgggtccctgagacagctagatgtgtctagcaatgagctgcagagtttgccaagtgagctgtgcggcctcagctcgttacgagacctaaacgtccgcagaaatcaattgagcaccctccctgaagagctgggggatcttcctcttgtccgtctggatttcagttgtaatcgagtgtcccgtatccccgtcagtttttgccgcctcagacacttgcaggttattcttctcgactcaaaccctcttcagagccctcctgctcaggtatgtttgaagggtaaactccacattttcaagtatctttcaacagaagcgggacagagaggttctgccctgggggatctcgctccttccagacccccatcattttcaccatgccctgctgaagatctgtttccgggtcaccggtacgacggtgggctggactctggattccactcagttgacagcggcagcaagcgctggagtggcaacgagtccaccgatgaatttagtgagctcagtttccgcatcagcgaactagccagggagccccgaggtccaagagagcggaaggaggatggatcagcggacggggaccccgtgcagatcgactttattgacagtcatgtcccgggagaggatgaggaacggggtacagttgaggagcagagaccacctgagctgtctcctggggcaggtgaccgcgaacgggctcctagttctcgacgggaggagcctgctggcgaagagcgaagaaggcccgacacgttgcagctgtggcaggagcgtgaacggagacaacagcagcagagcggcgcatggggagctcccagaaaagattctctgctcaaaccagggctcagagccgttgtgggaggggcagctgccgtcagcacccaggctatgcataatggcagtcccaagtcctcagcctcacaggccggtgctgctgccggacagggcgctccagcccctgcccctgcctcacaggagccactccctatagctggtccagcaaccgctcccgctccaaggcctctcggaagtattcagcgcccaaactccttcctctttaggtctagctcccaaagtgggagtggaccctcttcccccgatagtgttttgcggccaaggagatacccacaagtgcccgatgagaaggatctcatgacgcagttgagacaggttctcgaaagcaggcttcaacgccctctgccggaagatctggcagaggccttagcatcaggagtgattctgtgtcagctggccaatcaactgaggccgaggtctgtcccattcatacatgtgccaagccctgccgttcccaagttgtcggctctgaaagccaggaagaacgtggagtcttttctggaagcatgcaggaagatgggcgtgccagaggctgatctgtgttctccgtccgatctcctccagggcacagccagaggattaagaaccgcactcgaggctgtgaaaagggtaggcggaaaagccctgccacctttatggccccctagcgggctgggaggtttcgtggtgttttacgtcgtacttatgctcctgctgtacgttacttacacacgactgctgggctcatag

SEQ ID NO: 27890 - DNA, 303 bp, Artificial Sequence
  Description of Artificial Sequence: Synthetic coding sequence
atgtctacctccacttcctgtcccattcctggcggtcgcgaccaacttcctgactgttattcaactaccccagggggtacactctatgctactacacccggaggcacacggataatttacgatcgaaaattcctgctggaatgcaaaaactcccctatcgcgaggaccccaccttgctgtctcccacagataccaggggtaacaactcccccaaccgctccactgagtaaactggaggaactcaaggaacaggagaccgaagaggagattccagatgatgcgcaatttgagatggacatttag

SEQ ID NO: 27891 - DNA, 2382 bp, Artificial Sequence
  Description of Artificial Sequence: Synthetic coding sequence
atgccaatggagagtgcctctagtgataacaaaaagcagatacccaacgaggccagtgcaaggagtgagagagacacttccgatctagagcaaaattggtcactccaggaccactaccggatgtattcaccaatcatctatcaagcactgtgtgagcacgttcagacgcagatgtctctgatgaacgacctgacatcaaaaaatatccccaacggcatcccagccgtgccttgtcatgctcccagtcacagcgagagccaagccacaccacactcaagctacgggctctgtacctcgactcccgtatggtccctgcagcggccaccatgtccacccaaagttcattcagaagtccaaaccgacgggaatagccagttcgcttcacaaggtaagactgtgtctgctacctgtaccgacgttctccggaacagctttaatacatcgccaggtgtcccctgtagcttacctaaaaccgatatctccgccatccccaccttgcagcagttaggtctggtgaatggcatattgccacagcaggggatccacaaggaaacagatctacttaagtgcatccagacttacttgtccctttttcgctctcacggtaaggaaactcaccttgattctcagacacatagaagtccaacacagtcacagccggcatttctcgcaacaaacgaagaaaagtgtgctcgggagcaaattagggaagcaacctctgaaaggaaggacctcaatatccacgtgcgagataccaagaccgtgaaagatgtgcagaaggccaagaatgtgaataagacagcagaaaaggtgcgtatcattaaatatcttctgggtgagctgaaagctttagtggctgagcaggaggacagcgaaatccagcggctgattaccgaaatggaggcctgtatcagtgttctgccaacagtgagcggaaatactgacatccaagtcgagattgctttggctatgcagccattgaggtcggagaacgcacagttgcgtaggcagctgcggatactgaaccagcaactcagggagcagcagaagacacagaaaccttcaggcgctgttgactgtaatcttgagctcttttctttgcaatcactcaacatgtccctgcagaatcagctggaagagtctctgaaatcacaggagctattgcagagtaaaaatgaagaactgctcaaggttatcgagaatcagaaagacgagaacaagaagttcagttcaatttttaaggataaggaccagacaatcctcgagaataaacagcagtacgatattgagatcaccaggattaagatcgagctggaggaggctctggtcaacgtcaagtctagccaatttaaactagagactgcagagaaggaaaatcaaattctcggtatcacactgaggcagcgagacgccgaggttactaggctgagagagctgacacgcacactgcagacctctatggcaaagctcctgagcgacctgtccgtggatagcgctcgttgcaaacctggcaataacctgaccaaaagtctcttgaacatacacgacaaacagctccaacatgatcccgctcccgctcatacaagcataatgtcctatctcaacaagctcgagacgaattatagtttcacacacagtgagcctttatctaccatcaagaatgaggagacaattgaacctgacaagacctacgagaacgtgctgtcctctcggggacctcagaacagcaacacccgaggcatggaggaggctagcgccccaggcatcatttctgccctatccaaacaagattctgacgagggatctgaaacaatggcccttatagaagacgaacacaaccttgacaacactatttatattccttttgcaaggtccacgcccgagaagaaatctcctctctccaagaggctctctccacaaccacaaatacgggctgcgaccacccagctggttagcaattcagggttagccgttagcggaaaggagaataaattatgtacacccgtgatttgctctagcagcaccaaagaggcagaggacgcgccagaaaagctgtctcgcgcttcagatatgaaggacacacagctattaaaaaagataaaggaggcaatcggcaagattcctgcagccacaaaggaaccggaggagcaaaccgcttgccacggtccttccgggtgcctctccaattcactccaagtgaaaggcaataccgtatgcgatggttccgttttcacttcggatttgatgtctgactggtcaatttcaagtttctcaacctttacgtcccgggacgaacaggactttaggaacggcctggccgctctggacgcaaacatagcacggctacagaagtccctccgtactggcctgttggagaaatag

SEQ ID NO: 27892 - DNA, 1119 bp, Artificial Sequence
  Description of Artificial Sequence: Synthetic coding sequence
atgaccttccagtttaacttcactatagaggatcatctcgagaacgaacttactcctatacgagacggggctctgactctagactcctccaaggaactctctgttagcgaatcacagaagggagaggagcgcgataggaagtgcagcgccgaacagtttgacctcccccaagaccacttatgggagcacaagtcaatggagaatgccgctccaagccaagataccgacagtcctctctcagcagctagcagttcgcgaaatctcgagcctcacgggaagcagccctctctacgcgctgcaaaagagcacgcgatgcccaaagatctgaagaaaatgctcgagaacaaggttatagagaccctgcccggattccagcatgtgaaactgtccgttgtgaaaactatcctgcttaaggaaaatttcccgggagagaacatcgtgagcaagtctttttcatctcattccgatctcattaccggggtatacgaaggcggtctgaaaatttgggagtgtacattcgaccttttggcctactttacaaaagcaaaagtgaagttcgccggtaagaaagtcctcgatctgggctgcggctccggactgcttgggattaccgcttttaagggaggcagcaaggagatacacttccaggattacaactcgatggtcattgacgaagtcacactccccaatgtagtggccaattccactctggaggacgaggaaaacgatgtgaatgaacctgatgtcaaacgctgtagaaagcccaaagttacccaattgtataagtgtagatttttttctggcgagtggtcagagttttgtaagctggtgttgtctagcgagaagctgttcgtgaaatacgatctcatcctgacctccgaaactatctataacccagactattactccaacctgcaccagacatttctccgccttctgtccaagaatggacgcgtgctgttggcaagtaaggctcactactttggtgtgggcggtggtgtacacttattccagaagttcgtggaggaaagggacgtcttcaagaccagaatcctgaagattatcgacgagggactgaagagatttatcatcgagattaccttcaagtttcccggatag

SEQ ID NO: 27893 - DNA, 336 bp, Artificial Sequence
  Description of Artificial Sequence: Synthetic coding sequence
atgactacactgcgggcattcacctgtgacgatctctttagatttaacaacattaatctggatccactgacggagacttacgggatccctttctatctgcagtacctcgcccattggcctgaatatttcattgtagctgaagccccagggggagagctgatgggctatattatgggaaaagcagagggtagcgttgccagagaagaatggcacggccatgtcaccgctctgtcagtggctcccgaattccgcagactgggcctcgccgctaagctgatggaactgctggaagagatcagcgaaaggtatgaggagtctactttccagggctattag

SEQ ID NO: 27894 - DNA, 1449 bp, Artificial Sequence
  Description of Artificial Sequence: Synthetic coding sequence
atgaatggcacattggatcacccagaccaacctgatctggatgctatcaagatgtttgtgggacaagtccccaggacttggtccgagaaagatctgagggagctctttgagcagtacggggcagtatacgagatcaatgtgctgcgagacagaagccagaatccccctcagtcaaaaggttgctgcttcgtaacattctacacgcgaaaagcggctctagaggcccagaacgcacttcataacatgaaagtgctaccgggtatgcatcaccccattcagatgaaaccagctgactccgagaaaaacaacgccgtggaggacaggaagctgttcataggcatgatatcaaaaaagtgtaccgagaacgacatccgtgtgatgttcagcagtttcggtcagattgaagagtgtaggattctccgtggccctgatgggttgtctcgcggatgtgccttcgtgacctttaccactcgggctatggctcagaccgcaataaaggccatgcatcaggcccagactatggagggttgttccagtcctatggtggtgaaattcgctgacacacaaaaggataaggagcagaaaagaatggctcagcagctgcagcagcagatgcagcagatttctgccgctagcgtctggggtaatctggccggactcaataccctaggacctcagtacctggcgctcctgcaacagacagctagttccggcaacctgaatacattatcgtccctgcaccccatgggcggtcttaatgccatgcagctgcagaacctggctgcattggctgcagcagcctctgcggcacaaaacaccccttcagggacgaacgctcttacaacctctagtagtccactgagtgtgctaacatcctcagggagtagcccgagctcaagctcgagcaactccgtgaaccctatagcctctctgggggctctccaaaccctcgcaggagctacagccggtttaaacgtgggttccctggctggtatggcagctttgaatgggggactggggtcaagtggcctgtccaacgggaccggatcaaccatggaggccttgacccaagcttattccggaatacagcagtatgctgcagccgctctcccgacactatacaaccaaaatctgctaactcagcaatctattggtgcagccggatcacagaaagagggacctgagggtgcaaacttgtttatttatcatttgccacaggagttcggagatcaagacctcttacaaatgtttatgccgttcggtaatgtagtgtctgccaaggtgttcatcgacaagcagacgaatctaagtaaatgctttggtttcgtgagctatgataaccccgtgtcagctcaggcagcaatacagtcaatgaacggttttcaaatcgggatgaagagactgaaggtccagctgaaaaggtctaagaacgactctaagccgtactag

SEQ ID NO: 27895 - DNA, 1347 bp, Artificial Sequence
  Description of Artificial Sequence: Synthetic coding sequence
atgtctcccctggagtgcagcgaatgctttggagatcagctgcttcaccgcacttatacttggcagcttactctgcactctcgaccgaactacacccggaagagagatacccgctctgagagcctggaaataccgatctcagtggtgctgccgcagcgaggtactgccgagccatttccccgactgcacaacctatactcgacaccgcgatgtgcacagcaggctgccctgcccagactttctcgaaggatggcctcccagcattcttatcctctgaacaggttttcttctgtacccctggatcctatggaaagacccatgagccaggcagacctcgaactcgactacaacccaccgcgtgtccaactgtcagacgaaatgttcgttttccaagatggcagatgggtcaatgaaaactgccgcctacagtctccgtatttttcgccctcagcatcatttcatcacaagctgcaccacaagcgcctggctaaggagtgtatgctccaggaagaaaataagtccctccgggaagaaaacaaagcgcttagagaagagaacagaatgctttccaaggaaaataaaattctgcaagtgttctgggaggagcataaggctagcctcggccgtgaagaaagccgcgctcccagtcctctgctccataaagattctgccagtctggaggtcgtaaagaaagaccacgttgcattgcaggtaccgcgtggaaaagaagatagcacgctacagttactgcgagaagaaaatagagccctgcaacagctcctcgagcagaagcaagcttactgggctcaggcggaagacactgctgcacccgctgaggaaagcaagccagctcccagtccccatgaagaaccttgctcccccggactcctgcaggaccagggatccggcctgagctccaggtttgaggagcctaagggcccaccagccaggcaggaggacagtaaggaacttcgggctcttcgaaagatggttagtaacatgtctggaccttctggagaggaggaggcgaaggtagggccagggctgccagatggctgtcaacctctgcagctcctgagggagatgcgacaagcgctgcaggccttgcttaaggaaaatagacttttacaggaagagaacaggactctgcaggtccttagggcggaacacagaggttttcaggaggaaaacaaggccctgtgggagaataataaactgaagttgcagcagaaactcgtgatcgacacagttactgaggtaactgcgcgaatggaaatgttgatcgaggagctctacgcattcatgcctgcccgatctcaggatccgaaaaaacctagccgagtctag

SEQ ID NO: 27896 - DNA, 1002 bp, Artificial Sequence
  Description of Artificial Sequence: Synthetic coding sequence
atggcagcagcagcagccggtaccgcaaccagccagaggttttttcaaagcttcagtgatgccctgattgatgaggatccacaggcagccctggaggagctgactaaggctctggagcagaaaccggatgacgcacagtattactgtcagagagcctattgccatatcctgctgggaaactactgcgtggcagtagcagacgcaaagaaatcactggagctgaaccctaataacagcacagcaatgctgaggaaagggatctgcgaataccacgagaagaactacgcagcagctctggagacctttaccgagggccaaaagttggacagcgccgatgccaacttcagcgtgtggatcaagcgctgccaagaagctcagaacggtagcgaatcagaagtctggacccaccaaagcaagatcaagtacgattggtatcaaactgaaagtcaggtcgtcattacgctgatgataaaaaatgtccaaaaaaacgacgtaaatgtagagttcagcgagaaggaactttcggccctggttaagctgccgagcggcgaggactataatttgaaactggagcttctgcaccccattatacccgaacaaagcacctttaaagtcttgagcactaagatagagataaagctgaaaaaaccagaagctgttcgctgggagaagctcgagggtcagggggacgtgcccaccccaaaacagtttgtggctgatgtgaaaaatctgtatcctagttcaagcccttatacgcgcaattgggacaaattggtaggagagatcaaggaagaggaaaagaacgaaaaactcgagggagatgctgctttaaacagactttttcaacagatctactccgatggcagtgacgaagttaaaagagctatgaacaagtcttttatggagagcggagggactgtgctgagtacgaactggtcggatgtgggcaagcggaaagttgaaatcaatcctcctgatgacatggaatggaagaaatactag

SEQ ID NO: 27897 - DNA, 1029 bp, Artificial Sequence
  Description of Artificial Sequence: Synthetic coding sequence
atgtctctacacggaaagcgaaaggaaatttataaatatgaggccccatggacagtctacgctatgaactggagcgttcgccctgacaagaggtttcggctcgcccttgggagcttcgtggaggaatataataacaaagtccaactggtgggtctggatgaggagtctagtgagttcatttgcaggaataccttcgatcacccctaccctacaaccaagctgatgtggatccctgatacaaagggtgtctacccagaccttctggccacctctggcgactatctgcgggtgtggcgggtgggggagacggagactcgactcgaatgcctgttgaataacaacaaaaatagtgacttctgtgctccactcacaagctttgattggaacgaagtggacccctatctgcttgggacaagctctatcgacacaacgtgcactatttggggattggagaccggtcaggtcctcggtcgagttaacctagtatcagggcacgtgaagacgcagctcatcgcccacgacaaggaagtttacgatatcgcctttagccgggcagggggtgggagggacatgtttgcttctgtcggtgccgacggctcggtgcggatgtttgacctcagacacctggagcattctactattatctatgaggacccccagcatcaccctcttttgcggctttgctggaacaagcaggatccgaattatctggctacaatggcaatggatggtatggaggtagtgatcctggacgtgcgcgtcccatgtaccccagtcgccagactgaacaaccacagggcctgcgtcaatggcatcgcctgggcaccacacagctcctgccatatctgcacagccgcagacgaccatcaggctttaatttgggatatccagcagatgcctcgtgccatcgaggacccaatactcgcttacacagcagagggggaaataaacaacgtacagtgggcctcaacacagccagattggatagccatttgctacaacaactgtttagagattctgcgggtttag

SEQ ID NO: 27898 - DNA, 507 bp, Artificial Sequence
  Description of Artificial Sequence: Synthetic coding sequence
atggccgagggctcgcgcatccctcaagctcgcgcactactgcagcagtgtctccacgccaggctacagatcaggcctgccgacggagacgtggcagctcaatgggttgaggtgcagagaggcctcgtgatctatgtgtgcttctttaaaggggcagataaggaactgctacccaagatggtaaacacgcttctcaacgtcaagttatccgaaactgagaatggcaaacatgtgtccatcttggaccttccaggcaatatccttattattccccaggccacgttgggcggacgactgaaaggcagaaacatgcagtaccatagcaatagcgggaaggaggagggatttgagctgtattcccagtttgtgactctgtgtgagaaggaagtagcagctaacagcaagtgtgcagaagccagagtggtggtggagcacgggacttatggcaaccggcaggtcctgaaactggacactaatggaccatttacccacctgatcgagttttag

SEQ ID NO: 27899 - DNA, 3069 bp, Artificial Sequence
  Description of Artificial Sequence: Synthetic coding sequence
atggagggggctttaactgcacgagacaaggtgggtgtgcaggacttcgtattgctggacgcttacacatccgaatccgcatttgtggacaatctccgaaagcgcttcagcgagaacctgatctacacgtatattggtaccctcctcgtaagtgtgaatccttatcaggaactgggcatctacactgtgagccagatggagctttatcagggggttaattttttcgagctcccgccacatgtgtacgctatcgccgacaacgcctaccgcatgatgtgtgccgaactgaataatcactttattctcatttccggggagagtggggcagggaagacggaggcatctaagaagatactggagtacttcgcagttacttgcccaatgacccagtctctacagatcgccagggaccggctgctgttcagcaatcccgtccttgaagcttttggtaacgctcgaacacttaggaatgataattcctccagatttggtaagtatatggatatacagtttgacttccagggtatcccagtggggggacacattattagctatctcatcgagaagagccgggtggtttaccagaatgagggcgaacggaacttccatatcttctaccagctgcttgcgggtggtgaggaagagcgtctttcctatttgggcctcgaacgggaccctcaactgtacaagtaccttagtcagggtcactgtgccaaggagtcctccatcagcgataagaacgattggaaaactgtttccaacgcgttctccgttatagacttcacggaagcggatttggagaatctcttcggcatcatcgcaagcgtgctccacctgggaaacatcgggttcgaagaagacgaccagggctgcgctacaatccctgacacccacgaaatcaagtggatcgcgaagctgcttggcgttcacccttccgtcctcctggaggcccttacccaccgtaagattgaggccaagactgaagaggtgatctgcccactgacacttgagctctccgtgtatgctagggacgctatggcgaaagcagtgtatgggcgtacattcacttggcttgtgaataagattaactcttctttagtcaacaaagactttacccggaagacggtgattggcctgctggatatctacgggtttgaggtcttcgataagaacgggttcgaacagttctgcatcaattactgcaatgaaaaattgcagcaacttctgatcgagcgcaccctgaaagctgagcaagccgagtatgagatggagggcatcgagtgggagccaattaaatacttcaataataaaatcatctgcgaccttgttgaggagaggcacaaagggatcatctcaatcctggacgaggaatgcatcaggcccggacccgcaactgacctgagctttcttgagaaacttgaggagaaagttggtaagcacgcacactttgagaccaggaaattagccggtcccaagggacgaaagaggatcggatggatggagttcagattattgcattacgctggggaagttacttactgtaccaaagggttcctggagaagaacaatgatctgctctataggcatttgaaagaggttctgtgcaagagcaagaatataatactgcgcgagtgcttcctgctggctgagctcgagaatcgccgacggccaccaactgtgggcacacagtttaagaacagtttgtcatccctgctggaaactttaatctcaaaggaacccagctacatacggtgcataaaacccaacgacagaaaggaaccctcaaaattcgatgacttcctcattcgacaccaaattaagtacctgggtctgatggagcatttacgcgtccgacgcgctggctttgcgtaccggcgtaaatatgagcatttcctacaacgctacaaaagcctgtgccctgacacgtggccccattggcatggacctcctgcagagggtgtcgagagactgattaagtacataggctacaaacccgaggagtataagctcggaaagactaagatattcatacggtttccgcgaaccttgtttgccacggaggatgccttcgagttctcgaaacaccagctggtcgctaggatccaggccacctataagagatgcctgggacgacgggagtacgtaaagaagagacaagctgccatcaagctcgaggctcattggagaggggctctcgccaggaaggccatacagcgtaggaaatgggccgtccgtatcatcaggaagtttataaaaggcttcattagcaggaataaacctctgtgtcctgacaacgaagagtttatcgtgtttgtgagaaaaaattacatcctgaaccttaggtaccacttaccaaagacggttctggataagtcttggttgcgacctcccggtattcttgaaaacgcttcagacctgctacgcaagatgtgtgtgagaaatcttgttcaaaagtactgtcgcggaattactgcagaacgaaaagctatgatgcagcagaaggtcgtgacaagtgagatatttcggggaaggaaggacggctatacagaaagtttaaaccagccattcgtgaacagcaggatagatgagggcgacattaatccaaaggtgttgcagttgatttctcacgagaagatccagtacggtgtcccagtgattaagtatgaccgcaagggttttaaggctcgtcagagacagctcatcctaacccagaaggccgcatacgtggtggagcttgccaaaatcaagcagaagatcgaatactctgctcttaaaggcgtctccacgtccaacttgagcgatggcatacttgtgatccacgtctcacccgaagatagcaagcagaagggcgacgctgtgttacaatgcggacatgtttttgaggctgtgacgaagctggtgatgctggtcaaaaaagaaaacatcgtgaatgtcgtccagggaagcctgcagttttttatctctccaggcaaagagggtaccattgtgtttgatacagggctagaggagcaggtttataaaaataaaaacggacagctcaccgttgtgtctgtgcggaggaagtcttag

SEQ ID NO: 27900 - DNA, 1044 bp, Artificial Sequence
  Description of Artificial Sequence: Synthetic coding sequence
atgaatactcttatggatgttctgcgccaccgcccagggtgggtggaggtcaaagatgaaggggagtgggatttctactggtgcgacgtctcatggctgagggagaactttgaccacacatacatggatgaacacgtcagaatcagtcatttcagaaatcactacgagttgaccaggaaaaattatatggtgaagaatctgaagcgattcagaaaacagttagagagagaggccggaaagctggaagcggctaagtgcgatttctttcccaagacattcgagatgccctgcgagtaccacctgttcgtagaagaattccgcaagaatcctggcatcacttggatcatgaaacctgttgctcggagtcaggggaaaggcatcttcctgtttagaagattgaaggacattgtagattggcgcaaggatacccgcagctccgacgaccaaaaagacgatatacctgtggagaactatgtggcccagagatacatcgaaaacccttacctgattggcggaaggaagtttgacttacgagtctacgttctggtgatgtcatatattccccttcgggcatggctttaccgcgacggtttcgccagattcagtaacactcggtttaccctcaatagtatagatgatcagtacgtgcacctgaccaatgttgctgtgcagaagacaagcccagattatcacccgaaaaaaggatgcaaatggaccctgcaaagattccggcagtacctagcctccaaacacggccctgaggctgtcgagaccttatttagggatatcgataatatcttcgtgaaaagcctgcagtcagttcaaaaagttatcatatctgacaaacactgcttcgagctctatggatacgacatccttatagaccaggacttgaaaccttggctccttgaagtgaacgccagtcctagcctgactgcttcctcgcaagaggactacgaattaaagacatgcctgctcgaagacacactgcacgtcgtggatatggaggcaagatcactgagagccgattctccatgttggtag

SEQ ID NO: 27901 - DNA, 444 bp, Artificial Sequence
  Description of Artificial Sequence: Synthetic coding sequence
atgtcctcagaacctccacctccaccccagcccccaacccatcaagcaagcgttgggttgcttgatacccccagaagccgcgagaggtcaccgagccccctcagaggcaatgtcgtccctagccccctgccaacacggcgtacccgaacattctctgccaccgtgcgtgcctcccaggggcctgtgtacaagggcgtgtgcaagtgtttctgtcgtagcaagggccacggcttcattaccccggcagacggtggacctgatattttcctccacataagcgatgtggagggggagtacgtacctgtcgaaggggacgaagtcacctacaagatgtgctcaattcccccaaaaaatgaaaaactgcaggccgtagaggttgtcatcactcacctagcaccgggaacaaagcacgagacctggtcaggacacgttattagctcctag

SEQ ID NO: 27902 - DNA, 558 bp, Artificial Sequence
  Description of Artificial Sequence: Synthetic coding sequence
atggccgacggaggcggtggcggtgggacaggggctgtgggcggaggcggtacctcacaggcgtctgccggtgctgccaccggcgctaccggtgcttccggaggcggtgggccaattaaccctgcatcattgccccctggggatccccagctcattgccctcatcgttgaacagttgaaatccagggggcttttcgatagtttcaggcgcgactgtctggctgatgtcgatactaaacctgcctaccagaatcttcgccagaaagtggacaatttcgtgagcacgcacctggataaacaagagtggaaccccaccatgaataagaatcagctgagaaatggcctcagacagtctgtcgtccaaagcggcatgttagaagcaggcgtggatcggattataagtcaagttgtagaccctaaacttaaccacatattcaggccccagatagagagagccattcatgagtttctcgccgcacaaaagaaagcagctgttccagcacccccacctgagccggaaggacaggatcccccagccccatctcaggacacttcttag

SEQ ID NO: 27903 - DNA, 6351 bp, Artificial Sequence
  Description of Artificial Sequence: Synthetic coding sequence
atggatgaggtcgaacaggaccagcatgaggccaggcttaaagagctgttcgactctttcgacacaacgggtaccggatccctaggacaggaggagctcacagacttgtgtcatatgttgtctctcgaggaggtggccccagtgcttcagcagacacttctgcaggacaacctgttgggcagggtgcactttgaccaatttaaggaggcactcattctaatcctttcacgcaccttgagcaacgaagaacattttcaagagcctgactgtagcctcgaggcccaaccgaagtatgttaggggcggtaagcggtatgggcgacggtccctcccggaattccaggagagtgtagaggaatttcctgaggtgaccgtgatagagccactcgacgaagaagctagaccgtcccacatacccgctggcgactgctccgaacactggaagactcaaagaagcgaagagtacgaagctgagggacagctgcgcttctggaatcccgatgatctgaatgcttctcagtccggctcatcacccccacaggactggattgaagagaaactgcaagaggtgtgtgaggatctgggaataaccagagacggccacctgaatcgcaagaaacttgtctcgatctgcgagcagtacgggctccagaacgtggatggggagatgttagaggaagtgttccataacctcgacccagacggaaccatgtcagtggaagacttcttttatggtctgtttaaaaacggcaagagcctgacgccgtcggcctctacaccgtaccgtcagctcaaacggcatttgtcgatgcaaagctttgatgaaagcggcagacggaccactacaagttcagctatgacatccacgataggtttccgggtgttcagttgccttgatgacgggatgggacatgcgagcgtcgagcgaatcttggacacctggcaggaagaaggaattgaaaattcacaagaaattctgaaagccctggactttagtcttgatggcaatattaatctgaccgagcttacgctggccctcgagaatgagttgttggttactaagaactctatacatcaggccgcacttgcgagcttcaaagcagagatccgccatcttcttgaaagggtggaccaggtagtgcgcgaaaaggagaaactccggagcgacctggacaaggccgagaaactgaagtccctcatggccagcgaagttgacgatcaccatgctgctatagagaggcgcaacgagtataacctccggaaactcgacgaggaatacaaagagcgaatagctgcacttaaaaatgagctccgaaaagagcgcgagcaaattctgcagcaggctgggaaacagcggctcgagcttgaacaggagattgaaaaagctaaaaccgaagagaattatatccgagaccgcttggccctgtcactcaaggagaattcaaggctggagaatgagttgctggaaaatgcagagaacgttcttgctgagaaattcggcgacctcgatccttcgagcgccgagttcttcctgcaggaggagcgattaacccagatgcggaatgagtatgaacgtcagtgtagggtgctgcaggaccaggtggatgagctgcagtcagaactggaagagtatcgggcacaggggagggttctccgacttccgctcaaaaattccccttctgaggaggtagaagccaactctggtggaatcgaaccagagcacgggctgggttcggaagagtgtaatccactgaacatgtcaattgaagccgagctcgtgatcgagcagatgaaggaacagcaccaccgggatatctgctgccttaggttggaactcgaagacaaggtgcggcattatgagaagcagctggatgagactgtcgtaagttgtaaaaaagctcaagaaaacatgaaacagcgccacgaaaatgagactcacaccctcgagaagcaaattagtgatctgaagaatgagatcgctgagctgcaggggcaggccgctgtgctgaaggaggcccatcatgaggctacgtgtcggcacgaagaagagaagaagcagcttcaggtgaagctggaagaggaaaaaacccacctccaggaaaaactcagacttcaacatgagatggagctcaaagcacggctgacccaggcccaggcgtcctttgaaagagaacgagaaggcctgcagagctccgcctggacagaggagaaggtccgcggtcttacacaggagctggagcagttccatcaggaacaattaacttccctggtcgaaaagcatactctggaaaaagaggaacttagaaaggagctgcttgagaagcaccagcgagaactgcaggaaggcagagagaagatggagactgagtgcaatagacgcacctcccagattgaggcccagtttcagtcagactgtcagaaggtgacagagcgatgtgagtcagccctgcaatcgcttgagggacggtaccgtcaggaattgaaagaccttcaggagcagcaacgcgaagaaaagtcccaatgggagtttgaaaaagatgagttgactcaggaatgtgccgaagcccaggagctgttaaaggagacactcaaacgggaaaaaacaactagcctggtgctgacccaagagcgagaaatgctcgagaaaacatataaagaacacctcaattcaatggtggtggagcgccaacaactacttcaagacttggaggatctacgaaacgtatccgagacccagcagtccctgctgagcgatcagattctggaactcaagagctctcacaaacgcgaactaagagagagagaggaggtgctctgtcaggccggagcatctgaacagctcgcctcacaacgactagagagactggaaatggaacatgaccaggagcgccaggagatgatgtccaagttactggcaatggagaatattcacaaggccacttgcgagacagcggatagagaaagagctgagatgagcacagaaatatccagactgcagtcgaagattaaggagatgcagcaggctacctcccccctttcaatgctacagagcgggtgccaggtgattggggaagaagaagtggagggggatggagccctgtctctactgcagcagggagagcaattgcttgaagagaacggggacgtcttgctctcactgcagcgggctcacgaacaggcggtcaaagaaaatgtgaaaatggccaccgagatctccagattacagcagagactccagaagttagagcccggtctggtgatgtcctcatgtttggatgaaccggcaaccgagttctttgggaacaccgccgagcaaacagagcagtttctgcagcaaaatagaactaaacaggtggaaggagtgacccgccgtcatgtgctgtcagatcttgaggacgatgaggtccgagacctcgggagtacgggcacctctagcgtgcaacgacaggaagtcaagattgaagagtcagaggcctccgtggagggatttagcgagcttgagaattctgaggaaactcgcacagaaagctgggagctgaagaatcaaatctcacagctgcaggagcagttaatgatgctgtgtgccgactgcgaccgtgcctcagagaaaaaacaggatctactgtttgatgtatcagtgctgaaaaagaagcttaaaatgttggagcggattccagaggcctctcccaagtacaaactgctgtatgaggatgtgagtagagagaatgattgcctgcaagaggagctccgcatgatggagactaggtacgatgaagccctcgaaaacaataaggagctgaccgcagaagtgttcaggttgcaagacgagttgaagaagatggaagaggtgacagaaaccttccttagtctggaaaaaagctacgatgaggtcaaaatcgaaaacgagggcctgaatgtgttagtgttaagattgcaggggaagatcgaaaaattacaggagtcggtggtgcagagatgtgattgttgtctgtgggaggcgagtctagaaaatctcgagatagaacctgacggtaatatcctgcagctgaatcagacattggaggaatgcgtgccaagagtgcgctccgtacaccatgtcattgaagaatgtaaacaggaaaaccagtaccttgagggaaacacacagctgctggagaaggtcaaggctcatgagatagcctggctgcacggaaccatccagacgcatcaagaaaggccacgggtgcaaaatcaggtgattctggaggagaacacaaccctgctggggtttcaagacaagcatttccagcatcaggctactattgctgagttagagctagaaaagaccaagctccaggagttgactcgtaaactgaaggagcgggttacaattctcgtaaagcagaaggacgttctaagtcatggcgagaaagaggaggagctgaaagcgatgatgcacgacctgcagatcacttgtagcgagatgcagcagaaagtcgagcttctgcgctatgagtctgaaaaactgcagcaggaaaactcaatcctgaggaatgaaatcactacactcaacgaagaagattcaatttctaacctgaagttggggactctgaatggtagccaggaggagatgtggcagaagaccgaaaccgtgaaacaggagaacgcagcggtccaaaaaatggttgagaacctgaaaaaacagatttctgaacttaaaattaaaaatcagcagttggacctggagaacactgagttaagtcagaagaactcccaaaatcaggagaagctccaagaactgaatcagcgcctgaccgaaatgctgtgtcagaaggagaaagagcccggtaacagcgcccttgaggagcgcgagcaagaaaagttcaacctcaaggaggaactcgagcgttgcaaagtgcagtcttcgacgctcgtgagtagcctcgaggccgagctgtccgaagtgaaaattcagactcacatagtgcagcaggagaatcacttgctgaaggatgaattagagaagatgaaacagcttcatcgttgtccagatttatctgacttccagcaaaagatttcctccgtgttgagttacaatgagaaactgctgaaggagaaagaggccttgtcagaagagctgaattcttgtgttgataagctggcgaaatcctccctgttggagcacagaatcgcaacaatgaagcaggaacagaaaagctgggagcatcagtccgcctccttgaagtcccagctggtggcgagtcaggagaaggtgcaaaatcttgaggatacagtccagaacgtgaatctgcagatgtcaaggatgaagtccgatctgcgagtgacccagcaggaaaaggaagcgctaaagcaggaagtgatgtccctgcataaacagctgcagaacgctggtggtaaatcctgggctccggagatcgctacacatcctagcggacttcataatcagcaaaagcgactaagctgggacaagttggatcatttaatgaatgaggaacagcagctgctctggcaggagaacgaacgcctacaaacaatggtccagaataccaaggctgaactcacacactcaagagagaaggtcagacagcttgaatcaaatctgctgccaaagcatcagaaacacctgaacccctccggcacgatgaaccctacggagcaggaaaagctgtccctgaagcgggagtgcgaccagtttcagaaggagcaatcacccgctaaccggaaggtgtctcagatgaatagcctggagcaagagcttgaaacaattcacctggaaaatgaaggacttaaaaaaaagcaggtcaagttggacgagcagctgatggaaatgcagcatcttcggtcgactgccacaccctctccttctcctcacgcatgggacctacagctcctgcagcagcaagcttgccccatggtgcctcgggagcagttcctgcaactacaacgacagctgctacaggcagagaggatcaaccagcatctgcaggaagagctcgagaaccgaacttcagagacgaacactccccaaggcaaccaagagcagttagtcaccgtgatggaggagaggatgatcgaggtggagcaaaagctgaagctcgttaagcgtctgctccaggagaaagtaaaccagctaaaagagcagctttgcaagaatacgaaggcagacgcaatggtcaaagatctgtatgtcgagaatgcacagttgttaaaagcactagaggtgaccgagcaacgacaaaagacagcagagaagaaaaattatctgttggaggaaaaaatcgcgtccctgtcaaacatagttcgcaacctgacccccgcacccttgacctccactcctccattgcggtcttag

SEQ ID NO: 27904 - DNA, 2664 bp, Artificial Sequence
  Description of Artificial Sequence: Synthetic coding sequence
atgcccattcttttgtttctgattgacactagtgcttcaatgaaccagcgtagtcatctcggcacaacatacctggatacagctaagggcgctgtggagacattcatgaagctacgcgctagggatcctgcatccagaggggatcggtatatgctcgtgactttcgaagagccaccttacgctatcaaggccggttggaaggaaaaccacgccacctttatgaatgagctgaagaacctccaggccgaagggctgaccaccctgggccaaagcctacggaccgcttttgacttgcttaaccttaaccgtctcgtaaccggcatcgataattacggccaggggaggaatccctttttcctggaaccggcaatcatcataacaattaccgacgggtcaaaactgacaaccactagcggtgtacaggacgagttacacctccccctgaatagcccactgcctggaagcgagttaaccaaagagcctttccgctgggaccaacggttgttcgctcttgttctgagactccctgggacaatgtccgtggagtctgagcagctaactggggtgccccttgatgacagcgccattactccgatgtgtgaggtgaccggagggaggagttacagtgtgtgttctcctagaatgctcaatcagtgtctggaaagcctagtgcagaaggtccagtcgggcgtggtgataaattttgagaaggctgggcctgacccttctccagtagaggacggccaacccgatataagtcgtcccttcgggagtcagccatggcactcgtgccacaagctgatttacgtacgcccaaaccctaagaccggcgtgcccatcggtcactggccagtaccggagagcttctggccggaccaaaacagtcccaccctaccccctagaacaagccaccccgtggtcaagttcagctgtacagactgtgaaccaatggtgatcgacaagctcccttttgacaagtatgagctggagcctagtcctctgacccagtttattcttgaacggaagtcgcctcagacatgctggcaggtttacgtcagtaattccgccaagtatagtgagctgggccacccgtttggctacttgaaagccagcacagctctgaactgtgttaacctgtttgtgatgccttataattaccccgtgctgctgcccctcctggacgacctgtttaaggttcataaggcaaaaccaaccctgaagtggcgacagtcgttcgaaagctacctgaagaccatgcctccctattatctgggccctctcaaaaaggccgtaagaatgatgggtgcgccaaacttaatagcggatagcatggaatatggtctgtcctactcagtcatatcctatctaaaaaaattaagtcagcaggccaagattgagtcagaccgtgttatcggatctgtcgggaagaaagttgtgcaggaaaccggaatcaaggtcagatcaaggtcacacggcttatccatggcttacaggaaggactttcagcagttgctgcagggaattagcgaggacgtaccccacagactcttagacctgaatatgaaggagtataccggcttccaggtggccctgcttaataaggacctgaagccccagacgttccgtaacgcctatgacatcccacggcgtaacttacttgaccaccttacacgaatgcggagcaacctcttgaagagtacccgaaggtttctcaaaggtcaggacgaggaccaagtgcacagcgtgcccatcgctcagatgggaaactatcaggagtacctaaaacaagtcccttctccacttcgcgaactcgatccggaccaacccagacgccttcacactttcggcaatcctttcaaacttgataaaaagggaatgatgatcgatgaagccgatgagtttgttgccggacctcaaaataagcacaaaagaccgggtgaacccaacatgcagggcatacccaaaagacgcagatgcatgtcccccctcctacgaggaagacagcagaatccagtcgtgaataaccatatcggaggcaaggggcctccagctccgactacccaagctcagcccgatctgattaagccattgcctttgcataagatcagtgaaacaactaacgactccatcatccatgacgtggtcgagaatcacgtggctgatcagctcagtagcgacattacccctaacgctatggacaccgagttctccgcttcttccccggcttctctgctcgagagaccaactaatcacatggaagcactgggacacgatcacttggggaccaacgacctgaccgtgggcggtttcttggaaaaccatgaggagccgagagacaaggagcaatgtgctgaagagaacatccccgcaagcagcctgaataaagggaaaaagctgatgcactgtcgcagtcacgaagaggttaataccgagctcaaggcccagatcatgaaggaaattcgcaagcctgggcgtaagtatgagagaatcttcacattgctaaagcacgtccagggttccctacagacgagacttatattcctccagaacgttatcaaggaagcttctaggtttaaaaagagaatgctgatagaacagttggagaattttctggacgagatacaccggcgagccaatcagatcaaccacatcaatagcaactag

SEQ ID NO: 27905 - DNA, 1944 bp, Artificial Sequence
  Description of Artificial Sequence: Synthetic coding sequence
atgtctgatgaggtgttctcaacgaccctggcttacaccaagtcaccaaaagtgaccaagagaacgaccttccaggacgagttgattagagctataacagccagaagtgctagacaaagaagcagcgagtactctgatgacttcgacagtgacgagattgtgagtcttggcgacttctccgacaccagcgcagacgagaatagtgtgaacaaaaagatgaatgactttcacatcagtgatgacgaggaaaaaaaccccagcaagttgttgttcctgaagacaaacaaaagcaacggaaatatcactaaggacgaacccgtgtgtgccattaagaatgaggaagagatggcacccgacggatgtgaggacattgtggtgaagtccttttcagaatcacagaataaggatgaagaatttgaaaaagataaaataaagatgaagcccaagcctcgcattctgtccattaaatccacgtcctccgctgaaaataactcgttggacacggacgaccatttcaaaccgagcccaaggccacgctcgatgctgaagaagaaatcgcatatggaagagaaagacggtctcgaggacaaagaaacagccttgtccgaagagttggagctgcactctgcaccatcgtccctgcctactcctaatggtattcagttagaagccgagaaaaaagcattttccgaaaatctggatcccgaggactcctgtttgaccagcctggcatccagctcgctgaaacagattctcggcgatagcttcagtcctgggtcagagggcaacgcctcaggtaaagatcctaatgaggagataacggaaaaccataacagcctgaagtcagatgagaacaaagaaaattcattctctgctgaccatgtgacaaccgcagttgagaagagtaaggagtctcaggtcactgccgatgacttggaggaagagaaggccaaagcagagctgattatggacgacgacaggaccgtcgatcccttgctgagcaagtctcagagtatactaatcagcacatccgctactgcttcaagtaagaagacgattgaggataggaacatcaaaaacaaaaagtccacgaacaatagggcctcttctgccagtgccaggctgatgacatctgagtttttgaagaagagctcgagcaagagacggacaccctcaacaacgaccagcagtcactacctagggacactcaaggtgttggaccagaaaccctctcagaagcagagcatcgagcccgatagagcagacaacatacgggcagccgtgtatcaggaatggctagagaagaaaaatgtgtacctgcacgaaatgcaccgtataaaaagaattgagtctgagaatctgaggatccagaacgaacagaaaaaagcagctaagagagaggaggccctggccagcttcgaggcctggaaggctatgaaggaaaaagaggctaaaaagatagccgcaaagaaaaggctggaggaaaaaaataaaaaaaaaacagaggaagagaacgccgcaagaaagggtgaggctttgcaggctttcgaaaagtggaaagaaaagaaaatggaatatctgaaggaaaaaaatcggaaggagagggagtacgagagagctaaaaagcagaaagaagaggaaactgtcgcagaaaagaaaaaggataacctcacggcggtggaaaaatggaacgagaagaaggaggccttctttaaacagaaagagaaagagaagattaatgagaagaggaaggaggaactcaaacgtgctgagaaaaaagataaggacaagcaagcgatcaacgagtacgagaagtggcttgaaaacaaagagaagcaggaacgcattgagcgaaaacagaaaaagcggcatagcttcttggagagtgaggctcttcctccttggtccccaccgtccagaaccgtttttgcgaaggtattctag

SEQ ID NO: 27906 - DNA, 1074 bp, Artificial Sequence
  Description of Artificial Sequence: Synthetic coding sequence
atgcaaacattccttaaggggaaacgcgtagggtactggctcagcgaaaaaaaaattaagaagctcaactttcaggcgttcgccgagctgtgcagaaagcgcggtatggaagtggtacagttgaatctgtctcgacctattgaggaacaaggcccattggatgtcattattcacaagctcaccgacgtgatactcgaagctgaccagaacgatagccagtctttggagctggttcaccgtttccaggaatacatcgacgcccaccccgaaaccatagtcctggaccccctgccagccattcggactctgttagacaggtctaagagttacgagctcatccgaaagattgaagcctatatggaggatgacaggatctgttcccctcccttcatggaactgacttctctgtgtggcgacgatacgatgagactgcttgaaaaaaacgggctcacattcccttttatttgcaaaactcgtgttgcccatgggaccaattcacatgaaatggccatcgtcttcaaccaagagggcctgaacgcaatacagccaccttgcgtggtgcagaacttcattaatcacaatgccgtgctctataaggtcttcgtcgtaggtgagtcatacaccgtggtgcagcggccttccctgaagaatttcagcgcaggtaccagtgatagagaatccatatttttcaattcacacaacgtgagtaagcccgaatcaagcagcgtgcttactgagctggacaagatcgaaggggtgttcgagcggccaagcgatgaagtcatccgagagctttctagagcccttcgccaagccctgggagtaagcctgtttgggatcgatattatcataaataaccaaactggacagcatgccgtgatcgatattaacgcctttccaggctacgaaggcgtgagcgaattcttcaccgatctgctcaatcatatagcaacagttcttcagggacaatctactgctatggcagctccatcgggcgagttccgcgctggcgacctttgctgtgacctaggcaaatcatttcaggtattcgggcctccacctccctgcttgtag

SEQ ID NO: 27907 - DNA, 852 bp, Artificial Sequence
  Description of Artificial Sequence: Synthetic coding sequence
atgctgaggtgcggtcaaatgattttcgctcaggcactggtgtgcagacatctgggaagagactggcgttggacacaacggaagagacagcccgacagctacttttctgtgcttaacgcttttatcgacaggaaggatagttactactctattcaccagattgctcagatgggagtcggggaggggaaaagcattggccagtggtatgggccaaacaccgtcgcccaggtgctgaagaagctggccgtgtttgatacctggagttcattggcggtgcatatcgctatggacaatactgtcgtaatggaggagatccgaaggctgtgtaggacaagcgtgccgtgtgcgggagcgactgcctttccagccgattccgataggcactgcaacggcttccccgctggggctgaggtgaccaaccggccttcaccttggcggcctctggtgttgcttattcctctgcgcctgggactgacagatattaacgaggcttacgtggagactctgaagcactgcttcatgatgccacagagcctgggcgtgattggcggtaagcctaattcagctcactatttcattggctacgtgggcgaggagctgatctatctggacccccacaccacccagcccgcagtggagcccacggatgggtgttttatacctgacgagtccttccactgccagcaccctccatgtaggatgtcaatagctgaacttgatcctagtatcgctgtcgtcttgggggttggtaagcagggcagactggtacgtagcataccctgggctccccgtccgtcatcatggtgcgccgctgtcctcggcgctgcagtggtgatgtgcgggacgccctag

SEQ ID NO: 27908 - DNA, 2160 bp, Artificial Sequence
  Description of Artificial Sequence: Synthetic coding sequence
atggggttcagtaacatggaagatgatgggccagaagaagaggagcgagtggcggagcctcaggcaaatttcaatacacctcaagcacttcggtttgaagaactgctcgccaacctcctcaacgaacagcatcagattgcaaaggagctgtttgaacaactcaaaatgaagaagcctagtgcaaagcagcaaaaagaggtggagaaagtcaaaccccagtgcaaggaggttcatcagacccttattctggaccctgctcagcgcaagcgtctgcagcagcaaatgcagcagcatgtgcagttgctcacacagattcacctgctggccacctgcaacccgaacttaaatcctgaagcgtctagtacccggatctgcctgaaggagcttggaacattcgcccagagctcaattgcactgcaccaccagtataaccctaaatttcagaccctctttcagccatgcaatctcatgggagccatgcagctgattgaggatttttccacccatgtcagcattgactgttcgcctcacaagaccgtgaaaaaaaccgccaatgagttcccatgtctgccaaaacaggtggcgtggatcctcgctaccagcaaggtctttatgtacccagaactgctgcccgtctgcagtttaaaggcaaagaacccccaggacaaaatcttattcacgaaagctgaggacaacaagtaccttttaacgtgtaaaacagcccgacaattgactgtgcgcataaaaaaccttaacatgaacagggcaccggacaacattattaagttctataaaaagacgaagcagttgccagtcctgggtaaatgttgtgaggagatccagccgcatcagtggaaaccgcctatcgagagagaagagcatagactccctttctggctaaaggcaagcctgcctagcatccaggaggagcttagacacatggctgacggcgctagagaggtggggaacatgactggcaccacagaaataaattcagaccagggtctcgagaaagacaactccgaactcggctctgaaacccgctacccacttctgcttcctaaaggtgtcgtcttgaagttgaagcctgtggccgatcggttccctaaaaaagcttggaggcagaaacgctcatcagtgcttaagcccctgctgatccagcctagccccagtctgcagccttccttcaaccccggaaagaccccagcgcagagcacccattccgaagctccacccagtaaaatggtactaagaatccctcatcccatccagcctgctaccgttctgcagacagtccccggagtgcccccactgggagtgtcaggcggtgaaagttttgagagtccagccgcacttccagccatgcccccagaagcacgaacatcttttcctctgagcgagagccagactctcctctccagcgcaccagtccctaaggtaatgatgccctctcctgcaagttccatgtttcggaaaccttatgttcggcgtagaccgtcgaagcggaggggcgctcgcgcattccgctgtattaaaccagctcccgtcattcaccctgcctctgtgatattcaccgtgccggctacaactgttaagatcgtctcattgggaggcggttgtaacatgatacagcctgtgaacgcagctgttgctcagtccccacagaccattccaattgccactctcctggtgaaccccacttccttcccgtgcccgctaaatcagcctctggtggcaagcagtgtgtcacccttaattgtgagcggcaactcagtaaacctgccgatcccctcaacccccgaagataaggcgcacatgaacgtagacattgcctgcgccgttgccgatggtgagaatgctttccagggactcgagcccaagttagagccgcaggagctgagccccctatcggctactgtctttcccaaagtggaacacagccccggaccccctcccgtcgataagcagtgccaggagggtttgtcagagaacagcgcctatcgatggacggtggttaaaacagaagagggcaggcaagctcttgagccgcttcctcagggcattcaggaaagcctgaacaactcctcaccaggggatttggaggaagtcgttaagatggaacctgaagatgccacagaagagataagtggcttcctgtag

SEQ ID NO: 27909 - DNA, 1134 bp, Artificial Sequence
  Description of Artificial Sequence: Synthetic coding sequence
atggaagctgccgcagttaccgtgactagatccgcaacgcggagaaggaggcgccagctacaggggctggccgcacccgaagctggcactcaggaggaacaggaggatcaggaacctagacctaggagaaggcggcctgggaggtccataaaggatgaagaggaagaaaccgtattccgcgaagttgtgtctttctcccccgacccgctgccagtccgctactacgataaggacaccaccaagcctatctcattttacctctcatctttggaggaattacttgcctggaagccacgcttagaggatgggttcaacgtagcgctggaaccgctcgcttgcaggcaacccccactatcttcgcagcgaccgagaaccctcctctgtcacgacatgatggggggttatttggatgaccggttcattcagggcagtgtggtccagacaccctatgcattttaccactggcaatgtattgacgtgttcgtctacttctcacaccacaccgttaccataccccctgtgggatggacgaatacggcacaccgccatggggtctgtgtcctggggacctttattactgagtggaacgagggaggtaggctgtgcgaggccttccttgccggagacgagaggtcatatcaagctgtggccgatagactggtgcaaataactcagttcttccggtttgacggatggttgataaacatcgaaaacagtctgtcactagcagccgtcggtaatatgcctccctttctcagatacttaactacccagttgcaccgacaggtgccaggcggattggtgctatggtacgactctgttgtgcagagtggtcagctaaaatggcaggacgagctgaatcaacacaaccgtgtattctttgactcctgcgacggcttcttcacaaactacaattggcgagaagagcacctcgagaggatgctagggcaggcaggagagcgcagagctgacgtctatgtcggagttgatgtgttcgccaggggcaatgtagtggggggaaggttcgacacagacaagtccctcgagttgatccggaagcacgggtttagcgtcgctctgttcgctccgggatgctccgtgtttccaggggtgggtaacctgctctgttgctag

SEQ ID NO: 27910 - DNA, 927 bp, Artificial Sequence
  Description of Artificial Sequence: Synthetic coding sequence
atgcggggaaaacgcagacctcagactcgggcagctcgcagattggctgcccaagagtcttctgaagctgaagatatgtctgtccccagaggcccaatcgcccagtgggctgatggagctatcagtcctaacggccacaggccgcagctgcgtgcagcttcaggggaagactcgactgaagaggccctggccgctgccgcagccccttgggagggtgggccagtcccgggtgttgacacttcacctttcgccaagtcactcgggcattcccggggagaagcagatttatttgactcaggggatattttctccacaggtaccgggagccagtctgtggaaagaacaaagcctaaagcgaagatcgctgaaaaccctgccaacccaccagtcgggggaaaggcgaaatcgcctatgtttccagctttaggcgaggccagctctgacgatgatttgttccagtcggccaaacctaagcccgcaaagaagaccaatccctttcctctattagaggacgaggatgacctgtttactgatcagaaggtgaaaaaaaacgagacgaagagctcatcccaacaggacgtcatactgacgacccaggacatcttcgaagacgatatttttgccacagaagcgattaagccttctcaaaaaacaagagagaaggaaaagacactggagtcgaacctattcgatgacaatattgacatcttcgccgacctgactgtcaaacccaaggagaaatccaagaaaaaggttgaggctaagtcgatctttgatgatgacatggacgatattttttccactggaattcaggccaaaacaaccaagcctaagtctcgcagtgctcaagctgccccagaaccaagatttgaacataaggtgagcaatatcttcgacgacccattgaacgccttcggcggacaatag

SEQ ID NO: 27911 - DNA, 933 bp, Artificial Sequence
  Description of Artificial Sequence: Synthetic coding sequence
atgcttaagaataaagggcacagcagcaagaaagataacctagctgttaacgccgtggccctgcaagaccacatcttgcacgacttacaactccgcaatctgagcgtagccgaccacagtaagacacaggtacaaaagaaggagaacaaaagtcttaagagagacaccaaagccattatagataccggcctgaagaaaacaacccagtgcccaaagctggaggactctgaaaaggagtacgtcttggatccgaagccaccaccactcaccctggcccagaagttaggactaattggccctccaccccctcctctgtcttcagacgaatgggaaaaagtaaagcagcggagcctcttgcagggcgacagtgtgcagccctgccccatatgtaaggaggaatttgagctgagaccacaggtgctcctttcatgctctcacgtttttcataaggcttgtctgcaggcattcgaaaagttcactaataaaaagacttgcccactatgcaggaagaatcagtaccagaccagggtgattcacgacggcgcaagactgtttcggattaagtgcgtcacaaggatccaggcttattggagaggctgcgtggtgcgaaaatggtatagaaatctccgtaagacagtgcccccaacagacgccaaactgcggaaaaagttcttcgaaaaaaaatttaccgaaatttcgcatagaattttgtgctcctacaataccaatatcgaggagctattcgcagaaattgatcagtgcttagccattaatcggtcagtgttacaacagctcgaggagaaatgtggacatgaaatcacagaggaggagtgggagaaaattcaagtgcagaacgaaacaagcgcgtgtttcgaagatccatgcctcggcgctcacgggtcccatttctccctcagtaacttcttgctgtag

SEQ ID NO: 27912 - DNA, 1119 bp, Artificial Sequence
  Description of Artificial Sequence: Synthetic coding sequence
atgagagttggcccagtccggtccgcgatgtcaggggcaagccagccgagaggtcccgctctcctttttcccgcaacccgcggagtgccagccaagcgcctgctggatgccgacgatgcggctgccgtggcagccaaatgtccaaggctgagcgagtgttccagtcccccagattacctgtcaccgcctggttctccctgcagccctcaaccccctccagctgctccaggagccggaggtggcagtggcagcgcaccgggtccaagcagaatcgccgactatcttcttttgcctctcgccgaacgggaacacgttagcagagctctatgcatccatactggcagggaacttcgctgcaaagtattccccataaagcactaccaagataaaattcggccatacatccagctcccaagccactcaaatatcacaggcattgtggaggtgatcctgggcgaaaccaaggcgtacgtgtttttcgagaaggatttcggagacatgcattcctatgtgagaagcaggaaaaggttgagggaagaagaggctgccagactatttaaacaaatagtgtccgcagtagcgcactgccaccaaagcgcgattgtgctcggtgacctcaaacttagaaagtttgtatttagtaccgaggaaagaacacagcttaggctggaaagtctcgaagacacgcatatcatgaaaggtgaggatgatgctctgtctgataagcacgggtgcccggcttatgtttcacccgaaatcttgaatacaaccggcacttatagcgggaaagccgctgacgtatggagcctgggcgtcatgctctacacgttgttagtgggaaggtacccttttcatgacagtgatccctccgcccttttctcgaaaattcgtcgcggacagttttgcataccagagcatatctctccaaaagcacgatgtctcattaggagcctgttaaggagggaaccaagtgaacggctgaccgctccggagattttgcttcatccttggtttgaaagtgtattggaacctggttacattgactcagaaattggaaccagtgaccaaatcgttccggaatatcaggaagattccgacatcagttcctttttctgttag

SEQ ID NO: 27913 - DNA, 1554 bp, Artificial Sequence
  Description of Artificial Sequence: Synthetic coding sequence
atggagactgacctcaattcccaggaccggaaggacctggataaatttattaaattttttgccctgaaaaccgtccaagtgatcgtccaagcacgcttaggtgagaagatctgcacacgatcgtcaagctcgcctactgggagcgactggttcaacctggcgattaaggatatccctgaagtgactcatgaggccaagaaggctctcgccggtcaactgccggctgtgggtcgctccatgtgcgtggaaatctctcttaagacatcagagggtgacagcatggagcttgagatttggtgcctggaaatgaatgaaaaatgtgataaggagattaaggtgtcgtacactgtctataacaggcttagtctattgctgaaatcgctgctcgcgattaccagggtgacccctgcctaccgtctgagcagaaagcagggccacgaatacgtgattctctaccgaatttattttggtgaggtgcaactctccggcttgggggaaggttttcagacggtccgcgtcggaactgtgggcacgcccgtcggaaccatcaccctgagctgtgcctaccggattaatctggcctttatgtcaacacgccagttcgagcgcaccccacctatcatgggcattatcatcgaccatttcgtggaccgcccataccccagcagctcaccgatgcatccatgcaattatagaactgcgggagaggacacaggggttatttatccttctgtggaggacagccaggaggtctgtactacatccttttcaaccagcccccctagtcagctatcatcctcccgcctgtcttaccagcccgcagcgctaggcgtcgggagtgccgaccttgcatacccagtggtgtttgcagctggtctaaacgcgactcacccacatcagctgatggtgcctggcaaggagggcggagtacctctggctccaaaccaacctgtgcatggaacacaggctgaccaggagcgactagctacttgtacaccctccgacaggacacactgtgctgcgacacctagctcttctgaagacaccgagacagtttcaaactcatctgaaggccgtgcgtccccacatgatgtgctggaaaccatcttcgtccgtaaagtgggggcatttgttaataaacctatcaatcaagtgactttgacgagtttggacatccccttcgccatgttcgcacccaaaaatctggaattggaggataccgatcccatggttaatccgcctgacagtccagaaactgaatcaccgctgcagggctccctgcattctgacggatcgtccggaggctcatcggggaacacccacgatgacttcgtgatgatagatttcaaaccagccttctcaaaggatgacattctgcctatggatcttgggactttctaccgggaattccagaacccaccacaactgtcctccttgagcatagatatcggggcacagtctatggccgaggatctggactctctcccagagaaactggccgtccacgaaaagaacgtcagggaatttgatgccttcgtggaaacgctccagtag

SEQ ID NO: 27914 - DNA, 1488 bp, Artificial Sequence
  Description of Artificial Sequence: Synthetic coding sequence
atgtggaggggttgtgccaggtcaagaaaaagaaagaaggttgacaacgattataatgcactgcgtgagcgtctgagtacccttcctgacaagttgagctataatataatggtccctttcggcccattcgctttcatgccgggaaagctggtccataccaatgaagtgacagttcttcttggggataattggtttgctaaatgcagcgcgaagcaggcagtcggcttggtggagcatcgcaaagaacacgtacggaagacaatcgatgacctgaaaaaggtgatgaagaatttcgagtctcgggttgaattcaccgaagaccttcaaaagatgagcgatgccgctggtgatattgtggatattcgggaagagatcaaatgtgacttcgagttcaaggcaaagcacaggatagcccacaagccccactcgaagccaaaaacttctgatattttcgaggccgacatagcaaatgatgtgaaatctaaggatctgctggccgacaaggagctgtgggcccgactggaggagctagagaggcaagaggaactgctgggtgagttggatagcaaacccgataccgtgattgccaatggtgaggatacaacaagtagtgaggaggagaaggaggacagaaataccaatgtaaacgccatgcaccaggttaccgactctcatactccatgtcataaagacgtggcaagcagtgagcccttttcaggacaggtcaatagtcagctgaactgttctgtgaatgggtcgtcctcctaccactccgacgatgacgatgacgatgacgatgatgatgatgacgacaatatcgacgacgatgacggagataatgatcatgaggccctgggtgtgggagacaactcaataccgactatttactttagccataccgtggaacctaagcgagttaggatcaacacaggaaagaatactacccttaaattttccgaaaagaaggaagaagccaagcgcaaacggaaaaactcaacgggaagtggtcacagcgcccaggaattacccacaatccgcacgccagctgatatttaccgcgcatttgttgacgtggtgaacggagagtatgtgccacgaaagagcatcttgaagagtcggtctagagagaattcggtgtgctccgacacttccgagtctagcgccgcagagttcgatgacaggcgaggtgtcctcaggtctatatcttgtgaggaagccacttgcagcgacacatccgagagtattctggaggaggaaccccaagaaaaccagaagaagctgctcccactgagtgtcacacccgaggcttttagcggcaccgtcatcgagaaagaattcgtctctccttccttaacccccccacccgctatcgcccacccagctctgcccacaattcctgaaagaaaagaggtgcttctggaggccagtgaggagaccgggaagagagtcagtaagtttaaagccgctcgattgcagcagaaggattag

SEQ ID NO: 27915 - DNA, 1458 bp, Artificial Sequence
  Description of Artificial Sequence: Synthetic coding sequence
atgtgccaggtgggtgaagattacggggaacctgcgccagaggaaccacctcccgcaccgcgtccgagcagggagcaaaagtgcgttaagtgcaaagaagcccagcctgtggtggtgattcgcgctggggacgccttctgccgcgactgtttcaaggctttttacgtccataaattcagagctatgctgggcaaaaaccgccttatctttccaggggagaaagtgctgctggcctggtctggaggcccttcgtcctcatctatggtgtggcaggtgctggaaggactgagtcaggacagcgctaagcggcttcggttcgttgccggtgtaatattcgttgatgaaggggcagcatgtggccaaagtctggaggaaagaagtaagacacttgcagaagtcaagcccatcctgcaggcaacgggatttccctggcatgttgtggctttggaagaggtgtttagtctgcctccatcggtgctgtggtgctccgctcaagaactggtgggcagtgaaggagcctataaggccgcagtggatagttttcttcagcagcaacatgtgctcggagcgggtggcggacctggaccaacacagggagaagaacaacctcctcaacctcctcttgatccacagaatctggctagacctccggctcccgcacagaccgaggctctgagccaactattttgttctgtgcgaactctcacagctaaggaggaacttttgcagactttgaggacccacctgatcctgcacatggcacgcgctcatggctatagcaaagtaatgacaggagattcttgtaccaggttagccattaagctgatgaccaatttggcactcggacgcggagcattcctggcctgggatactggattctctgatgagaggcatggagatgtggtggtggtcaggcccatgcgggatcatactctgaaagaagtcgctttctataatcgtctgttctctgttccttcggtctttactcctgctgtggacaccaaagcacccgagaaggcctctatccaccggctgatggaggcattcatcttgcgactgcaaacgcagttcccctcaacagtgtccaccgtttatagaaccagtgaaaagctcgtgaagggcccaagagacggcccagccgcaggtgatagtggcccacgatgcttgctctgcatgtgtgccctcgatgtagatgctgcggactccgccaccgcatttggggctcagacttctagcagactaagtcagatgcaaagtccaattccactgactgaaaccagaaccccacctggaccttgctgttcacctggagtcggatgggcccaacgttgtgggcaaggagcctgcaggcgcgaggacccccaagcatgtatagaagaacagctgtgttactcatgccgggtgaatatgaaggatctgggactgggacttgcaggggatcccggtctatccgactag

SEQ ID NO: 27916 - DNA, 1353 bp, Artificial Sequence
  Description of Artificial Sequence: Synthetic coding sequence
atgagtttgagactgagttccgcttcacggagatcatgtcctagaccaactactggcagcctccggctgtatgggggtggcactagcttcggaacaggtaatagctgcggcatctctggcatcgggtctggcttctcatcagccttcggtggcagctcatctggcggaaataccggcggtgggaacccatgtgctgggtttaccgtgaacgagcgtgggctcctgagtggtaatgaaaaggtgacaatgcagaacctcaacgaccggctcgccagctaccttgactcagtacatgcactagaagaggccaatgccgatctcgaacagaaaataaagggatggtacgagaagttcggcccaggctcctgccggggactcgatcatgactactcaagatacttcccgatcattgacgatctcaagaatcagatcatcgctagcactactagcaacgccaacgccgttctgcaaatcgacaacgccaggttgaccgctgatgatttccgcctgaaatatgaaaatgagcttgctcttcatcagagcgttgaggctgacgttaatgggctgaggagggtgttggacgagataaccctctgcagaaccgacctcgagattcaatatgaaacgctgtcagaggaaatgacttatctcaagaagaaccacaaggaagagatgcaggtgctccaatgtgctgctggcggaaacgtgaatgtggagatgaatgcggctcctggcgtcgacttgaccgtccttctcaacaacatgagggccgagtatgaggccctcgctgagcagaaccgccgtgatgctgaggcctggtttaatgagaaatccgcgtctttacagcagcaaatctcggaagatgtcggtgccacaacctccgcaaggaacgagctcactgagatgaaacgcaccctgcaaaccctcgaaatcgagcttcaatccctcttggccacgaaacatagtctcgagtgttcactgacagagaccgaaagcaattactgtgctcagctcgcccaaatccaagctcagattggcgcactggaagaacaattacatcaagtccggactgagaccgagggccagaaactcgaatacgaacaactgttggacatcaagctgcatcttgagaaggagatagaaacatactgcctgctgatcgggggtgacgatggcgcttgtaaatcaggaggctataaatcaaaggattacggctcagggaacgttggtagccaggtaaaggatccggcaaaagccatcgtcgtgaagaaggtactggaggaggtggaccaaagatcgaagatactgaccactagacttcacagtttagaagagaagagtcagagtaactag

SEQ ID NO: 27917 - DNA, 2679 bp, Artificial Sequence
  Description of Artificial Sequence: Synthetic coding sequence
atggaccaacccgaggcaccctgctcatctacaggccctcgtctagccgtggcacgtgagctcctgctggccgctctcgaagagctttctcaggagcaactaaagcggtttaggcacaaactgagagatgtcggcccagacgggagaagtataccttggggccgactggagcgcgcagacgcagtcgatcttgccgagcagctggctcaattctacggccctgagcctgctctggaagtggccaggaagactctcaaacgcgctgacgccagagacgtcgcggcacagctgcaggagcgcagacttcagcggttgggcttggggtccggaacactgttatccgtgtctgagtataagaagaaataccgagagcatgtgctgcagttgcatgccagggtgaaagagcggaatgcccgatctgtgaagattaccaaaaggttcacaaagctgctcatcgcacctgaaagtgcagctcctgaagaggcgatgggtcctgctgaagaaccagagcccggtcgggcaaggcgcagtgatacgcatacctttaatcgccttttccgcagggatgaggaaggacgccgacccctgacagtggtgctgcaaggaccagctggtatcgggaaaactatggccgctaaaaagatactctacgattgggcggctgggaaactgtatcaggggcaggtggacttcgccttttttatgccgtgcggtgagctactggagcgtccagggacacgcagcttggcggacctcattctcgaccagtgtcccgaccggggagccccagtcccacagatgctagctcaacctcagcgattgttatttattctcgacggcgctgatgagctccccgcacttggaggcccagaggcagcaccttgtactgatccatttgaggctgccagtggtgctagggtcttgggaggcttattgagcaaggcgctcctacctaccgccctgctcttagtcaccacaagggccgcagccccagggaggctccaggggcgtctgtgctcaccccagtgcgccgaggtgcgtggtttcagtgacaaagataagaaaaaatacttttacaaatatttcagagatgagagaagagccgagagggcctacaggtttgtgaaggaaaatgaaactctgttcgccctctgtttcgtcccctttgtttgttggatcgtgtgcactgttctgagacaacagttggagctcggacgtgacctgtccagaacatctaagaccacaacgtctgtgtatctgttgtttataacatcagtactgtccagcgcccctgtggccgacgggcctcgcttacagggggacctccgaaacctgtgccggttggccagggaaggtgttctcggcagaagagcgcagttcgcggaaaaggagttagagcaactagagttacgcggatcgaaagtgcagaccctcttcctatccaaaaaggagttacctggggtccttgagactgaagttacttaccaattcatcgaccaaagcttccaggagttcttagcagcattgtcttacttactggaagatgggggagtccctcgcacagcagccggtggtgtagggacacttctgcggggagacgctcagccgcattctcacctggtcctgaccacccgcttcctttttggtctccttagtgctgaacgtatgagggatattgagcgccacttcggctgcatggtgtcggaacgggttaaacaggaagcacttcggtgggtgcagggccaggggcagggctgtcccggagttgcacctgaagtaactgagggcgctaagggtctcgaagacactgaggaacccgaggaggaagaagagggggaggagccaaactaccccctggagctcttgtactgcctgtatgagacacaggaggatgccttcgtcagacaagccctgtgccggttcccagaattggctctgcaacgggtgcgcttttgtaggatggacgttgccgtgctgtcatactgtgttcgctgttgccctgcaggccaggcactccgacttatctcgtgtcgtcttgtcgcagcacaggagaaaaaaaaaaaaagcttaggaaagaggctccaggccagcctcggcggaggttctagctcccagggaactacgaagcagctcccagcatccctgttgcatccactctttcaggcaatgactgaccccctgtgccatctctctagtctgaccttatctcattgcaaacttcctgacgccgtttgccgggacctgtctgaggccctccgggctgccccagccctgaccgaactaggtctgctgcacaaccgcctgagcgaggccggtttgagaatgttgagcgagggacttgcctggcctcagtgtcgcgtgcagaccgttcgggtgcaattgccagacccccagcggggactccaatatctggtaggaatgttgagacagtccccagcactgactacactcgatcttagtggatgccagttgccagcccctatggtcacgtatctttgtgcggtcctgcagcatcagggttgtgggcttcagaccctgagcctggctagtgtggagctttcagagcagagtctgcaggaattgcaggctgtgaagcgggcaaagcctgaccttgtgattactcatccggctttggatgggcacccccagccgccaaaggagttgatttccaccttctag

SEQ ID NO: 27918 - DNA, 1047 bp, Artificial Sequence
  Description of Artificial Sequence: Synthetic coding sequence
atgggcaaagactactataaaatcctgggaataccaagcggggctaatgaagatgaaattaaaaaagcgtataggaaaatggccctgaaatatcaccccgacaagaataaagaaccgaacgccgaggagaaatttaaggagattgcggaagcttatgatgttctgtcagatcccaagaaacggggattgtatgatcagtacggagaggagggcctgaagacaggaggcggtacgtctggcggttcaagcgggtctttccactacacttttcatggagatcctcatgcaacatttgcaagtttttttgggggatccaatccattcgacatttttttcgcgtcatcccggtctacacgccctttctccggatttgaccctgacgatatggatgtcgacgaggacgaagatccctttggtgcctttggtagattcggctttaacggactgtcgaggggtccacgacgcgctccagagcctctttatcccagacgcaaagttcaggaccctccggtggtgcacgagctgcgagtgagcctcgaagaaatttatcacggctcaacaaaacgcatgaagattactcgcaggcggcttaacccagatggtcgtaccgtgagaaccgaagacaagattttgcatatcgtaattaaacggggttggaaggaagggacaaaaatcacctttccgaaagaaggcgacgctacccctgacaacatcccagccgacatagtgttcgttctgaaagataaaccacatgcacactttaggcgggatgggaccaatgtactgtatagcgccctgataagtctgaaagaggccctgtgtgggtgtacagtaaatattcccaccatcgatggtagggtcattcctctcccctgtaatgatgtcataaagccaggaacagtgaagaggctgagaggggaaggcttgcccttccccaaggttccgactcagcggggagatttgatcgttgaattcaaagtcagattcccagaccgcctgacaccacagactcggcaaatcctgaagcagcatctgccatgcagctag

SEQ ID NO: 27919 - DNA, 1899 bp, Artificial Sequence
  Description of Artificial Sequence: Synthetic coding sequence
atggatactatgatgctgaatgtgcgtaacctatttgagcagctggtcagaagagtagagattttgagtgagggtaatgaggtgcagtttattcaactggccaaggattttgaggattttcggaaaaagtggcagcgcaccgatcacgaactgggaaaatacaaggatctccttatgaaagctgaaaccgaacgttctgctctggatgtaaagctgaagcacgcacgtaaccaggtagatgttgaaattaagaggcgccagcgagccgaggctgactgtgagaaacttgagagacaaattcagctgatccgcgaaatgcttatgtgtgacacctctggttcaatccagctgagcgaggaacaaaagtcagccctggcattcttgaacaggggtcagccctcgagttctaacgccggaaacaaaagactgagcaccattgacgagtcaggaagtattttgtccgacatctcatttgacaagacagacgagagcttagattgggactccagtctggtgaaaacatttaaactgaaaaagcgagaaaaacggagatccacatcacggcagtttgtggatggtccccctggccctgtgaaaaagacccgctctataggcagcgcagtcgaccaagggaatgaatctatcgtcgcgaaaacgactgttactgtacctaacgacggagggcctattgaagcagtttcaacaattgagacggtgccatattggacccggtctagacgcaaaactggaactcttcagccttggaactccgatagtacccttaacagccggcaacttgagccgcgaacagagacagacagtgtgggtaccccacagagtaacgggggaatgcgactacacgatttcgtttctaagaccgtcataaaaccagagagctgcgtgccatgcggtaagagaatcaaatttgggaaactctcccttaagtgtcgggattgtcgcgtggtgtctcatcccgagtgtcgagataggtgtcccctgccttgcatcccaactttgattggaactcccgtcaaaattggggagggcatgctggccgattttgtaagccagacctcaccaatgattccttcaatcgtggttcactgtgttaatgagatcgagcaaagaggattgacggagacgggactgtataggatatccggatgtgacagaaccgtgaaggagctcaaggagaagtttctccgtgtcaagactgtgccgttgctgagcaaggtggacgatatccacgcaatttgtagtctcctgaaggatttcctgaggaatctaaaagaaccactgctgaccttccgattgaaccgcgcttttatggaagcggcagaaattacagatgaggataattcgattgcggctatgtaccaggctgtgggggagttgccccaagcaaacagggacactctggccttcctaatgatccatctacagcgagtcgctcagagcccccatacaaaaatggacgtcgccaatctcgctaaggtgttcggtccaaccatagtggctcatgcggtacccaatcccgatcccgttactatgctacaagacattaagcgccaacccaaggttgttgagcgtttgcttagcttgcctctagaatactggagccaatttatgatggtcgagcaggagaacattgatcctttacacgtgatagaaaactccaatgcattctcgaccccacagacccccgacattaaagtgtcccttctaggtccagtgaccacccccgaacatcagctcctgaagacaccatcttcttcatccttgtcccagcgagtgcgatccaccctgacaaagaacactccccgtttcggatcaaagtctaaatccgcaaccaatctggggcgacagggcaacttcttcgcatcacctatgttaaagtag

SEQ ID NO: 27920 - DNA, 12075 bp, Artificial Sequence
  Description of Artificial Sequence: Synthetic coding sequence
atgtcctccgagcaggataagtccgcgtctaaagagaagagcaaaaagcctgtccgctttctgccacagctgtcaatggaaaagctggcttctaaggaaaaatttaaggccccagctagagcactccctcaattaagcatggtatcaacaaagccgcattggcagcaggcagcaccctcatttcacttgagtgtgaagcaggacgacgaatcccccgaaccattctcagtcaagaatgagcaatcccatgccgaatatatggagcggtttggcaagaagggcaagctcccccaccaagtagacgactcgtacgtgggacctagcaccagcaaatctaaggggaaaagtccccataaagagagagaaaactttagaagcaccctggtgaatgtaattatgcagcaagatgcggatctggattctgcagttcctgatggttcaacaatccccaaacccacagcttcagccatcgagaaagacatcctccgctactattactatattcaccacggcattgatacagaccatgtcgccccaatggaagacagttggctggaacacgttttggacctggtcccccagcatctgaaggtctttacggattctatcgtgactctttctgatgaaatgcgggaagattacctactgtctgtgaggaaaagcattgtggactttgtgcttaaggacccccgtgagaaaggtgatgataagaaaactgacgagctgcccgcacaccgtgcagagatggaaatcctcccgaagccctggaggaagtccttcctcgccgcaagttcctatatccgtgaccacctaaatgctatgaatccaactatgctggccgttctcgacctctggcatactaacttcaagaaactgaggttagtggatatcaaagaattccataattgccaggatgcactggaattaagcagttttcagaatattattatgcgccatatggacagcgccaaggagacgcttctgaaaatgtggttccccgaggttcagaacatctattaccaggggaataagaagaagcaactgccaactggggattctagcgccaagctagaaagcttttttaattgtgccgctgccttgatgaccttacaacttcaagatctgacactggtatcgatgcaagactttactgatctcatcgcccagccacccgactccgtcagggcttttgaacatcctggctttatcatgcgcctgattctcgataacgatactatcaaattcgagcctgaactgagtgattatatcgatatcttcctcaacgtgtacgacgtaatgattaaggctgttagcttcgtacctcgcgtagagaccaagctgtattcaaaatgggaaagcaaaagcaaaccgactacactcaagccaattattcttaacgagatcgtcgatgcccataaggagaagataaaggaggttattatgaaggagtcagtcgcacccactgagcatttacgcttgtatgacaagtacgactttctgatcaccagaaaagcagaaagggatgtggataacttcctggccgagaatcattcatatgagaagatcatcgatgagatttgcaaataccagaagttaatcgaggaaatacaatatacatccatcaaaacgatcaggctgggcatgtttgagatgcactgtgaagaattgatacgggctctggttaagcgcgctgacatcatctgcggtaagctgttggccaaaatgttccgggatcaccaggaggttaacactagactgtgtgacgagtttgagcgcattgccgagaaagccctctccactcccccaaacactgctgaactcatggagatgaaggcctatattcagaaggtggaggtgacagacatgatcgagctggaacaacgacttgtggattcaaagaactgcctggcctttctcatagagtatgttaacttcagcccagcagatatgcggctgaacaattcagtgttccagtggtacgggcgtatgggagagatattcgaagagcacaggaagattatcaaagagaaaatcgaacagtatcaggagggcctaaagctgaggtgtgaaaggttcgtggaagaactggagtcctacgcaaagcagagtgaggaattttatagtttcggagatctgcaagacgtgcaaaggtaccttaaaaaggctcagattctgaatgggaaactggaccttgctgccgataaaatcgagcaattcaatgccgaggaggaagccttcgggtggttgccatctgtgtaccctcagagaaaaaaaatacaggacgggctgaatccctatctccggttatacgagaccgcggttgaattcagtagcaattacagggcctggacagaggggccttaccataaggtaaatccggaccaggtggaagcagatataggcaattattggaggggtctgtataagttggaaaagaccttccacgattcaccctacgctctagccatgactaagaaagtccgcagcaaggtggaagatttcaagcagcacattccactgatacaggtgatctgtaatccgggactgcgacctcgacattgggaggcgatgtcagccatcgtggggtaccctctccagccttctgatgactctacggtgagcagtttcctagacatgaatttagaaccatacatagatcggttcgagggaattagcgaggctgcctcaaaggagtatagtcttgaaaaggctatggagaagatgattacagagtgggacgctgtcgaatttgtgattcactcctacagggaaactggcactttcatcctagcctctgttgacgaaattcagatgttgctagacgatcatattattaagacccagaccatgcgagggtccccctttatcaagccctatgaaaaacaaatgagagaatgggaaggaaagctgctgctgttacaagagatcctcgatgagtggctcaaggtgcaagcgacttggctttatctggaaccaatcttctctagccccgacatcatgtctcagatgcccgaggagggccgtagatttaccgcggttgacaaaacatggcgggacattatgaggagcgtaatgcaggataagcacgtcctaaccgtagttaccattgacagaatgctggagaggcttaagaagagcaacgagctcctggagctgatcctaaagggcctgaatgaatatttagagaagaagagactgttctttcctaggtttttcttcctgagtaacgatgaactgctggaaatcctcagtgaaacgaaggaccccacccgtgtgcagccacacctcaagaagtgttttgaaggtatcgccaaggtcgaatttactgaaaccttggacattacccatatgaaaagctccgagggagaagtagtggagttaatcgaaatcatttccaccgccaaggccagggggcaggtcgagaaatggttggtggaactggagagagtgatgattaactctatccataaggtgaccggcgacgccacgttcgcctacaccaagtatgaacggattaactgggtgcgggactggcccggtcagacagtcctttgcgtctcgcagatattttggacaaaagaagtgcaaaccgccattcccatggggatcaaggccttggaacagtacctcaaaacatgtaataggcagattgacgatattgtcacccttgtacggggaaagttgagcatgcagaaccgtgtcacacttggggctctggtcgttctggacgtacacgccagagacgtcctctcatctctggttaagaaaaacatatctgacgacagtgattttgagtggttaagtcaactcaggtactactggcaggaaaatcatctggaaacgaaaatgattaacgccggactgcggtacggctatgagtacctgggcaattccccccgactcgttatcacgccgttgaccgaccggtgctatcggaccttattcggtgcactccacctccacctggggggagcaccggagggcccagccggaactgggaaaacagagacaaccaaggatctggcaaaggcagtggcaaagcagtgcgttgtcttcaactgtagtgacggcctggattatctcgcgcttggcaagtttttcaagggcctgctttcatgcggggcatgggcttgcttcgatgaatttaacaggattgacctagaggtgctctccgtcgtcgctcagcagattctaacaatccagcgcggtataaacgccggagccgatattctgatgttcgaaggcacagaactcaagctcgatccgacctgtgccgtgtttattaccatgaaccccggttacgccggtagaagtgagttgccggacaacctgaaagcattgtttaggacagtagcgatgatggtgcctgactacgcgatgatagccgagatcgttctctattcctgcggctttgtgactgccagaccattaagcgtgaagatcgtggccacatacaggctgtgctcagaacagctgtcaagccagcaccattacgactacgggatgcgggcagttaaaagtgtgctaaccgcggcaggaaatctgaagttgaagtatcctaatgagaacgaggagattctactcctgcggtcaattattgacgtgaacctccctaaattcctcagtcatgacctacccctcttcgaagggatcacatctgacctgttccctggggtcaaattacccaagcctgactacaatgatttgctcgcagccatcaaagataactgcgcctcaatgaacttgcagatgactgcctttttctctgagaaaattctacaggtctatgaaatgatgatcgtccgacatgggttcatgatcgtcggggagcccttcggcggaaagacatcagcttaccgcgtcttagctggggctctcaacgacatctgcgaaaaaggattaatggaggagaataaggttcagatcactgtgcttaatcccaagtccgtgacaatgggacagctgtacggacagttcgactcggtttcccacgagtggagcgatggagtgttagccgtgtccttccgcgcattcgctagttccgtcacacccgataggaaatggctgatctttgatgggccagtggatgcggtgtggattgaaaatatgaatactgtccttgatgataataagaagctatgcctaatgagtggtgaaataattcaaatgtcaccacagatgaatctcatcttcgagccgatggatctcgaagtagcatccccagccacagtatcaagatgcggcatgatctacatggagccacacatgctgggctggaggcctctgatgctgtcctgggtcaacctcctgccagcaagcgtcagtgtgattcagaaggaattcatcatgggactgttcgacaggatggtgcccgtatcagtggagttcataagaaagcacacaaaggaactgtcgcctacctccgacacgaaccttgtgcgctccctaatgaacctgatcgactgcttcatggatgactttgcagatgaggtcaagctcaaagagaggaacgaccgcgaaacatactccctcttggaaggcatcttcctattttctttaatctggagcgttggggcaagctgcaccgacgacgacagactgaagttcaataagatcctgcgggagctgatggagagcccaatttctgaccggactcgcaacaccttcaagctccagtccggcacagaacagacgagctcaaaggctctcacagtcccctttcctgaaaaggggactatctacgattaccaattcgtaacagagggaatcggaaaatgggagccctggatcaagaagctaaaggaagcccctccaatccctaaggacgtgatgttcaacgaaatcatcgtcccaacactggacacaatcagatattccgccctgatggaactgttgaccactcatcagaagcctagtattttcgttggccctacgggcaccggcaagagtgtgtatatcacgaatttcttgctgaaccagttgaacaaggagatctataaaccacttctgattaatttcagtgctcagacaacagctgcccaaactcaaaatatcgtgatgagtaaacttgacaaacggagaaaaggagtatttggtccgccacttggcaaaagaatggtggtgtttgtcgatgatgtgaatatgcccgctagggaggtctacggcgcacagccaccaatcgagttattacgccagtggttggatcattggaattggtacgacctgaaggattgtagtatgatcaaattggtagacatccaaatcatgtgcgccatgggccctcccggaggcggtcgcaatcccgtgacacctcgctacatgagacactttaacatcattaccattaatgaattctcagacaagtctatgtatactatcttcagcagaatactaacgtggcacctcgagatatgttacaagttccctgatgagtttctcgaccttacaacacagattgtgaatggtaccatgaccctctacaaggaggcaatgaagaacctgctccctacacccgctaagagtcactatctatttaatctacgcgacttctccagagttatccagggggtatgtctttccagacccgagacaactgagaccacggaggtaatcaaacgcctctgggtgcatgaggtgctccgggtttattacgatcgccttttggacaacacagataggtcctggctgattaactatatccaggagatcctgcgaaactatatgtacgaggattttcatgagctttttcagcgcctcgatttcgataacgatggaatggtggaggccgacgacttgaggtccttaatgttctgcgacttccacgatccgaaacgagaagatacaaactatcgtgagattgcagatgtagacaatttacgcatgattgtcgagatccacctggaagaatacaacaacatttctaagaagcctatgaatctggtgctgttcaggttcgcaatagagcatatcagtcgaatctcgcggatactgaagcagcccaggtctcatgctctcttggtcggcgtgggtggatctgggaggcagtctgtgacccgcctagctgcacacatggcagactactccgttttccaggtcgagatttccaaaggctatgacacaacagaatggcacgaagaccttaaggtcatcctgagaaaatgcgctgaaggggagatgcaaggcgtattcctgttcacagacacccaaatcaaggaggaatccttcttggaagacgtttccaatcttctgaatgctggagaaatccccaatctctttgcacttgatgaaaaacaagagatctgcgacaagatgaggcagctggaccggcagagagacaagactaaacagacggatggaagccccatcgccttgtttaatatgttcatcgatcattgtcgcagccagctccacgtggtcttggctatgtctcccattggagacgcttttagaaatcggctgcggaaatttcccgctctggtgaactgttgtactattgactggttccagtcatggcctgaagacgcactacaggctgttgcatcccggttcctggaagagattgaaatgtctgaagagattcgtgacggctgcattgacatgtgtaagtcatttcatacctccaccatcgacctcagcaaatccttcttcgtagaactgcagcgctacaattacgttacacctaccagctatcttgagctgatcagcacatttaaattgctgttagagaaaaagcgctccgaagtgatgaagatgaagaaaaggtacgaagtggggttggaaaaacttgattctgcatcctcccaggttgccacaatgcagatggaattggaggccctacatcctcagctgaaggtggcctcaaaggaggtcgatgagatgatgattatgatcgaaaaagagtctgttgaagtcgcaaaaactgaaaaaatcgtgaaggctgatgaaaccattgccaatgaacaggctatggccagcaaggccattaaggatgaatgcgacgccgaccttgctggcgctctgcctatccttgagagcgctctcgcagcactggacacgctgactgcacaggatatcacagtcgtgaagtcaatgaagtcaccacccgctggcgttaagctcgtgatggaagccatctgtatcctgaaaggcatcaaggccgacaagattccagatccaactggctctggcaaaaagatagaagacttttggggtccagcaaagcgtttgcttggggatatgcggttcctacaaagcctccacgagtacgacaaagataacattcctccagcatatatgaacataattaggaaaaactatattccaaaccccgattttgtgcccgagaagatccggaacgcaagcacagctgccgaaggcctctgcaagtgggtgatcgcaatggacagctacgacaaagtggctaagatcgtagcaccgaagaagattaagctggcggcagccgaaggagagctgaaaatcgcaatggacgggttgcgcaagaagcaggctgccttgaaggaagtgcaggacaaactcgcccgattacaggataccctggagctgaacaagcaaaagaaagccgatctcgagaaccaggttgatctgtgttctaagaagctcgaacgggcagagcaattgataggcggactggggggagaaaagactaggtggagccacaccgccttagaactgggacaattgtatatcaatctgactggggacatcctgatatccagtggggttgtggcttatctgggagcattcaccagcacttatcggcagaatcaaacaaaagagtggacaacactgtgtaagggaagggatattccttgtagtgatgattgctccctcatgggcaccctaggagaagcagtgacaatacgcacctggaatatcgcgggattacctagtgatagttttagcatcgacaacggtatcattattatgaacgcacgcagatggcccctcatgatagacccacagtctcaagctaacaaatggatcaagaatatggagaaagccaactctctctacgtgatcaaacttagtgagccagactatgtccgtacgttggagaattgtatccaatttggtacgcccgtgctgttagaaaacgtgggcgaggagctggaccctatcttggagcctctccttctgaagcagacctttaagcaaggcggaagtacatgcatcagactgggcgattctaccatagagtacgcaccagacttccgtttttatatcacgacaaaactgcgcaatccccactatctcccagagacttccgtaaaagttaccttactgaatttcatgataacacctgagggaatgcaagatcagctcctgggcatcgtcgtcgctcaggaacgccctgacttggaagaggagaaacaggcgttgatcctgcaaggcgcagagaacaagcgccagctcaaggagattgaagacaaaatccttgaggtgctctcctcttccgagggtaatattctggaggacgagacggccattaagatcctctctagttcaaaggcactggctaacgaaatatcacagaaacaagaggtcgccgaagaaacagagaagaaaatcgacacaacccgcatgggctacagacctatcgcaattcattcctctatactgtttttttcgttggccgacttggcaaacatcgaaccaatgtatcagtatagcctgacctggttcattaaccttttcatcctaagcatcgagaatagcgagaaatcagaaatcctcgcgaaaaggctgcagatcctaaaagatcacttcacatacagcttgtatgtgaacgtgtgtcggagcctgtttgaaaaggacaaactgctgttctccttctgcctgacaataaacttgttactacacgaacgagctatcaataaggcagagtggagattcttactgactgggggtataggcctcgacaacccctacgcaaatttgtgtacctggctgccacaaaaatcctgggatgaaatctgtagattagacgatctgcccgcttttaagaccattaggcgggagttcatgaggctcaaggatggatggaagaaggtgtatgactctttggagcctcaccacgaggtcttccctgaagagtgggaagacaaagcaaacgagtttcagcggatgcttattatacggtgtctgagacctgataaagtgattccaatgctgcaggagtttattatcaatcgtctgggacgcgctttcatagagccacccccattcgaccttgctaaagcatttggagattcaaattgctgcgcaccactgatatttgtgctcagcccaggagcggatcctatggccgctctcctgaaatttgccgacgaccaggggtacggagggtctaagctcagctctctttcattgggacaagggcaaggacccatcgcgatgaagatgctcgagaaagccgtgaaggaagggacttgggtggtactccaaaattgccacttggcaacatcctggatgcccaccctcgagaaggtgtgtgaggagctttcccccgagagcacgcatcccgactttcggatgtggttaactagctacccaagcccaaacttccccgtgagcgtgctccagaacggggtgaagatgacaaacgaggcccctaaagggttgcgtgccaacatcattcgaagttacctaatggaccccatttctgatcctgagttttttggtagctgtaagaagcccgaggaatttaagaagttactgtacgggctctgcttcttccacgccctcgtgcaggagcgacgaaaattcggtccactcgggtggaatataccctatgagtttaatgagaccgaccttagaatctcggtgcagcaactccacatgtttctcaatcaatatgaagaactgccttatgaagctcttcggtatatgacaggggagtgtaattacggcggacgcgtcaccgacgactgggacagaaggacactgaggagtatactcaataagtttttcaaccctgagcttgtggagaattcagactacaagtttgatagttcaggcatctatttcgtgcctccctctggtgaccataagtcttatatcgaatacaccaaaaccttgccactgacacctgctcccgaaatctttggcatgaacgccaatgccgacattacaaaagaccagtcagagacccaactcttgtttgataacattctgctgacccagtcaaggtccgccggagcgggtgccaagtcaagtgatgaggtcgtgaatgaagttgccagcgacattctgggaaagctccctaacaacttcgacatcgaggcagccatgcggaggtacccgacaacatacacacaatccatgaacaccgtattagtacaggagatgggaagatttaacaagctcctgaaaacgattagggatagctgtgtgaacatccagaaagcaatcaaaggcctcgccgttatgtcgaccgacctggaggaggtggtgtcgagcatcctcaacgtgaagattccggagatgtggatgggcaagtcttaccccagccttaagcccttaggtagctacgttaacgacttcttggcgaggctaaagtttctgcagcaatggtacgaggtgggacccccacccgtgttctggctaagcgggtttttttttacccaggcttttcttacaggcgcacaacagaattatgcacgaaaatatacaatccctatcgacctactcggctttgattacgaggtcatggaagataaagagtataaacacccgccagaggatggagtctttatccatggattattcctggacggggcttcatggaaccgcaagatcaaaaagctggccgagagccaccccaaaattctctatgataccgtgcccgtaatgtggctaaaaccatgcaaacgcgcagacatccctaagcggccttcttacgtggccccactttataagacaagtgagcggagaggcgtgctgtccaccacaggacattctactaattttgtcattgcaatgacgttgccatctgatcagcccaaggaacattggatagggaggggcgtggcactgctttgccagctcaactcctag

SEQ ID NO: 27921 - DNA, 1506 bp, Artificial Sequence
  Description of Artificial Sequence: Synthetic coding sequence
atgagctctcgacaggacaaaagcgcatccaaagaaaagagtaaaaagcccgtgcgctttctgccacagctgtcaatggaaaaattggcctccaaagaaaagttcaaggcacctgctagagcgctgccccaactgagcatggtgagtactaagccacactggcagcaggcagctccttcctttcatctttctgtgaaacaggacgatgagagtccagagccctttagcgtgaaaaacgaacagtcacatgcagaatatatggagcgctttgggaaaaaaggcaagttgccacatcaagtcgatgatagctacgttggcccatcaaccagcaagtcaaaaggcaaatcacctcataaagaaagggaaaatttccgctctacacttgttaacgtgattatgcagcaggatgctgacctcgattctgccgtgcctgacgggagcacaatcccaaagccaaccgcatccgcaatcgagaaagacatcctccgatactattactacatacaccatggcattgacaccgatcacgtggcccctatggaggattcttggcttgaacatgtgctagacctcgtcccgcagcacttaaaggtgttcacagatagtattgtaacactgagtgatgagatgcgagaggattacctgctgtccgtgcgaaagtcaattgtggacttcgtgctaaaggaccctcgcgagaagggcgatgacaagaagacagatgaacttcctgcacatagggcagaaatggaaattttgcccaagccctggcgtaagtcattccttgctgcctcatcgtatatcagagatcatttaaacgctatgaatcccacaatgctcgccgtcctggacctgtggcacaccaatttcaaaaaattgaggctggtcgacatcaaagagtttcacaattgccaggacgcccttgaattgtccagcttccagaatattattatgcgccatatggactctgcaaaggagaccctgctcaagatgtggttcccggaagtgcaaaatatttattaccagggcaataaaaaaaaacagcttcccaccggggatagcagcgcaaaactagaatcattctttaattgtgcagcagccttaatgaccctgcagcttcaggacctcactctggtgtccatgcaggactttactgaccttatagcccaacccccagatagcgtgagagcgttcgaacaccctggtttcatcatgagacttattctggataacgacactataaaatttgagcccgaattatctgattacatcgacatattcctgaacgtgtatgatgtgatgatcaaagcggtaagtttcgtgcccagggtggagacaaagttgtactcgaagtggagaaataaggccaagccgggacacttttatttttcgcacatccaacgttctgtgaccttccagcacagcgaagtcagttcaccccagaacagccactttaaaattgtgtcaccatttagcgtgttgggcttcacgtggcgttgccagctctag

SEQ ID NO: 27922 - DNA, 840 bp, Artificial Sequence
  Description of Artificial Sequence: Synthetic coding sequence
atggcagctcctgttcgccgaaccctgttaggggtggccggagggtggcgccgattcgagagactctgggccggtagcctgtccagccgttcactcgcgctggccgctgccccttcatccaatggttcaccctggagactgctgggggcattgtgtttgcaaagacctcccgtggtgagcaagccgctgacccctctgcaagaggagatggccagtcttcttcagcagatcgagatcgagcgttccctctattcagatcacgaacttagggcacttgatgagaaccaaagacttgctaagaaaaaagccgacctccatgatgaagaagacgaacaggatattttgctcgctcaagacctcgaagatatgtgggaacaaaagtttcttcaattcaaattaggagcaagaatcaccgaggctgacgagaaaaatgatagaacctcccttaatcgcaaactggacaggaatctggtgctgctggttcgagagaagttcggtgatcaggacgtttggattctgcctcaggctgagtggcaacccggagagaccctgcgtgggaccgctgaacggactttggcgacactgtccgagaataatatggaggctaaatttctcggcaatgccccttgcggtcattacacattcaagtttccgcaagctatgaggacagagtcaaatctgggcgctaaggtttttttcttcaaggcactgttgctcacaggcgatttttcacaggccggaaataaggggcatcacgtgtgggtgacaaaggatgagctcggggactacctgaaacccaagtaccttgctcaagttcgacggttcgtgtctgatttgtag

SEQ ID NO: 27923 - DNA, 609 bp, Artificial Sequence
  Description of Artificial Sequence: Synthetic coding sequence
atggaggctgaggctggtggcttagaggaactcactgacgaagagatggcagctctgggtaaggaggagctggtcagacgactgcggcgtgaggaggccgctaggctggccgctctggtacagagagggaggctgatgcaggaggtcaatcggcagctgcaggggcatctcggcgagattcgagagctgaagcagcttaaccgaaggttgcaagcagagaatcgcgagctccgggatctttgctgcttcctggacagcgagcgtcaaagagggcgacgagccgctagacagtggcagctgtttggtacacaggccagccgggctgtgcgcgaggacctgggaggttgctggcagaagttggccgagctggaggggcgtcaagaggagctcctaagggagaacctggccctgaaagaactctgtttggcattaggagaggaatggggccctcgcggagggccaagtggggcaggcggatctggtgcagggccagcacccgagctggcgctgcctccatgtgggccacgggacctgggggacggctcgtcatccacaggaagcgtcgggtcacctgaccagctgcccctggcctgctcacccgatgactag

SEQ ID NO: 27924 - DNA, 1353 bp, Artificial Sequence
  Description of Artificial Sequence: Synthetic coding sequence
atgcgcgagtgtataagcatccacgtgggacaggcaggggtccaaatcggaaatgcctgttgggagctatactgccttgaacatggaatccaacctgacggccagatgccttccgacaagaccatcgggggtggggacgattccttcaatacgttcttcagcgaaacaggtgctggaaaacatgtccctcgagccgtgttcgtggatctcgagcccaccgtagtggacgaagtgcgtacgggaacatacaggcaactctttcaccctgaacagttgatcaccgggaaagaggacgctgccagtaactacgcacgcggtcattacactataggcaaagaaatcgtcgacttagtactcgatcgcatcaggaagctggccgatctctgcacgggactgcagggctttttgatctttcattcattcgggggaggcaccggatctggattcgcatctctgttgatggagcgtctgagcgtcgactattctaagaaaagtaagcttgagttcgcgatttacccagcccctcaggtttcaaccgcggttgtcgagccatacaacagcatcctcacaacacatacgactctggagcatagtgattgcgctttcatggttgataatgaagcaatctatgacatttgccgcaggaatcttgacattgagcgaccaacgtatacgaacttaaatagactgattggccaaatcgtgtcttctattacagcaagcctgaggtttgacggtgccctgaacgtcgatctcaccgaatttcagaccaatcttgtgccttatcccagaattcacttccccctcgctacttatgcacctgtgataagcgccgagaaggcataccacgagcagctttccgtcgcagaaattaccaatgcatgtttcgagcctgctaaccagatggttaagtgcgatcccaggcatggcaagtatatggcctgctgtatgttgtatcggggagatgtcgtccccaaagatgtgaacgcagccatcgccaccattaagactaaacgtacgatccagtttgtggattggtgtcccacaggattcaaagtcgggattaattatcagccaccaacagtcgtgcctgggggagatcttgcaaaggtccagcgggcagtgtgcatgctgagtaatactaccgcaatcgctgaggcgtgggctcgtctggtacacaagtttgaccttatgtacgcaaagtgggcctttgtccactggtacgtcggtgagggcatggaggagggtgaattttcggaagcgagagaagacctggccgctcttgagaaagattgcgaagaagtgggcgtagattccgttgaggctgaggccgaggagggtgaagcttactag

SEQ ID NO: 27925 - DNA, 3078 bp, Artificial Sequence
  Description of Artificial Sequence: Synthetic coding sequence
atggtagctatggcagaggcggaggccggtgtcgccgtagaggttcgaggactcccccctgctgtcccagacgagcttctgaccctttacttcgaaaatcgacgccgtagcggcggtggaccagtgttaagttggcagcggctgggttgtggaggggtactcaccttccgggaacctgcggacgccgaacgtgtcttggctcaagccgaccacgagctacacggggctcagctttctctgcgacccgctcccccaagagccccagccaggttactgctgcaggggctgcccccaggcacgactcctcaacgcctggagcaacatgtgcaggcactactgcgcgcttctggtcttcctgtgcagccatgttgcgctttggcaagcccaaggccagaccgagccctggtgcaactgcccaagccgctcagcgaagctgacgtgagggtgcttgaagagcaagcacagaatttgggtctcgagggcacacttgtgagtctggctcgggttccccaggctcgcgcagtacgggtggttggcgatggggcttctgttgacttgctgttgctcgagctgtacttggaaaatgaacggcgaagcggcggagggccactagaggatttgcagagactcccaggccctctgggcaccgtggccagctttcagcagtggcaggtggcagagcgcgtgctgcagcaggaacacagactgcaaggctctgagctgtctctggtgccacattacgatatcctggagccagaagagctcgcggaaaatacctcaggcggtgaccacccaagcacgcagggccctagagccaccaaacatgccttactgagaactggaggcctggttaccgcactgcaaggagccggtactgtgaccatggggtccggcgaggaaccaggacagtcaggagcgtccctccggacagggcctatggtgcagggacggggaatcatgaccacaggaagcggccaggagcctggccagtctggtacgtcattaaggactggtcctatggggagcctcggccaggccgagcaggtgtcatccatgccgatgggatcacttgagcatgagggactggtgtcactccgacctgttgggttacaggagcaggaaggacctatgtctctcggaccagttggctccgcgggaccagtggaaacatccaaaggcctcctgggtcaggaagggctggtggaaattgctatggattcaccagaacaagaaggactggtggggcctatggagatcaccatgggcagcttggagaaggcaggccctgtgagccccggatgtgtgaaactcgcaggccaggaaggcctcgtggagatggtcctgctgatggaacccggtgccatgagatttcttcagctgtaccacgaagatcttttggctggccttggggatgttgcactgctgccactggaagggcctgacatgacaggattccgcttgtgcggcgctcaagcgagttgtcaggccgcagaggagtttctccggtcccttctggggagtatctcctgccatgtgctctgcctggagcatcctgggtccgccagatttctccttgggccagaaggccaacacctgctccagggtctcgaggcccagttccagtgcgtcttcgggaccgaacgcctggccactgccacccttgatacaggcctcgaagaagttgaccccacagaagccctgcccgtgctcccagggaacgcgcacacactgtggacacccgactctaccggcggagaccaggaagatgtgtccttagaagaagtgcgtgagctgctcgccaccttggaggggctggatctggatggggaggattggcttccaagggaacttgaagaggaaggaccacaggagcagccagaggaagaggtgacaccaggccacgaggaagaggagcctgtggccccttctactgtggccccacggtggctggaagaagaagccgcactgcaactggctctgcacaggagtctcgagcctcagggacaggtggccgaacaggaggaagccgctgccttgagacaggccctcaccctctctctgctggagcagcctcccctggaagccgaggaacccccagatggagggacagacggaaaagcccagttggtggtgcactcagcctttgaacaagatgtcgaggagctggaccgagcccttcgggcagccctagaagtccacgtgcaggaggaaaccgtgggcccatggcgacgcaccctgcccgctgaactccgggcacggcttgaaaggtgtcacggggtgagtgtagctctgaggggagattgtaccatcttaaggggcttcggggctcatcctgccagggctgctcggcatctggtcgcgctgctcgctggaccttgggaccagagtcttgccttccccctggctgcctccggcccaacactcgcgggacaaacccttaaaggcccttggaacaatctggaaaggttagctgagaatacgggcgaattccaggaggttgtgcgggcattctacgatactttggatgcagccaggagttcaattagggtcgtcagggtcgagcgggtctcacaccctctgctccagcaacaatacgaactatatcgcgagcgactcttacagcgttgtgagagacgacccgtagaacaagttctatatcacggcactactgcccctgccgttccagacatctgtgcccacgggtttaatagaagcttttgcgggaggaatgctactgtctacggtaaaggcgtctattttgcacggagagcctccctgtctgtgcaagaccgctactctccacctaacgcagatgggcataaggccgtttttgtcgcacgcgtgctgacgggagactatgggcagggaaggaggggactgcgagccccacctctgcgcggacccggtcacgttctcctccgatacgacagcgcggtggactgtatctgccagccttctattttcgtcattttccatgacacacaggcactccctacccatctcattacatgtgaacacgttccccgagccagccccgacgacccttcaggcttgcctgggaggtcccccgatacgtag

SEQ ID NO: 27926 - DNA, 390 bp, Artificial Sequence
  Description of Artificial Sequence: Synthetic coding sequence
atgagtcatctgcagtctctactcctggatacactactcgggactaagcacgtggactccgctgcactgattaagattcaggaaagaagcctgtgtgtggcttctcccggttttaacgtgactcccagcgatgttagaacacttgtaaacgggttcgcgaagaaccctctccaagccaggcgcgagggcctttatttcaaggggaaagattatcgatgcgtcagggcggatgagtacagtctgtacgcgaagaatgagaatacgggcgttgttgttgtgaagactcacctgtacctgttggtggcaacatacactgagggcatgtaccctagtatctgtgtggaggccactgaatctctcggagactatctgaggaagaagggctcctag

SEQ ID NO: 27927 - DNA, 945 bp, Artificial Sequence
  Description of Artificial Sequence: Synthetic coding sequence
atgttgggtaaaggcggaaaacggaagtttgatgaacatgaagacggactcgaggggaagatcgtttctccttgcgacggcccttccaaagtctcttatacactgcagaggcagacaatcttcaatatctctctaatgaaactgtataatcataggcccctcaccgagccatctcttcaaaaaactgtgctgatcaacaatatgttgcggaggatccaggaggagctgaagcaggagggcagtctgcgacctatgttcacaccctcaagtcagcctaccaccgagcccagtgatagttatagggaggccccacccgctttctcgcatctggcctccccaagcagccatccttgtgacttgggatcaacaactccacttgaagcctgtttaactcctgcctccctgctcgaggacgatgacgacacgttctgtacaagtcaagcaatgcagccaaccgctcctacgaagctcagccctcctgctctgctccccgaaaaggactcatttagcagcgcgttggatgaaatcgaagagctttgtcccacgtctacatcaacggaggccgcaaccgcagcaacggactctgtgaagggaacgtcatctgaagccggtactcagaaacttgatggaccccaggagagccgcgctgacgattctaagctcatggacagtcttcccggaaattttgaaatcacaactagcactgggttcctgaccgatctgaccctggacgacatcttatttgcggacatcgacacgtccatgtatgatttcgacccatgtacttcgtctagcggcaccgcttccaagatggctcctgtcagcgcagatgacctgctgaagacactggccccttactcatcacagccagttacaccttcccagccgttcaagatggatttgacggagttagatcacataatggaggttctggtcgggtcatag

SEQ ID NO: 27928 - DNA, 246 bp, Artificial Sequence
  Description of Artificial Sequence: Synthetic coding sequence
atgaaaggctctcgcatagagctcggcgatgttacccctcataacatcaaacagctgaagagactgaaccaagtcatttttcctgtgtcatataatgataaattttacaagaagttcgggtttgagatcatagaaacgaagaagaattattacaaaaggattgaaccggctgacgcacatgtattacagaagaacctgaaagtcccttcaggacagaatgccgacgtgcagaaaaccgataattag

SEQ ID NO: 27929 - DNA, 1437 bp, Artificial Sequence
  Description of Artificial Sequence: Synthetic coding sequence
atggcgtccgcaactgaggacccagtactcgaacgatactttaaaggccataaagcagccatcacctctctcgacctctcccccaatggcaagcaactggccacagcaagctgggacacctttctgatgctgtggaacttcaaacctcacgcaagagcctatcggtatgttggccacaaagacgttgtcacctccgtgcagttttcaccacacgggaatcttctggcaagtgcctctagggaccggaccgtcaggctctggattccggacaagcgtggcaaattttctgaatttaaggcacacactgctcctgtcaggagcgttgatttcagtgccgacgggcagtttctcgccactgcatccgaggacaagtccatcaaagtctggtctatgtaccgacagcgattcttgtactctctgtatagacatactcactgggtgcggtgcgcgaaatttagtcccgacggacgtctgatcgtctcttgctctgaagataagactatcaaaatctgggatactacaaataaacagtgtgtgaacaactttagcgattccgtgggctttgccaattttgtggatttcaacccctccgggacctgcatcgcgtcagcgggaagtgaccagacggttaaggtctgggatgtacgggtcaacaagttgttgcagcactaccaggtgcactccggcggagtcaattgcatatctttccatcctagcggaaactacctgattacggcatccagtgacggaacccttaagattctggatctgctcgaggggcgtttgatctacacactgcaaggtcacaccggaccagtttttaccgtcagctttagtaaagggggtgagctgtttgcatccggaggcgctgatactcaggtactcttatggcgtactaacttcgatgagctccactgtaaaggcctgaccaagcggaacttaaagcgcctgcacttcgactcccctccacacttgcttgacatatatccccgtactcctcacccacacgaagaaaaggttgagaccgttgagatcaatccaaaactggaagttattgacctccagatctctacaccacccgtgatggacattttgtcgtttgattctacaaccacgaccgaaacttcaggacggaccctccctgataagggcgaagaagcctgtggatactttcttaaccctagcttaatgtctcctgagtgccttcccaccacaactaagaagaaaacggaggacatgtcagacttaccgtgcgagtcccagcgtagtatccccttggccgtcactgacgccctcgagcatattatggaacagctgaacgtgctgactcaaaccgtttcaatcctcgagcaacgtttgacattgaccgaggacaaattgaaggactgtctggagaaccaacagaagttgtttagcgctgttcagcagaaaagttag

SEQ ID NO: 27930 - DNA, 1263 bp, Artificial Sequence
  Description of Artificial Sequence: Synthetic coding sequence
atgcttaaggcagttatcttaatcgggggtccccagaagggtacacgtttccgtcccttatcttttgaagtcccaaagccactcttcccggttgccggagtgccaatgattcaacatcacatcgaagcctgcgcccaagtcccaggtatgcaggagatcctcctaattggattttaccaacctgatgagcccctaactcagtttctggaggctgcccaacaagagttcaacctcccggtccggtacctgcaggagttcgcacctcttggcactgggggaggtctatatcactttcgcgatcagattcttgctggaagccccgaagccttcttcgttctgaacgccgatgtatgctccgactttcctttgagtgcaatgctcgaggcacacagaagacagaggcaccctttccttctgctcggcaccacagccaaccgaactcagagtctcaattatgggtgcatagtcgagaatccgcagacccacgaagtgcttcactatgtggagaaaccttccacatttatctctgatataatcaattgtgggatctatctcttcagccctgaggcactgaaacccttgagggatgtgttccagcgaaatcagcaggacggccagcttgaagatagcccaggtctgtggcctggggcaggaactatcagattggaacaggacgtgttctctgccttagcaggtcaagggcaaatttatgtgcatcttactgacggtatatggagccaaatcaagagcgctggatctgcactgtatgcgtctcgtctgtatctgtctcgatatcaagacactcaccctgaacgactggccaagcatactcccggaggcccttggattcgcggaaatgtgtacatacaccccaccgctaaggtggccccttcagccgtgcttgggccaaacgtgtcaatcggcaagggcgtcacggtgggggagggcgtgcggctgcgagagtcaatcgtgcttcacggcgcaacgctgcaggagcatacgtgcgtcctccactccattgtcggctggggatccaccgtgggccgatgggctagggtcgaaggcactccctcggaccccaaccctaacgatccaagggccaggatggattctgagtccttgttcaaagatggaaaattgcttccagccatcaccattttggggtgcagagtgcggatccccgctgaggtacttatactgaactccattgtgcttccgcataaggagctgtcaaggtccttcacgaaccagattattctctag

SEQ ID NO: 27931 - DNA, 1215 bp, Artificial Sequence
  Description of Artificial Sequence: Synthetic coding sequence
atggaccaggattacgaacgcagactgctgagacaaatcgtcattcagaatgaaaacaccatgccgagagtgaccgagatgagaagaacactgactcctgcttcttctccagtgagttccccaagtaagcacggtgaccgattcatccccagcagagcaggtgctaactggtccgtgaacttccaccgaattaacgaaaacgagaagagtcctagtcagaacagaaaggctaaggatgcaacctctgacaatggcaaagatggcctggcatatagtgctctgctgaagaatgaattactaggggctgggattgaaaaggtccaggatccgcagacggaggatcgcagattgcagccttccacccccgaaaagaagggcctttttacggttacccgtttatgcgacctttccgtcgaaggagactctgttacatcggttggctggagcgaacgaggcaatctggtagccgttggaacccacaaggggttcgtccagatctgggatgccgctgcaggcaaaaaattgagcatgctcgaaggtcacacagcacgagtgggagctctggcctggaatgccgagcagttaagctctggttctcgggatcgcatgatcctgcagagggacattaggaccccccctctccagagcgaacgcaggctccaggggcaccgacaggaggtctgtgggctcaaatggagcacagaccaccagctcctcgcctcagggggaaatgataataagctgctggtgtggaaccattcttctctgtctcctgtgcaacagtataccgaacacttagccgctgtgaaagcaatcgcttggagccctcatcaacacggattactcgcctcaggcggaggcaccgccgaccgctgcattcggttttggaacactctgacaggccagccgctgcagtgcatagacacaggctcacaggtttgcaacctggcctggtcaaagcacgcaaacgagcttgtaagcacccatggttactcccagaatcaaatcctcgtttggaagtaccccagcttgactcaagtagcaaagctgaccggccacagctatcgggtgctgtatttggctatgtctccagatggcgaggccatcgtcactggcgcaggcgacgagaccctacgtttctggaacgtgtttagcaagactaggtctactaaagagagcgtgtcggtgctcaacttgttcacacgcatccgatag

SEQ ID NO: 27932 - DNA, 5892 bp, Artificial Sequence
  Description of Artificial Sequence: Synthetic coding sequence
atgaagcagcggaagggacaagggtccggtggaagccgagggagaaaaaaacggggtctctctgacatttctccctccacttccctgccacctttggttgagggacagctcagatgttttttgaagctaacggtgaatcgggttatttggaagatagctaaaccccctacatgcgttctagtgcgcgtcagatggtggggtgagactagcgatgggacccttttttgccctagggatgctttacagacagaaccgaaagctgtacgcacaaccacgaggtacgctatcagatgtggaccaaagcagttcaccagctacctgaccgacatggcggtcttggtacttgaggttattaccaagttggatggattgcctatcggaagggtacaaatcaacggcctggcacagctctcccccacacaccagatcaatggcttcttcacaatcgtgagcagcacctccaagaagcttggagagctgcaggtgagcctggctctggagccactaagcgagacttacgatagctatcacccacttccaactacagacatgaccgaaaacgtcctgctgtccaagcagggcttccgagaaaacacggaaccttctagcacccagtttcaggtgccgagtagaccacgcgatatacatactataaagattgacggcaaagaattagccgctaactcaagcagaagtaccacgcccagaggtaaagatcatgtgtgcttcgccgaaaatccggacactatcaaagatagctccttcggccttcagcactcgcttaacagtggccagagcctggagtccgtgacacttaaaggtcgggcaccaagaaaacagatgagtctcctgaattcctccgagttccagcctcagattcggactgtggccaagtctcactccgattcttgtattttaagcagcaacaatctccctacgaaggacttgctttcagcactgctcgagcagggcaataagctgagaaatgctatggttatcagcgctatgaagagtagcccagaaacatctatgctgctggaccaggtgcatcctcccatcaatgaagacagtctgagggccagcacccagattagggccttctcccggaatcggttcaaggatcatatcgaagatcacttgctgccgtccactgagaacacgttttggagacatgatacgaaagctgataccagggccattcagctcctgcttggcagcgcagagttgtctcaggggaacttttgggacggactgggcagccctcccgactccccatctcctggttctgatgtatattgtatatctgagcttaatgatccccagtacgatcagtccctcttagagaacctgttttacactgctcccaagagcgatacttcgataagtgactttctttcggaggaagacgacatcgtccccagcaagaaaattagccaatctaccgcgctcgcgaggtcaagcaaagtgttagaaagcagcgaccacaagctcaagaagcggagtgctggaaagcgaaatcgcaaccttgtcgaacagcagatgttgagcgaaactccagaagacgcccagacaatgacgctgagtgtggacaggctggcactactgggccgaacccatagcgtgcggatcattatagagactatgggggtgcccccagacagccctcaaatgactccagggaagaagtcatacgccggacccccacctaaagtgacaactgctaagaagagaacattcttcgtagagtatcacttcccggtaggcttttctgagagcggccttggcaagacggcactgatcaccgaagtcgtaaggctcgcttcatccaagattaccgatggcaaagtgaagttccagcagcgcttcgtctttcccgtccagtttgggggtccgatgatcgaacactggtggaactccaacttaaccttccaaatctatgtcaagaaaactccccagaagaagcccgaagtaatcggctctgtatccctatccctgagggccgtgattcagtctgaactcctctcattctccgaccagctgcccgtgcaacaagagaatggccagagcccctttgggccactcaaagtgaccatggagctcatcactgacaacaaggacttcactggcataaatactaagctgagtgggaacactcactataccccattgtgtgcccctactagccctaacaaagctcttcccgaactcaaccaggatatgacttgcactaaaaacccacagaatctaaatcaaatacacgaggagaccgccaaaaaggcccagaacctggttctgcctaacagaaagtcaccttctcccgtcgccccacacccatctacattcgtcgctacacctgcttcacacaatctggttaaccagaccaacggtactacgaaggaatctgctcttcttctgcacgtcttgttgatggtccccgatggaaaggattttatcagcggtgaatctgagaaacagagtccatgtaacgtctatttgaactgtaagttgttcagtacagaagaagtgacccgatcagtgatcgcctggggaaccactcagcctgtcttcaacttctcacaggtgatacctgtgtccctctcctcaaaatatctggagcgtctgaagaacaacgtcatggtgatagaaacttggaataaggtgcgcagcccaggccaggataagctgctagggctggtaaagctgcccctgcaccagttttatatgagctttaaagacgcaaagatctccaggttgcttcttgacgcgcagtacccagtggtggctgtggattcttacatgcccgtgatcgacgtgtttagcgggcaccaaaacgggagcttgagggtgttcctggctatgggctcttccaatcagatcatggctctgcagagattgaagaacgaggagggcacactgccgcctttctcacccaggcccgctcattttcttgatcagccaactgccgcttccgtggcgatggccgaggaccggggtaacggactcatggaacactgcttcgagatccacatagaaatggtaaaaggcctggctccacttcaggccacggtgtggggcgaagccgattgctatgtgcagtattatttccctgtacagcacagtcagtccagcgtccttaaagggccagaattcctagaaaatggcattactcttaagcccttccggaccgcgacaaccctgtgtgtccctgatccgatcttcaattccgagcatcaccactcactgttgttgccagccgaagtccccgttcaacggttgctcctgtctgccttcagcgcacagggcttagtgccaggcggaggggttcagttcgaaatatggtgcagatactactatcctaatgtgagagaccagaaagtcgctaaagggacacttcctctttctagaatttgtgctatggttacaacccagcatagagaggacgtgggaatacaaacgttcaacctgccactcaccccacgtatcgaaaatcgcaaagagctgagaaaccagagctcaggcctgctggacgtaggcttgcgctaccgaagaagtccgaggaccgcagaaggggtacttgctgccagaacggtcagtatatcggtgcaaattattcgagcctgcgggctacaggccgctgctaaagccctggcagaaagagagcctgcccttcagttctctgccaccgtcggtgtaaacgcttctgtcacaacccatctgagttttttaccgcagggggaacagaggcgaacccaccctgttgcctgctccttttgcccggagttttcccaccatgtcgagtttacctgcaatctcgttacccagcattgctccggtgaggcttgcttcctggcagaacttctggaatttgcggaagtcatttttgccgtctatcatgaaaacaccaaatcagccagtgacatcattagcattgagtcatgcaaggagtatctgctaggggtcgtaaaggtgcctacaaaggaactcttaattaagcggtctggcataactggatggtatcccatcatcctcccagaggatggagggctgccccacggcctagaactaatgcagaaaattgtgggagggcttgaactgagtatcagttttacacacaggggtgatagggagagggtattggaagctgctgagcatctgggatggagttttgagaattctctgaaggactttgtgcggatggatgagggcgagccagcaacagtgactatcagtaccccaaggctatggttacccattcattgcgtactgctcgcgggtcataaccacattcacaagaacacgtattgttatctccgctataagttctacgatcatgaagcattttggaccccactgaaaaaacccaaggaaagcgtgaacaagaaacaaattatggtcacttttaaagcaagcaaacgtgccgaagttacacggggaccgagccttctgtggtatttcagggaagagcgtctggaaatacaggtgtggagggcgtacggcaatgacagcgttgaacgcccacaccagacagacagctggatagggtctgcatatgtcgacttagcaagactcggggagagatctgcacggactctgactgttagtggagtataccctctgtttggacgtaacgcatcaaatctctcgggggctgcacttcgcgtgcacgtggtgctttcttcacttagcagtcatttggaacctacacacgaactcgacagcatggactgttcatcccacagcgaaagcgaacagctgcccaggagaaacgatgaagtgcagctgtctcctccagaagtgatttcgtgtcaccagaagtcgcctgctagtacccaggtgccgtgcagttccacaacagcagaagtccggctcacacaagaaggcccagcagatctcgatggcacattcgccgtgagcattctggtggagcgagctatgcacctctctctgaaagggtcacccctgactgaacgtaaggtgtcaatcccctcatgctgcgtgagctttgctactgctgatgagagctctccagtgtatacccaggtcgtggagaacactgactcgcctatatggaattttcagcagcaatcaaggttatcaaaggagctcttgctcgaccctcagcagactctggtgtttaaggtatggcacaaaggtgacgaggaaagggttatcgggtttgcatcagtggacctctcccctctgctgtctggttttcagttcgtttgtgggtggtataacatcacagacttttctggggaatgccagggtcaaatcaaggtggccgtatctcccctggagtcccttattcatttcaaggaggaaagacaagccaggcgaggggtggaaacaagcaagagcctgatccctatttactcaccattctcctttcctgcttccgatacatacgccgcattcagctcacatatggctagacagacactggaccaactggcccacgcaagctctaaggaattagactttagcagcccgggtcgtagcgacaccacgagatctcaggcctcccggcacgaagagcatgtgcagaacatcaggcgcttccatgagtccctacatctgcagggcgaggcccctctgccttgtgatgataagcttacaacctctcccctctcatcacaaacaagtattcttacaagcctgcgtaaaaacctgagcgagctcgaccaaatccagcggtattttcgacagaagcttacgaaaccttttctgcctctgtcccctcagacacagacggccatctcccaacatcaggaaagctgtcgggaccaccttggaccaggagcaagctccttagatcctgggagccagtgcatcctggaaaagtcatcaaatctggtgctccaggtgtcatcactcatcaccgggtcctattat

SEQ ID NO: 27933 - DNA, 5586 bp, Artificial Sequence
  Description of Artificial Sequence: Synthetic coding sequence
atgaaacagcgtaagggacaaggatctggagggagtaggggtcgcaagaagagaggactgtccgatatttcccccagcacctccctgcctcccctcgtcgaaggccaattacgatgtttccttaaactcaccgttaacagggtgatttggaagatcgcaaagccacccacctgtgtgttagtgagagttcgctggtggggtgaaacgagtgacggtactctgttctgccccagagatgcactgcaaacagagccaaaggcggtgcggaccacgacccgctacgctattagatgtggccctaagcaatttacttcgtacttaacagatatggcagtactcgtgctggaggttattacaaaacttgacggcctgccgataggcagagtgcagattaatggtctggcccaattgagccctactcaccagattaacggattttttactattgtctcttccacaagcaaaaaactcggtgagttacaggtgtcccttgctcttgaacctctatcggagacctatgacagctatcacccgctccctaccacagacatgactgagaacgttctgctgtccaaacagggtttccgggaaaatactgagcccagcagtacacagttccaagtgcctagccgcccacgggacatacacaccatcaaaatcgacgggaaggagctggccgctaactccagcagaagcacgaccccaagagggaaggatcatgtctgctttgccgaaaaccctgacacaataaaggattcatccttcggcctccagcattccttgaattctggtcagtcccttgaatcagtcacgctcaagggcagggctcctcgaaagcagatgtcattactcaacagctcagaatttcaaccccaaatccgcacagttgcaaagtcccattctgactcatgcatactcagctcaaataatcttcccactaaagatctcttaagtgccttgttagagcaagggaacaagctgcgcaacgcgatggtcatttccgccatgaaaagttcacctgagacctctatgctgctagaccaggtgcacccacccattaatgaggactcattgcgagcaagcacccaaattcgggctttttccagaaatcgctttaaggatcatattgaggaccacctgctcccttcgaccgagaacaccttttggagacacgatactaaggccgacaccagagcaatccagctgcttctcggcagtgcagaactcagccaggggaatttctgggatggcctcgggtctccaccagattccccttcgccaggatccgatgtttactgcatcagcgagctgaatgacccccagtacgaccagtcccttctcgagaatctgttctatacagcaccaaagtccgacacgtccatctccgatttcctcagcgaggaagacgacatagtccctagtaagaagatatcccagagcactgccttggctcggagttcaaaagtgctagagtcgagcgaccataagctgaagaagagaagtgcgggaaaaaggaataggaatctagtggagcagcaaatgctgagtgaaactcctgaggacgcccagacaatgactctgagcgtcgatcggctggcactgctaggacggacccatagtgtcagaatcatcatcgagactatgggggtgcctccagacagcccccagatgacccccggaaaaaagagctatgccggaccaccaccaaaggtaaccacagctaaaaaaagaactttcttcgtggaatatcattttccagttgggttctctgaatccggtctaggcaagacagcactgatcacggaagttgtgcgcctagccagctccaagatcacagatggcaaagtgaaattccagcagagattcgtcttccctgttcagttcgggggtccaatgatagagcattggtggaatagcaatttgacttttcagatttacgtgaaaaagaccccccaaaaaaagcctgaggtaatcggctctgtgagcttgagcctgagagcggtgatacagagtgagctgttatctttttcagatcagctgcccgttcaacaggaaaacggccagagcccatttgggccactcaaggtcactatggaactgatcacagataacaaggactttactggcattaataccaaactctcaggcaacacacactacacccccctctgcgccccaacatcccctaacaaggccttgcctgagttgaaccaggatatgacctgtacaaagaatccacaaaacctgaatcagatacacgaggagaccgctaagaaggctcagaacctagtgctgccaaacaggaagtctccatccccggtcgccccacacccttccacttttgttgccacacctgcctcgcacaatcttgtgaaccagacgaacggtaccactaaggaatcagctttgctgctacatgttcttctgatggtccccgacgggaaagatttcatttctggagagagcgagaaacaaagcccctgcaacgtttatttgaattgcaagctgtttagtaccgaggaggtaacgcgttctgttatagcctggggcactactcaacctgtgttcaatttctctcaggtcatcccagtctcactgagttccaagtatttggaaaggctaaagaacaacgtcatggtgatagaaacttggaacaaggtgcgatcccctggtcaggataaactcctgggcctggtgaaactgcctctgcaccaattttatatgtcattcaaggacgccaagattagcaggctcctattggacgctcagtaccccgtcgtggccgtagactcatatatgcctgtgatcgacgtcttttccggtcatcagaatggatccctccgcgttttcctggccatgggatcgtcaaaccagatcatggcccttcagagacttaagaatgaagagggaacattacccccattcagtcctagacccgcacactttctcgaccagcctactgctgcctccgtggcgatggccgaagatcgaggcaatggcctgatggagcattgcttcgagatccacattgaaatggtgaagggccttgctccattacaggcaaccgtatggggcgaggctgactgttacgtgcagtattacttcccggttcagcacagtcaaagttctgtgctcaaaggccctgagttcctggagaacggcatcacgctgaagccctttaggacagcaactacattatgcgtgcctgatcctatctttaattcagagcaccaccacagtctgctgctgcctgctgaggtccctgtccagcgccttttattgtctgcattctcagctcaaggccttgtcccagggggtggtgttcaattcgagatttggtgtcggtattattaccccaatgttcgtgaccagaaagtggcgaagggaaccctgccgctgtctcggatttgcgcaatggtgacaacgcaacacagagaggacgtgggaatacagaccttcaacttgcccctcacacccaggatcgagaacaggaaggagctgaggaatcagtcatccggcctgctcgacgtaggtctacgctatcggaggtctccacggactgctgagggcgtgctggctgcccgaacagtgtctatcagcgtgcagatcataagagcatgtggcctgcaggctgcagccaaggcactcgcagagcgcgagcccgctttgcagtttagcgccacagtaggagtaaacgcctcagtgactacccacctgagtttcctgccccagggtgagcagaggcgcacacatcccgtcgcttgttcattttgcccggagttctcacatcacgtcgagttcacctgcaatctggtcacacaacattgctctggagaggcttgcttcctggccgagctgctggaattcgccgaagttatttttgccgtttatcatgagaacacaaagtcagcgtcagatattatatcgatcgaatcttgcaaagagtatctgctgggggtcgtcaaagtcccaacaaaagagctgctgatcaaacgcagtgggattaccggttggtatccgattattttgccagaggacggagggctgccccacggcctggagctgatgcaaaagattgtcggaggtctagaacatctcggctggtcctttgagaatagtctgaaggactttgtgcgtatggacgaaggagagcccgcaacggtaaccatcagcactcctaggctttggttgcctattcactgcgttctgctcgcagggcataaccatatccacaagaatacttattgttacctgcgatacaagttttatgatcatgaggctttttggacacccctcaagaaaccaaaagaaagtgtcaataagaagcagataatggttacatttaaggcctccaaacgggcagaagttaccaggggtcctagcctactatggtatttcagagaggagagacttgaaattcaagtatggagagcttatggtaatgattctgttgaacggcctcatcaaaccgattcctggattggatccgcctacgtcgaccttgctcgcttgggcgaacggtcagcacgcacattgacggtcagcggtgtataccctctgttcggcagaaacgcctctaatttgtctggagccgcactccgcgtgcatgtggtcctgtcttctctgagctcccatctagaacccactcatgagctggacagtatggattgcagttcgcacagcgaatccgagcagttgcccagacggaacgacgaagtccagctatccccgccagaagtcatcagctgccatcagaagagtcccgcatccacgcaagttccctgctccagtacaactgctgaagtcaggctcactcaagagggccctgctgaccttgacgggacctttgcagtctctatcctcgtggagcgggctatgcacctgagtcttaagggcagccctctgaccgagaggaaggtgagcatcccttcatgctgcgtgagctttgcgaccgcagatgagtccagccctgtctacacccaggttgttgagaacacggactccccaatctggaactttcagcagcaaagcagactgtctaaggagctgctactagatcctcagcagacgttagtcttcaaggtctggcataagggtgacgaggagagggtgatcggctttgcaagcgtggacctgtctcccctgctgtctgggttccagttcgtgtgcggttggtacaatattacagatttttctggggagtgtcagggccagattaaggtggcagtcagccccctggaaagcctgatacacttcaaggaagagcgccaggctcgacgaggggtggagacaagtaaaagcctcatccctatttattcgcccttctcatttcccgcttcagatacatacgccgcattcagctctcacatggctagacagactctggaccagttagctcacgcgtcgagcaaagaacttgatttttccagccccggtcgcagtgatacaacccggtcacaggcttcgagacatgaggagcacgtccaaaatatcagacgctttcatgaatccttgcatcttcaaggcgaagccccactcccctgcgatgacaagctgaccacctctccgctatcttctcagacttaa

SEQ ID NO: 27934 - DNA, 1131 bp, Artificial Sequence
  Description of Artificial Sequence: Synthetic coding sequence
atgctcacttttcttcagcagttgcgcgtggattggcccgctgccagtgagcgagcttcgagccataccctcagaagccatgctttagaggagctgacgagcgccaatgacggcagaaccctcagtcctggcatcttggggaggctctgtttgaaggagctcgtagaagagcagggacgcactgcgggttacgaccctaacttagataactgcctggtgacagaggatttgctgtccgtgctggcagagctgcaggaggcattatggcattggcccgaagattcccaccctgggctcgccggagcatccgacacagggactgggggatgtcttgtcgttcacgtggtcagctgcgaggaggagttccaacaacagaaattagatttactgtggcaaaaactggtggataaggcaccacttagacaaaagcatcttatatgtggcccagtcaaagttgctggagctccaggcacgctgatgactgcacccgagtattatgagttccggcatacacaggtttgtaaagcatccgcgttaaagcacggaggtgacctcgcccaggaccccgcttggaccgaaattttcggcgtgttgagtgtagcaactattaagtttgagatgctgagcaccgcacctcaaagtcagctgttcctggccctggccgatagctcaatatcaaccaaaggcacgaagagcggcacatttgtgatgtacaattgtgccagactggccacacttttcgagtcctacaagtgctcaatggaacaaggactgtatccgactttccctccggtttccagcttagatttttctctgctacatgatgagggcgaatggctcctcctgtttaatagcattctcccctttccggacttgctatcccgtaccgccgtgctggattgtaccgcaccaggtttacatatcgccgttcgcactgagatgatctgtaaatttctcgtccagctttcaatggatttcagcagctactataatcgcgtgcatattttgggagagcccaggccccacctatttggccagatgtttgtaagactccagctgttgcgagcagttcgtgaggtcctgcatacaggtctagcgatgctgggcttaccacccctgtctcacatctag

SEQ ID NO: 27935 - DNA, 1572 bp, Artificial Sequence
  Description of Artificial Sequence: Synthetic coding sequence
atgaaccagccctgcaattccatggagcccagggttatggacgatgacatgttgaagctagctgtgggggatcaggggccacaagaggaggccggacagctcgctaagcaggaaggcattcttttcaaggacgtgttgagcctgcagctggatttccgcaacatcttacgtatcgataacctgtggcaatttgaaaacctccgcaagctccaacttgacaacaacatcatagaaaagatcgagggactggagaatcttgcccacttagtttggttggatctctcgtttaataacattgagacaatcgaaggtctcgatacattggttaacttggaagatttgagcttattcaacaacagaattagcaaaatcgatagccttgatgccctggtgaaattacaggtgctgtctctcggaaacaatagaattgataacatgatgaacatcatctacctcaggcggttcaaatgcctcaggacgctgtctctctccaggaaccctatcagcgaggcagaagattacaagatgtttatctgtgcctacctcccagacctgatgtatcttgattatagaaggattgatgatcacacaaaaaagctagctgaggcaaagcatcagtatagcatcgacgagctgaagcatcaggaaaatttaatgcaggcacagctcgaagatgagcaggcccaacgcgaagaactcgagaagcataaaaccgcatttgtggagcatctcaatggatcctttctcttcgatagtatgtatgccgaggattctgaaggcaacaaccttagttacctgccgggtgtgggggaacttctggagacttacaaagataaattcgtgattatttgtgtgaacatcttcgagtacggactcaaacagcaggagaaaaggaagaccgagcttgatacctttagcgaatgcgtaagggaggccatacaggaaaatcaggaacaggggaagaggaaaatcgcgaagttcgaggagaagcatctgagttctctctcagccattagggaagagcttgaactgcctaatattgagaagatgattctggaatgttctgcggacatctcagagctgttcgatgccctaatgacgctggaaatgcagctcgttgaacaactggaagagactatcaacatgtttgagagaaacatcgttgacatggtgggcctctttattgagaatgttcagtccctgatggcgcaatgtagagacctggaaaatcatcatcatgaaaagctgctggagatcagcatcagcacgctcgagaagattgtagagggtgatctcgatgaagatctgccaaacgatctcagggcactatttgttgataaagatacaattgtcaatgcggtgggtgcgagccacgatatccatttattgaagatcgacaacagagaagacgagctggtgacccggattaattcttggtgcacaaggttaattgatcggatccataaagacgaaatcatgagaaaccggaaacgggttaaagaaataaatcaatacatcgatcacatgcaaagcgaactcgacaacctcgagtgtggcgatattttggactag

SEQ ID NO: 27936 - DNA, 1680 bp, Artificial Sequence
  Description of Artificial Sequence: Synthetic coding sequence
atgaaggtcatcacctgtgaaatcgcatggcacaacaaggagcctgtatatagtctcgatttccagcatggaaccgccggaaggatccaccggctggcatccgcgggtgttgatactaatgtgcgtatatggaaggtggaaaagggaccagacggtaaggctattgtggaatttctcagtaacctggccagacacacaaaggccgtaaacgtggtaagattcagtcccaccggcgaaatcttagcgtctggaggcgacgacgccgtgatcctgctctggaaagtgaatgacaacaaggaacctgagcaaatcgcttttcaagatgaagatgaagcgcagctcaataaagagaactggaccgtagtgaaaacgctcagaggtcacctggaagacgtgtacgatatttgttgggctactgatggtaacctgatggcttctgccagcgtggacaacaccgccatcatttgggatgtgtccaagggtcagaaaatctcaatctttaacgagcataaaagttatgttcagggggttacgtgggaccccctggggcaatatgtggcaactctcagctgcgatcgcgtgctgcgtgtgtatagcattcagaaaaagcgggttgccttcaacgtatcgaagatgctcagcggcatcggggcagagggcgaggcccgaagttatcgaatgtttcacgacgatagtatgaagtcatttttcagacgcctgtctttcaccccagacggctctctgctgctgactccggcaggttgtgtagaaagcggcgaaaacgttatgaacacgacctacgtcttcagccggaagaatctgaagcggcctattgcccacctcccctgccccggaaaggctaccttagccgtaaggtgctgccctgtctacttcgagctccgaccagttgtggagacaggagtggagttaatgtcactcccctaccgcttggtatttgctgtggctagcgaggattctgttttgctgtatgatacccagcaatcatttcccttcggttacgtgtcgaacatccactatcatacgctgagcgacatttcctggtcttccgacggagcatttctggctattagctctaccgacggatactgcagctttgtgacatttgagaaagatgagctcggcatcccactaaaagaaaaacccgtgttaaatatgcgcacccctgatacggcaaagaaaaccaagagtcagacccacagaggtagttccccgggaccaaggcccgtcgaaggtactcctgcttctcgtacccaagatccgtcctccccaggaactactccacctcaggcgaggcaggcaccagcacccacggtgataagagacccccctagtattacccccgcagttaagagtcccctgcctggaccttccgaggagaagacactgcagccgtccagtcagaacactaaggcacatccctcaaggagggtgaccttgaatactcttcaggcttggtcaaaaactactcctcggaggataaatctgacaccccttaagactgatactcctccctctagtgtgcccacatcagtcatctctactccatccactgaggagatccagtctgaaacacccggtgatgcacagggatctcccccagagctcaagcggcctcgcttagatgagaacaaagggggtaccgaaagtttggatccctag

SEQ ID NO: 27937 - DNA, 1527 bp, Artificial Sequence
  Description of Artificial Sequence: Synthetic coding sequence
atggccgacggtcaggttgccgagctgctccttcgccgattggaagcgtctgatggaggcctggattccgcagagctggcagcagagttggggatggagcatcaagccgtggtgggggctgtgaaatccctccaggcacttggagaagtgatagaagctgaactgcgcagcaccaaacactgggaattaaccgccgagggcgaagaaatagccagggaaggctctcacgaggccagagtgttccggtctattcctcctgaagggctcgctcagtccgagctgatgagactcccatcaggtaaagtgggtttttccaaagcaatgtctaataagtggatcagggtggacaagtcagccgcagacggaccacgcgtcttcagggtggtggattctatggaggacgaggtgcagcgaagacttcagcttgtcagagggggacaggctgagaaattaggggagaaggaacgatccgagttgaggaaaagaaaactcctcgcggaagtcaccctgaagacatactgggtcagcaaaggttctgcattttccactagcatcagcaaacaggagactgaactctcgcctgaaatgatatcatccggaagctggcgcgaccgtccttttaagccctacaattttctggctcacggcgtgctgcccgactcaggccacctacacccactgctgaaagtgcggtcccagtttcggcagatcttcctggaaatgggcttcacagagatgcctaccgacaacttcattgaatcttcattttggaattttgacgcactgtttcagccacagcagcacccggcaagagatcaacacgacacattctttctcagggatcccgctgaagccttacagctgccgatggattacgtgcaaagagtgaagcgtacgcactctcaagggggttacggatctcaggggtataagtataattggaagttggacgaagccaggaaaaatctcttacgtacccataccacctcagcgagcgctcgtgccctgtatcgcctggcccagaagaagccttttacacctgttaaatattttagtattgaccgtgtgttccggaatgagaccctcgacgcaacccacttggccgagtttcaccagatagagggcgtagtggctgatcacggactcacactcgggcacttaatgggtgttctcagggaattcttcacgaagctggggatcactcagctcaggtttaagccggcttataatccttacacagaaccttctatggaggtcttttcctatcaccaaggcctgaaaaaatgggtggaagtgggaaactccggagtgttcaggcccgagatgctgctcccaatgggtcttccagagaatgtgagcgtaattgcctggggcttatcattggaacgtcccacaatgatcaagtacggcattaataacattagagaactcgtgggacataaggtgaatctgcagatggtgtacgacagtccattgtgcagactggatgcagagccccgacctcctccaactcaggaagctgcctag

SEQ ID NO: 27938 - DNA, 1203 bp, Artificial Sequence
  Description of Artificial Sequence: Synthetic coding sequence
atgtcgtcaccattggcatcattgagcaagactcgcaaggttccactacctagtgaacctatgaatccgggtcggaggggtatccggatctacggagacgaggatgaggtcgatatgctttctgatggttgcgggagcgaggagaagattagcgtgcctagctgctatggtggcataggcgctcctgtcagtcgccaaggtgattcgttggcgcctcccgaggtcgactttgaccggctcctggcttcacttcaggacctgtccgagctggtggtggagggagacacccaggtgaccccagtgcccggaggcgctcggctccgcacccttgaacctatcccattgaagctgtataggaacggaatcatgatgtttgatgggcctttccagcccttttacgacccaagtactcagcgctgcctgagggacattttggatggattttttccatccgaacttcagcgcctttatcctaacggcgttccatttaaagtgagtgatctgcggaaccaggtttacctggaagacgggcttgatcctttccccggtgagggcagagtggtaggcagacaactcatgcacaaggcattggacagggtggaggagcaccccggtagcaggatgacagcagagaagtttctgaaccgcctgcctaagttcgtgatccgacagggggaagtcatcgatattaggggaccaatcagggatacactccaaaactgctgccctcttccagccagaatccaagagatagtggtggaaactcccacgctggccgctgagcgggagcggtcgcaagaatcaccaaatactcccgcacctcccctgtctatgctgcgaattaaatctgagaacggagagcaggccttccttctgatgatgcagccagacaacacaatcggcgacgtgcgggctctgcttgcccaagctcgtgtcatggatgcgagtgccttcgaaatattcagcaccttccctcccactctgtaccaggacgacaccctcactcttcaagccgcaggcttggtcccaaaggccgcactcctgctccgcgcaagacgggctcctaagtcatctttaaagttctcccccggaccctgccctggtcccggacctggaccttcacctggcccaggtcccggtccctcacccggtcccggtcctggcccaagcccctgtccaggccctagtccgtctccacagtag

SEQ ID NO: 27939 - DNA, 1350 bp, Artificial Sequence
  Description of Artificial Sequence: Synthetic coding sequence
atggctagcgcgctcagacctcccagggtccccaaacccaagggagtcctgccttcccactactacgagtccttcctggagaagaagggcccatgtgacagagactataaaaagttttgggctggcctgcaaggcctgaccatctacttttacaattccaacagagacttccagcatgtggaaaagctaaatctaggcgctttcgaaaaactgacagacgagattccgtggggctcatcacgggatcccggaacacatttttccctcattctgcgcgatcaagagataaagttcaaggtagagaccttggaatgcagagaaatgtggaagggattcatcctcactgtggtggagctgagggtaccaacagatctaaccttgttgccagggcatctttatatgatgtcagaagttttggctaaagaggaggcgagaagagccttggaaacaccatcttgtttcctgaaagtgtccaggctggaggcccagcttctccttgaacggtatcctgagtgtgggaacttactactaagaccctcgggcgacggagccgatggggtgtcggtgacgacacggcaaatgcacaatgggactcacgtggttcgtcactacaaggtgaagcgagaagggccaaagtatgtcattgatgtggagcaacctttcagctgtacaagtctggatgctgtggtgaattattttgtgagccacactaaaaaggccttggtcccatttttgctcgacgaagattatgagaaggtgttaggatatgtcgaggccgacaaggaaaatggagagaacgtttgggtcgccccttctgctccaggacctgggccagccccatgtacaggcggacctaaacccttgagcccagcgtcatcccaggataaactccctccacttcctccactgcccaatcaagaggagaactatgtgacacctattggagacggacccgcagtggattacgagaatcaagatgtggctagctcatcctggccagtgattttaaaaccaaagaaactccctaagccgcctgctaagctgccaaaaccaccagtgggacctaagccagtcgagaagggattccatcacgttgcacaggccggactggagctcctcacttcatcagatccacctacctctgcatcgcaaagcgccggaatcaccggcgtgagtcaccacacgtggccccacctgagcagtctccctgaacccaaggtcttcaacggaggcctcggacgcaagctgcccgtgtcatctgcgcaacccttattcccgacagcgggactggctgatatgacagctgagctgcagaaaaaacttgaaaaaagacgtgccctggaacactag

SEQ ID NO: 27940 - DNA, 1239 bp, Artificial Sequence
  Description of Artificial Sequence: Synthetic coding sequence
atggatcccattagatccttttgtgggaaactgagaagcttagcctccacactggactgtgaaacagccaggctccagcgtgccttagatggcgaggagtccgatttcgaagactatcctatgcgcattctttatgacctgcacagcgaggtgcagaccctgaaggatgatgtgaatatcctcctggataaagcccgtctggagaaccaggagggaatcgatttcatcaaggctaccaaagttttaatggaaaagaacagcatggacattatgaagattagggaatatttccagaaatatggttactcccccagggtaaagaagaatagcgtgcacgagcaggaagccatcaacagcgacccggaactttctaattgcgaaaacttccagaagaccgacgttaaagacgacttgtctgatcctccagtagcaagctcctgtatttcagaaaaaagccctcgctcaccgcaattgtctgattttggactcgagcgctatatagtgagccaagtgctgcctaatccacctcaggcagtcaataactacaaggaagagcccgtcatcgtaacgcctcccaccaaacaatctcttgttaaggtgctcaagacccccaagtgcgctctgaagatggatgattttgaatgcgtaacaccaaaactggagcacttcggaatctcggagtataccatgtgtctcaacgaggactacactatgggactcaagaacgccaggaataataagagcgaggaagcaatcgatacagagagtaggctgaacgataatgtgtttgccacccccagcccaattattcagcagctcgagaagtcagatgctgaatacacaaattctccacttgtccctacattctgcactccaggactaaaaataccgtctacaaaaaacagcattgctcttgtcagtacaaattatcccctgtcaaagactaactcctcttcaaatgatctcgaagtggaagatcgaacgagcctggtcttaaattctgatacatgcttcgaaaatcttaccgacccttcctcacccacaatctcttcatatgagaatttgctgcgtaccccgacacctcctgaagttaccaagatccctgaagacatattacagttacttagcaaatacaattcaaatctcgcgactccaatcgccataaaggctgtgccaccttccaaacgattcctcaaacacgggcagaatattagagatgtcagcaacaaagaaaactag

SEQ ID NO: 27941 - DNA, 2583 bp, Artificial Sequence
  Description of Artificial Sequence: Synthetic coding sequence
atgacagagggcaccaagaagacctccaaaaaatttaagttctttaaattcaagggctttggttccctctctaacctcccgagatctttcacactccggaggtcttccgctagcatctctaggcaaagtcaccttgagcctgatacttttgaggcaacgcaggacgatatggttactgttcctaagtcccctccagcctacgccagatcctcagatatgtattcgcatatgggcacgatgcctcgacctagtatcaagaaggcccagaatagtcaagccgcaaggcaggcccaggaagccggaccgaagccaaacttagtgccaggaggggtccccgatcctcctggcctcgaggctgccaaagaggtcatggtaaaggccactgggcctttggaggatactccggcaatggagcccaacccatcagcggtggaggtggaccctatacggaagcctgaggtgccgacgggagacgttgaggaggaacgcccaccgagagatgtgcatagcgaaagggcagcaggagaaccagaagctggcagtgattacgtgaaattttccaaagagaagtacattctggacagctcacctgagaagcttcacaaagagctagaagaagaactgaagctatctagtacagacctgagatcccacgcctggtaccacggcagaatccccagggaggtgagcgaaacactcgtgcagaggaacggcgattttctgatccgtgatagtctcacgtcccttggagactatgtactgacgtgcagatggagaaaccaggctctgcacttcaaaatcaacaaggtggttgtaaaggccggagaatcttatacgcacatccagtacctctttgaacaagagtccttcgatcacgtgccggcactcgtaagatatcacgtgggatccagaaaagccgtctccgagcaatcaggggctatcatttactgccctgtcaacaggacctttccgcttcgatatctggaggccagttatggcttgggacaaggttcaagcaaaccagcctccccggtgagcccgtccggcccaaagggttcccatatgaagcggagatctgtgactatgacagacggcctcacagcagacaaggtgactagaagtgatggatgtccaacctcaaccagcctccctagacccagggactctatcaggagctgcgcccttagcatggaccagatccctgatctgcacagccccatgtccccaatctcagagagcccctcatcgcctgcatatagcacggtgacaagggtgcacgccgctcccgcagctcccagcgcaacggcactacccgcttccccggtggcacggagatcatcagaaccccagctgtgtcccggtagcgcccctaagacacatggcgaatccgacaaaggtccccataccagcccttcccatacccttggaaaggccagcccatctccttctctgtcttcctattctgaccccgattctgggcactactgtcagctgcagccacctgtcaggggatccagagagtgggccgctacggaaacatctagtcaacaagccaggagctacggggagaggttgaaagagttatctgagaacggggctcccgagggcgattggggaaagaccttcacggtgccgatagttgaggtcacgagcagcttcaatccagcgacctttcagagtctgttaatccccagagataacagacctctcgaggtgggcctgttgcgtaaggttaaggagctgctggcagaggtggatgcccgaacactggctagacacgttactaaggtcgactgcctggtggccagaatcctgggtgttacaaaagaaatgcaaactttgatgggagtgcgttggggcatggagctcctcacattaccacacggccgtcaattacggctggaccttctagagagattccacaccatgagtattatgttagccgtcgacattctgggttgtacaggatcggcagaagagcgcgctgccttgctgcataaaaccatacagctggctgcggaactgagaggaacgatgggcaacatgttttccttcgccgcagtgatgggcgctctcgatatggcgcagataagccggttggagcagacgtgggtaaccttgaggcagcgccataccgaaggagcaatcctatacgagaagaaactgaagcccttcctcaagagcctgaacgaggggaaagaggggccacccttaagcaacaccactttcccacacgtgttgccgttgatcaccttgctcgagtgcgactctgcccctcctgagggtccagaaccttggggtagcacagaacacggggtggaagtagtgctggcacacttggaggcagcacgtaccgtggcccaccatggcggtctgtaccacacaaacgccgaggttaaactgcagggattccaggccagacctgagctgttagaagtgtttagtacagaattccagatgcgcctcctttggggttcccagggagcctccagttcacaggcaaggaggtatgaaaaattcgacaaggtgctgacggccctgtcccacaagctggagcctgccgtacgctcctccgagctttag

SEQ ID NO: 27942 - DNA, 573 bp, Artificial Sequence
  Description of Artificial Sequence: Synthetic coding sequence
atgaccgtcccatggaggccgggaaaaaggagaattacttacaaggaggaggaagatctgactctccagcccagacctgcctctagcgcccctgaaagcctggtggggttacaggaaggcaaatcaacggaacagggaaatcacgaccaactgaaggagctatattctgcgggaaatctgactgtgcttgcaaccgaccctctgttgcatcaagatccggtgcagctcgattttcattttcggcttacaagccaaacgtccgcccattggcacggactcctgtgtgaccggagactgtttttggacatcccttaccaggcactcgatcaaggcaatcgggagagtctgacagccacactagaatacgttgaagaaaaaaccaacgtggactcggtgttcgtgaatttccagaatgaccgtaacgaccgcggtgcgttgctgcgcgctttcagttacatgggcttcgaagttgtgcgtcccgaccatcctgcccttcctcctctcgataatgtgatctttatggtttaccccctggagcgcgacgtagggcacctccccagtgagcccccatag

SEQ ID NO: 27943 - DNA, 1527 bp, Artificial Sequence
  Description of Artificial Sequence: Synthetic coding sequence
atggcaacagattggctcggatctatcgtgtccattaattgtggcgactcactgggcgtgtatcaggggagagtgtctgcagtggatcaggtgtcccaaaccatctcgctcacaagaccttttcacaatggtgttaaatgcttagtgcccgaggtgacattccgggctggtgatattacggagctgaaaattctggaaattccgggacctggagacaaccagcacttcggcgacctgcatcagaccgaactgggccctagcggtgccggatgccaagtggggattaatcaaaatggaactgggaagttcgtgaagaaacctgcaagcagcagctccgccccacaaaatataccgaagcggaccgacgtgaaaagccaggatgtcgctgttagcccccagcagcaacagtgctccaagagctatgttgataggcacatggaatctctgtctcagagcaaatcttttcggaggcgccacaattcttggtcgtctagctcgagacaccccaatcaggccaccccaaagaagagtggtctcaaaaatggccagatgaagaacaaagatgacgaatgtttcggggatgacatcgaggagattcctgatacagatttcgactttgagggcaacctagccctttttgacaaagctgccgtttttgaagagatcgacacgtatgaacgccgaagtggcacaagatccaggggaattccaaatgaaaggccgacgcgatatagacatgatgagaacattctggaatccgagccaattgtgtatcgcaggatcatcgttccccacaacgtctccaaagaattctgcactgacagcggcctcgtggtgcctagtataagttacgaacttcataaaaaactgctgtccgtagctgaaaaacacggactcaccctcgaaaggcgtctggagatgacaggagtctgcgcctcgcagatggcacttaccctgctgggcggtccaaataggctgaaccctaagaatgtgcatcagaggcctaccgtagcgctgctgtgcggcccacacgtgaaaggagcacaaggaatctcttgcggccgtcacctggccaatcacgacgtgcaggtcatcctgttcctccccaacttcgttaagatgctagagagcatcactaacgagctgagtctttttagcaaaacacagggccagcaagtgtcatccttgaaagacctgcccacaagccccgtggaccttgttataaactgcctggactgtcctgagaacgtcttcttacgcgatcagccttggtataaagcagccgtggcatgggcgaaccaaaatagagccccagtgctgagcattgatccccctgtccacgaggtggaacaagggatagacgcaaagtggtccctagccctcggcctgccattacccctgggtgaacacgcaggacgtatctacctgtgcgacattgggatcccacaacaggtgttccaggaggtagggatcaattaccactcgccgtttggatgtaagttcgtgatcccattgcattccgcatag

SEQ ID NO: 27944 - DNA, 1158 bp, Artificial Sequence
  Description of Artificial Sequence: Synthetic coding sequence
atgggccgttggtgccagacggtcgctagaggtcagcggccacggacaagcgccccatcccgtgccggagctctgctattgctcctcctcctgctcaggtcagccggttgctggggagccggagaggcccctggcgcactctcgaccgccgaccccgcagaccagagtgtccagtgcgtacccaaagctacatgcccgtcttcgaggccacggctcctgtggcagaccccaactacccagactctgcctagcactactatggaaacccagtttccagttagcgagggcaaggtggacccctaccgatcatgtggattctcatatgaacaggacccaacactccgggacccagaagcggtcgctagaagatggccttggatggtttctgttcgagctaacggaacacacatttgcgcgggtactatcattgcttcccagtgggttctcaccgtcgcccactgtctgatctggagagacgtgatttactctgtcagggtcggctctccttggatcgatcagatgacacagactgcatctgacgtccccgtgctccaggtgatcatgcatagtcgatacagagcccagcgtttctggtcctgggttggccaggccaacgacatcgggctactgaagttaaaacaggaattgaaatattctaactacgttagaccaatctgtctacctggaacagactacgtcctgaaggaccattctagatgcactgtcaccgggtggggcttaagcaaggctgatgggatgtggccgcaatttagaacgatccaagaaaaggaagtgattatcctgaataacaaagaatgcgacaatttttatcataacttcaccaagattcccacactggtccagatcataaagagtcaaatgatgtgcgcggaagacactcacagagagaagttctgttacgaattgacaggggagcctctcgtctgctcaatggaaggcacctggtacctagtgggcctggtgagctggggagccggatgccagaaaagtgaagctcctcccatatatcttcaggtgagttcttaccaacattggatttgggattgcctgaacggacaggcactggcacttccagctcctagccgcaccctgctgctggccctgccgttgcccttgtcgctcctcgccgctctgtag

SEQ ID NO: 27945 - DNA, 750 bp, Artificial Sequence
  Description of Artificial Sequence: Synthetic coding sequence
atggtggaccgtctggccaactctgaggcgaatacccgaaggatctccatagttgaaaattgttttggagctgctgggcagcctctgaccattcccggaagggttctgatcggggagggggtcttgactaaactttgtaggaagaaacctaaagctcgacaattctttctcttcaacgacatcctagtatacggtaatatcgtcattcagaaaaagaagtataacaagcagcacattattcccctggagaatgttaccatagattcgatcaaggatgaaggagatctgcgcaatggttggctgattaagactcccactaaaagttttgccgtgtacgcggctacggccaccgaaaagagtgaatggatgaaccacatcaacaaatgcgtgactgacctgctgtcaaagtcagggaaaacaccctctaacgagcacgcagctgtgtgggtccccgactcggaagctaccgtgtgtatgcgttgccagaaggccaaatttactccggtgaaccgcaggcaccattgtcggaaatgcggtttcgtagtgtgtggcccttgttctgaaaagcgtttcctgctgccttcccagtcaagtaaacctgtcagaatttgcgacttctgctacgacctgctctccgcgggagacatggcgacctgccagccggcaaggagcgacagttactctcagtcactgaaatccccactaaacgacatgtccgatgatgacgacgatgacgactctagcgattag

SEQ ID NO: 27946 - DNA, 2745 bp, Artificial Sequence
  Description of Artificial Sequence: Synthetic coding sequence
atgggcgatagtcgtgacctgtgcccccatctcgactccatcggtgaagtgactaaagaggacctgttacttaagagtaaagggacctgccagtcttgtggcgtgactggacccaacttgtgggcctgcctgcaagtggcatgcccttatgtcggctgcggagaaagttttgcagaccactctaccattcacgcgcaggcgaagaagcataatttgactgtgaatctgacaaccttcagactctggtgttatgcctgtgaaaaggaggtgttcttggaacagcgcttagctgcccctcttcttggtagcagtagcaaatttagcgagcaagactcccctcccccttcacaccccctgaaagccgtacctatcgccgtggccgacgagggggaaagtgagtctgaggacgatgacttgaagcctcgagggctgactggcatgaaaaacttaggcaacagttgctatatgaacgccgcattgcaagctttgtcgaattgtccacccttaacgcagttcttcttggagtgcggaggactcgtgcgcaccgataagaaacccgcactgtgcaagagctatcaaaagctagtcagcgaggtttggcataagaagcggcctagctacgtcgtgcctacttccctttctcacggaataaagctggtcaatccgatgttccgaggatacgctcagcaggatacacaagagtttctgcgatgcctgatggaccagttgcacgaagaattgaaggagccggtggtagctaccgttgctttaactgaagcccgtgacagcgattcgtccgacaccgacgagaagagggagggagacaggagcccctccgaggacgagtttctgtcttgcgatagctcctcagacagaggagagggcgatggacagggccgaggtggtggctccagccaggctgagactgagctgttgatccccgacgaggctggtcgggctatttctgagaaagagcggatgaaagaccggaaattctcctggggacagcagcgcaccaactctgagcaggtcgacgaggacgccgacgtggataccgctatggcagccctggacgatcaaccggctgaggcacagccacccagtccccgatcatcatctccttgtcgaactcctgagccagataacgacgcccatctccggagttcctcccgcccttgcagcccagtgcaccatcatgaggggcacgctaaactctccagcagtccaccgcgagcctcccctgtcagaatggctccaagttatgtgcttaaaaaggcccaggtgctatctgctggctccagaagaagaaaagagcagcggtatcgatctgtaatctctgacatctttgacggatctatcctgtccctggtgcagtgccttacatgtgatagggttagtactaccgtcgagacctttcaggatttgagcctccccattccaggaaaagaagaccttgccaaactgcattccgccatataccagaacgtgcccgctaagcctggcgcttgtggagattcgtacgctgcacagggttggttagccttcatagttgagtatatccgcagatttgttgtttcctgcaccccctcttggttctgggggcctgtagttaccctggaagactgtctcgctgcatttttcgcggcagacgagctcaagggagataacatgtacagttgtgagcgttgcaaaaagcttcggaatggagtgaagtactgtaaagtgcttagattacctgaaatcctgtgcatccaccttaagcgctttcgacacgaagtgatgtactcgtttaagattaacagtcacgtgagttttccactcgagggcctggatttgcggccatttcttgccaaggagtgtacctcacagattactacttacgatcttctgtccgtcatctgtcaccatggcactgccggaagcggccactatatcgcctattgccagaacgtaatcaacgggcagtggtacgagttcgatgatcaatatgtgaccgaggtgcacgagactgtggttcaaaacgcagagggctacgtcttgttttatcggaagtcttccgaggaggctatgagggagaggcagcaggtcgtgtctttggcggcaatgcgggaaccgtcgctgttacgtttctatgtttcgcgtgagtggctgaataaattcaacactttcgccgaaccaggacctattaccaatcaaacgtttctttgtagtcacggtggcattcccccacataagtaccactacatcgacgacctggttgtgattctacctcaaaacgtatgggagcacctctacaatcgctttggcggtgggcctgccgtgaaccatctctacgtgtgttccatctgtcaagtggaaattgaggccctcgctaaacggagacgaattgagattgataccttcataaaactcaacaaggcattccaggctgaagaatctccgggagtcatctactgtataagtatgcaatggttccgtgaatgggaggcgttcgttaaagggaaggataatgaaccccctgggccaatcgacaactcccgcattgcccaggtgaaaggtagtggccacgtccaactgaaacagggagccgactatggtcagatttccgaggagacatggacctaccttaacagcttatacggcggagggcctgaaatcgccatacggcagtcagtggcacagcctctgggaccagagaatctacacggtgagcaaaagattgaggctgaaaccagagcagtgtag

SEQ ID NO: 27947 - DNA, 1341 bp, Artificial Sequence
  Description of Artificial Sequence: Synthetic coding sequence
atgagagcggctaggagaggactccattgcgcgggagccgagaggcccaggaggcggggaaggctgtgggactcgagcggagttcctcagcgccagaagagacccggtccatggcgcactcagactcaagaacagatgtccagagacgtatgcatacatacatggccctgtacttattatcttgagcccaagagacgttgggtaacgggtcagctgtccctgacttccctatcgttaaggttcatgacggactctacaggcgagattttagtgtctttcccgctgtcttccattgttgagattaagaaggaggcttctcacttcatcttctcctccatcaccatcttagaaaagggtcatgccaaacattggttttcctcactacggccaagccgcaatgttgtcttcagcatcatcgagcacttctggcgcgaactgcttctctctcagccaggggcagttgccgatgcgtctgtgccccgtaccagaggcgaagaactcacaggacttatggcaggaagccagaaacgacttgaggataccgccagagtcctgcaccatcagggacagcaattggattcggtcatgcggggactggataagatggaatccgacctggaagttgccgaccgcctgctcacagagctcgagagccccgcttggtggccttttagctctaaactctggaagacaccccctgaaaccaagccgcgagaagatgtgagcatgacttcatgcgaaccttttggcaaggaggggatccttataaagattccagccgttatctcccatcgaactgagagccacgttaaacccggtcgcctgactgtgcttgtgagcggtttggagatccacgattctagcagcttactcatgcaccgatttgagcgtgaggatgttgacgatatcaaggtccactccccctacgagattagcatcagacagagattcattggcaagccagatatggcctacagactgatttcagcaaagatgccagaggtgatacctatactagaagtccagttcagtaagaaaatggagttgttagaggatgcactggtgctacggtctgccaggacatcgtcaccggctgagaaatcatgcagtgtgtggcacgcagcgtctgggctaatggggaggacactacatcgggagcctcccgctggtgatcaggaaggtaccgcgctccatctgcagaccagtctcccagccctgtccgaggctgacacgcaagaactgacccagggtttcagaccaatgagtcttagcactcagacggttctggtaatgctgtgtagcgaatcggccggagccttatggcgacagagactgagctag

SEQ ID NO: 27948 - DNA, 1896 bp, Artificial Sequence
  Description of Artificial Sequence: Synthetic coding sequence
atggctattgtccagaccctgccagtgcctctcgagcctgcccctgaggcggctactgcccctcaggcgcctgtaatggggagtgttagctccctgatctctggcaggccctgtcccggtgggccagcaccccctaggcatcacggccctcctggacctacgtttttcaggcagcaggacggactactgcgcggtggctacgaagcccaggaacctctatgccctgccgtccctcctaggaaggctgttcccgttactagttttacctatattaacgaggacttccgcacagagagcccaccgtctccatcctctgatgtcgaggatgccagagagcagcgggctcacaacgcccatctccggggaccaccaccgaagttaatccctgtgagtggcaagcttgagaaaaacatggaaaaaatactgattcgcccaacagccttcaaacctgtgctgccaaagcctcgtggagcgccatctttgcccagttttatgggaccgagggcaaccggcctgtcaggcagccagggcagtctgacccagctattcggaggccctgcatcctctagcagcagtagcagctcaagcagtgcggcagacaaacctctggccttctctggttgggccagtggttgcccaagcggaacacttagtgatagcgggagaaattcactgagttcacttccaacatatagcaccgggggagccgagcctaccacgagtagtcccggagggcatctgccctcacatggctccggacggggagctctccctggacctgccaggggcgttcccaccggcccatcccactcggactccggaagatcttcctcctctaagtcgactggaagcctagggggacgcgtggcgggaggcctgctggggtctggcacaagggcaagcccggattcaagctcttgcggggagaggagccccccacctccgccacccccaccatccgacgaggctctgttacattgcgtgcttgaaggaaaactgcgcgaccgtgaagccgagctgcagcagctacgcgattctctcgatgaaaacgaggctacgatgtgccaagcgtacgaagagcgacagagacattggcagcgtgagcgggaggccctccgcgaagactgcgccgcacaggcacagagagcccagcgagcccaacagttgctgcagcttcaagtgtttcagctgcaacaggaaaagagacagctgcaggatgattttgcgcagctgctgcaagagcgcgagcagcttgagcgaaggtgcgcaacactggagagagaacaaagagagctgggacccagactcgaggagacaaagtgggaagtctgccaaaagtcaggagaaatttccctgctgaagcagcaactaaaagagagccaagctgaattggtgcagaagggctcagaattagtggcccttagagtcgcacttcgggaggccagggcaacattgagagttagcgagggccgtgcccgtggactgcaagaggccgctcgggctagggagttagagctggaggcctgcagtcaggagctgcaaaggcataggcaggaggccgagcagttacgagaaaaggccggtcaattggacgcagaggccgctggactgagagagcccccagttccacccgcaactgccgatcccttccttttggccgagtctgacgaggctagcgcaaccgccaacccagtacacagacggttccaacctacaccggcaagaggggctgggaaaaaaaaggggctgccgccactccatatcccacccgaccctaaggcgagagagtcccagatggctcctgcggctccagacgtccctgcccacatcggcggacaggggagggcctgggcgagatttccgggtcttagttctgcagcgtctctcctggagtag

SEQ ID NO: 27949 - DNA, 1473 bp, Artificial Sequence
  Description of Artificial Sequence: Synthetic coding sequence
atgaatggggctctggaccatagcgaccaaccagatcccgacgccatcaagatgttcgtaggtcagattcccaggagttggagtgaaaaggaattgaaagaactgttcgaaccctatggtgcagtgtatcagatcaacgtccttcgagatcgcagccaaaacccccctcagtctaagggttgctgctttgtcaccttttacactcgaaaggccgctctcgaggctcagaacgccctgcataacattaagacactgcccggaatgcatcatcccatacagatgaagcccgctgactccgagaagagtaatgccgttgaggacagaaaattgtttataggcatggtgagcaaaaaatgtaatgaaaacgacatccgcgtgatgtttagcccctttggacagatagaggaatgccggatccttaggggacccgatggactctcgcgtgggtgtgcctttgtgaccttcagcaccagggcaatggcccagaacgcaattaaggctatgcatcagtcccaaaccatggaagggtgctcttcacccatcgtggtgaagttcgccgatactcaaaaagacaaagaacagcgcagactgcagcaacagctggcacagcagatgcagcaactgaatacggccacctggggtaatttgaccggcctaggcggacttacgcctcaatatctggcacttctccaacaggccacgagctcgtcaaatcttggagcattctctgggatccagcagatggcaggaatgaacgccttgcagttacagaatctggccacgttggccgctgctgctgcagcggctcagactagcgccaccagtaccaacgctaacccgctgtccaccacatcaagcgccctcggcgctttaacatcacctgttgccgcatccaccccaaattctacagctggcgctgccatgaacagtctgacttctctcgggacgctgcagggactggccggagccactgtcggcctgaacaacatcaacgccctggccgtggcccaaatgctatctggaatggccgctctgaatggaggtctgggcgctaccgggctcacgaatggcacggcaggcacaatggacgctctgacgcaggcgtacagtggaatccagcagtacgcggctgccgcacttccaaccctgtattcccaaagtctattgcaacagcagagtgcagccggatcacaaaaggagggtcccgagggagccaatttgtttatctatcacctccctcaggaatttggagatcaggatatcctgcagatgtttatgccgttcgggaatgtaatcagtgccaaagtctttatcgataagcagactaatttgagcaaatgttttggtttcgtgtcttatgataatccagtgtcagcgcaggcggcaattcaggcaatgaacggattccaaatcggaatgaagcggcttaaagttcagcttaagaggagcaagaatgactcaaaaccatactag

SEQ ID NO: 27950 - DNA, 627 bp, Artificial Sequence
  Description of Artificial Sequence: Synthetic coding sequence
atggcggcaagcgtggaacagagggaaggtactatccaggttcaggggcaggccctcttctttcgtgaggccttacctggctcaggccaagcacgcttctccgtattgctgctgcacgggattagattcagttcagaaacttggcagaatcttggaacccttcataggctcgctcaggctggatatagggccgtggctattgacctccctgggctcaagggagaaccacctgcccaggaaccccttctgtcacagtcgcgagcatcttttctggcagccgtggttgacgcattggagcttggccctcccgtggtaatttcaccatccctaagtgggatgtactctctgccctttctgacagcgcctggcagtcagctcccgggattcgtccctgtcgctccaatctgtaccgataagattaacgccgcaaactatgccagcgttaagactcctgctctcatagtgtacggtgaccaggaccccatgggtcaaactagtttcgaacaccttaagcagctcccaaatcatcgggtgcttatcatgaagggggctgggcatccgtgttacctggataagcctgaggagtggcatacggggctactggatttcctgcagggtctccaatag

SEQ ID NO: 27951 - DNA, 546 bp, Artificial Sequence
  Description of Artificial Sequence: Synthetic coding sequence
atggagagccgaagcgtagcacaggctggcgtgcagtggtgcgatctggggtctctgcagccgcctccccctggctttaagcagtttagttacttctccttgcagagcagctgggactacagatacgtccccccatgccccgcaaattttgttttcttggtcgagatgggattccttcatgtggaccaggccggactgaaactcttgacaagtggcatcgatttcgccactcggaagattgcaaaactactgaaaccccagaaggtcattgaacagaatggggacagttttacgatccacactaattcctcgttacgtaattacttcgtgaaattcaaagtgggagaggaatttgatgaagataacagggggcttgacaacaggaaatgtaaaagcttggtgatttgggataacgataggctcacatgcatccaaaaaggggagaagaaaaatcgcggatggacccactggatcgaaggggataagctgcatctggagatgttctgtgagggacaggtctgtaaacagacctttcagcgggcttag

SEQ ID NO: 27952 - DNA, 1647 bp, Artificial Sequence
  Description of Artificial Sequence: Synthetic coding sequence
atgagtgccagtctcaattacaagagcttctctaaggaacagcagaccatggacaacctggaaaagcagcttatttgcccaatttgcctggagatgtttaccaagcccgtcgtcatcctgccgtgtcagcacaacctgtgtagaaaatgtgcttccgatatctttcaagcaagcaacccatacctcccaacacggggaggtacaactatggcgtcagggggtaggttccgctgcccctcatgcaggcatgaagtagttcttgaccgacacggggtatacgggttgcagcggaatctgttagtggaaaacatcatcgatatctataagcaggaaagcactcgccctgagaagaagtccgaccagcctatgtgcgaggaacacgaggaggagaggatcaacatctattgcctgaattgtgaagtgccaacatgttcactgtgtaaagtgtttggcgcacataaagattgccaggtggcccctctgactcacgttttccaacggcagaagagtgaattgtctgatgggatcgctatactggtcggtagtaacgatagggttcaaggggtgatttcgcaacttgaagacacatgcaaaactatcgaagaatgctgccggaaacagaagcaggagctgtgcgaaaaatttgattacctctatggaatcctggaagagagaaagaacgagatgacacaggttatcacacggactcaggaagaaaagctggaacacgtaagagctctcataaagaagtacagcgaccacctggaaaacgtgagcaagttggtcgagtcgggtatacaattcatggatgagcctgaaatggcagtctttctgcagaatgctaaaacattgctcaagaagatttccgaagccagcaaagccttccaaatggagaaaatagagcacggctacgagaacatgaatcattttacggttaatctgaatcgcgaagagaagatcatcagagaaatcgacttttatagagaagacgaagacgaagaggaggaggaaggcggtgaaggcgaaaaagaaggcgagggtgaggtcggaggcgaggccgtcgaggtcgaagaagtggagaatgtgcagactgagttcccaggagaagatgagaaccccgagaaagcaagtgagctcagccaggttgagttacaggccgctccgggagcattacccgttagcagcccagaaccacccccagcactgcctccagctgccgatgcacctgtcacccagggcgaggttgttcctactggttcagaacagacaacagagtctgagacaccagtgcctgctgctgccgagactgctgaccccctgttctacccttcctggtataagggccaaacaagaaaggcgactaccaatcccccttgtacaccaggaagcgagggacttggccagataggtcccccaggctccgaagactctaatgtcaggaaggccgaagtagcggctgccgctgcatccgagcgtgcggctgtctctgggaaggagacaagtgcgccagcagcaacaagtcagattgggtttgaggcccctccactgcaggggcaggccgcagcaccggcttcaggaagtggagcagattcagaaccagcaagacatatcttttcctttagctggctgaactcactcaatgaatag

SEQ ID NO: 27953 - DNA, 1374 bp, Artificial Sequence
  Description of Artificial Sequence: Synthetic coding sequence
atgtttccaaagttctccttacggtccatgtttcacggggcaggaggcggaaacgacatccagtggtgcttctcccaggttaaaggcgctgtggatgatgatgtggcagaggcagacatcatctcaaccgtggaattcaatcattcaggtgagctgctcgccaccggagataaaggcggacgcgtagtcattttccaacaggagcaggagaacaaaatccagagccattctcgcggagaatacaacgtttactctaccttccagtcccacgaaccggagtttgattaccttaagagcctagagattgaggagaagattaacaaaattcggtggcttccacagaaaaatgccgctcagttcctgttgagcacaaatgacaaaaccatcaaactatggaagatctccgagcgggacaaaaggccagaagggtataacctaaaagaggaggacgggaggtaccgcgatcccacgactgtcaccacattgcgggtcccagtcttcagacctatggatctgatggtggaggcctccccacggaggatattcgccaatgcacacacataccacatcaatagtatttcaatcaatagcgactatgaaacatacctttcagccgacgatctcagaataaatctgtggcatctggagatcactgaccgttctttcaatatagtagacatcaaaccagccaacatggaagaacttactgaagttataacggccgctgagttccaccctaactcctgcaatacgtttgtgtactcaagttccaaaggaaccatccgtctctgtgatatgcgcgcttccgctctgtgtgaccgccacagcaagctttttgaagagccagaagatcccagtaaccgcagtttcttcagcgaaatcatcagtagtattagtgacgtgaaatttagccacagcggacggtacatgatgactagggactatctttcagtaaaaatttgggacctcaacatggagaatcgccctgtcgagacctaccaggttcatgagtatctgcgcagcaagctctgctccctgtatgaaaacgactgcattttcgataaatttgagtgctgttggaacgggtcagactccgtcgtgatgaccggatcatataacaacttttttcgcatgttcgacaggaacacaaagagggacattacccttgaggcctctcgggagaataataagcctagaactgttctaaagccacgaaaagtgtgcgccagtggaaagcgaaaaaaggatgagattagcgttgactctttggatttcaacaaaaaaatcctgcacactgcatggcaccctaaggaaaatatcattgccgtggccacaacaaacaatctatatatcttccaggacaaggtcaactag

SEQ ID NO: 27954 - DNA, 738 bp, Artificial Sequence
  Description of Artificial Sequence: Synthetic coding sequence
atggccggactggagctgctcagcgaccagggctatagggtggatgggcgaagggccggtgaactgcgcaagatccaagctagaatgggtgtctttgcgcaggcagatggaagtgcttacatcgagcaagggaatacgaaggccctggctgttgtgtacggaccacacgagattcgtggcagtcgcgctagggccctcccggatagagctctggtgaactgtcagtactcctccgcaaccttctctaccggggaacgcaagcgtcgccctcatggggatcgtaagagttgtgagatgggactgcagctgcggcagacatttgaggccgctatcctcacccaactgcatcccaggagccagatcgatatctacgtgcaggtcttgcaggctgacggcggaacgtacgcagcttgcgtgaatgccgcaaccctggctgtactggatgcaggcatccccatgcgcgatttcgtgtgcgcctgttctgcaggcttcgtggacggcaccgctctggccgacttgagtcatgtggaagaggccgctggaggcccacaacttgccctggccctgctgcccgcatccgggcagatagctctgctggagatggatgccagattacacgaagaccatctggaaagagtgcttgaggcagccgcacaggctgctcgtgacgttcacactcttttggaccgcgtggtaaggcaacacgtccgcgaggcttctatcctcctaggtgactag

SEQ ID NO: 27955 - DNA, 2631 bp, Artificial Sequence
  Description of Artificial Sequence: Synthetic coding sequence
atgatggcagacggcgcagctgcgggagctgggggatccccgagtctgcgcgaattacgtgcaaggatggtggctgcagccaacgagattgccaaagagcgcaggaaacaggacgtcgtgaatcgcgtcgccactcattcctctaatatacgatcaacattcaagcctgtcatcgatggctcaatgttaaagaacgacataaagcagcgcctggctagagagcgacgcgaagagaaacgcaggcagcaagatgctaacaaagagactcagctgctcgaaaaggaacgcaaaaccaagctgcaatacgaaaagcagatggaggaacgccagcgaaagttaaaggagcgaaaggagaaggaagaacagcgacgaatcgcagccgaagagaagcgccaccagaaagacgaggcccagaaggagaagttcacagcaatactgtaccgaacactagaacgaaggagacttgcagatgactaccaacaaaagagatggagttgggggggttctgccatggctaactccgagtccaaaacggcgaacaagcgctcagcgtccaccgagaagctggagcagggcacttccgctctgataaggcaaatgccactctcatcagcaggccttcagaatagcgtggcgaagagaaaaaccgataaagagaggtctagttccctcaatcgacgcgactctaatctccacagcagtacagacaaagaacaggcggaacggaaacctcgagtgactggcgttactaactacgtaatgcagtacgtaactgtgcctctgagaaagtgcaccagcgacgaattgcgtgccgtgatgtttccgatgtcgaccatgaaaatacctcctcagactaaggttgaagagtcacctttagaaaaggttgagaccccacctaaggcttcagtcgatgccccaccgcaagtaaatgtggaagtcttttgcaacactagtatggaggcctcccccaaggccggtgtaggcatggctcccgaggtcagcaccgatagtttccctgtcgtcagtgtggacgtgtctccagtggtctccacttacgactccgaaatgtctatggacgcaagccctgagttatctatcgaggcattaccaaaagtcgacttagagaccgtgcccaaggtctcaatcgttgcaagtccagaagccagcttggaggcaccacctgaagtgtccctggaagctttacccgaggtaagcgtcgaggccgctcccgagggatccttggaagcccctcctaagggaagcgcagaggtggcccctaaggagagcgttaaaggctcccctaaagaaagtatggaagcttcccccgaagcgatggtgaaggcttctcccaaaacatccctggaggcaagtatggaagcctctcccaaggcgaaagcaagagatgcaccaaaaaagtctgagatggacaagcaggcactgatcccaatagccaagaagcgactttcctcatatactgagtgttacaagtggtcttcgagcccagaaaacgcctgcggcctgccaagccccatatctacaaaccgtcagatccaaaagaactgtccgccatcccctctgcctcttatctctaaacagtctcctcagacatcttttccgtataagataatgcccatacagcacaccttgtccgtgcagtctgcgtccagtacagtgaaaaagaaaaaggagactgtctccaaaacaaccaataggtgcgaggctctgtctcagcggcacatgatttatgaagagagcggcaacaagagtaccgccggtattatgaacgctgaagccgctactaaaattttgaccgaattgcgtcggctcgctagagagcaaagagagaaggaagaagaagagcggcagcgcgaggaaatgcagcagcgcgttattaagaagtctaaagacatggccaaggaggccgtgggcggacaggcggaagaccaccttaagctaaaggacggtcaacagcagaatgagacaaaaaagaagaagggatggctcgaccaggaggaccaagaagcccctctgcagaaaggagacgccaaaatcaaagcccaggaggaagctgataaaagaaaaaaggagcacgagcggattatgctgcagaacttgcaggaacgactggaaagaaaaaaaaggatcgaagagatcatgaaaagaacccgtaaaaccgacgtcaatgcctcaaaagtcactgagacatctagtcatgacatctacgaggaggcagaagccgataacgaagagagtgacaaagattcactcaacgagatgttcccttcagccattttaaatggcaccggcagtcctaccaaattcaaaatgcctttcaacaatgccaaaaaaatgacccacaagctcgtgttcctagaagatggaacatctcaggtgcgaaaagaacccaagacttatttcaatggtgatctcaagaattttagacagaagtcaatgaaggatacctctatacaggaagtggtctcgaggccttcctccaaaagaatgacttctcacacgaccaagacaaggaaagctgatgaaactaacactacctcacggagctccgcccagacaaagtctgaggggtttcacgacattctgccgaaatcttccgacacatttcggcagtag

SEQ ID NO: 27956 - DNA, 6290 bp, Artificial Sequence
  Description of Artificial Sequence: Synthetic coding sequence
atgtgctccacccccggaatgccagccccaggggctagcctagctctgcgcgtgagcttcgtggatgtgcatcctgacgtgattccagtccagttatggggattggtgggtgaacgcaggggggagtacctccgcctttcacgggaaatacaggaagccgcagctaccaggggtcagtgggccctgggcagtgcgtccgcttcacctggagagctctgcctggtccaggtagggctgctctggcaccgctgtcgcgtggtcagcagacaggctcaggagagtcgggtttttctgcttgatgaaggccgaactattactgccggtgccggatccctggcgccaggtcggagagagttttttaatctgcctagcgaagtactcggctgtgtgcttgctgggctggtgcccgctggatgtggggctggcagcggagaacctccccaacactggccggctgacgccgtcgatttcctcagcaacctacaggggaaagaagtgcacggatgtgtgttagacgttctgcttctgcacaggctggtcctgctcgaagtacctgacgtctttcaacagatgagagagctgggtctcgcacgtagggtgcccgattcgctgttccgctccttactggaacgatatctgacggcggctaccgcatcagttgggtccggtgtgcctgtgctgtccagagttcctctgaaacagaagcagccagggctagactatttctatccacagctacagttaggggtcacagaggcagtggtgatcactcaggtctgccacccccatcgcattcactgccagcttcgtagcgttagtcaggagattcaccgcctgtccgagtcaatggcccaggtgtatagaggaagcactgggaccggtgacgagaactcaacttccgccacatgggaggagcgggaggaatctccagacaagccaggctccccatgcgccagttgtggactggacgggcactggtaccgcgctctgctgctcgaaacttttagacctcagagatgtgctcaggtccttcacgtcgattatgggcgaaaggagcttgtgagctgcagcagtttaagataccttctgcctgaatatttcaggatgccagtcgtcacatacccatgcgctctctacgggctgtgggacgggggaagggggtggagccgatcccaggtgggcgacctcaagacactgatccttggcaaggctgtgaatgcgaagatcgaattttattgctcatttgagcacgtatactatgtaagcctctacggcgaggatggaattaatttaaaccgggtgtttggagtacagtcatgctgcctcgccgatagagtcctgcagtctcaggctacggaggaggaggaaccagagactagccagtcacagagccccgcagaggaggtagacgaggagatcagcctcccagctctacggagtataaggttaaagatgaacgccttctatgatgcccaggtggagtttgtcaagaatccctccgaattctggatacgtctgcggaagcacaatgtgacattcagcaagctcatgcgtcggatgtgtggtttctatagctcggctagcaaactcgatggtgtggtgttaaaacccgaacctgatgacctttgttgtgtgaaatggaaagagaatggatactatcgggcaatcgttaccaagctagacgacaagagtgtcgatgtttttctggtggaccggggtaattctgaaaacgtggactggtatgatgttagaatgcttctccctcagttcagacaactcccaatccttgctgtgaagtgtacgctggctgacatatggccgctgggtaagacttggagtcaagaagccgtgagctttttcaaaaaaactgtgcttcacaaggagctagtaatccacatcttagataagcaggatcatcagtatgttatcgaaattctcgatgaatcaaggaccggagaggaaaatatttcgaaggtgatcgctcaggccggatacgctaagtaccaggaattcgagaccaaagagaatattctcgtgaatgctcatagccctggccacgtcagcaaccattttacaaccgaaagcaacaagattccattcgccaaaaccggcgagggggagcagaaagctaaacgggaaaataaaactactagcgtctccaaggccttgagtgataccaccgttgtcacaaacgggagcacagagctggtggtgcaagaaaaggttaagagagcttccgtgtacttcccattgatgcagaactgtctggagataaaaccagggtcttcttccaagggggagttggaggtgggatccacggtcgaggtgagagtctcatacgtggagaacccaggatatttttggtgccaactcacacggaatattcaggggttaaaaaccctcatgagtgacattcagtactattgtaagaatacagcggctcctcatcagcggaacactcttgcctgcttagcaaagcgcaccgtcaatcgccagtggtccagagcgctgatctctgggatccagtccgtggagcatgtcaatgtgactttcgtggattatggtgatagagagatggtgtctgtgaaaaacatatacagtatttcagaggaatttctgaaggtgaaagcacaggcattccgatgctccctctacaacctgatccagcctgtgggtcagaaccctttcgtgtgggatgtgaaggccatccaggctttcaacgagtttatcgacaatgcctggcaaaagaatttggagctaaagtgtactatttttgcattggcatcaattaatgaagaattgtttaacatagtggatcttctgacaccctttcagtcagcttgccactttctggtagagaagcggctcgcccgacccgttaagcttcagaagcccttggagagttccgtgcagttgcactcctacttttatagcacacacgacatgaaaattggatcagaggagctggtgtatatcacacatatcgacgacccatggaccttttactgtcagctcgctaggaacgccaacattctggagcagctgtcttgttcaatcacgcagctgagtaaggtcctcctgaatctgaagacctctcctctgaatcctgggacgttgtgtctcgctaagtatactgacggcaactggtacagaggcattgtcatcgagaaagagccaaaaaaggtttttttcgttgattttgggaatatttatgtcgtgacctccgacgacctcctgcccattccttccgacgcatatgatgttttattattgcctatgcaagcggtgcgctgcagcttgtcagatattccagaccatatccctgaggaggttgtcgtctggttccaggaaaccatccttgacaagtctttgaaggccctggttgtagctaaagaccctgacgggaccctgattatagaactgtatggggataacatccagatatctgccagcattaataagaagctcggcctcctgtcatacaaggataggatccggaaaaaggagtccgaggtgctgtgttcgactacagagactctggaagaaaaaaacgagaatatgaaactgccttgcaccgagtatctgtctaagtcagtgggttataagctgcctaataaagagatcttagaagaatcatacaagccacaaataaatagctcttataaagaactcaaactgctccagtcactgaccaagaccaatctggtgactcagtatcaggattccgtgggcaataaaaattctcaggtgtttcctttgacaactgagaaaaaagaagaaatctcggccgagacccctctcaagaccgctagggtcgaggccaccctctcagagcggaaaatcggggactcttgcgacaaggaccttcctctgaagttctgtgagtttccacaaaaaactatcatgcctgggttcaagactacagtctacgtgtctcacataaacgacctgagcgacttctacgtgcaattgatagaggacgaggccgagattagccatctgagtgaaagattaaatagcgttaagacccgccctgagtactacgtgggccctcctctgcaaaggggggatatgatctgtgctgtcttccctgaagataatttgtggtacagggcagtgattaaagagcagcagcctaacgaccttctgagtgttcagttcattgactatggaaacgtgagtgtggtgcacacaaataagataggacgtctcgacctcgttaacgctatactcccaggtctgtgcattcattgctctctgcaggggtttgaggtgcccgacaacaaaaattcaaaaaagatgatgcactacttttcccaaagaacttccgaggctgcaattaggtgtgaattcgtcaaatttcaagatagatgggaggtcatcctggccgatgagcacgggattatcgcggatgatatgatcagtaggtacgcactttcagaaaaaagtcaggttgagctttcaacccaggttattaaatcggcttcttctaaatccgtgaacaaatccgatatcgacacttcagttttcttgaattggtacaaccctgaaaaaaagatgattcgcgcttatgcaaccgtgattgatgggccagaatacttttggtgccagtttgccgatacggagaaactgcagtgtctcgaagtggaagtgcagaccgcgggagaacaggtggcggatcgacgcaattgtattccctgtccctacatcggcgatccgtgtatcgttcgataccgggaggacggccattactatagggccctgatcacaaacatatgtgaagattaccttgtttcagtgcggctagtggatttcggtaacattgaggactgcgtggatcccaaggctctctgggccataccctccgaactattgagcgtccctatgcaggcattcccttgctgcttatccggctttaacatctctgagggactgtgctcccaggagggaaacgattacttctacgaaatcatcaccgaggacgtcctggaaattacaattctagagattcgcagggacgtctgtgacattcctctggcgattgttgacttaaaatccaaaggcaagtccattaacgagaagatggaaaagtactctaaaacaggtatcaagtccgcactgccatacgagaatatcgactcagagatcaagcagaccctgggaagctacaacctggacgtggggctcaaaaaactgtcgaacaaggccgtacagaataagatctacatggagcagcagacggacgaactggccgaaataacagagaaagatgtgaacatcataggtacaaagccgtccaattttagggatcctaagacggataacatttgcgaagggttcgagaatccctgtaaagataagatagacaccgaagaactggagggcgagcttgagtgccacctggtagataaagccgagttcgatgataagtacctgataaccgggttcaatacactgctcccacatgccaatgagacaaaagagatcctggaactaaatagcctggaagttcccttgtctcccgatgacgagtctaaagaatttctggagctggagtcaatcgagctccagaactcactggtggtcgatgaggaaaagggagagctgtctccggtcccgcctaacgttcccctgtcccaggagtgtgttaccaaaggagccatggaacttttcaccctacaattgcccctgtcatgcgaggctgagaagcagcctgaactcgagctccccacagctcaactgccactagacgataagatggacccgctgtccctgggcgtctctcagaaggctcaggagtccatgtgcaccgaggacatgaggaaatcgtcgtgcgtggagagctttgacgatcagcgaaggatgagtctacaccttcatggtgcagactgtgatcctaagacccagaatgaaatgaacatttgcgaagaagagtttgttgaatacaaaaaccgcgacgcaatcagcgctctgatgcccttatttagcgaggaggagtctagcgacgggagcaagcacaacaatggcctccctgaccatatctcagctcagctgcaaaacacatacacgctgaaggcctttacagtagggtctaagtgcgtggtgtggagctcacttcgcaacacctggagtaaatgcgagattctcgagactgccgaagaggggactcgagtgcttaacctatcaaatggaatggaagagatcgtaaaccccgaaaatgtgtggaatgggatacctaagcttgacaagagcccgccagagaagaggggcttagaggtgatggaaatcta

SEQ ID NO: 27957 - DNA, 690 bp, Artificial Sequence
  Description of Artificial Sequence: Synthetic coding sequence
atgggtaaaagttgtaaagtggttgtgtgtggacaggcaagtgtaggcaagaccagtatcctggaacagttactctatggcaatcacgtggtgggaagcgaaatgatcgaaactcaggaagatatctacgtagggagtattgagaccgatcggggagtccgggaacaggtgagattctacgacaccagaggcctgcgtgacggtgctgagttaccacggcactgcttcagttgcactgacggctatgttctggtgtactcgacggacagtcgggaaagttttcagagggtggaattgctcaaaaaagagatcgacaaaagtaaggacaaaaaggaagggcttacgctccccccaagactcgagtgctctggaatgattactgctcattgtagcttaaacctgccaaggctcagatggagctcttgtctgtctccactgctccgcctgcaggtgacgatcgtcgtgctgggtaacaagtgcgatttacaggagcaaaggcgcgtggatcctgacgtggcacagcactgggccaagagcgagaaagtgaaactgtgggaagtgagcgtcgctgaccggaggtcattgctcgagcctttcgtgtatctggcctctaaaatgacccagccccaatcaaaatctgcattcccactgtcgcgcaaaaataaaggtagtgggtcacttgatgggtag

SEQ ID NO: 27958 - DNA, 2412 bp, Artificial Sequence
  Description of Artificial Sequence: Synthetic coding sequence
atggagtccggacctcgagcggagttaggagccggtgcccctcctgctgtcgtcgcgagaaccccacccgagcctcgcccttctcctgaaggggatccctctcccccacctccccctatgagcgcgttagtgcctgatacgccaccggatactcctcctgccatgaagaatgccacatcctcaaagcagctccccttggagcccgaatccccctcggggcaggttgggcctaggccggctccccctcaggaggagagcccttcctccgaggctaagtctaggggccctacccccccagcaatgggacctagagatgcccgacccccacggagaagctctcaacccagccctaccgccgtaccagcatcagacagccccccaacaaagcaggaggtaaagaaagctggcgagcgacacaaactcgcgaaagaaaggcgggaggagcgggcaaagtatctggccgctaagaaagccgtctggttggagaaggaagagaaggccaaggccttgcgggaaaaacagctgcaggaacgccgaaggcgcctggaggaacagcgactgaaagctgagcagcgcagagcagctctcgaagagcgtcaacgacagaagctggagaagaataaggaaaggtacgaagcagccatccaaagaagtgtgaagaagacttgggctgagattcgacagcagaggtggtcctgggccggtgccttacatcacagctcccctggccacaagacaaacaggagtctgcagttatccgcttgggaaagtagcatagtggaccgtcttatgactccaactctctcatttctggccagatcacgctcggccgtcaccctgccacgtaatggcagagaccaagggaggggttgcgaccctggacggggacctacctggggcagggcgggtgcttcacttgccagagggcctcagccggatcggacccatcccagcgctgcggtccctgtgtgcccgagaagtgcaagcgcctccccgctgaccccttgtagcgtcacgaggtccgtccaccgttgtgcacctgccggagaacgcggagaaaggaggaaacctaacgcagggggttcccctgcacccgttcggaggcggccagaggcatctcctgtgcagaaaaaggagaagaaagacaaagaacgggagaacgagaaggagaagtccgcactggcgagagaacggtcccttaagaagcgacagagcctgcccgcttccccacgcgctcgactcagcgcaagcactgcctcagagctcagccccaaatccaaggcgagacctagttctccaagcacatcttggcatcggcctgcctctccgtgcccttcccccggaccaggccatacattgcctcctaagcccccttcccctcggggtacgacagcctctccaaaggggagggttaggcgcaaagaggaggcaaaagagagcccgagtgcagcaggcccagaagataagagccaatcaaaacggagagcgtccaatgaaaaggaaagtgccgctcctgcctcccctgccccttcgcctgccccaagtcctactcctgcgcctccacagaaggagcaaccccctgctgaaacacctacagatgccgctgttcttacttcccctcccgcaccagcaccccctgtaaccccctctaagccgatggccggaaccaccgatagagaggaggcaaccagactgctggcagagaaacgcaggcaagcgagagagcaaagggagagagaagagcaggaaaggcggctgcaggctgaacgcgacaagcgcatgagggaggaacagttagcacgggaagccgaggcgcgtgctgagagggaagccgaggcgcgacggagggaagagcaggaggcccgagagaaggcccaggccgagcaggaggagcaagagcggctccagaaacagaaggaggaagccgaagccaggtctagagaagaggcggaaagacaaagactggagcgcgaaaagcactttcagcagcaggagcaagagcgccaagaaaggagaaaacggctcgaggaaattatgaaacggacgcgtaagagcgaggtgtcggaaacaaaaaaacaggattctaaggaggccaacgccaacggaagtagccccgaaccagtgaaggcagttgaagctaggtcccccggactgcagaaggaggccgtgcaaaaagaagaacccatcccacaggagccccagtggtccctcccgagtaaggaactgcccgcttcactagtcaacggtctgcagcctctacccgctcaccaggaaaatgggtttagcaccaatggcccatccggcgataaatcacttagccgcacccctgaaacgcttcttccgttcgccgaggctgaggcctttctgaaaaaggcagtagttcaaagtccgcaagtgacagaagtgctgtag

SEQ ID NO: 27959 - DNA, 1125 bp, Artificial Sequence
  Description of Artificial Sequence: Synthetic coding sequence
atgcgcgctccaatgttgcaaaaacaacaagcccctcgcatggacaccccaccgcctgaagaacggttagagaagcagaacgagaagctgaacaatcaggaagaggagactgaatttaaggagcttgatggcctgagagaagctctggcaaacctgagaggtttgtcagaagaggaacggagcgagaaagcaatgcttcgctctcggatcgaggagcaaagccagctgatctgcatactaaaaaggcggtctgacgaggccttagagcgttgccagatcctggagctcctaaacgccgagctggaagaaaagatgatgcaggaggctgagaaactcaaggctcaaggtgagtacagccgcaagctggaggaacgttttatgactctggccgctaaccatgagttgatgctccgattcaaggacgagtacaagtccgagaacatcaaactcagagaagagaatgagaaactccgcctcgaaaacagctcactattctcccaagcgctcaaggacgaggaggcgaaggtgcttcagctgaccgtgcggtgcgaggcgctgaccggggaactggagacactgaaagaaaggtgtgctcaggacgcttgccaagcccaggcccgtgagaaggaactgctggagctgcagagccaacaggcttgcacccacactaaagagacagaacagttacggagtcaactccagacactgaagcagcaacatcagcaagctgtcgaacagattgcaaaggccgaggaaactcacagtagtctcagtcaggaacttcaggccagactacagaccgtgacaagagagaaagaggaactgctgcagctgagtatagagcgtggtaaggtcctccagaacaaacaggccgaaatctgccagttggaggagaagttagagatcgccaatgaggatcgcaagcacgctctggaacgctttgaacaagaggcagtggcggtggatagtaacctgcgagtccgggagctgcaacggaaggttgacggaatccaaaaggcctacgacgaacttagactgcaatcagaggcattcaaaaaacactccctggacttgctctctaaagaaagggaactgaatggcaaattgaggcatctatccccctag

SEQ ID NO: 27960 - DNA, 585 bp, Artificial Sequence
  Description of Artificial Sequence: Synthetic coding sequence
atggaagatgggcttttggagattatgacaaaagacggcggagatatgccggcacctctggaggtgtccacagttccagcagtgggcgacgtgatctcaggggagtacaatgggggtatgaaggaactgatggagcatctaaaagcacagttacaggccctcttcgaggatgtgcgggcaatgaggggggcactcgatgagcaggcttcccatattcaagtgcttagcgacgatgtctgcgctaatcagcgagctattgtatcaatgtgtcagattatgacaacggcaccaaggcaggggggactcggggtggtcggtggtaaaggatccttccaatctgaccctcaggaacctgaaacccccagccctggcatcggtgacagcggcttattggggagggatcccgaagatgaagaggaagaggaagaagaaaaggagatgccaagtcccgcaacaccaagttctcactgcgaaaggcccgaatccccctgcgcaggcctactcggcggtgatggtcctctagttgaacctctggacatgccggatattaccctgttgcagttggagggagaggcttccctatag

SEQ ID NO: 27961 - DNA, 1281 bp, Artificial Sequence
  Description of Artificial Sequence: Synthetic coding sequence
atggctcatctgaggggcttcgccaatcaacactcacgcgtcgacccggaggagctgtttaccaagcttgaccgaatcggaaaaggtagcttcggggaagtctataagggcattgataatcacacgaaggaagtcgtcgccattaagatcatcgaccttgaggaggccgaagacgagatcgaggatattcagcaggaaatcaccgtcctctctcagtgcgactccccttacattacccggtattttggaagttacttgaaatcaacaaaactttggataatcatggagtacctcggaggagggtccgcattggatctcctcaaaccaggacccctcgaggagacatatattgctaccatcctgagggaaatcttgaagggtcttgactacctccattctgagcgtaaaatacatagggacatcaaagccgctaatgtgcttctctctgagcagggtgatgttaaattggccgattttggagtcgctggccagctcaccgatacacagatcaaacgaaatacatttgtgggtactccgttctggatggcccctgaggttatcaagcaaagtgcttacgatttcaaagcagacatatggtcgctggggatcacagcaatcgagttggccaagggggaaccgcctaactccgacctgcatccaatgcgcgtgctttttcttattcctaaaaatagcccaccaaccctcgaaggccagcactctaagcccttcaaggaattcgtggaagcatgtcttaacaaggatcccaggttcagacccacagccaaggagctacttaagcacaagtttatcactcgttatactaagaaaacttcattcctgacagaactcatcgaccgatacaaacgatggaaatccgagggtcacggtgaggagtcatcaagtgaggacagcgatattgacggagaggcagaggacggtgagcaggggcctatttggacctttcctccaactatcaggcccagcccccattctaaattgcataagggaacagctctccattcctctcagaaacctgccgagccggtgaaaaggcaacctcgttctcagtgtttgagcacactggtccgtcccgttttcggcgaacttaaagaaaagcacaaacaatcaggtggcagtgtcggggctctagaggaattggagaacgcttttagcttggccgaagaatcttgtccaggtataagcgataagctgatggtgcacctggttgagagagtgcaacgatttagccacaatcgcaaccatctcacttccacccggtag

SEQ ID NO: 27962 - DNA, 1350 bp, Artificial Sequence
  Description of Artificial Sequence: Synthetic coding sequence
atgatgctcagtaccgaaggaagagaaggctttgtggtgaaggtgagagggctaccctggagttgttcagctgatgaagtaatgcggtttttcagcgactgcaagatccagaacggcaccagtggcattcggtttatctacacccgggaagggaggccgagcggcgaagcatttgtagaacttgagagcgaagaggaagtgaaactggcactcaagaaggatagggaaaccatgggccatagatacgttgaggtattcaaaagcaattccgttgaaatggactgggtccttaaacacactgggcctaacagcccagacactgcaaatgacggctttgtccggctgagggggttgcccttcgggtgttctaaggaggaaatcgttcaattcttctctggtcttgaaatcgttcccaatgggatgaccttaccagttgactttcagggccgttcgaccggcgaagcattcgtgcagtttgctagtcaggaaattgccgagaaagcgcttaagaagcataaggagcgaataggccatcgatatatcgaaatctttaaaagcagcagagccgaggtgaggacacactacgacccaccgcgtaagctgatggccatgcagagacccggtccttacgaccggcctggagccggacggggttacaacagcattgggaggggggctggttttgagagaatgagaaggggtgcctatggcggaggctacggcggatatgatgactatggcggatacaatgatggttacggcttcggaagcgatcgatttgggagagacctgaactattgctttagtgggatgtctgatcaccggtatggcgatggcggatcttctttccaatccacaacaggccattgcgtccacatgcggggtcttccataccgggctactgagaacgacatctacaactttttttcacccctcaatccgatgcgagtccacattgagattggcccagatggcagggtaacaggggaagctgatgttgagtttgccacccatgaggatgcggttgctgccatggccaaagataaagccaatatgcagcatcgttatgtggaactcttcctcaactcgactgccggtacatcaggtggagcgtacgatcattcctatgtagagttgtttctgaatagtactgccggagcttcagggggagcctacggttctcagatgatgggcggtatgggcttgtccaatcagagttcatatgggggtccagcaagccagcagctctcaggtggctacgggggtgggtatggagggcagagctcaatgtctggctatgatcaggtgctacaggagaatagttctgattaccagtccaacttggcatag

SEQ ID NO: 27963 - DNA, 1317 bp, Artificial Sequence
  Description of Artificial Sequence: Synthetic coding sequence
atgtgccctaaaaacgcttcatattacggaaaccgagcggcaaccctgatgatgttaggacggttccgggaggcactgggcgatgcccagcaatccgtgaggcttgacgactctttcgttcgcggtcaccttcgcgaaggcaaatgtcacctgtccctgggtaacgcaatggctgcatgccgttcctttcagagggctctcgaacttgatcacaagaatgcacaggcacagcaggagtttaaaaacgctaacgccgtcatggaatacgagaagatagccgagacagacttcgagaagagagacttccggaaggtggtgttctgtatggatagggctctggaattcgcgcctgcatgtcacaggtttaagattctcaaagccgagtgcctcgcaatgctaggtagataccctgaggcccagtcagtggctagcgatattttacgaatggactcaacaaatgcagatgctctgtacgtacgtggactctgtctctactatgaagactgcatagagaaggctgtccagttcttcgtgcaagcattgcggatggcacctgaccatgagaaggcctgcatcgcatgccgcaatgcgaaagctctcaaggccaagaaggaagatggcaataaagcgttcaaagaaggtaattataagctggcctacgaactttacacggaggccctgggcatcgaccccaacaatattaaaactaatgccaagctgtattgcaaccgaggcacagtaaacagcaaattaagaaaactggatgatgcaattgaagactgtaccaatgccgtcaagctggatgacacctatatcaaggcttacctgagacgagctcagtgctacatggacaccgaacagtatgaggaggcggtcagggattatgaaaaagtttaccaaacagaaaaaacgaaggagcacaagcaacttctgaagaatgcacagcttgaactcaaaaaaagcaagcgaaaggattattacaagatcctgggggttgacaagaacgcatctgaggatgaaatcaaaaaggcctataggaaacgggcactgatgcatcacccggatcgccattctggagcaagtgccgaagttcagaaagaggaggagaaaaaatttaaagaagttggagaagcttttaccatcctgagcgatcccaaaaagaaaactcgatacgacagtggtcaggatctagatgaagaaggcatgaacatgggtgattttgatcctaataacattttcaaggccttttttggcggacccggtggattctccttcgaagcgtccggcccaggaaatttcttctttcagtttggctag

SEQ ID NO: 27964 - DNA, 165 bp, Artificial Sequence
  Description of Artificial Sequence: Synthetic coding sequence
atgcctggcaagaaagctagaaagaatgcacaacctagcccagccagggccccagcagagttagaggtcgagtgtgctactcagcttcgcaggtttggcgataagcttaacttccgccagaaactgctcaatttgatcagcaaactgttttgttccggcacttag

SEQ ID NO: 27965 - DNA, 1404 bp, Artificial Sequence
  Description of Artificial Sequence: Synthetic coding sequence
atggcttctgtagcagctgctcgggctgtgcctgtcggaagtgggctgcggggacttcagaggacgctgccattggtagtcattctcggggcaaccggcaccgggaaatcgacactggctttgcagttaggccagaggctgggtggtgaaattgtgtccgctgatagcatgcaggtgtatgaagggctcgacatcataacgaacaaggtctccgcccaggagcagagaatttgcaggcatcatatgatcagcttcgttgatcctctggttacgaattatacagtggtcgatttcaggaaccgtgcaacagcactgattgaagacatcttcgccagggacaaaattccaattgtcgtgggcggaacgaactactatattgagagccttctttggaaagtgctagtgaacaccaagccacaggagatgggaactgagaaagtaatcgataggaaggtggaactggaaaaagaggacggcttggtcctgcacaagaggctatcacaggttgatcctgagatggccgctaaattacacccacacgataagagaaaagtggccagaagtctgcaggtctttgaagaaacgggaatatcacactctgagtttctacatagacagcataccgaagagggaggcggtcctcttgggggaccactaaaattcagtaacccgtgcattctgtggcttcatgcagaccaggccgttctggacgagagacttgacaagcgagtagacgatatgctggccgctgggctcctcgaagaacttagggacttccatcgccgatacaaccagaagaatgtatccgaaaacagtcaggattaccagcatgggatcttccagtccatcggtttcaaagagttccatgaatacctgattacggagggcaaatgcactcttgaaactagcaaccagctgcttaaaaagggtatcgaggccttgaagcaggtgaccaagaggtacgcgagaaagcagaatcgatgggtaaaaaaccgcttcctgtcccggcctggacctatagttcctccggtttatgggcttgaagtgtcagatgtctcgaagtgggaggagtccgttcttgaaccggcattggagattgtccaatcttttatccaaggtcacaaacccaccgctacccccatcaaaatgccctataacgaggccgaaaataaaagatcgtatcatctctgcgatttgtgtgatcggattatcatcggcgaccgagagtgggctgcccacattaagtccaagagtcacttaaaccagctgaagaaaaggcgtagactggactccgacgctgtgaacacaattgagagccaaagcgttagcccagatcataacaaagagcctaaagagaaaggtagtcccggtcagaatgatcaggaactgaaatgttccgtatag

SEQ ID NO: 27966 - DNA, 558 bp, Artificial Sequence
  Description of Artificial Sequence: Synthetic coding sequence
atgggggtgaacctgacaaggtcgaataaggaaaccgtaaaacatagtgacgtattgttccttgccgtgaaaccacacattattccgttcatcctggacgagatcggcgctgatgtacaagcgaggcatatcgtcgtgagttgtgccgctggcgtgactatttcatcagtagagaaaaagctcatggcttttcaacccgctcccaaggtcatcaggtgcatgacaaacactcccgtggtcgttcaggaaggtgcaaccgtgtacgcgacaggcacacacgcgctggtggaggacggacaattgctcgagcagttgatgtccagcgtgggtttctgcaccgaggtcgaagaggatcttatcgacgcagtgaccggattgagtggtagcggaccggcttaccagagcatggcggatcaggagaagataagccccgctgcccttaagaagacgctgctggacagggtcaaattagagtcgccaaccgtgtccacactgactccttccagccctggaaaactcctgacacgcagcctcgctctggggggaaaaaaagactag

SEQ ID NO: 27967 - DNA, 960 bp, Artificial Sequence
  Description of Artificial Sequence: Synthetic coding sequence
atgtctgtcgggtttattggtgcgggacagctcgcaatgctctggaggggagccagcaggccccagcaccctgtggggtctcaagacaattctcaactccccaggaacgagcctgcccatggtgttcgcgctcaagaagacgggtgtgaaccagatactcaacagcaaggggacggtgaggcccagaggagaccggtaagcggttgtgaagctcatattatacctttcattctggacgagatcggagccgatgtccaagcgaggcacattgtcgtcagttgcgctgcaggagtgacgatcagttccgtggagaagaaactaatggcattccaacctgcacccaaggtcatccgctgcatgacaaatactcccgtagtggtccaagaaggagccaccgtctacgccacaggaactcatgcacttgtggaggacgggcagttgctcgagcagctcatgtcgagtgtgggattctgcaccgaggtagaggaggacctgattgacgccgtcacaggcctctcagggagtggtccagcctacgctttcatggctctagacgcgttggccgacggtggagtgaagatgggcttgcctaggcggctggctatccaattgggggcacaggccctgctcggcgcagctaagatgctgctcgacagcgaacagcacccatgtcaactaaaggacaatgtttgttctccaggcggagctactattcatgctctgcattttttggaatcaggtggctttaggagtctactcatcaacgccgtagaggcctcttgtatccggactcgagagttgcaatctatggctgatcaggagaaaatttcacccgctgcattaaagaagacactgctggatcgagtgaaactggagagccctaccgtgagcactttgactccgagcagtccgggtaagttactaacacgatcactggccttaggcggaaagaaagactag

SEQ ID NO: 27968 - DNA, 708 bp, Artificial Sequence
  Description of Artificial Sequence: Synthetic coding sequence
atgctgagcgcaactagaagggcctgtcagctgctcctcctccactcattattccctgtgcccaggatggggaactctgctagtaatatcgtatccccacaggaggcgctacccggacggaaagaacagacaccggtggcagctaaacaccatgttaacggtaatcgcaccgtcgagcctttccctgaaggcacacagatggccgtctttggaatgggttgcttctggggagccgaaagaaagttttgggtcctgaaaggggtatactccacccaagtcggcttcgcaggtggatacacatcaaaccccacatataaggaagtgtgttcagaaaaaaccgggcacgccgaggttgtgcgcgtggtatatcagcccgagcatatgagttttgaagagcttcttaaggtgttttgggagaaccatgatccgacacaggggatgcgccaaggcaacgaccacggaactcagtatcgtagcgccatctacccgactagcgcgaaacaaatggaagccgctctttcctctaaggagaactatcagaaggttctatcagagcatggcttcggcccaattacaaccgatatccgcgaaggtcagaccttttactacgcagaagactaccaccagcagtacctctccaagaaccccaacggttactgcggactgggaggtactggcgtatcgtgcccagtaggaatcaaaaaatag

SEQ ID NO: 27969 - DNA, 3873 bp, Artificial Sequence
  Description of Artificial Sequence: Synthetic coding sequence
atgagcggtcccctcgaaggggctgacggcggaggggatcccagacctggcgaaagcttttgtccgggaggggttccaagtcctgggcctccgcagcatcggccatgccctggtccgagcctggccgacgacacagatgcaaactcgaatgggtccagcggaaatgagtccaatggacacgaatcgcggggagcaagccagcgatcttcacatagcagttcctcaggcaacgggaaggacagtgcgctcttagagaccactgaatcctctaaaagtaccaattcccagtcaccatcgccacctagttccagcatcgcgtatagcttgctgtctgcatcttcagagcaggataacccatcaaccagtggctgctctagtgaacagtcggcacgagctagaacccagaaggaactcatgactgccctccgggagctcaaactgcggcttccccctgaacggagggggaagggccgttctggaactctggctacactgcagtacgcgctcgcgtgtgttaaacaggttcaagccaatcaggagtattaccagcaatggtcactggaagagggtgaaccctgctcaatggacatgtctacctacaccttagaagaactagagcacatcacaagcgaatataccttacagaaccaggacaccttctctgtagccgtgagctttctaaccggccgtatcgtctacatctccgaacaggccgcagtgttactcagatgcaagagagatgtgttccgagggacacgtttctcagaactgctcgcgccacaagacgtgggcgtgttttacggatcaacggctccaagtcgactgcctacctggggaaccggcgctagcgctggctcaggacttcgcgacttcacacaggagaaatccgtcttttgccggattagagggggacctgaccgggaccctgggccacgctatcagcctttcagattgaccccatacgtgaccaagattagagtatccgacggtgcccctgcacagccgtgctgcctgctgattgccgagcgcattcattccggctatgaagctccaagaattcccccagacaagcgcatttttaccactcggcacacccccagctgtctctttcaagatgtggacgagagggctgctccgctcctgggttacctgcctcaggatctccttggagcccctgtcttgttgttcctgcatccagaggatcgtccacttatgctcgccatccacaaaaagattctgcagttggccggacagccatttgatcacagccccattcggttctgcgccagaaatggagagtatgtcactatggatacgagctgggcgggatttgttcacccctggtctcgcaaagtggcctttgtgcttggacggcataaagtgcgcactgctcctctgaatgaagacgtgttcaccccacccgctccctccccggcacctagcttggacacggacattcaggaactaagtgagcaaattcaccggctgcttttgcagcctgttcactccccaagcccaacagggctttgtggagtgggcgctgttacctccccaggacccctgcactcacccggttctagcagcgactctaacgggggagatgctgaggggcctggtccccctgcacctgtaacattccagcagatatgtaaggatgtccacctggtcaaacaccaaggacagcagttgttcatcgagtcccgagctcggcctcagtctcggcctcggttgcctgctactgggacctttaaggccaaggccttgccatgccagagccccgaccctgagctggaggccggaagtgctccggttcaagccccactcgccctcgttccagaggaggcggagcggaaggaggcctcaagttgtagctaccagcagattaattgcctggactcgatcttgaggtacctagagtcatgcaacctgccatcaaccacgaagcggaagtgcgcaagttccagttcctacaccacaagctcagcctcggacgacgacaggcagcggaccggccctgtgtctgttggtaccaaaaaggacccacctagcgccgcactttccggcgagggagctacccctcgcaaagagcctgtggtgggtggcacactaagtcctttggctctggccaacaaggccgaatctgtagtcagtgtgacatctcagtgctcattctctagcacaatcgtccatgtcggcgataaaaagccacctgagagcgacatcatcatgatggaggacttacccggacttgctcccggacctgctccctcacctgcccctagccctaccgtggctcctgaccctgccccagatgcttatcgtcctgttggcttaacgaaagctgtgctctcgcttcacacccagaaagaagagcaggcctttctttcacgcttcagagatctgggcagactccgtggtctggattccagttcaacggccccttccgccttaggggaaaggggatgtcatcacgggcctgcacctccgtcaagacggcaccactgcaggtctaaagcgaaaaggtccaggcatcaccagaacccacgagctgaggcaccatgctatgtgagccacccgagtccagtccccccatcgacaccctggccaactcctcccgctaccactccattcccagccgttgtgcaaccatacccgctgccagtgttctccccaagggggggacctcagcctcttcccccagcaccaacctccgtgccccctgcagccttcccagcgccactcgtgactccaatggttgcccttgtgctcccgaactaccttttccctacaccttccagctacccctatggtgccctccagaccccagccgagggcccacctacgcccgcttcgcattctccgtcccctagtctgcctgccctggccccttcacctccccacaggcctgacagtccgctcttcaacagtcgctgttcatctccgctgcaactgaacctgctccagctggaagaattgccccgagcggagggcgctgccgtggctggaggacccggtagctccgcgggacctcccccaccaagcgccgaagcggcagaaccagaggctcgtctcgccgaagtgaccgaaagctccaaccaggacgctctgtctggatcttccgacttgctagagcttctgctgcaggaagacagcagatctggcaccggaagcgccgctagtggttccctggggagcgggctgggttccgggtcagggtctggctctcatgagggcggatccactagtgcatcgatcacacggtcaagccaatctagccacacctcgaaatattttggttcaattgattcctctgaggctgaggcaggtgccgcaagaggcggagccgagcctggagaccaggtcatcaagtacgtgcttcaagaccccatatggttgctcatggccaacgcagatcagcgggtaatgatgacctatcaggttccgtctcgcgacatgacttcagtgctcaaacaagatagggagcgcctgcgagctatgcaaaaacagcagccaaggttcagcgaggaccagcggagagagctgggagccgttcactcttgggtgagaaagggacagcttcctcgcgcactggatgtgatggcctgcgtggactgcgggagctccacacaggatccagggcaccccgacgaccctcttttctctgagctagatggccttggactggagccaatggaagaaggcggaggcgagcaaggcagtagtggcggtggctcaggcgaaggagaagggtgcgaggaggcccaagggggtgcaaaggcatcctccagtcaagacctcgctatggaggaggaggaggaaggacgaagctctagctccccagccctgcctactgctgggaactgcacctcatag

SEQ ID NO: 27970 - DNA, 2022 bp, Artificial Sequence
  Description of Artificial Sequence: Synthetic coding sequence
atggaaaaagctgtgaacgatggctcgcactcggaggagctattctgccacttgaaaaccatttccgaaaaagaagatcttccaagatgtacctccgagagccatttgtcttgtcttaaacaggacatcctgaatgagaagactgagctggaagccactctcaaagaagctgaactggtgacacattccgtagaactgctcctacccctcttcaaggatacgattgaaaagataaacttcgagaatgcaaacctttctgcgctgaacctgaaaatttcagaacagaaagagatcctgataaaggaactcgatacatttaagagtgtaaagctggctctggagcacctgctaaggaagcgtgattacaaacagactggtgataacctgtcttctatgctgcttgaaaatcttaccgataatgaaagcgaaaacaccaatctgaaaaagaaggtgttcgagaaggaagctcatattcaggagctcagttgtctgtttcaatccgagaaggccaatactcttaaggcaaaccgcttcagccagtccgttaaggtggttcatgagaggctgcagattcagatccacaaaagggaggctgagaacgacaagctgaaagagtacgtcaagtccttggaaaccaagatcgctaaatggaacctccagtcacggatgaataaaaacgaagccatagtcatgaaggaagcatcccgccagaaaacagtggcgctgaaaaaggctagcaaagtttacaagcagaggctagatcacttcacgggagcgatagagaaactgacttctcaaatccgagatcaggaggccaaactctcggagactatctctgctagcaatgcttggaaatcccattacgaaaaaattgtgattgagaaaactgagttggaggtacagatcgagaccatgaagaagcaaattatcaatcttctcgaagatttgaaaaagatggaggatcatggtaagaactcatgcgaggagatcctccgcaaggttcactcaatcgagtacgaaaatgaaaccctgaacttggagaacacaaagctcaaactcagattcccatgccggataaccgaaagtaagaacatgaacattctcattgtgctggacatgttgtgttatatctcttcagagaagaccacactcgccgcacttaaggatgaagtcgtgtccgtggaaaacgagctctcggaactacaagaggtcgagaaaaagcagaagacactgatcgaaatgtacaagacacaagtacaaaaactgcaggaagcggcagaaatcgtgaaatcacgatgcgagaacctgctccataaaaataaccagattactaagacaaaaaacaagaatgtggagaagatgagaggacagatggaatcccatttgaaagagttagagcgcgtgtgtgactccttgactgcggcagaacggaggctccacgagtgtcaggagagtttgcagtgctgcaaaggtaaatgcgctgaccaggagcacacaattcgggagctgcagggtcaagtagatggaaaccataatctgcttactaaattatccctggaagaagagaactgcctgatccaactaaagtgcgagaacctccagcagaagctcgagcagatggatgccgagaataaggagctggaaaagaagctagccaatcaagaagaatgtctgaagcattctaacttaaagttcaaagagaaatcagcggagtataccgcgctggctcggcagctcgaggcagccttggaagagggacgtcaaaaggtggccgaggaaatcgagaagatgtcttcccgcgagtcagccttacagattaaaatcctggacctcgaaacagagcttcgcaagaaaaatgaggagcagaatcagcttgtctgcaagatgaacagtaaggctcagcatcaagaagtgtgtctgaaggaggtgcagaacagcctggaaaagtccgaaaatcagaacgaaagcatcaagaattatctccagtttctcaaaacatcatacgtgacaatgttcgagtag

SEQ ID NO: 27971 - DNA, 798 bp, Artificial Sequence
  Description of Artificial Sequence: Synthetic coding sequence
atggatgacaaggcaagcgtgggaaagatctctgtatcaagtgactctgtgagcacattgaacagcgaggacttcgtactggtcagtagacagggggatgagactccctctactaacaacggaagtgatgacgagaagaccggccttaagatcgtgggtaacggctcagagcagcagctgcagaaagagcttgcagatgtcctgatggatccaccaatggacgaccagcccggtgaaaaggaactggtcaagcgtagtcagctggacggcgaaggggacggccctctgtctaaccagctgtctgcttcctccacaatcaaccccgtgccacttgtggggctgcaaaaacccgaaatgtcccttccagtgaagccgggacagggcgactccgaagctagctcgcctttcactcccgtggccgatgaagacagtgtggtgttcagcaaactgacctacctgggctgtgcttcagtgaatgcccctcgttctgaagtggaggccctgaggatgatgtctatcctgcggtcacaatgtcaaatatcgctcgacgttactcttagtgtgccgaacgttagtgaggggattgtgcggctcttggatcctcagactaacaccgagattgctaattacccgatatataaaatactcttctgtgttcggggtcatgacggaactcccgagagtgattgcttcgcttttactgaatcccactacaatgccgagctcttccggatccacgtcttcaggtgtgagatccaggaggccgtgagcccacaagaaaagacactgtgtaaatag

SEQ ID NO: 27972 - DNA, 636 bp, Artificial Sequence
  Description of Artificial Sequence: Synthetic coding sequence
atgtgggcaagcctaagccttgatcaccccagtgccaaagagaatcaggctcttagactcatagagatgcgtgaggagaacggtaacgtgccgaagactgagcaagccggaagtttgaagccactacgcgataccggcaagtcaaatctgaaggagaagaaggcaaacagtaaattaaaacaaattgagaaggagtacacacagaagctggccaagagcagccagataattgccgagctgcaaactacaatttcctccttgaaggaggagaatagtcagcagcagttggccgctgaacgacgtctgcaggacgtgagacaaaaatttgaagacgaaaagaaacaactcattcgcgacaatgaccaagccataaaggttctccaggatgagctggagaacaggtcgaaccaggtcagatgtgcggaaaagaaactgcaacacaaggagctggaaagccaggaacagattacctacattcgtcaggaatacgaaaccaaactaaaaggtttaatgccagccagtctgcggcaagagttagaggacactatctcaagtcttaagtcacaggtaaactttctccagaagcgggcttctattctacaggaggagctgaccacttatcaggggagaaggtag

SEQ ID NO: 27973 - DNA, 867 bp, Artificial Sequence
  Description of Artificial Sequence: Synthetic coding sequence
atgtcatcaagcatgtggtatatcatgcagagcattcagagtaagtattcattatccgagagattgattaggacgatcgctgcaattcgatcttttccgcacgacaacgtcgaggatcttattcgaggcggtgctgatgtgaattgtacacatggcactttaaaacctctccattgcgcttgtatggtaagtgacgcagattgcgtcgagcttttgcttgagaagggcgctgaggtgaatgctctggacggctacaacaggacggcgctgcactatgccgcagagaaggacgaagcttgtgtggaagtgcttctggagtacggcgctaatcccaacgcattggatggaaatcgggataccccgctccactgggcagcgttcaagaataatgcagagtgcgtgagagcgttactggagagtggagcctccgtgaacgctctggactacaacaatgatactccccttagctgggctgcaatgaagggaaatttagagtccgtgtccatactgctcgattatggtgctgaggttcgtgtgattaatctcatcggacagacaccgatctcccggctggtcgccctcctcgttcgcggtctaggtacagagaaggaagattcatgctttgagttgctgcatcgtgcagtcggtcatttcgagctacgcaagaatggcactatgcccagggaagtagccagagacccacaactgtgcgagaagctaaccgtcctctgctcggcaccaggcaccctgaaaacactggctagatatgccgtcaggcggagcctgggccttcagtacctccctgatgccgtgaaggggctgccactgcccgctagtctgaaggaatacctcctcttactggagtag

SEQ ID NO: 27974 - DNA, 1341 bp, Artificial Sequence
  Description of Artificial Sequence: Synthetic coding sequence
atgagagagatcgtgcatatccaggccggacagtgcggcaaccagattggcactaagttctgggaagtgatctcggatgagcatggaatcgacccagccggtgggtatgtgggggatagcgccttgcaactcgagaggatcaacgtatattacaacgaatcctcatctcagaagtacgtgccacgtgctgctctggtggacctggaacccggaaccatggactctgttagatcagggcctttcggtcagttgttccggcctgacaatttcatctttgggcagacaggcgctggcaacaattgggctaagggacactataccgaaggggctgagctggtggatgcagtactcgacgtggtgcggaaagagtgtgaacattgtgactgcttacagggctttcagctcacccatagtctggggggagggacaggtagcggcatggggacgctgttgataagtaagatccgcgaggagtttcctgacaggattatgaacacgttttcagttatgccaagcccaaaggtctcagacacggttgtagaaccgtataatgcgaccctcagcgtccaccagctggtcgagaatacagacgaaacatactgcattgataacgaagcattatatgacatatgctttaggaccttgaaactgacaaccccaacgtacggggatctgaaccatctggtgagcgccaccatgtctggagttacgacttcattacgattcccgggacaattgaacgccgacctgcgaaagctggccgtcaacatggttccctttccaagactgcatttcttcatgcctggattcgccccattgacctcccgaggctctcagcagtacagagcacttacggtgccagaactaactcagcaaatgtttgatgctcgtaacatgatggctgcctgcgatcccaggcacggcaggtatctgaccgtggccacagtgtttcgcggacccatgtccatgaaggaagtcgatgagcagatgctagcaatccagagcaagaactcctcttattttgtagaatggatcccaaacaatgttaaggttgccgtctgtgatatccccccacgaggcctcaaaatggcgagtacttttattggaaatagcactgcaatccaggagctattcaagcgcatctcagaacagttctccgccatgttccggagaaaggcctttctgcactggtttacaggggagggcatggatgaaatggagtttacagaggcggagagcaacatgaatgacctggtttctgagtatcagcagtatcaggatgccacggcaaatgacggggaggaggcgttcgaggatgaagaggaagagattgacggttag

SEQ ID NO: 27975 - DNA, 792 bp, Artificial Sequence
  Description of Artificial Sequence: Synthetic coding sequence
atgctgagctcaaagggtttgacagtagtggacgtatatcaaggctggtgcggtccttgtaaacctgtagtctcacttttccagaagatgcgcatcgaagtgggcctggatctgctgcatttcgccctggcagaggccgatcgcctggacgtgctcgagaagtatcggggtaaatgtgaaccaacgttcctattttatgccattaaggatgaggcgctgagcgacgaggatgaatgcgtctcacacgggaagaacaacggtgaggacgaagatatggtcagctctgaacgcacttgtaccctggcaatcattaaacctgacgctgtggcccatggcaaaactgacgagattataatgaagatacaggaggcgggattcgaaatactgactaacgaagaaagaactatgacagaagcagaagtgaggctcttctatcagcataaagccggtgaggaggctttcgagaagcttgttcaccacatgtgttccggcccatcccacttgctgattctgaccaggaccgagggatttgaagacgtagtgacgacttggcgcaccgtaatgggcccacgcgatccaaacgtggccagacgagaacagcctgaaagtctccgcgctcagtatggcaccgaaatgccattcaatgccgtgcacggatcccgcgacagagaggacgccgaccgggaattggcgctgctattcccgtctctcaagtttagcgataaagatactgaggcccctcaaggagagtcctcgactcagccacgattgaaaattactgacctcgattag

SEQ ID NO: 27976 - DNA, 1089 bp, Artificial Sequence
  Description of Artificial Sequence: Synthetic coding sequence
atgttgaaaaacaagggacactcttccaaaaaggataatctggcagtaaacgctgtcgcactgcaggatcacatccttcatgatctacagcttagaaatctgtccgtggccgaccacagtaagactcaagtgcagaaaaaggagaataaatcacttaagcgagacacgaaagccattatagatactggcctcaaaaagacaacacaatgtccaaagttggaagattcggagaaagaatatgtgctggaccccaagcctccacccctgacattagcccaaaagctgggactgatcgggcctccacctcccccattgtctagcgacgaatgggagaaggtgaaacagaggtccctcctccagggagacagtgtgcagccatgccccatctgcaaagaggagttcgagctgcgaccgcaggtgctcctgtcctgctctcacgtcttccacaaagcctgcctgcaagcttttgaaaagttcactaataaaaaaacctgcccactgtgccgcaagaaccaataccagaccagggtgatccatgacggcgctcgcctattcaggataaaatgtgttactaggatccaggcttattggaggggctgtgtcgtacggaagtggtatcgcaatttgagaaagacggttccaccaactgacgccaagcttcgaaaaaagttcttcgaaaaaaaatttaccgaaatttcccatcggatcctgtgttcatataatacgaatattgaggagttgtttgctgagattgatcagtgcctcgctattaatcgaagcgtcctgcagcagctcgaggagaaatgtggccatgagatcacagaagaggagtgggagaagatccaagtgcaggcactgagacgcgagacccacgaatgctccatatgtttagccccactgagcgctgccggagggcagagagtcggcgctgggagacggagtagagagatggccctgctgtcatgttctcacgttttccatcatgcctgcctgctggccctggaggaattcagcgtgggcgatcgaccaccttttcatgcctgccccctgtgtaggtcctgctaccagaagaaaatccttgaatgctag

SEQ ID NO: 27977 - DNA, 291 bp, Artificial Sequence
  Description of Artificial Sequence: Synthetic coding sequence
atgatcgaaaagatgcaagggtctagaatggacgaacagaggtgctcttttccaccacctcttaaaacagaagaggactacataccttacccctccgtacatgaagtactgggtcgcgaaggccctttcccattaattctcctgccacagtttggcggatactggatcgaaggtactaaccacgaaatcacctccatccccgagactgagcccttgcagagtcctaccacaaaagtcaagcttgagtgtaatccgactgccagaatataccgcaagcacttcctcgggtag

SEQ ID NO: 27978 - DNA, 459 bp, Artificial Sequence
  Description of Artificial Sequence: Synthetic coding sequence
atggcgggactgccccgacggatcataaaggaaacgcagagactgcttgccgaacctgtcccaggtattaaagcagaacctgacgagtctaacgccagatacttccacgtggtgatagcaggcccacaggattctcccttcgagggaggcacttttaaactcgagctctttctcccagaggaatatcctatggctgcgcctaaagtccgcttcatgactaaaatttatcaccctaatgtggacaagctcgggcgaatttgtctggatattcttaaggacaagtggagccctgccctacagatccgcacagttctgctctctatccaagcattactgtctgcacctaatccagatgacccactggcgaatgacgtggcagaacaatggaaaactaacgaggcccaggccatagaaacagcccgagcctggacaaggttgtacgccatgaacaacatttag

SEQ ID NO: 27979 - DNA, 3354 bp, Artificial Sequence
  Description of Artificial Sequence: Synthetic coding sequence
atgtatagaagctcagcacggagcagtgtcagttcgcatcgacccaaagacgacggaggcggaggacccagatcgggacgatcctcgggttcctcctcaggaccagccagacgcagtagcccgcctccccctcccagcgggtcctcctccaggactcccgcacgcagacccaggtcaccaagtggacatagaggacgacgcgcttctcccagccccccacgcggacgccgagtctccccttccccaccgagagccaggagagggtctccctcgcctcctcgtgggagaaggctcttcccccctgggcctgcaggtttccgagggagtagtagaggggaaagcagagccgattacgcccgagatggaagaggggaccatcccggagactccgggtcacgcaggcggagcccgggactgtgttctgatagcctggagaaatctctcaggataacagtgggtaatgatcacttttgcgtgagtactcctgagcggcgtcgactgtccgataggctgggaagtcctgtcgacaacttggaagatatggaccgtgacgacttaactgacgactccgtcttcacgcggtctagccagtgctccagggggctagaacggtacatttcacaggaagagggtccgctgtcgccgttcctgggccagcttgacgaggactaccgtaccaaagagacctttttgcatcgctccgattacagtccacatatctcatgccacgatgagttacttagaggcaccgagaggaacagagagaaactgaaaggatactctatcaggtccgaggagcggtcaagagaagcaaagcgcccaagatatgacgacaccgtcaaaattaattcaatggggggagatcaccctagttttactagtgggactagaaattaccgacagagacggagatctccttccccacgcttcctggacccggaatttagagagttggacttggctcgtaggaaacgagaggaggaggaagagcggtcacgctcattatcgcaggagctcgttggtgtagatggtgggggaacaggatgcagtattcctggtctatccggcgttctgactgcttcagaaccgggttattcgctacaccgccctgaggaagtttcagtgatgccaaagaagtcaatcctgaaaaagcggatcgaggttgacattatggagccatctatgcagctggaatccttttccagctccacaagttcctcacaagaccaccctctctatagcgggcacccatctctgccccttagcggggcaattgccgctttcgctagcgaaattgagaacaagggcaccatggttgaaaccgccttgaaggagcctcaggggaacctttaccagtggggacccttaccaggtattcccaaagataattccccactgagagagaagttcggctcatttctatgtcacaaggacaacctggacctaaaggcggaaggcccagaaaggcacacggactttctgcttccgcatgagagggcctcccaggacggctccggcttcagtagaattttaagcatgctcgcagactcaacctccactcaggaaaaacgtaggagatcctttcctgacattgaagatgaggaaaagtttctgtacggcgatgaggaagaggaccttaaagctgaaagcgtgccaaagcctctcggcagttccgagagcgaagtgatgaggcagaaagctagcagcctccccagctccgcccctgcggtcaagctagagtccctcgaggagacaaatcccgagtacgccaagatacatgacctactgaaaactattggtctggatatcggggtcgcagagatctctcaattagccgctaggactcaggaaagactgcatggtaaaaagccatcattacggagctctgcagacaggaggtccagtgttgatcgctatttctcagccgaccactgctcatcagtggaccacaggtttagcgctgataggtgctccagcgttgaccattgcttttcagccgacaggcggtcgtctgatccccaccgccttgaatctcgggaggcccaccatagtaatacacattcccctgaggtgtcacatcctcatccaccttctccggtcgatccttacctgttgaccaagaatagcccaccttttctgaagtcagatcacccagttggccatatttccgggccagaagtggttgggagcgggttccagtcatccgtcgccgtaaggtgcatgctgcctagtgccccaagtgctccgatacgactgcctcacaccgccgcactctcgcagttccatatgccacgtgcttctcagtttgccgctgctcgaatcccgccaaattaccaagggccagcgattccaccagccagtttcgacgcatataggcattacatggcatatgctgccagtcgctggcctatgtaccccacttcacagccaagcaatcacccggttcctgagccacatagaattatgcccatcacaaaacaggctactcgttcacgacctaacttgagagttatcccaacagttacccctgataagcctaagcagaaagaaagtcttcggggttccatccccgcagcccaggtgcccgtgcaggtgtctatcccatctctcatcagatacaacccagaaaaaatctctgacgagaagaaccgcgctagccagaaacagaaagtgatcgaggaaagagaaaaacttaagaacgaccgcgaagccaggcaaaaaaaaatgtactatctgcgaactgaactcgagcgcctgcacaagcagcaaggggaaatgctccggaaaaagcgcagggagaaggacggtcataaagacccacttttggttgaagtttcacgattgcaggacaacattatgaaggacatagccgaactgagacaggaagccgaagaggccgagaagaagcagtcagagctggataaagttgctcagattttgggcataaacatctttgacaagtctcagaaaagtttgtctgatagtcgcgaaccgacggagaaacctgggaaggcagagaaatctaaatcccccgaaaaagtaagctcattcagcaactcctccagcaataaggaatcaaaagtaaacaatgagaaattccggacaaaaagccctaagccagcagagtcaccacagagcgcaacaaagcagctcgatcagcctaccgccgcatatgagtactatgacgccggaaaccactggtgcaaggactgcaataccatctgcgggaccatgttcgacttcttcacgcacatgcacaataagaagcatacacagggccaattccagaaaagctccgacttccaaaaagagggcctccagcagacctttctcccgccagagcgacaggggtag

SEQ ID NO: 27980 - DNA, 576 bp, Artificial Sequence
  Description of Artificial Sequence: Synthetic coding sequence
atgtatgtttgtctctgtgtttcagttgccaaagtgacaatggccgaccgcgctgctgcagagagggcttgtaaggacccaaatccaattatcgatggaagaaaagctaacgttaatctggcatatcttggagcaaagccgagaattatgcagcctggcttcgccttcggagtccaacagctgcaccccgctttgatccaacgcccttttgggatacctgcacattacgtatacccccaggcctttgtgcagccaggcgtcgttattccccatgtgcaacctacagctgcagctgcttctaccacaccttacattgactacactggtgcagcctatgctcaatattcagccgcagccgcagccgcagccgcagccgcagcttatgaccagtatccatacgccgcatcgccggcagcggcaggctatgttaccgctgggggttatggctatgcagtccaacaacccatcacagcagcagcgccaggcacagccgctgctgctgctgccgcagccgcagcagcagcagccttcggccagtatcaaccgcagcaactgcagactgaccgtatgcaatag

SEQ ID NO: 27981 - DNA, 330 bp, Artificial Sequence
  Description of Artificial Sequence: Synthetic coding sequence
atggctggtgccccaaccgtttcactgccagagctgcgatccctattagcatcaggacgcgctaggcttttcgatgttagatctagggaggaggcggctgcagggacaattcccggtgctctgaatatacccgtctctgaactcgaaagcgctctccagatggaacccgctgcctttcaggctctctattctgccgaaaagcccaagctggaggacgaacacctggtgttcttttgccaaatggggaagaggggactccaagccacccagctggcccgtagcctcggatatactggatatggcgaggtgtggctgctcgcaggccgatag

SEQ ID NO: 27982 - DNA, 630 bp, Artificial Sequence
  Description of Artificial Sequence: Synthetic coding sequence
atggcccttctggcagagcacctcctcaaaccactgcccgcagacaaacaaattgagactggcccttttctggaggcagtctcacacctgcctccctttttcgattgtctcggcagccccgtgttcacgcccataaaggcagacatcagcgggaatattaccaaaattaaggccgtttacgacactaacccagctaaatttaggaccttgcaaaatatccttgaagtggaaaaggagatgtacggtgccgagtggccaaaggtgggcgctacccttgctctcatgtggctcaagaggggtctgagatttattcaggtgttcctgcagtccatctgcgatggtgagcgggatgaaaatcatccaaacctgattcgtgtgaacgccactaaggcctacgagatggctctgaagaaatatcatgggtggatagtccaaaaaatctttcaggctgccctttatgctgcgccttataaaagtgattttcttaaggccctgtctaagggtcagaacgtcacggaggaggagtgccttgagaagattcggctgtttctagtgaactatactgcaactatagacgtgatatacgaaatgtacactcagatgaatgctgagctcaattacaaggtttag

SEQ ID NO: 27983 - DNA, 474 bp, Artificial Sequence
  Description of Artificial Sequence: Synthetic coding sequence
atggaagaagctcaacggaagaggacccagctgcgcgaggcatttgagcagctgcaggctaagaagcagatggctatggagaagcggcgagccgtgcagaatcaatggcaactccagcaggagaagcaccttcagcatctggcagaagtgagtgcagaggtgcgggagcgaaagacaggcacccagcaagagctggaccgggtgttccagaagctgggcaatctcaagcagcaagccgagcaggaacgggacaagctccagcgctaccagacatttctgcaattactatacactttacagggtaaactgctgtttccagaggcagaggcagaagccgaaaacctgcctgacgacaaaccgcagcagccaacccgtccacaggagcagtctacaggcgatacgatgggcagagaccccggagttagcttcaaagccgtcggcctgcaaccggctggagacgtcaacttgccctag

SEQ ID NO: 27984 - DNA, 639 bp, Artificial Sequence
  Description of Artificial Sequence: Synthetic coding sequence
atggaggtgctccgacggtcctcggtattcgcggcagagattatggacgcatttgaccgaagtcccacagacaaggaactggtcgcccaggctaaagcgcttggacgcgaatatgtgcacgcgagattgttgagggccggtctgagttggagcgctccagagcgcgcagcacccgtgccaggtagattggcagaggtctgcgctgtactgctgaggttgggagacgagttggaaatgatccgaccatccgtctacagaaatgtggccagacaacttcatatttcacttcagagcgagcccgtggttacagatgctttccttgctgtcgcgggacatatcttcagcgccggaattacttgggggaaagtcgtgtccctttatgctgtggctgcagggttggccgtagactgcgtcagacaggctcaaccggctatggttcacgccctagtggactgcctcggggaattcgtccggaaaactctggccacttggcttcgcagaaggggtggatggactgatgtgctgaagtgcgtggtctctaccgatccgggtctgaggtcccactggttagtcgcggcactctgtagctttggcagattccttaaggcggctttcttcgtgctgctccccgagaggtag

SEQ ID NO: 27985 - DNA, 2148 bp, Artificial Sequence
  Description of Artificial Sequence: Synthetic coding sequence
atgtcgcaaagcggcgctgttagctgttgtcccggagccactaacggctcactcggcaggagcgacggcgtcgcaaagatgtctcctaaagatctctttgagcaacgcaagaaatactctaattcaaacgttattatgcacgagactagccagtatcatgtgcagcatctggctacttttatcatggataagagtgaagccattacctctgttgacgacgccatccgaaagctggtgcagctatctagtaaagaaaaaatatggactcaagagatgctgcttcaggttaacgaccagagtctgagacttcttgatatcgaaagtcaggaagaactcgaagattttcctttgcctaccgtccagaggagccagaccgttcttaaccagctgcggtacccctcagtactactcctcgtgtgccaggacagcgaacagagtaagccggacgtgcattttttccactgtgatgaggtagaagccgagctggtgcacgaggatatcgagtcagcccttgccgattgtagattgggaaagaaaatgagaccgcagacgctcaagggtcatcaagagaagatcaggcaacgccagtctatcctccccccacctcagggccctgcccctattcccttccagcataggggcggagacagcccagaggctaaaaatcgggtggggcctcaggttcctctgtctgaaccgggatttagaaggagggagagccaggaagaacccagggctgtgcttgcccagaagatagagaaggagacccagatcctgaattgcgctctcgacgacatcgagtggttcgtggcgaggctgcagaaagctgcagaagccttcaaacagttgaaccagcgaaaaaagggcaagaaaaagggaaaaaaggctcccgctgagggagtccttacactccgggcacggccacccagtgagggtgagtttattgactgctttcagaaaatcaagctcgccataaatctgctggctaaacttcagaagcacattcagaaccccagcgccgcagagctggtgcatttcctttttgggcctctggaccttatcgtgaacacctgcagcgggccagatatagcaaggagcgtgtcatgccctctgctctctcgagatgcagtagatttcctccggggacacctcgttccgaaagagatgtcactctgggaaagtttgggggagagctggatgagaccacgctcagagtggccaagagaaccgcaggtgcctctctacgtgcccaaatttcacagtgggtgggagcctcccgtcgatgttctccaggaagccccatgggaggtagagggtctggcttccgctccaattgaggaagtatcccccgtgagccgtcaatccatcaggaattcccagaagcatagtccaacatcagaacccaccccgccaggcgacgccctgccacccgttagctccccacacacgcacaggggataccaacctacaccagctatggctaagtacgtgaagattctatatgatttcaccgccaggaatgcgaatgagctcagcgtcttaaaagacgaagtgctggaagtgcttgaagatgggaggcagtggtggaaactccgatccagatcgggacaggcaggttacgtaccttgcaatattctcggagaagcccgacctgaggacgccggagctccttttgagcaggctggacagaaatactgggggcctgcttctccgacacataaactgcccccatcgtttcctgggaataaggatgaattaatgcagcacatggatgaggtcaatgacgagcttatccgcaagatcagtaacataagagcccagcctcagcgacactttcgggtggagcggagccagccagtgtctcagccactgacgtacgaatcaggccctgatgaagttagagcttggctggaagccaaagcttttagcccaaggatcgtcgagaacctgggcattctcacaggaccgcagcttttctcccttaacaaagaagaactcaagaaggtctgcggtgaggagggagttcgggtatattctcaactaaccatgcagaaggccttcctggagaagcagcagtccggttcagaactggaagaactgatgaacaagtttcactctatgaaccagagacggggagaggattcctag

SEQ ID NO: 27986 - DNA, 600 bp, Artificial Sequence
  Description of Artificial Sequence: Synthetic coding sequence
atggcatggccatgcatctccaggctctgttgtcttgccaggcgctggaaccagctggatcgctccgacgtggcggtgccactgaccctgcacggttactctgacctcgactctgaagagcccggtaccggcggagccgcaagtaggaggggccagcccccagctggagctcgcgattcaggtcgggatgtaccactgacacagtaccagcgggactttggcttatggacaaccccagcagggcctaaggatccccctccagggcgaggaccgggagcaggcggacgccgaggcaagagtagcgcacagtcctccgcacccccagctccaggggcacggggagtgtatgtgctccccataggcgatgccgatgcggcagcagccgtgacaactagctacagacaggagttccaggcctggaccggcgttaagccatctaggtcaacaaaaactaaacctgccagagtgattaccactcacacaagtgggtgggactcttcgccaggagctggcttccaggtgccggaggtcaggaagaaatttacccctaatcctagcgcgattttccaggcgagtgctcccaggatattaaacgtctag

SEQ ID NO: 27987 - DNA, 5105 bp, Artificial Sequence
  Description of Artificial Sequence: Synthetic coding sequence
atgggcaattctgatagccagtacactctccagggctcgaaaaaccactctaacacgatcactggcgctaaacagatcccctgtagcctgaagatccgtgggatccacgctaaagaagaaaagagcctacacggctggggccacggatccaatggggctggatataaatcaaggagcctggccagatcctgcctcagccacttcaagagtaaccagccttacgcgtctcgcctgggtgggcctacatgcaaggttagccgcggagtggcttactctacacatagaacgaacgcccctggcaaagacttccaaggcatctcagccgcatttagcacagagaacggattccactccgtgggacatgaattggccgacaatcacatcacctccagagactgcaacggccatttgctgaactgctatggtcgcaacgaatctatcgcctctacacctcccggagaagataggaaaagcccacgggtgctgattaagacgttaggcaaacttgatgggtgcctaagagtggaattccacaacgggggtaacccaagcaaggtgcccgcagaagactgctccgagcctgtgcagctccttaggtattcccctacactggcctctgaaacgtccccagttcccgaggcacggagagggagcagcgctgattctctaccttctcatagaccctcacctaccgactcccggctgcgatcaagtaaagggagctcactaagtagtgagagctcatggtacgactctccctggggtaatgccggagaactatccgaggctgagggatcttttcttgcacctggcatgcccgatcccagtttacacgcctcctttccaccaggggacgctaagaagcccttcaatcagtcttcgtccctctctagtctgagagagctctacaaagacgccaacctgggaagtctctcaccatcaggtattagactctccgatgagtatatgggaacccatgcgagcctctctaacagggtctcctttgcatccgatattgatgtgccctcacgggtggcccatggagatcctattcagtattcatcctttaccttgccctgcaggaagccaaaggcatttgtggaagatacagccaagaaagactctctgaaggcccgtatgagacggatcagtgattggacgggctctctgtcccgcaaaaagcggaaactccaggagccacgttctaaggagggcagcgattattttgattcacgctcggatggactgaacaccgacgtgcagggcagctcacaggcaagtgctttcctgtggagcggtggtagcacccagattctgtcccaacggtctgaatcaactcacgcgatcgggtccgatcccctgcggcagaacatctatgaaaactttatgagggagctggagatgagtaggactaataccgagaacatcgagactagcacagaaaccgccgagtcaagcagcgaaagcctttcaagtctcgagcagctagacctcctgttcgaaaaggagcagggcgtcgtccgaaaagccggttggctgttttttaaaccactcgttacagtacagaaggagcggaaactcgagctggtggccaggcggaaatggaagcagtattgggtaaccctgaaaggctgtacactgctcttttacgagacatatggcaagaatagtatggatcagagcagcgccccacgatgtgcgctgtttgctgaagatagtattgtgcagagtgtgcccgagcacccaaaaaaggaaaacgttttctgcttatcaaactcatttggcgatgtctacctgttccaggccacctcacaaacagatctggaaaactgggtcaccgcggtccactctgcttgcgccagcttgttcgccaaaaagcatggaaaggaggacactctgagattgctgaaaaaccaaaccaaaaatctgctccagaagattgacatggattctaagatgaagaagatggctgaactccagctgtccgttgtttctgaccctaaaaatcgtaaggcgattgagaaccagattcagcagtgggaacagaatctggaaaagtttcacatggatttgtttagaatgcggtgctacctcgcctccttacagggtggtgagctccccaatccgaagagcctcctcgcagccgcaagcaggccttcgaaattagctctgggcaggctagggatccttagtgtcagttcattccatgccttggtctgctcacgggacgattcggccctgcgcaagcgaaccctgagcctgactcagcgtggccgaaacaaaaagggcattttttcatcactcaagggcctcgatacgctggctagaaaaggaaaggagaagagaccttctattacccaagtggatgaactactgcacatctatggctccaccgttgacggggtcccgcgagacaacgcatgggagatccaaacgtacgtgcatttccaggataatcatggggtgacagttggtattaagccagagcatagggtagaggatatattaactttagcctgtaaaatgcgccaactggaacccagccactatgggctccagctcaggaaactcgtggacgacaatgtcgagtattgtatcccagccccttacgagtatatgcaacaacaggtttacgatgagattgaggtatttccactaaatgtgtacgacgtccagctcacgaagacaggatccgtctgtgactttggctttgcagtgacagcacaggtcgacgagagacagcatctctcacgaatttttattagtgacgtcctaccagatggactggcttatggtgaaggtctgcggaaaggcaatgagattatgacgttgaacggcgaggccgtttctgacctcgacctgaaacaaatggaggcccttttctccgagaaatccgtgggcctcacactgatcgctagaccacccgatactaaagccacactctgcacatcttggagcgactcagacctcttttcgagggatcaaaagtctctgctgccaccccctaatcaatcgcagttacttgaagaattcctggataattttaagaaaaacactgcaaatgatttttcaaacgttcccgacatcacaaccggtttgaagcgctcgcagaccgacggaacgctcgaccaggtttcgcatcgggagaaaatggagcagactttcagatctgctgagcagattactgctctgtgccgcagctttaacgattcccaggcaaatggcatggagggtcctcgcgagaaccaggatcctccaccaagaagcctggccaggcacctctctgacgctgaccgactgagaaaagtcatccaggaactggttgacacagagaaatcctacgttaaggacctttcttgcctttttgagctgtacctcgaaccattgcaaaacgaaacatttctaactcaggacgagatggaatcactgtttgggtctctgcccgaaatgcttgaatttcaaaaagtcttcttggagacactggaagatgggatctcagcgagctcggactttaacactctcgagacaccatcccagttccgcaagctcctgttttctctggggggatccttcctgtattacgcggatcatttcaagttatattctggattctgtgcgaaccacattaaagtgcagaaggtacttgaacgtgcaaaaacggacaaagcgttcaaggcattcttggacgccagaaatccaaccaagcaacacagcagcacacttgagtcgtatctgattaagcccgttcagcgggttttgaaataccctctgctgctgaaggaacttgtaagtcttacagatcaggagagtgaggagcactaccatctaactgaagcgctgaaggccatggagaaggtggccagccatattaatgagatgcagaagatctatgaggactacggcacagttttcgatcagctggtcgctgaacaatcgggcacagagaaggaagttactgagctgagtatgggggagttgctcatgcactctaccgtgagctggttaaacccattcttgtctctgggtaaggcgaggaaggatctcgaactcaccgtcttcgtgttcaagagagcagtaatactggtgtacaaagagaactgtaaactgaagaaaaagctgccaagcaacagccgaccggcacataatagcaccgatttggatcccttcaagttcagatggttgattcctattagcgctttgcaggtgcgcctgggaaaccccgcaggcactgagaacaactcaatctgggaactgatccacaccaaaagcgaaattgaggggaggcccgagacgatctttcagttgtgttgctctgacagtgagagtaaaacgaatatcgtgaaggttatccggagcattctgcgcgagaacttcaggcggcatattaaatgcgaactgcctcttgaaaaaacatgtaaagaccgactggtccctctgaagaatcgtgtgcccgtgagcgctaaactcgcatcaagcaggtccttaaaggttttgaagaattcatccagcaacgaatggacaggggaaacaggaaaggggaccctactggacagtgacgaagggagcctcagttctggaacccagtcttctggttgtccaaccgccgagggtcggcaggacagcaagtcaacatctcctggaaagtacccccaccccggacttgcagactttgccgataacctcattaaggagtctgacattctcagtgacgaggacgatgatcaccgtcagactgtaaagcaggggagccctaccaaggacatcgaaatccagttccaacggttgaggatttccgaagatcctgatgttcaccccgaggccgaacagcaacctggcccagagtcaggcgaaggacagaaaggaggcgagcagcccaagctggtccgaggccacttctgtccaatcaagcgaaaggctaatagtaccaagagggaccgaggaacactgctaaaggctcagatcagacatcagtctttggacagtcagtccgagaatgccacgatagatttgaatagcgtactcgaacgcgaattttccgtgcagagcctgacatctgtggttagcgaggagtgcttctacgaaactgagtcacacggcaagagcta

SEQ ID NO: 27988 - DNA, 3177 bp, Artificial Sequence
  Description of Artificial Sequence: Synthetic coding sequence
atggacctgggaccactgaatatctgcgaggagatgaccatccttcacggagggtttctgctggccgagcagctgttccatcccaaggccctagccgaattgaccaagtcggattgggaacgggtgggacgacctatcgtggaagccctccgcgagatatctagtgctgccgctcactctcaaccatttgcctggaagaagaaggctctcatcatcatttgggccaaagtactccagccacacccagtcacccctagcgatacggaaacccgatggcaggaagatctgtttttttcagtgggcaacatgatccctaccatcaaccataccattctcttcgaactcctgaaatctcttgaggctagcgggctgtttattcagctgctgatggcgttaccgacaaccatctgtcacgccgaactggagcgcttcctcgaacacgtgacggtcgacaccagcgctgaggacgtggccttcttcttagacgtatggtgggaagtcatgaaacacaaaggtcatccacaggaccccctgctgtcccaattctctgcaatggctcataagtacctaccagcactcgacgaattccctcatcctcccaaaagattgcgatcagacccagacgcctgcccgactatgccactgctcgcaatgttgctgaggggactgacacaaatccaatcgagaatcttgggccctggcaggaaatgttgcgccctggctaatctcgccgacatgctgaccgtttttgctcttaccgaagacgaccctcaggaggttagcgctaccgtgtacctggataaactagctacagtgatcagcgtttggaactcagacacccagaatccgtaccaccaacaagctctggctgaaaaagtgaaagaggctgagcgcgacgtgtccctgactagtctagctaaactgcctagcgagacgattttcgttggctgcgaatttcttcaccacctcctccgcgagtggggggaggaacttcaggccgtgctgagatcatctcaagggaccagttacgattcttatcgactctgtgacagtctcacctctttctcccagaacgcaacactttacctaaatcgaacaagtcttagcaaggaggaccggcaagtcgtaagtgagcttgccgagtgcgttagagattttctccggaagacatcaaccgtgctgaaaaacagagcactcgaggacataactgcctcaatcgccatggcagtaattcagcagaaaatggatcgtcatatggaggtctgctacatattcgcaagcgaaaagaaatgggctttttctgacgagtgggtggcgtgtttgggttctaatcgtgcattatttcgtcagccagatctcgttcttagacttttggaaacagtgatcgatgttagcactgcagatcgcgcaattcccgagagtcagattcggcaagtcattcatctgatactggagtgctacgccgatctctcactcccagggaagaataaggtccttgcagggattctacggtcctgggggagaaaaggactttctgaaaaactgttggcctatgtggaaggattccaagaagatctgaatactaccttcaaccagctgactcagagcgcctcagaacagggacttgccaaggccgtggcttctgtcgctaggctggtgattgtacaccctgaagtgacggttaagaagatgtgttctcttgcagtagtcaaccttggaactcataaatttctcgcccagattctgacggcttttcccgctcttcggtttgtcgaagagcagggccctaatagcagcgccacattcatggtcagttgtcttaaagaaaccgtgtggatgaagtttagcacacccaaggaggagaaacagtttctcgaattgctgaactgcctgatgagtcctgttaagccgcaaggcatccctgtggcagccctactggaacccgatgaagtcctcaaggagttcgtcttgccatttctgcggctggatgtagaggaagttgatctgtcgcttaggattttcattcagaccctagaggccaacgcctgcagagaggagtattggctgcagacctgctcccccttccccctcctgtttagtttgtgtcagctgttagataggttctctaaatattggcaattaccaaaggagaagaggtgcctgagcctggaccgtaaggatctggcaatccatatccttgaactcctgtgcgagattgttagcgctaatgcagagacctttagccccgacgtatggataaagtcgctttcttggttacaccgtaagcttgagcagttggactggaccgtgggactaaggttgaaatccttcttcgagggccattttaagtgcgaggtgccagccaccctatttgagatatgtaaattaagtgaggacgaatggacctcacaagctcatcccggatacggtgcagggactggactcctcgcttggatggaatgttgctgcgtgagtagtggcattagtgaacggatgctgagtttacttgtggtggacgtgggaaatcccgaagaagtgcggctgttcagtaagggcttcctcgtggctctggtccaggtgatgccttggtgcagcccacaggagtggcaacgcctgcaccaactgacccgaaggctgttagagaagcagctgttgcacgtcccctacagcctggaatacatacagttcgtcccccttctaaatctcaagccatttgctcaggaattacagctgagtgttttattcctgcgtacattccagtttctatgctctcacagctgtagagactggctccccttggagggctggaatcatgtcgttaaactgctatgcggttctttaactcgactcctagattccgtgcgggcaatccaggcggctggtccatgggtgcagggacctgaacaggacttgacacaagaggccctgtttgtctacactcaggtgttctgtcacgctcttcacatcatggccatgctgcaccccgaggtgtgcgaacctctgtatgttttagctctggagacattgacttgttacgaaacactttctaaaaccaacccgtccgtgagctccctgctgcaacgtgcccatgaacagcgttttctgaaatccatagccgaaggtataggcccagaggaacgccgacagactctcctgcagaaaatgtcttccttctag

SEQ ID NO: 27989 - DNA, 267 bp, Artificial Sequence
  Description of Artificial Sequence: Synthetic coding sequence
atgtccggcctccgcgtctactccacgtctgtgaccggcagccgcgaaattaaaagccagcagtctgaggtaaccaggattcttgatgggaagcgcattcaataccaactcgtggatatctcacaggacaacgccctacgggatgaaatgcgggcactcgctggcaatccaaaagcgactcctcctcagatcgttaatggcgaccagtactgcggagtgtgggccggagggcgaggcggaggcggatccgttggtagaggcctgtag

SEQ ID NO: 27990 - DNA, 933 bp, Artificial Sequence
  Description of Artificial Sequence: Synthetic coding sequence
atggacgggagcttcgtgcagcattccgtacgcgttctccaggaactcaataagcaacgagaaaaaggccaatactgcgacgctaccctggatgtcggtggattggtgtttaaggcccattggagcgtgttggcgtgctgcagtcactttttccagagcctgtatggcgatgggtctgggggatctgtggtgcttccagccggatttgcagagatcttcggcctgctgctggattttttttacacgggtcacctcgccctgaccagcggcaaccgtgatcaggtgctcctggcagccagggagcttagagtccccgaagctgttgaattgtgtcaaagttttaaacccaagacatccgtgggacaggcggctggcggacagtctggccttggaccgccagcatctcaaaacgtcaattcccacgtcaaagagcccgcaggactggaagaagaggaagtatcgagaacactcggcctggtacctcgtgaccaggagcctagagggtcccacagtccacagcggcctcagcttcacagcccggcacagagcgagggtcctagtagtctgtgcggtaagctcaaacaggccctaaagccatgcccgcttgaggataagaagccggaggactgtaaagtgcccccacggcctctcgaggccgaaggagcccagttgcagggaggatctaatgaatgggaagtggtggttcaggttgaggacgatggagacggcgactacatgtctgaacctgaggccgtgctcactcgtagaaagtctaacgtcatccgtaagccctgtgccgcagaacccgctttgagcgccggatcacttgccgctgagcccgctgaaaatcggaaaggaaccgccgttcccgtggagtgcccaacttgtcataagaagtttctttccaaatattacctgaaagtccacaattag

SEQ ID NO: 27991 - DNA, 600 bp, Artificial Sequence
  Description of Artificial Sequence: Synthetic coding sequence
atgtctagtggaaatgcaaagattgggcatcccgcaccaaatttcaaggctaccgccgtaatgcctgacggtcagttcaaagacatctccctctctgactacaaaggcaaatacgtcgtgtttttcttctatcccttggatttcacttttgtctgccccacagaaatcatagccttttccgaccgcgcagaggagttcaaaaaactaaactgccaggtgatcggcgcatcagtggatagccacttttgccacctggcctgggtgaacacgcccaagaaacaagggggtctgggacccatgaatattcctttggtcagcgacccgaaacgcaccattgcccaggactacggagtcctgaaagctgatgaaggcatatcctttcgtggcctgtttatcatagacgataagggcatcctgaggcagatcacggtcaatgacctgccagtcggccgatccgtcgatgaaaccctccgccttgtgcaggcctttcagttcaccgacaaacatggcgaggtgtgtccggcagggtggaagcctggcagcgacacaatcaagccagacgttcagaaaagtaaggagtacttttctaaacagaaatag

SEQ ID NO: 27992 - DNA, 513 bp, Artificial Sequence
  Description of Artificial Sequence: Synthetic coding sequence
atgtccgtggccggtggggaaatacgcggagacacaggaggtgaagataccgccgctccaggcagattctcctttagccctgaacctacacttgaggacatacgcaggcttcacgcagagttcgccgcagagcgtgactgggaacaatttcaccaacctagaaatctgctcttggccctggtcggagaggtgggcgagctggcggagctttttcagtggaagacagatggcgagcctggaccacagggatggagtccacgggagcgcgcagccctccaggaagagctttccgacgtgctcatttatctggttgcgcttgctgcaaggtgtcgagtggatctgccgctggccgtgctgagcaaaatggatattaaccggaggcgataccctgctcatcttgcacgcagtagttctagaaagtacacagagcttccacacggagccattagcgaggatcaggccgtgggccctgcggatattccgtgcgacagcacggggcagactagtacctag

SEQ ID NO: 27993 - DNA, 702 bp, Artificial Sequence
  Description of Artificial Sequence: Synthetic coding sequence
atgtccgctaagcgagcagaattgaaaaagacccacctgtcaaaaaactacaaagctgtatgcctggaattgaagccagaacctactaaaacttttgattataaagccgtgaaacaggagggtagattcaccaaagccggagtgacacaggatctcaaaaatgagctgcgggaagttagagaggagcttaaagagaagatggaggaaatcaagcagatcaaggatcttatggataaagactttgacaagttacatgaattcgtggagatcatgaaagagatgcagaaggacatggatgagaaaatggatatcctgatcaacacacagaaaaactataagctccctctaaggcgggcacccaaggagcagcaggagctgcgtttgatgggcaaaacccatcgggagcctcaactcaggcctaagaaaatggatggtgcctctggggtgaatggcgcaccttgtgcgctgcacaaaaagaccatggcaccccagaagaccaagcagggcagcctggatcctttgcaccactgcgggacatgttgcgaaaaatgtcttttatgcgctctgaagaataattacaacaggggtaacattccaagcgaagcttctggcctctataaagggggtgaggaacctgttaccacccagccatcagtgggacatgcagtccccgcacccaaatcgcagacagaaggaagatag

SEQ ID NO: 27994 - DNA, 2196 bp, Artificial Sequence
  Description of Artificial Sequence: Synthetic coding sequence
atgagcgtgacactgaccagcgtcaagagggtccagtcctctccgaatctcctcgccgcagggcgtgactcccagagccctgattccgcgtggcgctcatacaatgatggcaaccaggagacactgaacggagatgcaacctacagttcacttgctgccaaaggcttcagatcagtgcggccaaatctccaagacaaacgttcccccacgcagtcccaaatcaccgtgaatgggaacagcggaggtgctgtgtccccgatgagttactaccaacgcccttttagccctagcgcatatagtcttccggctagcctaaacagctcaattgttatgcagcacggaacttcactggactctacagacacgtacccacaacatgcacaatcccttgatggaactaccagcagcagcattccactctatcgatccagcgaagaagaaaaacgggtgaccgttatcaaggcccctcactatccaggtatcgggccagtggatgaatcaggcattccaacagccatccgtacaacagtagaccgcccaaaggattggtataaaaccatgttcaaacagattcacatggtccacaaacctgacgacgacactgatatgtacaataccccctatacctacaacgccggactctacaacccaccatatagcgcccagagccaccccgcagccaagacacagacataccgtccgctgtcaaagagccatagcgacaattctcctaatgcttttaaggatgcttcctcccccgtccctccccctcatgtcccacctcctgtccctcccctacggccacgggacaggtcatccacagagaaacacgattgggatccaccggacagaaaggtggacacacggaaatttcgctctgagccaagatccatatttgagtacgaaccgggaaaatcctcaatactccagcacgagcggccaccaccattgcccactaccccaactcccgtgccgcgagaacctggacgtaagcccctgtctagcagcaggctgggggaggttacaggtagcccatcgcctcctccgcgatccggagctcccacgccctctagccgggctccagcacttagcccaacacgaccccctaagaagcctctggattacgtacaggaccactcaagcggtgtgtttaatgaggccagtctgtatcaatcctccatcgaccgctccctggaaagacctatgagttctgcatctatggctagtgactttcggaaacgccgaaaatctgaaccggcagtcggccctcccagaggccttggcgaccagtccgcctcacggacgtcaccaggaagggtggaccttcctggatcatctacgaccctaaccaagagcttcacctccagtagcccatcttccccgagccgcgcaaaggacagagagtccccccgatcctactctagcacgctgactgacatgggacggagcgctccgcgagaacggcgaggaaccccggagaaggagaagctacccgctaaggcagtatatgatttcaaagcccaaacatctaaggagctttctttcaaaaagggtgataccgtatatatactccgcaagattgaccagaattggtacgaaggggagcaccatggcagagttggcattttccctatcagctacgtcgagaagctcactccaccagaaaaagcacagcctgccagacccccaccaccagcacagcctggtgagattggcgaggcaatcgccaaatataatttcaatgctgatactaatgtagagctgagcctcaggaagggagacagggtgatcctgctgaagagagtcgaccagaattggtatgaaggcaaaatcccaggcaccaaccgacagggtatctttccggtatcctatgttgaagtggttaagaaaaacaccaaaggagcggaggattatccagacccccctattccgcacagctactcttccgacagaatccacagtctctcctcaaacaaaccacagcgacctgtattcacccacgagaacatacaggggggaggggagccatttcaggccctttacaactacacacccaggaatgaggatgaacttgaattgcgggaatcagacgtgatcgacgttatggagaagtgcgatgacgggtggtttgttgggacttctcgtcgaaccaagttttttggaactttccctgggaattatgtcaagcggctgtag

SEQ ID NO: 27995 - DNA, 969 bp, Artificial Sequence
  Description of Artificial Sequence: Synthetic coding sequence
atgacgctggaggctatccggtatagccgtggaagtctccaaatcctagatcagctcctcctgcccaagcagagtagatatgaggcagtgggaagcgtgcatcaagcctgggaggccattcgggcaatgaaagtccgaggggctccagctatcgcactcgtgggctgcttatctctcgcagtcgagttacaggccggtgccggtggacccggtctagctgctctggtcgccttcgtgcgggacaaactgagcttcctcgtgaccgctcggccaacagcagtaaatatggcccgtgcagcgagagatctggcggacgtggccgctcgggaagcggagagggaaggggcaaccgaggaagcagttcgcgagcgtcgagagaccgaactatgcgaacattgggaggaacacaccaggcaaagggagctgcctcttcgcggacccctcggtggtactgttctcgaaacacggccatataaccagggagcacgactgaccgcattcgagctcgtctatgagcagattcccgctacccttataaccgattccatggtcgcagcggctatggcacaccggggagtgagcgctgtggtggtgggggctgatagggttgttgccaacggggacactgctaacaaggtgggaacgtatcagctggctattgtagccaagcaccacgggattccgttttacgtcgcagcacctagcagcagttgcgatctcagactagagaccggcaaggagattatcattgaagaaagaccaggccaggagctgaccgacgtgaacggcgtgcgaatcgcggctcccggaatcggcgtttggaatcctgccttcgatgtgacaccacatgatttgattacaggtggtattattactgaattgggagtgttcgctcctgaggaacttcggactgctctgaccactactatctcttccagagacggaaccctcgacggaccacagatgtag

SEQ ID NO: 27996 - DNA, 5168 bp, Artificial Sequence
  Description of Artificial Sequence: Synthetic coding sequence
atgggcaaccaggatggcaagctgaaacgtagcgccggagacgcactccacgagggaggcggaggcgctgaagacgctctgggccctcgcgacgtggaagcaacaaagaagggcagtggcggaaaaaaagctctggggaagcacggaaaagggggtgggggaggagggggtggcggagagagtggaaaaaagaagtccaaaagtgactccagagcgagcgtattttccaatctgaggataagaaagaacctgtcaaagggaaaaggcgcaggagggagcagggaagacgtgctggattcacaggcacttcaaacaggggagttagatagtgctcacagcctgcttacaaagactcccgacctttctttgtcagcagatgaagccggactatccgataccgaatgcgctgacccctttgaagttactggtccgggaggacctggccctgccgaagccagagtgggtggcaggcccattgccgaggatgtggagacggcagccggtgcccaggatgggcagcgaacctcctccggtagtgacacggacatatactccttccactcggctaccgaacaggaggacctcctcagcgacatccagcaagccattagactccagcaacagcagcaacagcaattacaacttcagctgcagcagcagcagcaacagcagcaactacaaggcgctgaagaacctgctgcaccaccaacagccgtgagccctcagcctggagcatttttgggcttggaccgtttcctcctgggaccctctggcggagcaggagaggctcccggtagccccgataccgagcaggccctgtccgccctgtctgatctgccggagagcctagccgctgagccgcgagaaccgcaacagcccccatcccccggagggcttccagtctccgaagctccaagcctgccagctgcgcagcctgctgccaaggacagtccctccagcaccgctttcccctttcctgaggcaggcccaggagaggaggcagccggtgcacctgttcgtggagctggcgacacagatgaagagggcgaggaagatgcctttgaggatgctccacgaggaagtcctggcgaagagtgggcgcctgaagttggggaggacgcacctcagcgcctgggagaggaacctgaggaggaggcccaggggccagatgcaccagctgccgctagtctacctggctcccctgcccctagtcaacggtgttttaaaccgtatccactcataacaccatgctacattaaaaccaccaccagacaactctcttcacctaatcactcccctagccagtcccctaaccaaagtccaagaataaaaagacggccagagccaagcctgtcacgcggttcgaggaccgctctcgctagcgtagccgctccagctaagaaacacagggcagatggcggtctggcagcgggactgagccgctcagcagactggaccgaggaacttggagctaggacaccaagagtcggaggcagcgcccatctgctggaaagaggagtagcctcggattctggcggaggcgtgtcccccgcactggctgcaaaagcttctggcgctcctgctgcagctgatgggttccagaacgtattcaccggacgaacgctgctggagaagttattttctcaacaggagaacggacctccagaagaagccgagaagttttgttcaaggattatagcaatggggctgctgctacccttttccgactgtttcagagagccttgtaaccagaatgcgcaaaccaatgccgcatcttttgatcaggaccagctgtatacctgggcagcggtgtctcagccgacccacagtttagactattcagagggtcagttccccaggagagtgccaagcatgggacccccttccaaacctcctgatgaagaacaccgattggaggatgccgagaccgaatcgcaaagcgctgtgtctgagactccgcaaaagagaagcgatgcggtccagaaggaagttgtcgatatgaaaagcgagggccaagccaccgtgatccagcaacttgagcagaccatcgaagatcttcgcacaaaaatcgctgaactagagcgacagtaccctgcccttgacacagaggtggcctctggacaccagggtctagagaacggcgtcactgcgtcgggcgatgtgtgcctggaagcgttgcgcctcgaggagaaagaggtgcgccaccatcgaatactggaagccaagtcgatacaaacgtccccaactgaggaggggggagtgctcactctacccccagtcgatggactgcccggacgacccccatgcccccctggcgcagagagtggcccacagactaagttttgctccgaaataagtcttattgtgtctccacggagaatatctgtccagctagacagtcaccagccaacccagtctatctctcagccacctccccctcctagcttactgtggagcgccggtcaaggccagcctggcagtcagccaccccatagcatcagtaccgaattccagacttctcacgagcactcggtgtccagcgcgttcaaaaacagttgtaacattccaagtccacccccactgccatgtaccgagtctagctcatccatgccaggtctgggtatggtcccacctccacctcctcccttgcctggtatgaccgtgccaactctgccctccaccgctatccctcagccacctcctctgcaggggaccgaaatgcttcctcctcctccccctcctctgccgggtgccggaatccccccaccacctcccctgccgggtgctgggatcctcccgctgccccctctcccaggcgcaggaattcccccacccccaccgctgcccggagccgctattcccccaccccctccgctcccgggagccggtatccccctgcccccaccccttccaggcgcaggaataccaccccctccaccactcccaggagccggtatccccccacctcccccactccctggagcagggatccctcctcccccaccactgcctggcgcagggattcccccaccccctccactcccgggagccggaattcctcctcctccaccactacccggtgcaggcatacccccacctccaccccttccaggagccggtatacctccccctcctcctctgccaggagcgggaattccaccccctcccccactcccaggagcagggatcccccctccgcctccgttgccaggcgctggaatcccaccaccgcctccacttccgggagccggaattccacctcctccacctctgcctggagctggaatcccacccccacctccactaccaggggtggggatcccgcctcctcctccactacccggagccggaattcctccccctccaccactgcctggcgctggcatacctccccctccacctctacccggagcaggaataccacctccccctcctctccccagagtcgggatccctcccccaccccctttgcccggtgcgggaattcccccacccccacccttgccaggtgccggtatccccccaccacctccgctgcccggtgtgggaatccctccgccaccgcctttacccggagttggcatacctcctccgccacccctgcccggagcaggaataccccctccccctcccctccctggtatgggaattccccctgccccagccccacccctgcctcccccaggtactggcataccaccccctcccttgttgcctgtatctggcccacccctgctgccgcaggtgggaagttccactctccctactccacaggtctgtgggttcctaccccctcctctccctagtggtttattcggcctgggtatgaatcaggataagggatccaggaaacagcccattgaaccgtgcagacccatgaagccattatactggacccggatccagctacactccaaaagagacagctctacaagcttgatctgggagaagattgaagagccctccattgattgtcacgagttcgaggagctcttcagtaaaaccgccgttaaggaaagaaaaaagccaattagtgatacaatcagcaagaccaaagccaagcaggtggtgaaactgttgagcaacaaaaggtctcaggcggtgggtattctcatgtctagccttcacctggatatgaaagacatccagcacgcagttgtcaatctcgataatagtgtggtggacctggaaaccctgcaggccctctacgagaatagagcacaaagtgacgaactagagaagatcgagaagcacggacgcagctcgaaagataaagaaaatgcaaagagcctcgacaaacctgagcaattcctctatgagctgtcactcatccctaatttcagtgaacgagtgttctgcattttgtttcaatcgaccttttctgaatccatctgtagcatacgcaggaagttagagctgttgcaaaagttatgcgagactctcaagaatggcccaggcgttatgcaggtgcttggtcttgttctggccttcggtaattatatgaacggtggaaataagacccggggacaagcagatggattcggcctggacattctacctaagctcaaagatgttaagtcttccgacaactccaggtccctgttgagttacattgttagctattacctgagaaattttgatgaagacgcaggaaaagagcagtgcctgtttcccctgcctgagccgcaggacctctttcaggctagccaaatgaagtttgaggatttccagaaggacctgcggaaactgaagaaggaccttaaagcgtgcgaagttgaagccggtaaagtctaccaggtttcaagcaaggagcatatgcagccctttaaggagaacatggaacagttcatcatccaggccaaaattgaccaggaggctgaggaaaactctctgactgagacacacaagtgctttctggagactacagcctacttttttatgaaaccaaagctgggcgagaaggaggtgtccccaaacgccttttttagcatttggcatgaattctcgtctgattttaaggatttttggaagaaagagaataaattgcttcttcaagagagggttaaagaggcggaagaagtctgccgacagaagaaaggaaagagtctgtacaagataaaaccacggcacgatagtgggatcaaagccaagatttcaatgaagactta

SEQ ID NO: 27997 - DNA, 3048 bp, Artificial Sequence
  Description of Artificial Sequence: Synthetic coding sequence
atgaccgtcagccagaaaggcggtccccagcctaccccttctccggcaggccctggtacacaactcggtcctatcaccggagaaatggacgaggccgacagcgcctttctgaaattcaaacaaaccgctgatgatagcctgagcctcaccagtcccaacactgaatcgatcttcgtggaggacccatatactgcgtccctgagatcagaaattgagtccgatggccatgagtttgaggccgaatcttggtcgctggcagtggacgcggcatacgcaaagaagcaaaaaagagaggttgttaaaaggcaggacgtcctgtatgaactgatgcagaccgaggtacatcacgttcggaccctcaagatcatgttaaaggtatatagcagggctctgcaggaggagctgcagttttcctcaaaagccatcggccgactcttcccctgtgctgatgacctgctggaaacccactcccattttctggccagattgaaggagcgcaggcaagagtcactagaggagggcagcgacagaaattatgtgatccaaaaaatcggagacctcctggtccagcaattctccggtgagaatggtgagaggatgaaggagaaatatggcgtgttttgttcagggcataatgaggcagtcagccactacaagttactacttcaacagaataagaagttccagaacctcattaaaaaaataggtaatttctccatagtcagaagattaggcgtgcaggagtgtatcctgcttgttactcaacggatcactaaatatcctgtgctggtggaaaggataatacaaaacacagaggccggaactgaggactatgaggatctgacccaggccttgaacctcattaaagacatcatctcacaggtcgacgcgaaggtgagcgaatgtgagaaagggcagagattgcgggaaatcgctgggaaaatggatctgaaatcctcatctaagctcaagaatggcctgactttcaggaaggaagacatgctgcagcgccagctgcacctcgagggtatgctttgttggaagactacctccggtaggctaaaggacatcttagctatactgctaaccgatgtgctgctgctactacaagagaaggaccagaagtacgtgtttgccagcgtggactccaaacctccagtgatctctctgcagaaactcatcgttcgggaagtggccaatgaagagaaggcaatgtttttgatttctgccagtttacagggcccagagatgtacgagatctatacttcaagcaaagaggatcgtaatgcatggatggcccatattcaacgcgcagtggaaagctgcccagatgaggaagagggtcccttcagtctgcccgaagaagaaagaaaagtggtggaagccagagccactagactccgagacttccaggaacggctgtccatgaaggaccagcttatagcccagtcactgctggaaaagcagcaaatttacctagaaatggccgagatggggggactggaagacctgcctcagcccaggggcctgttccggggtggagatccaagcgagaccctccaaggagaattgatcctgaaaagcgctatgagcgaaatcgagggtatacagtctctgatctgccggcagcttggctcagctaatgggcaggcggaagacggcggtagcagtactggccctcccaggagggctgaaactttcgccggttacgactgtaccaacagtccaactaaaaatggatctttcaaaaaaaaagtgtcttcaactgatcccaggccccgagattggcggggaccaccgaactcacccgatttaaagttgagcgattctgacattcctggcagctcggaggaatcaccacaagtggttgaagctccaggaaccgaatcggaccccagattgccaactgtgctcgaatcagagcttgtgcaaaggatccagactctgtcacaactgctactgaacttacaggcagtgatcgcacaccaagacagctacgtcgagacgcaacgtgctgcaatacaagagcgggagaaacagtttcgcctgcagagcaccagaggtaatcttcttttggagcaagagcgtcagcgaaactttgagaagcaaagggaggagcgggcagcactggaaaagctgcagagtcagctgaggcatgaacagcaaaggtgggagcgcgagcggcagtggcaacaccaggagctggagagggccggagctagacttcaggagcgcgagggagaggctagacaattgagagagaggttggagcaggaaagagctgaactggaacgccagagacaggcataccagcacgacctggagcgcctgcgagaggcccagagagcagtcgagagagaaagggagcgcctcgaactgttacgacgccttaagaagcagaatacagccccaggagctctaccacctgatacccttgctgaggctcagcccccatcgcaccccccttcctttaatggcgaaggcctggagggccctcgcgtttctatgttaccctctggcgtgggcccagagtacgcggaaaggcctgaagtggcccgtcgtgactcagcacctaccgaaaacagactggctaaatctgacgttccgatccaactcctgtctgctaccaaccaatttcagagacaggctgctgtgcagcaacagatcccaacaaaattggccgcatcaacaaagggaggaaaagacaaggggggaaagtctcgcggttcccagcggtgggaatccagcgcctcctttgatctcaaacagcaactgctcctaaataaactcatgggcaaggacgagagcactagccgcaaccgtcggtctctttcacccatccttcccggtagacattctccagctccgcctcccgaccccggtttccccgcaccttccccccctccagcggattcaccctccgaaggattttctctgaaggcaggtggcaccgccctgttaccaggtcccccagctccttcacccctgcctgccacgcctctcagcgccaaagaggatgctagcaaagaagacgtgatatttttctag

SEQ ID NO: 27998 - DNA, 2544 bp, Artificial Sequence
  Description of Artificial Sequence: Synthetic coding sequence
atggaagctctgggaccaggaggagacagggccagccccgcaagctcaacttcatctcttgacctttggcacctttcaatgcgcgcagattcagcctactcatccttcagcgccgcttctggtggcccagaacccagaactcagtcgcccggaaccgatctcctaccttacctggactgggattacgtgcgagttgtttgggggggacctggcccagccccaccagatgccgcactgtgtacttccccgagaccacgccctgcggtggctgcccgttcgggcccacagcctaccgaggttccaggtactcctggccctctgaacaggcaggctacaccacttctctacgctttggccgctgaagcagaggctgccgctcaggcagctgagccaccatcacctccggcaagccgggctgcttatagacagaggcttcagggcgctcagcgccgagtactacgtgaaacatcttttcaaagaaaagaactgagaatgagcctgcctgccaggctgaggcctactgttcccgctagacctccggcaactcaccctcgttcagccagcctgtcccatccagggggtgagggagagcccgctaggtcaagggcccctgcaccgggaacggcgggacgtggcccacttgccaaccaacagcggaagtggtgcttctccgagcccggtaagctggatcgagttggcagagggggtggcccagctcgcgagtgcctgggtgaggcatgctcatcgagcggactacccggtcctgagccattggaattccagcaccctgcattggccaagtttgaagatcatgaggtggggtggttacccgagacacagccccaggggtctatgaacctggattctggctctctaaagctcggcgatgcttttcggcctgcgtctaggtcccgcagcgcttccggagaagtactgggctcatggggcggatcaggaggcacaatcccaattgtgcaagcagtgccccagggcgcagagacaccacgaccgctgttccagacgaaacttagcagatttttgccccagaaggaagccgcagtaatgtatcccgcagagctccctcaaagcagccctgccgattctgagcagcgggtttctgaaacctgtatcgttccagcatggctgccatcactgccggacgaggtgtttctagaggaagctcctttggtgaggatgcgctcacctcctgacccacatgcatcccagggccctcccgcaagcgtgcacgcaagcgaccagccatacgggaccggcttgggtcagaggacaggccaggtcacagtgcccactgaataccccctgcacgaatgccctgggacggctggagctgacgactgctggcagggggtgaacggctcagtaggtatctcccgcccaaccagtcatacacctactggcaccgccaatgataacatccctaccatagatccaaccgggcttaccaccaaccctcccaccgctgcagaatccgatctgctaaaaccagtgccggcagacgccctgggcctctcgggcaatgatacccccggaccaagccataatactgccctggcacgtggaactggccagccaggcagcaggccaacatggccctcccagtgcctggaagaattggttcaggaattggctagattggaccctagtctttgtgacccactagccagtcagccttctcctgagcctcccctgggactgttggatgggctcatcccccttgcagaagtgagagctgccatgagaccagcctgcggcgaagccggagaagaagctgcaagtaccttcgagcccggaagttatcaattttcatttacccagttactcccagctccccgagaggaaacacggctggagaatccggcaacgcatcccgtactggatcaaccctgcggacaaggcctccccgctcctaataactccattcaggggaaaaaggttgaactcgcagcaagattacaaaaaatgctccaggacttacacacagagcaggagcgtctgcagggtgaagcccaggcctgggcaagacgccaagctgcattggaagccgctgtgcgtcaagcttgcgcaccacaggagctggaacgctttagtcggttcatggccgacctggaaagagtcttgggtctgttactgcttttggggagtagactggcaagagtgaggcgcgctctcgccagggctgcttcagacagcgatcctgacgagcagaggctccggttgctacaaaggcaggaggaagatgccaaggaattaaaagaacacgtcgcccgtcgagagagggcagtgcgcgaggttctcgttcgggctctccccgtagaggagttgcgggtgtactgtgcgcttttggcgggtaaggctgctgtgctcgcccagcagcgtaacctggatgagcgtattagactgttgcaggaccagttggacgcgatacgggatgatttgggacatcacgcccctagtccgagccccgcaagaccaccagggacatgccccccagtacaacctccttttccactcctacttacctag

SEQ ID NO: 27999 - DNA, 2502 bp, Artificial Sequence
  Description of Artificial Sequence: Synthetic coding sequence
atgaaatttacaaatactaaggttcagatgatgcagaacgtgcacctcgcgcctgagacggacgaggacgacttgtactccggatataacgattataatccaatatatgacatcgaagagctggagaatgacgccgcttttcagcaagcagttaggacctcccatggtcggaggcctccaatcacagcaaaaattagttcaaccgccgtcactcggcctatcgccactggctacggatccaaaaccagcctggcatcaagtatagggagaccgatgaccggcgctatccaggatggtgttacccgtcctatgactgcagtgcgcgctgcagggttcactaaagccgcactgagaggaagcgctttcgatccactctcccagtccaggggccctgcgtcaccattggaagccaaaaaaaaggacagccccgaggaaaaaatcaagcaactggagaaagaggtgaatgagctcgtcgaagagtcttgtatcgccaattcctgcggagatctgaagctggcactggaaaaagctaaagacgctggcagaaaggaaagagttttggtccggcaacgagagcaagttaccactccagagaacatcaacctcgacctcacatattctgttctgtttaatctggcttcacagtactccgtcaacgagatgtatgccgaagctctcaacacctatcaggttatcgttaagaataagatgttttctaacgctggtatcctgaagatgaacatggggaacatctacctcaagcagaggaactattctaaagctatcaaattctaccgcatggccttggaccaggtgccaagcgtgaataagcagatgcgcattaagattatgcaaaatattggtgtgacgtttatccaagcagggcaatactccgacgccataaactcctatgagcacattatgtccatggcacctaatcttaaagccggatataacctgacaatctgttattttgccatcggggaccgggaaaagatgaaaaaggcgttccagaaactcattacagtcccgctggaaatagatgaagacaagtacatttccccctccgacgaccctcacaccaacctcgtcactgaggcaattaaaaacgatcacttgcgccagatggaaagggagagaaaggcaatggcagaaaaatatattatgacgagcgctaagcttattgccccagtaattgagacaagttttgctgctggctacgactggtgcgttgaggttgtgaaagcctctcagtacgtggagcttgccaacgacttggaaatcaacaaagccgtgacttacctccgccaaaaagactacaatcaggctgtggagatcctgaaagtgctggaaaagaaagatagtagagtaaaaagtgcagccgctacaaatttgtccgctctttactacatggggaaagatttcgctcaggcaagctcgtatgccgatatcgccgtcaattccgacaggtacaatccagcggctttaacaaataaaggaaacacagtgtttgcaaacggggattacgagaaggcggcagagttctataaggaggccttgcggaatgattcctcctgcactgaggccctgtacaacatagggctcacctacgagaaattaaaccgtctggatgaggccctggactgcttcctcaagctccacgctattctgcgtaacagcgccgaagtgctgtaccagatcgcaaacatatatgagctgatggaaaaccctagtcaggccatcgagtggctgatgcaggtggtgtcagtgatcccgaccgatccccaggttctgtccaaattaggggaattatatgaccgggagggggataagtcacaggcttttcagtactattatgagtcttacagatacttcccctgcaacatagaagtcatcgaatggctgggggcttactacattgacactcagttctgggagaaagcaattcagtattttgagcgggcatcacttattcagcccacccaggtgaaatggcagctgatggtcgcctcctgttttcgaagaagcggcaactaccaaaaagccttagacacttacaaagacacacatcggaagtttccagaaaatgttgagtgcctccgtttcctggtcagactctgcaccgatctggggttgaaggatgctcaggaatacgctcgtaagctcaagaggttagagaagatgaaggagatacgcgagcagcgcatcaagtctgggagggacgggtccggtgggtctcgtggcaagcgcgaaggaagcgcctcaggcgactcaggccagaattactcagcatctagcaaaggagagcgtttatcagccaggctaagagcactcccgggtactaacgagccgtatgaatcttcaagcaacaaagagattgatgcaagctacgtagatcccctgggtccccagattgagaggcccaagacggcggctaaaaaacgaattgacgaggacgacttcgcagacgaagagctgggggatgatttattgccagagtag

SEQ ID NO: 28000 - DNA, 918 bp, Artificial Sequence
  Description of Artificial Sequence: Synthetic coding sequence
atggacttgtccggggttaagaaaaaaagtctcctcggagttaaggaaaataacaagaaaagctcaaccagagctccttcaccaaccaaacggaaagacaggtcggacgagaagagcaaagacagaagtaaagacaagggggcaaccaaagagagctccgaaaaagatagaggtagagacaagacaaggaagcggagatcagcttcaagcgggtcgtcctctacgaggagccgatcttccagcacctcaagcagcggatccagcaccagcacaggttcatccagtggaagctcatccagttccgcatcatcccgctctgggtcatcaagcaccagccgaagctcaagttcttcctcctcctcaggtagtccctctccatcaagacggaggcatgataaccgacgacgatctcggagtaaatccaagccccctaaaagagatgagaaagaacggaaacgcaggagcccatctcctaaacccacgaaagtgcatatcgggagactgaccagaaacgtcactaaagaccatataatggagatctttagcacttacgggaagatcaaaatgattgacatgcctgtggagaggatgcaccctcatttgtccaagggatatgcctatgtggagtttgagaacccagacgaagctgagaaagccctgaaacatatggacggcggtcagatcgacggccaagaaattacagctactgcggtgctcgcaccttggcctcgaccccctccgagacgcttcagcccccctcgacgaatgttgcctcctccacctatgtggcgccgaagtcctcctcgaatgcgcagaagatctcgttcgcctcggaggcgatccccagtccgccgaaggtcaagaagcccaggaaggcgaaggcaccgcagtagatcctcttcaaactcctccaggtag

SEQ ID NO: 28001 - DNA, 1119 bp, Artificial Sequence
  Description of Artificial Sequence: Synthetic coding sequence
atggacgtcctgtcccccctcagctttatcaaggtgtcacacgtgcgaatgcagggcatactgcttctggtgttcgccaaataccagcacctaccctacatacagatactgagcactaaatctacccctaccgggctgtttggttattggggtaacaaaggaggggtcaacatctgtctaaaactgtacggatattatgtgtcaatcattaactgccacttgccccctcacatatcaaacaattatcagaggctggaacacttcgatcgaatccttgaaatgcagaactgcgaaggccgagacattcctaacattctggaccatgacctgattatatggttcggggatatgaactttcggattgaggattttgggttacacttcgtgagagagagtattaagaatcgatgctacgggggtctctgggaaaaggaccagttgagcatagcaaaaaaacatgatcccctgctgcgcgagttccaagagggaaggctcctatttcctcccacgtacaaattcgataggaattccaatgattacgacacatcagagaaaaagagaaagccagcttggaccgaccgcatcctgtggcgcctcaaacgacagccttgcgccggacctgacaccccgatcccgcctgcatcccattttagcctctcattgaggggctacagctctcacatgacctacgggatcagcgaccataaacctgtatccggaacattcgacctggaactgaagcccctggtgtctgctcccctgattgttctaatgccagaggacctgtggacagtagagaacgacatgatggtatcttactcaagtacgtccgactttccaagttcaccatgggattggataggcctgtacaaggttggactccgcgacgtgaacgattacgtgagttatgcatgggtgggggatagcaaagtctcatgtagcgacaacttgaatcaggtgtacattgacatctctaacatacccaccaccgaagacgaattcctgctgtgctattattcaaatagcctccggagcgttgtgggtatcagccgcccttttcagatcccccctggctcactcagggaggatcctctgggggaagcgcagccgcagatttag

SEQ ID NO: 28002 - DNA, 1692 bp, Artificial Sequence
  Description of Artificial Sequence: Synthetic coding sequence
atgaggctggaccttgcttcgcttatgagcgctccaaagagtctgggttccgcttttaaatcctggcgactggacaaggcccctagtccgcagcacacattcccctccacaagcattcctggcatggcttttgcgctcctagctagtgtgccgcctgttttcggactgtacacgagtttctttcccgtcctcatttattctctcctgggcacaggcaggcacctctcgacaggcaccttcgccatattgtccctgatgacagggagtgccgtagaacgcttggtccccgaacccctagtgggcaacttgtcaggaattgagaaggagcagctggatgctcaaagagtaggcgtggcagctgcagtggctttcggtagcggagccctgatgttaggaatgtttgtgttacagttaggagtactaagcacgttcttgtcagagcctgtcgtgaaagcactgacatcaggcgctgcacttcatgtcctcctgagtcaactgccaagcctccttggacttagcctccccagacagatcggctgtttcagtctgttcaaaacactagcttccttgctgactgctctcccccgttcgagcccagcagaactgaccataagcgctttgtctctggccttattagtccccgtaaaggaactgaacgtcaggtttcgtgatcgcctgccgacacccatccccggagaagtagtgctggtcctgctcgcgagcgtgctatgttttacaagctctgtggacacacgctaccaagtccaaatcgtaggactgttgcctggtggcttcccccaacctttattgcctaacttggccgaactcccgcgaattctggctgacagtttgccaattgcactggtgtcgtttgccgtctctgcatcacttgcctctatacatgctgacaagtactcctacaccatcgattctaaccaggaatttctcgcccacggcgcatccaatctgatctcctctctgttcagctgttttccaaattcagcaaccttagcaacgacgaacctactggttgatgccggaggcaaaacccagctggcgggtttattcagctgcacggtcgtgctaagtgtgctgctttggttggggcctttcttctattatctgccaaaggcagtgctggcttgcatcaacatttcaagtatgaggcaggttttttgccagatgcaggaattacctcagctatggcatatatccagggtggattttcttcttcaggtaccgggactctgcatcttatcctatccaacacccctttacttcggtacccgtgggcagtttcggtgtaatctcgagtggcatctgggccttggcgagggggagaaggagacaagcaaacccgatggtcccatggtagcagtggccgagccagtgcgagtggtcgtgttggattttagtggcgtgacatttgcggatgcagctggggcacgcgaggtagtgcaagtgagagaaagattggcttcaaggtgccgggacgcgaggatcagacttttgctggctcagtgtaacgcacttgtccagggcacacttacaagagttggtctgctggaccgagttacccccgatcagctgttcgtgagcgtccaggatgccgcagcctacgccctaggctcgctgctccgaggctcatctactcggtcgggcagtcaagaggccctcgggtgcggaaaatag

SEQ ID NO: 28003 - DNA, 2892 bp, Artificial Sequence
  Description of Artificial Sequence: Synthetic coding sequence
atggccgagcgtggcggagccggagggggtccaggaggcgcaggaggcggatcagggcagaggggcagcggagtagcacagagccctcaacagccgccaccacagcaacaacagcagcaaccccctcaacaaccaacgcctcctaaattggctcaggctacttctagttcttccagcacttcggccgcagctgctagctcatcctcctcctctacatccacaagtatggcggtcgcggtggcaagtggctcagctcccccagggggtcccggtcctggtcgcacaccagcacctgtgcaaatgaacctttacgcaacttgggaggtggataggtccagttctagctgcgtgcctaggttattttccctgaccctgaagaagctggtgatgctgaaggagatggataaagacttgaacagcgtggtcattgcggtgaaactgcaaggatctaagcggatccttagaagcaacgaaatcgtactccccgctagcggcctcgtggaaaccgagctacagcttactttctccttgcagtatcctcacttcttgaagcgcgatgctaacaagctgcaaattatgctgcagagaagaaaacgctataagaatcggaccattctcggatataagaccttagcagtgggtctgattaacatggctgaggtaatgcaacaccctaatgagggggctctcgttctggggttacacagtaatgtaaaagacgtttccgtgcctgtggctgagatcaagatttattccctcagttctcagcccatagatcatgagggcataaagagcaaactctcggaccgatctccagacattgacaactatagcgaggaggaagaggagtcattcagctccgaacaggaggggtcagatgatccactccatgggcaggatctcttttatgaggacgaagatctaagaaaggtgaagaaaactagacgtaagttaacctctacttccgctatcacgcggcagcccaatatcaaacagaaattcgtggccctgctcaaacgctttaaggtgagcgacgaagtcggattcggcctggaacatgtgtccagggagcaaattcgtgaggtggaagaggaccttgatgaactctatgatagtcttgagatgtacaacccatccgacagcggaccagagatggaagagacagaatccatcctgtccacccctaagcctaaattaaagccattcttcgaggggatgtctcagtcctccagccagactgaaatcggctcgctcaacagtaagggttccctggggaaagacaccacttccccaatggagttggcagctctcgaaaaaataaagagcacatggatcaagaaccaggacgactcactgacggaaacggacacacttgaaatcacagatcaggatatgtttggcgacgcctctacatcgctggttgtgcccgagaaagtaaaaactccaatgaaaagtagcaagacagatctgcaggggtctgccagcccgtccaaggtggagggcgtgcacaccccaagacagaaacgtagcacccccttaaaagagcgccagctgtcaaaacccctgtccgagcgcaccaactctagcgattctgagcgtagccccgatctaggacacagcactcagattccgagaaaagtagtctatgaccagctgaaccaaattcttgtcagcgacgccgcattaccggaaaatgtgatcctggtgaacaccactgattggcaggggcagtacgtcgcagagttattgcaggatcagcgaaagccagtggtgtgtacttgttcgacggtggaggtgcaggcggtcctgagcgccctccttacaaggatacagcgatattgcaactgcaactcaagtatgccaagacccgttaaggttgcagcagtcggcggacaatcatatttgagttccattttaaggttctttgtcaagtcacttgctaacaagacctccgactggctcggttacatgcggtttttaatcatacctctggggtcccacccagttgccaagtatctcgggagtgtagactctaagtacagttcttcctttctcgacagtggctggagggacttgttctccaggagcgaacctcctgtctccgagcagttagatgtcgcaggccgagttatgcaatacgtcaatggtgctgccacgacacaccagctgccggtcgcagaagcaatgctaacctgtcgacacaaatttcctgatgaagacagctatcagaagtttatcccttttattggggtggtcaaggtgggcctcgtcgaggactctccaagcaccgcaggtgatggcgacgattcccccgttgtgagcctgaccgtcccaagtactagcccaccatcgagctcagggcttagccgcgacgccacagccacacccccatcaagcccttccatgtcctctgccctagccatcgtggggtctcctaatagcccctacggagatgtgatcgggctgcaggtggactattggttgggccaccccggtgaaagacggcgagagggcgataaaagagatgcctcttcgaaaaacacactcaagagcgtgttcaggagtgtacaggtgagccgacttccacatagtggggaagcccagctctctgggacaatggctatgaccgttgtcaccaaagagaaaaataagaaagtccctacaatttttctgtctaagaagccccgtgagaaagaagtcgattcgaagtctcaggtgatcgaagggatctcgaggctgatttgcagcgctaagcaacaacagacaatgttaagggtgagcatcgacggggtggagtggagtgatatcaaattttttcagctagcggcacagtggcctactcacgtcaaacattttccagtgggcctattctcaggatctaaagccacctag

SEQ ID NO: 28004 - DNA, 546 bp, Artificial Sequence
  Description of Artificial Sequence: Synthetic coding sequence
atggaggaaattccagcgcaggaagcagcgggaagtccaagagtgcaattccagagcctggagacgcagagcgagtgcctgagtcccgagccacagtttgtgcaagacacagacatggagcagggcttaaccggcgctcccccagtgccacaggtgcctgccttgcccagagaaggctctcctggcgaccaggctgctgctctgctgacagccaggtaccaggaattcgttaccttcgaagatgtggccgttcaccttacccgggaggagtggggatacttggatccagtgcagagggacctgtatagggaagtgatgctggagaattatgggaacgtggtgtctctgggtattctcctgcgattacctacaactagaattcacagcgtgaactcttgcccagctctgagccacacacaggcgagtgcatttagtggggagaccctagccgtattaacagccggtatttccaaacggtggccaaaataccggttacccatcgacattgcccgaccatgcagcgaaaccccatttcctagactttag

SEQ ID NO: 28005 - DNA, 1410 bp, Artificial Sequence
  Description of Artificial Sequence: Synthetic coding sequence
atggtgctcgagggtaaccccgaagtgggctcaccacgtaccagtgaccttcaacaccggggtaacaagggcagctgcgttttatcctcgcccggagaagacgcacagccaggcgaagaacccatcaagtacggagagctaatcgttctgggctgctgcgaggaaggcggagaagagaccgaggcccagcggggagaggtcacaggacccagggctcactcctgttataatggctgcctagcatccggggataagggcaggaggaggtctcgtttagctctgagcaggcggagccacgctaacggcgtgaagcccgatgtgatgcaccatatctccacgcctttagtcagcaaagcactctcaaataggggacaacacagtatcagctacacgctttcccggtcccattctgtgatcgtggagtatacacacgatagcgacacggatatgtttcagatcggcagatccacagagaatatgattgacttcgtagtcacagacaccagccccggaggaggcgcagctgaaggtccttctgcacaaagcaccatctctcggtatgcctgcaggatactctgtgatcggcgaccaccttacactgcgagaatatacgccgctggattcgatgcctcatctaacattttcctgggggaaagggcggctaagtggcgcacaccagacggtctgatggacggcctcacaacaaacggtgtcttggttatgcaccccgcagggggtttctcagaagattccgcacccggtgtgtggagggagatcagcgtgtgtggcaacgtatataccctgagggatagtaggtctgctcaacaaaggggaaaactggtggaaaacgaaagcaatgttcttcaggacggcagtttaatcgatctttgtggcgcaactctgctgtggagaactccagccggattattgagggcacccaccctcaagcagcttgaggcccagagacaagaagcaaatgccgcacgtccgcagtgtcccgtgggcctgagcacgctagctttcccttcaccagctcggggtaggactgcccctgacaaacagcaaccctgggtttatgtgcggtgtggtcacgtacatggctaccacggatgggggtgcaggcgcgagaggggcccacaggaaagggagtgtcctttgtgcaggcttgtggggccttacgtgcccttgtggcttggccaggaagcaggcctgtgtctagacccagggcctccctcacatgcctttgccccttgtggacatgtgtgctccgaaaaaacagcccgatactgggctcagacacctctcccccacggaacacatgcattccacgccgcttgtcccttctgcggtgcatggctcaccggagagcacgggtgtgtacggctcatctttcagggtcccctggactag

SEQ ID NO: 28006 - DNA, 3312 bp, Artificial Sequence
  Description of Artificial Sequence: Synthetic coding sequence
atggccggagcctctgtgaaagtggcagtgcgcgttagacctttcaatgcaagagagacgtcgcaggatgctaagtgtgtcgtcagcatgcaaggcaatactacatctataataaatcccaaacagtcaaaggatgcgccaaaaagttttacctttgattacagctattggtctcatacctcaacagaggacccgcagttcgcctcccagcagcaggtgtatagggacatcggagaggagatgttgttgcacgcctttgaaggatataatgtctgcatctttgcttatggacaaaccggtgctggcaagagctacacgatgatgggacgacaggagccaggacagcaaggcatcgtgcctcagctctgcgaagacctgttctcccgggtgagcgaaaaccagtccgcacaactctcttatagcgtggaggtaagctacatggaaatttactgcgagagagtccgtgacctgcttaacccaaaatcccggggtagcctgcgcgtccgggagcatccgattcttggcccttacgtccaggacctctctaagttggccgttacatcctatgccgacatagccgatttgatggattgcgggaataaggcacggactgtggccgcaacgaacatgaacgagacatcttctcggtcccacgccgtgttcacaattgttttcacgcagcgttgccacgatcagctgaccggcctggacagcgaaaaggtgagtaagatatcgctcgtggacctcgcaggatctgaacgggctgatagctctggtgcacgcggaatgcggttgaaagagggtgctaacatcaataagagcttgacaaccctcggcaaagtcattagcgcactcgcggacatgcagtctaaaaaacgcaagtcagacttcatcccttacagagacagtgttctgacctggttgctgaaggagaacctgggaggcaacagcagaactgccatgatcgctgcattaagtcccgctgatattaattatgaagagactttgtccacactaaggtacgccgatcggacgaaacagatacgctgcaatgccatcatcaatgaagacccgaacgcacgattaatcagggagctccaggaagaggtagcgagactgcgggagctgctgatggcccaaggtcttagtgcctcggcattagagggcttgaaaactgaagaaggaagtgtcagaggcgctctccccgctgtgagctctcccccagccccagtgagcccatcttcaccaaccacccataatggcgaactggaaccctctttcagccccaatactgagagtcagatcgggcctgaagaggccatggaacggctacaggagaccgaaaagataattgctgaactgaatgaaacttgggaggaaaagctccgtaagaccgaagcactcaggatggagagggaagctttactggcagagatgggggttgccgttcgtgaagacggcggaacggtgggtgtgttttctcctaaaaaaacaccacacctggttaacttgaacgaagaccccctgatgtctgaatgcttactttatcacatcaaggacggcgtgacgagagtcggacaggttgacatggacatcaaactgaccggccaattcatacgggagcagcactgcttattcagatcgatccctcagccggatggcgaggtcgtggtaactctggagccgtgtgaaggagccgaaacatacgttaatggaaagctggttacggagcctctggtattgaaaagtggtaataggatcgtcatggggaaaaatcacgtattccggtttaatcatccagaacaggcaaggctggagcgggagagaggtgtgccgccaccaccgggacccccttccgagccggtggattggaacttcgcacagaaggaactgttagaacagcagggcatcgacatcaaactggagatggaaaaacggcttcaggacttggagaaccaatatagaaaagagaaagaagaagccgatctgctccttgagcagcaacgcctctatgcagattccgacagtggagacgactccgataagcgctcatgcgaggagagctggcggctcatttctagcctgcgcgaacagctgcctcctacaacggtacagacgatcgtcaaacgctgcggcctgcctagctcaggcaagcgcagagcgcctagacgggtgtatcagattccgcagagacggcgactacagggcaaggaccctaggtgggctacgatggctgacctgaaaatgcaagcggtgaaggaaatttgttatgaggtggccctggccgactttaggcacggtagagccgagattgaggccctggccgcacttaaaatgcgagaactgtgcagaacctatgggaagcctgacggaccaggagatgcctggcgggctgtcgcaagagatgtatgggatacggtgggcgaagaggaaggcggaggcgcaggatccggaggtggtagtgaggagggcgctcggggagctgaggttgaagacttacgggcacacatcgacaaattaaccggtatcctccaagaggtcaaacttcagaacagttctaaagaccgcgaattgcaggccttgagagaccggatgctgagaatggaacgtgtgatcccactcgcccaggatcacgaggatgaaaacgaggagggcggagaagtgccctgggctcctcctgagggcagcgaggcagccgaagaggctgctccttccgatcgtatgcccagcgctcgccctccctctccccctctttcttcctgggagcgggtctccagactgatggaggaggatcctgcctttaggcgcggtcggctgcggtggttaaaacaggaacagctgcgtcttcagggcctgcagggcagtggcggacgaggcggaggccttagaaggcccccagcccgttttgtccctccacatgactgcaagctgcgtttcccattcaagagcaacccccagcaccgtgagtcatggcctgggatgggtagtggggaggcccctactccattgcaaccccctgaagaagttactcctcacccggctacacccgctaggagaccgccaagtccccgacggtcccaccacccacgtaggaattctcttgatggtggcggaagatcccgcggagccggatccgcccagcctgaacctcagcattttcagcccaagaagcataactcatatcctcagcctcctcaaccctacccggctcagagaccacctgggccaaggtaccccccatataccactccacccaggatgcgcagacaacgaagcgcacccgacctgaaagaatcaggcgcagccgtgtag

SEQ ID NO: 28007 - DNA, 1260 bp, Artificial Sequence
  Description of Artificial Sequence: Synthetic coding sequence
atggccgaacctgttggtaagcgcggacggtggagcggcggttcaggcgcaggacgaggcggacggggagggtggggtggcaggggaaggaggcccagagcccaacgctctccaagccggggaaccctcgatgtcgtttctgtggaccttgtgactgactctgatgaagaaatactggaggtcgcgacagctcgaggagcagctgatgaggtggaggttgagccaccagaacctccaggcccagtggccagccgtgacaactctaatagcgacagcgagggcgaagaccgtaggccggctggaccgcctcgggagcctgtcagacgtcgacgccgactggtgctggatccaggcgaagctcccctcgtccctgtttactcaggcaaggtaaagtcttccctgaggttgattcctgacgatctgtcgttgcttaagctctacccacccggagatgaagaagaagctgaattagccgacagtagcggcctctaccatgagggctccccatctccagggtctccatggaagaccaagctgcgcaccaaagacaaggaagagaagaaaaaaaccgaatttctggacttggacaactcaccactcagcccaccttcccccagaactaaatcccggacgcacacgagggcgcttaaaaagctgtccgaggtcaacaagcgtttgcaggacctccgcagctgtcttagtcccaagcctccacaaggccaggagcagcaaggtcaagaggatgaggtagtgctcgtagaaggccctaccctaccagagacaccaagactattccccttgaagattcgttgcagggccgatctggtaagattacctttgcggatgtcagaacccctgcaaagtgtcgtggaccatatggccacccatttgggcgtgagcccttctcggatcctcctactcttcggcgagaccgaactgagccctacagctaccccgagaaccttaaagctgggcgttgctgacattatcgactgtgtagtactgacatcatcacccgaagcaactgagaccagtcagcaattgcagctgagggtgcagggaaaggagaaacatcaaaccctcgaggtgtctctgagtcgtgattcaccattgaagacgttgatgagccattacgaggaagccatgggtctgtccgggaggaagctttccttttttttcgacggcacaaaactcagtgggagggagctccccgcagacctgggtatggaatccggggacctgattgaagtctggggttag

SEQ ID NO: 28008 - DNA, 384 bp, Artificial Sequence
  Description of Artificial Sequence: Synthetic coding sequence
atgcggccactcgatatagtggagcttgctgagccagaggaagtagaggtgttagaaccggaggaggacttcgagcagttcctcctgccagtcatcaacgagatgcgggaagacatcgcctcacttactagagaacacgggagagcatacctcaggaacagaagtaagttatgggaaatggacaacatgttgatccaaattaaaacccaggtggaagccagtgaggaaagcgctctgaatcatctgcagaaccccggagatgcagcagaaggacgggcagctaagagatgtgaaaaggcagaagaaaaagccaaggagatcgcaaaaatggcagagatgctggtggagctggtgcgtagaatcgagaagtctgaaagctcctag

SEQ ID NO: 28009 - DNA, 1263 bp, Artificial Sequence
  Description of Artificial Sequence: Synthetic coding sequence
atgcccctgcaagtttctgattactcttggcagcaaaccaagacggctgtttttctctctttaccactcaagggcgtgtgcgttcgagatactgatgtattctgtactgaaaactacctcaaggtgaactttcccccattcctgttcgaagcctttctttacgctcctatagatgacgagtcttctaaagctaaaatcggcaatgatacaatcgtcttcactctgtataagaaagaggctgccatgtgggaaacgctgtcagttaccggtgtagataaggaaatgatgcaaaggattagggagaaaagcatcttgcaggcacaggagagagctaaggaggctacggaggccaaagccgctgccaagcgggaggatcagaaatacgctctttccgttatgatgaagatcgaggaggaagagcgtaagaaaattgaagacatgaaagagaacgagaggatcaaggcaaccaaggctcttgaagcctggaaagaatatcagagaaaggccgaggagcagaagaagattcagcgggaggaaaagctgtgtcagaaggaaaagcaaatcaaggaggagaggaagaagattaagtataagagtctcactcgaaatctggcctctaggaacttagcccctaagggcagaaattccgaaaatatattcacagaaaaactgaaagaggactccatcccagcccctcgctccgtgggatcaattaagatcaattttaccccacgagtgttcccaaccgcattacgtgaaagccaagtggccgaggaagaagagtggctgcacaaacaggcagaggctaggcgagccatgaataccgacattgctgagctgtgtgacctcaaagaggaggaaaaaaatcccgagtggctgaaagacaagggaaacaagctgttcgcgaccgaaaattacctggcagctatcaatgcctataacctcgcgattaggctgaataacaaaatgccactgctctaccttaacagggccgcatgccatctaaagcttaagaacttacacaaagccatagaggacagcagtaaggccctcgaattgctgatgcccccagtaactgataacgccaacgctcggatgaaggcacatgtgcgaaggggcacggccttctgccagttggagctctatgtcgaaggattacaggattacgaagccgcactgaagattgatccatcaaataagattgttcagattgatgctgagaaaatccgtaacgtgatccaggggacggaactgaagagttag

SEQ ID NO: 28010 - DNA, 348 bp, Artificial Sequence
  Description of Artificial Sequence: Synthetic coding sequence
atgagatacgttgccagctatctcctggctgcgctgggtggaaatagctcaccgtctgcaaaggacatcaagaaaatcctggacagcgttgggatcgaagccgatgatgataggctgaataaagttataagcgaactgaatggaaagaatatcgaggatgtaatcgcacaggggattgggaagttagccagcgtcccagctgggggagccgtggctgtgtctgctgcccctggctccgcagcacctgccgcaggctctgccccagccgctgcagaggagaagaaagacgagaaaaaagaggagtctgaagaaagcgatgacgatatgggattcggccttttcgactag

SEQ ID NO: 28011 - DNA, 1233 bp, Artificial Sequence
  Description of Artificial Sequence: Synthetic coding sequence
ctcaacagggcctgcttctgtgtgacaggggtccccgaactcgaggtgatttgtgggcttcagcaggcagagtggcctcgcctcggccttagtcacctgggtgcagtcggcggaggatggggcggacttcccacgagtacatgggtgtctctacacacacaagaggtcgacctagcctcagaggtggcattagaagtagtgcggacagcggagcctggcgtgtggttggaggcacaggcacccgtcgccctggtagcccaaccagaaccactgcccgctaccgctggagtcaaacgcgagtctgtgggaatggaggtggccgtacttaccgacgatccactccctgtcgtcgaccaacagcaagtgctagcacggctgcaactgttagagcagcaagtagtgggaggagagcaggcaaagaataaagatttgaaggagaaacacaagcggcgtaagaggtacgccgacgaaagaagaaaacagctcgtagctgccctccagaactctgacgaggactccggagactgggtcttgctcaacgtctacgattccatccaggaggaggtcagagcgaagagtaaattactagagaagatgcagagaaagctgcgtgcagctgaggtggagataaaagatctccagtccgaattccagttggagaagatcgattacttagcaacgattcgcagacaagaaagggattctatgctcttacaacagctgctggaacaagtccagcctctaatcaggagggactgtaattactcaaatcttgaaaaaatcctgcgcgagagttgttgggatgaagataatggcttttggaaaattccccatcctgtcatcaccaaaacatccctgccagttgcggtaagcaccgggcctcagaataagccagcgagaaaaacttccgcggcagacaacggggagcccaatatggaagatgaccgataccgtctgatgctgtctaggtctaatagcgagaacatcgcaagcaactatttccgcagtaagcgggcaagtcaaatactttctacagacgcgcgaaagagcctaacacaccataacagcccacccggactctcttgtcccctgagcaataacagtgctatcccaccaacccaggcccctgaaatgccgcaacctcggccatttagattggaatccctcgacatacccttcacgaaagccaaaaggaaaaaaagcaagagcaatttcggatcagagccgctctag

SEQ ID NO: 28012 - DNA, 1353 bp, Artificial Sequence
  Description of Artificial Sequence: Synthetic coding sequence
atgcgggagtgcatcagtattcacgtcggacaggcgggtgtgcagatcggaaacgcttgttgggagttgtactgtctggagcacgggatacaaccggatgggcaaatgccctccgataagacaatcggcggaggcgatgactcatttaatacctttttttcagagaccggagcaggcaagcacgttccacgagccgtgtttgtggacctggagcctacagtcgtcgatgaagtgcgcaccggcacctaccgccagctttttcaccccgagcagctgataaccggaaaggaagatgcagccaacaattatgcacggggacattataccatcggaaaggaaattgtcgatctggttttggataggatcagaaagcttgccgacctctgcacaggtctccaggggtttttgatcttccacagcttcggcggaggcacaggaagcggatttgcttcactgctgatggaacgtctgagcgttgactacggtaaaaagagcaaactagaattcgctatttaccctgccccacaggtctctacggccgtagtggagccatacaattccattttgactacccatacaacactggaacactctgactgtgcctttatggtagacaatgaagccatttacgatatttgccgaagaaacctggatatcgaaaggccaacctacaccaacctgaaccgccttatcggtcagattgtctcctccattactgcgtccttgcgcttcgacggtgctctgaacgtagatctgacggagtttcagaccaatctcgtgccatatcctaggattcacttcccactggccacgtacgcaccggtgatatctgcggaaaaggcctaccacgaacagctgagcgtcgccgagattaccaacgcttgtttcgagccggcaaatcagatggtgaagtgcgacccccgacacggcaagtatatggcgtgttgtatgctgtatcggggtgatgtcgtgcccaaagatgtgaatgccgcaatcgccacaattaagaccaagagaactatccaattcgtggactggtgtcctactggctttaaagtgggcatcaactaccaacccccaaccgtggtgcctggcggtgacctggctaaagtgcaaagagccgtctgcatgctgagcaatacaaccgccatcgccgaagcttgggcgagactggatcacaaatttgatctgatgtacgcaaagagggcctttgtccactggtacgtaggcgagggaatggaggagggcgagttctcagaagcacgtgaggatttagctgctcttgagaaagattatgaggaagttggcgtggacagtgttgaagccgaggcagaggagggcgaagagtactag

SEQ ID NO: 28013 - DNA, 471 bp, Artificial Sequence
  Description of Artificial Sequence: Synthetic coding sequence
atgtccggaggactgcttaaagccctgagatcagactcctacgtggagctgtctcaatatcgcgaccagcatttcaggggcgataatgaggagcaggagaagctcttaaagaagagttgtacactctacgtggggaatctgtccttctacacaacagaggaacagatttacgaactatttagcaaatccggtgacatcaagaagatcattatgggcctggacaagatgaaaaagaccgcctgcggcttttgttttgttgagtactactcacgcgcagatgccgagaatgccatgagatatatcaacggcacgagactggatgataggattatacgcacggactgggacgccggatttaaagagggaagacaatacggcagaggacgctcaggaggccaggttagggacgaatatcggcaggattatgatgcgggaagagggggttatgggaaactcgctcagaatcagtag

SEQ ID NO: 28014 - DNA, 996 bp, Artificial Sequence
  Description of Artificial Sequence: Synthetic coding sequence
atgggaggagaacaggaggaggaacgctttgacggaatgctgttagcaatggcacagcagcatgaaggcggagtgcaagagcttgtgaatacgtttttttcatttctgcgaaggaaaacagacttcttcataggaggcgaggaaggaatggccgaaaagctcatcacgcagacctttagccatcacaatcaactggcccagaagactcgacgcgaaaagcgggcaagacaggaggccgagcggagagagaaagccgagcgtgccgctcggctcgctaaagaggccaagtccgagacttccggcccacagatcaaggaactgacagatgaggaggcagagcgactgcagctggagatagatcagaaaaaggacgccgagaaccacgaggcccaactgaagaatggctcccttgactccccagggaaacaggataccgaggaagacgaggaagaagatgaaaaggataagggtaaactcaagcccaatcttggtaacggcgctgacctaccaaactacaggtggacacaaacacttagcgagcttgatcttgccgtccctttttgcgtgaactttaggctgaaaggaaaagacatggtggtggatatccagcgacgtcacttgcgtgtgggcctaaagggccagccagccattattgacggcgaactgtataacgaggtgaaggttgaggagtcgtcctggctaatcgaggatggcaaagtcgtgacagttcacctggagaaaataaataagatggagtggtggtcaagactcgtctcaagcgatcccgagattaacaccaagaaaattaacccggagaactccaaactgtccgatctggacagcgaaacccgctctatggtcgagaagatgatgtacgatcagcgacaaaaatccatgggacttcctacctctgacgaacagaaaaaacaggaaatccttaagaagtttatggatcagcaccctgaaatggacttctcaaaggctaagtttaactag

SEQ ID NO: 28015 - DNA, 1860 bp, Artificial Sequence
  Description of Artificial Sequence: Synthetic coding sequence
atggccggaccaggggtgcccggtgccccagccgcaaggtggaagcgacacatcgtaagacagctgaggctgagggacaggacccagaaggccctattcctcgagctcgtcccggcttataatcatctcttagaaaaggctgaactgttggacaaattcagtaagaagctgcagcctgaaccaaatagcgtcaccccaacaactcaccaaggtccctgggaggaaagcgagttggacagcgatcaggtccccagcctcgttgctctgagggtgaagtggcaggaggaggaagaaggcttacgtttggtgtgcggtgagatggcctaccaggtggtagagaagggtgcagctcttggaactcttgagtcagaattgcagcaaaggcaaagccgcctggccgcactagaggcaagagtagcacagctccgggaagctcgcgcacagcaggcccagcaagtcgaggagtggcgcgctcagaatgccgtccagagagctgcctacgaggcccttagggctcatgtgggtttaagggaggccgcactgcgcaggctccaggaggaggcaagagacttgctggagaggcttgtgcagcgcaaagctcgcgcagccgctgagaggaacttgcgcaacgagcggagagaaagagctaagcaagcccgtgtatctcaggagctgaaaaaagctgctaagcgtactgtgagcatctcagagggtcccgatactctcggagacggcatgagggagagaagagagactttggcacttgccccagaacccgagccattagagaaggaggcatgtgaaaagtggaagcgacctttccgctccgctagcgccacatctctgacactgagtcactgcgttgacgtcgtgaaaggccttcttgattttaagaagaggcggggacactcaattggcggtgctccggaacagcggtaccaaattatacccgtgtgtgtggcagccagattgcctacaagggctcaagatgtcctcgacgcacacctctcagaagtcaatgctgtcagatttggcccaaactcgtctctgctggcaaccgggggtgccgacagactgattcatctctggaacgtagtggggtccaggctggaggctaaccagacacttgaaggcgcaggaggatccattacatctgtcgatttcgatccgagtggataccaagtgctcgccgcaacttataaccaggccgctcaactatggaaggtaggtgaggcccaatctaaggaaaccctgtcgggtcacaaagacaaggtgaccgccgcaaaatttaagttgacacggcatcaggcggtcaccgggagccgggatcgcacagtgaaggaatgggacctcggcagagcctactgcagcagaacaatcaatgtcctgtcctactgcaatgacgtcgtgtgcggtgaccacatcattatatctggccacaacgaccagaagatccggttttgggacagcagagggccacattgcacccaggtgatccctgtgcaaggaagagtcacttctctttctctgtcacacgaccaactgcacctactgagctgttctcgtgacaatacactgaaagtcattgatctgagagtaagcaacatcaggcaggtgttcagagccgacggattcaaatgtgggagcgactggaccaaagccgtgtttagtccagataggtcctacgccctggccggaagctgtgatggagctctgtatatttgggatgtggacactggcaaacttgagagccgcttgcagggacctcactgcgcggctgtcaatgctgttgcatggtgctatagtggttcccatatggtgtcagtggatcaagggagaaaggtcgtcctatggcagtag

SEQ ID NO: 28016 - DNA, 5048 bp, Artificial Sequence
  Description of Artificial Sequence: Synthetic coding sequence
atggaaggcaatggtaccgaaaattcctgtagccgtactcgcggatggttgcagcaggacaacgacgcaaaaccctggctctggaagtttagcaactgtttcagcaggcccgagcagacactgcctcactccccacagaccaaagaatacatggaaaataagaaagtggccgtggagcttaaggatgtgccatctccactgcatgcgggttccaaactctttccagccgtgccactaccggatattcggtcactgcagcagcccaagattcaactgtcctctgtgcctaaggtgagttgctgtgcacactgccccaacgagccctctacctcacctatgcggttcggaggcggaggcggtggttcagggggtacaagttctctgattcatccaggggcactccttgactctcaaagtacaaggaccatcacgtgccaggtgggcagcggttttgcattccagtccgcatctagcctccaaaatgccagtgcgagaaataacttagctggaattgcttcagacttccccagtatgtgcctcgaatccaatctgagttcgtgcaaacatctcccttgctgcgggaagcttcacttccagagctgtcacggtaatgtgcataaattgcatcagttcccatctttgcaaggctgcacctccgccggttacttcccttgttcagatttcacatcaggagcccctggccatctcgaagagcacatcagtcagtctgagctgacaccccatctttgtacgaatagcttacacctgaatgtggtaccccctgtgtgtctgaagggtagcttgtactgtgaggactgtctgaataagcccgctcgtaacagcatcatcgatgcagcaaaagtgtggcctaatattcctccgccaaatacacagcctgccccattggcagtgccactttgtaatggttgcggcaccaaggggacgggcaaggaaacaaccctgctgttggccacatccctcggtaaagcagcaagcaagttcggctcacctgaggtagctgtagcgggacaggtgttggagaatcttcccccaataggtgtgttctgggacattgagaattgcagcgtcccaagcggtcgctccgccactgccgtggtgcaaaggatccgggagaaattcttcaaagggcatagggaagcagagtttatctgcgtgtgtgacatttccaaagagaataaagaggtcattcaggagttgaacaactgccaggtgacggtggcacacattaatgccacagcaaagaatgctgcagatgataaactacgccagtcactgaggcggtttgcaaatactcatacggcgcctgctaccgtggtgttggtctcaacggatgtcaacttcgccctggaactctccgacctgcggcacaggcatgggtttcacatcattctggtgcataaaaaccaagcctctgaagcgctgcttcatcatgcaaacgagttaattaggtttgaggaattcatctccgatctgccacccagactaccgctaaagatgccacaatgtcatactttgttgtacgtctataaccttccagcaaataaagatggaaagtcagtgagcaatcgattaagaagactgtctgacaattgcggcggtaaagtcctcagtattaccggctgctccgcgatcctccggtttatcaaccaggattccgcagagagagcccaaaagcgcatggagaatgaagacgtctttggcaacagaatcatcgtgtcattcacacccaagaatcgggagctgtgcgaaaccaagagctctaatgccatcgcggacaaggtaaagtcacccaaaaagttgaaaaatcctaaactttgcctgataaaagatgcgagcgagcagagctctagcgccaaggctacaccagggaaggggtcgcaggctaatagcgggtccgccacaaagaatactaatgttaagtctctccaggaactgtgtcggatggagagcaaaacaggacatcggaacagcgagcatcagcagggtcatttgaggctcgtcgtcccaacacacgggaattccagcgcagccgtgtccaccccaaaaaacagcggagtggccgagccagtttataaaacatcacagaaaaaagaaaatctgtccgccaggtcagtaacttccagcccggttgagaagaaggacaaggaagagacggtgttccaggtctcgtaccccagcgcattcagcaagctggttgcatcgaggcaagtgtccccattgctcgcatcacagagttggagttcacgttccatgtcccctaaccttttaaatcgcgcatccccattggccttcaacatcgctaatagctcctcggaggcagactgtcccgacccattcgccaacggcgcagatgtccaagtctcaaatatagattatcggctcagtagaaaggaactgcagcagctgcttcaagaggcattcgctcgccatggcaaggtgaagagcgtggagttgagccctcacaccgactaccagctcaaggccgtggtgcagatggagaatctccaggatgccatcggtgctgtgaactccctgcatcggtataaaataggctctaaaaaaatcctggtgtcattggcaaccggagctgcgtccaagtcattgtctctgctgtcagctgaaaccatgtcagttttacaagatgcaccggcatgctgtctaccactcttcaaatttactgacatctatgagaagaaatttggacataagctgaatgtgtccgatctgtacaagcttactgacacagtggcgatccgagaacaggggaacgggagactcgtatgtctgctgccgagcagccaggctagacagtcaccactcgggagctcgcagtcccacgatggaagttccaccaactgttcccctattatttttgaagaattggagtaccatgaacctgtgtgtagacagcattgtagcaacaaggacttctctgagcacgagttcgatcccgattcttacaagatccccttcgtgatcctgtctctaaaaacttttgctcctcaggtgcacagcctcctgcaaacacatgagggcaccgtgcctctgttagacccttggctgctgagatctaagtctcccgtcggaaacccccagctgattcagttttctagagaagtgattgatcttctaaagtcacagccatcctgcgttatcccgatctcccactttattcctagctatcaccaccactttgcgaaacaatgtcgtgttagcgactatgggtacagtaaactgattgaactcttggaggcggtgcctcacgttttacagattctgggtatgggtagtaaacgcttactgaccctgacccaccgcgctcaagtgaagcgctttacacaggaccttctgaagttgcttaagtctcaggcaagtaagcaggttattgtgagagaattctcccaggcataccactggtgcttcagcaaggactgggatgttactgagtatggtgtgtgcgaactcattgatatcgtgtccgaaatcccggacactaccatttgcctaagccagcaggataatgaaatggtgatttgcataccgaagcgggaacgcacacaggacgagatagaacggaccaagcagttttctaaggatgtggtggacctgctgcgtcaccagccccacttccggatgccctttaacaagttcatcccttcttatcatcaccactttgggcgacagtgcaagcttgcttactacggctttaccaagctgcttgagttgtttgaggctattccagatacattacaagtgttggaatgcggcgaagaaaagatcctaacccttacagaagtagagcggttcaaggcgctggcagcgcagtttgtgaagttgctacgctcccaaaaggacaactgcctgatgatgacggatctgctcaccgaatacgcaaagacattcgggtacactttccgacttcaggactacgacgtgagctcaatctcagcactgacccagaagctgtgtcatgttgtgaaagtagctgacatcgaatcaggcaggcagatccagctgatcaatagaaaatctctccgcagcctgactgcacagctgctggttctcctgatgagctgggaggggactacccatttaagcgtagaagaactgaaaaggcactacgaatctacccataataccccccttaacccttgcgaatacggatttatgaccctcactgaacttctgaagtccctcccttatctagtcgaggtgttcaccaacgacaagatggaggaatgtgtgaaattaacttccctgtacctttttgcaaagaacgttaggtccctgctgcatacctatcactatcagcagatttttttacacgagttctccatggcctacaccaagtatgtgggcgagacgctccagccgaaaacttacgggcacagctctgttgaagagctgctgggggctattcctcaggtggtgtggataaaggggcatgggcacaagcgaattgtggtgctgaaaaatgacatgaagtcccgcctctcgtccttaagcctgagccctgcaaatcacgaaaaccagccttccgagggcgaacggatcctggaggtgcccgagtcacacaccgcttccgaacttaagctgggtgcagacggctcagggccttcccacactgagcaggagctcctgcgcctcacggacgatagcccggtcgatctactgtgtgctcctgtgccttcctgcctgccttcaccgcaactcagacccgatcctgtcatcctgcagtccgccgacctgattcagttcgaagagcggccacaggagccatccgaaatcatgatcctgaaccaagaagagaagatggaaatccctatacccggaaagagcaagacactcacctccgactctagtagtagctgtatctccgccgctgtgcccgtacctccatgcccaagctcagaaacttcagaatctctattatccaaagaccccgtggagtcgcctgccaaaaaacagccgaaaaatagagtcaagctggctgccaatttctctctcgccccaataactaagctgta

SEQ ID NO: 28017 - DNA, 735 bp, Artificial Sequence
  Description of Artificial Sequence: Synthetic coding sequence
ggtggtggatatgacctcaatctgtttgcgtcgcccccagacagtaacttcgtgtgtagcgtgtgccacggtgtgcttaagcggcctgccaggctgccctgctctcacatcttttgtaagaagtgtattcttcggtggctcgctcgtcagaaaacctgtccctgttgcagaaaggaagtgaagcgcaaaaaggttgtgcatatgaataaactgaggaagacaatcggacggttggaggtcaagtgcaagaacgcagacgccggttgtattgttacctgtccattggcccaccggaaggggcaccaagactcatgcccattcgagctgactgcttgccccaacgaaggctgcacatctcaggtacctaggggaactttagccgagcaccgccaacactgccagcaaggttcccaacagcggtgcccactcggatgcggcgctaccttagatcctgcggaaagagctcgccacaactgttatagggaactacataatgcgtggtctgtccgtcaagaacgcagacgaccactgttgctgtcactgttgagaagggtacggtggctcgaccaggccacctcagtagtgaggagagaactagctgagctgtccaactttcttgaagaggacacagctctcctggagggagcgccacaagaagaagctgaggcggctcctgaagggaacgtgggtgctgaggtagtcggagagccacgggcaaatattccctgcaaatag

SEQ ID NO: 28018 - DNA, 705 bp, Artificial Sequence
  Description of Artificial Sequence: Synthetic coding sequence
ttgccttgcaagcgctgtagaccttccgtgtacagtctgtcatacatcaaacgaggtaagacaaggaactacttgtaccctatatggtccccgtacgcatattacttgtactgctacaaatataggattacactgagagagaagatgcttccccgttgttataagtctattacctacaaagaggaagaggatctgaccttgcagccacggtcttgcctccaatgcgagtccttggtcggcctgcaggagggcaaaagtaccgaacaggggaaccacgatcagcttaaggaactatacagcgcgggtaacttgaccgtcctagcaactgacccacttctgcaccaagatcctgttcagctggatttccactttcggctgacttcccagacgtctgcacattggcacggcctcctgtgtgatcgaagactgtttcttgatataccataccaagctttggatcaggggaatcgcgagtctcttacagccacgctggagtacgtcgaggagaagacaaatgtagattcggtctttgttaattttcagaatgatagaaatgacagaggggcactcctcagggctttttcctatatgggatttgaagtggtccggccagaccacccagctctccccccacttgataacgtgattttcatggtgtaccctctggagcgggacgttggacatctgccttcggaaccgccttag

SEQ ID NO: 28019 - DNA, 2403 bp, Artificial Sequence
  Description of Artificial Sequence: Synthetic coding sequence
atggctgccgcagcgagcgttacaggaagggttacctgggccgcatcccctatgcgctcactcggcttgggacggaggctctccctgcccggacctcgcctcgatgctgtgacagccgctgtgaatcctagcctgtctgaccatgggaacggtctgggaaggggtacccggggatccgggtgttctggcggaagtctggtggctgattggggaggaggcgctgcagccgctgccgctgtggctctggctttggccccagctctgagtacgatgcgcaggggtagctctgagagcgaattggccgcacgctgggaggccgaggccgtcgcagcagctaaggccgctgcaaaagcagaagcagaagccacagccgaaaccgtggccgagcaggtacgggtggacgcaggcgctgcaggagagcccgaatgcaaggccggagaagagcagccaaaggttctggctccggctcccgcacagccgtcagcagctgaagaaggcaatactcaggtgttgcagcggcctccacctactctgcctccttctaagccaaagccagttcagggtttatgcccgcacgggaagccacgggacaagggaaggtcctgcaaacgttcaagtggacacgggtccggtgagaatggatcacagaggcccgtgactgtcgattcgagtaaagccagaacatcgcttgatgccctgaagatttcaattagacagctaaagtggaaagagttccccttcggacggcgactgccttgtgatatctactggcacggcgtctcttttcatgacaatgacatcttctccgggcaggtcaataaatttcctgggatgaccgaaatggtgagaaagattaccctctcgcgggcagtgagaaccatgcagaatctcttccctgaggagtacaatttctatccccgtagctggatcctgccggacgaattccagctgtttgtggcgcaggtacaaatggtcaaggacgacgaccctagctggaagcctaccttcatcgtcaaaccagatgggggatgtcagggtgacggcatttatcttattaaagatccaagcgacattagactggcgggaacactacagtcaagacccgctgtagttcaggaatatatatgcaaaccccttcttatagacaagctgaaatttgatattagattgtacgtgctgcttaagtcattggaccctctggagatttacatcgccaaagacgggttatcacgattttgcaccgagccctaccaggagccgacaccgaaaaaccttcaccgcatctttatgcacctgacgaattattcactgaacatccacagcgggaatttcatccattctgattcggcctctacgggatccaaacgaaccttcagctcaatactatgccgcctgtcttcaaagggcgtggacattaaaaaggtctggtccgacataattagtgttgtcattaaaaccgtgattgcattaacaccagaacttaaagtcttttatcaatccgacatccctactggcagaccaggacccacgtgtttccagatccttggcttcgatattttgctgatgaaaaacttgaaaccaattttactagaagttaatgccaaccccagcatgcgaatcgagcacgagcatgagttatcccccggtgtgttcgagaacgtaccttctctggtggatgaagaggtaaaggtggcagtcatcagagacacactgcgcctgatggacccactaaagaaaaagcgggagaatcagagccaacaactcgagaaacccttcgccggaaaagaagatgcactggatggggagctgacttccgcaccagattgcaacgccaatccagaggcccacttgccctctatctgtctaaaacaggtgttccctaagtacgcaaagcagtttaactacttgcggctcgtggaccgtatggcgaacctttttattcgatttctgggcatcaagggcaccatgaaactggggcctactgggtttcgcacctttatccgtagctgtaagctgtcatctagcagcctgagcatggccgctgtcgatatcctgtacattgacatcacacggagatggaactctatgactctggaccagcgagactccgggatgtgtctgcaggctttcgtggaggcgttcttcttcctcgcccaaaggaaattcaaaatgctgcccctgcacgagcaggtagcttctctgatcgacctgtgcgagtatcacctgtccctgttggatgaaaagagactcgtttgcggcaggggcgtccccagtggagggcgaccccctcaccgcggtcctccgcaggagccaagtccttccgcccaacccgctggcgacaacccccctcccagaacgtcttgtgctaacaaactgtcccacccaaggcacactctgagctag

SEQ ID NO: 28020 - DNA, 981 bp, Artificial Sequence
  Description of Artificial Sequence: Synthetic coding sequence
atgcgagaatgcatcagtattcacgtgggacaggctggagtgcagattggaaatgcttgttgggaactatattgtctggaacatggcatccagccggatggccaaatgccaagcgacaagactataggcggaggcgacgatagttttaacacattcttcagtgagactggagccggtaagcatgtaccgagagctgtcttcgtggacctggagcctaccgtgatcgatgaagtgaggacaggcacctacagacagctgttccaccctgagcagttgatcacgggaaaagaggatgccgctaataattacgccaggggccattacaccatagggaaagagataatcgatcttgttctggatagaatccgcaaactgaagagctttttcgcaacaaaaccacgcattcacttccccctggctacatatgccccagtgatcagcgctgagaaggcctatcatgagcagctcactgtcgctgagattactaatgcctgctttgagccggctaaccagatggttaaatgcgacccccgacacggcaaatacatggcatgctgcctgctatacaggggtgacgtggtgcctaaggacgtgaacgcggctatcgcgacaattaagaccaaaagaaccatacagtttgtcgactggtgtccaacaggcttcaaagtaggtattaactatcagccccctaccgtggtccccggaggtgatctggccaaggtccagcgggcagtgtgtatgctgagtaacaccactgcagtggctgaagcttgggctcgactagaccacaagttcgatctcatgcctctgagacgcattatgcgaagactcgagcagatcgtgctaacagaacggatgagagtgaaatctatcaatctttgtgcagtgctgttacattcctttgtgctcgagctttcctatttctgttccgtaaacgtttattgtcgcaaactgttaattaaattaaaattccccttttag

SEQ ID NO: 28021 - DNA, 1005 bp, Artificial Sequence
  Description of Artificial Sequence: Synthetic coding sequence
atggtcggcagagaaaaagagctctcaattcactttgtcccgggtagttgtagacttgtagaggaagaagtgaatattccgaatcgcagagtactggtgaccggcgcaaccggactcttggggagggccgttcacaaggagttccaacagaataactggcacgctgtggggtgtggctttagaagagccaggcccaaattcgagcaagtaaaccttttggactcgaatgccgtccatcacataatccacgatttccagccccatgtgatagtccattgcgccgcagagaggcgccctgatgtcgttgaaaatcagcctgatgccgcatcccagcttaatgtcgacgcatccgggaacctggccaaggaggctgcggctgtgggcgcatttctgatttacatctctagcgattacgtcttcgacgggaccaaccccccataccgtgaggaggacatcccagcacctttaaacctgtacggcaagaccaagctagacggtgaaaaggctgttctggagaacaacctaggcgcagctgttctgcgcattcccatcttgtacggcgaggttgagaagctcgaggaaagcgctgtaactgtgatgttcgacaaagtgcaattttctaacaagagcgcaaatatggatcactggcagcagagattcccaacacacgtgaaagatgttgcaacagtgtgccgccagctagcggagaagaggatgctggatcctagtatcaaggggacattccattggtcagggaacgaacagatgacaaaatacgagatggcttgtgctatcgccgatgcatttaatttgcccagtagccatctccgtcctatcacagatagtcccgtcctcggggctcaacgaccgagaaacgctcaactggattgttccaagctcgagaccctcgggattggccagagaactccttttaggatcgggataaaggaaagcttgtggccgttcctgattgacaaaaggtggcgtcagacagtgtttcactag

SEQ ID NO: 28022 - DNA, 513 bp, Artificial Sequence
  Description of Artificial Sequence: Synthetic coding sequence
atggcaagtgaagcagaaaagactttccacagatttgcggctttcggagaaagctcctcatccggcacagaaatgaataacaaaaattttagtaagctgtgcaaagactgcggaataatggacgggaaaaccgtgacctcgaccgacgtggacatagtattttccaaggttaaggccaaaaatgctcggaccattacctttcagcagtttaaagaagccgtgaaagaactgggccagaagagattcaagggtaagtctcccgatgaagtccttgaaaacatctacggcctaatggaggggaaggatccagccactacaggagctacgaaagcaaccactgtcggcgcagtcgataggctgaccgataccagcaagtacacaggcacacacaaggagcgcttcgacgagagtgggaaaggaaaagggatagctggcagggaagaaatgaccgataataccggctatgtctcaggatacaagggatccggaacttatgataagaaaaccaagtag

SEQ ID NO: 28023 - DNA, 3582 bp, Artificial Sequence
  Description of Artificial Sequence: Synthetic coding sequence
atgtggagagtgaaaaagctctccctgtcactctcgccgtcgcctcagacaggcaagccgtccatgaggacccccctgcgcgaactgaccttacaaccaggtgcactcactaatagcggaaaacgctctcctgcctgtagctcactgacacctagtctgtgcaaactcggccttcaggaaggctcaaacaactcaagccctgtggactttgtcaacaataaacggaccgaccttagctcagagcacttctcccactctagcaaatggctggaaacctgtcagcacgagtcagacgagcaacctcttgacccaattcctcagatctcaagcacacccaagacttccgaagaagctgtggatccactgggaaactatatggtgaagactattgtgctggtgcctagcccccttgggcaacagcaggacatgatcttcgaggccaggctggatactatggctgaaactaacagtatatcactgaacggtccactcaggacagatgatctcgtacgggaggaggtcgcaccatgtatgggagacagattttctgaggtcgctgccgtatcagaaaagcccattttccaggagtctccatctcacctcctcgaggaatcgccacccaatccatgttcagagcagttacactgctccaaggagtctttaagttcacgaactgaagccgtgcgcgaggacctagtgccctccgagagtaatgcattcctgccatcatccgtcttgtggcttagtccgagcaccgccctggctgccgattttagggtgaatcatgtcgatcccgaagaagagatcgtcgaacacggcgctatggaagaacgcgaaatgcgctttcccacgcacccaaaggaaagtgagaccgaagatcaggcactggtaagctctgtggaagatattctgtctacatgcctgacaccaaacttggtagagatggagtctcaagaagctcctgggcctgccgttgaggatgtcggcagaattctaggttcagacaccgagagctggatgagcccccttgcctggctggagaaaggagtgaacacctcagtgatgctggagaatctgagacagagcttgagcttgccgagtatgctaagagacgcagctattggcactaccccgttcagcacttgcagcgttggaacctggtttacgcctagcgcgcctcaggagaagtccactaatacctcccagaccgggttggtgggaactaagcactcaacttctgagaccgagcagctgctgtgcggcaggcctcccgatctcacagcgttgagccgtcatgatctagaagacaatctcttgtcttccctggttatcctcgaagtactgtcccgccagcttagagattggaaatcccagctggccgtaccccatccggaaacccaggactctagcacacagacggacaccagccacagtggcatcaccaataaattacagcacttaaaagagagccacgaaatgggccaggcgcttcagcaggcacgcaacgtgatgcagagctgggtcttaatcagcaaagagctcatttccttgctgcacctgagtctgctgcacctcgaggaggataagaccaccgtgtctcaggagtcacgtcgcgcagagactctggtttgttgttgctttgatctcctaaagaaactgagagccaagctccagagtttgaaagctgaacgggaagaagccagacaccgcgaagaaatggctctgcgcggaaaggacgcagccgaaattgtcctggaggctttctgtgctcatgcctcccagcggatctctcagttggagcaggacttagcatcaatgcgggagttcaggggccttctcaaggacgcacagacccagttggtgggtctgcatgccaaacaggaggagctggtccagcaaaccgtatccttgaccagtactttacagcaggactggagatctatgcagttagattatactacgtggactgctctcttgtcccgctctcggcagctaacggagaagttgacagtaaagtctcagcaggcactccaggaacgagacgtggcgattgaagagaagcaagaggtgtcacgggtgcttgaacaggtgagcgcacagttagaggaatgcaaaggccaaacagaacaattagaacttgagaacagtcgcctggcaaccgatttgcgcgctcagctgcagatcctcgcgaatatggactctcaactcaaagagttgcaatctcagcacactcactgtgcacaggatcttgccatgaaggatgaactattgtgtcagctgacccagtcaaacgaggagcaagctgcccagtggcagaaggaagaaatggcactcaagcatatgcaggccgaactccaacagcagcaggccgttctcgccaaggaagtgagagatctcaaggagaccctcgaattcgctgaccaggagaaccaggtggcacacctcgagctcgggcaggtggaatgccagctgaagaccactctggaggtgctgagagaaaggagcctgcagtgcgaaaacctcaaggacactgtagaaaacttgaccgccaaactagcctccacaatcgcagacaaccaggagcaggatctggagaagacccgacagtactcccagaaactgggcctgctaaccgagcagttgcagtccctcaccctttttctgcaaaccaaactcaaggagaaaaccgaacaagaaacactcctcttgagcacggcctgtcctccaactcaggaacatccactccctaatgataggaccttcctcggttcaatccttacagctgtggccgacgaagaaccagagtctacccctgtgccacttttgggcagcgacaaaagtgctttcactcgcgtcgcctccatggtgagcttacaaccggctgaaacacccggaatggaggagtcactggccgagatgtcaatcatgaccactgaactgcaatcactttgttcgctactgcaggaatccaaggaggaggcaatccgaacactgcagcggaagatctgtgaactccaggcgcgactgcaagctcaagaagagcagcaccaagaggttcaaaaggctaaagaagctgacattgagaagctcaaccaggccttgtgtcttcggtataaaaatgagaaagagttgcaagaggtgatccagcaacagaacgaaaaaattctagaacagattgataagtccggcgagttaatcagcctaagagaagaggtgacccacttgacccgcagcctccgccgagccgaaacagagactaaagtgttgcaggaggcgttggctggccagctagactcaaactgccagcccatggcaaccaattggatccaggagaaggtgtggttaagccaggaggtggacaagctgcgcgtaatgtttcttgaaatgaaaaacgaaaaagaaaagcttatgataaaattccagagccaccgaaatattctcgaggagaacctacggcgtagcgacaaggaactggagaaactggacgatatcgtgcagcacatctataagactctgctttccattcccgaggtggtgcgcggatgtaaagaattgcagggtttgctagagttcctctcctag

SEQ ID NO: 28024 - DNA, 9140 bp, Artificial Sequence
  Description of Artificial Sequence: Synthetic coding sequence
atgcgcggacggcgaggcaggcctccaaaacaacctgcagcgcctgccgcagagagatgtgccccagctcctccaccccctcctcccccaccgaccagcggtcccattgggggactgcgctctcgacacagaggatcctccagagggagatgggcggctgcgcaagccgaggtggccccaaaaacccgcttatcttctccacgcggtggcagctcttccagacgtaagcctccccctccaccacctgctcccccttctaccagcgctccaggaagaggcggaagaggagggggaggcggtcgcaccgggggtggcggtgggggaggtcacctcgctaggaccacagccgctaggcgcgctgtcaacaaggtagtctacgatgaccacgagtctgaggaagaagaggaggaagaagatatggtctccgaggaagaagaagaggaggatggcgacgcagaggagacacaggatagcgaggacgatgaggaggatgagatggaggaggatgacgatgatagcgactatccggaagagatggaggatgacgatgacgatgcatcatattgcaccgagtctagctttaggagtcacagcacctattcctcaacacctggtaggcggaagccgcgagtgcaccgacccagatcacccatactagaagaaaaagacattcctccactcgagttcccgaagtcctccgaggacctgatggtgcccaacgaacacattatgaatgtgattgctatctacgaggtacttcgaaacttcggtacggtgctcaggctgtccccgttcagatttgaggacttttgtgcggcattagtgagccaagagcaatgtactttgatggcagagatgcacgtagtgctgttgaaggccgttctgagagaggaggatacaagcaataccacattcggcccagctgaccttaaagatagcgtaaacagtacattgtacttcatcgacggaatgacctggcctgaagtgctccgtgtatactgtgaatctgacaaggagtaccaccatgtgctgccatatcaggaggccgaggactatccctatggacccgtggaaaataaaattaaggttcttcagtttctggtcgaccagtttctgactaccaatatagcccgtgaggaactgatgagtgaaggggtgatccagtatgatgaccactgcagagtatgccacaaattgggggacttactatgctgtgaaacctgcagcgcagtctaccacctggagtgtgttaaaccgcctctcgaggaggtgcccgaggatgagtggcagtgtgaggtgtgcgtggcacataaagtgcccggagtaacagactgtgtcgctgaaattcagaagaacaagccatatattagacatgaacctattggctatgaccgttccaggcgcaagtactggttcctgaacagaaggttgattattgaggaggatacagagaatgagaatgagaaaaagatctggtattacagtactaaagtgcagctcgcagaactcattgactgcctggacaaagactactgggaagccgaactgtgcaagattcttgaagaaatgcgagaggaaattcaccgacacatggacatcaccgaggatttaacaaacaaagcaagggggtctaataaatcctttctggccgctgctaatgaggagatcctggagtctatcagggccaaaaagggagacattgataacgtgaaaagcccggaagagactgagaaagataagaatgagaccgagaatgatagcaaggatgctgaaaagaaccgggaagagtttgaagaccagtcccttgagaaggattccgatgataaaaccccagacgacgatcctgaacaggggaagtccgaggaacctacagaggtcggcgataaagggaacagtgtttccgcaaaccttggggacaatacaacaaatgctaccagcgaagagactagtccttccgaagggagatctccagtgggctgcctgagcgaaaccccagactcgagtaatatggcagagaagaaggttgcgtctgagctccctcaggatgtccccgaagaacccaataagacgtgcgagtcctcaaacacatcagctactacgacttcaattcaacccaatctggaaaattcaaactcttctagtgagttgaattccagtcagtcagagtcggctaaggcggcagacgaccctgagaacggagagcgggagagccatactccagtgtccattcaggaggagattgtcggcgattttaagagcgagaaatccaacggcgagctgagcgagagtcctggcgctggaaaaggcgcaagtggctccaccaggattatcactcgcctgcgaaacccggattcaaagctgtctcagctcaagtctcagcaggttgccgcagcagcccacgaagctaataaactgttcaaggaaggaaaggaagttttagtagtcaattcacagggagagataagcagattgagcaccaaaaaggaggttataatgaagggaaatattaataattattttaagcttggccaggaggggaagtaccgggtgtaccacaaccaatactccaccaattcattcgccctcaacaagcatcagcacagggaagaccacgataaacggagacatcttgctcataagttctgtctgacccccgctggggagttcaagtggaatggctctgtccacggtagtaaagtgctgacaatatctacattgagacttaccatcacacagttagagaacaacattccctcaagcttccttcatcctaactgggcaagccaccgggctaactggattaaggcagtgcagatgtgctctaagccacgcgaattcgccttggccctggctattttagagtgcgccgtcaaaccggtggtgatgctgccaatatggcgggagagccttgggcatacccgcctgcatagaatgaccagcatcgagagggaagagaaggaaaaggtgaagaagaaggagaagaaacaggaggaggaagagaccatgcagcaagccacttgggtgaaatataccttcccggtcaaacatcaggtgtggaagcagaaaggggaggagtatcgcgttaccggctacggcggatggtcttggatatctaaaacccacgtctatcgattcgtgccaaagcttcctggtaacactaatgtaaactatagaaaatctctggagggaaccaagaataacatggacgagaatatggacgaatccgacaagagaaagtgcagtcggtcccccaagaaaattaagatagaaccagactctgagaaggacgaagttaagggaagcgatgccgctaagggcgcagatcagaatgaaatggacatctcaaagataaccgaaaaaaaggatcaagatgtcaaagagctactggacagtgactccgacaaaccttgtaaggaggagcctatggaggtggacgatgatatgaaaactgaatcacatgtgaactgtcaggaatccagccaggtggacgtagttaatgtatctgagggcttccatctcagaactagctataagaaaaaaaccaagtccagtaagcttgacgggctgctggagagacgcatcaagcagttcacactcgaggagaagcagcggctcgaaaagatcaagttggagggcggaattaagggaatcggaaagaccagtacaaactcctcgaagaatttgagcgagtctcccgtgattaccaaggccaaggagggatgtcagtctgacagcatgaggcaggagcagtcacctaatgctaacaacgatcagcccgaggatctgattcaggggtgttccgaaagcgatagcagcgtcctccgaatgtcagatccctcccacaccacaaataagttgtaccccaaagaccgagtgcttgacgatgtgagcattaggagccctgaaaccaaatgtccaaaacagaattccatcgaaaatgatatcgaggaaaaagtgagcgacctggcctcccggggtcaagagcccagcaaaagcaaaactaaagggaatgatttctttatcgatgactccaaacttgcttctgcggacgacattggcaccctgatctgcaaaaacaagaaaccgctaatacaggaggaaagcgatacgatcgtgtcgtcttctaaatccgccctgcactcctcagtgcctaaatccacaaacgacagagatgcaacacccttgagtcgggcaatggactttgagggcaagcttgggtgtgattcagagtccaatagtactctcgaaaacagtagcgatacagtgagcattcaggactcatctgaggaggatatgatagttcaaaactctaatgaaagcatttctgagcagtttagaacacgggagcaggatgtcgaagtgttggaacctctaaagtgtgaattggtgtccggcgaatcaaccggaaactgtgaggaccggctgccggtgaagggaactgaggcaaacgggaagaagccttcccagcagaagaaacttgaggaacggcctgtgaacaaatgtagcgaccagatcaaattgaagaataccaccgacaagaagaacaacgaaaacagagaatccgaaaagaaaggccagcgcacatctacatttcagatcaacggcaaagataacaagccaaagatttatcttaagggagaatgcctgaaggagatatccgagtcgagagtcgtctccggtaatgttgaaccgaaggttaacaacatcaacaaaattattcctgaaaatgatattaagtctctcaccgtaaaagagagcgctatccggccattcatcaatggtgatgtcataatggaagattttaatgagcggaactcatccgagaccaagtcccatctgcttagttcctcggatgccgagggaaactaccgagattctctggaaaccctacccagtacgaaagagtctgattcaacccagacgaccactccatctgccagttgcccagagtccaatagtgtcaaccaagtggaagacatggaaatcgagacaagtgaggtgaagaaggttacctcctcccccatcacctccgaggaggagagtaacctttcaaacgactttatagatgaaaacgggttgccgatcaataaaaacgagaatgtgaatggcgaatccaaacggaaaactgtgattaccgaagtgacaactatgacatccaccgttgccacggagtcaaagacagtaattaaggtcgagaagggcgataaacagaccgtggtttcaagtaccgaaaactgcgccaagtcaactgttaccacaaccaccaccacagtgacaaagttgtctacacctagtactggagggtccgtcgatattatctcagtcaaggaacaatctaagaccgttgttactaccaccgtgactgatagcctgaccactactgggggtacccttgttacctcaatgaccgtgagtaaagagtattcaacccgcgataaagtcaaattgatgaagtttagtaggccaaaaaaaacacgatctggcactgcactgccaagttatcgcaagttcgtgactaagtccagtaaaaagtctatattcgtcctgccaaatgatgacctcaagaaattagctaggaaaggtggcatacgtgaagtcccttattttaattataacgcaaaacccgcactggacatttggccttatccctcccctaggcctacttttggcataacatggaggtaccgactccagactgtcaagagcctcgccggagtcagtttaatgctgagacttctttgggcatcccttcggtgggacgatatggccgctaaagctccgccaggcggaggtacaacccggaccgagactagtgagacggagatcaccactacagagattatcaaaagacgcgatgttggaccatacggcataaggtctgaatattgcataagaaagattatatgcccgatcggcgtccccgagacccccaaggagactcccaccccccagcgaaaaggcctgcgctcttcagctttgcggcctaagcggcctgagacccccaagcagacaggacccgtgattatcgagacctgggtggccgaagaggagttggagttgtgggagattcgagctttcgcagaaagagtagaaaaagaaaaggcgcaagcagtggagcagcaggccaagaagcggctcgagcagcaaaagcctaccgtcatcgctacttcgactactagccccaccagttctactacctctacgatctcccctgctcagaaggtcatggtggcacctattagcgggtccgtgacaacaggaaccaaaatggttctcactactaaagtggggtcaccagccacggttacctttcagcagaacaagaatttccaccagactttcgccacgtgggtcaagcagggacaatcgaattcaggtgtggtgcaagtgcagcagaaggtgctaggcatcatcccctccagcaccgggacctcacaacagactttcacctccttccagccacgaacagccacagtaaccatacgtccaaacacatcagggtcagggggaactacttctaattcacaagtgatcacagggccacagatcaggcctggtatgaccgtgattcggacaccactgcagcagtctacgctgggcaaagcaatcattagaaccccagtgatggtccaacccggagccccacaacaggtgatgacccaaatcatacgaggccagccagttagcacggccgtgtcggcccctaacacggtctcctctacacccggacagaagagcctcacctcggctactagtaccagcaacattcagtcctccgccagccagccccctaggccacaacagggccaggtcaagctcaccatggcacagctgacccaactcacccaaggacatgggggtaatcaggggctcactgtggttattcagggccagggtcagactacaggacaactgcagttgatcccccagggagtaacagtactccctggaccgggacagcagctgatgcaggctgctatgcccaacggtacggttcagaggtttctgtttacgcccctggccactaccgcgaccaccgcctcgaccacaacaacgacagtaagtacgactgcagccggtacaggcgaacaacggcagtcaaagctgagcccgcagatgcaagtacaccaagataaaacactaccacctgcgcaatccagtagcgtcggtccagcggaagctcaaccccagactgcacaacctagtgcacagccgcagccccagacacagcctcagtcgcccgctcaaccagaagtgcagacccaaccagaagtgcagactcagactaccgtgtcatcacatgtgccctcagaagcccagcctacccatgctcaaagcagcaagccccaagtggcagcccagtctcaaccccaatccaatgtgcaaggacagagtcccgtacgcgtgcagtctccctcacaaactcgaatcagacccagcacccccagccagctatctcctggacagcaaagccaagtgcaaacaacaactagccagcccattcctatccagccccacacgtcactgcagattccatcacaagggcagcctcagtctcagccccaggtacagtcctccacacaaaccttgtcaagcggtcagacccttaaccaggtcacagtctcttctccctcacgaccgcagcttcagattcaacagccccaacctcaggttattgccgtaccacagctccagcaacaagtccaggtgctcagtcagatacaatctcaagtggtggcccaaatacaggcccaacagtccggcgtaccacaacagatcaaactgcagctccctatccagatacagcagagttcggctgtgcagacgcaccagattcagaacgtcgtcaccgtacaggccgcatctgtgcaggagcagctgcagagagtacagcagttaagagatcaacagcagaagaagaagcagcaacagatcgagatcaagagagaacatacactgcaggcttccaatcaatctgagattatccagaagcaggttgtgatgaagcacaacgctgtcatagagcacttgaagcagaagaagagcatgacacccgctgaacgggaggagaaccagcgcatgattgtatgcaaccaggttatgaaatatattctggacaaaatcgacaaggaggagaaacaggccgcaaaaaagcggaagcgggaagagtccgttgagcagaagcgcagtaagcaaaacgcaacaaagctgtctgccctgttgttcaagcataaggagcagctgcgcgcagagatattgaaaaaacgggcattgctcgataaggaccttcagatcgaggtgcaggaagagttgaagagagatctcaaaataaagaaggaaaaagacctaatgcagctggcccaagctaccgccgtggcagccccatgccctcctgtgacaccggcacctccagctccgccagcccctcctccaagccccccaccgcctcccgcagtgcagcacaccggcctgttaagcaccccgacactcccggctgcaagccagaagcggaaaagagaagaagagaaggactcctcaagcaaaagtaaaaaaaaaaagatgatatctaccacatcaaaggaaaccaaaaaggatactaagttgtactgtatatgtaaaacaccttacgacgagagcaagttttatatcggttgcgatcgctgccagaattggtatcatggacggtgtgtcgggatcctgcagagcgaagcagagctaatagacgaatacgtttgtccgcaatgccagtcaactgaggacgccatgactgtgctgactccacttactgagaaggactatgaggggctgaagcgggtcctgcggtcactacaggcgcacaagatggcttggccgttcttagaaccagtggatccaaacgatgctcccgattattacggagtgatcaaagaacctatggatctcgctacaatggaggaaagggtgcaaaggaggtactacgaaaagctgactgaatttgtagcagacatgacaaagatctttgataattgtcggtactacaacccttctgactcccccttctatcaatgcgcagaggtcttggaaagctttttcgtccagaagttaaaagggtttaaagcttccagaagtcataacaataaactccagagcaccgcgtctta

SEQ ID NO: 28025 - DNA, 927 bp, Artificial Sequence
  Description of Artificial Sequence: Synthetic coding sequence
atggccagctctaatacagttctcatgagattagtggcttcagcctactccattgcccagaaggcaggcatgattgtgcgacgagtgatcgcggagggcgatctagggatcgtggaaaagacttgtgctacagacctccagactaaggctgaccgtctagctcagatgagcatttgctcgtccttggctcgtaagtttccaaagctgacaatcataggcgaggaggatttgccatcagaagaagtggaccaggaactgattgaggattcacagtgggaagaaatattgaagcagccgtgtccctcgcaatacagtgcaataaaagaggaagatctcgtggtttgggtggatccactcgacggcacaaaggaatacaccgaaggtcttttggacaatgtcactgtgttgatcggaatagcttacgaaggaaaagccatagccggtgtgatcaaccagccctattacaactacgaggcagggcctgacgctgttctcgggaggactatctggggggtgcttggattaggggcttttggatttcagttgaaagaggtgccagcaggaaagcatataattacgaccaccagaagtcatagcaataagctcgtgacagattgtgttgccgcaatgaaccctgacgctgttcttcgagtaggtggggcaggcaataaaattattcagctcatcgaaggcaaagcctctgcttacgtgttcgctagccctggctgtaaaaagtgggacacctgtgcccctgaggtgattctgcatgcggtcgggggaaagctgaccgacatccatgggaatgtccttcagtaccacaaagacgtcaagcacatgaacagtgcgggtgttctggcaaccttaagaaactatgactactatgcgtctcgggtccctgaatccataaagaatgccctggtgccatag

SEQ ID NO: 28026 - DNA, 1212 bp, Artificial Sequence
  Description of Artificial Sequence: Synthetic coding sequence
atgtcaggttccgatggaggcctggaggaggagcctgagctttccatcacactgactctcagaatgcttatgcacggcaaagaagtgggttctattatcggcaagaaaggcgagaccgtcaagcgtatccgcgagcagagtagtgcgcgaatcactatttccgagggctcttgccctgagcggattactacaatcacgggcagtaccgctgcagtgttccatgctgtttcaatgatcgctttcaaactggacgaagatctctgcgccgctccagcaaacggaggcaatgtctctcgcccacctgtgacactgaggctggtgattcccgctagtcaatgtgggtctctcattggaaaagccggaaccaagatcaaggagattagagaaacaactggcgctcaagtgcaggtcgccggagaccttcttcccaactctactgagcgagccgtgactgtttcaggagtacccgacgctatcatcctctgcgtgagacagatctgcgccgtgattcttgaaagccccccaaagggcgctacaatcccctaccacccttctctgagccttgggactgtccttctgtcagccaatcagggattttctgtgcagggtcagtacggtgccgttaccccagcggaagtcaccaagctgcagcagctgtcatcacacgctgtccctttcgctacgccgagcgttgtgccgggactggatcctggaacgcagacgagctctcaggaattcctcgtccccaacgacctgatcggctgtgtaatcggtcgccagggctcaaaaatatctgagatcagacagatgagtggcgcacacataaagataggaaatcaggcagagggagcaggagagcgccatgtgaccattacagggtcccctgtcagcatcgccctggcccaatatctgattaccgcgtgcctggaaactgctaaatctacctcaggtggtacccccagctctgctcccgctgatctgcccgctcctttttcacctcctctgacagcactcccaactgcccctcccggattactgggcactccgtatgccatcagtctgtccaacttcattggactaaagcccatgccctttttagcacttccacccgcttcccccggacccccaccgggactcgccgcttatactgctaaaatggctgccgctaatggcagcaaaaaggctgaacgacagaagttctcaccttactag

SEQ ID NO: 28027 - DNA, 654 bp, Artificial Sequence
  Description of Artificial Sequence: Synthetic coding sequence
atgtcttcaaaggtaagccgagacacactttacgaggcagttcgcgaagtgctgcacggaaatcagcgcaagcggcgtaaattcctggagaccgtggagctgcaaatctctctgaagaactacgatccccaaaaagataaacggttctcaggaaccgtgaggttgaaatccacccccaggcctaagttttcggtctgtgtcttgggagaccagcagcactgcgacgaagctaaagcggtcgatattccccacatggatattgaggcgctgaaaaaactcaataagaacaagaaacttgttaagaaactagccaaaaaatacgacgcctttctcgcctcagagtccctgattaagcagattcccagaatacttgggccaggccttaataaggcaggaaagtttcctagccttctcactcataacgaaaatatggtggcaaaagtggacgaggtgaagagtactatcaagttccagatgaagaaggtactctgtctggctgtcgccgtggggcacgtgaaaatgacagacgatgagcttgtgtataacatccatctcgccgtcaacttcctcgtcagtctgctcaagaagaattggcagaacgtgcgtgctctatatattaaaagcactatgggtaagccacagcgcctttattag

SEQ ID NO: 28028 - DNA, 3159 bp, Artificial Sequence
  Description of Artificial Sequence: Synthetic coding sequence
atggagggaagcgaaccggtggccgcacaccagggtgaagaggctagctgttcaagctggggcaccggcagcaccaataaaaaccttcctataatgagtacagcctcggttgagattgatgacgccttgtatagtcggcagagatacgtgctcggtgatacagcaatgcagaagatggccaaatctcatgtttttctgtctggcatggggggactcggcctggagattgccaagaatctagtgctcgctggaatcaaggcggtgacaattcacgatactgagaagtgccaagcttgggacctgggtaccaatttttttctcagtgaagacgatgtggtgaacaagaggaatcgggcagaggcggttctgaagcacattgctgaacttaatccgtatgttcacgtcacatcttccagcgttccctttaatgagaccacggacctgagctttctagataagtaccagtgtgtcgtcctgactgaaatgaaattacctttgcagaagaagatcaacgacttctgccggtcgcaatgtccccctatcaaattcatcagcgctgacgttcacggaatttggtctcgcctcttttgcgactttggagatgaattcgaggttctggacactaccggcgaggagcctaaagagatctttatttccaatattacccaggccaaccctggtatcgtgacctgtctggaaaatcaccctcataagttggaaacagggcagtttttgacttttcgagaaatcaacggaatgacaggcctgaatggctcaattcagcagatcaccgtgattagccccttcagcttctcgattggggacactactgaactcgagccctacctgcacgggggtattgccgtccaggttaagacaccaaaaaccgtgtttttcgagtcactcgaaaggcaactgaagcacccaaagtgccttattgtcgacttcagtaatccagaggccccattagagatacacacagcaatgttggcgcttgatcagttccaggagaagtatagtagaaagccaaacgttggttgtcagcaggactcagaagagctcctgaagttggccacaagcatttctgaaaccctagaggagaaacccgacgttaacgcggatatagtccactggctcagctggacagcccaggggtttctcagccctctcgccgctgctgtggggggtgtggcctcccaggaagtgctgaaagccgttacagggaagttttctcctctgtgccagtggctgtacctcgaagccgcagacatcgtcgagagcctagggaagccggagtgtgaagagtttttgcccagaggggaccgttacgacgctttgcgagcctgcatcggtgacaccctttgccagaaactgcagaatctgaatatatttctcgtgggctgcggcgctattggttgcgaaatgctcaaaaactttgcactcctgggcgttgggacatccaaagaaaaggggatgataaccgtcactgatcctgatcttattgaaaagtcaaacctcaatcgacagtttttgtttaggccacatcatatccagaaacctaagtcctatactgctgcggatgctaccctgaaaataaatagtcagataaaaatcgacgctcatttaaacaaggtctgccccactacagagacaatatataacgacgagttttacacgaagcaggacgtgatcattacggcgttggataacgtagaggccagaagatatgtcgatagcaggtgtttagcaaacctgcgccctctgcttgactctggcacgatgggcaccaagggccatacggaggtaattgtgccccacctcaccgaatcgtacaacagccatagggatcccccagaggaggaaatacctttctgtaccctgaaatcctttcctgctgcgattgagcatactatccagtgggcacgtgacaagtttgaaagctcattctcacacaaaccctctctattcaacaagttttggcagacttactctagcgccgaggaagttcttcagaagattcagtctggacatagtcttgagggctgttttcaggttatcaagctcctgtcccgcagacctagaaactggtcgcagtgcgtggaattggccaggctgaagttcgaaaaatacttcaatcacaaagccctgcagctgctacactgttttccgctcgatatcaggctcaaggacggttctctgttctggcagtcaccaaaaagaccaccctctcctattaagttcgacttgaacgagccgttgcacttgagctttctccagaacgcagcgaagttatatgccacagtttattgcattccttttgcagaagaggacttgagcgcggacgcattactaaacattcttagtgaagtgaaaatccaggagttcaagcctagcaacaaagtagtgcagaccgacgaaacagctagaaagccggatcatgtcccaatctcctctgaagacgagcggaacgccatttttcagttagaaaaagcaatcctgagcaacgaagccaccaagtccgatctgcaaatggccgtactgtcattcgaaaaggacgacgatcacaatggacacattgatttcataacagctgcatctaacctgcgcgcaaagatgtacagcattgagcctgccgaccgatttaagactaagagaatcgcaggcaagatcatccccgctatcgccaccactactgctaccgtatctggattggtcgcactcgaaatgattaaggtgactggcggatacccatttgaagcttacaagaattgctttctgaacctcgccattcccatagtggtttttacagaaaccaccgaggtgcgcaaaacaaaaattcgcaatgggatttcatttaccatctgggaccggtggaccgtgcatggcaaagaagattttacactgttggacttcattaatgccgtgaaggagaaatatgggatcgaaccaacaatggtagtgcaaggcgtgaaaatgctttacgtacccgtaatgccaggccatgccaaaagattgaagctcactatgcacaagttagtgaagcccacgaccgagaagaagtacgttgacctcacagtctctttcgctccagacattgacggtgatgaagatttgcccggaccaccggtccggtattacttttctcatgataccgactag

SEQ ID NO: 28029 - DNA, 1134 bp, Artificial Sequence
  Description of Artificial Sequence: Synthetic coding sequence
atgttaagactagtgcccaccggagcacgcgctattgttgacatgagctacgccagacattttcttgatttccagggctcagcgatccctcaggcaatgcaaaagttggttgtcacacgactgtctccgaattttagggaggcagtgaccctgtcacgagattgtccagtccctttacctggtgatggagacctgcttgtgcggaatcggtttgtgggcgtgaatgccagcgatattaattactcagccggaaggtacgacccgtcagtgaaaccgccattcgatattggatttgagggtattggtgaggttgttgccctggggctgtcagcatctgcacgctacacagtggggcaggctgtcgcatacatggcacccggtagctttgctgaatataccgtggttcctgccagcatagccacaccggtcccctccgtgaaaccagaatacctgacacttctcgtgagtggaacaactgcttacatatccttgaaggaactgggcggactgtccgagggcaagaaggtgctggtgacagccgcagccggtggtactggccagtttgcgatgcaactgtccaagaaggctaagtgccacgtgattggtacctgctcatctgatgagaaatcggccttcctcaaatccctcggatgcgatcgccctatcaattacaagactgagccagtgggaacggtcttgaagcaggaatacccagaaggcgtagacgtggtctacgagagtgtcggcggtgcgatgtttgatctcgctgttgacgctctggcaacgaagggacggcttatagttatcggattcataagcgggtaccagactccaacagggttaagccccgtgaaagctggaactctgcccgcaaagctgctgaaaaaaagtgcttcggtgcagggtttttttctgaatcattatctgagcaagtaccaggcggcaatgagtcacctgctggagatgtgcgtgtccggagatctcgtgtgcgaagtcgatttaggcgatcttagtcccgaagggagatttacagggctggaaagtatctttagagctgtgaattacatgtacatgggaaaaaataccgggaagattgttgtcgagctgccacatagcgtaaattcaaaactatag

SEQ ID NO: 28030 - DNA, 2538 bp, Artificial Sequence
  Description of Artificial Sequence: Synthetic coding sequence
atgtccaattctcggccacgctctcgccgtgacgctgggggaggagctggagcggctgggagagatgagctggtgtctaggagtctgcagtctgccgagcattgtcttggagtgcaggattttggcactgcctacgctcactacctgctggtgctatctctcgctccagaattgaaacatgacgtgaaggaaacgtttcagtacactctgtttcgctgggcagaggaactggatgcattaagcaggatccaagatctgctcgggtgctatgaacaggccttggagctgtttcctgacgacgaggtgatctgtaacagtatgggagaacacctgttccgtatggggttccgagatgaagcggctggatattttcacaaagccgtaaaacttaatcctgacttttccgacgccaaagaaaacttctacagagtggctaactggttagtggagagatggcacttcatcatgttaaacgacaccaaacgcaacacaatctacaatgccgcaatccagaaggcagtgtgtttaggatctaaaagtgtcctggacattggagccggtacaggaattttgagtatgttcgcaaagaaggctggcgcacactctgtgtacgcctgtgagctgagtaaaaccatgtatgagctcgcctgcgatgtggtggcagcgaataagatggaggcaggaatcaaactcctgcatacaaaaagcctggacatcgaaattcccaagcacataccagagcgagtatcccttgtcgttaccgaaacagtggacgccggactgtttggggaaggcattgtggagtctctcatccacgcctgggaacacttgttgctacagccaaagactaagggggaatcggcaaactgtgaaaagtacggtaaggtgataccagcatctgccgtgattttcggaatggcggtcgagtgcgccgagattcggcgtcaccatagggtgggcattaaagatatagcgggtatacatctgcccactaacgtgaaattccagtcccctgcttatagcagcgtggatacagaagagactatcgaaccctatacaaccgagaaaatgagcagggtcccaggcggatatctggcattaaccgagtgcttcgaaatcatgactgtggattttaataacctgcaagagctgaaaagcctcgcaaccaaaaagccggataaaatcggaatccctgtaattaaggagggcatactggatgctataatggtctggttcgtgcttcaattggacgatgagcacagtctttctactagtccttcagaggagacatgttgggaacaggccgtgtatcccgtgcaggacctggcggactactggataaagcccggagaccacgttatgatggaggtttcctgccaggattgctatctacgtattcagtctatcagcgtgttaggtctggaatgtgagatggacgtggccaaaagctttacccagaacaaagacctgttgagtttaggtaatgaggcggagctctgcagcgccctggctaatctacagacttctaaacctgatgcggtggaacagacttgcattctcgaatctacagagattgcactactcaataatatcccctaccacgaagggttcaagatggcgatgtctaaagttttgtcaagtctgacaccagagaaactgtatcaaaccatggatacacactgtcaaaacgaaatgtccagcggtaccgggcagtctaacacagttcagaacattctggagcctttctacgtcctggatgtttcagagggtttttcagtccttccagtgattgccggaacactgggacaggttaaaccgtacagctcagtggagaaggatcaacatagaattgccctagacctgatttctgaggccaaccacttccctaaagagaccctggagttttggctccggcacgtggaagacgagagcgctatgctccagcgacccaagtccgacaagctttggtccatcatcatcctcgatgtgatagagccctcaggcctgattcagcaggaaatcatggagaaagccgcaatttctcgatgtctactccagagtggagggaagattttcccacaatatgtcctaatgttcgggctgctcgtggaatcccagaccttgctggaagagaacgcagttcaaggaacagagcgcacccttggcctgaacatcgccccttttattaaccagttccaagtcccaattagggtgtttctggatctctctagcctgccttgtattccccttagcaaacccgtggaactgttgagattggatctcatgacgccatacctaaacacgagtaatcgagaggttaaagtgtacgtctgtaagtcaggccgtctaaccgcaatacccttctggtaccacatgtacctagacgaagagattcggctggatacatcgtcagaggcttcccactggaaacaggctgcagttgtgctcgacaatcctatccaggtggaaatgggcgaggaattagttctgtccattcagcatcataaaagcaacgtgtctatcactgttaaacagtag

SEQ ID NO: 28031 - DNA, 756 bp, Artificial Sequence
  Description of Artificial Sequence: Synthetic coding sequence
atggctgacctaacatctgtgttgacatctgtgatgttctctcctagctcaaaaatgttcattggtggtctttcctggcagacatcccccgactctcttagggattatttttctaaattcggggagatccgcgagtgcatggtgatgcgggacccaacaactaaaaggagtcggggtttcggattcgtcactttcgcagatccagcctccgtcgataaagtccttggtcagcctcatcacgaactggattctaaaaccattgaccccaaggtggcattccctcggagagcgcagccaaagatggttaccagaacaaagaagatatttgtgggcggactgagtgccaatactgtggtggaggatgtaaagcagtatttcgaacagttcggcaaggtcgaggacgctatgctgatgttcgacaagaccaccaatagacaccgaggctttggatttgtcacattcgagaatgaagatgtggtagaaaaggtatgcgagatccactttcatgagataaataacaaaatggttgaatgtaaaaaggcacaacccaaggaagtgatgtttcctcctgggacaagaggaagggccagaggcctcccttatactatggacgccttcatgttgggaatgggcatgctcggatatccgaattttgtggccacttatggcagggggtaccccggattcgctccgagctatggctaccaattcccagattatctgccagtgagccaggacattatttttataaactag

SEQ ID NO: 28032 - DNA, 510 bp, Artificial Sequence
  Description of Artificial Sequence: Synthetic coding sequence
atggctccgaagcgggcaaaaaggaggaccgtggagggtggttctagcagcgtattctccatgtttgaccagactcagatccaggagtttaaagaggccttcaccgtcatcgaccagaacagggacgggatcatcgataaagaggacctgagggatacgtttgccgctatgggtagacttaatgtgaaaaacgaggagttggacgcgatgatgaaagaggccagtggacctataaactttaccgtctttctgaccatgtttggagagaagcttaagggagccgatccagaagatgttataactggagcctttaaggtcctggaccctgaagggaaaggcacgataaagaagaaatttctggaggagctgctcacaacccagtgtgatcgtttttcccaagaggagattaagaacatgtgggccgcttttccaccggatgtaggaggcaatgttgactacaagaatatctgttatgtaattacacatggagatgccaaagatcaagaatag

SEQ ID NO: 28033 - DNA, 546 bp, Artificial Sequence
  Description of Artificial Sequence: Synthetic coding sequence
atggcaacagaacccgaagctgccgagccagtggttcccagcttagtggaccggtactttaccaggtggtacaagccagacgttaaagggaagttttgcgaggaccattgcattctgcagcactccaaccgcatatgtgttatcacattggcggaatcacatcccgttctgcagtctggaaaaaccattaagtccataagctaccagatttcgactaattgctcacgtcttcagaataaagtttcaggcaagtttaaaaggggcgctcagttcttgacagagctcgcacccttgtgtaagatttattgctcggacggcgaggaatacacagtgtcctcctgtgtgagggggagacttatggaagttaatgaaaatattcttcacaaaccttctattctccaggagaaaccgagtactgaaggctacatagctgtcgtcctccctaagttcgaggagagcaagtcaatcaccgaagggttgcttactcagaagcagtacgaggaagtgatggtcaagagaataaacgctacaactgccaccagctag

SEQ ID NO: 28034 - DNA, 2154 bp, Artificial Sequence
  Description of Artificial Sequence: Synthetic coding sequence
atggagctcagatgcgggggattactgttctcctccaggtttgattccggcaacctggcacacgtggagaaagttgagtcccttagctcagatggggaaggggtaggtggcggtgcaagtgctctgacttcagggatcgcatctagccctgactacgagtttaatgtctggacacgaccagattgtgcggagactgagttcgaaaacggaaacaggtcctggttctatttttccgtcaggggcggaatgcccggtaagttaattaaaatcaatattatgaacatgaataagcagtcaaagctgtactcccagggcatggcgcctttcgtgcgcactcttcccacaaggccaagatgggaaaggattcgagatcgtccaacctttgagatgaccgagacccagttcgtgctgtcattcgtacaccggtttgtggaaggacgcggagctaccacattttttgccttttgctaccccttctcttatagtgactgccaggaattgctgaatcagctagaccagcggttcccagaaaatcatcccactcatagttctcctcttgatactatttactaccatagggagctgttgtgctatagcctcgatggtctccgcgtggacttgttgactataacgagctgtcacggcctacgtgaagatagggaacccaggctggagcagctatttccagatacctcaacacctcggccttttagatttgccggaaagagaatctttttcctgagttcacgagtccatccaggggagaccccctcttccttcgttttcaatggctttcttgatttcatacttaggcctgatgacccacgagctcagacattaaggcgacttttcgtcttcaaacttattcccatgctgaatccagatggtgtggtcaggggccactaccgcacagacagtagaggagtaaatctgaaccgccagtatctgaagccagacgccgtgctgcaccccgcaatatatggggcaaaggccgtgcttctttatcaccacgtccattcccggttaaactctcagtcttcgtcagaacaccagccttccagctgcttgccgcctgacgctcccgtgtcagatctggagaaggctaataatctgcagaatgaagcacagtgtgggcatagcgctgacaggcataatgccgaagcctggaagcaaactgagccagctgagcaaaaacttaactccgtgtggattatgccccagcagtctgccggattggaggagtccgctccggacaccattccacccaaggagagcggggtcgcgtattatgtagacttgcacggtcacgcgagcaagcgaggatgctttatgtacggcaactcgttctccgatgaatcaactcaggtagagaatatgctctatccaaagctgatcagccttaattccgcgcatttcgacttccaaggctgtaatttctcagaaaagaatatgtatgccagagacaggcgagatggccaaagcaaggagggttccggaagggtagcaatatataaagcaagcggaatcattcactcctacaccctcgaatgcaattataacacaggaagatccgtcaacagtatcccagccgcttgtcacgataacggccgtgcctccccccctcccccacctgcctttccaagccgatacacagtggagctgttcgaacaggtgggcagagctatggcgattgcagcactggatatggccgagtgtaacccttggccccgaatcgtgctcagcgaacacagcagcctgacaaatcttcgtgcctggatgctgaaacatgtgagaaattctagaggcctgagttccactctgaacgttggagtgaacaagaagcgcggattgagaacaccgccaaagtcacataacggtttaccagtgagctgttccgagaacacgctgagcagagcccgaagcttttcaacaggcacctccgctggtggttcttcttctagtcagcagaattctccccaaatgaaaaatagtccaagcttcccttttcacgggtcccggcctgcagggctgccaggtctgggtagttcaacacagaaagtgacacacagagtgctagggcctgtacggggaaaaccagtgtgggaacccctgcagcacgtttttggttgtttgggccactgttggggaaaatag

SEQ ID NO: 28035 - DNA, 678 bp, Artificial Sequence
  Description of Artificial Sequence: Synthetic coding sequence
atggttatggccgaggggacagccgtgttgcgtcggaatcggcctgggaccaaggcacaagacttctataattggccggatgaatcatttgacgagatggacagtactctagctgttcagcagtatattcagcagaatatccgggcagattgctctaatattgacaagatcttagagcccccagagggacaggacgagggcgtctggaaatacgaacacctccggcagttctgcctcgaactaaacggacttgcagttaagctgcagagcgagtgtcaccccgatacttgcactcagatgactgcaactgagcagtggatcttcctgtgtgcagcacacaaaacacctaaagaatgccccgcaatagattacaccagacataccttggacggcgcagcttgtctgttaaactctaacaagtattttccgtccagggtgtcgataaaggagagctccgtagccaaactcggctccgtttgtcggagaatataccgaattttttcacacgcatacttccatcaccgccaaattttcgacgagtatgagaacgaaaccttcctctgccacaggttcaccaagtttgtgatgaagtataatctaatgagcaaagacaatctgattgttcctattttagaggaggaggttcagaacagtgtctctggggaatccgaggcttag

SEQ ID NO: 28036 - DNA, 1173 bp, Artificial Sequence
  Description of Artificial Sequence: Synthetic coding sequence
atggccgcacagaaggacctttgggacgccatcgtcattggagctggtattcagggctgcttcacagcttatcacctggctaaacataggaaacgtatcctcctcttggaacagtttttccttccccatagtagaggcagcagtcacggacagagccggatcatccggaaagcgtacctggaagacttttatacaaggatgatgcacgagtgttatcagatttgggcccagttggaacatgaagcaggtacccagctgcatagacagaccgggctcctccttctgggcatgaaagagaatcaagagctgaagacaatccaggccaatctttcccgccagagagttgagcaccagtgtctgtcatcagaggaactgaagcagagattcccaaacatcagactgccacgaggagaggtgggactgctagacaacagcgggggtgtgatctatgcttacaaagcattacgtgccctccaagatgccatccgccagctgggtggcattgttagagacggtgaaaaagtcgtagaaattaaccccggactactcgtcacagtgaagacaacgagcaggtcctaccaggccaaatctctcgtgatcaccgccggtccatggactaaccagctattgcgaccgctggggatagaaatgccactccagacacttcgcatcaatgtgtgctactggcgggagatggtcccgggaagttacggggtgagccaggcttttccctgcttcctgtggcttggcctgtgcccgcaccacatctacggcctgcctaccggcgaataccctggtctgatgaaggtgtcctaccatcatggcaaccatgctgatcccgaagagcgggattgccctacagcacggactgacattggagacgttcagatcctgagctccttcgtgagagaccacctccctgatctgaaaccagaacctgccgtaatcgagtcatgcatgtatacgaatacgcccgatgagcaattcatactcgaccgccatcctaaatacgataacatagtcatcggagccggatttagtggtcatggcttcaagttagcaccagtggttgggaaaatcctttatgagctgagcatgaaactgacgccatcttacgacctcgctcccttccggataagtagattcccgtcactcgggaaggctcacctgtag

SEQ ID NO: 28037 - DNA, 135 bp, Artificial Sequence
  Description of Artificial Sequence: Synthetic coding sequence
atgtccgacaaaccggatatggcggaaatcgagaaatttgacaaatccaagcttaaaaagaccgagatgcaagagaaaaatcctctcccctctaaagaaactatcgagcaagaaaagcaggccagcgaatcttag

SEQ ID NO: 28038 - DNA, 1323 bp, Artificial Sequence
  Description of Artificial Sequence: Synthetic coding sequence
atgcctatcccgcctcctccgcctcccccaccaggccctccacctccgccaactttccatcaggctaacactgagcaacctaagttgagtagagatgagcagagaggcaggggggcattgctgcaggacatttgtaaagggacaaaactgaagaaagtgaccaacatcaacgataggtccgctccaattctggagaaaccgaagggatcgtctggcggatacggatccgggggtgcggctctgcagcccaagggcggtctgttccagggcggagtgctgaagctcaggcccgtgggcgctaaagatggtagtgagaatctcgccggaaagcctgcattacagataccctcatcccgggcagccgctcctcgcccaccagttagtgctgccagcgggaggccacaggatgatacagactcttcccgcgctagtctgcccgagttaccccgaatgcagagaccgtccctccccgatctgtctcggcctaataccaccagtagtaccggcatgaaacattcttcaagtgcccctccaccccctccacctggacggagagccaatgctccacccactcctttgccaatgcatagtagtaaggccccagcttataatcgtgaaaagccgttgcctcccacgcccggacagagacttcatccagggagggagggacctccagcccctcctcctgtaaaaccacctcccagccccgtcaacattcgtactggaccttcagggcagtcactcgccccacctcctccgccttaccgccagccacccggagtgcctaatggaccatcctctccaaccaatgagtccgccccagagttaccacagcgtcacaactccttacaccgaaagaccccgggtcctgtgcgcggtctggctccgccacccccaacctccgcctctccatctctattgagcaataggccccctccacctgccagagatccaccatctagaggtgctgccccacctccgccacctcccgtcattcggaatggcgctcgagacgcgccacctccccctcccccttatagaatgcacgggagtgagccgccatcccgagggaagccacctccacccccatccagaacgccagccggacctcctccgccaccccctcctccacttagaaatgggcaccgcgactcaattactaccgtccgatcttttctcgacgacttcgagtctaaatactcgtttcatccagtggaggattttccagcccctgaggaatacaaacatttccagcgcatatacccgtcaaagacaaatagagcggctaggggcgcaccccctttgcctcctatactccgatag

SEQ ID NO: 28039 - DNA, 2703 bp, Artificial Sequence
  Description of Artificial Sequence: Synthetic coding sequence
atgaactatccgggtcggggtagccctcgctccccagagcacaatggtagggggggaggcggtggagcctgggagctcggcagcgacgcgcgtcccgcatttggaggaggcgtatgctgctttgagcacttacccggtggcgatccagacgatggtgacgtgcctctggcactcctgcggggagagcccggactccatctcgcaccgggaaccgatgaccacaaccaccatcttgctctggacccatgtctgtccgacgagaattacgatttttctagtgccgaaagcggctcatccctgaggtattactctgagggtgagtcagggggaggaggcagcagtttgtccctccatcccccacaacagcctccactggtgcctactaattcaggtggagggggagctacaggtgggagtcccggagagaggaagcgcacccgattgggtggtcccgctgcgaggcacaggtacgaagttgttaccgagctcggccctgaggaggtgcggtggttttacaaggaggataaaaagacctggaagccttttattggctacgattctctccggatagaattggcgtttaggacacttctgcagacaaccggtgctagaccccagggaggagatagagatggcgaccatgtttgctcacctacaggtccagcatcctcaagcggggaagacgacgacgaagatagagcatgtggattctgtcagagtactacaggtcacgaacctgaaatggtcgagttggtgaacattgaaccagtctgtgtcaggggtgggctgtatgaagttgatgttactcagggcgaatgctatccagtttattggaatcaggctgacaaaatccccgtcatgagagggcagtggtttatcgatggaacttggcaaccactggaagaggaagagtctaatttgattgagcaagagcacctcaattgctttagagggcagcagatgcaggaaaattttgacatagaggttagtaagagtatcgacggcaaagatgccgtgcactcattcaagttatcacggaatcatgtggactggcattccgtcgacgaggtttacctttattcagatgcaacgaccagcaagatcgcgcgtactgtcacacagaagctcggattttctaaagcatctagctccggaacgaggctgcaccgtggatatgtggaagaagcgacactggaggacaaaccaagtcaaaccactcatattgtattcgtggtacacggtattgggcagaaaatggaccagggtaggatcattaagaatacagcaatgatgcgtgaagccgctcgaaagattgaggaacgtcacttttcaaaccacgccacgcacgtagagttcctacccgttgaatggcgaagcaaactgactctggacggggacacagttgactcaattacccccgataaagttcgcggtctgagggacatgttgaactccagtgccatggatataatgtattacacatccccgttgtatagagatgaactggtcaaggggttgcagcaggaactaaatcgcctgtacagccttttctgttctcggaacccagacttcgaagagaaaggaggcaaggtatctattgtctctcacagcctgggatgtgtgatcacttatgacataatgaccgggtggaacccagtgcgcctgtacgaacaactcctgcaaaaagaggaagagctgccagatgaacggtggatgagctacgaggagcgacacctcctcgacgaactgtacataacaaagaggagactaaaggaaatcgaggaacgtttgcacggtctgaaggcgtcaagtatgacccagacacccgcactgaagttcaaagtcgagaatttcttttgtatggggtctcctttagccgtgttccttgctctgcgaggcatacgaccaggaaacaccggctcccaggaccatattctgcccagagaaatatgtaaccgcctgcttaacatatttcatcccacggatccagttgcatacaggctggaaccactgatactcaagcattatagcaacatctcacccgtacaaattcactggtataatacctctaatccacttccgtatgagcacatgaaaccatcttttctgaatccagccaaagagcccacgtctgtgagcgagaatgagggcatcagcacgatcccatcgcccgtaacctccccagtcttatccagacggcattacggcgaatctatcaccaacataggaaaggcgtctatcctgggagcagcctccattgggaaaggcctagggggtatgctcttttccaggtttggaagaagctcaactacccagagctctgagacctcgaaagattctatggaagacgagaagaagccagttgcatccccttctgccacaactgtgggcacacaaacgctgccccactcctcttctggtttcttagacagtgcatattttagactccaggagtccttcttcaatctgccgcagctgctctttcccgaaaacgtgatgcagaacaaagacaacgctctggttgagctggaccataggatagatttcgaattaagggagggactcgtcgagagtcgctactggtccgcagtaacctcccatacagcatattggtcttccctcgatgtcgccttattcttgttaaccttcatgtataagcacgagcatgatgacgacgctaaacctaacctggatccgatttag

SEQ ID NO: 28040 - DNA, 1278 bp, Artificial Sequence
  Description of Artificial Sequence: Synthetic coding sequence
atgaataagatgccagccggagaacaggagtgcgaatataacaaggagggcaaatattacagcaaaggtgttaaactagtccgaaaaaagaagaaaatacctgggtacaggtggggggacatcaagattaacatcatcggtgagaaggatgaccttcccatccatttctgtgataaatgcgaccttcccattaagatatatggcaggataattccatgcaagcatgctttctgctaccattgcgctaatctgtacgacaaggtaggctacaaggtatgtcctagatgtcgctatcctgttttgcgcatcgaggctcacaagagagggtccgtgttcatgtgtagtatcgtccagcagtgtaagcggacttatcttagtcagaaatccctgcaggctcatattaagagaaggcataagcgagcaagaaagcaggtgactagtgccagtctggagaaagtacgtccacacatcgccccaccacagacagaaatatcagacatcccaaaacgactccaggatcgcgaccatctatcatatatccccccagagcaacacaccatggtcagccttccttctgtccagcacatgctgcaagaacaacataatcagccccataaagatattcaggccccaccccctgaactgtctctgagtcttcctttcccaatacagtgggaaactgtgtcgatcttcacacgcaagcatggcaacctgacggttgatcacatccagaacaatagtgattccggggctaaaaaacctaccccacccgattattacccagagtgccagtctcaacctgccgttagcagcccccaccacataattccccagaagcagcattacgcccctcctccgtccccatcaagccctgttaaccaccagatgccatacccaccccaagacgtcgtgacaccgaactcagtgcgctcacaggtgcccgcacttaccaccacttacgacccctcctccggttacattatcgtcaaagtgccacccgacatgaattcgcctcctttacgggcaccgcaatctcagaatggcaaccccagtgcatccgagttcgcttctcaccactataacctcaacattcttccacagtttacagaaaatcaggaaactttaagtcctcaattcacgcagaccgacgcaatggatcaccggagatggcccgcttggaaaaggctgtcaccatgcccacccacaagatcacccccaccttccaccctccatggcaggtctcaccattcccatcagcggagacatagacggtactag

SEQ ID NO: 28041 - DNA, 1926 bp, Artificial Sequence
  Description of Artificial Sequence: Synthetic coding sequence
atgggtccgcctttaaagttgtttaaaaaccaaaagtatcaggaacttaaacaagagtgcatcaaggacagtagacttttttgtgaccccacttttttgcctgagaatgatagtctattttacaataggcttttgccagggaaggtggtatggaagagaccccaagacatctgcgatgatcctcaccttatcgtcgggaatatctccaatcatcagcttactcaggggaggctcggccataaaccaatggtgtccgccttctcctgtctcgcagtccaggagagtcattggactaaaactataccaaatcataaggagcaggagtgggaccctcagaaaaccgagaaatacgctggcatctttcactttcgattctggcactttggggaatggaccgaagtcgtgatagatgatctgttaccaactattaatggtgatcttgtgtttagtttttcgacaagcatgaatgagttttggaatgcgttgctcgaaaaagcatacgccaagctgctgggatgttacgaggcactcgatggactaacgatcactgatatcatcgtcgattttacagggactctcgctgaaaccgtggatatgcagaaggggagatatactgaacttgtcgaggagaagtacaaactcttcggggagttgtataagacgttcacgaaggggggtctcatatgctgctcaatcgaatccccgaatcaggaagaacaggaggtggaaacagactgggggctattaaagggccacacatataccatgacagatatccgcaaaatcaggctgggcgaacggctcgtggaggtattctccgcagaaaaggtttacatggtgcggttacgcaaccccctgggcagacaggagtggtccgggccttggtccgagattagtgaagaatggcagcagctgacagcatccgatcggaaaaatctgggcttggtgatgagtgacgatggagaattttggatgtccttagaggacttctgcaggaattttcacaaattgaacgtctgccgtaatgtcaacaatcctatctttgggaggaaggagcttgaatctgtgttaggctgctggacagttgacgatgatcctttgatgaatcggtctgggggttgctataataatagggacaccttcctccaaaatccccaatacatcttcactgtccccgaagatggccacaaagttatcatgtccctccagcagaaagatctgagaacctaccggagaatgggcagacccgataattacattatcggatttgagctttttaaggtcgagatgaatagaaagttccgcctacaccacctgtatattcaagagcgggctgggacgtccacctatattgacactcgaaccgtctttctaagcaagtatctgaaaaaggggaactacgtgctagtgccaacaatgtttcaacacgggcgtacctccgagttcctgctccggatcttctccgaggtccctgtgcaacttagagagctgacactggacatgccaaagatgtcatgctggaatctcgccagaggatatcccaaagttgttacccagatcaccgtccacagcgctgaggatttggagaaaaaatacgctaatgagactgtgaacccatacctggtaattaagtgtgggaaggaggaggtcaggtcacctgtgcagaagaatacggtacatgctatctttgacactcaggccattttttaccgtaggactacggacattccaattattgtccaggtgtggaatagccggaagttctgcgatcagttcctggggcaagttactctcgatgccgatccttccgactgtagggacctgaaaagcctttatttaaggaagaaaggtggcccaactgccaaggtaaagcagggccacatttcgttcaaagtgatttctagtgacgacctgacagaactgtag

SEQ ID NO: 28042 - DNA, 3180 bp, Artificial Sequence
  Description of Artificial Sequence: Synthetic coding sequence
atggctgcagtggctgggtctggcgcagccgctgccccttcatcattgttgctagttgtcgggtccgaattcggctccccaggcttactcacttacgtcctcgaggagctcgagaggggaatcaggagttgggacgtggatcctggggtgtgtaacttagacgagcagcttaaggtcttcgtgtcacgacacagcgcaaccttctcatcaattgtgaaagggcagaggagcctacaccatcgcggagataacttagagacattggttttgttaaaccctagtgataagtccctgtacgatgagctccgcaatctgctcctggacccagcttcccacaagcttctggtgctggccggaccctgcttggaggaaacgggagagctgctgctgcagacagggggattctcgcctcatcacttcctgcaggtgctcaaagatagggagatccgcgacatcctggctacaactccccctcctgtacagccaccgatcctcacgataacctgtccaacattcggcgattgggctcagctggcgcctgcagtgccaggattgcagggtgctcttcgactgcagctccggctcaaccctcctgctcagctaccaaatagtgaaggcttgtgtgagttcctggagtacgtggcagagtctctggagcccccttctccctttgagctgctcgagccccctacctctggtggcttcctcaggttaggtcgaccttgctgctacatcttcccagggggattgggagatgctgccttcttcgctgttaatgggttcactgtgctggtaaacgggggaagcaacccaaaaagtagcttctggaaattagtcagacaccttgatcgggtcgatgccgtgcttgtcacacatccaggagctgattctttgcccggtctaaattccctgctgagacgcaaactggctgaaagatctgaggtagcagctgggggtgggtcttgggacgaccgattgcgacgattgattagccccaatctgggcgtcgtgtttttcaacgcctgcgaagctgcgtctaggttggctcggggagaagacgaggccgagttggcactcagcctgttagcacagctgggcattactccactccccctgtcgagaggtccagtaccagcaaagcctactgttctatttgaaaaaatgggcgtgggcagactggatatgtacgtgctgcaccccccatccgctggggctgagagaacactagcctccgtatgcgcgctactggtgtggcaccctgcaggacctggagaaaaagtggtgagagtcctgtttcccggatgcactccccctgcctgcctgttggacggactcgtcaggctccaacaccttagatttctgagagaacctgtggtgacgcctcaggatctggaaggcccaggccgagcggagtcaaaggagagcgtcggtagccgcgactcctctaaacgcgaggggcttctggccacacaccccagaccgggtcaagaacgccctggcgtggcgagaaaagagcctgcacgcgctgaggctccccgtaagacagagaaggaagcaaaaacaccccgtgagctcaaaaaagaccccaaacccagcgtaagtaggacacagccacgagaggttaggcgggctgcctccagcgttccaaacctaaagaaaaccaatgcgcaggctgcccctaaacccaggaaggccccatctaccagccattccggatttccacccgtggccaatgggccaaggagccctccctcactgcgatgcggcgaagcgtcaccaccgagcgcggcatgtggctctccagcttcccagctggtcgccaccccttcgttggaattaggtcccattcctgctggcgaggagaaagctctggagctcccactcgccgcttcctcaatccccaggccccgaaccccctcaccagaaagccacaggtcgcccgctgaaggcagtgaaaggcttagtctgtccccattacggggtggcgaagctgggccagacgcaagccccacggtgaccacacctaccgtgaccacaccatcactgcccgctgaggtcggttctccccattctactgaggtcgatgagagcttatctgtatctttcgagcaggtgctaccaccatctgcgcctacctcagaggcagggctctccctgccattgcgaggacctcgtgcacggaggagcgcctctcctcatgacgtcgacctgtgtcttgttagtccgtgtgagtttgaacaccggaaagcagtgcctatggcccctgcgcctgccagccccggtagctcaaatgactctagcgcgagatctcaagaaagggcgggtggactgggagcagaagagacaccacctacgtccgtgtccgaaagtttgccaaccctgtctgatagtgatcctgtgcccctggccccaggcgcagcagatagcgatgaggatactgaaggctttggtgtcccccgacacgatccgctgccagatccgctgaaagtccccccaccccttcctgacccgagctctatatgtatggtggacccagaaatgcttccgcctaaaacagccagacaaaccgaaaacgtgagtagaactaggaaacccctggctcggccaaattcgagggccgctgcgcctaaagccactccggtcgctgcagctaaaactaaaggcttagcgggtggggaccgagctagccgtcccctatccgcacggtccgaacctagtgaaaagggcggtagagctccactgagtcgtaaaagtagcactcccaaaacagccaccaggggcccatctggatccgcctcttcacggcctggggtttctgctacgcccccaaagagccctgtttacctggacctggcatatctcccaagtggctcctctgcgcatctcgtggacgaagaatttttccagcgcgttagggccctgtgctacgtcatctcgggccaggaccaacgcaaagaggaaggcatgcgcgcagtcctggatgcgctgttagcgtctaagcaacactgggaccgcgacctgcaagtgacactgatacccacgtttgacagcgtggccatgcacacctggtatgctgaaacacatgccaggcatcaggccctcggcataactgttctgggatctaattccatggtgtccatgcaggacgatgcttttcctgcttgcaaagttgagttctag

SEQ ID NO: 28043 - DNA, 4734 bp, Artificial Sequence
  Description of Artificial Sequence: Synthetic coding sequence
atggaggctggaagtgttgttcgagctatcttcgatttttgtccgtccgtgagcgaggagctcccactctttgtgggtgacattattgaggtgctcgctgtggtggacgaattttggttgctggggaaaaaagaggacgtgacaggtcagtttccatcatcattcgtggaaattgtcactatcccaagtcttaaagagggcgagcgcctgtttgtgtgcatctgtgaatttacaagccaggagttggacaatttgccactgcatcggggtgacctggtgatcttggatggaatcccaaccgctggctggttgcaggggcgatcctgttggggagccagggggttctttccaagtagttgcgtccgtgaactatgtctttcctcccagagcaggcaatggcattcacagagtgcacttttccaaattcctgagtactctatgggccaggctagagctttgatgggcctgagtgcccagctcgacgaggaactggacttccgagagggcgacgttatcactattataggcgtgcctgagccaggatggttcgagggcgagctggagggtcgcagaggcattttcccagagggctttgtcgaattgttgggcccacttcgaaccgtggacgagtctgtctcttccggcaaccaggacgactgcattgtcaatggggaggtcgataccccagttggggaagaggagattggcccagacgaggacgaggaagaaccaggaacctacggcgtggcgctgtacagattccaagccctggaacccaatgagctcgactttgaggtgggcgataaaattcgcattctggctactctagaggatggctggctagagggctccctgaaggggcgaacaggtatcttcccctacaggttcgtgaagctttgcccggacacacgagtggaagagactatggcactgccacaagagggaagccttgctcggatccccgagaccagcttagattgtttagaaaacactctgggagtggaagagcagcgacatgagaccagcgaccatgaagccgaagagcccgattgtatcattagcgaggcacccacatctccccttggtcacctgacaagtgaatacgatacagaccgcaactcttaccaagacgaggataccgcagggggacccccacggtcacctggcgtggaatgggaaatgcccctggctaccgacagcccaacgagcgacccaactgaggtcgttaacggtatcagcagccagccacaggtgcctttccacccgaacttgcaaaagagccaatattacagtacagtcggaggctcgcatcctcatagtgaacaatatcccgatcttctacccttggaagcacggactcgggattatgcctccctgccaccaaagagaatgtatagtcagctaaagaccctccagaagccagttctcccactgtacagaggatcttccgtcagtgcaagtcgagtcgtgaagcccagacagtcttccccacaactccacaacctggccagttacacgaaaaagcaccacaccagttccgtatactccatttcagaacggctcgagatgaagcccggaccgcaagcacagggccttgtgatggaggctgccactcacagccagggtgacggctctaccgatttggattccaagttaacacaacagctgattgagttcgagaagtcactggccggtcctggtaccgagccagataaaatcctcaggcacttctcgataatggactttaacagcgaaaaggatattgtgagggggtcctctaaactgattacggaacaggaactacccgaacgcagaaaggccctgcgtcccccaccgccacgcccttgtacgccagtttccacttctccacatttactagttgaccagaatctgaaacctgccccaccactggtagtgaggcccagtcgcccagctccgttgcctccgtctgctcagcagcgtaccaatgccgtttcaccaaagttgctgtctagacacaggccaacatgcgaaacgcttgagaaggaggggcctggtcacatgggccgatccctagaccaaaccagcccatgccctctggtgctggtgcgaattgaagaaatggagcgcgaccttgacatgtacagccgagcgcaagaggagctcaatctgatgttggaggaaaaacaagacgagtctagccgagccgagaccttagaagacctgaaattttgtgaaagcaatatcgaatccctcaacatggaacttcagcagctgagagaaatgaccctcctctcttctcagtcaagtagcctcgtggccccttccggtagcgtgtccgcagagaatccggaacagcgcatgcttgagaagcgtgctaaagttattgaagaattactacagactgaaagggattacattcgggatctggaaatgtgcattgagagaatcatggtgcctatgcagcaggcccaggtccctaatatcgacttcgagggcctgttcggcaatatgcagatggtgatcaaagtttccaagcagctgctggcggctcttgaaatttcagatgcggtcggcccagtttttctcggccaccgggacgaactggagggcacatacaagatttattgtcagaaccacgacgaggcaatcgccctgttagaaatctacgagaaagatgagaaaattcagaagcatctgcaggatagcctcgccgatctaaaatcgctgtataatgagtggggttgtacgaattatattaatctgggaagcttcctcatcaaacccgttcaaagagtaatgcgctatcctcttctgttgatggaactgctgaattccacccccgaatctcatcctgataaggtaccgctcaccaacgccgtgcttgctgtgaaggaaatcaatgttaacattaatgagtacaagcgcaggaaagacctggtacttaagtatcggaagggcgacgaggattccctcatggagaagatttccaagctcaatatccacagtatcattaagaagtctaacagagttagctcacacctgaaacaccttaccgggttcgctccacagatcaaagatgaggtgttcgaggaaaccgagaaaaattttcggatgcaggagcggttaattaagtcctttatacgagacctttccttgtacttacaacatattcgggagtctgcatgcgttaaggtcgtggcagcagtgtctatgtgggacgtttgtatggagagggggcatcgcgacctggaacagttcgagagagttcaccgctatatctccgaccaattatttacaaatttcaaggagaggactgagcgtctcgtgatctcccctctgaatcagctgctctcaatgtttacaggaccccataagctggttcagaaacgctttgacaagttgctggacttctataattgcactgaaagggccgagaagctaaaggataagaagacattagaagaactgcagtcagctcgcaataattatgaagcactgaatgcacagctactggatgagctgccgaaatttcatcagtacgcgcagggcttgttcaccaactgtgtgcacgggtacgctgaggcacattgtgattttgttcatcaagctcttgagcagctgaaacccctgctatctctcctcaaagttgccggtcgggagggcaatttgatagcaatatttcacgaggagcactcgcgcgttttgcagcagttgcaggtgttcacattttttccagaatcgcttccggcaactaaaaaacctttcgaacgcaagactatcgatcggcagtcagctagaaagccgctgctgggactccccagctacatgctgcagtccgaagagctgcgcgcaagtctgttagccagatatccacccgaaaaactgttccaagccgagagaaactttaatgctgcacaagacctggatgtttcgctcctagagggtgacctggtcggcgtcatcaagaagaaagatcccatgggcagccagaacaggtggctcattgacaacggggtgactaaaggctttgtgtattctagcttcctgaagccctacaacccaaggcgaagccacagcgacgcgtccgtaggctcccattccagcacagagtcggaacatggctcttcatcgccccgatttcccaggcaaaacagtggcagcacgttgacatttaacccatcttctatggccgtcagttttactagcggctcatgtcagaagcaaccgcaggatgccagcccccctccaaaggaatgcgatcagggaacactttcagcttccttgaaccccagcaactccgagtcaagtcccagtcggtgcccttcggatccagactctacgtcccagcctcgctctggcgattcagccgatgtggcgcgagacgtgaagcagcccacggcaactcccaggagctatcgcaacttcagacatcccgaaatcgtggggtactcagtgccaggcagaaacggacagagtcaggaccttgtgaagggctgcgctcgcaccgctcaggcacctgaggaccgaagtactgagcctgatgggagtgaggcagaggggaatcaagtgtactttgctgtgtataccttcaaagctcgcaatccaaacgagctgtccgtctctgcaaaccagaagttaaaaatattggagtttaaagatgtgactggcaatacagagtggtggctcgcagaggtcaacggtaagaagggttacgtccccagtaactatatccgaaagacagagtatacttag

SEQ ID NO: 28044 - DNA, 3186 bp, Artificial Sequence
  Description of Artificial Sequence: Synthetic coding sequence
atgctgagaactgcaggacgcgacgggttgtgtagacttagcacgtatctcgaagagcttgaggctgttgagctcaaaaagttcaaactgtacttaggaacagctactgaactgggggaaggaaaaattccatggggtagtatggagaaggcagggccactcgaaatggcccaactactcatcacccacttcggccctgaggaagcatggagactggccctgtccactttcgaacgcatcaaccggaaagacctgtgggaaagaggccagagggaagacctagtacgagacactccacctggcggaccttcttctctgggtaaccaatctacatgcctgctggaagtcagcctggtgacgcctaggaaagatccccaggaaacgtatcgggactatgtgaggagaaagtttagattaatggaggaccgcaatgccaggctgggcgagtgtgtcaatctcagtcacagatacactcgcctgcttctggtgaaagagcactctaatcccatgcaggtgcagcagcagctgttggataccggacggggacacgcacggactgtcggtcatcaagcaagtcctattaagatagagaccctgttcgagcccgatgaggaacggccagagccgcctagaacagtcgttatgcagggtgcagccggaattgggaagagcatgttggcacataaagtaatgttagactgggctgacgggaagctgtttcagggcaggtttgattatcttttttatattaattgccgggagatgaatcaatctgccacagaatgttctatgcaggatctgatcttttcctgttggccagagcctagtgcccctctgcaggaactcatcagagtgcctgaacgcttattgttcataatcgatggcttcgatgagttgaaaccgagtttccacgatccccaggggccttggtgcctctgctgggaagagaagagacccaccgaacttctcctcaattctctcatccggaagaagctgctgcccgagctgagcctattaataacaactagacctacggctctggaaaagctgcatcggctccttgagcatcctcggcatgtggaaattcttggtttctccgaagctgagaggaaagagtatttctacaaatattttcataacgcagaacaggccggacaggtcttcaattatgttcgcgataatgaaccactgtttactatgtgtttcgttcccctcgtatgttgggtggtgtgtacttgtctgcagcagcaattggaagggggtgggctgctgaggcaaacgtcgaggactacaacggcggtctatatgctgtatctgttgtcgctgatgcaaccaaagcccggagctccgaggctgcagccgccacctaatcaacggggactgtgctcactcgcagcggacggcctttggaatcagaagatcctgttcgaagaacaggacttaaggaagcatggactagatggcgaggatgtgagcgcatttctgaacatgaatattttccaaaaagacatcaactgcgaaagatactatagcttcattcatcttagcttccaggagttcttcgccgctatgtattatattctcgacgagggtgagggtggagccggacccgaccaggatgtcactaggttacttaccgagtatgccttctccgagaggtccttcctggcccttacctcacggtttcttttcgggttgctaaacgaggagactcgcagccacctggagaaatcgctttgttggaaagtctcccctcacatcaaaatggacctcctgcagtggatccagtccaaagcccagtccgacggctccactctgcagcagggatctctggaatttttctcctgtctgtacgagatacaggaggaggaatttattcaacaagcactgagtcactttcaagtgatagtcgtcagcaatatcgccagcaagatggagcatatggtcagctcattttgtctcaagaggtgtcgcagcgcccaggtgctccatctgtacggcgcaacctatagcgcagacggcgaagatcgcgcaaggtgctccgctggggcacataccctcctggtgcaactgccagaacgcacagtgctactagatgcctactcagagcacctcgccgcagccctttgtaccaatccaaacctgatagagctgtccctctataggaatgccctggggagcaggggagtgaaattgctttgccagggtttgcggcacccgaattgtaaactgcagaacctgcggctgaaaagatgtcgtataagctcttccgcttgcgaggatttgagtgctgcccttatcgccaacaagaacctcacccgaatggatctctccgggaatggtgtggggttccctggaatgatgctgctgtgcgaggggctgaggcatccccagtgccgcttgcagatgattcagttgcggaaatgtcagttggagagcggtgcgtgccaggagatggctagcgtgcttggaactaacccccacctagtggagttggacctcacagggaacgccctggaagatctgggactgcgactgctctgtcagggtctgcggcaccctgtctgccggttgcggaccctatggctgaagatctgccggctgaccgctgcggcatgtgatgaactggctagcaccctgagcgtgaatcagtctctcagggaactcgatctttccctaaatgagcttggggatttgggagttcttttgctctgtgagggtctgcgtcaccctacctgcaagttacagacactgcgtctcggcatttgtcgactggggtccgccgcttgcgaagggctgtctgttgtcctgcaggctaatcataatttgagggaactagacctcagttttaacgacctgggcgactggggactctggctgctcgctgaggggctgcagcatcctgcttgccgactgcagaagctgtggcttgacagttgcgggctgaccgccaaggcctgtgagaatctctacttcacactcggaatcaatcagaccctgaccgacctgtatctcaccaacaacgcacttggcgatacaggcgtgcgtctgctgtgtaaacgcctgtcacatcctggatgcaagcttcgagtgctgtggctatttggcatggacttaaacaagatgacacactctaggctggcggcactgcgggtcacgaagccataccttgacatcggatgttag

SEQ ID NO: 28045 - DNA, 3963 bp, Artificial Sequence
  Description of Artificial Sequence: Synthetic coding sequence
atggccaatgactcccctgccaaaagcctggtagacattgacttaagttctcttagggacccagcaggcatatttgagctcgtggaagtggtaggcaacgggacctacggacaggtttacaagggcaggcatgtgaagacaggccagctggccgctattaaagttatggacgtgaccgaggacgaggaggaagagattaagttggaaatcaatatgttaaagaaatactcccaccaccgcaatattgctacatattacggagcttttatcaaaaagagcccacctggccacgacgaccagttgtggctggtcatggaattctgcggcgcaggcagcattaccgatttagttaaaaatacaaaaggcaataccctaaaggaggattggattgcttatatctcacgcgagatcctgagaggcctagcacatctccacatacaccacgtgattcaccgagatattaagggacagaacgtcttgcttacagagaacgccgaggtgaaactggttgactttggcgtgtctgctcagctggaccggaccgtcggacgcagaaacacattcatcggaaccccttactggatggcacctgaggtgatcgcttgtgacgaaaatccagatgccacctacgactataggtcagacctgtggtcatgcggaatcactgccattgagatggccgagggggcacccccactgtgtgatatgcatccaatgagggccctgttcctcattcctaggaatcctcctcctcgactgaagtctaaaaaatggtccaagaagttcttctcctttatcgagggctgtcttgtgaagaattatatgcaacgtccaagtactgagcagcttctgaagcatccctttatcagagaccagccgaacgagcgccaggttcggatccagttaaaggaccatatcgatcggacgaggaagaagcggggtgaaaaagacgagacggaatacgaatacagtggcagcgaagaagaggaggaagaggttcccgagcaggaaggagaaccatcctcgatcgttaatgtgcctggcgaatccaccctgaggagagacttcctgcgcctgcaacaagagaataaggagaggagcgaggctttgagaagacaacagctgctgcaagagcagcagctgagggagcaggaggagtacaagaggcagctgctcgcggagcgacagaagcggatcgagcagcagaaagagcagagacggaggttggaggaacagcagcggagagaacgagaagcaagaaggcagcaggagcgggagcaaagacgtagggaacaagaggagaagcgacgcctcgaggagctcgagcgacgcaggaaagaagaggaggagcgccgacgggcagaggaagaaaagcgtagagtcgagcgggaacaggaatatatcagaaggcagctggaagaggagcaaagacacctggaagtactgcagcaacagctactgcaagaacaagccatgcttctggagtgcagatggagagagatggaggagcatagacaagctgagagactccagcgtcagctgcagcaagaacaggcttatctgttatcacttcagcacgaccacagacggcctcacccccagcattctcagcaaccacctcccccacaacaagaaagaagcaagcccagctttcacgcaccagagccaaaggcccattatgagccagccgaccgcgctagggaagtagaggaccgatttcgaaagaccaatcacagctctcccgaagcgcagtctaaacagaccggtcgtgtcttggaaccccctgtccccagtcgttccgaatccttcagcaatggtaactcagagtctgtccaccccgctctgcagagacccgcagagccccaggtccagtggtctcacttggccagcctaaaaaacaacgtcagccccgtgagcagaagccactccttcagtgacccttccccgaagtttgcgcaccaccatttgcgctcacaggacccatgccccccttcccgctccgaagtcctgtcccagtcaagtgattcaaagagtgaggccccagatccaacacaaaaagcatggagcagatctgatagcgatgaggtcccaccacgagtgcccgtccggacaacatccaggagtcctgtgctcagcaggcgggacagccctctgcagggctctggacaacagaacagtcaagccggacagagaaattccacctcctctatcgagccgcgtcttctttgggaaagagtcgaaaaattagtgcctcggccaggttctggttccagctcaggctcctcaaactccggctcccagccgggtagccacccaggcagtcagtctggatcgggcgagcgctttagggtgcggagtagttctaaatcggaagggagccccagccagaggttagaaaacgccgtaaagaagccggaggacaaaaaagaggtgtttcgtcccctcaagcctgcagtgcgaatcgatctcaccgcattagccaaggaactgcgtgcagttgaggatgtgcggccaccccataaagtcactgactactctagttcctcagaggagagcggtacaaccgatgaggaggacgatgacgtcgagcaggaaggcgcagacgaatccacctccggccctgaggacacgcgggcagcctcttcactaaacctgtctaacggtgagactgagagcgtcaagactatgatcgtgcacgatgacgttgagtcagaaccagccatgaccccttctaaagagggtacacttattgtgaggcagacacagagtgccagcagcacattacagaaacataaatctagctccagcttcacaccatttatcgacccacgactgctccagattagcccatctagcggcaccaccgtcacgagcgtggtcggcttctcttgtgacgggatgcggcctgaggccatccgccaagaccctacccggaagggttccgtggtcaacgtcaaccctaccaatactaggcctcagtctgatactcctgaaatccgtaaatataagaaacgatttaatagcgaaatactgtgtgcggcactctggggggtgaacctcctcgtgggcactgagtctgggctgatgttattggaccggtctgggcaagggaaggtctatccactgatcaaccgtagacggtttcagcagatggacgtcctggagggcctgaacgtgctggtgaccataagcgggaaaaaggataagctgagagtgtactatctgtcatggctgaggaataaaatcttacataacgatccggaagtggagaaaaaacagggttggactactgtcggcgacttggagggctgtgtgcactacaaggtggtcaaatacgagcggattaaatttctggtgatcgctctgaaatccagcgtggaagtatacgcgtgggcccctaagccctaccacaagttcatggccttcaagagctttggcgagctagtgcataagcctcttctggtggacttaactgtggaggagggacagcggctgaaggtcatctatggctcttgcgccggattccatgccgttgacgttgactctggatcagtgtacgatatctaccttcccacccatattcagtgctcaattaaaccccacgccattattatactgccaaatacggacgggatggaactgttagtgtgttacgaggacgagggagtatacgtcaatacgtacggccgaatcactaaggatgtagttttacagtggggggaaatgccaaccagcgtggcctacatcaggtcgaaccagactatggggtggggagaaaaagccatcgaaattcgctcggtggagactgggcacctggatggtgtgttcatgcataaacgcgctcagaggctcaaatttctgtgcgagagaaatgacaaggttttcttcgccagcgtgcgtagcggtgggtcgtcacaagtatatttcatgacgttaggcagaaccagcctcctatcctggtag

SEQ ID NO: 28046 - DNA, 606 bp, Artificial Sequence
  Description of Artificial Sequence: Synthetic coding sequence
atgtatacgctacttagtggtttgtacaaatacatgtttcagaaggatgagtactgtattctcatcctgggtctcgacaatgccggaaaaactaccttcctagagcagtccaagaccaggttcaacaagaactataaaggaatgtcactgagcaaaattaccacgaccgtcggcttaaatattggaacggtggatgtggggaaggcccgtttaatgttctgggatctgggtgggcaggaggaactgcagtccctgtgggacaagtactacgccgagtgccatggtgtcatctacgtgattgactccactgacgaagagaggctggccgaatcaaagcaggctttcgagaaagtggtaacaagcgaggctctctgcggcgtgcccgtactcgtcttggctaacaagcaggatgtggagacctgcttgagtatccctgatatcaagactgcattttcggactgcaccagcaagattggacgccgtgattgcttgacgcaggcgtgcagcgcactcactggaaagggcgtgagggagggcatcgagtggatggtgaaatgtgtggttcgaaatgtgcataggccaccacgacagagggacatcacctag

SEQ ID NO: 28047 - DNA, 1329 bp, Artificial Sequence
  Description of Artificial Sequence: Synthetic coding sequence
atgaggggtgccatggagctggagcccgagctgctcctccaggaggcaagagaaaatgtggaggcagcccagtcgtacaggagagaactagggcaccggctggagggccttcgggaggcaaggaggcagatcaaagagagcgcctcgcagactagggatgtgctcaaacagcactttaatgacctcaaagggaccctgggcaagctcctggacgaacgcctcgttacacttttgcaagaggtcgacacgattgagcaagagactatcaaacctctcgatgattgtcaaaagctgattgaacatggtgtcaataccgcagaggacctggtgagggagggagagattgccatgctgggtggtgtgggcgaggaaaacgagaaattgtggtccttcacaaagaaggcaagccatatacagctcgatagcctgcccgaagtgccattgttggtggatgtaccatgtctctcagcgcagctggacgatagtattcttaatatcgtcaaggaccacatattcaagcacggtaccgtggccagcagacctccagtacagatcgaggagctcatcgaaaaacccggagggataatagtccgttggtgtaaagtagatgatgatttcactgcccaggattatagactacagttcaggaagtgcacctctaaccatttcgaggatgtgtacgtgggatcagagaccgaatttattgtattgcatattgaccccaacgtggattatcagttcagagtatgtgcgaggggcgatgggcgacaggagtggtctccttggtcagttccgcagatcggccattctacactggttccgcacgagtggaccgcaggcttcgaaggttattccctatcaagcaggaggaacatcgccttgcgcaatgacagtgagtcctcaggtgtcctgtactcaagagcccctacatatttttgcgggcagaccctcaccttcagggtagaaacggtcggtcaaccggaccggagagattccatcggcgtttgcgccgaaaagcaggatgggtacgacagtctgcagagagatcaggcagtatgcatctctaccaacggtgctgtgtttgttaatggcaaggagatgaccaaccaactgccagccgtaacctcaggtagcactgttaccttcgacatagaggccgtgacgctgggcaccaccagcaataatgaaggcggtcatttcaagcttagagttaccatatcctccaataacagggaggtggtgttcgattggttgctcgatcagtcatgcggaagtctgtatttcgggtgcagtttcttttaccccggatggaaggtccttgttttctag

SEQ ID NO: 28048 - DNA, 1428 bp, Artificial Sequence
  Description of Artificial Sequence: Synthetic coding sequence
atggcggctttgacaacattattcaaatatatcgatgaaaatcaggatcgctacatcaagaaactagctaaatgggtggcaattcaaagcgtgtccgcttggcccgaaaagcgcggtgagatccggagaatgatggaggtggccgctgctgacgtgaagcagctgggaggtagtgtagagctagtggacatcggtaagcagaaacttcccgacggatcagagatccctttgccgcctattctcctgggccgactgggctccgaccctcagaagaaaaccgtctgcatttatggacacctggatgttcagccagccgctctcgaggacgggtgggacagcgaaccattcaccttagtggagcgggacggcaaactatacggaaggggaagtacagacgacaagggtccagtcgctggctggattaatgctcttgaggcgtatcagaaaactggccaggagattcccgtcaacgtacgcttttgcctggaggggatggaggaatctggtagcgaaggactagacgagctgatcttcgcgagaaaagacacattctttaaagatgtcgactacgtgtgtatttccgacaactactggctcggcaaaaagaagccttgcatcacatatgggctgcgaggaatatgttacttttttatcgaagttgagtgcagcaataaggatctccatagcggagtatacggcggatcagttcacgaggccatgacggacctgatacttcttatgggttctcttgtcgacaagagaggcaatattctcatcccaggcattaatgaagccgttgcggcagttacagaggaggaacacaagttatacgatgacattgatttcgacatcgaggaatttgccaaggatgtgggtgctcagatcttactgcattcacacaaaaaggatatactgatgcataggtggcggtatccaagcttgtccctgcatggaattgagggtgccttcagcggcagcggcgcaaagacggtcattccacgtaaggtagtaggtaaatttagtatccggctggttcccaacatgactcctgaagtcgtcggggaacaggtgacttcctacctgacaaagaaattcgccgagctgcgaagcccaaatgagttcaaggtctacatgggacacggaggcaaaccctgggtatcggacttttcacacccccattacttggccggtagaagggccatgaaaacagtgtttggcgtagagccagaccttactagggaaggcggatctatcccagtgacattaaccttccaggaagccaccggcaaaaacgtgatgctgctgcccgttggatccgcagacgacggcgcacactctcagaacgagaagcttaataggtataattatatcgaggggactaagatgttggccgcatatttgtatgaagtgagtcagctgaaggactag

SEQ ID NO: 28049 - DNA, 6290 bp, Artificial Sequence
  Description of Artificial Sequence: Synthetic coding sequence
atggcagaagtgaccgtgccccgagtgtatgtggtctttggcatccattgcatcatggcaaaggcatcaagtgatgtccaagtgtcaggtttccatcgcaaaatacagcatgtgaagaacgagctgtgtcatatgttgtccctagaggaggtcgcacccgtcttgcagcagacgctcctgcaggacaacctactagggagggtgcactttgatcaattcaaggaagccttgatcctcattctgtcgcgcaccctgtctaacgaggagcatttccaggagcccgactgttcacttgaggcccagccgaagtatgtgagggggggtaaacggtacggaaggcggtccctacccgagttccaagaatcagtagaggaattccctgaggtgactgtcatcgagcctttagacgaagaggcccgaccaagtcacatccccgcaggtgactgttctgagcactggaaaacccagagatctgaggagtacgaggccgagggccagttgcggttttggaaccccgatgatctgaacgcttcccaatccggaagttctccaccacaggattggatcgaggagaagttgcaggaggtctgcgaggatctgggcatcacccgcgacggacatctgaatcgcaaaaaattagtgtccatatgcgaacagtacggacttcagaacgtggacggagagatgttggaagaagtcttccataatttggatcccgatggaacaatgtctgttgaagactttttctacggtttattcaaaaatggaaagagcctgaccccgagtgcatcaactccgtatcgccagctcaaaaggcacctgagcatgcagtcattcgacgagtctggcaggcggacaaccacctccagcgccatgacgagtacgatcggattcagagtgtttagctgtcttgacgacgggatgggacatgcttcagtcgagagaatcttggacacatggcaagaagaagggattgaaaatagccaggaaatactaaaggctctcgatttctcattagatggcaacattaacctgaccgaactgacactagcgctggaaaacgaactgctggtcaccaaaaactccattcatcaggcggctctcgctagttttaaagccgaaatcaggcacctacttgaacgcgttgatcaggtagtgagggagaaggagaagctacggtccgacttagataaagccgagaaactcaaaagcctcatggccagtgaggttgatgaccaccatgcagccatagaacggagaaacgaatacaatctgcggaaactcgatgaggaatacaaagaaagaattgctgccttgaaaaatgaacttaggaaagaaagggagcaaatcctacagcaagctggcaaacagcggcttgaactggaacaggagatcgagaaggccaaaaccgaagagaactacattcgagataggttggccttgtccctcaaagagaatagcagattagaaaatgagttgctcgagaatgccgaaaaactggccgaatatgaaaatttgacaaataagctgcagcgcaacttggaaaacgtcctcgctgagaagtttggtgatctggaccctagttccgccgaattcttccttcaggaagagagactcacccagatgaggaacgaatacgaaaggcagtgtcgtgtgttacaggaccaagtggacgagttgcagtcagagctggaggaatacagagcccaaggaagagttctccgcttgcctcttaaaaactcgccatctgaagaagttgaggccaattccgggggaattgaaccggagcacggcctcggtagcgaagaatgcaaccctctgaatatgagcattgaagccgagctggttatcgaacagatgaaagaacagcaccatagggacatatgctgtctgcgcttggagttggaagataaagtgagacattatgaaaagcagctagatgagactgtcgtctcctgcaagaaggcccaggagaatatgaagcaacgccatgaaaacgagacccatacactggagaaacagatctcggacttaaagaacgagattgccgaattacagggtcaggctgcagtcctcaaggaggcgcatcacgaagcaacttgccgacacgaggaagagaagaagcaactgcaagtgaagctggaagaagaaaagacgcatctgcaggaaaaattgcggctccagcatgagatggaactaaaggctcgtctgactcaagcacaggcctcatttgaaagagaacgcgaggggttacagtcatcagcatggactgaagaaaaggtgcgcggacttacacaggaactggagcagttccaccaggagcagctaacctcactggtggagaaacacacactcgagaaggaagagctgcgtaaggagctgctcgagaagcatcagagggagctccaggaggggcgagagaagatggagacggagtgtaataggaggacctcacaaatcgaagctcagtttcagagcgactgccagaaggtgaccgagcggtgcgagtcagccctccagtctttggagggcaggtacaggcaggagttgaaagatctgcaggagcagcagcgcgaagagaagagccagtgggagtttgagaaggacgagctgacccaggagtgcgcggaagcccaggaactcctgaaggaaacactgaaacgggagaagacgacttctctggtactcactcaggaacgggaaatgctcgagaagacatacaaggaacacctgaatagcatggtggtcgagaggcagcaactgttgcaggacctggaagatttgagaaatgtctccgaaactcagcaatccctcctgtcagaccagattctagagctcaagtcctctcacaagagagagctacgggaacgagaagaagtgctgtgccaggcaggagcaagcgaacagctcgcgagccagcggctggagagactcgaaatggagcatgatcaggagcgtcaggaaatgatgtctaaactgctcgccatggagaatatccacaaggccacctgcgagaccgcagaccgcgagcgcgctgaaatgagcaccgagatctcgagactgcaaagcaagatcaaggagatgcagcaggccactagtccactgagcatgcttcagtctgggtgccaagtcatcggggaggaagaggttgagggcgatggcgctctgtccctgttgcagcagggagaacagcttttggaagagaatggtgacgtacttctctctcttcaaagagcccacgaacaggctgtgaaggagaacgtcaaaatggcaacggagatcagcagactgcagcagcgattacagaaactggaacccggtctggttatgagttcatgtcttgacgagccagctacagaattcttcgggaacaccgccgagcagaccgagcagttcctgcagcagaaccgaaccaaacaagtcgagggggtgacccggcgtcatgttttatccgacctggaggatgacgaagttcgcgacttgggttcaaccggtacctcaagcgtccagcgtcaggaggtgaagatagaggagtccgaagctagtgtggaaggattctctgagctggaaaactcagaggagactaggacggagagttgggagctcaaaaatcaaatctcccagctacaggagcagctcatgatgctctgcgctgattgcgatagggccagtgaaaaaaaacaggatctgctatttgacgtttcagtactgaaaaagaaactgaaaatgctcgaacggatcccagaggcgagcccaaagtacaaactactgtacgaggacgtgtcacgtgaaaacgattgtctgcaagaggagttaaggatgatggagactagatacgacgaggccctcgagaacaacaaggaattgaccgccgaagtcttcaggttgcaagatgaattgaagaagatggaagaggtcacagaaactttcctatcccttgaaaaatcatatgatgaagtcaaaatcgagaatgaaggtctgaacgtcttggttctgagacttcagggcaaaatcgaaaagctccaggagtcggtggtccaaagatgcgattgctgcttgtgggaagcatcgctggagaatctcgaaattgaacctgacgggaatattttacagctcaaccagacactggaggaatgtgtgccgagggtaaggtctgtgcatcatgtgattgaagagtgcaagcaagaaaatcaatatctcgaaggaaacacccagctactcgagaaggtgaaagcacacgagatagcatggctgcacggtaccattcagacccatcaggagaggcctcgcgttcagaatcaggtgatactggaggagaacacaacacttctgggatttcaagataaacactttcagcaccaggccaccatcgctgaattagagctggaaaagaccaaactgcaagagttgacgcggaaattgaaggagagagtgaccatactggtcaagcagaaggacgtactctcccatggcgaaaaggaggaagaactgaaagctatgatgcacgatctgcagattacgtgtagcgaaatgcagcagaaagtcgaactactgaggtatgaatccgaaaagctccagcaggagaacagcatcttgagaaatgagatcactactctgaatgaggaagactcaatctctaacctgaagttgggcaccctgaacggcagccaggaagagatgtggcagaagacggagacagtgaaacaggagaacgcagcagtgcagaaaatggttgagaacctgaagaagcaaataagcgaactgaagatcaaaaaccaacagttggatttagagaataccgaactttctcagaagaactcacagaatcaggagaagttgcaggaactgaaccaaaggttgaccgaaatgttgtgtcagaaagaaaaagagccaggcaactcagcactcgaagagcgggagcaggaaaaattcaacttaaaggaagagctcgagcggtgcaaggtgcagtcctctactctggtgagctcattggaagcggagctctcggaggtgaagattcaaacacatatcgtgcagcaggaaaatcatctgctcaaagatgagctggagaagatgaaacaactccatcgctgccccgatctgtcagatttccagcagaagatatcatcggtcttgagttataatgagaaactgcttaaggaaaaagaagccctgtccgaagaattaaacagctgcgttgataagttggctaagagtagcctcctggagcatcgcatcgccaccatgaagcaggaacaaaagtcctgggagcatcagtccgcaagcctgaagtctcagctggtggccagccaagagaaagtacagaatctcgaagacacagtccagaatgtgaatctgcagatgtctaggatgaagtccgatctgagggttacgcagcaggagaaggaggccctgaagcaggaagtgatgtccctgcacaagcaactgcaaaacgcagggggtaagtcctgggctccggaaattgcgacacacccatccgggctccataatcagcaaaagagattgtcctgggacaaactcgatcaccttatgaatgaggaacagcaactgttatggcaggaaaacgagcggctccagactatggtgcagaatactaaggccgaactcactcattctcgagagaaggttaggcagcttgagtctaacctgctacccaagcaccagaaacacctgaatcccagtggcaccatgaacccaaccgaacaggaaaaattatcccttaagcgggaatgcgaccaattccagaaggaacagagccccgcaaatcgcaaggtgtctcagatgaacagcctagaacaggagctggaaactatccatctggaaaatgagggactcaaaaaaaaacaggtgaagctcgatgaacagctgatggagatgcagcacctaagatcaaccgccactccatccccctctcctcatgcatgggatctccagctgctgcaacagcaggcctgcccgatggtcccacgggagcagttcttgcagctccagcggcagttactccaggcggaaaggattaatcagcacctccaggaggaattggaaaaccggaccagtgaaaccaacaccccacagggcaaccaggaacagttggtgacagttatggaagagcgcatgattgaggtagagcagaaacttaagttagtaaagcggttgcttcaggaaaaagttaatcaacttaaggagcaagttagcttgcctggccatttgtgttcaccgacatcacattctagtttcaactcatcatttacttcactctactgtcatta

SEQ ID NO: 28050 - DNA, 1176 bp, Artificial Sequence
  Description of Artificial Sequence: Synthetic coding sequence
atggccgctctaacaacgctctttaagtatattgacgaaaatcaggatcgctacattaagaagctggccaagtgggtcgcaatccagtccgtgtctgcttggcccgagaagagaggggaaattcggagaatgatggaagtcgccgctgctgacgtgaagcagctgggtggctccgtggagttagtcgatattggtaagcagaaggagattccagtgaacgtgaggttttgtctagaaggaatggaagaatctgggtcagaggggctcgacgagttgatcttcgccaggaaggataccttttttaaggacgtggattacgtgtgcatttctgataactactggttaggcaagaagaagccctgcatcacatacgggctcagaggcatctgctacttcttcatcgaggtagaatgtagtaacaaagacctgcattctggggtatacggcggaagtgtacatgaggccatgaccgacctgatccttctcatgggctcgctggtggacaaaaggggaaacattctgattccaggaatcaacgaggcagtggctgcagtcacagaagaagagcacaagttgtatgatgacattgacttcgatatcgaagaattcgctaaagacgttggcgctcaaattctgctgcactcacacaagaaagatatactcatgcacaggtggcgatatcccagcctgtctttgcatggcattgagggggctttttccgggagtggtgccaaaaccgtcatccccagaaaggtcgtcggtaaattcagcatcaggctggtacccaatatgacccctgaagtcgttggggaacaggtgacctcctatttgacaaagaagtttgccgaactcaggtctcccaacgaatttaaagtctatatgggacatggtggcaagccgtgggtgagcgacttctctcacccccactatctggccggacggcgagccatgaaaaccgtatttggggttgaacctgacttgacccgtgaagggggtagcattcctgttactctaacattccaggaggccacgggtaaaaacgtcatgctgctcccagtcggaagtgcagacgatggtgcgcattctcagaacgagaagctgaatagatataattacattgaaggaactaaaatgctggctgcctatctgtatgaagtgtcacaactgaaggactag

SEQ ID NO: 28051 - DNA, 5969 bp, Artificial Sequence
  Description of Artificial Sequence: Synthetic coding sequence
atggatgaagtcgagcaagaccagcacgaggccaggctgaaagaactgttcgactcctttgacacgaccgggaccggtagcctaggtcaggaggaactgactgatctgtgccacatgctcagccttgaagaagtagcaccagtgctgcagcagactctcctgcaggacaatttgctgggcagggtgcactttgaccagtttaaggaggccctgatcctcatcctgagcaggactttaagcaacgaagagcattttcaagaaccagactgttctctcgaagcgcagccaaagtacgtgcgcggtggaaaacgatatggcaggcggagcctgcctgagtttcaagaatcagtggaggagttccctgaggtaacagttatcgaaccactggacgaagaggcccgtccctcccatattccagccggagattgctccgagcactggaagacacagcgatcagaggagtatgaggcagaaggccagttgcggttctggaaccccgacgacctgaacgcatcccaaagtgggtcttcgccgccacaagactggattgaagaaaaactgcaggaggtctgcgaggatctgggcattacacgggacgggcacctaaacaggaaaaagctggtctccatatgcgagcagtacggcctgcagaacgttgatggggagatgctggaggaggtgttccacaatctggaccccgacggcactatgtcagtagaggattttttctatggactgtttaagaatggaaagtcacttactcctagcgcttctaccccctaccgacagctgaaaaggcatctgtcgatgcagtcttttgatgagagtgggaggagaactacaacttccagtgcaatgacctctacaatcgggtttcgggtgtttagttgcctcgacgacggcatgggccacgcctctgtggaaaggattctcgatacctggcaagaggaggggatcgagaactctcaggagatactcaaggccctggacttctccctcgacggcaacattaaccttacggagctcaccctcgctctggagaacgaattgctagtgacaaaaaactcgatccatcaagccgcactagcttcattcaaggccgaaattaggcatctgctggagagggtcgatcaggttgtgagagagaaagagaagcttcgctccgacttagataaggcagaaaaactaaaatcgctgatggcttccgaagttgatgaccatcatgcggcaatagaacgtcgaaacgagtacaatctgagaaaactcgatgaggagtacaaagaacggatcgctgcgctcaagaatgaactgcgcaaagaacgagagcagattctccaacaagcaggcaagcaaaggttggaactcgagcaggagatcgagaaggccaagactgaagaaaattacatccgcgatcggttggccctgagtctcaaggagaatagccgcctggaaaacgagctgctggaaaacgctgaaaaactggccgaatatgagaacctaaccaataaactgcagcggaacctggagaatgtgctcgcagagaaattcggtgatctagatcctagttctgctgaattctttttgcaggaagagcgattgacacagatgcgaaacgagtatgaaaggcaatgcagggtcttgcaggatcaagttgacgaactacagtctgaattagaggaatatcgtgcccagggcagggtgctccgcttaccgttaaagaattcacctagtgaagaagtagaggcaaactccgggggtatcgagcctgagcacggcctggggtccgaggagtgtaacccattgaacatgagcatagaggcggagctggtgatagagcagatgaaagagcagcatcaccgcgatatttgctgtctgcgtcttgagctagaggataaggtgagacattatgaaaaacagcttgacgaaaccgttgtgtcatgtaagaaagcgcaggaaaatatgaaacaacggcacgagaacgagacccatactttggaaaagcaaataagcgaccttaaaaatgaaatcgccgagctccaggggcaggccgcagtgttgaaggaagcgcaccacgaggctacttgccgccatgaggaagaaaagaagcaattacaggtcaagcttgaagaagagaagacacatctgcaggaaaaactgagattgcagcacgagatggaattaaaggccagactaactcaggcccaggcatcttttgaacgcgaacgggaaggtttacagtccagtgcgtggaccgaggagaaagttaggggactaacgcaggagctcgagcagttccaccaggagcagttgacatccctggtggaaaaacacacactggagaaggaggaactgcggaaggaactgctcgagaagcaccagcgggaattgcaggagggaagagaaaaaatggagactgaatgtaaccgcagaacctcacagatcgaggcacagttccagagcgactgccagaaagtcactgaacgatgtgagagcgcgttacagtccttggaagggagatatcggcaggaactgaaagacctgcaggaacagcagcgagaagagaagagtcagtgggaatttgagaaggatgagctgactcaggagtgtgccgaagctcaagaactacttaaagaaaccctcaagagagaaaaaacgacctcgttagtgctaacccaagaacgggaaatgttggaaaaaacctacaaagaacatctcaactcaatggtagttgagaggcagcaactcctgcaggatctcgaggatctcaggaacgtcagcgagacccaacagtctttgctctcagaccagatcctggagctgaagagttcacacaaacgagagctcagagagagagaagaggttctgtgtcaggccggtgcatcagaacagcttgcgtcccagcggttggaaaggttagaaatggagcatgaccaggagcggcaggagatgatgtctaaactccttgccatggagaatatacacaaagcaacgtgtgagaccgcagacagggagcgggctgagatgtcaacggagatttctagactgcagagcaaaattaaagagatgcagcaggctacctcgcccctgtccatgctgcaatctgggtgccaagttataggtgaggaggaggttgaaggtgacggagctctgagtctgctacagcagggagaacagttgcttgaagagaacggggatgtgcttctttcactgcaacgggcacacgaacaggcagttaaggaaaatgtcaagatggcaacagagattagcaggttgcaacaaaggttgcagaaactggagcctggcctggtgatgtctagctgtctagatgagccagctacagagttcttcggtaacactgctgaacagacagagcagttcctgcagcagaatcgaacaaaacaggtggagggcgtgacaaggcgccacgtgttgtcggatttagaagatgacgaagtccgggacttgggcagcactggaaccagctcggtgcagcgacaggaagtgaaaatagaggaatctgaagctagtgtggaaggcttctcagaactggagaattctgaagagactcgtaccgagagttgggaactcaaaaatcaaatctctcagctgcaagaacagctcatgatgctttgtgctgactgcgacagagcctcagagaagaagcaggatttactgtttgatgtctccgtgctgaaaaagaagctcaagatgctggagcgcatccccgaggctagccctaaatataaactgctctatgaggacgtgtcccgagagaatgattgcctccaggaagagctcagaatgatggagactagatatgacgaagccttagagaataacaaggagctgacagccgaggtgttcagactgcaggatgaactcaaaaaaatggaagaggtcactgagacctttctcagccttgagaagtcatacgatgaggtcaaaattgaaaatgaggggctgaatgtcctggtgctccgtctgcagggtaaaatagaaaagctgcaagaatcagtggtgcaacgctgcgactgctgcctatgggaagcaagccttgagaatctggagattgaacctgatggcaatatcctccagctgaaccagacactggaggaatgtgtaccaagagtgcgctctgtacatcacgtgattgaggagtgtaaacaggagaatcagtatctggagggcaacacacagctcctggaaaaggtaaaggcccacgagattgcatggctgcatggcaccatccagacccatcaggagcggcctcgggtccagaaccaggtgatcctggaagagaacacaacactgctgggattccaggataaacactttcagcatcaggccacaatcgctgagctggaactcgagaaaaccaagctgcaggaattgactaggaagctcaaagaaagggtgacgattctcgtcaagcagaaagatgtcctctcacacggggagaaggaggaggagctgaaagccatgatgcacgacctgcagatcacgtgttctgaaatgcagcaaaaggtggagttgctcaggtacgagtccgaaaaactgcaacaggagaattccattctgcggaacgaaatcaccacccttaacgaggaagactcaatctcgaatctaaagctgggtacactgaatggaagccaggaggagatgtggcaaaagaccgaaactgtgaagcaggagaacgccgctgtccagaagatggtggagaacttgaagaaacagatttcagagctgaaaatcaaaaatcaacaactcgatctggaaaataccgagctgtcccagaaaaacagtcagaatcaagagaaactgcaagaactgaatcagaggctgacggaaatgttgtgtcagaaggagaaggaacctggaaacagcgctcttgaggaacgcgagcaggagaaattcaatctgaaagaggagctggaaaggtgtaaagtacagtcgtccacactagtttcaagcttagaggccgagttgtctgaggtgaaaatccaaactcacattgttcagcaggagaatcacctgctgaaagatgaacttgaaaagatgaagcagctccaccgctgcccagacctctctgactttcaacagaaaatttcaagcgttctgtcgtacaacgaaaaattgctaaaggagaaagaagccctgagtgaggagctgaattcatgcgtggataagttggctaaatcttcgctgctggaacatcggatcgccacgatgaaacaggaacagaaatcttgggagcaccagtccgcctccctgaagagccagctcgtagcctcacaagagaaagtgcaaaatctggaggacacagtacagaacgtgaacctgcagatgagcaggatgaagtccgacctcagagttacccagcaggaaaaggaagctctcaagcaggaggtgatgtcactgcacaagcaactgcaaaatgccggaggcaagtcttgggcacccgaaatagcaacccaccccagcggcctgcataatcaacagaaacggctgtcctgggataagcttgatcacctgatgaatgaggagcagcagctattgtggcaggagaatgaaaggctccaaaccatggtgcagaatactaaggctgaactgacacattcaagagaaaaggttcgccagctggaatctaacttgctgcccaaacatcagaagcacttgaacccatctggaactatgaatcccacagagcaggagaagttgagccttaagagggagtgtgaccaatttcagaaggagcagagtccagccaacagaaaggtcagtcagatgaattcactggaacaggaattggaaaccatacatctggagaatgaggggctgaagaagaagcaggtgaagctcgatgaacagctgatggaaaattctgttgtgggatcgagcagggaagggtgcagctctttgccagagattgtatgcgaggacgccgcaccagaagtgcattgtgatgccta

SEQ ID NO: 28052 - DNA, 915 bp, Artificial Sequence
  Description of Artificial Sequence: Synthetic coding sequence
atgggccagtgtgtcaccaagtgtaaaaatccgagctcaaccctcggcagcaagaacggggaccgggagcctagtaataagagtcacagtcggcgaggtgctggacatcgggaggaacaggtgcctccctgcgggaagccaggaggcgacatcctggtaaacggcaccaagaaagccgaggccgctacagaagcatgccagctgccaacaagctcaggagacgctggaagggaaagtaagagtaacgcagaagagagcagcctgcaaaggctggaggagctgttccgcaggtacaaggatgagagagaggacgcaatcttggaagaaggcatggagcggttttgcaacgacctgtgcgtagatccaacagagttccgagttctcctccttgcttggaagtttcaggccgcaaccatgtgcaagttcaccagaaaagagttctttgacggctgtaaagcaatttccgccgattctatcgacggaatatgtgcaagatttcccagtctgctgaccgaagcaaaacaagaagacaaattcaaggacctctaccgtttcacttttcaatttggactggattccgaggaaggacagcggagcctgcatagggagatagcgatagccctatggaaattggtgttcactcaaaacaatccccctgtgctggaccaatggcttaattttctgaccgaaaatccaagcggaattaaaggaatctctcgggacacatggaacatgtttctgaacttcacccaggtgatcggacctgatctgtcgaattactccgaggacgaagcatggccatctctgttcgacacttttgtggagtgggagatggaacggaggaagcgcgagggcgagggacgaggggcactttcttccgggcctgagggtctgtgtccagaagagcagacctag

SEQ ID NO: 28053 - DNA, 1914 bp, Artificial Sequence
  Description of Artificial Sequence: Synthetic coding sequence
atggctgcgatggcggttggtggggcagggggttcaagagtttcgtcgggccgagaccttaattgtgtgccggaaattgccgatacattgggtgccgtcgccaaacagggattcgattttctctgcatgccagtctttcatccacggttcaaaagggagttcatccaggaacccgctaagaatcgccctggcccacagacaagatccgacctgctgttatctggcagagactggaataccttgattgtgggcaagctaagcccttggatcaggcctgattcgaaagtcgagaagatccggaggaatagtgaggcagcgatgctgcaagagctcaacttcggggcttacttggggctgcccgcatttttgctccctctgaatcaggaggataacaccaacctcgccagggttctgaccaaccatatccatacaggccatcacagctctatgttttggatgagagtgccgttagttgcccctgaggatcttcgagacgacattatcgaaaacgcaccaactacccacacagaggagtacagtggagaagagaagacctggatgtggtggcataatttcagaacattgtgcgactacagtaaacgtatcgcagtggcactggaaattggagccgatcttcccagcaatcatgtgatagacaggtggttaggggaacccatcaaagcagccattctgccaacctcaatctttctgacgaataagaaggggttccctgtgctgtccaaaatgcaccagaggctgatattccgcctgctcaagctcgaagtgcagttcatcatcaccgggaccaaccaccattccgagaaggagttctgttcttacctccagtatctggaatacttgtctcagaaccgccctcctccaaatgcctatgagctcttcgccaaagggtacgaagactacttacagagtcccctgcaacccctcatggacaacctggagtcacagacttacgaagttttcgagaaagaccctataaagtacagtcagtaccaacaagccatctacaaatgcctcctggacagggtacccgaagaggagaaagatacaaatgtgcaggtcctgatggtccttggtgctgggaggggccctctggttaatgcaagtctccgcgctgccaaacaggcagataggcgtatcaaactgtacgccgtggagaaaaacccaaatgccgtggtcaccctagaaaactggcagttcgaggagtggggcagccaggtaaccgtggtgagctccgacatgcgagagtgggtggcccctgagaaggctgacattatcgtttccgagctgcttggcagttttgccgacaacgaactgagccccgaatgcttggacggcgctcagcattttctgaaagatgacggtgtctcaattcctggcgagtataccagctttctcgcccctatctcttcctcaaagctgtacaacgaggtaagagcgtgtcgggagaaagaccgcgacccagaggcccagttcgagatgccctacgtggtgagactccataatttccaccagctgtctgcaccccagccctgctttactttcagccaccctaatagggatcccatgattgacaataacagatactgtaccctggagttccctgtggaagtgaacactgtgctccacgggtttgccggttattttgagactgtactttatcaagatatcactctgtctatccgacccgaaacacattctcctgggatgtttagctggttccctattctcttccccatcaagcagcccataacagttcgcgaaggccagaccatctgcgtgcgattctggcgatgcagtaatagtaaaaaagtctggtatgagtgggcagtaacagcacccgtctgtagcgcaatccataacccaaccgggaggagctatacaattggtctctag

SEQ ID NO: 28054 - DNA, 1041 bp, Artificial Sequence
  Description of Artificial Sequence: Synthetic coding sequence
atggccccaggatccgtgacgtccgacatatcccccagctctacttccacagccggaagttccagaagcccagaaagtgaaaagcctgggccatcccatggcggtgttcctcctggcggacctagccacagctcactacccgtcgggaggcgccatcccccagttttaagaatggtactggaggccctccaagccggagagcagagacgagggaccagcgttgcagccatcaaactgtatatcctgcacaaataccctaccgtggatgtattgcgcttcaagtacctgttaaaacaggctttagcaaccgggatgcgcagagggcttctggctcgacctctgaattccaaggctagaggcgcaaccggatccttcaagctagttcctaaacataagaagaagatacagccaaggaaaatggccccagctacagcccctcgcagggctggagaagcaaagggcaaaggccctaagaaaccgagtgaggctaaagaagaccctcctaacgtcggcaaggtgaaaaaggcagcgaagcggccagccaaagtccagaaacctcctccaaaaccaggggcagccactgaaaaggcgaggaaacaaggcggtgccgctaaagacacaagagctcagtctggcgaagcacgaaaggtcccacccaaacctgataaggccatgcgtgctcctagttccgcgggtgggctaagccggaaagcgaaagcgaaagggtcgaggtcttctcaaggagatgcagaggcctaccgcaaaaccaaggctgaaagtaagagttcaaagcctactgcatccaaagtgaagaatggtgccgctagccccactaaaaagaaggtggtggccaaggccaaggcaccaaaggccggacagggcccaaacaccaaggccgctgcacccgcaaagggcagtggaagcaaggtggtaccagcacatctctccagaaaaaccgaagcaccgaagggaccgaggaaagctggccttccgattaaagcatcatccagcaaggtgtcttcacaacgcgctgaagcttag

SEQ ID NO: 28055 - DNA, 1869 bp, Artificial Sequence
  Description of Artificial Sequence: Synthetic coding sequence
atggcaatggcaccgtcccccagcttggtacaggtgtacacctcgcctgccgctgtggccgtttgggagtggcaggacggactgggcacctggcacccatatagcgcgactgtgtgcagcttcatcgagcaacagttcgtgcagcagaaaggccaaaggtttggacttgggagtttggctcactctattcctctcgggcaggcggaccctagcctcgccccttatataatagaccttccaagttggactcagttccgccaggatacaggcacgatgcgggctgtcagaagacatctgtttcctcagcactcagccccaggtagaggcgtggtctgggagtggctaagtgacgacggctcctggaccgcatatgaggcctccgtctgtgattatctcgagcagcaggtcgctagaggaaatcaattggtagatctggcaccactcggttataactacactgtgaactacaccactcatactcagaccaacaagacgtcatccttttgccgttcggtgcggagacaggctggcccaccttatccagtgaccaccatcattgcaccaccgggtcataccggtgtggcatgctcttgtcaccagtgcctgagcggttctagaaccggccctgtgtccggtaggtatcgccactcaatgactaacttgcctgcatacccagtgccccagcaccctcctcatcggaccgcttccgtgtttggaacgcatcaggcttttgcgccatataataagccgagcctatcgggggctaggagcgctcccaggttgaacactacaaatgcctggggagcagctcccccttctctgggcagccagccgctgtacaggagctcactcagccacctgggtcctcagcacctgcccccaggtagctctacctctggtgcagtcagtgctagtcttccaagtgggcctagtagcagccctggctccgtgcccgcaaccgtccccatgcagatgccaaagccatctagagttcagcaggcacttgccggaatgactagcgtgctcatgtcggctatcggcctgcccgtgtgcctgtcacgagcgcctcagcccacctcaccgccagccagcaggctggctagtaagagtcacgggtcagttaaacgtctgcgcaagatgtccgtgaagggtgctactcccaaaccagagcccgaaccagagcaggttattaaaaactatacagaagaactgaaagtccccccagacgaggactgcattatctgtatggaaaaactgtccactgcctcaggatacagcgatgtgaccgatagcaaagccatcgggtccctggcggtgggccacctgacaaaatgtagccatgcattccacttattgtgcctgctggctatgtactgtaatggcaacaaagacggatctctccagtgcccatcctgcaaaactatctatggagaaaaaacgggaacccagccacagggaaagatggaagtgctacgctttcagatgtcactccctggtcacgaggattgcggcactatcttaatcgtctattcaatcccacacggcatccagggtccagagcaccccaaccccggaaagccctttacagcacgcggatttcctcgacaatgttacctcccagataacgcacagggaagaaaggtactggagctgttgaaagtcgcctggaagaggcgactgatcttcacagtgggcacctctagcacaactggggagaccgacaccgtagtatggaatgaaattcaccacaaaacagagatggaccgaaacattactggccatgggtatcctgacccgaactacctgcaaaatgtgctggcggagttggccgctcagggcgtgacagaggattgtttggagcagcaatag

SEQ ID NO: 28056 - DNA, 786 bp, Artificial Sequence
  Description of Artificial Sequence: Synthetic coding sequence
atggccgcaacagccagagaggacggcgcttctgggcaagaaagagggcaaagggggtgtgaacattacgaccgcggatgccttctcaaagccccatgttgcgacaaattatacacatgtagactttgccacgacaacaatgaggaccatcagttagacagattcaaagtgaaggaggttcagtgcattaactgtgagaagatccagcatgcccaacagacatgtgaggagtgttctaccttgtttggagaatactactgtgatatatgccatctcttcgataaggataagaagcagtaccactgcgaaaattgcgggatttgccggatcgggcctaaggaagactttttccactgtctgaaatgtaatttatgcctcgcaatgaatctgcagggacgacacaaatgcattgagaacgtgagtagacaaaactgtccgatttgcctggaagatatccacacatcccgagtggtcgcccacgtactgccctgcggccaccttctccatcgtacatgttacgaggagatgctgaaggagggctaccgatgcccactgtgtatgcactctgcactcgatatgaccagatattggcggcaacttgatgacgaggtggcccaaactcctatgccctccgagtaccaaaatatgacggttgatattctgtgcaacgactgcaacggtagatccaccgtgcagtttcacatattaggcatgaagtgcaagatctgtgaaagctataatacagctcaggccggaggtaggagaatcagtttagaccagcagtag

SEQ ID NO: 28057 - DNA, 1983 bp, Artificial Sequence
  Description of Artificial Sequence: Synthetic coding sequence
ctgagcctgccgtcagtgacctacctgctgctcgaggtcatccccgattctatgcggaagcaggaggtccggacagggagagaggctggacagggtcatggaacaggctccccagctgagcaggttaaggcactgatggatctcctggccggaaaggggagccaggggtcccaggccccacaggcactcgatcgcactcctgacgctcctctggggccttgcagtaacgactctcgaatacagcggcatagaaaagcattacttagcaaggtggaagcaacacggggaggtggacatccggctagaaccgtagctctggataggctgtttttgcctcttagcagggtgagtgttcctccaagagtgagcatcacaataggagtcgcgggaatgggtaagaccactcttgtacggcactttgtgaggctgtgggctcacggtcaggttggaaaagacttcagcctagttctgccactgacatttcgggaccttaatacacatgaaaagctgtgtgctgaccggctgatctgtagtgttttcccacacgtgggggaaccatcgctggccgtggcagtacctgcaagggcactactcatccttgacggactcgacgagtgccggacacctctggacttcagcaacacagtcgcttgtaccgatcccaaaaaagagatcccagtggatcacctgattactaatatcattcgaggtaacctgttcccggaagtgtcaatctggattacaagtcgaccatcggcatccggccaaattcctggagggctggttgaccgaatgaccgagatcagaggcttcaacgaagaagagataaaagtgtgcttggagcagatgttccctgaagatcaggccctgctaggttggatgctgagccaagtccaggccgatagggctctttacttgatgtgtaccgttcccgctttctgcagacttacagggatggcccttgggcatctctggaggagccgcacaggtccccaagacgccgagctgtggcccccacgaactctgtgtgagttatattcatggtacttccgaatggccctgagcggcgaagggcaggagaagggaaaggcctcacccaggatcgaacaggtagcacatggcggtcggaaaatggttgggactttagggcgtttagcctttcacggtctgctgaagaaaaaatatgtgttctatgaacaggatatgaaagctttcggcgtggaccttgccctgcttcaaggggctccttgttcttgcttcctgcagagggaggaaacccttgcgtcatctgtcgcctattgttttacacacctgagtctgcaagaattcgtggccgctgcttattattatggggcttctaggcgagccatctttgatctgtttacagagtccggagtaagttggccacgtcttggcttcctgacacattttagaagtgccgctcagcgggctatgcaggccgaagacgggcgtctggacgtgtttttacggttcttgagcggcttgctttccccccgtgtaaacgccctgctggccggatcccttctagcacaaggagaacaccaggcatatagaactcaggttgctgaactccttcaggggtgcttgcggcctgacgccgctgtttgtgccagggccatcaatgtgctccactgcttacatgagctccaacacacagagttggctaggtccgtggaagaggccatggaaagtggtgcattggccaggcttacaggtcccgcacaccgtgctgcactggcctatcttttgcaagtttcagatgcatgcgcacaggaagctaacctttccctgtctctgagccaaggcgttctgcagtcccttctgcctcagctcctctactgtcggaagctccggtggattcctggccagggagctggagccggtgaaggggcagaggagcgcgcagaggcagtgccctcgcccccaccaagcttttctgtgtccctcctcggcctgccgtag

SEQ ID NO: 28058 - DNA, 1152 bp, Artificial Sequence
  Description of Artificial Sequence: Synthetic coding sequence
atgctgtctaggaaaaagacgaagaatgaggtttcaaagcccgctgaggtccagggcaagtatgtcaagaaggagacctccccactactcagaaatctgatgccttctttcatacgccacggtcccaccatcccacggcgaactgatatctgtttgcccgacagctcccccaacgcattctctactagtggcgatgtggtgagccgtaatcagtcctttctcaggacaccaatccagcgcaccccacacgaaataatgaggagggaatctaaccgcctttctgcccctagctatctcgcacgctccctcgcagacgtccctcgagaatatggttcttctcagtcctttgtgacagaagttagcttcgcagtcgaaaacggcgactcaggatctcggtattactatagcgataactttttcgacggccagcggaaacggcctcttggtgaccgggctcacgaggactatcgttattacgaatataaccatgatctctttcagagaatgccacaaaaccaggggaggcatgcctcggggatagggagggtggccgctaccagcctaggcaacctgactaatcatggttctgaggatctgccgttgccccctggatggtctgtcgactggaccatgagggggagaaaatattacattgaccacaacacaaatacgactcactggtcgcacccactggagcgggaaggcctccctccaggttgggagagggtcgagagctccgaattcggaacttattatgtcgaccacaccaacaaaaaggcccagtaccgtcatccatgtgccccttccgtcccaaggtacgaccaaccaccgccagttacatatcagccccaacagactgagcgaaaccagtccctcctggtgcccgcaaatccctatcacactgctgaaataccggattggttacaggtatatgcccgtgcccctgtgaaatatgaccacatcctcaaatgggagcttttccagttggcagacctcgacacttaccagggcatgctgaaattgctgttcatgaaagagctggagcagatcgtgaaaatgtatgaggcgtaccgtcaggcactgctgacagaactggaaaaccgtaagcagcggcagcaatggtacgcacagcagcacggaaaaaacttctag

SEQ ID NO: 28059 - DNA, 2376 bp, Artificial Sequence
  Description of Artificial Sequence: Synthetic coding sequence
atgagtaatcagcaggagaaatatgaagctcaaaacatagttaattccaccgaagagtctgatgacgccttcgacaccgtgacaatacccgtgcctagcgaagagcctcaggagagtgaccaaaccgaagagcacgagtctggcatagagcagtttagcgaaagccacgcaattcacgttgaggagcagtccgatcagagcttttccagcctggagcccgataacgagcaactgatggaggaagttatttccccaaggcaggtgtcctatactccccagcaccatgagaaacaatatgccatgcagcgtcctaatgatgattctctggcgtttctggacaagataaagtcagtcaaagaatccctgcaggaatctgtagaagactctttagccacggtgaaggtggttctcatccctgtgggccaggaaatcgtgatcccattcaaagtggatactatcctcaaatacctgaaggaccatttcagccaccttcttggtattccccactcagtattgcagatccgctattcgggcaagatcttaaaaaataacgagaccctcgtgcagcatggggtgaaacctcaagagattgtccaagtggagattttcagtactaatcctgacctgtatcccgtacgtcggatcgacggtttgaccgatgtttctcagatcattaccgttaccgtacagaccgggctggaccaataccagcaggtccctgtggaaattgtcaagtctgatttccataagccttttcttggaggattccgacacaaagtgaccggcgttgagtatcataacgccggaactcagaccgtacccaagcgtatcccagaacgcctaagtatcttctgtcgagacacccaaacggtgtttcagaaaaagaacctgcaacagaccaccaatacaactagcacccagatgacaaatatcggagtttacgtgagtaacatgacagacaagctcgtcacccctggcaagtatttttccgccgctgaataccacgcccaacgacttaaggccgtcatagtcatccaaacttactatagacagtggcacgccaagatcttcgttgagaatctacgtcgccagaagtccctgaggctggagtgggagacacaacaggaactgagaaaaattagagaaaaggaagagtggattaagctggattatcacaggcggcataatcccaagacaaatgaagactttgagtttctgtataatgcactagagttttggcgacaggaggaattgacacggatcaaccaatccttcacaggggctgaacgaaaggccgctttatgcgaactgctcgaaaaagagacccaaatcattgcaagtatcggtcgccacaggtacattgcctatatggccaaccaggaggccgctattcaagctttccttgacaagtgtagtgcaccaaaaatttggcgcacaccaaatggtaaaacaatcgagatggacacccagttcacaattagggcgagggagctccagaatatctacaaatgtattatgcttaagaacatttctcaggacgaacgcctggacgtgctgcttaccctgaagcatacagtcaaagaacatgagtgcaagctgactcaagaaatcctggaattgattgatagagaggtggatcttatgatgaggggcgttaagcaccacaaccttgaaggtctgcgcaaacggatagcgacactcttcttccattacataaaaactcctttattcaatcccgaagtggctaagtacctgaaagtgcctcaggatccactgaagttctacaagaagatctacttctgccattcctgtcagttatacctcccttcaacagagttcagcgtgagttccacatctagacgaatctaccgctgtcgcaattgtatcaatttacaaaatgaggctcagaaacgggagtcttttttgaaatataaatgtctgttgcaacaactgtattatacggaggccgactacgaggatgactcaaaaattgccttcctgatgcagctccaggacatccagtacctcaccgaaaatatttgggccagccagtcagtgctgtctgcatgcgataacctatctgatctggtcatggtgaggtggaataaaagcctcgagtggtccccttggaattgcatattgctgaccaaggacgaggcagcggctcacctcaagctgacttccattgaagaagggtacgaaagatcgttcattcacaagattaaacataaacatatcttggccaaaaattacttcagccaagtccctgttctggctagttttatcctggacgacggcgaaatagatgagatcaggtggaaataccactctgacaccacaccgaagatcattgagtctcaacgaccgccacactag

SEQ ID NO: 28060 - DNA, 1767 bp, Artificial Sequence
  Description of Artificial Sequence: Synthetic coding sequence
atgagttcctgcgtatcgtcccaacccagtagcaacagggcggcacctcaggacgaattagggggacggggatcctcctcctccgaaagccagaagccatgcgaggcactccgtgggttatcaagcctgtcaatccacctgggcatggagagcttcatagtcgtgactgagtgcgaaccaggatgcgcggtggatcttggacttgctagagacaggcctctcgaagcagacggccaggaggtaccgctggataccagcggatcccaggcccgtccccacctgtccggacgaaagctctcactccaagagaggtctcaggggggactagcagccggagggtcgttagatatgaacggaaggtgcatttgccccagccttccctattctcctgtgtccagtccgcagtccagccctagacttcccagaagaccaacggtggagtcccatcatgtctctattacagggatgcaagattgtgtgcaactgaatcagtataccctcaaggatgaaattgggaagggctcatatggagtggtcaaactggcctataatgaaaatgataatacctattatgcaatgaaggtgttatctaagaagaagctaatcagacaggctggttttccgaggagaccacccccaaggggcaccaggcccgctccaggcggatgcatccagcctcgaggccctattgagcaggtatatcaggaaatagcgatcctgaaaaagttggatcatcccaacgtagtgaaactggtcgaggtgctcgatgatcccaacgaggatcatctgtacatggtttttgagttagtcaaccaggggcctgtgatggaggtgcccaccctgaagcctctcagtgaggatcaggccaggttctactttcaggatttgatcaaaggtattgagtaccttcattaccagaaaataatccaccgagacattaagccatccaacttactggtgggagaggacggccacatcaagatcgcagactttggcgtgagcaatgagtttaagggctcagacgcattgttatccaataccgtcggaacaccagctttcatggcgcctgagtccctttccgagacacggaagatcttctctgggaaagccctcgacgtctgggcaatgggagtgaccctgtattgctttgttttcggtcagtgcccttttatggacgagcgaatcatgtgtttacactccaagatcaaaagtcaggccttggagttccccgatcagcccgacattgctgaggatcttaaggatttgattaccagaatgctggacaagaatcctgagtcccgaattgtggtaccagagatcaagctgcatccttgggttactcgtcacggagcggagcccttgccctcggaggacgagaattgtactctcgttgaagtgactgaagaagaggtcgaaaacagcgtcaagcatatcccttccctggcgacagtcatcctcgtgaagacgatgattcgcaagagatcattcgggaatcccttcgaggggtcccgcagagaggaacgaagcttatcagctcccggtaatctgttaacgaaaaagccaactcgcgagtgtgagagcctttcagagttgaaagaagcgaggcagcgccgtcagccccctgggcatcgccctgctcctcggggtggaggcggtagcgcactggtccgcggtagcccctgtgtcgaaagctgctgggctcccgcaccgggatctccagccagaatgcacccgctgaggccggaggaggcgatggaacctgagtag

SEQ ID NO: 28061 - DNA, 2052 bp, Artificial Sequence
  Description of Artificial Sequence: Synthetic coding sequence
atggccttatccaagcgcgaactcgacgagctgaagccctggatagaaaagaccgtgaaaagggtgcttggattttctgagcctactgtggtcaccgccgcattaaactgtgtgggaaagggaatggataaaaaaaaggccgctgatcacctgaaaccatttctggatgacagtactttgaggtttgtcgacaaactcttcgaagccgtggaagagggtcgatcatccagacactcaaaatcttcatccgatcgaagcaggaaacgagagcttaaagaagtcttcggggacgactctgagatctcaaaagagtcttccggcgtcaagaagcggagaatccctcgatttgaggaggtcgaagaggaaccagaggttatcccgggtcccccatcagagagccctggtatgctcaccaagctccagataaagcaaatgatggaagcggcaacacgacagatcgaagagcgcaagaaacagctttctttcatctcccccccaaccccacagcccaaaaccccatcctcatcccaacccgagcgtctacccattgggaatacaatccagccatcccaggccgctacgtttatgaacgatgccatagagaaggcacgcaaggccgctgagcttcaggctcgcatccaggcacaactcgctctgaagcccggactgatcgggaatgcaaacatggttggactcgctaacctccatgctatgggaattgcgccacccaaggtcgagttgaaagatcagaccaagcctacacctctcattctggacgagcaaggaagaacagtggacgcgacaggaaaggaaattgaactgactcaccgtatgcccaccctgaaggcgaacatcagggccgtgaaaagggagcagtttaaacaacagctcaaagaaaaacctagtgaggatatggaatccaacaccttctttgacccgagagtaagcatcgctccgtcacagcgacaaaggcgcacattcaagttccatgataagggcaaattcgaaaagattgcccagcggctacggaccaaggctcagttagaaaaactccaggctgagatttctcaagccgctaggaagacgggaattcacacctctacacgcctggctctgatagcacctaagaaagagctaaaggaaggagacattcccgagattgagtggtgggactcttacatcatcccgaatgggttcgacctgactgaggagaatcctaaaagagaagactactttgggatcacaaatcttgtggaacatcccgcacagctgaacccaccagtcgataatgatacgcctgtcacactgggagtgtaccttaccaagaaagagcaaaagaagctccggagacaaactcgtcgcgaggctcagaaggagttgcaggagaaagtcagactgggtttgatgccccctccggagcctaaagtacgcatctccaacctgatgagggtccttggcaccgaagcagtacaggaccccactaaagtggaagcccacgttcgggctcagatggctaagaggcaaaaagctcatgaggaggccaacgcagcaaggaagctgactgccgagcagcgaaaggtgaaaaagatcaagaaactgaaggaggatattagtcagggggtccatatctcagtctaccgcgtcaggaatctctctaaccctgccaaaaagttcaagatcgaggcgaacgctggtcagctgtaccttactggcgtggtggtcttgcataaagatgttaatgtagtggtcgtcgaggggggaccaaaggctcagaagaagtttaagcggttaatgctgcataggattaaatgggacgaacagactagcaatacgaaaggagacgacgacgaggagagcgatgaggaagcagtgaaaaagacgaataaatgcgtcctagtctgggagggcacagctaaggatagatcttttggggaaatgaagttcaaacagtgtcccaccgaaaatatggcacgcgagcatttcaagaagcatggggcagagcattactgggacttagccttatccgaaagcgtcctagaatcaacggattag

SEQ ID NO: 28062 - DNA, 1938 bp, Artificial Sequence
  Description of Artificial Sequence: Synthetic coding sequence
atgagtgataagtcagatctgaaagcagaactagagagaaaaaaacagaggttggctcagatccgtgaagaaaaaaaaagaaaggaggaggagaggaagaagaaggaggcagatatgcagcagaagaaggagcctgtacaggacgactccgatttagatcgaaaacgcagagaaactgaggctcttctgcagtctatcggcatttctcccgaacctccactggttcagcctcttcacttcctgacttgggacacgtgctactttcactacctggtccctacacccatgtcaccatcaagtaaatctgtctccactcccagcgaggccggttctcaagacagcggggaccttgggcctctgacaaggactcttcagtgggacacagatccatctgtcctgcaattgcagtccgatagtgaattgggtagacggctacataaactgggggtgtccaaagtgacccaggtggattttctaccgagagaggtcgtttcttattccaaagagacccaaacccctcttgccacccatcagagcgaggaagacgaagaagacgaagagatggtcgaatctaaagtggggcaggattccgagctggaaaaccaagacaaaaaacaagaggtgaaagaggcccctcccagagaactgaccgaggaggaaaaacaacaaatactgcattctgaggagtttttgatttttttcgatcgaactatcagagtcattgagcgagcacttgccgaggactcagatatcttttttgactatagcggaagggagctggaggagaaggatggggacgtacaggcgggtgctaatctcagcttcaaccgacagttttacgatgagcactggagtaaacaccgcgtggtgacgtgcatggactggagtttgcagtaccccgagctgatggtggcttcctataataataacgaagacgcaccccatgagcccgatggggtcgccctggtgtggaatatgaagtttaagaagacaacgccagagtatgtgtttcattgccagtcatccgtgatgtctgtgtgtttcgctaggttccaccctaatctagtagtggggggaacttacagcgggcagatcgtactgtgggataaccggtcccataggcgcactccagtgcagagaactccactgagtgccgcagcccacacacaccctgtctactgcgtcaatgtagtgggaactcagaatgcccacaatttgattaccgtatctacagacggcaaaatgtgcagttggagccttgatatgctttcaacgccacaggaaagtatggagctggtttacaacaagtcaaaacccgttgcggttacgggtatggctttccccactggggacgtgaataactttgttgtggggagtgaggaggggactgtgtacaccgcctgcaggcatggcagtaaggctggcattggagaggtatttgagggccaccaaggcccagtaacaggcattaattgtcatatggcagtaggcccaatagatttttcgcacctgttcgtcactagcagctttgactggaccgtcaagctgtggactaccaagcataacaagcccctctactctttcgaggataatgctgattacgtatatgacgtgatgtggagtccagtgcacccagcgctgtttgcttgtgtggatgggatgggacgattggatctctggaacttgaataacgacactgaggtgcccactgcgtcagtggccatagaaggagcctcagcactcaacagagttcgctgggcccaggcaggtaaagaagtcgcagtcggggattcagaaggcaggatatgggtctatgatgtaggagaactggcggttccccataatgatgaatggactaggtttgctcgcaccctcgtggagatcagggcaaacagagcagattcggaggaagaagggactgtcgaattgtctgcctag
